United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 43

SEQ ID NO: 1800880 - DNA, 13 bp, Homo sapiens
tttttgtacatta

SEQ ID NO: 1800881 - DNA, 13 bp, Homo sapiens
ttttttgtaactt

SEQ ID NO: 1800882 - DNA, 21 bp, Homo sapiens
tccacggagccactcctctga

SEQ ID NO: 1800883 - DNA, 22 bp, Homo sapiens
tccacggagccactcctctgac

SEQ ID NO: 1800884 - DNA, 19 bp, Homo sapiens
tccacgttctgctcatcat

SEQ ID NO: 1800885 - DNA, 20 bp, Homo sapiens
tccacgttctgctcatcatt

SEQ ID NO: 1800886 - DNA, 21 bp, Homo sapiens
tccacgttctgctcatcattc

SEQ ID NO: 1800887 - DNA, 15 bp, Homo sapiens
tccactgagggcagt

SEQ ID NO: 1800888 - DNA, 21 bp, Homo sapiens
tccacttttaaaactatattt

SEQ ID NO: 1800889 - DNA, 12 bp, Homo sapiens
tccagagggcac

SEQ ID NO: 1800890 - DNA, 19 bp, Homo sapiens
tccagagtccctgcctgga

SEQ ID NO: 1800891 - DNA, 23 bp, Homo sapiens
tccaggagaaggccaattcctat

SEQ ID NO: 1800892 - DNA, 14 bp, Homo sapiens
tccaggcactgaga

SEQ ID NO: 1800893 - DNA, 19 bp, Homo sapiens
tccagttaaaaaaaatttt

SEQ ID NO: 1800894 - DNA, 22 bp, Homo sapiens
tccagttaaaaaaaattttaat

SEQ ID NO: 1800895 - DNA, 23 bp, Homo sapiens
tccagttcacaggccagaaaaca

SEQ ID NO: 1800896 - DNA, 13 bp, Homo sapiens
tccatcatcatgt

SEQ ID NO: 1800897 - DNA, 16 bp, Homo sapiens
tccatcctaccccctg

SEQ ID NO: 1800898 - DNA, 20 bp, Homo sapiens
tccatcctaccccctgtgcc

SEQ ID NO: 1800899 - DNA, 16 bp, Homo sapiens
tccatgggcagagccc

SEQ ID NO: 1800900 - DNA, 22 bp, Homo sapiens
tccatgggcagagcccaaggga

SEQ ID NO: 1800901 - DNA, 15 bp, Homo sapiens
tccatttgcaaggga

SEQ ID NO: 1800902 - DNA, 14 bp, Homo sapiens
tcccaacactgcca

SEQ ID NO: 1800903 - DNA, 17 bp, Homo sapiens
tcccacaggacatttct

SEQ ID NO: 1800904 - DNA, 15 bp, Homo sapiens
tccccagctgtttat

SEQ ID NO: 1800905 - DNA, 22 bp, Homo sapiens
tcccgagcacctccacatcctc

SEQ ID NO: 1800906 - DNA, 21 bp, Homo sapiens
tccctcatctgtccctccggg

SEQ ID NO: 1800907 - DNA, 15 bp, Homo sapiens
tccctccgggacctg

SEQ ID NO: 1800908 - DNA, 16 bp, Homo sapiens
tccctgactcattctg

SEQ ID NO: 1800909 - DNA, 22 bp, Homo sapiens
tccctgactcattctgaaggag

SEQ ID NO: 1800910 - DNA, 14 bp, Homo sapiens
tccctgactgggag

SEQ ID NO: 1800911 - DNA, 22 bp, Homo sapiens
tccctgtaacctcttcagaggc

SEQ ID NO: 1800912 - DNA, 23 bp, Homo sapiens
tccctgtaacctcttcagaggcc

SEQ ID NO: 1800913 - DNA, 16 bp, Homo sapiens
tcccttccttcctctc

SEQ ID NO: 1800914 - DNA, 19 bp, Homo sapiens
tcccttccttcctctcctg

SEQ ID NO: 1800915 - DNA, 18 bp, Homo sapiens
tcctaataaagttctgta

SEQ ID NO: 1800916 - DNA, 16 bp, Homo sapiens
tcctaccccctgtgcc

SEQ ID NO: 1800917 - DNA, 17 bp, Homo sapiens
tcctaccccctgtgcct

SEQ ID NO: 1800918 - DNA, 18 bp, Homo sapiens
tcctatgtttttgttcaa

SEQ ID NO: 1800919 - DNA, 13 bp, Homo sapiens
tcctcaatccagc

SEQ ID NO: 1800920 - DNA, 14 bp, Homo sapiens
tcctcaatccagct

SEQ ID NO: 1800921 - DNA, 11 bp, Homo sapiens
tcctcagcccc

SEQ ID NO: 1800922 - DNA, 11 bp, Homo sapiens
tcctcctctgt

SEQ ID NO: 1800923 - DNA, 13 bp, Homo sapiens
tcctcctctgtga

SEQ ID NO: 1800924 - DNA, 14 bp, Homo sapiens
tcctcctgggccct

SEQ ID NO: 1800925 - DNA, 15 bp, Homo sapiens
tcctcctgggccctc

SEQ ID NO: 1800926 - DNA, 16 bp, Homo sapiens
tcctcctgggccctct

SEQ ID NO: 1800927 - DNA, 23 bp, Homo sapiens
tcctcgagatcccaacactgcca

SEQ ID NO: 1800928 - DNA, 16 bp, Homo sapiens
tcctctgcccgggagc

SEQ ID NO: 1800929 - DNA, 14 bp, Homo sapiens
tcctgatcagagcc

SEQ ID NO: 1800930 - DNA, 19 bp, Homo sapiens
tcctgcaccggggcctggg

SEQ ID NO: 1800931 - DNA, 20 bp, Homo sapiens
tcctgcaccggggcctgggc

SEQ ID NO: 1800932 - DNA, 14 bp, Homo sapiens
tcctgggaaatatt

SEQ ID NO: 1800933 - DNA, 20 bp, Homo sapiens
tcctgggaaatattccctag

SEQ ID NO: 1800934 - DNA, 21 bp, Homo sapiens
tcctgggaaatattccctaga

SEQ ID NO: 1800935 - DNA, 23 bp, Homo sapiens
tcctgggccctctctgctctgcg

SEQ ID NO: 1800936 - DNA, 21 bp, Homo sapiens
tcctgggttttgtattctctg

SEQ ID NO: 1800937 - DNA, 19 bp, Homo sapiens
tcctgttcttaagacgtga

SEQ ID NO: 1800938 - DNA, 22 bp, Homo sapiens
tccttaaaatgtgagtgacctc

SEQ ID NO: 1800939 - DNA, 16 bp, Homo sapiens
tccttaaggctctttt

SEQ ID NO: 1800940 - DNA, 13 bp, Homo sapiens
tccttgggccctt

SEQ ID NO: 1800941 - DNA, 14 bp, Homo sapiens
tccttgggcccttt

SEQ ID NO: 1800942 - DNA, 17 bp, Homo sapiens
tcgagatcccaacactg

SEQ ID NO: 1800943 - DNA, 21 bp, Homo sapiens
tcgagatcccaacactgccag

SEQ ID NO: 1800944 - DNA, 22 bp, Homo sapiens
tcgagatcccaacactgccagc

SEQ ID NO: 1800945 - DNA, 22 bp, Homo sapiens
tcgctggactctcagtctctga

SEQ ID NO: 1800946 - DNA, 20 bp, Homo sapiens
tcggggagccgggagcctga

SEQ ID NO: 1800947 - DNA, 13 bp, Homo sapiens
tctaagtctttcc

SEQ ID NO: 1800948 - DNA, 17 bp, Homo sapiens
tctacagagcttccctg

SEQ ID NO: 1800949 - DNA, 14 bp, Homo sapiens
tctagttctgccag

SEQ ID NO: 1800950 - DNA, 22 bp, Homo sapiens
tctagttgattgcgagaatttt

SEQ ID NO: 1800951 - DNA, 16 bp, Homo sapiens
tctatttctcctccat

SEQ ID NO: 1800952 - DNA, 22 bp, Homo sapiens
tctcagcgaggtgtaaagttgt

SEQ ID NO: 1800953 - DNA, 13 bp, Homo sapiens
tctcagtctctga

SEQ ID NO: 1800954 - DNA, 18 bp, Homo sapiens
tctccatggccctgcaaa

SEQ ID NO: 1800955 - DNA, 19 bp, Homo sapiens
agggatccctcatctgtcc

SEQ ID NO: 1800956 - DNA, 12 bp, Homo sapiens
agggcagagtga

SEQ ID NO: 1800957 - DNA, 14 bp, Homo sapiens
agggcagcagggct

SEQ ID NO: 1800958 - DNA, 15 bp, Homo sapiens
agggcagcagggcta

SEQ ID NO: 1800959 - DNA, 17 bp, Homo sapiens
agggcagggccccaggc

SEQ ID NO: 1800960 - DNA, 21 bp, Homo sapiens
agggccaagcccagcactgct

SEQ ID NO: 1800961 - DNA, 20 bp, Homo sapiens
agggccacatgggaggctca

SEQ ID NO: 1800962 - DNA, 15 bp, Homo sapiens
agggctaccctgagc

SEQ ID NO: 1800963 - DNA, 18 bp, Homo sapiens
agggctaccctgagctga

SEQ ID NO: 1800964 - DNA, 21 bp, Homo sapiens
agggctaccctgagctgaggc

SEQ ID NO: 1800965 - DNA, 23 bp, Homo sapiens
agggctaccctgagctgaggcag

SEQ ID NO: 1800966 - DNA, 21 bp, Homo sapiens
agggcttttttttgagaatac

SEQ ID NO: 1800967 - DNA, 15 bp, Homo sapiens
aggggccagaggctc

SEQ ID NO: 1800968 - DNA, 17 bp, Homo sapiens
aggggccgggggcagtc

SEQ ID NO: 1800969 - DNA, 20 bp, Homo sapiens
agtataggataaattacatt

SEQ ID NO: 1800970 - DNA, 20 bp, Homo sapiens
agtatttcaaattggagctt

SEQ ID NO: 1800971 - DNA, 14 bp, Homo sapiens
agtcaacctgggca

SEQ ID NO: 1800972 - DNA, 14 bp, Homo sapiens
agtcataccaatga

SEQ ID NO: 1800973 - DNA, 14 bp, Homo sapiens
agtccacaaaataa

SEQ ID NO: 1800974 - DNA, 16 bp, Homo sapiens
agtccatcagcctcca

SEQ ID NO: 1800975 - DNA, 21 bp, Homo sapiens
agtccctgcctggaccagcct

SEQ ID NO: 1800976 - DNA, 23 bp, Homo sapiens
agtccctgcctggaccagcctct

SEQ ID NO: 1800977 - DNA, 11 bp, Homo sapiens
agtctctgagc

SEQ ID NO: 1800978 - DNA, 23 bp, Homo sapiens
agtctctgtataatctatttaca

SEQ ID NO: 1800979 - DNA, 16 bp, Homo sapiens
agtctgagagaggcca

SEQ ID NO: 1800980 - DNA, 20 bp, Homo sapiens
agtctgtgccacgtgtttgt

SEQ ID NO: 1800981 - DNA, 15 bp, Homo sapiens
agtcttccatttgca

SEQ ID NO: 1800982 - DNA, 13 bp, Homo sapiens
agtgaatgattca

SEQ ID NO: 1800983 - DNA, 17 bp, Homo sapiens
agtgaatgattcagtgt

SEQ ID NO: 1800984 - DNA, 21 bp, Homo sapiens
agtgacctgccctacatatct

SEQ ID NO: 1800985 - DNA, 21 bp, Homo sapiens
agtgagacccagccctcatcc

SEQ ID NO: 1800986 - DNA, 16 bp, Homo sapiens
agtgcagtcctgatca

SEQ ID NO: 1800987 - DNA, 22 bp, Homo sapiens
agtgcagtggtgcgatcttggc

SEQ ID NO: 1800988 - DNA, 11 bp, Homo sapiens
agtgctccctc

SEQ ID NO: 1800989 - DNA, 14 bp, Homo sapiens
agtgctccctcaca

SEQ ID NO: 1800990 - DNA, 17 bp, Homo sapiens
agtgctctgatccctct

SEQ ID NO: 1800991 - DNA, 14 bp, Homo sapiens
agtggtatagaaat

SEQ ID NO: 1800992 - DNA, 18 bp, Homo sapiens
agtgtccccaaagactac

SEQ ID NO: 1800993 - DNA, 15 bp, Homo sapiens
agtgttagggaaggg

SEQ ID NO: 1800994 - DNA, 13 bp, Homo sapiens
agttacacatttt

SEQ ID NO: 1800995 - DNA, 17 bp, Homo sapiens
agttctagttgattgcg

SEQ ID NO: 1800996 - DNA, 13 bp, Homo sapiens
agttctgccagga

SEQ ID NO: 1800997 - DNA, 14 bp, Homo sapiens
agttctgccaggag

SEQ ID NO: 1800998 - DNA, 16 bp, Homo sapiens
agttcttagttgctgt

SEQ ID NO: 1800999 - DNA, 18 bp, Homo sapiens
agttgattgcgagaattt

SEQ ID NO: 1801000 - DNA, 18 bp, Homo sapiens
agtttaattgacttattt

SEQ ID NO: 1801001 - DNA, 17 bp, Homo sapiens
agtttgattattcagtg

SEQ ID NO: 1801002 - DNA, 17 bp, Homo sapiens
agtttgttgctgtcaag

SEQ ID NO: 1801003 - DNA, 12 bp, Homo sapiens
agttttcagtgg

SEQ ID NO: 1801004 - DNA, 17 bp, Homo sapiens
agttttgacagagttgg

SEQ ID NO: 1801005 - DNA, 20 bp, Homo sapiens
agtttttattgcttgttgga

SEQ ID NO: 1801006 - DNA, 15 bp, Homo sapiens
ataaaagtacatgtt

SEQ ID NO: 1801007 - DNA, 14 bp, Homo sapiens
ataaataacttttt

SEQ ID NO: 1801008 - DNA, 15 bp, Homo sapiens
ataaattacattaaa

SEQ ID NO: 1801009 - DNA, 16 bp, Homo sapiens
ataagagtagaaactg

SEQ ID NO: 1801010 - DNA, 19 bp, Homo sapiens
ataagtatttcaaattgga

SEQ ID NO: 1801011 - DNA, 18 bp, Homo sapiens
ataatctctccattcccg

SEQ ID NO: 1801012 - DNA, 16 bp, Homo sapiens
ataatgtgaaaatggt

SEQ ID NO: 1801013 - DNA, 19 bp, Homo sapiens
ataattgagttttcagtgg

SEQ ID NO: 1801014 - DNA, 16 bp, Homo sapiens
atacagaactctttca

SEQ ID NO: 1801015 - DNA, 18 bp, Homo sapiens
atacagaggtaactatca

SEQ ID NO: 1801016 - DNA, 13 bp, Homo sapiens
atagagctgtatt

SEQ ID NO: 1801017 - DNA, 16 bp, Homo sapiens
atagcacatgattttc

SEQ ID NO: 1801018 - DNA, 19 bp, Homo sapiens
ataggataaattacattaa

SEQ ID NO: 1801019 - DNA, 20 bp, Homo sapiens
atagtgatgtaatcttgaat

SEQ ID NO: 1801020 - DNA, 16 bp, Homo sapiens
atataaaagactgacc

SEQ ID NO: 1801021 - DNA, 16 bp, Homo sapiens
atattgaaaaaataga

SEQ ID NO: 1801022 - DNA, 20 bp, Homo sapiens
atcaccgtgggctccctgac

SEQ ID NO: 1801023 - DNA, 18 bp, Homo sapiens
atcaggacccagaggaag

SEQ ID NO: 1801024 - DNA, 18 bp, Homo sapiens
atcatcatgtgtgtccac

SEQ ID NO: 1801025 - DNA, 24 bp, Homo sapiens
atcattctctgtctcatccatcat

SEQ ID NO: 1801026 - DNA, 18 bp, Homo sapiens
atccatcatcatgtgtgt

SEQ ID NO: 1801027 - DNA, 14 bp, Homo sapiens
atcccgagcacctc

SEQ ID NO: 1801028 - DNA, 17 bp, Homo sapiens
atcccgagcacctccac

SEQ ID NO: 1801029 - DNA, 19 bp, Homo sapiens
atcccgagcacctccacat

SEQ ID NO: 1801030 - DNA, 11 bp, Homo sapiens
atccctcatct

SEQ ID NO: 1801031 - DNA, 14 bp, Homo sapiens
atccctctcctccc

SEQ ID NO: 1801032 - DNA, 22 bp, Homo sapiens
atcctggacatgaagattcttt

SEQ ID NO: 1801033 - DNA, 17 bp, Homo sapiens
atcgctgccttgccatg

SEQ ID NO: 1801034 - DNA, 12 bp, Homo sapiens
atctatttacat

SEQ ID NO: 1801035 - DNA, 14 bp, Homo sapiens
atctatttacataa

SEQ ID NO: 1801036 - DNA, 15 bp, Homo sapiens
atctatttacataaa

SEQ ID NO: 1801037 - DNA, 14 bp, Homo sapiens
atctcattggaccc

SEQ ID NO: 1801038 - DNA, 20 bp, Homo sapiens
atctcctgccttcctcctgg

SEQ ID NO: 1801039 - DNA, 19 bp, Homo sapiens
atctctttttgctttcgaa

SEQ ID NO: 1801040 - DNA, 21 bp, Homo sapiens
atctgtcaaagaaaacttcca

SEQ ID NO: 1801041 - DNA, 12 bp, Homo sapiens
atctgtgtcttg

SEQ ID NO: 1801042 - DNA, 14 bp, Homo sapiens
atctgtgtcttgtt

SEQ ID NO: 1801043 - DNA, 15 bp, Homo sapiens
atctgtgtcttgttt

SEQ ID NO: 1801044 - DNA, 16 bp, Homo sapiens
atcttgaattgtaact

SEQ ID NO: 1801045 - DNA, 22 bp, Homo sapiens
atgactggatacagaatgaatc

SEQ ID NO: 1801046 - DNA, 21 bp, Homo sapiens
atgcactgttccccctgtgca

SEQ ID NO: 1801047 - DNA, 19 bp, Homo sapiens
atgcacttataattttcct

SEQ ID NO: 1801048 - DNA, 17 bp, Homo sapiens
atgcatgcactgttccc

SEQ ID NO: 1801049 - DNA, 14 bp, Homo sapiens
atgccatcatctcc

SEQ ID NO: 1801050 - DNA, 13 bp, Homo sapiens
atggcagaaggca

SEQ ID NO: 1801051 - DNA, 18 bp, Homo sapiens
atggtcagccctagggtg

SEQ ID NO: 1801052 - DNA, 13 bp, Homo sapiens
atggtccaggaga

SEQ ID NO: 1801053 - DNA, 19 bp, Homo sapiens
atggtccaggagaaggcca

SEQ ID NO: 1801054 - DNA, 13 bp, Homo sapiens
atggtggagggcc

SEQ ID NO: 1801055 - DNA, 14 bp, Homo sapiens
atggtggagggcca

SEQ ID NO: 1801056 - DNA, 17 bp, Homo sapiens
atgtatattttatatga

SEQ ID NO: 1801057 - DNA, 13 bp, Homo sapiens
atgtatggcatgt

SEQ ID NO: 1801058 - DNA, 15 bp, Homo sapiens
atgtctcgtggtagg

SEQ ID NO: 1801059 - DNA, 23 bp, Homo sapiens
atgtcttgatgcatgcactgttc

SEQ ID NO: 1801060 - DNA, 22 bp, Homo sapiens
atgtgaaaatggtccaggagaa

SEQ ID NO: 1801061 - DNA, 17 bp, Homo sapiens
ctgagggagcctggccc

SEQ ID NO: 1801062 - DNA, 14 bp, Homo sapiens
ctgatcagagccgt

SEQ ID NO: 1801063 - DNA, 20 bp, Homo sapiens
ctgatcagagccgtggtcct

SEQ ID NO: 1801064 - DNA, 13 bp, Homo sapiens
ctgcaaactcctt

SEQ ID NO: 1801065 - DNA, 17 bp, Homo sapiens
ctgccagctctgtatca

SEQ ID NO: 1801066 - DNA, 22 bp, Homo sapiens
ctgcctcttctgggagggcagc

SEQ ID NO: 1801067 - DNA, 23 bp, Homo sapiens
ctgcctgacatttggagtgttcc

SEQ ID NO: 1801068 - DNA, 16 bp, Homo sapiens
ctgccttcctcctggg

SEQ ID NO: 1801069 - DNA, 17 bp, Homo sapiens
ctgctcatcattctctg

SEQ ID NO: 1801070 - DNA, 22 bp, Homo sapiens
ctgctcatcattctctgtctca

SEQ ID NO: 1801071 - DNA, 20 bp, Homo sapiens
ctgctctgcgtgtcacctgt

SEQ ID NO: 1801072 - DNA, 12 bp, Homo sapiens
ctgcttgaggaa

SEQ ID NO: 1801073 - DNA, 13 bp, Homo sapiens
ctgcttgaggaaa

SEQ ID NO: 1801074 - DNA, 14 bp, Homo sapiens
ctgcttgaggaaaa

SEQ ID NO: 1801075 - DNA, 14 bp, Homo sapiens
ctggaccagcctct

SEQ ID NO: 1801076 - DNA, 14 bp, Homo sapiens
ctggactctcagtc

SEQ ID NO: 1801077 - DNA, 18 bp, Homo sapiens
ctggactctcagtctctg

SEQ ID NO: 1801078 - DNA, 21 bp, Homo sapiens
ctggactctcagtctctgagc

SEQ ID NO: 1801079 - DNA, 22 bp, Homo sapiens
ctggcgacacgtagcagcttag

SEQ ID NO: 1801080 - DNA, 18 bp, Homo sapiens
ctggctgtggcctaacct

SEQ ID NO: 1801081 - DNA, 18 bp, Homo sapiens
ctgggaaatattccctag

SEQ ID NO: 1801082 - DNA, 12 bp, Homo sapiens
ctgggctgaggg

SEQ ID NO: 1801083 - DNA, 16 bp, Homo sapiens
ctgggctgagggagcc

SEQ ID NO: 1801084 - DNA, 19 bp, Homo sapiens
ctgggctgagggagcctgg

SEQ ID NO: 1801085 - DNA, 19 bp, Homo sapiens
ctggtgctgcctctacctg

SEQ ID NO: 1801086 - DNA, 22 bp, Homo sapiens
ctggtggtggctcgggaggcga

SEQ ID NO: 1801087 - DNA, 20 bp, Homo sapiens
ctgtacataaaatgtcattt

SEQ ID NO: 1801088 - DNA, 19 bp, Homo sapiens
ctgtagaaaagggaactga

SEQ ID NO: 1801089 - DNA, 16 bp, Homo sapiens
ctgtatcaggacccag

SEQ ID NO: 1801090 - DNA, 20 bp, Homo sapiens
ctgtatgtctcgtggtagga

SEQ ID NO: 1801091 - DNA, 15 bp, Homo sapiens
ctgtattaagccact

SEQ ID NO: 1801092 - DNA, 20 bp, Homo sapiens
ctgtcaaagaaaacttccaa

SEQ ID NO: 1801093 - DNA, 19 bp, Homo sapiens
ctgtccaggcactgagata

SEQ ID NO: 1801094 - DNA, 12 bp, Homo sapiens
ctgtccctccgg

SEQ ID NO: 1801095 - DNA, 21 bp, Homo sapiens
ctgtctcatccatcatcatgt

SEQ ID NO: 1801096 - DNA, 16 bp, Homo sapiens
ctgtgaccaatgtctt

SEQ ID NO: 1801097 - DNA, 18 bp, Homo sapiens
ctgtgcacatctgtgtct

SEQ ID NO: 1801098 - DNA, 20 bp, Homo sapiens
ctgtgcacatctgtgtcttg

SEQ ID NO: 1801099 - DNA, 14 bp, Homo sapiens
ctgtgcaccaagca

SEQ ID NO: 1801100 - DNA, 17 bp, Homo sapiens
ctgtgcttcgggccctt

SEQ ID NO: 1801101 - DNA, 20 bp, Homo sapiens
ctgtgcttcgggcccttccc

SEQ ID NO: 1801102 - DNA, 21 bp, Homo sapiens
ctgtgcttcgggcccttccca

SEQ ID NO: 1801103 - DNA, 16 bp, Homo sapiens
ctgtggccaagttctt

SEQ ID NO: 1801104 - DNA, 22 bp, Homo sapiens
ctgtggtgtgtccccctctgtc

SEQ ID NO: 1801105 - DNA, 24 bp, Homo sapiens
cttaaaatgttcacttttgacaaa

SEQ ID NO: 1801106 - DNA, 15 bp, Homo sapiens
cttcatggcagaagg

SEQ ID NO: 1801107 - DNA, 21 bp, Homo sapiens
cttcatggcagaaggcaaacc

SEQ ID NO: 1801108 - DNA, 20 bp, Homo sapiens
cttccaaatcccctaagcag

SEQ ID NO: 1801109 - DNA, 14 bp, Homo sapiens
cttccatttgcaag

SEQ ID NO: 1801110 - DNA, 15 bp, Homo sapiens
cttcctctcctgtct

SEQ ID NO: 1801111 - DNA, 14 bp, Homo sapiens
cttcctggagactg

SEQ ID NO: 1801112 - DNA, 16 bp, Homo sapiens
cttcgggcccttccca

SEQ ID NO: 1801113 - DNA, 17 bp, Homo sapiens
cttctagttctgccagg

SEQ ID NO: 1801114 - DNA, 23 bp, Homo sapiens
cttctgggagggcagcagggcta

SEQ ID NO: 1801115 - DNA, 19 bp, Homo sapiens
cttgaaaacctcatttacc

SEQ ID NO: 1801116 - DNA, 22 bp, Homo sapiens
cttgaaaacctcatttaccata

SEQ ID NO: 1801117 - DNA, 20 bp, Homo sapiens
cttgccttattagagtgtct

SEQ ID NO: 1801118 - DNA, 13 bp, Homo sapiens
cttgctttttcaa

SEQ ID NO: 1801119 - DNA, 14 bp, Homo sapiens
cttgggccctttga

SEQ ID NO: 1801120 - DNA, 16 bp, Homo sapiens
cttgggccctttgagt

SEQ ID NO: 1801121 - DNA, 13 bp, Homo sapiens
cttgggctccctg

SEQ ID NO: 1801122 - DNA, 20 bp, Homo sapiens
cttggggagtttagggtggg

SEQ ID NO: 1801123 - DNA, 21 bp, Homo sapiens
cttggggagtttagggtgggg

SEQ ID NO: 1801124 - DNA, 16 bp, Homo sapiens
cttggttcccccactg

SEQ ID NO: 1801125 - DNA, 15 bp, Homo sapiens
cttggttgaggaaac

SEQ ID NO: 1801126 - DNA, 13 bp, Homo sapiens
cttgtattaagtt

SEQ ID NO: 1801127 - DNA, 21 bp, Homo sapiens
cttgtgtttctttagtttttg

SEQ ID NO: 1801128 - DNA, 15 bp, Homo sapiens
ctttagtttttgtga

SEQ ID NO: 1801129 - DNA, 16 bp, Homo sapiens
ctttcatacattatat

SEQ ID NO: 1801130 - DNA, 22 bp, Homo sapiens
ctttcatacattatattcctct

SEQ ID NO: 1801131 - DNA, 19 bp, Homo sapiens
ctttcatgtaaactgtgca

SEQ ID NO: 1801132 - DNA, 20 bp, Homo sapiens
ctttcatgtaaactgtgcac

SEQ ID NO: 1801133 - DNA, 21 bp, Homo sapiens
ctttcatgtaaactgtgcacc

SEQ ID NO: 1801134 - DNA, 18 bp, Homo sapiens
ctttccattggatctcat

SEQ ID NO: 1801135 - DNA, 16 bp, Homo sapiens
ctttgaagtcatacca

SEQ ID NO: 1801136 - DNA, 21 bp, Homo sapiens
ctttgagtgcagtcctgatca

SEQ ID NO: 1801137 - DNA, 12 bp, Homo sapiens
ctttggacttgt

SEQ ID NO: 1801138 - DNA, 19 bp, Homo sapiens
ctttgttttgcacactttg

SEQ ID NO: 1801139 - DNA, 23 bp, Homo sapiens
cttttaacaaaaaaggaaaatga

SEQ ID NO: 1801140 - DNA, 17 bp, Homo sapiens
cttttgacaaaggcaag

SEQ ID NO: 1801141 - DNA, 15 bp, Homo sapiens
cttttgccctttgat

SEQ ID NO: 1801142 - DNA, 16 bp, Homo sapiens
cttttgttttcttcat

SEQ ID NO: 1801143 - DNA, 13 bp, Homo sapiens
ctttttgctttcg

SEQ ID NO: 1801144 - DNA, 17 bp, Homo sapiens
gaaaatttgttattttg

SEQ ID NO: 1801145 - DNA, 21 bp, Homo sapiens
gaaaatttgttattttgcaac

SEQ ID NO: 1801146 - DNA, 17 bp, Homo sapiens
gaaacaactctttgaga

SEQ ID NO: 1801147 - DNA, 20 bp, Homo sapiens
gaaacaactctttgagaaac

SEQ ID NO: 1801148 - DNA, 15 bp, Homo sapiens
gaaactgcagggaaa

SEQ ID NO: 1801149 - DNA, 22 bp, Homo sapiens
gaaagctgctttcgaataaagt

SEQ ID NO: 1801150 - DNA, 21 bp, Homo sapiens
gaacaatgtgctatgtgaaga

SEQ ID NO: 1801151 - DNA, 19 bp, Homo sapiens
gaactaccttggttccccc

SEQ ID NO: 1801152 - DNA, 20 bp, Homo sapiens
gaactaccttggttccccca

SEQ ID NO: 1801153 - DNA, 22 bp, Homo sapiens
gaactgctagtcaagtgcgtcc

SEQ ID NO: 1801154 - DNA, 14 bp, Homo sapiens
gaaggggccagagg

SEQ ID NO: 1801155 - DNA, 18 bp, Homo sapiens
gaagtcataccaatgaaa

SEQ ID NO: 1801156 - DNA, 20 bp, Homo sapiens
gaatagctttatcttggttt

SEQ ID NO: 1801157 - DNA, 13 bp, Homo sapiens
gaatattgtccat

SEQ ID NO: 1801158 - DNA, 18 bp, Homo sapiens
gaatctctttttgctttc

SEQ ID NO: 1801159 - DNA, 13 bp, Homo sapiens
gaatgctgagacc

SEQ ID NO: 1801160 - DNA, 12 bp, Homo sapiens
gaatgtctcagc

SEQ ID NO: 1801161 - DNA, 20 bp, Homo sapiens
gaattcttggttgaggaaac

SEQ ID NO: 1801162 - DNA, 23 bp, Homo sapiens
gaattgctaattctgagggaatt

SEQ ID NO: 1801163 - DNA, 17 bp, Homo sapiens
gaatttgagtgctctga

SEQ ID NO: 1801164 - DNA, 13 bp, Homo sapiens
gacaaaggcaagc

SEQ ID NO: 1801165 - DNA, 15 bp, Homo sapiens
gacaacatttttgta

SEQ ID NO: 1801166 - DNA, 12 bp, Homo sapiens
gtggagggccac

SEQ ID NO: 1801167 - DNA, 14 bp, Homo sapiens
gtggcactggggca

SEQ ID NO: 1801168 - DNA, 18 bp, Homo sapiens
gtggcactggggcagggg

SEQ ID NO: 1801169 - DNA, 14 bp, Homo sapiens
gtggcatccagagt

SEQ ID NO: 1801170 - DNA, 21 bp, Homo sapiens
gtggcctaacctgccgagagt

SEQ ID NO: 1801171 - DNA, 17 bp, Homo sapiens
gtggggagactgggctg

SEQ ID NO: 1801172 - DNA, 23 bp, Homo sapiens
gtggggggggggcgcggctggga

SEQ ID NO: 1801173 - DNA, 20 bp, Homo sapiens
gtgggtccatgggcagagcc

SEQ ID NO: 1801174 - DNA, 23 bp, Homo sapiens
gtggtgtgtccccctctgtccag

SEQ ID NO: 1801175 - DNA, 13 bp, Homo sapiens
gtgtacagtcttg

SEQ ID NO: 1801176 - DNA, 17 bp, Homo sapiens
gtgtagttaattttatt

SEQ ID NO: 1801177 - DNA, 18 bp, Homo sapiens
gtgtccacgactgtctcc

SEQ ID NO: 1801178 - DNA, 18 bp, Homo sapiens
gtgtccccctctgtccag

SEQ ID NO: 1801179 - DNA, 17 bp, Homo sapiens
gtgtctggcacagcctg

SEQ ID NO: 1801180 - DNA, 12 bp, Homo sapiens
gtgtgaggccag

SEQ ID NO: 1801181 - DNA, 17 bp, Homo sapiens
gtgtgaggccagggcag

SEQ ID NO: 1801182 - DNA, 16 bp, Homo sapiens
gtgtgtccccctctgt

SEQ ID NO: 1801183 - DNA, 21 bp, Homo sapiens
gtgttaaatgtgatgaatact

SEQ ID NO: 1801184 - DNA, 16 bp, Homo sapiens
gttacacatttttcag

SEQ ID NO: 1801185 - DNA, 20 bp, Homo sapiens
gttatcaccgtgggctccct

SEQ ID NO: 1801186 - DNA, 13 bp, Homo sapiens
gttattttgcaac

SEQ ID NO: 1801187 - DNA, 13 bp, Homo sapiens
gttcaaagccagc

SEQ ID NO: 1801188 - DNA, 22 bp, Homo sapiens
gttccccttccactgagggcag

SEQ ID NO: 1801189 - DNA, 12 bp, Homo sapiens
gttctgccagga

SEQ ID NO: 1801190 - DNA, 18 bp, Homo sapiens
gttctgctcatcattctc

SEQ ID NO: 1801191 - DNA, 23 bp, Homo sapiens
gttctgctcatcattctctgtct

SEQ ID NO: 1801192 - DNA, 22 bp, Homo sapiens
gtttactagggatccctcatct

SEQ ID NO: 1801193 - DNA, 17 bp, Homo sapiens
gtttagaactactgata

SEQ ID NO: 1801194 - DNA, 14 bp, Homo sapiens
gtttgtgtgcatga

SEQ ID NO: 1801195 - DNA, 17 bp, Homo sapiens
gttttattttaagaggg

SEQ ID NO: 1801196 - DNA, 24 bp, Homo sapiens
gttttcaggagtgggttgatttca

SEQ ID NO: 1801197 - DNA, 12 bp, Homo sapiens
gtttttcagttt

SEQ ID NO: 1801198 - DNA, 18 bp, Homo sapiens
gtttttggtttttaaaac

SEQ ID NO: 1801199 - DNA, 20 bp, Homo sapiens
taaagaggaaaagtgcaatg

SEQ ID NO: 1801200 - DNA, 15 bp, Homo sapiens
taaagctagaaatga

SEQ ID NO: 1801201 - DNA, 21 bp, Homo sapiens
taaataagaaacaactctttg

SEQ ID NO: 1801202 - DNA, 22 bp, Homo sapiens
taaatacagtcttccatttgca

SEQ ID NO: 1801203 - DNA, 14 bp, Homo sapiens
taacaatcagctcc

SEQ ID NO: 1801204 - DNA, 18 bp, Homo sapiens
taacaattaattttctat

SEQ ID NO: 1801205 - DNA, 14 bp, Homo sapiens
taacaattcctcta

SEQ ID NO: 1801206 - DNA, 17 bp, Homo sapiens
taacctcttcagaggcc

SEQ ID NO: 1801207 - DNA, 22 bp, Homo sapiens
taacttaacaattaattttcta

SEQ ID NO: 1801208 - DNA, 17 bp, Homo sapiens
taacttcaaatatagag

SEQ ID NO: 1801209 - DNA, 13 bp, Homo sapiens
taagacgtgaatg

SEQ ID NO: 1801210 - DNA, 14 bp, Homo sapiens
taagacgtgaatgt

SEQ ID NO: 1801211 - DNA, 19 bp, Homo sapiens
taagacgtgaatgtctcag

SEQ ID NO: 1801212 - DNA, 17 bp, Homo sapiens
taagcagaccactgata

SEQ ID NO: 1801213 - DNA, 12 bp, Homo sapiens
taatatattaag

SEQ ID NO: 1801214 - DNA, 19 bp, Homo sapiens
taatccgaatctctttttg

SEQ ID NO: 1801215 - DNA, 16 bp, Homo sapiens
taatcttgaattgtaa

SEQ ID NO: 1801216 - DNA, 16 bp, Homo sapiens
taatgaagaaagtgga

SEQ ID NO: 1801217 - DNA, 17 bp, Homo sapiens
taatgaagaaagtggaa

SEQ ID NO: 1801218 - DNA, 17 bp, Homo sapiens
tacacatttttcagata

SEQ ID NO: 1801219 - DNA, 19 bp, Homo sapiens
tacacatttttcagatata

SEQ ID NO: 1801220 - DNA, 16 bp, Homo sapiens
tacacccttttccagc

SEQ ID NO: 1801221 - DNA, 13 bp, Homo sapiens
tacagaatgaatc

SEQ ID NO: 1801222 - DNA, 22 bp, Homo sapiens
tacagtaggagcccagctctga

SEQ ID NO: 1801223 - DNA, 13 bp, Homo sapiens
tacagtcttgtat

SEQ ID NO: 1801224 - DNA, 16 bp, Homo sapiens
tacagtgtacagtctt

SEQ ID NO: 1801225 - DNA, 22 bp, Homo sapiens
tacagtgtacagtcttgtatta

SEQ ID NO: 1801226 - DNA, 21 bp, Homo sapiens
tacatgacatttatttttcat

SEQ ID NO: 1801227 - DNA, 13 bp, Homo sapiens
tacattatgttat

SEQ ID NO: 1801228 - DNA, 21 bp, Homo sapiens
tacattatgttattggaattt

SEQ ID NO: 1801229 - DNA, 21 bp, Homo sapiens
tacattttgcacaaagtaagc

SEQ ID NO: 1801230 - DNA, 13 bp, Homo sapiens
taccagcgaggag

SEQ ID NO: 1801231 - DNA, 17 bp, Homo sapiens
taccctgagctgaggca

SEQ ID NO: 1801232 - DNA, 13 bp, Homo sapiens
tacctcctgagaa

SEQ ID NO: 1801233 - DNA, 13 bp, Homo sapiens
tacctgaaaacac

SEQ ID NO: 1801234 - DNA, 17 bp, Homo sapiens
tacctgacactcccttg

SEQ ID NO: 1801235 - DNA, 20 bp, Homo sapiens
tacctgacactcccttgggc

SEQ ID NO: 1801236 - DNA, 22 bp, Homo sapiens
tacttgaactttccaaaaccta

SEQ ID NO: 1801237 - DNA, 14 bp, Homo sapiens
tactttgaagtcat

SEQ ID NO: 1801238 - DNA, 18 bp, Homo sapiens
tactttgaagtcatacca

SEQ ID NO: 1801239 - DNA, 22 bp, Homo sapiens
tagaaaatttgttattttgcaa

SEQ ID NO: 1801240 - DNA, 22 bp, Homo sapiens
tagaacttggatgtacctgccc

SEQ ID NO: 1801241 - DNA, 18 bp, Homo sapiens
tagaagatggcacttata

SEQ ID NO: 1801242 - DNA, 17 bp, Homo sapiens
tagagatatttttgtac

SEQ ID NO: 1801243 - DNA, 20 bp, Homo sapiens
tagagctgtattaagccact

SEQ ID NO: 1801244 - DNA, 18 bp, Homo sapiens
tagccttgctcaggtgca

SEQ ID NO: 1801245 - DNA, 15 bp, Homo sapiens
taggctagggtgggg

SEQ ID NO: 1801246 - DNA, 16 bp, Homo sapiens
taggctagggtgggga

SEQ ID NO: 1801247 - DNA, 14 bp, Homo sapiens
tagggaagggcctg

SEQ ID NO: 1801248 - DNA, 16 bp, Homo sapiens
tagggtggagagccac

SEQ ID NO: 1801249 - DNA, 21 bp, Homo sapiens
tagtgaaggcttctctctgtg

SEQ ID NO: 1801250 - DNA, 22 bp, Homo sapiens
tagtgatttttatgccacctga

SEQ ID NO: 1801251 - DNA, 13 bp, Homo sapiens
tagttctgccagg

SEQ ID NO: 1801252 - DNA, 20 bp, Homo sapiens
tagttgattgcgagaatttt

SEQ ID NO: 1801253 - DNA, 21 bp, Homo sapiens
tagtttgattattcagtgtca

SEQ ID NO: 1801254 - DNA, 14 bp, Homo sapiens
tataatctatttac

SEQ ID NO: 1801255 - DNA, 19 bp, Homo sapiens
tataccagtataattgagt

SEQ ID NO: 1801256 - DNA, 12 bp, Homo sapiens
tatatgttgtaa

SEQ ID NO: 1801257 - DNA, 15 bp, Homo sapiens
tatattgtattaagg

SEQ ID NO: 1801258 - DNA, 21 bp, Homo sapiens
tatattgtcctcccctatttt

SEQ ID NO: 1801259 - DNA, 21 bp, Homo sapiens
tatccaggtaatccaagatat

SEQ ID NO: 1801260 - DNA, 15 bp, Homo sapiens
tatcttggtttaact

SEQ ID NO: 1801261 - DNA, 22 bp, Homo sapiens
tatgcatttaaatacagtcttc

SEQ ID NO: 1801262 - DNA, 20 bp, Homo sapiens
tatgccacctgaataaagaa

SEQ ID NO: 1801263 - DNA, 16 bp, Homo sapiens
tatgtaggatctgtca

SEQ ID NO: 1801264 - DNA, 21 bp, Homo sapiens
tatgtctcgtggtaggactgt

SEQ ID NO: 1801265 - DNA, 20 bp, Homo sapiens
tatgtgtgggtgtgtgttac

SEQ ID NO: 1801266 - DNA, 20 bp, Homo sapiens
tatgttattggaattttctt

SEQ ID NO: 1801267 - DNA, 15 bp, Homo sapiens
tattaagttgttaat

SEQ ID NO: 1801268 - DNA, 21 bp, Homo sapiens
tattacttgaactttccaaaa

SEQ ID NO: 1801269 - DNA, 18 bp, Homo sapiens
tattagagtgtctttcca

SEQ ID NO: 1801270 - DNA, 15 bp, Homo sapiens
tattcagtgtcactg

SEQ ID NO: 1801271 - DNA, 21 bp, Homo sapiens
tctctgctctgcgtgtcacct

SEQ ID NO: 1801272 - DNA, 22 bp, Homo sapiens
tctctgctctgcgtgtcacctg

SEQ ID NO: 1801273 - DNA, 12 bp, Homo sapiens
tctctgtctcat

SEQ ID NO: 1801274 - DNA, 14 bp, Homo sapiens
tctctgtctcatcc

SEQ ID NO: 1801275 - DNA, 15 bp, Homo sapiens
tctctgtctcatcca

SEQ ID NO: 1801276 - DNA, 21 bp, Homo sapiens
tctgacagccctgcggagacc

SEQ ID NO: 1801277 - DNA, 14 bp, Homo sapiens
tctgactcagggct

SEQ ID NO: 1801278 - DNA, 20 bp, Homo sapiens
tctgactcagggctcctggg

SEQ ID NO: 1801279 - DNA, 19 bp, Homo sapiens
tctgagcagtgaatgattc

SEQ ID NO: 1801280 - DNA, 15 bp, Homo sapiens
tctgcctcttctggg

SEQ ID NO: 1801281 - DNA, 19 bp, Homo sapiens
tctgcctcttctgggaggg

SEQ ID NO: 1801282 - DNA, 14 bp, Homo sapiens
tctgctcatcattc

SEQ ID NO: 1801283 - DNA, 21 bp, Homo sapiens
tctgctctgcgtgtcacctgt

SEQ ID NO: 1801284 - DNA, 16 bp, Homo sapiens
tctgtgaccaatgtct

SEQ ID NO: 1801285 - DNA, 18 bp, Homo sapiens
tctgtgaccaatgtcttg

SEQ ID NO: 1801286 - DNA, 23 bp, Homo sapiens
tctgtgggatgggatggtggagg

SEQ ID NO: 1801287 - DNA, 13 bp, Homo sapiens
tcttaaaaattaa

SEQ ID NO: 1801288 - DNA, 17 bp, Homo sapiens
tcttcaccatttggcaa

SEQ ID NO: 1801289 - DNA, 17 bp, Homo sapiens
tcttctgggagggcagc

SEQ ID NO: 1801290 - DNA, 20 bp, Homo sapiens
tcttctgggagggcagcagg

SEQ ID NO: 1801291 - DNA, 21 bp, Homo sapiens
tcttctgtatgtgacaacatt

SEQ ID NO: 1801292 - DNA, 21 bp, Homo sapiens
tcttgaatttaataatctgta

SEQ ID NO: 1801293 - DNA, 21 bp, Homo sapiens
tcttgatgcatgcactgttcc

SEQ ID NO: 1801294 - DNA, 19 bp, Homo sapiens
tcttgtaatccgaatctct

SEQ ID NO: 1801295 - DNA, 22 bp, Homo sapiens
tcttgtattaagttgttaataa

SEQ ID NO: 1801296 - DNA, 15 bp, Homo sapiens
tctttagtttttgtg

SEQ ID NO: 1801297 - DNA, 11 bp, Homo sapiens
tctttcaaaac

SEQ ID NO: 1801298 - DNA, 16 bp, Homo sapiens
tcttttgttttcttca

SEQ ID NO: 1801299 - DNA, 17 bp, Homo sapiens
tcttttgttttcttcat

SEQ ID NO: 1801300 - DNA, 16 bp, Homo sapiens
tgaaaacactgtgcac

SEQ ID NO: 1801301 - DNA, 18 bp, Homo sapiens
tgaaaacactgtgcacat

SEQ ID NO: 1801302 - DNA, 15 bp, Homo sapiens
tgaaaatgtcttgtg

SEQ ID NO: 1801303 - DNA, 18 bp, Homo sapiens
tgaaagagaaagactgat

SEQ ID NO: 1801304 - DNA, 13 bp, Homo sapiens
tgaacattccaga

SEQ ID NO: 1801305 - DNA, 20 bp, Homo sapiens
tgaactaccttggttccccc

SEQ ID NO: 1801306 - DNA, 14 bp, Homo sapiens
tgaactttccaaaa

SEQ ID NO: 1801307 - DNA, 16 bp, Homo sapiens
tgaatactgtattttg

SEQ ID NO: 1801308 - DNA, 17 bp, Homo sapiens
tgaatcacgtaaagcta

SEQ ID NO: 1801309 - DNA, 14 bp, Homo sapiens
tgaatgctgagacc

SEQ ID NO: 1801310 - DNA, 20 bp, Homo sapiens
tgaattcttggttgaggaaa

SEQ ID NO: 1801311 - DNA, 22 bp, Homo sapiens
tgaattgatgactatatataaa

SEQ ID NO: 1801312 - DNA, 16 bp, Homo sapiens
tgaattgctaattctg

SEQ ID NO: 1801313 - DNA, 19 bp, Homo sapiens
tgacagagttggtgttcat

SEQ ID NO: 1801314 - DNA, 21 bp, Homo sapiens
tgacatttatttttcatttag

SEQ ID NO: 1801315 - DNA, 21 bp, Homo sapiens
tgacatttggagtgttcccct

SEQ ID NO: 1801316 - DNA, 17 bp, Homo sapiens
tgaccaatattgtacag

SEQ ID NO: 1801317 - DNA, 13 bp, Homo sapiens
tgaccaatgtctt

SEQ ID NO: 1801318 - DNA, 15 bp, Homo sapiens
tgaccaatgtcttga

SEQ ID NO: 1801319 - DNA, 18 bp, Homo sapiens
tgacctgccctacatatc

SEQ ID NO: 1801320 - DNA, 16 bp, Homo sapiens
tgactacagtcaggaa

SEQ ID NO: 1801321 - DNA, 18 bp, Homo sapiens
tgactactatggctgttt

SEQ ID NO: 1801322 - DNA, 17 bp, Homo sapiens
tgactaggaagaaaaca

SEQ ID NO: 1801323 - DNA, 17 bp, Homo sapiens
tgactcagggctcctgg

SEQ ID NO: 1801324 - DNA, 18 bp, Homo sapiens
tgactcagggctcctggg

SEQ ID NO: 1801325 - DNA, 14 bp, Homo sapiens
tgactctttccaac

SEQ ID NO: 1801326 - DNA, 16 bp, Homo sapiens
tgactctttccaaccg

SEQ ID NO: 1801327 - DNA, 23 bp, Homo sapiens
tgactggtgttatcaccgtgggc

SEQ ID NO: 1801328 - DNA, 16 bp, Homo sapiens
tgagaaatgaatgctg

SEQ ID NO: 1801329 - DNA, 18 bp, Homo sapiens
tgagacccagccctcatc

SEQ ID NO: 1801330 - DNA, 19 bp, Homo sapiens
tgagctccttaaggctctt

SEQ ID NO: 1801331 - DNA, 14 bp, Homo sapiens
tgagctgaggcagc

SEQ ID NO: 1801332 - DNA, 13 bp, Homo sapiens
tgaggccagggca

SEQ ID NO: 1801333 - DNA, 16 bp, Homo sapiens
tgataaaaccatgtag

SEQ ID NO: 1801334 - DNA, 17 bp, Homo sapiens
tgataacgtattttgat

SEQ ID NO: 1801335 - DNA, 17 bp, Homo sapiens
tgatcgcctttcccagg

SEQ ID NO: 1801336 - DNA, 16 bp, Homo sapiens
tgatgtttaaaagtcc

SEQ ID NO: 1801337 - DNA, 15 bp, Homo sapiens
tgattgcgagaattt

SEQ ID NO: 1801338 - DNA, 11 bp, Homo sapiens
tgatttctcac

SEQ ID NO: 1801339 - DNA, 22 bp, Homo sapiens
tgcaacctcgctggactctcag

SEQ ID NO: 1801340 - DNA, 18 bp, Homo sapiens
tgcacatctgtgtcttgt

SEQ ID NO: 1801341 - DNA, 16 bp, Homo sapiens
tgcacccatgccatag

SEQ ID NO: 1801342 - DNA, 12 bp, Homo sapiens
tgcaccggggcc

SEQ ID NO: 1801343 - DNA, 22 bp, Homo sapiens
tgcaccggggcctgggcaggag

SEQ ID NO: 1801344 - DNA, 14 bp, Homo sapiens
tgcactgttccccc

SEQ ID NO: 1801345 - DNA, 17 bp, Homo sapiens
tgcagatgtgtgtccca

SEQ ID NO: 1801346 - DNA, 15 bp, Homo sapiens
tgcagggaaaattat

SEQ ID NO: 1801347 - DNA, 13 bp, Homo sapiens
tgcaggtggggag

SEQ ID NO: 1801348 - DNA, 19 bp, Homo sapiens
tgcatgcactgttccccct

SEQ ID NO: 1801349 - DNA, 24 bp, Homo sapiens
tgcatttaaatacagtcttccatt

SEQ ID NO: 1801350 - DNA, 17 bp, Homo sapiens
tgccacagcctcccctg

SEQ ID NO: 1801351 - DNA, 16 bp, Homo sapiens
tgccagggcagggccc

SEQ ID NO: 1801352 - DNA, 13 bp, Homo sapiens
tgccatattttca

SEQ ID NO: 1801353 - DNA, 22 bp, Homo sapiens
tgccatgtcttgttcagaagac

SEQ ID NO: 1801354 - DNA, 16 bp, Homo sapiens
tgccccatcagtgctc

SEQ ID NO: 1801355 - DNA, 21 bp, Homo sapiens
tgccccatcagtgctccctca

SEQ ID NO: 1801356 - DNA, 17 bp, Homo sapiens
tgcccgggagctcagga

SEQ ID NO: 1801357 - DNA, 23 bp, Homo sapiens
tgcctctacctgacactcccttg

SEQ ID NO: 1801358 - DNA, 16 bp, Homo sapiens
tgcctcttctgggagg

SEQ ID NO: 1801359 - DNA, 23 bp, Homo sapiens
tgccttattagagtgtctttcca

SEQ ID NO: 1801360 - DNA, 15 bp, Homo sapiens
tgccttcctcctggg

SEQ ID NO: 1801361 - DNA, 17 bp, Homo sapiens
tgccttcctcctgggcc

SEQ ID NO: 1801362 - DNA, 15 bp, Homo sapiens
tgccttgtcacgcca

SEQ ID NO: 1801363 - DNA, 14 bp, Homo sapiens
tgcgagaattttca

SEQ ID NO: 1801364 - DNA, 15 bp, Homo sapiens
tgcgagaattttcaa

SEQ ID NO: 1801365 - DNA, 17 bp, Homo sapiens
tgctcatcattctctgt

SEQ ID NO: 1801366 - DNA, 19 bp, Homo sapiens
tgctcatcattctctgtct

SEQ ID NO: 1801367 - DNA, 12 bp, Homo sapiens
tgctccttgggc

SEQ ID NO: 1801368 - DNA, 19 bp, Homo sapiens
tgctcgcccacaaactgat

SEQ ID NO: 1801369 - DNA, 12 bp, Homo sapiens
tgctggtttttc

SEQ ID NO: 1801370 - DNA, 18 bp, Homo sapiens
tgctggtttttcagtttt

SEQ ID NO: 1801371 - DNA, 15 bp, Homo sapiens
tgcttcgggcccttc

SEQ ID NO: 1801372 - DNA, 18 bp, Homo sapiens
tgcttcgggcccttccca

SEQ ID NO: 1801373 - DNA, 21 bp, Homo sapiens
tgctttcgaataaagtgaata

SEQ ID NO: 1801374 - DNA, 15 bp, Homo sapiens
tggaatattgtccat

SEQ ID NO: 1801375 - DNA, 15 bp, Homo sapiens
tggaatgtgagtgtg

SEQ ID NO: 1801376 - DNA, 20 bp, Homo sapiens
tggactctcagtctctgagc

SEQ ID NO: 1801377 - DNA, 10 bp, Homo sapiens
aaaaaaattt

SEQ ID NO: 1801378 - DNA, 17 bp, Homo sapiens
aaaaagtatatattcta

SEQ ID NO: 1801379 - DNA, 15 bp, Homo sapiens
aaaaatactgtttca

SEQ ID NO: 1801380 - DNA, 15 bp, Homo sapiens
aaaacatttcaaagc

SEQ ID NO: 1801381 - DNA, 16 bp, Homo sapiens
aaaactagacaaaagt

SEQ ID NO: 1801382 - DNA, 15 bp, Homo sapiens
aaaagaaaaatatga

SEQ ID NO: 1801383 - DNA, 14 bp, Homo sapiens
aaaaggaaaaaaga

SEQ ID NO: 1801384 - DNA, 23 bp, Homo sapiens
aaaagggacagtattctcagtgc

SEQ ID NO: 1801385 - DNA, 16 bp, Homo sapiens
aaaaggttttattttg

SEQ ID NO: 1801386 - DNA, 23 bp, Homo sapiens
aaaaggttttattttgtaattat

SEQ ID NO: 1801387 - DNA, 19 bp, Homo sapiens
aaaagtatgtgaatatgaa

SEQ ID NO: 1801388 - DNA, 16 bp, Homo sapiens
aaaagtccacttttaa

SEQ ID NO: 1801389 - DNA, 20 bp, Homo sapiens
aaaatagtaattttttacat

SEQ ID NO: 1801390 - DNA, 20 bp, Homo sapiens
aaaatcaaaaggcactgtga

SEQ ID NO: 1801391 - DNA, 17 bp, Homo sapiens
aaaatcaaaaggtaatg

SEQ ID NO: 1801392 - DNA, 20 bp, Homo sapiens
aaaatgttcccttgaccatt

SEQ ID NO: 1801393 - DNA, 14 bp, Homo sapiens
aaaattttgtatgt

SEQ ID NO: 1801394 - DNA, 16 bp, Homo sapiens
aaaattttgtatgtca

SEQ ID NO: 1801395 - DNA, 21 bp, Homo sapiens
aaaattttgtatgtcaataac

SEQ ID NO: 1801396 - DNA, 13 bp, Homo sapiens
aaacaaaaataaa

SEQ ID NO: 1801397 - DNA, 18 bp, Homo sapiens
aaacagggacaaagaaat

SEQ ID NO: 1801398 - DNA, 17 bp, Homo sapiens
aaacattcctccagcct

SEQ ID NO: 1801399 - DNA, 12 bp, Homo sapiens
aaaccccagccc

SEQ ID NO: 1801400 - DNA, 19 bp, Homo sapiens
aaacctctaatttattttg

SEQ ID NO: 1801401 - DNA, 24 bp, Homo sapiens
aaacctctaatttattttgtcgaa

SEQ ID NO: 1801402 - DNA, 17 bp, Homo sapiens
aaacctgtccataaagt

SEQ ID NO: 1801403 - DNA, 18 bp, Homo sapiens
aaacctgtccataaagta

SEQ ID NO: 1801404 - DNA, 23 bp, Homo sapiens
aaactatatttatttatgtagga

SEQ ID NO: 1801405 - DNA, 18 bp, Homo sapiens
aaactgcgtaggagagaa

SEQ ID NO: 1801406 - DNA, 22 bp, Homo sapiens
aaagaaaaaaaattttgtatgt

SEQ ID NO: 1801407 - DNA, 15 bp, Homo sapiens
aaagaaaaaaatgat

SEQ ID NO: 1801408 - DNA, 13 bp, Homo sapiens
aaagaaaaagtat

SEQ ID NO: 1801409 - DNA, 13 bp, Homo sapiens
aaagaaagggaaa

SEQ ID NO: 1801410 - DNA, 13 bp, Homo sapiens
aaagaactgcccc

SEQ ID NO: 1801411 - DNA, 15 bp, Homo sapiens
aaagaactgccccat

SEQ ID NO: 1801412 - DNA, 13 bp, Homo sapiens
aaagaagtaaaag

SEQ ID NO: 1801413 - DNA, 17 bp, Homo sapiens
aaagaataaatgaatct

SEQ ID NO: 1801414 - DNA, 18 bp, Homo sapiens
aaagaataaatgaatctt

SEQ ID NO: 1801415 - DNA, 15 bp, Homo sapiens
aaagagtatgtacgt

SEQ ID NO: 1801416 - DNA, 14 bp, Homo sapiens
aaagcaaaagaagt

SEQ ID NO: 1801417 - DNA, 16 bp, Homo sapiens
aaagcaatgtgatggt

SEQ ID NO: 1801418 - DNA, 21 bp, Homo sapiens
aaagcagcagctaggactgag

SEQ ID NO: 1801419 - DNA, 16 bp, Homo sapiens
aaagcagttaaactga

SEQ ID NO: 1801420 - DNA, 20 bp, Homo sapiens
aaagcctcctgccccctgcc

SEQ ID NO: 1801421 - DNA, 22 bp, Homo sapiens
aaagcctcctgccccctgccag

SEQ ID NO: 1801422 - DNA, 20 bp, Homo sapiens
aaagctggacaagaagctgc

SEQ ID NO: 1801423 - DNA, 15 bp, Homo sapiens
aaaggaaaaaagaaa

SEQ ID NO: 1801424 - DNA, 20 bp, Homo sapiens
aaaggcctggaaccagggag

SEQ ID NO: 1801425 - DNA, 14 bp, Homo sapiens
aaaggggctgctgg

SEQ ID NO: 1801426 - DNA, 18 bp, Homo sapiens
aaaggtaatgcacatcct

SEQ ID NO: 1801427 - DNA, 19 bp, Homo sapiens
aaaggtttcactgttcatg

SEQ ID NO: 1801428 - DNA, 16 bp, Homo sapiens
aaaggttttattttgt

SEQ ID NO: 1801429 - DNA, 18 bp, Homo sapiens
aaaggttttattttgtaa

SEQ ID NO: 1801430 - DNA, 15 bp, Homo sapiens
aaagtatatattcta

SEQ ID NO: 1801431 - DNA, 14 bp, Homo sapiens
aaagtctcctgtat

SEQ ID NO: 1801432 - DNA, 21 bp, Homo sapiens
aaagtgccccttaagggttga

SEQ ID NO: 1801433 - DNA, 20 bp, Homo sapiens
aaagtggggctaaatgaagt

SEQ ID NO: 1801434 - DNA, 12 bp, Homo sapiens
aaataaactagt

SEQ ID NO: 1801435 - DNA, 13 bp, Homo sapiens
aaataacacagat

SEQ ID NO: 1801436 - DNA, 23 bp, Homo sapiens
aaataattggctttgcagatatt

SEQ ID NO: 1801437 - DNA, 16 bp, Homo sapiens
aaatacgtgttcaaaa

SEQ ID NO: 1801438 - DNA, 22 bp, Homo sapiens
aaatacgtgttcaaaaatttct

SEQ ID NO: 1801439 - DNA, 15 bp, Homo sapiens
aaatataaaaacaac

SEQ ID NO: 1801440 - DNA, 15 bp, Homo sapiens
aaatattagcaaaga

SEQ ID NO: 1801441 - DNA, 21 bp, Homo sapiens
aaatcaaaaggtaatgcacat

SEQ ID NO: 1801442 - DNA, 17 bp, Homo sapiens
aaatcattttcattaaa

SEQ ID NO: 1801443 - DNA, 18 bp, Homo sapiens
aaatccccccttcagaac

SEQ ID NO: 1801444 - DNA, 22 bp, Homo sapiens
aaatcgtattctaattcttcat

SEQ ID NO: 1801445 - DNA, 22 bp, Homo sapiens
aaatctggcaaagttatattta

SEQ ID NO: 1801446 - DNA, 19 bp, Homo sapiens
aaatgagatttttgttttc

SEQ ID NO: 1801447 - DNA, 16 bp, Homo sapiens
aaatgagtctgtttga

SEQ ID NO: 1801448 - DNA, 17 bp, Homo sapiens
aaatgcatatttctatg

SEQ ID NO: 1801449 - DNA, 12 bp, Homo sapiens
aaatgcccagtt

SEQ ID NO: 1801450 - DNA, 20 bp, Homo sapiens
aaatgttgcacatcattcat

SEQ ID NO: 1801451 - DNA, 20 bp, Homo sapiens
aaatgtttgtactttttaat

SEQ ID NO: 1801452 - DNA, 16 bp, Homo sapiens
aaattacagtgcagtt

SEQ ID NO: 1801453 - DNA, 13 bp, Homo sapiens
aaattgcttctag

SEQ ID NO: 1801454 - DNA, 19 bp, Homo sapiens
aaatttactgtgagactgt

SEQ ID NO: 1801455 - DNA, 12 bp, Homo sapiens
aaatttatgtga

SEQ ID NO: 1801456 - DNA, 15 bp, Homo sapiens
aaatttatgtgatgg

SEQ ID NO: 1801457 - DNA, 12 bp, Homo sapiens
aaatttctgtat

SEQ ID NO: 1801458 - DNA, 19 bp, Homo sapiens
aaattttactgacagaaat

SEQ ID NO: 1801459 - DNA, 16 bp, Homo sapiens
aacaaaaaccagcagg

SEQ ID NO: 1801460 - DNA, 17 bp, Homo sapiens
aacaaaattccattaca

SEQ ID NO: 1801461 - DNA, 22 bp, Homo sapiens
aacaagcaaggatatcagagct

SEQ ID NO: 1801462 - DNA, 17 bp, Homo sapiens
aacaagtcacagctgca

SEQ ID NO: 1801463 - DNA, 19 bp, Homo sapiens
aacaagtcacagctgcagc

SEQ ID NO: 1801464 - DNA, 13 bp, Homo sapiens
aacaataattcat

SEQ ID NO: 1801465 - DNA, 16 bp, Homo sapiens
aacaatctatagttat

SEQ ID NO: 1801466 - DNA, 16 bp, Homo sapiens
aacctcacactactgt

SEQ ID NO: 1801467 - DNA, 18 bp, Homo sapiens
aacctcacactactgtat

SEQ ID NO: 1801468 - DNA, 16 bp, Homo sapiens
aacctcatttaccata

SEQ ID NO: 1801469 - DNA, 21 bp, Homo sapiens
aacctctaatttattttgtcg

SEQ ID NO: 1801470 - DNA, 14 bp, Homo sapiens
aacctgaattattc

SEQ ID NO: 1801471 - DNA, 13 bp, Homo sapiens
aacctgtgtctta

SEQ ID NO: 1801472 - DNA, 12 bp, Homo sapiens
aacgcaccccac

SEQ ID NO: 1801473 - DNA, 14 bp, Homo sapiens
aactagccaaggct

SEQ ID NO: 1801474 - DNA, 14 bp, Homo sapiens
aactattttgaaga

SEQ ID NO: 1801475 - DNA, 23 bp, Homo sapiens
aactcgatgaatgtgttgatttg

SEQ ID NO: 1801476 - DNA, 14 bp, Homo sapiens
aactctatactcaa

SEQ ID NO: 1801477 - DNA, 17 bp, Homo sapiens
aactctatactcaatca

SEQ ID NO: 1801478 - DNA, 15 bp, Homo sapiens
aactgatggaccggg

SEQ ID NO: 1801479 - DNA, 17 bp, Homo sapiens
aactgattagtattcag

SEQ ID NO: 1801480 - DNA, 15 bp, Homo sapiens
aactgctgagccact

SEQ ID NO: 1801481 - DNA, 14 bp, Homo sapiens
aactggatactgta

SEQ ID NO: 1801482 - DNA, 15 bp, Homo sapiens
aactggatactgtac

SEQ ID NO: 1801483 - DNA, 18 bp, Homo sapiens
aactggatactgtactga

SEQ ID NO: 1801484 - DNA, 13 bp, Homo sapiens
aactggctggcca

SEQ ID NO: 1801485 - DNA, 21 bp, Homo sapiens
aactgtcttgagagaaaagaa

SEQ ID NO: 1801486 - DNA, 21 bp, Homo sapiens
aacttatctagaaagaaaaga

SEQ ID NO: 1801487 - DNA, 18 bp, Homo sapiens
aacttcttccactttttc

SEQ ID NO: 1801488 - DNA, 22 bp, Homo sapiens
aacttcttccactttttccaga

SEQ ID NO: 1801489 - DNA, 12 bp, Homo sapiens
aacttgaggaca

SEQ ID NO: 1801490 - DNA, 13 bp, Homo sapiens
aacttgaggacac

SEQ ID NO: 1801491 - DNA, 14 bp, Homo sapiens
aacttgaggacaca

SEQ ID NO: 1801492 - DNA, 15 bp, Homo sapiens
aacttgaggacacat

SEQ ID NO: 1801493 - DNA, 16 bp, Homo sapiens
aacttgaggacacatg

SEQ ID NO: 1801494 - DNA, 20 bp, Homo sapiens
aacttgaggacacatgtcca

SEQ ID NO: 1801495 - DNA, 16 bp, Homo sapiens
aacttgctgaaaaaca

SEQ ID NO: 1801496 - DNA, 17 bp, Homo sapiens
aacttgcttctaaatgc

SEQ ID NO: 1801497 - DNA, 14 bp, Homo sapiens
aagaaaaaaaattt

SEQ ID NO: 1801498 - DNA, 13 bp, Homo sapiens
aagaaaaaaatga

SEQ ID NO: 1801499 - DNA, 19 bp, Homo sapiens
aagaaaaatataaaaacaa

SEQ ID NO: 1801500 - DNA, 13 bp, Homo sapiens
aagaaaacacaac

SEQ ID NO: 1801501 - DNA, 18 bp, Homo sapiens
aagaactgccccatctcc

SEQ ID NO: 1801502 - DNA, 14 bp, Homo sapiens
aagaagtaaaagct

SEQ ID NO: 1801503 - DNA, 12 bp, Homo sapiens
aagaataaatga

SEQ ID NO: 1801504 - DNA, 22 bp, Homo sapiens
aagaatgcagattcctgggcct

SEQ ID NO: 1801505 - DNA, 23 bp, Homo sapiens
aagaatgcagattcctgggcctg

SEQ ID NO: 1801506 - DNA, 15 bp, Homo sapiens
aagaccctgagactc

SEQ ID NO: 1801507 - DNA, 15 bp, Homo sapiens
aagaccgtgtcccaa

SEQ ID NO: 1801508 - DNA, 22 bp, Homo sapiens
aagaccgtgtcccaaggagctg

SEQ ID NO: 1801509 - DNA, 19 bp, Homo sapiens
aagacgtggctctgggtga

SEQ ID NO: 1801510 - DNA, 15 bp, Homo sapiens
aagactaactaaaat

SEQ ID NO: 1801511 - DNA, 21 bp, Homo sapiens
aagagatgtggcaaagtgctg

SEQ ID NO: 1801512 - DNA, 19 bp, Homo sapiens
aagagattgtgcgttcaaa

SEQ ID NO: 1801513 - DNA, 13 bp, Homo sapiens
aagagcacagccc

SEQ ID NO: 1801514 - DNA, 11 bp, Homo sapiens
aagagcagcct

SEQ ID NO: 1801515 - DNA, 15 bp, Homo sapiens
aagagcagcctgatg

SEQ ID NO: 1801516 - DNA, 19 bp, Homo sapiens
aagaggaactagactttcc

SEQ ID NO: 1801517 - DNA, 15 bp, Homo sapiens
aagaggagaccctgg

SEQ ID NO: 1801518 - DNA, 14 bp, Homo sapiens
aagaggcaaagaat

SEQ ID NO: 1801519 - DNA, 16 bp, Homo sapiens
aagaggcaaagaatca

SEQ ID NO: 1801520 - DNA, 17 bp, Homo sapiens
aagagttattcaaatga

SEQ ID NO: 1801521 - DNA, 20 bp, Homo sapiens
aagagttattcaaatgaagg

SEQ ID NO: 1801522 - DNA, 16 bp, Homo sapiens
aagattatatatcata

SEQ ID NO: 1801523 - DNA, 15 bp, Homo sapiens
aagcaaatgctttgt

SEQ ID NO: 1801524 - DNA, 22 bp, Homo sapiens
aagcaacttgcttctaaatgcc

SEQ ID NO: 1801525 - DNA, 20 bp, Homo sapiens
aagcaagggctccagcatcc

SEQ ID NO: 1801526 - DNA, 15 bp, Homo sapiens
aagcaattgccctgt

SEQ ID NO: 1801527 - DNA, 20 bp, Homo sapiens
aagcactttacgctgtctgt

SEQ ID NO: 1801528 - DNA, 23 bp, Homo sapiens
aagcagacgtgagtgtgactttt

SEQ ID NO: 1801529 - DNA, 10 bp, Homo sapiens
aagcagccag

SEQ ID NO: 1801530 - DNA, 18 bp, Homo sapiens
aagcagggaaagctccac

SEQ ID NO: 1801531 - DNA, 13 bp, Homo sapiens
aagccccagggcc

SEQ ID NO: 1801532 - DNA, 17 bp, Homo sapiens
aagccccagggcctggg

SEQ ID NO: 1801533 - DNA, 13 bp, Homo sapiens
aagcccctcagcc

SEQ ID NO: 1801534 - DNA, 16 bp, Homo sapiens
aagcccctcagccctt

SEQ ID NO: 1801535 - DNA, 11 bp, Homo sapiens
aagccctggca

SEQ ID NO: 1801536 - DNA, 13 bp, Homo sapiens
aagcctctgtgtc

SEQ ID NO: 1801537 - DNA, 17 bp, Homo sapiens
aagcctctgtgtcactg

SEQ ID NO: 1801538 - DNA, 22 bp, Homo sapiens
aagcctctgtgtcactggctgc

SEQ ID NO: 1801539 - DNA, 24 bp, Homo sapiens
aagcctctgtgtcactggctgcct

SEQ ID NO: 1801540 - DNA, 23 bp, Homo sapiens
aagcggaaaaggttttattttgt

SEQ ID NO: 1801541 - DNA, 13 bp, Homo sapiens
aagctagaaacaa

SEQ ID NO: 1801542 - DNA, 19 bp, Homo sapiens
aagctccacggtgcgtggc

SEQ ID NO: 1801543 - DNA, 18 bp, Homo sapiens
aagctctgaacaaaagct

SEQ ID NO: 1801544 - DNA, 19 bp, Homo sapiens
aagctctgaacaaaagctt

SEQ ID NO: 1801545 - DNA, 21 bp, Homo sapiens
aagctgagttacttgtctgag

SEQ ID NO: 1801546 - DNA, 23 bp, Homo sapiens
aagctgagttacttgtctgaggc

SEQ ID NO: 1801547 - DNA, 21 bp, Homo sapiens
aagctgctgagaatctagcct

SEQ ID NO: 1801548 - DNA, 19 bp, Homo sapiens
aagctggacaagaagctgc

SEQ ID NO: 1801549 - DNA, 21 bp, Homo sapiens
aagctgtgccaccctgggctc

SEQ ID NO: 1801550 - DNA, 16 bp, Homo sapiens
aagctttctcctttga

SEQ ID NO: 1801551 - DNA, 15 bp, Homo sapiens
aaggaaaaaagaaaa

SEQ ID NO: 1801552 - DNA, 18 bp, Homo sapiens
aaggaaaaactgatgttt

SEQ ID NO: 1801553 - DNA, 16 bp, Homo sapiens
aaggaatagccagaga

SEQ ID NO: 1801554 - DNA, 21 bp, Homo sapiens
aaggacaacctgcccctcccc

SEQ ID NO: 1801555 - DNA, 23 bp, Homo sapiens
aaggacccacccatcttcctgct

SEQ ID NO: 1801556 - DNA, 19 bp, Homo sapiens
aaggagctgatttccaggc

SEQ ID NO: 1801557 - DNA, 21 bp, Homo sapiens
aaggagctgatttccaggccc

SEQ ID NO: 1801558 - DNA, 13 bp, Homo sapiens
aaggaggctggct

SEQ ID NO: 1801559 - DNA, 15 bp, Homo sapiens
aaggaggctggctgg

SEQ ID NO: 1801560 - DNA, 13 bp, Homo sapiens
aaggagggcagag

SEQ ID NO: 1801561 - DNA, 20 bp, Homo sapiens
cagtgagcccctccccagcc

SEQ ID NO: 1801562 - DNA, 22 bp, Homo sapiens
cagtgagcccctccccagccag

SEQ ID NO: 1801563 - DNA, 17 bp, Homo sapiens
agtgagcccctccccag

SEQ ID NO: 1801564 - DNA, 16 bp, Homo sapiens
agtgaggcttccaggc

SEQ ID NO: 1801565 - DNA, 20 bp, Homo sapiens
agtgatctttcaatatcatt

SEQ ID NO: 1801566 - DNA, 23 bp, Homo sapiens
agtgatctttcaatatcattact

SEQ ID NO: 1801567 - DNA, 19 bp, Homo sapiens
agtgatggcgcgggaggca

SEQ ID NO: 1801568 - DNA, 20 bp, Homo sapiens
agtgatggcgcgggaggcac

SEQ ID NO: 1801569 - DNA, 23 bp, Homo sapiens
agtgatggcgcgggaggcaccag

SEQ ID NO: 1801570 - DNA, 20 bp, Homo sapiens
agtgccaagtttttcagaaa

SEQ ID NO: 1801571 - DNA, 22 bp, Homo sapiens
agtgccaagtttttcagaaagt

SEQ ID NO: 1801572 - DNA, 17 bp, Homo sapiens
agtgcccattcctcacc

SEQ ID NO: 1801573 - DNA, 16 bp, Homo sapiens
agtgccgccgcctcgc

SEQ ID NO: 1801574 - DNA, 15 bp, Homo sapiens
agtgcctagaaagca

SEQ ID NO: 1801575 - DNA, 22 bp, Homo sapiens
agtgctgccatgccactgccag

SEQ ID NO: 1801576 - DNA, 15 bp, Homo sapiens
agtgctgcttctctt

SEQ ID NO: 1801577 - DNA, 19 bp, Homo sapiens
agtgctgcttctcttggga

SEQ ID NO: 1801578 - DNA, 15 bp, Homo sapiens
agtggaagagcagcc

SEQ ID NO: 1801579 - DNA, 16 bp, Homo sapiens
agtggaagagcagcct

SEQ ID NO: 1801580 - DNA, 19 bp, Homo sapiens
agtggaagagcagcctgat

SEQ ID NO: 1801581 - DNA, 22 bp, Homo sapiens
agtggaagagcagcctgatggc

SEQ ID NO: 1801582 - DNA, 16 bp, Homo sapiens
agtggaatgcagggaa

SEQ ID NO: 1801583 - DNA, 12 bp, Homo sapiens
agtggcagccat

SEQ ID NO: 1801584 - DNA, 14 bp, Homo sapiens
agtggcagccatgc

SEQ ID NO: 1801585 - DNA, 16 bp, Homo sapiens
agtggcattggcagca

SEQ ID NO: 1801586 - DNA, 16 bp, Homo sapiens
agtggctggatctgtg

SEQ ID NO: 1801587 - DNA, 22 bp, Homo sapiens
agtgggttttattgtccttcag

SEQ ID NO: 1801588 - DNA, 20 bp, Homo sapiens
agtgtacccccgcccaggct

SEQ ID NO: 1801589 - DNA, 22 bp, Homo sapiens
agtgtacccccgcccaggctgg

SEQ ID NO: 1801590 - DNA, 23 bp, Homo sapiens
agtgtatgctgtagctgaaagag

SEQ ID NO: 1801591 - DNA, 15 bp, Homo sapiens
agtgtattatttctg

SEQ ID NO: 1801592 - DNA, 18 bp, Homo sapiens
agtgtccccaaagactac

SEQ ID NO: 1801593 - DNA, 19 bp, Homo sapiens
agtgtcttcctagtatatt

SEQ ID NO: 1801594 - DNA, 14 bp, Homo sapiens
agtgtcttcctgtg

SEQ ID NO: 1801595 - DNA, 15 bp, Homo sapiens
agtgtgagtggcagc

SEQ ID NO: 1801596 - DNA, 17 bp, Homo sapiens
agtgtgagtggcagcca

SEQ ID NO: 1801597 - DNA, 15 bp, Homo sapiens
agtgtgccagagtta

SEQ ID NO: 1801598 - DNA, 23 bp, Homo sapiens
agtgtgccccccatcctggccca

SEQ ID NO: 1801599 - DNA, 13 bp, Homo sapiens
agtgtggagaggg

SEQ ID NO: 1801600 - DNA, 18 bp, Homo sapiens
agtgtgggagtgcagaga

SEQ ID NO: 1801601 - DNA, 20 bp, Homo sapiens
agtgtgggagtgcagagaaa

SEQ ID NO: 1801602 - DNA, 19 bp, Homo sapiens
agtgttaggcctggcacag

SEQ ID NO: 1801603 - DNA, 15 bp, Homo sapiens
agtgttgtggagaaa

SEQ ID NO: 1801604 - DNA, 16 bp, Homo sapiens
agtgttttctcagaac

SEQ ID NO: 1801605 - DNA, 19 bp, Homo sapiens
agtgttttctcagaacagc

SEQ ID NO: 1801606 - DNA, 22 bp, Homo sapiens
agtgttttctcagaacagctga

SEQ ID NO: 1801607 - DNA, 15 bp, Homo sapiens
agttacttgtctgag

SEQ ID NO: 1801608 - DNA, 18 bp, Homo sapiens
agttacttgtctgaggcc

SEQ ID NO: 1801609 - DNA, 19 bp, Homo sapiens
agttacttgtctgaggcct

SEQ ID NO: 1801610 - DNA, 20 bp, Homo sapiens
agttacttgtctgaggcctc

SEQ ID NO: 1801611 - DNA, 14 bp, Homo sapiens
agttagccctcagt

SEQ ID NO: 1801612 - DNA, 17 bp, Homo sapiens
agttatacatcttcatt

SEQ ID NO: 1801613 - DNA, 19 bp, Homo sapiens
agttatatttactttaaaa

SEQ ID NO: 1801614 - DNA, 19 bp, Homo sapiens
agttatggtttcctcattt

SEQ ID NO: 1801615 - DNA, 15 bp, Homo sapiens
agttattcaaatgaa

SEQ ID NO: 1801616 - DNA, 18 bp, Homo sapiens
agttcaagtgatctttca

SEQ ID NO: 1801617 - DNA, 22 bp, Homo sapiens
agttcaagtgatctttcaatat

SEQ ID NO: 1801618 - DNA, 15 bp, Homo sapiens
agttcagttctgttt

SEQ ID NO: 1801619 - DNA, 18 bp, Homo sapiens
agttcataaatttatggt

SEQ ID NO: 1801620 - DNA, 20 bp, Homo sapiens
agttcattcgctttgtctgt

SEQ ID NO: 1801621 - DNA, 18 bp, Homo sapiens
agttcccggagcacagcc

SEQ ID NO: 1801622 - DNA, 19 bp, Homo sapiens
agttcccggagcacagccc

SEQ ID NO: 1801623 - DNA, 23 bp, Homo sapiens
agttcccggagcacagccctggg

SEQ ID NO: 1801624 - DNA, 22 bp, Homo sapiens
agttcttagagcacttttaaca

SEQ ID NO: 1801625 - DNA, 16 bp, Homo sapiens
agttcttgggggaggc

SEQ ID NO: 1801626 - DNA, 18 bp, Homo sapiens
agttctttgctgcccctg

SEQ ID NO: 1801627 - DNA, 17 bp, Homo sapiens
agttgacagaatggtgc

SEQ ID NO: 1801628 - DNA, 20 bp, Homo sapiens
agttgagtacagtgaggagg

SEQ ID NO: 1801629 - DNA, 20 bp, Homo sapiens
agttgattgcgagaattttc

SEQ ID NO: 1801630 - DNA, 19 bp, Homo sapiens
agttggcagagaaggcctc

SEQ ID NO: 1801631 - DNA, 20 bp, Homo sapiens
agttggcagagaaggcctct

SEQ ID NO: 1801632 - DNA, 21 bp, Homo sapiens
agttggcagagaaggcctctt

SEQ ID NO: 1801633 - DNA, 11 bp, Homo sapiens
caaagcaaggg

SEQ ID NO: 1801634 - DNA, 13 bp, Homo sapiens
caaagcaagggct

SEQ ID NO: 1801635 - DNA, 15 bp, Homo sapiens
caaagcaagggctcc

SEQ ID NO: 1801636 - DNA, 15 bp, Homo sapiens
caaaggggctgctgg

SEQ ID NO: 1801637 - DNA, 21 bp, Homo sapiens
caaagtgttttctcagaacag

SEQ ID NO: 1801638 - DNA, 17 bp, Homo sapiens
caaagttatatttactt

SEQ ID NO: 1801639 - DNA, 14 bp, Homo sapiens
caaataaactagtc

SEQ ID NO: 1801640 - DNA, 21 bp, Homo sapiens
caaataattggctttgcagat

SEQ ID NO: 1801641 - DNA, 18 bp, Homo sapiens
caaatattttttgagtgt

SEQ ID NO: 1801642 - DNA, 16 bp, Homo sapiens
caaatcaaagcaaggg

SEQ ID NO: 1801643 - DNA, 14 bp, Homo sapiens
caaatgaactttaa

SEQ ID NO: 1801644 - DNA, 15 bp, Homo sapiens
caaatgaactttaaa

SEQ ID NO: 1801645 - DNA, 16 bp, Homo sapiens
caaatgcacaagctca

SEQ ID NO: 1801646 - DNA, 18 bp, Homo sapiens
caaatgcacaagctcaga

SEQ ID NO: 1801647 - DNA, 15 bp, Homo sapiens
caaatgctttgtgac

SEQ ID NO: 1801648 - DNA, 23 bp, Homo sapiens
caaattagaaacaccattcatct

SEQ ID NO: 1801649 - DNA, 14 bp, Homo sapiens
caaattgcttctag

SEQ ID NO: 1801650 - DNA, 15 bp, Homo sapiens
caaatttttcatctc

SEQ ID NO: 1801651 - DNA, 14 bp, Homo sapiens
caacaagttgcctc

SEQ ID NO: 1801652 - DNA, 11 bp, Homo sapiens
caacaatgcaa

SEQ ID NO: 1801653 - DNA, 12 bp, Homo sapiens
caacaatgcaaa

SEQ ID NO: 1801654 - DNA, 15 bp, Homo sapiens
caacagatttctaag

SEQ ID NO: 1801655 - DNA, 18 bp, Homo sapiens
caacattttaatacagat

SEQ ID NO: 1801656 - DNA, 11 bp, Homo sapiens
caacccagccg

SEQ ID NO: 1801657 - DNA, 15 bp, Homo sapiens
caacccccagcaccc

SEQ ID NO: 1801658 - DNA, 18 bp, Homo sapiens
caaccccgcggtgctctg

SEQ ID NO: 1801659 - DNA, 21 bp, Homo sapiens
caaccccgcggtgctctggcg

SEQ ID NO: 1801660 - DNA, 13 bp, Homo sapiens
caacccctgtacc

SEQ ID NO: 1801661 - DNA, 14 bp, Homo sapiens
caacccctgtaccc

SEQ ID NO: 1801662 - DNA, 17 bp, Homo sapiens
caacctgcccctcccca

SEQ ID NO: 1801663 - DNA, 14 bp, Homo sapiens
caactaaataacac

SEQ ID NO: 1801664 - DNA, 21 bp, Homo sapiens
caactaacccttaaaaatgca

SEQ ID NO: 1801665 - DNA, 13 bp, Homo sapiens
caactagccaagg

SEQ ID NO: 1801666 - DNA, 15 bp, Homo sapiens
caactagccaaggct

SEQ ID NO: 1801667 - DNA, 13 bp, Homo sapiens
caactccaggggc

SEQ ID NO: 1801668 - DNA, 19 bp, Homo sapiens
caactctatactcaatcaa

SEQ ID NO: 1801669 - DNA, 20 bp, Homo sapiens
caactgtgaatatgagaaat

SEQ ID NO: 1801670 - DNA, 23 bp, Homo sapiens
caactgtgaatatgagaaataca

SEQ ID NO: 1801671 - DNA, 23 bp, Homo sapiens
caacttgcttctaaatgcccagt

SEQ ID NO: 1801672 - DNA, 19 bp, Homo sapiens
caagaattctagaaaattt

SEQ ID NO: 1801673 - DNA, 17 bp, Homo sapiens
caagagaaacaaataaa

SEQ ID NO: 1801674 - DNA, 23 bp, Homo sapiens
caagcaacagcactttctgtagt

SEQ ID NO: 1801675 - DNA, 23 bp, Homo sapiens
caagcagacgtgagtgtgacttt

SEQ ID NO: 1801676 - DNA, 11 bp, Homo sapiens
caagcagccag

SEQ ID NO: 1801677 - DNA, 14 bp, Homo sapiens
caagcagccagcca

SEQ ID NO: 1801678 - DNA, 18 bp, Homo sapiens
caagcagccagccagtct

SEQ ID NO: 1801679 - DNA, 14 bp, Homo sapiens
caagccccagggcc

SEQ ID NO: 1801680 - DNA, 16 bp, Homo sapiens
caagccccagggcctg

SEQ ID NO: 1801681 - DNA, 19 bp, Homo sapiens
caagccccagggcctgggg

SEQ ID NO: 1801682 - DNA, 21 bp, Homo sapiens
caagccccagggcctgggggc

SEQ ID NO: 1801683 - DNA, 14 bp, Homo sapiens
caagcccctcagcc

SEQ ID NO: 1801684 - DNA, 11 bp, Homo sapiens
caagccctggc

SEQ ID NO: 1801685 - DNA, 20 bp, Homo sapiens
caagctgtcccctctgtcat

SEQ ID NO: 1801686 - DNA, 16 bp, Homo sapiens
caagctgtgccaccct

SEQ ID NO: 1801687 - DNA, 19 bp, Homo sapiens
caaggagctgatttccagg

SEQ ID NO: 1801688 - DNA, 16 bp, Homo sapiens
caaggaggctggctgg

SEQ ID NO: 1801689 - DNA, 22 bp, Homo sapiens
caaggaggctggctggggccta

SEQ ID NO: 1801690 - DNA, 17 bp, Homo sapiens
caaggatatcagagctg

SEQ ID NO: 1801691 - DNA, 19 bp, Homo sapiens
caaggcacctgcaggttgg

SEQ ID NO: 1801692 - DNA, 16 bp, Homo sapiens
caaggcagcctccaga

SEQ ID NO: 1801693 - DNA, 19 bp, Homo sapiens
caaggcagcctccagagcc

SEQ ID NO: 1801694 - DNA, 20 bp, Homo sapiens
caaggcagcctccagagcca

SEQ ID NO: 1801695 - DNA, 23 bp, Homo sapiens
caaggcaggtagatcgcttgagc

SEQ ID NO: 1801696 - DNA, 20 bp, Homo sapiens
caaggccatattttaaaaaa

SEQ ID NO: 1801697 - DNA, 21 bp, Homo sapiens
caaggccatattttaaaaaat

SEQ ID NO: 1801698 - DNA, 13 bp, Homo sapiens
caaggcctcccac

SEQ ID NO: 1801699 - DNA, 17 bp, Homo sapiens
caaggcctcccacagtg

SEQ ID NO: 1801700 - DNA, 18 bp, Homo sapiens
caaggcctcccacagtga

SEQ ID NO: 1801701 - DNA, 18 bp, Homo sapiens
caagggcatcaggcactg

SEQ ID NO: 1801702 - DNA, 20 bp, Homo sapiens
caagggcatcaggcactggt

SEQ ID NO: 1801703 - DNA, 12 bp, Homo sapiens
caagggctccag

SEQ ID NO: 1801704 - DNA, 13 bp, Homo sapiens
caagggctccagc

SEQ ID NO: 1801705 - DNA, 22 bp, Homo sapiens
caagggggtgtcatctgaggag

SEQ ID NO: 1801706 - DNA, 23 bp, Homo sapiens
caaggtctccttactctgagccc

SEQ ID NO: 1801707 - DNA, 23 bp, Homo sapiens
caaggtggtctgctcgggcccag

SEQ ID NO: 1801708 - DNA, 16 bp, Homo sapiens
caaggttttggagtca

SEQ ID NO: 1801709 - DNA, 14 bp, Homo sapiens
caagtcacagctgc

SEQ ID NO: 1801710 - DNA, 20 bp, Homo sapiens
caagtcacagctgcagctgg

SEQ ID NO: 1801711 - DNA, 16 bp, Homo sapiens
caagtccacctgccta

SEQ ID NO: 1801712 - DNA, 16 bp, Homo sapiens
caagtctaaacaatga

SEQ ID NO: 1801713 - DNA, 18 bp, Homo sapiens
caagtctaaacaatgaat

SEQ ID NO: 1801714 - DNA, 14 bp, Homo sapiens
caagtgatctttca

SEQ ID NO: 1801715 - DNA, 18 bp, Homo sapiens
caagtgatctttcaatat

SEQ ID NO: 1801716 - DNA, 22 bp, Homo sapiens
caagtgatctttcaatatcatt

SEQ ID NO: 1801717 - DNA, 14 bp, Homo sapiens
caagtttttcagaa

SEQ ID NO: 1801718 - DNA, 11 bp, Homo sapiens
caataaagctg

SEQ ID NO: 1801719 - DNA, 17 bp, Homo sapiens
caataaagctgctgaga

SEQ ID NO: 1801720 - DNA, 12 bp, Homo sapiens
caataaagctgg

SEQ ID NO: 1801721 - DNA, 17 bp, Homo sapiens
caataaagctggacaag

SEQ ID NO: 1801722 - DNA, 23 bp, Homo sapiens
caataaagctggacaagaagctg

SEQ ID NO: 1801723 - DNA, 13 bp, Homo sapiens
caatatcattact

SEQ ID NO: 1801724 - DNA, 21 bp, Homo sapiens
caatatcattactaacttctt

SEQ ID NO: 1801725 - DNA, 14 bp, Homo sapiens
caatattcaataaa

SEQ ID NO: 1801726 - DNA, 20 bp, Homo sapiens
caatcaagcaaaatttctgt

SEQ ID NO: 1801727 - DNA, 20 bp, Homo sapiens
caatcactagtcaagaaaaa

SEQ ID NO: 1801728 - DNA, 18 bp, Homo sapiens
caatctccagggctgccc

SEQ ID NO: 1801729 - DNA, 13 bp, Homo sapiens
caatgaaaacaaa

SEQ ID NO: 1801730 - DNA, 20 bp, Homo sapiens
caatgaaaacaaaattccat

SEQ ID NO: 1801731 - DNA, 22 bp, Homo sapiens
caatgaaaacaaaattccatta

SEQ ID NO: 1801732 - DNA, 14 bp, Homo sapiens
caatgaattcttca

SEQ ID NO: 1801733 - DNA, 14 bp, Homo sapiens
caatgcaaaagcca

SEQ ID NO: 1801734 - DNA, 19 bp, Homo sapiens
caatgcaaaagccaagaaa

SEQ ID NO: 1801735 - DNA, 17 bp, Homo sapiens
caatgcaattcaatgca

SEQ ID NO: 1801736 - DNA, 19 bp, Homo sapiens
caatgctttgggaggccaa

SEQ ID NO: 1801737 - DNA, 20 bp, Homo sapiens
caatgctttgggaggccaag

SEQ ID NO: 1801738 - DNA, 22 bp, Homo sapiens
caatgctttgggaggccaaggc

SEQ ID NO: 1801739 - DNA, 23 bp, Homo sapiens
caatgctttgggaggccaaggca

SEQ ID NO: 1801740 - DNA, 18 bp, Homo sapiens
caatggcagctagactgg

SEQ ID NO: 1801741 - DNA, 22 bp, Homo sapiens
caatggcagctagactggagtg

SEQ ID NO: 1801742 - DNA, 23 bp, Homo sapiens
caatggcagctagactggagtga

SEQ ID NO: 1801743 - DNA, 16 bp, Homo sapiens
caatggggtgggccca

SEQ ID NO: 1801744 - DNA, 17 bp, Homo sapiens
caatgtcatttttaaaa

SEQ ID NO: 1801745 - DNA, 13 bp, Homo sapiens
caattcaatgcaa

SEQ ID NO: 1801746 - DNA, 14 bp, Homo sapiens
caattcaatgcaat

SEQ ID NO: 1801747 - DNA, 12 bp, Homo sapiens
caattgccctgt

SEQ ID NO: 1801748 - DNA, 12 bp, Homo sapiens
cacaattcattg

SEQ ID NO: 1801749 - DNA, 13 bp, Homo sapiens
cacacacagctcc

SEQ ID NO: 1801750 - DNA, 14 bp, Homo sapiens
cacacacagctcct

SEQ ID NO: 1801751 - DNA, 13 bp, Homo sapiens
cacacagctcctc

SEQ ID NO: 1801752 - DNA, 13 bp, Homo sapiens
attcaggcactga

SEQ ID NO: 1801753 - DNA, 14 bp, Homo sapiens
attcatgctttctc

SEQ ID NO: 1801754 - DNA, 18 bp, Homo sapiens
attcatgctttctccttt

SEQ ID NO: 1801755 - DNA, 16 bp, Homo sapiens
attcattgttaaaaaa

SEQ ID NO: 1801756 - DNA, 21 bp, Homo sapiens
attccactgaaatagagtgaa

SEQ ID NO: 1801757 - DNA, 12 bp, Homo sapiens
attccagaggaa

SEQ ID NO: 1801758 - DNA, 18 bp, Homo sapiens
attccatttaaaaaacaa

SEQ ID NO: 1801759 - DNA, 23 bp, Homo sapiens
attcccactaagctttctccttt

SEQ ID NO: 1801760 - DNA, 22 bp, Homo sapiens
attcccatggtagactgtgaca

SEQ ID NO: 1801761 - DNA, 21 bp, Homo sapiens
attcccccatgtggctgaaga

SEQ ID NO: 1801762 - DNA, 23 bp, Homo sapiens
attccctctgataagctgttctg

SEQ ID NO: 1801763 - DNA, 22 bp, Homo sapiens
attccgaagagggaatggatgg

SEQ ID NO: 1801764 - DNA, 19 bp, Homo sapiens
attcctccagcctcccctc

SEQ ID NO: 1801765 - DNA, 20 bp, Homo sapiens
attcctccagcctcccctcc

SEQ ID NO: 1801766 - DNA, 15 bp, Homo sapiens
attcctgggcctgtc

SEQ ID NO: 1801767 - DNA, 16 bp, Homo sapiens
attcctgggcctgtcc

SEQ ID NO: 1801768 - DNA, 17 bp, Homo sapiens
attcctgggcctgtccc

SEQ ID NO: 1801769 - DNA, 20 bp, Homo sapiens
attcctttacaactaaataa

SEQ ID NO: 1801770 - DNA, 19 bp, Homo sapiens
attctaattcttcattata

SEQ ID NO: 1801771 - DNA, 15 bp, Homo sapiens
attctacacatatat

SEQ ID NO: 1801772 - DNA, 21 bp, Homo sapiens
attctcaaaatacgtgttcaa

SEQ ID NO: 1801773 - DNA, 21 bp, Homo sapiens
attctcattggggttgcaaca

SEQ ID NO: 1801774 - DNA, 14 bp, Homo sapiens
attctgagccttga

SEQ ID NO: 1801775 - DNA, 16 bp, Homo sapiens
attctgcaactagcca

SEQ ID NO: 1801776 - DNA, 13 bp, Homo sapiens
attcttttcaaaa

SEQ ID NO: 1801777 - DNA, 16 bp, Homo sapiens
attcttttcaaaattg

SEQ ID NO: 1801778 - DNA, 17 bp, Homo sapiens
attcttttcaaaattgt

SEQ ID NO: 1801779 - DNA, 16 bp, Homo sapiens
attgaaggagaaaatg

SEQ ID NO: 1801780 - DNA, 16 bp, Homo sapiens
attgattttaaatata

SEQ ID NO: 1801781 - DNA, 17 bp, Homo sapiens
attgattttaaatataa

SEQ ID NO: 1801782 - DNA, 16 bp, Homo sapiens
attgcgagaattttca

SEQ ID NO: 1801783 - DNA, 10 bp, Homo sapiens
attgcttcta

SEQ ID NO: 1801784 - DNA, 23 bp, Homo sapiens
attggataccccattaaatctga

SEQ ID NO: 1801785 - DNA, 19 bp, Homo sapiens
attggcagcaggtgctgct

SEQ ID NO: 1801786 - DNA, 22 bp, Homo sapiens
attggcagcaggtgctgctacc

SEQ ID NO: 1801787 - DNA, 20 bp, Homo sapiens
attgtacttttggcatgaaa

SEQ ID NO: 1801788 - DNA, 17 bp, Homo sapiens
attgtagagccagaggt

SEQ ID NO: 1801789 - DNA, 18 bp, Homo sapiens
attgtagagccagaggtc

SEQ ID NO: 1801790 - DNA, 14 bp, Homo sapiens
attgtgatttcccg

SEQ ID NO: 1801791 - DNA, 17 bp, Homo sapiens
attgttataaataaaat

SEQ ID NO: 1801792 - DNA, 18 bp, Homo sapiens
attgttataaataaaatt

SEQ ID NO: 1801793 - DNA, 16 bp, Homo sapiens
attgttatattgtcct

SEQ ID NO: 1801794 - DNA, 19 bp, Homo sapiens
atttaaaattgtgatgtgt

SEQ ID NO: 1801795 - DNA, 16 bp, Homo sapiens
atttaatatctgagaa

SEQ ID NO: 1801796 - DNA, 16 bp, Homo sapiens
atttaatatttttcaa

SEQ ID NO: 1801797 - DNA, 23 bp, Homo sapiens
atttaatatttttcaaaatcaaa

SEQ ID NO: 1801798 - DNA, 20 bp, Homo sapiens
atttacagaatattatataa

SEQ ID NO: 1801799 - DNA, 13 bp, Homo sapiens
atttactaaaaga

SEQ ID NO: 1801800 - DNA, 15 bp, Homo sapiens
atttactaaaagaat

SEQ ID NO: 1801801 - DNA, 20 bp, Homo sapiens
atttagaatatattaaatcg

SEQ ID NO: 1801802 - DNA, 18 bp, Homo sapiens
atttcaaccgcttgccat

SEQ ID NO: 1801803 - DNA, 13 bp, Homo sapiens
atttcaaggccat

SEQ ID NO: 1801804 - DNA, 17 bp, Homo sapiens
atttcaaggccatattt

SEQ ID NO: 1801805 - DNA, 21 bp, Homo sapiens
atttccacataaaggtattta

SEQ ID NO: 1801806 - DNA, 14 bp, Homo sapiens
atttccaggcccct

SEQ ID NO: 1801807 - DNA, 22 bp, Homo sapiens
atttccataaggatttaggtat

SEQ ID NO: 1801808 - DNA, 15 bp, Homo sapiens
atttcccgtggcccc

SEQ ID NO: 1801809 - DNA, 18 bp, Homo sapiens
atttcccgtggccccagc

SEQ ID NO: 1801810 - DNA, 16 bp, Homo sapiens
atttctatgttgtaat

SEQ ID NO: 1801811 - DNA, 17 bp, Homo sapiens
atttctatgttgtaata

SEQ ID NO: 1801812 - DNA, 17 bp, Homo sapiens
atttctccatcccctcc

SEQ ID NO: 1801813 - DNA, 18 bp, Homo sapiens
atttctccatcccctccc

SEQ ID NO: 1801814 - DNA, 19 bp, Homo sapiens
atttctcctcatttaatat

SEQ ID NO: 1801815 - DNA, 21 bp, Homo sapiens
atttctcctcatttaatattt

SEQ ID NO: 1801816 - DNA, 14 bp, Homo sapiens
atttctctccccac

SEQ ID NO: 1801817 - DNA, 11 bp, Homo sapiens
atttctgtata

SEQ ID NO: 1801818 - DNA, 16 bp, Homo sapiens
atttcttcgctgctct

SEQ ID NO: 1801819 - DNA, 17 bp, Homo sapiens
atttcttcgctgctcta

SEQ ID NO: 1801820 - DNA, 23 bp, Homo sapiens
atttcttcgctgctctagctggc

SEQ ID NO: 1801821 - DNA, 14 bp, Homo sapiens
atttgaaacacaag

SEQ ID NO: 1801822 - DNA, 18 bp, Homo sapiens
atttgagtttctttcaga

SEQ ID NO: 1801823 - DNA, 19 bp, Homo sapiens
atttgagtttctttcagat

SEQ ID NO: 1801824 - DNA, 13 bp, Homo sapiens
atttgccagcaca

SEQ ID NO: 1801825 - DNA, 16 bp, Homo sapiens
atttgccagcacaggg

SEQ ID NO: 1801826 - DNA, 19 bp, Homo sapiens
atttgtaagcaacttgctt

SEQ ID NO: 1801827 - DNA, 22 bp, Homo sapiens
atttgtaagcaacttgcttcta

SEQ ID NO: 1801828 - DNA, 23 bp, Homo sapiens
atttgtattaccattacttgtat

SEQ ID NO: 1801829 - DNA, 21 bp, Homo sapiens
atttgtcctgactgtctgcta

SEQ ID NO: 1801830 - DNA, 16 bp, Homo sapiens
attttaagaggctttg

SEQ ID NO: 1801831 - DNA, 18 bp, Homo sapiens
attttacagtatcttcaa

SEQ ID NO: 1801832 - DNA, 18 bp, Homo sapiens
attttactaaaatcgtat

SEQ ID NO: 1801833 - DNA, 23 bp, Homo sapiens
attttactaaaatcgtattctaa

SEQ ID NO: 1801834 - DNA, 15 bp, Homo sapiens
attttactgacagaa

SEQ ID NO: 1801835 - DNA, 16 bp, Homo sapiens
attttactgacagaaa

SEQ ID NO: 1801836 - DNA, 20 bp, Homo sapiens
attttcacatgacgtaaaat

SEQ ID NO: 1801837 - DNA, 17 bp, Homo sapiens
attttctttcatacatt

SEQ ID NO: 1801838 - DNA, 21 bp, Homo sapiens
attttcttttgttttcttcat

SEQ ID NO: 1801839 - DNA, 19 bp, Homo sapiens
attttgaagaaaacacaac

SEQ ID NO: 1801840 - DNA, 13 bp, Homo sapiens
attttgacaaaaa

SEQ ID NO: 1801841 - DNA, 16 bp, Homo sapiens
attttgtaattattgt

SEQ ID NO: 1801842 - DNA, 20 bp, Homo sapiens
attttgtacaaagatatgct

SEQ ID NO: 1801843 - DNA, 16 bp, Homo sapiens
attttgtatgtcaata

SEQ ID NO: 1801844 - DNA, 23 bp, Homo sapiens
attttgtatgtcaataactttat

SEQ ID NO: 1801845 - DNA, 17 bp, Homo sapiens
atttttattttcttatg

SEQ ID NO: 1801846 - DNA, 22 bp, Homo sapiens
atttttcaaaatcaaagttatg

SEQ ID NO: 1801847 - DNA, 15 bp, Homo sapiens
atttttgaatgtgat

SEQ ID NO: 1801848 - DNA, 16 bp, Homo sapiens
atttttgctcttctgt

SEQ ID NO: 1801849 - DNA, 21 bp, Homo sapiens
atttttgctgaattcctttac

SEQ ID NO: 1801850 - DNA, 18 bp, Homo sapiens
atttttgtacattatgtt

SEQ ID NO: 1801851 - DNA, 20 bp, Homo sapiens
atttttgttttccactgtgc

SEQ ID NO: 1801852 - DNA, 22 bp, Homo sapiens
caaaaacatacttcaaaaatgt

SEQ ID NO: 1801853 - DNA, 15 bp, Homo sapiens
caaaaaccagcaggt

SEQ ID NO: 1801854 - DNA, 14 bp, Homo sapiens
caaaaagatttatt

SEQ ID NO: 1801855 - DNA, 13 bp, Homo sapiens
caaaaatttctgc

SEQ ID NO: 1801856 - DNA, 21 bp, Homo sapiens
caaaaatttctgcttttgcat

SEQ ID NO: 1801857 - DNA, 15 bp, Homo sapiens
caaaagaagtaaaag

SEQ ID NO: 1801858 - DNA, 21 bp, Homo sapiens
caaaagaagtaaaagctaatt

SEQ ID NO: 1801859 - DNA, 17 bp, Homo sapiens
caaaagccaagaaagta

SEQ ID NO: 1801860 - DNA, 16 bp, Homo sapiens
caaaaggcactgtgaa

SEQ ID NO: 1801861 - DNA, 20 bp, Homo sapiens
caaaaggtaatgcacatcct

SEQ ID NO: 1801862 - DNA, 22 bp, Homo sapiens
caaaagtggggctaaatgaagt

SEQ ID NO: 1801863 - DNA, 14 bp, Homo sapiens
caaaataaagctgt

SEQ ID NO: 1801864 - DNA, 12 bp, Homo sapiens
caaaccccagcc

SEQ ID NO: 1801865 - DNA, 15 bp, Homo sapiens
caaaccccagcccca

SEQ ID NO: 1801866 - DNA, 14 bp, Homo sapiens
caaactgctggggc

SEQ ID NO: 1801867 - DNA, 23 bp, Homo sapiens
caaagaaatccccccttcagaac

SEQ ID NO: 1801868 - DNA, 18 bp, Homo sapiens
caaagagccatgtgtcat

SEQ ID NO: 1801869 - DNA, 17 bp, Homo sapiens
caaagcaaaagaagtaa

SEQ ID NO: 1801870 - DNA, 13 bp, Homo sapiens
agggaagagggca

SEQ ID NO: 1801871 - DNA, 23 bp, Homo sapiens
agggaatgttccctgcaccctgg

SEQ ID NO: 1801872 - DNA, 16 bp, Homo sapiens
agggacagtattctca

SEQ ID NO: 1801873 - DNA, 22 bp, Homo sapiens
agggagacaggcagggagggct

SEQ ID NO: 1801874 - DNA, 21 bp, Homo sapiens
agggagggggcgctcaggacc

SEQ ID NO: 1801875 - DNA, 16 bp, Homo sapiens
agggatgatgccacac

SEQ ID NO: 1801876 - DNA, 12 bp, Homo sapiens
agggcagagcca

SEQ ID NO: 1801877 - DNA, 13 bp, Homo sapiens
agggcagagccat

SEQ ID NO: 1801878 - DNA, 15 bp, Homo sapiens
agggcagagccatgg

SEQ ID NO: 1801879 - DNA, 19 bp, Homo sapiens
agggcagagccatgggcct

SEQ ID NO: 1801880 - DNA, 20 bp, Homo sapiens
agggcagagccatgggcctg

SEQ ID NO: 1801881 - DNA, 13 bp, Homo sapiens
agggcagagggaa

SEQ ID NO: 1801882 - DNA, 18 bp, Homo sapiens
agggcagtacctgggaaa

SEQ ID NO: 1801883 - DNA, 14 bp, Homo sapiens
agggcatcaggcac

SEQ ID NO: 1801884 - DNA, 15 bp, Homo sapiens
agggcatcaggcact

SEQ ID NO: 1801885 - DNA, 16 bp, Homo sapiens
agggcatcaggcactg

SEQ ID NO: 1801886 - DNA, 12 bp, Homo sapiens
agggccagaagg

SEQ ID NO: 1801887 - DNA, 14 bp, Homo sapiens
agggccagaaggag

SEQ ID NO: 1801888 - DNA, 18 bp, Homo sapiens
agggccagaaggagggca

SEQ ID NO: 1801889 - DNA, 13 bp, Homo sapiens
agggcccagctgt

SEQ ID NO: 1801890 - DNA, 14 bp, Homo sapiens
agggcccagctgta

SEQ ID NO: 1801891 - DNA, 22 bp, Homo sapiens
agggcccagctgtagccatggc

SEQ ID NO: 1801892 - DNA, 23 bp, Homo sapiens
agggcccccaccgaggttcccag

SEQ ID NO: 1801893 - DNA, 16 bp, Homo sapiens
agggcccctccctctg

SEQ ID NO: 1801894 - DNA, 17 bp, Homo sapiens
agggcccctccctctgc

SEQ ID NO: 1801895 - DNA, 15 bp, Homo sapiens
agggcctgggggcag

SEQ ID NO: 1801896 - DNA, 21 bp, Homo sapiens
agggcctgggggcagtgactg

SEQ ID NO: 1801897 - DNA, 23 bp, Homo sapiens
agggcctgggggcagtgactggc

SEQ ID NO: 1801898 - DNA, 21 bp, Homo sapiens
agggctaattctgggaaggga

SEQ ID NO: 1801899 - DNA, 23 bp, Homo sapiens
agggctccagcatccagcctgtg

SEQ ID NO: 1801900 - DNA, 22 bp, Homo sapiens
agggctgcccctgtaggttgct

SEQ ID NO: 1801901 - DNA, 13 bp, Homo sapiens
agggcttggggct

SEQ ID NO: 1801902 - DNA, 15 bp, Homo sapiens
aggggcacaccactg

SEQ ID NO: 1801903 - DNA, 20 bp, Homo sapiens
aggggcacaccactgccctg

SEQ ID NO: 1801904 - DNA, 13 bp, Homo sapiens
aggggcaggcaca

SEQ ID NO: 1801905 - DNA, 14 bp, Homo sapiens
aggggcaggcacag

SEQ ID NO: 1801906 - DNA, 16 bp, Homo sapiens
aggggcaggcacagca

SEQ ID NO: 1801907 - DNA, 13 bp, Homo sapiens
aggggcaggcctg

SEQ ID NO: 1801908 - DNA, 23 bp, Homo sapiens
aggggcaggcctgggacccagct

SEQ ID NO: 1801909 - DNA, 21 bp, Homo sapiens
aggggccccagatctgcctgg

SEQ ID NO: 1801910 - DNA, 17 bp, Homo sapiens
aggggccccggggctgg

SEQ ID NO: 1801911 - DNA, 19 bp, Homo sapiens
aggggccccggggctggca

SEQ ID NO: 1801912 - DNA, 22 bp, Homo sapiens
aggggccccggggctggcaagc

SEQ ID NO: 1801913 - DNA, 19 bp, Homo sapiens
aggggcccgcttgcctcgg

SEQ ID NO: 1801914 - DNA, 20 bp, Homo sapiens
aggggcccgcttgcctcggc

SEQ ID NO: 1801915 - DNA, 12 bp, Homo sapiens
aggggctgcccg

SEQ ID NO: 1801916 - DNA, 16 bp, Homo sapiens
aggggctgcccgctcc

SEQ ID NO: 1801917 - DNA, 14 bp, Homo sapiens
aggggctgctgggg

SEQ ID NO: 1801918 - DNA, 18 bp, Homo sapiens
agggggcgctcaggaccc

SEQ ID NO: 1801919 - DNA, 19 bp, Homo sapiens
agggggcgctcaggaccca

SEQ ID NO: 1801920 - DNA, 19 bp, Homo sapiens
agggggtgtcatctgagga

SEQ ID NO: 1801921 - DNA, 22 bp, Homo sapiens
aggggtgcacccactcaccagg

SEQ ID NO: 1801922 - DNA, 16 bp, Homo sapiens
agggtccgcaccagct

SEQ ID NO: 1801923 - DNA, 23 bp, Homo sapiens
agggtcctggtcctaaagagtta

SEQ ID NO: 1801924 - DNA, 18 bp, Homo sapiens
agggtggaggaaggtgct

SEQ ID NO: 1801925 - DNA, 21 bp, Homo sapiens
agggttgaaggcagtctgaac

SEQ ID NO: 1801926 - DNA, 19 bp, Homo sapiens
aggtaaaatattttccaaa

SEQ ID NO: 1801927 - DNA, 16 bp, Homo sapiens
aggtacttcctcctga

SEQ ID NO: 1801928 - DNA, 19 bp, Homo sapiens
aggtacttcctcctgatgg

SEQ ID NO: 1801929 - DNA, 20 bp, Homo sapiens
aggtacttcctcctgatggc

SEQ ID NO: 1801930 - DNA, 21 bp, Homo sapiens
aggtagatcgcttgagcccag

SEQ ID NO: 1801931 - DNA, 22 bp, Homo sapiens
aggtagatcgcttgagcccagg

SEQ ID NO: 1801932 - DNA, 23 bp, Homo sapiens
aggtaggcccttgtcctgccagc

SEQ ID NO: 1801933 - DNA, 15 bp, Homo sapiens
aggtccaagggccat

SEQ ID NO: 1801934 - DNA, 15 bp, Homo sapiens
aggtctcctccaccg

SEQ ID NO: 1801935 - DNA, 23 bp, Homo sapiens
aggtctccttactctgagcccag

SEQ ID NO: 1801936 - DNA, 24 bp, Homo sapiens
aggtctccttactctgagcccagg

SEQ ID NO: 1801937 - DNA, 17 bp, Homo sapiens
aggtctcgctgatgctg

SEQ ID NO: 1801938 - DNA, 19 bp, Homo sapiens
aggtctcgctgatgctggg

SEQ ID NO: 1801939 - DNA, 22 bp, Homo sapiens
aggtctcgctgatgctgggctg

SEQ ID NO: 1801940 - DNA, 23 bp, Homo sapiens
aggtctcgctgatgctgggctgg

SEQ ID NO: 1801941 - DNA, 16 bp, Homo sapiens
aggtgagaccacctct

SEQ ID NO: 1801942 - DNA, 13 bp, Homo sapiens
aggtgctgagctt

SEQ ID NO: 1801943 - DNA, 20 bp, Homo sapiens
aggtgctgagcttagccttg

SEQ ID NO: 1801944 - DNA, 21 bp, Homo sapiens
aggtgctgctaccctccctgc

SEQ ID NO: 1801945 - DNA, 18 bp, Homo sapiens
aggtggagagcactagaa

SEQ ID NO: 1801946 - DNA, 14 bp, Homo sapiens
aggtgggcagctgg

SEQ ID NO: 1801947 - DNA, 16 bp, Homo sapiens
aggtgggcagctgggc

SEQ ID NO: 1801948 - DNA, 19 bp, Homo sapiens
aggtgggcagctgggcccc

SEQ ID NO: 1801949 - DNA, 14 bp, Homo sapiens
aggtgggtccagga

SEQ ID NO: 1801950 - DNA, 18 bp, Homo sapiens
aggtgggtccaggaaggc

SEQ ID NO: 1801951 - DNA, 21 bp, Homo sapiens
aggtggtctgctcgggcccag

SEQ ID NO: 1801952 - DNA, 22 bp, Homo sapiens
aggtggtctgctcgggcccagg

SEQ ID NO: 1801953 - DNA, 16 bp, Homo sapiens
aggtgtggtggctcat

SEQ ID NO: 1801954 - DNA, 18 bp, Homo sapiens
aggttaaggtgggtccag

SEQ ID NO: 1801955 - DNA, 18 bp, Homo sapiens
aggttactcagcagcaga

SEQ ID NO: 1801956 - DNA, 17 bp, Homo sapiens
aggttatctgcctggcc

SEQ ID NO: 1801957 - DNA, 22 bp, Homo sapiens
aggttatctgcctggcctggct

SEQ ID NO: 1801958 - DNA, 23 bp, Homo sapiens
aggttgggagaatgtcagtatgt

SEQ ID NO: 1801959 - DNA, 21 bp, Homo sapiens
aggttgggccatactggcctc

SEQ ID NO: 1801960 - DNA, 22 bp, Homo sapiens
aggtttagaatcaagtctgtga

SEQ ID NO: 1801961 - DNA, 16 bp, Homo sapiens
aggtttcactgttcat

SEQ ID NO: 1801962 - DNA, 13 bp, Homo sapiens
agtaaaagctaat

SEQ ID NO: 1801963 - DNA, 20 bp, Homo sapiens
agtaaaagctaattaggatt

SEQ ID NO: 1801964 - DNA, 21 bp, Homo sapiens
agtaaacatttgtaaaaatac

SEQ ID NO: 1801965 - DNA, 15 bp, Homo sapiens
agtaacatgcaacaa

SEQ ID NO: 1801966 - DNA, 21 bp, Homo sapiens
agtaacatgcaacaaaaatgt

SEQ ID NO: 1801967 - DNA, 20 bp, Homo sapiens
agtaataatgtaatactgta

SEQ ID NO: 1801968 - DNA, 23 bp, Homo sapiens
agtaatgaaggcatatttccaat

SEQ ID NO: 1801969 - DNA, 15 bp, Homo sapiens
agtacacttcctgtg

SEQ ID NO: 1801970 - DNA, 14 bp, Homo sapiens
agtaccttcaaata

SEQ ID NO: 1801971 - DNA, 13 bp, Homo sapiens
agtactctctgct

SEQ ID NO: 1801972 - DNA, 15 bp, Homo sapiens
agtactctctgctct

SEQ ID NO: 1801973 - DNA, 16 bp, Homo sapiens
agtactctctgctcta

SEQ ID NO: 1801974 - DNA, 22 bp, Homo sapiens
agtactctctgctctagccagg

SEQ ID NO: 1801975 - DNA, 17 bp, Homo sapiens
agtaggtccaagggcca

SEQ ID NO: 1801976 - DNA, 21 bp, Homo sapiens
agtagtgtcttcctagtatat

SEQ ID NO: 1801977 - DNA, 22 bp, Homo sapiens
agtataagggtcacaagtctaa

SEQ ID NO: 1801978 - DNA, 16 bp, Homo sapiens
agtataggataaatta

SEQ ID NO: 1801979 - DNA, 16 bp, Homo sapiens
agtatcttcaaaaata

SEQ ID NO: 1801980 - DNA, 19 bp, Homo sapiens
agtatcttcaaaaatacag

SEQ ID NO: 1801981 - DNA, 14 bp, Homo sapiens
agtatgtaatcttt

SEQ ID NO: 1801982 - DNA, 19 bp, Homo sapiens
agtatgtggaagtgtgggt

SEQ ID NO: 1801983 - DNA, 14 bp, Homo sapiens
agtattcaggcact

SEQ ID NO: 1801984 - DNA, 13 bp, Homo sapiens
agtcaagaaaaat

SEQ ID NO: 1801985 - DNA, 14 bp, Homo sapiens
agtcaagaaaaata

SEQ ID NO: 1801986 - DNA, 15 bp, Homo sapiens
agtcacaaaataaag

SEQ ID NO: 1801987 - DNA, 16 bp, Homo sapiens
agtcacagctgcagct

SEQ ID NO: 1801988 - DNA, 17 bp, Homo sapiens
agtcacagctgcagctg

SEQ ID NO: 1801989 - DNA, 22 bp, Homo sapiens
agtcacagctgcagctgggccc

SEQ ID NO: 1801990 - DNA, 23 bp, Homo sapiens
agtcacagctgcagctgggcccc

SEQ ID NO: 1801991 - DNA, 13 bp, Homo sapiens
agtcacctgcaag

SEQ ID NO: 1801992 - DNA, 14 bp, Homo sapiens
agtcacctgcaagc

SEQ ID NO: 1801993 - DNA, 17 bp, Homo sapiens
agtcacctgcaagcccc

SEQ ID NO: 1801994 - DNA, 19 bp, Homo sapiens
agtcagtaggtccaagggc

SEQ ID NO: 1801995 - DNA, 22 bp, Homo sapiens
agtcagtaggtccaagggccat

SEQ ID NO: 1801996 - DNA, 15 bp, Homo sapiens
agtcagttcccggag

SEQ ID NO: 1801997 - DNA, 19 bp, Homo sapiens
agtcagttcccggagcaca

SEQ ID NO: 1801998 - DNA, 23 bp, Homo sapiens
agtcagttcccggagcacagccc

SEQ ID NO: 1801999 - DNA, 17 bp, Homo sapiens
agtccacttttaaaact

SEQ ID NO: 1802000 - DNA, 14 bp, Homo sapiens
agtccccagccctt

SEQ ID NO: 1802001 - DNA, 18 bp, Homo sapiens
agtcctcacagcctctcc

SEQ ID NO: 1802002 - DNA, 20 bp, Homo sapiens
agtcctcacagcctctccct

SEQ ID NO: 1802003 - DNA, 13 bp, Homo sapiens
agtcctctccacc

SEQ ID NO: 1802004 - DNA, 13 bp, Homo sapiens
agtcgcgctgcct

SEQ ID NO: 1802005 - DNA, 18 bp, Homo sapiens
agtcgcgctgcctgtgtg

SEQ ID NO: 1802006 - DNA, 13 bp, Homo sapiens
agtcgtcaagttg

SEQ ID NO: 1802007 - DNA, 22 bp, Homo sapiens
agtctaaacaatgaattcttca

SEQ ID NO: 1802008 - DNA, 15 bp, Homo sapiens
agtctatcaacattg

SEQ ID NO: 1802009 - DNA, 16 bp, Homo sapiens
agtctcaaatttttca

SEQ ID NO: 1802010 - DNA, 14 bp, Homo sapiens
agtctcctgtatca

SEQ ID NO: 1802011 - DNA, 18 bp, Homo sapiens
agtctctatgatcttggc

SEQ ID NO: 1802012 - DNA, 12 bp, Homo sapiens
agtctgagcccc

SEQ ID NO: 1802013 - DNA, 22 bp, Homo sapiens
agtctgaggccccaggccctag

SEQ ID NO: 1802014 - DNA, 21 bp, Homo sapiens
agtctgggtctgggtttggat

SEQ ID NO: 1802015 - DNA, 16 bp, Homo sapiens
agtcttatttttctag

SEQ ID NO: 1802016 - DNA, 17 bp, Homo sapiens
agtcttatttttctagt

SEQ ID NO: 1802017 - DNA, 14 bp, Homo sapiens
agtgaaaaatgaga

SEQ ID NO: 1802018 - DNA, 18 bp, Homo sapiens
agtgaaagggctatggca

SEQ ID NO: 1802019 - DNA, 23 bp, Homo sapiens
agtgaacttacacttggagcccg

SEQ ID NO: 1802020 - DNA, 15 bp, Homo sapiens
agtgaagtccttcag

SEQ ID NO: 1802021 - DNA, 17 bp, Homo sapiens
agtgacctcacttctgg

SEQ ID NO: 1802022 - DNA, 15 bp, Homo sapiens
agtgactcgggctcc

SEQ ID NO: 1802023 - DNA, 17 bp, Homo sapiens
agtgactcgggctcctg

SEQ ID NO: 1802024 - DNA, 13 bp, Homo sapiens
agtgactggcagg

SEQ ID NO: 1802025 - DNA, 23 bp, Homo sapiens
agtgacttctgaatccttagaat

SEQ ID NO: 1802026 - DNA, 13 bp, Homo sapiens
agtgagcccctcc

SEQ ID NO: 1802027 - DNA, 22 bp, Homo sapiens
agagcaacccctgtacccagct

SEQ ID NO: 1802028 - DNA, 13 bp, Homo sapiens
agagcacagccct

SEQ ID NO: 1802029 - DNA, 16 bp, Homo sapiens
agagcagcctgatggc

SEQ ID NO: 1802030 - DNA, 21 bp, Homo sapiens
agagcagcctgatggccaagg

SEQ ID NO: 1802031 - DNA, 21 bp, Homo sapiens
agagcatcgtgacccttcagg

SEQ ID NO: 1802032 - DNA, 13 bp, Homo sapiens
agagccagcctgg

SEQ ID NO: 1802033 - DNA, 14 bp, Homo sapiens
agagccagcctggg

SEQ ID NO: 1802034 - DNA, 16 bp, Homo sapiens
agagccagcctgggac

SEQ ID NO: 1802035 - DNA, 18 bp, Homo sapiens
agagccagcctgggactc

SEQ ID NO: 1802036 - DNA, 17 bp, Homo sapiens
agagccatgggcctggg

SEQ ID NO: 1802037 - DNA, 17 bp, Homo sapiens
actgtgacacagctgag

SEQ ID NO: 1802038 - DNA, 14 bp, Homo sapiens
actgtggccagagc

SEQ ID NO: 1802039 - DNA, 14 bp, Homo sapiens
aatgttccctgcac

SEQ ID NO: 1802040 - DNA, 18 bp, Homo sapiens
aatgttccctgcaccctg

SEQ ID NO: 1802041 - DNA, 17 bp, Homo sapiens
aatgttgcacatcattc

SEQ ID NO: 1802042 - DNA, 18 bp, Homo sapiens
aatgttgcacatcattca

SEQ ID NO: 1802043 - DNA, 21 bp, Homo sapiens
aatgttgcacatcattcattc

SEQ ID NO: 1802044 - DNA, 23 bp, Homo sapiens
aattaaaccagactctgttgcaa

SEQ ID NO: 1802045 - DNA, 19 bp, Homo sapiens
aattaatctagaaaatgaa

SEQ ID NO: 1802046 - DNA, 17 bp, Homo sapiens
aattacattttatatgt

SEQ ID NO: 1802047 - DNA, 17 bp, Homo sapiens
aattcaacctgtgtctt

SEQ ID NO: 1802048 - DNA, 22 bp, Homo sapiens
aattcaatgcaatgaaaacaaa

SEQ ID NO: 1802049 - DNA, 17 bp, Homo sapiens
aattcagcaccctgggt

SEQ ID NO: 1802050 - DNA, 15 bp, Homo sapiens
aattcgcagtgatat

SEQ ID NO: 1802051 - DNA, 21 bp, Homo sapiens
aattctgagggaatttaacca

SEQ ID NO: 1802052 - DNA, 21 bp, Homo sapiens
aattcttcaacagggaaaaca

SEQ ID NO: 1802053 - DNA, 13 bp, Homo sapiens
aattcttcattat

SEQ ID NO: 1802054 - DNA, 18 bp, Homo sapiens
aattcttcattatagtaa

SEQ ID NO: 1802055 - DNA, 19 bp, Homo sapiens
aattcttcattatagtaaa

SEQ ID NO: 1802056 - DNA, 19 bp, Homo sapiens
aattcttttcaaaattgtt

SEQ ID NO: 1802057 - DNA, 11 bp, Homo sapiens
aattgcaacaa

SEQ ID NO: 1802058 - DNA, 14 bp, Homo sapiens
aattgcaacaatgc

SEQ ID NO: 1802059 - DNA, 16 bp, Homo sapiens
aattgcaacaatgcaa

SEQ ID NO: 1802060 - DNA, 17 bp, Homo sapiens
aattgcaacaatgcaaa

SEQ ID NO: 1802061 - DNA, 15 bp, Homo sapiens
aattgctaattctga

SEQ ID NO: 1802062 - DNA, 16 bp, Homo sapiens
aattgctaattctgag

SEQ ID NO: 1802063 - DNA, 15 bp, Homo sapiens
aattgtgatgtgtcc

SEQ ID NO: 1802064 - DNA, 17 bp, Homo sapiens
aattgtggtagaaattt

SEQ ID NO: 1802065 - DNA, 21 bp, Homo sapiens
aatttattttgtcgaattttt

SEQ ID NO: 1802066 - DNA, 15 bp, Homo sapiens
aatttctcctcattt

SEQ ID NO: 1802067 - DNA, 18 bp, Homo sapiens
aatttctcctcatttaat

SEQ ID NO: 1802068 - DNA, 22 bp, Homo sapiens
aatttctcctcatttaatattt

SEQ ID NO: 1802069 - DNA, 21 bp, Homo sapiens
aatttctgcttttgcatcttt

SEQ ID NO: 1802070 - DNA, 12 bp, Homo sapiens
aatttctgtata

SEQ ID NO: 1802071 - DNA, 18 bp, Homo sapiens
aattttactgacagaaat

SEQ ID NO: 1802072 - DNA, 19 bp, Homo sapiens
aattttactgacagaaatg

SEQ ID NO: 1802073 - DNA, 17 bp, Homo sapiens
aattttcaaataaggaa

SEQ ID NO: 1802074 - DNA, 18 bp, Homo sapiens
aattttctttcatacatt

SEQ ID NO: 1802075 - DNA, 19 bp, Homo sapiens
aattttctttcatacatta

SEQ ID NO: 1802076 - DNA, 13 bp, Homo sapiens
aattttgtatgtc

SEQ ID NO: 1802077 - DNA, 22 bp, Homo sapiens
aattttgtatgtcaataacttt

SEQ ID NO: 1802078 - DNA, 16 bp, Homo sapiens
aatttttattatttgt

SEQ ID NO: 1802079 - DNA, 21 bp, Homo sapiens
aatttttcatctcttcaatca

SEQ ID NO: 1802080 - DNA, 13 bp, Homo sapiens
acaacagatttct

SEQ ID NO: 1802081 - DNA, 18 bp, Homo sapiens
acaacattttaatacaga

SEQ ID NO: 1802082 - DNA, 20 bp, Homo sapiens
acaacatttttgtacattat

SEQ ID NO: 1802083 - DNA, 20 bp, Homo sapiens
acaactgtgaatatgagaaa

SEQ ID NO: 1802084 - DNA, 18 bp, Homo sapiens
acaagaggttaaggtggg

SEQ ID NO: 1802085 - DNA, 14 bp, Homo sapiens
acaagccctggcaa

SEQ ID NO: 1802086 - DNA, 19 bp, Homo sapiens
acaagtcacagctgcagct

SEQ ID NO: 1802087 - DNA, 15 bp, Homo sapiens
acaagtctaaacaat

SEQ ID NO: 1802088 - DNA, 18 bp, Homo sapiens
acaagtctaaacaatgaa

SEQ ID NO: 1802089 - DNA, 11 bp, Homo sapiens
acaagttgcct

SEQ ID NO: 1802090 - DNA, 17 bp, Homo sapiens
acaatgaattcttcaac

SEQ ID NO: 1802091 - DNA, 21 bp, Homo sapiens
acacagctgagctggcctatt

SEQ ID NO: 1802092 - DNA, 20 bp, Homo sapiens
acacatcccggcctcttcca

SEQ ID NO: 1802093 - DNA, 14 bp, Homo sapiens
acacattgtgcttg

SEQ ID NO: 1802094 - DNA, 17 bp, Homo sapiens
acaccaagctgtgccac

SEQ ID NO: 1802095 - DNA, 19 bp, Homo sapiens
acaccactgccctgcctgc

SEQ ID NO: 1802096 - DNA, 14 bp, Homo sapiens
acacccaggaaggg

SEQ ID NO: 1802097 - DNA, 18 bp, Homo sapiens
acacccccacctcctgca

SEQ ID NO: 1802098 - DNA, 16 bp, Homo sapiens
acacctaccatgctgc

SEQ ID NO: 1802099 - DNA, 20 bp, Homo sapiens
acacctcccaccccctgtat

SEQ ID NO: 1802100 - DNA, 23 bp, Homo sapiens
acacctgccctgccctgccacct

SEQ ID NO: 1802101 - DNA, 16 bp, Homo sapiens
acacgcaagggcatca

SEQ ID NO: 1802102 - DNA, 13 bp, Homo sapiens
acactgctgcacc

SEQ ID NO: 1802103 - DNA, 20 bp, Homo sapiens
acactttgccaaggctctcc

SEQ ID NO: 1802104 - DNA, 16 bp, Homo sapiens
acagaaaagaaagctg

SEQ ID NO: 1802105 - DNA, 14 bp, Homo sapiens
acagaatttataga

SEQ ID NO: 1802106 - DNA, 21 bp, Homo sapiens
acagacttctggaaggctggc

SEQ ID NO: 1802107 - DNA, 22 bp, Homo sapiens
acagacttctggaaggctggct

SEQ ID NO: 1802108 - DNA, 18 bp, Homo sapiens
acagatattgttataaat

SEQ ID NO: 1802109 - DNA, 17 bp, Homo sapiens
acagatttctaagttaa

SEQ ID NO: 1802110 - DNA, 19 bp, Homo sapiens
acagcaaggaggctggctg

SEQ ID NO: 1802111 - DNA, 21 bp, Homo sapiens
acagcaaggaggctggctggg

SEQ ID NO: 1802112 - DNA, 18 bp, Homo sapiens
acagcactttctgtagta

SEQ ID NO: 1802113 - DNA, 21 bp, Homo sapiens
acagccctcccgccccttccc

SEQ ID NO: 1802114 - DNA, 22 bp, Homo sapiens
acagccctcccgccccttcccc

SEQ ID NO: 1802115 - DNA, 13 bp, Homo sapiens
acagcctctccct

SEQ ID NO: 1802116 - DNA, 15 bp, Homo sapiens
acagctagcttgaaa

SEQ ID NO: 1802117 - DNA, 16 bp, Homo sapiens
acagctagcttgaaaa

SEQ ID NO: 1802118 - DNA, 13 bp, Homo sapiens
acagctgcagctg

SEQ ID NO: 1802119 - DNA, 18 bp, Homo sapiens
acagcttttcccaggaga

SEQ ID NO: 1802120 - DNA, 20 bp, Homo sapiens
acagcttttcccaggagacc

SEQ ID NO: 1802121 - DNA, 18 bp, Homo sapiens
acagggaaatactgtatt

SEQ ID NO: 1802122 - DNA, 15 bp, Homo sapiens
acagggacaaagaaa

SEQ ID NO: 1802123 - DNA, 20 bp, Homo sapiens
acagggacacagtctggtgc

SEQ ID NO: 1802124 - DNA, 16 bp, Homo sapiens
acaggggcaggcctgg

SEQ ID NO: 1802125 - DNA, 20 bp, Homo sapiens
acaggggcaggcctgggacc

SEQ ID NO: 1802126 - DNA, 23 bp, Homo sapiens
acaggggccccagatctgcctgg

SEQ ID NO: 1802127 - DNA, 14 bp, Homo sapiens
acagtatcttcaaa

SEQ ID NO: 1802128 - DNA, 16 bp, Homo sapiens
acagtatcttcaaaaa

SEQ ID NO: 1802129 - DNA, 18 bp, Homo sapiens
acagtattctcagtgctc

SEQ ID NO: 1802130 - DNA, 19 bp, Homo sapiens
acagtcctcacagcctctc

SEQ ID NO: 1802131 - DNA, 20 bp, Homo sapiens
acagtcctcacagcctctcc

SEQ ID NO: 1802132 - DNA, 18 bp, Homo sapiens
acagtgactcgggctcct

SEQ ID NO: 1802133 - DNA, 19 bp, Homo sapiens
acagtgactcgggctcctg

SEQ ID NO: 1802134 - DNA, 23 bp, Homo sapiens
acagtgactcgggctcctgtgcc

SEQ ID NO: 1802135 - DNA, 14 bp, Homo sapiens
acagtgaggagggt

SEQ ID NO: 1802136 - DNA, 21 bp, Homo sapiens
acagtgggtggcacctcctga

SEQ ID NO: 1802137 - DNA, 15 bp, Homo sapiens
acagtgtctgggctg

SEQ ID NO: 1802138 - DNA, 19 bp, Homo sapiens
acagtgtctgggctgactg

SEQ ID NO: 1802139 - DNA, 22 bp, Homo sapiens
acagtgttaggcctggcacagt

SEQ ID NO: 1802140 - DNA, 19 bp, Homo sapiens
acagttgtctattctgagc

SEQ ID NO: 1802141 - DNA, 19 bp, Homo sapiens
acataagaccgtgtcccaa

SEQ ID NO: 1802142 - DNA, 12 bp, Homo sapiens
acatataaaagt

SEQ ID NO: 1802143 - DNA, 22 bp, Homo sapiens
acatataaaagttaaactactt

SEQ ID NO: 1802144 - DNA, 13 bp, Homo sapiens
acatatatgtata

SEQ ID NO: 1802145 - DNA, 15 bp, Homo sapiens
acatcagccttctcc

SEQ ID NO: 1802146 - DNA, 13 bp, Homo sapiens
acatcattcattc

SEQ ID NO: 1802147 - DNA, 14 bp, Homo sapiens
acatcattcattca

SEQ ID NO: 1802148 - DNA, 21 bp, Homo sapiens
acatcattcattcactgtata

SEQ ID NO: 1802149 - DNA, 17 bp, Homo sapiens
acatctggcatggctcc

SEQ ID NO: 1802150 - DNA, 22 bp, Homo sapiens
acatgattttcttttgttttct

SEQ ID NO: 1802151 - DNA, 17 bp, Homo sapiens
acatggattccactgaa

SEQ ID NO: 1802152 - DNA, 21 bp, Homo sapiens
acatgtagaattcgcagtgat

SEQ ID NO: 1802153 - DNA, 23 bp, Homo sapiens
acattatatttgagtttctttca

SEQ ID NO: 1802154 - DNA, 17 bp, Homo sapiens
acattatgttattggaa

SEQ ID NO: 1802155 - DNA, 20 bp, Homo sapiens
acattatgttattggaattt

SEQ ID NO: 1802156 - DNA, 15 bp, Homo sapiens
acattccgaagaggg

SEQ ID NO: 1802157 - DNA, 12 bp, Homo sapiens
acattcctccag

SEQ ID NO: 1802158 - DNA, 19 bp, Homo sapiens
acattgacccagaaatgta

SEQ ID NO: 1802159 - DNA, 22 bp, Homo sapiens
acattggtatatttccattcat

SEQ ID NO: 1802160 - DNA, 16 bp, Homo sapiens
acatttgtaaaaatac

SEQ ID NO: 1802161 - DNA, 20 bp, Homo sapiens
acatttgtaaaaatactgtt

SEQ ID NO: 1802162 - DNA, 21 bp, Homo sapiens
acatttgtaaaaatactgttt

SEQ ID NO: 1802163 - DNA, 17 bp, Homo sapiens
acattttaaaaaacaaa

SEQ ID NO: 1802164 - DNA, 13 bp, Homo sapiens
acattttcctgtg

SEQ ID NO: 1802165 - DNA, 17 bp, Homo sapiens
acatttttgtacattat

SEQ ID NO: 1802166 - DNA, 18 bp, Homo sapiens
acatttttgtacattatg

SEQ ID NO: 1802167 - DNA, 21 bp, Homo sapiens
acatttttgtacattatgtta

SEQ ID NO: 1802168 - DNA, 14 bp, Homo sapiens
accaaattgcttct

SEQ ID NO: 1802169 - DNA, 15 bp, Homo sapiens
accaaattgcttcta

SEQ ID NO: 1802170 - DNA, 14 bp, Homo sapiens
accaacccagccgc

SEQ ID NO: 1802171 - DNA, 22 bp, Homo sapiens
accaactctatactcaatcaag

SEQ ID NO: 1802172 - DNA, 13 bp, Homo sapiens
accaaggcagcct

SEQ ID NO: 1802173 - DNA, 20 bp, Homo sapiens
accaaggcagcctccagagc

SEQ ID NO: 1802174 - DNA, 10 bp, Homo sapiens
accacagcaa

SEQ ID NO: 1802175 - DNA, 21 bp, Homo sapiens
accacagcaaggcacctgcag

SEQ ID NO: 1802176 - DNA, 18 bp, Homo sapiens
accacgccttgaccttcc

SEQ ID NO: 1802177 - DNA, 13 bp, Homo sapiens
accacgtctgcca

SEQ ID NO: 1802178 - DNA, 18 bp, Homo sapiens
accacgtctgccaggccc

SEQ ID NO: 1802179 - DNA, 23 bp, Homo sapiens
accacgtctgccaggcccatctc

SEQ ID NO: 1802180 - DNA, 13 bp, Homo sapiens
accactgccctgc

SEQ ID NO: 1802181 - DNA, 14 bp, Homo sapiens
accactgccctgcc

SEQ ID NO: 1802182 - DNA, 20 bp, Homo sapiens
accactgccctgcctgccca

SEQ ID NO: 1802183 - DNA, 20 bp, Homo sapiens
accactttgatattgagaca

SEQ ID NO: 1802184 - DNA, 18 bp, Homo sapiens
accagaacgcaccccact

SEQ ID NO: 1802185 - DNA, 18 bp, Homo sapiens
accagcaggtgtggtggc

SEQ ID NO: 1802186 - DNA, 21 bp, Homo sapiens
accagcaggtgtggtggctca

SEQ ID NO: 1802187 - DNA, 22 bp, Homo sapiens
accagcaggtgtggtggctcat

SEQ ID NO: 1802188 - DNA, 17 bp, Homo sapiens
accagccccctggatgg

SEQ ID NO: 1802189 - DNA, 12 bp, Homo sapiens
accagctctgtg

SEQ ID NO: 1802190 - DNA, 13 bp, Homo sapiens
accagctctgtgg

SEQ ID NO: 1802191 - DNA, 15 bp, Homo sapiens
accagctctgtggcc

SEQ ID NO: 1802192 - DNA, 17 bp, Homo sapiens
accagctctgtggcctg

SEQ ID NO: 1802193 - DNA, 13 bp, Homo sapiens
accagctgctctg

SEQ ID NO: 1802194 - DNA, 16 bp, Homo sapiens
accagctgctctgccc

SEQ ID NO: 1802195 - DNA, 17 bp, Homo sapiens
accagctgctctgcccc

SEQ ID NO: 1802196 - DNA, 11 bp, Homo sapiens
accaggagaca

SEQ ID NO: 1802197 - DNA, 16 bp, Homo sapiens
accaggggcaggcaca

SEQ ID NO: 1802198 - DNA, 19 bp, Homo sapiens
accagggtccgcaccagct

SEQ ID NO: 1802199 - DNA, 21 bp, Homo sapiens
accagggtccgcaccagctgc

SEQ ID NO: 1802200 - DNA, 22 bp, Homo sapiens
accagggtccgcaccagctgct

SEQ ID NO: 1802201 - DNA, 23 bp, Homo sapiens
accagggtccgcaccagctgctc

SEQ ID NO: 1802202 - DNA, 14 bp, Homo sapiens
accatctctttacc

SEQ ID NO: 1802203 - DNA, 12 bp, Homo sapiens
accatgctgctt

SEQ ID NO: 1802204 - DNA, 17 bp, Homo sapiens
accattcatctctaaca

SEQ ID NO: 1802205 - DNA, 17 bp, Homo sapiens
acccaccaaactgcaca

SEQ ID NO: 1802206 - DNA, 20 bp, Homo sapiens
acccacccatcttcctgctg

SEQ ID NO: 1802207 - DNA, 14 bp, Homo sapiens
acccactcaccagg

SEQ ID NO: 1802208 - DNA, 13 bp, Homo sapiens
acccagccgctgc

SEQ ID NO: 1802209 - DNA, 14 bp, Homo sapiens
acccagccgctgcc

SEQ ID NO: 1802210 - DNA, 16 bp, Homo sapiens
acccagccgctgcccg

SEQ ID NO: 1802211 - DNA, 14 bp, Homo sapiens
acccagctactctg

SEQ ID NO: 1802212 - DNA, 18 bp, Homo sapiens
acccagctactctgtcca

SEQ ID NO: 1802213 - DNA, 20 bp, Homo sapiens
acccagctactctgtccagg

SEQ ID NO: 1802214 - DNA, 22 bp, Homo sapiens
acccagctccttttgtccccag

SEQ ID NO: 1802215 - DNA, 13 bp, Homo sapiens
acccaggaaggga

SEQ ID NO: 1802216 - DNA, 23 bp, Homo sapiens
acccaggaagggaaagcgggcag

SEQ ID NO: 1802217 - DNA, 14 bp, Homo sapiens
acccaggccctcca

SEQ ID NO: 1802218 - DNA, 21 bp, Homo sapiens
acccaggccctccatgggcta

SEQ ID NO: 1802219 - DNA, 12 bp, Homo sapiens
acccaggctgca

SEQ ID NO: 1802220 - DNA, 15 bp, Homo sapiens
acccaggctgcactg

SEQ ID NO: 1802221 - DNA, 13 bp, Homo sapiens
acccagtgctgcc

SEQ ID NO: 1802222 - DNA, 15 bp, Homo sapiens
acccagtgctgccat

SEQ ID NO: 1802223 - DNA, 21 bp, Homo sapiens
acccagtgtaaagaataaatg

SEQ ID NO: 1802224 - DNA, 23 bp, Homo sapiens
acccagtgtaaagaataaatgaa

SEQ ID NO: 1802225 - DNA, 23 bp, Homo sapiens
acccattcccccatgtggctgaa

SEQ ID NO: 1802226 - DNA, 18 bp, Homo sapiens
accccaaaccccagcccc

SEQ ID NO: 1802227 - DNA, 15 bp, Homo sapiens
accccaagtccacct

SEQ ID NO: 1802228 - DNA, 22 bp, Homo sapiens
accccaagtccacctgcctatc

SEQ ID NO: 1802229 - DNA, 19 bp, Homo sapiens
accccacctcatgcctggc

SEQ ID NO: 1802230 - DNA, 14 bp, Homo sapiens
accccactgggaga

SEQ ID NO: 1802231 - DNA, 16 bp, Homo sapiens
accccatctgcccagg

SEQ ID NO: 1802232 - DNA, 13 bp, Homo sapiens
accccatgggctt

SEQ ID NO: 1802233 - DNA, 13 bp, Homo sapiens
acccccagcaccc

SEQ ID NO: 1802234 - DNA, 18 bp, Homo sapiens
acccccagcacccgggct

SEQ ID NO: 1802235 - DNA, 14 bp, Homo sapiens
acccccatgctgcc

SEQ ID NO: 1802236 - DNA, 17 bp, Homo sapiens
acccccatgctgccttc

SEQ ID NO: 1802237 - DNA, 19 bp, Homo sapiens
acccccatgctgccttcag

SEQ ID NO: 1802238 - DNA, 20 bp, Homo sapiens
accccccctcctgctgccta

SEQ ID NO: 1802239 - DNA, 13 bp, Homo sapiens
acccccgcccagg

SEQ ID NO: 1802240 - DNA, 14 bp, Homo sapiens
accccctcctgctg

SEQ ID NO: 1802241 - DNA, 16 bp, Homo sapiens
accccctcctgctgca

SEQ ID NO: 1802242 - DNA, 13 bp, Homo sapiens
accccgcagcccg

SEQ ID NO: 1802243 - DNA, 15 bp, Homo sapiens
accccggcctccact

SEQ ID NO: 1802244 - DNA, 12 bp, Homo sapiens
acccctgcactt

SEQ ID NO: 1802245 - DNA, 16 bp, Homo sapiens
accccttttcagcttc

SEQ ID NO: 1802246 - DNA, 19 bp, Homo sapiens
accccttttcagcttctgc

SEQ ID NO: 1802247 - DNA, 15 bp, Homo sapiens
accctatctgtgatt

SEQ ID NO: 1802248 - DNA, 22 bp, Homo sapiens
accctatctgtgattcccccaa

SEQ ID NO: 1802249 - DNA, 14 bp, Homo sapiens
accctccctgctgt

SEQ ID NO: 1802250 - DNA, 21 bp, Homo sapiens
accctccctgctgtcccctct

SEQ ID NO: 1802251 - DNA, 20 bp, Homo sapiens
accctcgtggacacctgccc

SEQ ID NO: 1802252 - DNA, 16 bp, Homo sapiens
accctggaaaggggag

SEQ ID NO: 1802253 - DNA, 19 bp, Homo sapiens
accctggaattcagcaccc

SEQ ID NO: 1802254 - DNA, 21 bp, Homo sapiens
accctggaattcagcaccctg

SEQ ID NO: 1802255 - DNA, 17 bp, Homo sapiens
accctgggctctgtggg

SEQ ID NO: 1802256 - DNA, 20 bp, Homo sapiens
accctgggctctgtgggctg

SEQ ID NO: 1802257 - DNA, 14 bp, Homo sapiens
accctgggtgccat

SEQ ID NO: 1802258 - DNA, 13 bp, Homo sapiens
acccttccacctc

SEQ ID NO: 1802259 - DNA, 22 bp, Homo sapiens
accgcatgccccctcgtgccag

SEQ ID NO: 1802260 - DNA, 15 bp, Homo sapiens
accgcttcacccctg

SEQ ID NO: 1802261 - DNA, 16 bp, Homo sapiens
accgcttcacccctgc

SEQ ID NO: 1802262 - DNA, 20 bp, Homo sapiens
accgggtgggcctggcctga

SEQ ID NO: 1802263 - DNA, 21 bp, Homo sapiens
accgtgtcccaaggagctgat

SEQ ID NO: 1802264 - DNA, 15 bp, Homo sapiens
acctaccatgctgct

SEQ ID NO: 1802265 - DNA, 16 bp, Homo sapiens
acctagtggctgtcca

SEQ ID NO: 1802266 - DNA, 17 bp, Homo sapiens
acctagtggctgtccag

SEQ ID NO: 1802267 - DNA, 23 bp, Homo sapiens
acctagtggctgtccagtgccca

SEQ ID NO: 1802268 - DNA, 21 bp, Homo sapiens
acctatgagatggccatgctc

SEQ ID NO: 1802269 - DNA, 22 bp, Homo sapiens
acctatgagatggccatgctca

SEQ ID NO: 1802270 - DNA, 19 bp, Homo sapiens
acctatgtgaaactctatt

SEQ ID NO: 1802271 - DNA, 11 bp, Homo sapiens
acctcagaaaa

SEQ ID NO: 1802272 - DNA, 15 bp, Homo sapiens
acctcagaaaactta

SEQ ID NO: 1802273 - DNA, 18 bp, Homo sapiens
acctcatgcctggccccc

SEQ ID NO: 1802274 - DNA, 16 bp, Homo sapiens
acctcctaccctccca

SEQ ID NO: 1802275 - DNA, 18 bp, Homo sapiens
acctcctaccctcccacc

SEQ ID NO: 1802276 - DNA, 14 bp, Homo sapiens
aaggagggcagagc

SEQ ID NO: 1802277 - DNA, 15 bp, Homo sapiens
aaggagggcagagcc

SEQ ID NO: 1802278 - DNA, 19 bp, Homo sapiens
aaggagggcagagccatgg

SEQ ID NO: 1802279 - DNA, 18 bp, Homo sapiens
aaggaggtgggccacacc

SEQ ID NO: 1802280 - DNA, 20 bp, Homo sapiens
aaggaggtgggccacaccca

SEQ ID NO: 1802281 - DNA, 16 bp, Homo sapiens
aaggcagcctccagag

SEQ ID NO: 1802282 - DNA, 21 bp, Homo sapiens
aaggcagcctccagagccagc

SEQ ID NO: 1802283 - DNA, 14 bp, Homo sapiens
aaggcatatttcca

SEQ ID NO: 1802284 - DNA, 16 bp, Homo sapiens
aaggcatatttccaat

SEQ ID NO: 1802285 - DNA, 22 bp, Homo sapiens
aaggccatattttaaaaaatca

SEQ ID NO: 1802286 - DNA, 19 bp, Homo sapiens
aaggcctcccacagtgact

SEQ ID NO: 1802287 - DNA, 15 bp, Homo sapiens
aaggcctcttgtgct

SEQ ID NO: 1802288 - DNA, 23 bp, Homo sapiens
aaggcctcttgtgctcacgctcc

SEQ ID NO: 1802289 - DNA, 19 bp, Homo sapiens
aaggcctggaaccagggag

SEQ ID NO: 1802290 - DNA, 14 bp, Homo sapiens
aaggctctcccctc

SEQ ID NO: 1802291 - DNA, 13 bp, Homo sapiens
aaggcttctccac

SEQ ID NO: 1802292 - DNA, 14 bp, Homo sapiens
aagggaaactggct

SEQ ID NO: 1802293 - DNA, 15 bp, Homo sapiens
aagggaaactggctg

SEQ ID NO: 1802294 - DNA, 13 bp, Homo sapiens
ttttttatttcca

SEQ ID NO: 1802295 - DNA, 19 bp, Homo sapiens
ttcctcctccacagtgctg

SEQ ID NO: 1802296 - DNA, 10 bp, Homo sapiens
ttcctggcct

SEQ ID NO: 1802297 - DNA, 20 bp, Homo sapiens
ttcctggcctcactggctgg

SEQ ID NO: 1802298 - DNA, 15 bp, Homo sapiens
ttcctggggccccgc

SEQ ID NO: 1802299 - DNA, 23 bp, Homo sapiens
ttcctgtgccatgttattcagct

SEQ ID NO: 1802300 - DNA, 13 bp, Homo sapiens
ttcctgtgtattc

SEQ ID NO: 1802301 - DNA, 20 bp, Homo sapiens
ttcctttacaactaaataac

SEQ ID NO: 1802302 - DNA, 21 bp, Homo sapiens
ttcgaaacctgtccataaagt

SEQ ID NO: 1802303 - DNA, 17 bp, Homo sapiens
ttcgaataaagtgaata

SEQ ID NO: 1802304 - DNA, 14 bp, Homo sapiens
ttcgctgctctagc

SEQ ID NO: 1802305 - DNA, 21 bp, Homo sapiens
ttcgtgtctctcccaccccgg

SEQ ID NO: 1802306 - DNA, 18 bp, Homo sapiens
ttctaaaggtttcactgt

SEQ ID NO: 1802307 - DNA, 22 bp, Homo sapiens
ttctaacccagtcttatttttc

SEQ ID NO: 1802308 - DNA, 23 bp, Homo sapiens
ttctaacccagtcttatttttct

SEQ ID NO: 1802309 - DNA, 13 bp, Homo sapiens
ttctaagttaaat

SEQ ID NO: 1802310 - DNA, 21 bp, Homo sapiens
ttctacctttttttctctcct

SEQ ID NO: 1802311 - DNA, 14 bp, Homo sapiens
ttctagtcagtaaa

SEQ ID NO: 1802312 - DNA, 17 bp, Homo sapiens
ttctcagaacagctgaa

SEQ ID NO: 1802313 - DNA, 22 bp, Homo sapiens
ttctcagtgctctcctacccca

SEQ ID NO: 1802314 - DNA, 13 bp, Homo sapiens
ttctccatcagct

SEQ ID NO: 1802315 - DNA, 17 bp, Homo sapiens
ttctcccccccggggct

SEQ ID NO: 1802316 - DNA, 17 bp, Homo sapiens
ttctgcaactagccaag

SEQ ID NO: 1802317 - DNA, 17 bp, Homo sapiens
ttctgccacttcccagg

SEQ ID NO: 1802318 - DNA, 13 bp, Homo sapiens
ttctgctgggctg

SEQ ID NO: 1802319 - DNA, 13 bp, Homo sapiens
ttctgggaaggga

SEQ ID NO: 1802320 - DNA, 16 bp, Homo sapiens
ttctgggtgttgacca

SEQ ID NO: 1802321 - DNA, 17 bp, Homo sapiens
ttctgggtgttgaccac

SEQ ID NO: 1802322 - DNA, 21 bp, Homo sapiens
ttctggtatgaacttgaggac

SEQ ID NO: 1802323 - DNA, 15 bp, Homo sapiens
ttctgtatgtgacaa

SEQ ID NO: 1802324 - DNA, 14 bp, Homo sapiens
ttcttaaaggcctg

SEQ ID NO: 1802325 - DNA, 16 bp, Homo sapiens
ttcttaaaggcctgga

SEQ ID NO: 1802326 - DNA, 22 bp, Homo sapiens
ttcttcattatagtaaatctat

SEQ ID NO: 1802327 - DNA, 20 bp, Homo sapiens
ttcttccactttttccagaa

SEQ ID NO: 1802328 - DNA, 14 bp, Homo sapiens
ttcttcgctgctct

SEQ ID NO: 1802329 - DNA, 16 bp, Homo sapiens
ttcttgtggttgtata

SEQ ID NO: 1802330 - DNA, 11 bp, Homo sapiens
ttctttcagat

SEQ ID NO: 1802331 - DNA, 21 bp, Homo sapiens
ttgaaaacttgctgaaaaaca

SEQ ID NO: 1802332 - DNA, 16 bp, Homo sapiens
ttgaaatttactgtga

SEQ ID NO: 1802333 - DNA, 13 bp, Homo sapiens
ttgaaggcagtct

SEQ ID NO: 1802334 - DNA, 19 bp, Homo sapiens
ttgaatatcagttgacaga

SEQ ID NO: 1802335 - DNA, 13 bp, Homo sapiens
ttgacaaaaatgt

SEQ ID NO: 1802336 - DNA, 13 bp, Homo sapiens
ttgaccactccag

SEQ ID NO: 1802337 - DNA, 14 bp, Homo sapiens
ttgactaaagccat

SEQ ID NO: 1802338 - DNA, 15 bp, Homo sapiens
ttgagacaagccctg

SEQ ID NO: 1802339 - DNA, 19 bp, Homo sapiens
ttgagacaagccctggcaa

SEQ ID NO: 1802340 - DNA, 14 bp, Homo sapiens
ttgagcacaaaatt

SEQ ID NO: 1802341 - DNA, 11 bp, Homo sapiens
ttgagcccagg

SEQ ID NO: 1802342 - DNA, 11 bp, Homo sapiens
ttgaggacaca

SEQ ID NO: 1802343 - DNA, 13 bp, Homo sapiens
ttgaggacacatg

SEQ ID NO: 1802344 - DNA, 16 bp, Homo sapiens
ttgaggacacatgtcc

SEQ ID NO: 1802345 - DNA, 16 bp, Homo sapiens
ttgatcaaaatcaaaa

SEQ ID NO: 1802346 - DNA, 15 bp, Homo sapiens
ttgatttgagaaatt

SEQ ID NO: 1802347 - DNA, 14 bp, Homo sapiens
ttgcacatcattca

SEQ ID NO: 1802348 - DNA, 17 bp, Homo sapiens
ttgcacatcattcattc

SEQ ID NO: 1802349 - DNA, 17 bp, Homo sapiens
ttgcaggcccagcagac

SEQ ID NO: 1802350 - DNA, 17 bp, Homo sapiens
ttgcaggctctgggctc

SEQ ID NO: 1802351 - DNA, 18 bp, Homo sapiens
ttgcaggctctgggctca

SEQ ID NO: 1802352 - DNA, 20 bp, Homo sapiens
ttgcaggctctgggctcagg

SEQ ID NO: 1802353 - DNA, 19 bp, Homo sapiens
ttgcatatcagtcatgact

SEQ ID NO: 1802354 - DNA, 17 bp, Homo sapiens
ttgcatcccccttagaa

SEQ ID NO: 1802355 - DNA, 17 bp, Homo sapiens
ttcaaaaatacagaatt

SEQ ID NO: 1802356 - DNA, 18 bp, Homo sapiens
ttcaaatgaactttaaaa

SEQ ID NO: 1802357 - DNA, 16 bp, Homo sapiens
ttcaacctgtgtctta

SEQ ID NO: 1802358 - DNA, 20 bp, Homo sapiens
ttcaagctgtcccctctgtc

SEQ ID NO: 1802359 - DNA, 21 bp, Homo sapiens
ttcaaggccatattttaaaaa

SEQ ID NO: 1802360 - DNA, 17 bp, Homo sapiens
ttcaagtgatctttcaa

SEQ ID NO: 1802361 - DNA, 13 bp, Homo sapiens
ttcaataaagctg

SEQ ID NO: 1802362 - DNA, 17 bp, Homo sapiens
ttcacaacagatttcta

SEQ ID NO: 1802363 - DNA, 19 bp, Homo sapiens
ttcacaacagatttctaag

SEQ ID NO: 1802364 - DNA, 12 bp, Homo sapiens
ttcacccctgca

SEQ ID NO: 1802365 - DNA, 23 bp, Homo sapiens
ttcacttcgatgactggatacag

SEQ ID NO: 1802366 - DNA, 17 bp, Homo sapiens
ttcacttctttgcagag

SEQ ID NO: 1802367 - DNA, 14 bp, Homo sapiens
ttcagaaattctca

SEQ ID NO: 1802368 - DNA, 15 bp, Homo sapiens
ttcagaaattctcaa

SEQ ID NO: 1802369 - DNA, 16 bp, Homo sapiens
ttcagaaattctcaaa

SEQ ID NO: 1802370 - DNA, 14 bp, Homo sapiens
ttcagagttttcta

SEQ ID NO: 1802371 - DNA, 13 bp, Homo sapiens
ttcagatcattta

SEQ ID NO: 1802372 - DNA, 15 bp, Homo sapiens
ttcagatttcaaatt

SEQ ID NO: 1802373 - DNA, 13 bp, Homo sapiens
ttcagcaccctgg

SEQ ID NO: 1802374 - DNA, 23 bp, Homo sapiens
ttcagcaccctgggtgccattcc

SEQ ID NO: 1802375 - DNA, 15 bp, Homo sapiens
ttcagcatctcactt

SEQ ID NO: 1802376 - DNA, 16 bp, Homo sapiens
ttcagcttctgctggg

SEQ ID NO: 1802377 - DNA, 18 bp, Homo sapiens
ttcagcttctgctgggct

SEQ ID NO: 1802378 - DNA, 20 bp, Homo sapiens
ttcaggaaaagcctctgtgt

SEQ ID NO: 1802379 - DNA, 17 bp, Homo sapiens
ttcaggcagcactgaca

SEQ ID NO: 1802380 - DNA, 22 bp, Homo sapiens
ttcaggggctgcccgctcccag

SEQ ID NO: 1802381 - DNA, 15 bp, Homo sapiens
ttcaggtaggccctt

SEQ ID NO: 1802382 - DNA, 18 bp, Homo sapiens
ttcaggtggagagcacta

SEQ ID NO: 1802383 - DNA, 12 bp, Homo sapiens
ttcatacattat

SEQ ID NO: 1802384 - DNA, 13 bp, Homo sapiens
ttcatacattata

SEQ ID NO: 1802385 - DNA, 16 bp, Homo sapiens
ttcatacattatattc

SEQ ID NO: 1802386 - DNA, 18 bp, Homo sapiens
ttcatctctaacatatga

SEQ ID NO: 1802387 - DNA, 21 bp, Homo sapiens
ttccaaagggcagtaaagttt

SEQ ID NO: 1802388 - DNA, 21 bp, Homo sapiens
ttccaacaatggggtgggccc

SEQ ID NO: 1802389 - DNA, 20 bp, Homo sapiens
ttccaaggtggtctgctcgg

SEQ ID NO: 1802390 - DNA, 21 bp, Homo sapiens
ttccactgaaatagagtgaat

SEQ ID NO: 1802391 - DNA, 13 bp, Homo sapiens
ttccactgtgcta

SEQ ID NO: 1802392 - DNA, 19 bp, Homo sapiens
ttccagctaagcctgatga

SEQ ID NO: 1802393 - DNA, 16 bp, Homo sapiens
ttccaggcccctgagg

SEQ ID NO: 1802394 - DNA, 20 bp, Homo sapiens
ttccaggctcttcctggacc

SEQ ID NO: 1802395 - DNA, 15 bp, Homo sapiens
ttccaggtggggtga

SEQ ID NO: 1802396 - DNA, 21 bp, Homo sapiens
ttccatatggagcatttttca

SEQ ID NO: 1802397 - DNA, 22 bp, Homo sapiens
ttccatatggagcatttttcag

SEQ ID NO: 1802398 - DNA, 18 bp, Homo sapiens
ttcccactgcaccccctc

SEQ ID NO: 1802399 - DNA, 22 bp, Homo sapiens
ttccccgagggatgatgccaca

SEQ ID NO: 1802400 - DNA, 16 bp, Homo sapiens
ttcccctcctacccct

SEQ ID NO: 1802401 - DNA, 18 bp, Homo sapiens
ttcccggagcacagccct

SEQ ID NO: 1802402 - DNA, 19 bp, Homo sapiens
ttcccggagcacagccctg

SEQ ID NO: 1802403 - DNA, 20 bp, Homo sapiens
ttcccggagcacagccctgg

SEQ ID NO: 1802404 - DNA, 15 bp, Homo sapiens
ttccctcccaacaga

SEQ ID NO: 1802405 - DNA, 15 bp, Homo sapiens
ttccctgcaccctgg

SEQ ID NO: 1802406 - DNA, 14 bp, Homo sapiens
ttcctccagcctcc

SEQ ID NO: 1802407 - DNA, 14 bp, Homo sapiens
ttcctccgtccacc

SEQ ID NO: 1802408 - DNA, 18 bp, Homo sapiens
ttcctccgtccacccagg

SEQ ID NO: 1802409 - DNA, 19 bp, Homo sapiens
ttcctccgtccacccaggc

SEQ ID NO: 1802410 - DNA, 22 bp, Homo sapiens
ttcctccgtccacccaggctgc

SEQ ID NO: 1802411 - DNA, 15 bp, Homo sapiens
tgccccaacccccag

SEQ ID NO: 1802412 - DNA, 17 bp, Homo sapiens
tgccccaacccccagca

SEQ ID NO: 1802413 - DNA, 15 bp, Homo sapiens
tgccccaagcagcca

SEQ ID NO: 1802414 - DNA, 17 bp, Homo sapiens
tgccccaagcagccagc

SEQ ID NO: 1802415 - DNA, 18 bp, Homo sapiens
tgccccaagcagccagcc

SEQ ID NO: 1802416 - DNA, 21 bp, Homo sapiens
tgccccaagcagccagccagt

SEQ ID NO: 1802417 - DNA, 21 bp, Homo sapiens
tgccccatctcctcccatggc

SEQ ID NO: 1802418 - DNA, 19 bp, Homo sapiens
tgcccccagaaagcctcct

SEQ ID NO: 1802419 - DNA, 20 bp, Homo sapiens
tgcccccagaaagcctcctg

SEQ ID NO: 1802420 - DNA, 21 bp, Homo sapiens
tgcccccatctccccaggcct

SEQ ID NO: 1802421 - DNA, 16 bp, Homo sapiens
tgccccccatcctggc

SEQ ID NO: 1802422 - DNA, 15 bp, Homo sapiens
tgccccctcgtgcca

SEQ ID NO: 1802423 - DNA, 16 bp, Homo sapiens
tgccccctcgtgccag

SEQ ID NO: 1802424 - DNA, 17 bp, Homo sapiens
tgccccctcgtgccagt

SEQ ID NO: 1802425 - DNA, 21 bp, Homo sapiens
tgccccgtcggactgccccca

SEQ ID NO: 1802426 - DNA, 17 bp, Homo sapiens
tgcccctccccagccct

SEQ ID NO: 1802427 - DNA, 17 bp, Homo sapiens
tgcccctgtaggttgct

SEQ ID NO: 1802428 - DNA, 21 bp, Homo sapiens
tgcccctgtaggttgcttaaa

SEQ ID NO: 1802429 - DNA, 12 bp, Homo sapiens
tgcccctgtctg

SEQ ID NO: 1802430 - DNA, 23 bp, Homo sapiens
tgccccttaagggttgaaggcag

SEQ ID NO: 1802431 - DNA, 14 bp, Homo sapiens
tgcccgctcccaca

SEQ ID NO: 1802432 - DNA, 16 bp, Homo sapiens
tgcccgctcccacagc

SEQ ID NO: 1802433 - DNA, 23 bp, Homo sapiens
tgcccgctcccacagcttcctga

SEQ ID NO: 1802434 - DNA, 14 bp, Homo sapiens
tgcccgctcccagt

SEQ ID NO: 1802435 - DNA, 15 bp, Homo sapiens
tgcccgctcccagtg

SEQ ID NO: 1802436 - DNA, 15 bp, Homo sapiens
tgcccggcgccctct

SEQ ID NO: 1802437 - DNA, 16 bp, Homo sapiens
tgccctccctccttcc

SEQ ID NO: 1802438 - DNA, 14 bp, Homo sapiens
tgccctgccacctg

SEQ ID NO: 1802439 - DNA, 16 bp, Homo sapiens
tgccctgccacctgtc

SEQ ID NO: 1802440 - DNA, 19 bp, Homo sapiens
tgccctgccacctgtctgt

SEQ ID NO: 1802441 - DNA, 15 bp, Homo sapiens
tgccctgccctgcca

SEQ ID NO: 1802442 - DNA, 12 bp, Homo sapiens
tgccctgcctgc

SEQ ID NO: 1802443 - DNA, 15 bp, Homo sapiens
tgccctgcctgccca

SEQ ID NO: 1802444 - DNA, 17 bp, Homo sapiens
tgccctgcctgcccact

SEQ ID NO: 1802445 - DNA, 15 bp, Homo sapiens
tgcctaataaagaga

SEQ ID NO: 1802446 - DNA, 17 bp, Homo sapiens
tgcctaataaagagact

SEQ ID NO: 1802447 - DNA, 20 bp, Homo sapiens
tgcctataaaatgcccattt

SEQ ID NO: 1802448 - DNA, 20 bp, Homo sapiens
tgcctatcacctcttatgca

SEQ ID NO: 1802449 - DNA, 17 bp, Homo sapiens
tgcctatccatcctgcg

SEQ ID NO: 1802450 - DNA, 16 bp, Homo sapiens
tgcctccactcccact

SEQ ID NO: 1802451 - DNA, 17 bp, Homo sapiens
tgcctcgaggcaccggc

SEQ ID NO: 1802452 - DNA, 21 bp, Homo sapiens
tgcctcgaggcaccggcgctg

SEQ ID NO: 1802453 - DNA, 17 bp, Homo sapiens
tgcctcggctcctgctg

SEQ ID NO: 1802454 - DNA, 18 bp, Homo sapiens
tgcctgattcggctgtct

SEQ ID NO: 1802455 - DNA, 16 bp, Homo sapiens
tgcctgccgcccaaag

SEQ ID NO: 1802456 - DNA, 13 bp, Homo sapiens
tgcctgctagagc

SEQ ID NO: 1802457 - DNA, 12 bp, Homo sapiens
tgcctggcctgg

SEQ ID NO: 1802458 - DNA, 13 bp, Homo sapiens
tgcctggctgtgg

SEQ ID NO: 1802459 - DNA, 16 bp, Homo sapiens
tgcctgggcctgtgca

SEQ ID NO: 1802460 - DNA, 21 bp, Homo sapiens
tgcctgggcctgtgcagcagc

SEQ ID NO: 1802461 - DNA, 18 bp, Homo sapiens
tgcctgtggcagaaaaga

SEQ ID NO: 1802462 - DNA, 14 bp, Homo sapiens
tgccttcagggaga

SEQ ID NO: 1802463 - DNA, 21 bp, Homo sapiens
tgccttcctgtttaaaaaaag

SEQ ID NO: 1802464 - DNA, 20 bp, Homo sapiens
tgcctttgtagcctatgtct

SEQ ID NO: 1802465 - DNA, 14 bp, Homo sapiens
tgcgagaattttca

SEQ ID NO: 1802466 - DNA, 15 bp, Homo sapiens
tgcgagaattttcaa

SEQ ID NO: 1802467 - DNA, 22 bp, Homo sapiens
tgcgctaacccccagcccacag

SEQ ID NO: 1802468 - DNA, 19 bp, Homo sapiens
tgcgtcctgcagaggacca

SEQ ID NO: 1802469 - DNA, 13 bp, Homo sapiens
tgcgttggagcca

SEQ ID NO: 1802470 - DNA, 19 bp, Homo sapiens
tgcgttggagccactcctg

SEQ ID NO: 1802471 - DNA, 23 bp, Homo sapiens
tgcgttggagccactcctgtccc

SEQ ID NO: 1802472 - DNA, 19 bp, Homo sapiens
tgctatgagctggggatgt

SEQ ID NO: 1802473 - DNA, 18 bp, Homo sapiens
tgctattgttgtgggctt

SEQ ID NO: 1802474 - DNA, 15 bp, Homo sapiens
tgctcaacccccctc

SEQ ID NO: 1802475 - DNA, 20 bp, Homo sapiens
tgctcaacccccctcccaga

SEQ ID NO: 1802476 - DNA, 17 bp, Homo sapiens
tgctcacttttgtgaaa

SEQ ID NO: 1802477 - DNA, 19 bp, Homo sapiens
tgctcagagtctatcaaca

SEQ ID NO: 1802478 - DNA, 20 bp, Homo sapiens
tgctcagcaaggggctctgc

SEQ ID NO: 1802479 - DNA, 12 bp, Homo sapiens
tgctccagggtc

SEQ ID NO: 1802480 - DNA, 13 bp, Homo sapiens
tgctccagggtct

SEQ ID NO: 1802481 - DNA, 16 bp, Homo sapiens
tgctccagggtcttgg

SEQ ID NO: 1802482 - DNA, 19 bp, Homo sapiens
tgctccagggtcttgggct

SEQ ID NO: 1802483 - DNA, 22 bp, Homo sapiens
tgctccttggcacccccatgct

SEQ ID NO: 1802484 - DNA, 16 bp, Homo sapiens
tgctcgggcccaggcc

SEQ ID NO: 1802485 - DNA, 18 bp, Homo sapiens
tgctctaattcttttcaa

SEQ ID NO: 1802486 - DNA, 19 bp, Homo sapiens
tgctctaattcttttcaaa

SEQ ID NO: 1802487 - DNA, 19 bp, Homo sapiens
tgctctagccaggagtctg

SEQ ID NO: 1802488 - DNA, 13 bp, Homo sapiens
tgctctagctggc

SEQ ID NO: 1802489 - DNA, 14 bp, Homo sapiens
tgctctagctggca

SEQ ID NO: 1802490 - DNA, 16 bp, Homo sapiens
tgctctgccccaagcc

SEQ ID NO: 1802491 - DNA, 14 bp, Homo sapiens
tgctctgccccttg

SEQ ID NO: 1802492 - DNA, 21 bp, Homo sapiens
tgctcttagtgcccgcctagg

SEQ ID NO: 1802493 - DNA, 20 bp, Homo sapiens
tgctcttttggtggggagca

SEQ ID NO: 1802494 - DNA, 22 bp, Homo sapiens
tgctcttttggtggggagcact

SEQ ID NO: 1802495 - DNA, 14 bp, Homo sapiens
tgctgaaaaagaaa

SEQ ID NO: 1802496 - DNA, 15 bp, Homo sapiens
tgctgaaaaagaaaa

SEQ ID NO: 1802497 - DNA, 13 bp, Homo sapiens
tgctgaattcctt

SEQ ID NO: 1802498 - DNA, 15 bp, Homo sapiens
tgctgagcttagcct

SEQ ID NO: 1802499 - DNA, 17 bp, Homo sapiens
tgctgagcttagccttg

SEQ ID NO: 1802500 - DNA, 23 bp, Homo sapiens
tgctgagcttagccttgtgccct

SEQ ID NO: 1802501 - DNA, 19 bp, Homo sapiens
tgctgcaccaacccagccg

SEQ ID NO: 1802502 - DNA, 22 bp, Homo sapiens
tgctgcaccaacccagccgctg

SEQ ID NO: 1802503 - DNA, 18 bp, Homo sapiens
tgctgccatgccactgcc

SEQ ID NO: 1802504 - DNA, 19 bp, Homo sapiens
tgctgcccctgtctggaag

SEQ ID NO: 1802505 - DNA, 20 bp, Homo sapiens
tgctgcccctgtctggaaga

SEQ ID NO: 1802506 - DNA, 15 bp, Homo sapiens
tgctgccttcaggga

SEQ ID NO: 1802507 - DNA, 16 bp, Homo sapiens
tgctgccttcagggag

SEQ ID NO: 1802508 - DNA, 14 bp, Homo sapiens
tgctgctaccctcc

SEQ ID NO: 1802509 - DNA, 16 bp, Homo sapiens
tgagttggctgggaat

SEQ ID NO: 1802510 - DNA, 17 bp, Homo sapiens
tgagttggctgggaata

SEQ ID NO: 1802511 - DNA, 16 bp, Homo sapiens
tgagtttcagaaattc

SEQ ID NO: 1802512 - DNA, 19 bp, Homo sapiens
tgagtttcagaaattctca

SEQ ID NO: 1802513 - DNA, 23 bp, Homo sapiens
tgataacaagcaaggatatcaga

SEQ ID NO: 1802514 - DNA, 21 bp, Homo sapiens
tgatagaaggctatggggata

SEQ ID NO: 1802515 - DNA, 13 bp, Homo sapiens
tgatattgagaca

SEQ ID NO: 1802516 - DNA, 18 bp, Homo sapiens
tgatattgagacattaat

SEQ ID NO: 1802517 - DNA, 15 bp, Homo sapiens
tgatcaaaatcaaaa

SEQ ID NO: 1802518 - DNA, 22 bp, Homo sapiens
tgatgccacaccaagctgtgcc

SEQ ID NO: 1802519 - DNA, 23 bp, Homo sapiens
tgatgccacaccaagctgtgcca

SEQ ID NO: 1802520 - DNA, 14 bp, Homo sapiens
tgatgctgggctgg

SEQ ID NO: 1802521 - DNA, 15 bp, Homo sapiens
tgatggaagggcctt

SEQ ID NO: 1802522 - DNA, 23 bp, Homo sapiens
tgatggaccgggtgggcctggcc

SEQ ID NO: 1802523 - DNA, 15 bp, Homo sapiens
tgatggccaaggggg

SEQ ID NO: 1802524 - DNA, 20 bp, Homo sapiens
tgatggcgcgggaggcacca

SEQ ID NO: 1802525 - DNA, 23 bp, Homo sapiens
tgatggcgcgggaggcaccagct

SEQ ID NO: 1802526 - DNA, 15 bp, Homo sapiens
tgatgggtcagttgt

SEQ ID NO: 1802527 - DNA, 13 bp, Homo sapiens
tgatggtgagctg

SEQ ID NO: 1802528 - DNA, 14 bp, Homo sapiens
tgatggtgagctgg

SEQ ID NO: 1802529 - DNA, 16 bp, Homo sapiens
tgatggtgagctggga

SEQ ID NO: 1802530 - DNA, 18 bp, Homo sapiens
tgatgtgggaagaagtaa

SEQ ID NO: 1802531 - DNA, 15 bp, Homo sapiens
tgattgcgagaattt

SEQ ID NO: 1802532 - DNA, 22 bp, Homo sapiens
tgattgttttagaagttaaagt

SEQ ID NO: 1802533 - DNA, 13 bp, Homo sapiens
tgatttaatatct

SEQ ID NO: 1802534 - DNA, 14 bp, Homo sapiens
tgatttccaggccc

SEQ ID NO: 1802535 - DNA, 19 bp, Homo sapiens
tgatttcccgtggccccag

SEQ ID NO: 1802536 - DNA, 21 bp, Homo sapiens
tgatttcccgtggccccagcc

SEQ ID NO: 1802537 - DNA, 16 bp, Homo sapiens
tgattttaaatataag

SEQ ID NO: 1802538 - DNA, 13 bp, Homo sapiens
tgcaaaagtgggg

SEQ ID NO: 1802539 - DNA, 21 bp, Homo sapiens
tgcaaagtgttttctcagaac

SEQ ID NO: 1802540 - DNA, 18 bp, Homo sapiens
tgcaaatattagcaaaga

SEQ ID NO: 1802541 - DNA, 19 bp, Homo sapiens
tgcaaatattagcaaagaa

SEQ ID NO: 1802542 - DNA, 16 bp, Homo sapiens
tgcaacaaaaatgtgg

SEQ ID NO: 1802543 - DNA, 16 bp, Homo sapiens
tgcaacaatgcaaaag

SEQ ID NO: 1802544 - DNA, 13 bp, Homo sapiens
tgcaagccccagg

SEQ ID NO: 1802545 - DNA, 15 bp, Homo sapiens
tgcaagccccagggc

SEQ ID NO: 1802546 - DNA, 16 bp, Homo sapiens
tgcaagccccagggcc

SEQ ID NO: 1802547 - DNA, 19 bp, Homo sapiens
tgcaagccccagggcctgg

SEQ ID NO: 1802548 - DNA, 20 bp, Homo sapiens
tgcaagccccagggcctggg

SEQ ID NO: 1802549 - DNA, 14 bp, Homo sapiens
tgcaatctccaggg

SEQ ID NO: 1802550 - DNA, 22 bp, Homo sapiens
tgcaatctccagggctgcccct

SEQ ID NO: 1802551 - DNA, 14 bp, Homo sapiens
tgcaatgaaaacaa

SEQ ID NO: 1802552 - DNA, 13 bp, Homo sapiens
tgcacaagctcag

SEQ ID NO: 1802553 - DNA, 13 bp, Homo sapiens
tgcacacacagct

SEQ ID NO: 1802554 - DNA, 19 bp, Homo sapiens
tgcacatcattcattcact

SEQ ID NO: 1802555 - DNA, 21 bp, Homo sapiens
tgcacatcattcattcactgt

SEQ ID NO: 1802556 - DNA, 19 bp, Homo sapiens
tgcacatcctcattcacta

SEQ ID NO: 1802557 - DNA, 19 bp, Homo sapiens
tgcacattttgtacaaaga

SEQ ID NO: 1802558 - DNA, 15 bp, Homo sapiens
tgcaccaacccagcc

SEQ ID NO: 1802559 - DNA, 12 bp, Homo sapiens
tgcaccagagtg

SEQ ID NO: 1802560 - DNA, 10 bp, Homo sapiens
tgcaccagga

SEQ ID NO: 1802561 - DNA, 14 bp, Homo sapiens
tgcaccatgtgaag

SEQ ID NO: 1802562 - DNA, 15 bp, Homo sapiens
tgcaccatgtgaagt

SEQ ID NO: 1802563 - DNA, 20 bp, Homo sapiens
tgcacccactcaccagggtc

SEQ ID NO: 1802564 - DNA, 15 bp, Homo sapiens
tgcaccccctcctgc

SEQ ID NO: 1802565 - DNA, 12 bp, Homo sapiens
tgcactctgtgc

SEQ ID NO: 1802566 - DNA, 13 bp, Homo sapiens
tgcactctgtgcc

SEQ ID NO: 1802567 - DNA, 20 bp, Homo sapiens
tgcactggaatatctgagaa

SEQ ID NO: 1802568 - DNA, 17 bp, Homo sapiens
tgcactggccccaccct

SEQ ID NO: 1802569 - DNA, 13 bp, Homo sapiens
tgcactgtcctgc

SEQ ID NO: 1802570 - DNA, 16 bp, Homo sapiens
tgcactgtcctgctcc

SEQ ID NO: 1802571 - DNA, 21 bp, Homo sapiens
tgcactgtcctgctccacagt

SEQ ID NO: 1802572 - DNA, 15 bp, Homo sapiens
tgcacttcagacacc

SEQ ID NO: 1802573 - DNA, 11 bp, Homo sapiens
tgcagagcctt

SEQ ID NO: 1802574 - DNA, 13 bp, Homo sapiens
tgcagaggggcag

SEQ ID NO: 1802575 - DNA, 20 bp, Homo sapiens
tgcagaggggcaggccctgc

SEQ ID NO: 1802576 - DNA, 16 bp, Homo sapiens
tgcagattcctgggcc

SEQ ID NO: 1802577 - DNA, 17 bp, Homo sapiens
tgcagattcctgggcct

SEQ ID NO: 1802578 - DNA, 13 bp, Homo sapiens
tgcagcagcccag

SEQ ID NO: 1802579 - DNA, 16 bp, Homo sapiens
tgcagccttcccctcc

SEQ ID NO: 1802580 - DNA, 19 bp, Homo sapiens
tgcagccttcccctccctg

SEQ ID NO: 1802581 - DNA, 13 bp, Homo sapiens
tgcagctgggccc

SEQ ID NO: 1802582 - DNA, 19 bp, Homo sapiens
tgcagctgggccccatgct

SEQ ID NO: 1802583 - DNA, 22 bp, Homo sapiens
tgcagctgggccccatgctctg

SEQ ID NO: 1802584 - DNA, 17 bp, Homo sapiens
tgcaggaacgagcactg

SEQ ID NO: 1802585 - DNA, 23 bp, Homo sapiens
tgcaggaacgagcactggccaga

SEQ ID NO: 1802586 - DNA, 14 bp, Homo sapiens
tgcaggcccagcag

SEQ ID NO: 1802587 - DNA, 13 bp, Homo sapiens
tgcaggctctggg

SEQ ID NO: 1802588 - DNA, 16 bp, Homo sapiens
tgcaggctctgggctc

SEQ ID NO: 1802589 - DNA, 18 bp, Homo sapiens
tgcaggctctgggctcag

SEQ ID NO: 1802590 - DNA, 21 bp, Homo sapiens
tgcaggctctgggctcagggc

SEQ ID NO: 1802591 - DNA, 23 bp, Homo sapiens
tgcaggctctgggctcagggctg

SEQ ID NO: 1802592 - DNA, 16 bp, Homo sapiens
tgcagggaagagggca

SEQ ID NO: 1802593 - DNA, 22 bp, Homo sapiens
tgcaggtacttcctcctgatgg

SEQ ID NO: 1802594 - DNA, 23 bp, Homo sapiens
tgcaggtacttcctcctgatggc

SEQ ID NO: 1802595 - DNA, 23 bp, Homo sapiens
tgcaggttgggccatactggcct

SEQ ID NO: 1802596 - DNA, 18 bp, Homo sapiens
tgcatatcagtcatgact

SEQ ID NO: 1802597 - DNA, 20 bp, Homo sapiens
tgccaaagcaaaagaagtaa

SEQ ID NO: 1802598 - DNA, 14 bp, Homo sapiens
tgccaaggctctcc

SEQ ID NO: 1802599 - DNA, 17 bp, Homo sapiens
tgccaagtttttcagaa

SEQ ID NO: 1802600 - DNA, 22 bp, Homo sapiens
tgccacaccaagctgtgccacc

SEQ ID NO: 1802601 - DNA, 23 bp, Homo sapiens
tgccacaccaagctgtgccaccc

SEQ ID NO: 1802602 - DNA, 14 bp, Homo sapiens
tgccaccctgggct

SEQ ID NO: 1802603 - DNA, 12 bp, Homo sapiens
tgccacctgtct

SEQ ID NO: 1802604 - DNA, 14 bp, Homo sapiens
tgccacctgtctgt

SEQ ID NO: 1802605 - DNA, 15 bp, Homo sapiens
tgccacctgtctgtc

SEQ ID NO: 1802606 - DNA, 16 bp, Homo sapiens
tgccactccctgagct

SEQ ID NO: 1802607 - DNA, 16 bp, Homo sapiens
tgccactgccaggcac

SEQ ID NO: 1802608 - DNA, 23 bp, Homo sapiens
tgccactgccaggcacctggcct

SEQ ID NO: 1802609 - DNA, 20 bp, Homo sapiens
tgccacttcttaaaggcctg

SEQ ID NO: 1802610 - DNA, 23 bp, Homo sapiens
tcctaccccacctcatgcctggc

SEQ ID NO: 1802611 - DNA, 20 bp, Homo sapiens
tctttactcccttcctggcc

SEQ ID NO: 1802612 - DNA, 22 bp, Homo sapiens
tctttactcccttcctggcctc

SEQ ID NO: 1802613 - DNA, 16 bp, Homo sapiens
tctttcagatcattta

SEQ ID NO: 1802614 - DNA, 12 bp, Homo sapiens
tctttcatacat

SEQ ID NO: 1802615 - DNA, 14 bp, Homo sapiens
taggcctggcacag

SEQ ID NO: 1802616 - DNA, 15 bp, Homo sapiens
taggtccaagggcca

SEQ ID NO: 1802617 - DNA, 19 bp, Homo sapiens
tagtaaatctatgagcaac

SEQ ID NO: 1802618 - DNA, 23 bp, Homo sapiens
tagtaacaggccttgagcacaaa

SEQ ID NO: 1802619 - DNA, 22 bp, Homo sapiens
tagtaattttttacattttcct

SEQ ID NO: 1802620 - DNA, 22 bp, Homo sapiens
tagtaccctatagagagggggc

SEQ ID NO: 1802621 - DNA, 13 bp, Homo sapiens
tagtaccttcaaa

SEQ ID NO: 1802622 - DNA, 17 bp, Homo sapiens
tagtactctctgctcta

SEQ ID NO: 1802623 - DNA, 20 bp, Homo sapiens
tagtgccaagtttttcagaa

SEQ ID NO: 1802624 - DNA, 14 bp, Homo sapiens
tagtggaagagcag

SEQ ID NO: 1802625 - DNA, 17 bp, Homo sapiens
tagtggaagagcagcct

SEQ ID NO: 1802626 - DNA, 18 bp, Homo sapiens
tagtggaagagcagcctg

SEQ ID NO: 1802627 - DNA, 23 bp, Homo sapiens
tagtggaagagcagcctgatggc

SEQ ID NO: 1802628 - DNA, 19 bp, Homo sapiens
tataaaaaatggtgcctga

SEQ ID NO: 1802629 - DNA, 12 bp, Homo sapiens
tataaaaacaac

SEQ ID NO: 1802630 - DNA, 23 bp, Homo sapiens
tataaaaacaacaaatacttcca

SEQ ID NO: 1802631 - DNA, 22 bp, Homo sapiens
tataaacatgcttgcattatat

SEQ ID NO: 1802632 - DNA, 19 bp, Homo sapiens
tataaacctctaatttatt

SEQ ID NO: 1802633 - DNA, 18 bp, Homo sapiens
tataacccactgctgaaa

SEQ ID NO: 1802634 - DNA, 18 bp, Homo sapiens
tataattttattgctgga

SEQ ID NO: 1802635 - DNA, 19 bp, Homo sapiens
tataattttattgctggaa

SEQ ID NO: 1802636 - DNA, 14 bp, Homo sapiens
tatacatcttcatt

SEQ ID NO: 1802637 - DNA, 15 bp, Homo sapiens
tatacatcttcatta

SEQ ID NO: 1802638 - DNA, 16 bp, Homo sapiens
tatacatcttcattaa

SEQ ID NO: 1802639 - DNA, 22 bp, Homo sapiens
tataccctaagatgaagctgtt

SEQ ID NO: 1802640 - DNA, 14 bp, Homo sapiens
tatagaataatttc

SEQ ID NO: 1802641 - DNA, 15 bp, Homo sapiens
tatagaataatttct

SEQ ID NO: 1802642 - DNA, 18 bp, Homo sapiens
tatagagagggggctctc

SEQ ID NO: 1802643 - DNA, 23 bp, Homo sapiens
tatagagagggggctctccaaag

SEQ ID NO: 1802644 - DNA, 22 bp, Homo sapiens
tatagttatacatcttcattaa

SEQ ID NO: 1802645 - DNA, 22 bp, Homo sapiens
tatataacccactgctgaaaaa

SEQ ID NO: 1802646 - DNA, 16 bp, Homo sapiens
tatatatcaggtaaaa

SEQ ID NO: 1802647 - DNA, 12 bp, Homo sapiens
tatatatcataa

SEQ ID NO: 1802648 - DNA, 17 bp, Homo sapiens
tatatatcataaagtat

SEQ ID NO: 1802649 - DNA, 18 bp, Homo sapiens
tatatctatatctctaaa

SEQ ID NO: 1802650 - DNA, 13 bp, Homo sapiens
tatatgtatatct

SEQ ID NO: 1802651 - DNA, 15 bp, Homo sapiens
tatatgtatatgtat

SEQ ID NO: 1802652 - DNA, 18 bp, Homo sapiens
tatatttactaaaagaat

SEQ ID NO: 1802653 - DNA, 15 bp, Homo sapiens
tatcagcacgtgtgg

SEQ ID NO: 1802654 - DNA, 23 bp, Homo sapiens
tatcaggtaaaatattttccaaa

SEQ ID NO: 1802655 - DNA, 15 bp, Homo sapiens
tatcagtcatgacta

SEQ ID NO: 1802656 - DNA, 22 bp, Homo sapiens
tatcagtgacttctgaatcctt

SEQ ID NO: 1802657 - DNA, 13 bp, Homo sapiens
tatcagtgtgccc

SEQ ID NO: 1802658 - DNA, 16 bp, Homo sapiens
tatcagttgacagaat

SEQ ID NO: 1802659 - DNA, 11 bp, Homo sapiens
tatcataaagt

SEQ ID NO: 1802660 - DNA, 12 bp, Homo sapiens
tatcataaagta

SEQ ID NO: 1802661 - DNA, 16 bp, Homo sapiens
tatctctaaactgctg

SEQ ID NO: 1802662 - DNA, 21 bp, Homo sapiens
tatctctaaactgctgttaat

SEQ ID NO: 1802663 - DNA, 18 bp, Homo sapiens
tatctgagaagtgtatat

SEQ ID NO: 1802664 - DNA, 22 bp, Homo sapiens
tatctgagaagtgtatatagtt

SEQ ID NO: 1802665 - DNA, 16 bp, Homo sapiens
tatctgagaattgcaa

SEQ ID NO: 1802666 - DNA, 18 bp, Homo sapiens
tatctgagaattgcaaaa

SEQ ID NO: 1802667 - DNA, 13 bp, Homo sapiens
tatctgcctggcc

SEQ ID NO: 1802668 - DNA, 19 bp, Homo sapiens
tatctgcctggcctggctc

SEQ ID NO: 1802669 - DNA, 21 bp, Homo sapiens
tatcttcaaaaatacagaatt

SEQ ID NO: 1802670 - DNA, 22 bp, Homo sapiens
tatgaacttgaggacacatgtc

SEQ ID NO: 1802671 - DNA, 15 bp, Homo sapiens
tatgaagtattaaaa

SEQ ID NO: 1802672 - DNA, 16 bp, Homo sapiens
tatgagactcttaaat

SEQ ID NO: 1802673 - DNA, 16 bp, Homo sapiens
tatgagatggccatgc

SEQ ID NO: 1802674 - DNA, 21 bp, Homo sapiens
tatgcacacctcccaccccct

SEQ ID NO: 1802675 - DNA, 21 bp, Homo sapiens
tatggagcatttttcagagtt

SEQ ID NO: 1802676 - DNA, 16 bp, Homo sapiens
tatgtaagtttgcata

SEQ ID NO: 1802677 - DNA, 16 bp, Homo sapiens
tatgtaggatctgtca

SEQ ID NO: 1802678 - DNA, 19 bp, Homo sapiens
tatgtatatgtatatctat

SEQ ID NO: 1802679 - DNA, 17 bp, Homo sapiens
tatgtgagcgagcaagc

SEQ ID NO: 1802680 - DNA, 16 bp, Homo sapiens
tatgtgagtttcagaa

SEQ ID NO: 1802681 - DNA, 17 bp, Homo sapiens
tatgtgagtttcagaaa

SEQ ID NO: 1802682 - DNA, 20 bp, Homo sapiens
tatgtgagtttcagaaattc

SEQ ID NO: 1802683 - DNA, 19 bp, Homo sapiens
tatgtgggggtctgtgtgt

SEQ ID NO: 1802684 - DNA, 20 bp, Homo sapiens
tatgtgggggtctgtgtgtt

SEQ ID NO: 1802685 - DNA, 14 bp, Homo sapiens
tatgtgtgtgtgtt

SEQ ID NO: 1802686 - DNA, 17 bp, Homo sapiens
tattaacaactgtgaat

SEQ ID NO: 1802687 - DNA, 21 bp, Homo sapiens
tattaacaactgtgaatatga

SEQ ID NO: 1802688 - DNA, 15 bp, Homo sapiens
tattagcaactgtgc

SEQ ID NO: 1802689 - DNA, 23 bp, Homo sapiens
tattagtgccaagtttttcagaa

SEQ ID NO: 1802690 - DNA, 22 bp, Homo sapiens
tattagtttgatttaatatctg

SEQ ID NO: 1802691 - DNA, 19 bp, Homo sapiens
tattcaaatgaaggtggtt

SEQ ID NO: 1802692 - DNA, 13 bp, Homo sapiens
tattcaataaagc

SEQ ID NO: 1802693 - DNA, 16 bp, Homo sapiens
tattcaggcactgaga

SEQ ID NO: 1802694 - DNA, 13 bp, Homo sapiens
tattctaattctt

SEQ ID NO: 1802695 - DNA, 16 bp, Homo sapiens
tattctaattcttcat

SEQ ID NO: 1802696 - DNA, 17 bp, Homo sapiens
tattctaattcttcatt

SEQ ID NO: 1802697 - DNA, 18 bp, Homo sapiens
tattctacacatatatgt

SEQ ID NO: 1802698 - DNA, 12 bp, Homo sapiens
tattctgagcct

SEQ ID NO: 1802699 - DNA, 15 bp, Homo sapiens
tattctgagccttga

SEQ ID NO: 1802700 - DNA, 17 bp, Homo sapiens
tattgattttaaatata

SEQ ID NO: 1802701 - DNA, 16 bp, Homo sapiens
tattgctctaattctt

SEQ ID NO: 1802702 - DNA, 18 bp, Homo sapiens
tattgctggaatctacta

SEQ ID NO: 1802703 - DNA, 15 bp, Homo sapiens
tattggaattttctt

SEQ ID NO: 1802704 - DNA, 17 bp, Homo sapiens
tattgtccttcagagct

SEQ ID NO: 1802705 - DNA, 13 bp, Homo sapiens
tatttagaatata

SEQ ID NO: 1802706 - DNA, 21 bp, Homo sapiens
tatttatgtaggatctgtcaa

SEQ ID NO: 1802707 - DNA, 19 bp, Homo sapiens
tatttccacataaaggtat

SEQ ID NO: 1802708 - DNA, 12 bp, Homo sapiens
tatttccttaaa

SEQ ID NO: 1802709 - DNA, 17 bp, Homo sapiens
tatttctccatcccctc

SEQ ID NO: 1802710 - DNA, 21 bp, Homo sapiens
tatttctccatcccctccctg

SEQ ID NO: 1802711 - DNA, 22 bp, Homo sapiens
tatttctggctttttgaattaa

SEQ ID NO: 1802712 - DNA, 20 bp, Homo sapiens
tatttgagtttctttcagat

SEQ ID NO: 1802713 - DNA, 13 bp, Homo sapiens
tatttggaatttt

SEQ ID NO: 1802714 - DNA, 17 bp, Homo sapiens
tatttggaattttaagt

SEQ ID NO: 1802715 - DNA, 17 bp, Homo sapiens
tatttgtaaatttatgt

SEQ ID NO: 1802716 - DNA, 12 bp, Homo sapiens
tattttgacaaa

SEQ ID NO: 1802717 - DNA, 14 bp, Homo sapiens
tattttgtaattat

SEQ ID NO: 1802718 - DNA, 16 bp, Homo sapiens
tattttgtaattattg

SEQ ID NO: 1802719 - DNA, 22 bp, Homo sapiens
tcaaaaatttctgcttttgcat

SEQ ID NO: 1802720 - DNA, 14 bp, Homo sapiens
gtactcagagcaga

SEQ ID NO: 1802721 - DNA, 18 bp, Homo sapiens
gtactcttgctttttcaa

SEQ ID NO: 1802722 - DNA, 13 bp, Homo sapiens
gtagactgtgaca

SEQ ID NO: 1802723 - DNA, 21 bp, Homo sapiens
gtagccatggctcaggcaagc

SEQ ID NO: 1802724 - DNA, 17 bp, Homo sapiens
gtaggcccttgtcctgc

SEQ ID NO: 1802725 - DNA, 18 bp, Homo sapiens
gtaggcccttgtcctgcc

SEQ ID NO: 1802726 - DNA, 20 bp, Homo sapiens
gtaggcccttgtcctgccag

SEQ ID NO: 1802727 - DNA, 23 bp, Homo sapiens
gtaggcccttgtcctgccagctg

SEQ ID NO: 1802728 - DNA, 14 bp, Homo sapiens
gtagtggaagagca

SEQ ID NO: 1802729 - DNA, 18 bp, Homo sapiens
gtagttaattttattcca

SEQ ID NO: 1802730 - DNA, 14 bp, Homo sapiens
gtatatattctaca

SEQ ID NO: 1802731 - DNA, 16 bp, Homo sapiens
gtatatctatatctct

SEQ ID NO: 1802732 - DNA, 16 bp, Homo sapiens
gtatatgtatatctat

SEQ ID NO: 1802733 - DNA, 19 bp, Homo sapiens
gtatcgctgccttgccatg

SEQ ID NO: 1802734 - DNA, 14 bp, Homo sapiens
gtatcttcaaaaat

SEQ ID NO: 1802735 - DNA, 15 bp, Homo sapiens
gtatgaacttgagga

SEQ ID NO: 1802736 - DNA, 18 bp, Homo sapiens
gtatgccttcctgtttaa

SEQ ID NO: 1802737 - DNA, 14 bp, Homo sapiens
gtattcaggcactg

SEQ ID NO: 1802738 - DNA, 17 bp, Homo sapiens
gtattcaggcactgaga

SEQ ID NO: 1802739 - DNA, 18 bp, Homo sapiens
gtattctaattcttcatt

SEQ ID NO: 1802740 - DNA, 18 bp, Homo sapiens
gtcaactggctggccagt

SEQ ID NO: 1802741 - DNA, 19 bp, Homo sapiens
gtcaactggctggccagtc

SEQ ID NO: 1802742 - DNA, 14 bp, Homo sapiens
gtcaagaaaaatat

SEQ ID NO: 1802743 - DNA, 12 bp, Homo sapiens
gtcacagctgca

SEQ ID NO: 1802744 - DNA, 17 bp, Homo sapiens
gtcacagctgcagctgg

SEQ ID NO: 1802745 - DNA, 18 bp, Homo sapiens
gtcacagctgcagctggg

SEQ ID NO: 1802746 - DNA, 19 bp, Homo sapiens
gtcacagctgcagctgggc

SEQ ID NO: 1802747 - DNA, 14 bp, Homo sapiens
gtcacctgcaagcc

SEQ ID NO: 1802748 - DNA, 22 bp, Homo sapiens
gtcacctgcaagccccagggcc

SEQ ID NO: 1802749 - DNA, 20 bp, Homo sapiens
gtcactggctgcctccactc

SEQ ID NO: 1802750 - DNA, 23 bp, Homo sapiens
gtcactggctgcctccactccca

SEQ ID NO: 1802751 - DNA, 19 bp, Homo sapiens
gtcagaggctaagatgaga

SEQ ID NO: 1802752 - DNA, 22 bp, Homo sapiens
gtcagtaaacatttgtaaaaat

SEQ ID NO: 1802753 - DNA, 17 bp, Homo sapiens
gtcagtgccgccgcctc

SEQ ID NO: 1802754 - DNA, 22 bp, Homo sapiens
gtcagtgccgccgcctcgccca

SEQ ID NO: 1802755 - DNA, 19 bp, Homo sapiens
gtcagtgtggagaggggtg

SEQ ID NO: 1802756 - DNA, 13 bp, Homo sapiens
gtcagttgtatca

SEQ ID NO: 1802757 - DNA, 16 bp, Homo sapiens
gtcatcactccctgga

SEQ ID NO: 1802758 - DNA, 20 bp, Homo sapiens
gtcatgctcacttttgtgaa

SEQ ID NO: 1802759 - DNA, 19 bp, Homo sapiens
gtgccccccatcctggccc

SEQ ID NO: 1802760 - DNA, 20 bp, Homo sapiens
gtgcccgcctaggagttgag

SEQ ID NO: 1802761 - DNA, 18 bp, Homo sapiens
gtgccctgcccccatctc

SEQ ID NO: 1802762 - DNA, 19 bp, Homo sapiens
gtgccctgcccccatctcc

SEQ ID NO: 1802763 - DNA, 17 bp, Homo sapiens
gtgccgccgcctcgccc

SEQ ID NO: 1802764 - DNA, 19 bp, Homo sapiens
gtgcctgattcggctgtct

SEQ ID NO: 1802765 - DNA, 21 bp, Homo sapiens
gtgcctgcaccaggagacaga

SEQ ID NO: 1802766 - DNA, 22 bp, Homo sapiens
gtgcctgctagagcaacccctg

SEQ ID NO: 1802767 - DNA, 23 bp, Homo sapiens
gtgcctgctagagcaacccctgt

SEQ ID NO: 1802768 - DNA, 16 bp, Homo sapiens
gtgcgaccccatctgc

SEQ ID NO: 1802769 - DNA, 14 bp, Homo sapiens
gtgcgtggctgtgg

SEQ ID NO: 1802770 - DNA, 20 bp, Homo sapiens
gtgctcacgctcccccgcag

SEQ ID NO: 1802771 - DNA, 14 bp, Homo sapiens
gtgctctggcggct

SEQ ID NO: 1802772 - DNA, 23 bp, Homo sapiens
gtgctctggcggcttcctgtcca

SEQ ID NO: 1802773 - DNA, 24 bp, Homo sapiens
gtgctctggcggcttcctgtccac

SEQ ID NO: 1802774 - DNA, 18 bp, Homo sapiens
gtgctctttgttcatcat

SEQ ID NO: 1802775 - DNA, 21 bp, Homo sapiens
gtgctgccatgccactgccag

SEQ ID NO: 1802776 - DNA, 22 bp, Homo sapiens
gtgctgccatgccactgccagg

SEQ ID NO: 1802777 - DNA, 15 bp, Homo sapiens
gtgctgctaccctcc

SEQ ID NO: 1802778 - DNA, 23 bp, Homo sapiens
gtgctgctaccctccctgctgtc

SEQ ID NO: 1802779 - DNA, 17 bp, Homo sapiens
gtgctgctgtggcatca

SEQ ID NO: 1802780 - DNA, 13 bp, Homo sapiens
gtgctgcttctct

SEQ ID NO: 1802781 - DNA, 13 bp, Homo sapiens
gtgctgtgcctgc

SEQ ID NO: 1802782 - DNA, 14 bp, Homo sapiens
gtgctgtgcctgct

SEQ ID NO: 1802783 - DNA, 23 bp, Homo sapiens
gtgcttggtggggctcgtggcct

SEQ ID NO: 1802784 - DNA, 14 bp, Homo sapiens
gtggaagtgtgggt

SEQ ID NO: 1802785 - DNA, 19 bp, Homo sapiens
gtggaagtgtgggtctgtg

SEQ ID NO: 1802786 - DNA, 19 bp, Homo sapiens
gtggacacctgccctgccc

SEQ ID NO: 1802787 - DNA, 20 bp, Homo sapiens
gtggacgcaattgtgggatg

SEQ ID NO: 1802788 - DNA, 20 bp, Homo sapiens
gtggagaggggtgcacccac

SEQ ID NO: 1802789 - DNA, 20 bp, Homo sapiens
gtggaggaaggtgctgagct

SEQ ID NO: 1802790 - DNA, 13 bp, Homo sapiens
gtggaggcctgat

SEQ ID NO: 1802791 - DNA, 16 bp, Homo sapiens
gtggaggcctgatgct

SEQ ID NO: 1802792 - DNA, 20 bp, Homo sapiens
gtggaggcctgatgctgccc

SEQ ID NO: 1802793 - DNA, 16 bp, Homo sapiens
gtggcaaagtgctgta

SEQ ID NO: 1802794 - DNA, 20 bp, Homo sapiens
gtggcaaagtgctgtaccct

SEQ ID NO: 1802795 - DNA, 22 bp, Homo sapiens
gtggcacagacttctggaaggc

SEQ ID NO: 1802796 - DNA, 13 bp, Homo sapiens
gtggcacctcctg

SEQ ID NO: 1802797 - DNA, 14 bp, Homo sapiens
gtggcacctcctga

SEQ ID NO: 1802798 - DNA, 17 bp, Homo sapiens
gtggcacctcctgagaa

SEQ ID NO: 1802799 - DNA, 24 bp, Homo sapiens
gtggcagaaaagaggagaccctgg

SEQ ID NO: 1802800 - DNA, 16 bp, Homo sapiens
gtggcagccatgcctc

SEQ ID NO: 1802801 - DNA, 22 bp, Homo sapiens
gtggcattggcagcaggtgctg

SEQ ID NO: 1802802 - DNA, 11 bp, Homo sapiens
gtggccagagc

SEQ ID NO: 1802803 - DNA, 12 bp, Homo sapiens
gtggccagagct

SEQ ID NO: 1802804 - DNA, 19 bp, Homo sapiens
gtggccagagctggaaggc

SEQ ID NO: 1802805 - DNA, 16 bp, Homo sapiens
gtggccccagcctggc

SEQ ID NO: 1802806 - DNA, 17 bp, Homo sapiens
gtggccccagcctggcc

SEQ ID NO: 1802807 - DNA, 19 bp, Homo sapiens
gtggccccagcctggccca

SEQ ID NO: 1802808 - DNA, 17 bp, Homo sapiens
gtggcctgtgtccagca

SEQ ID NO: 1802809 - DNA, 21 bp, Homo sapiens
gtggcctgtgtccagcagctg

SEQ ID NO: 1802810 - DNA, 23 bp, Homo sapiens
gtggccttccccttttgcctggc

SEQ ID NO: 1802811 - DNA, 24 bp, Homo sapiens
gtggccttccccttttgcctggct

SEQ ID NO: 1802812 - DNA, 14 bp, Homo sapiens
gtggctaacatcct

SEQ ID NO: 1802813 - DNA, 17 bp, Homo sapiens
gtggctctgggtgaggt

SEQ ID NO: 1802814 - DNA, 19 bp, Homo sapiens
gtggctgtccagtgcccat

SEQ ID NO: 1802815 - DNA, 12 bp, Homo sapiens
gtggctgtggca

SEQ ID NO: 1802816 - DNA, 14 bp, Homo sapiens
gtgggcagctgggc

SEQ ID NO: 1802817 - DNA, 21 bp, Homo sapiens
gtgggccacacccaggaaggg

SEQ ID NO: 1802818 - DNA, 12 bp, Homo sapiens
gtgggcctggcc

SEQ ID NO: 1802819 - DNA, 13 bp, Homo sapiens
gtgggcctggcct

SEQ ID NO: 1802820 - DNA, 15 bp, Homo sapiens
gtgggcctggcctga

SEQ ID NO: 1802821 - DNA, 17 bp, Homo sapiens
gtgggcctggcctgagc

SEQ ID NO: 1802822 - DNA, 22 bp, Homo sapiens
gtgggcctggcctgagctgggg

SEQ ID NO: 1802823 - DNA, 18 bp, Homo sapiens
gtgggcgggcagcacagc

SEQ ID NO: 1802824 - DNA, 19 bp, Homo sapiens
gtgggctgcactctgtgcc

SEQ ID NO: 1802825 - DNA, 20 bp, Homo sapiens
gtgggctgcactctgtgccc

SEQ ID NO: 1802826 - DNA, 21 bp, Homo sapiens
gtgggctgcactctgtgccca

SEQ ID NO: 1802827 - DNA, 14 bp, Homo sapiens
gtgggggtctgtgt

SEQ ID NO: 1802828 - DNA, 15 bp, Homo sapiens
gtgggggtctgtgtg

SEQ ID NO: 1802829 - DNA, 12 bp, Homo sapiens
gtgggtccagga

SEQ ID NO: 1802830 - DNA, 16 bp, Homo sapiens
gtgggtccaggaaggc

SEQ ID NO: 1802831 - DNA, 20 bp, Homo sapiens
gtgggtccaggaaggcagct

SEQ ID NO: 1802832 - DNA, 20 bp, Homo sapiens
gtgggtggcacctcctgaga

SEQ ID NO: 1802833 - DNA, 22 bp, Homo sapiens
gtgggttttattgtccttcaga

SEQ ID NO: 1802834 - DNA, 20 bp, Homo sapiens
gtggtgcagccttcccctcc

SEQ ID NO: 1802835 - DNA, 22 bp, Homo sapiens
gtgtaaagaataaatgaatctt

SEQ ID NO: 1802836 - DNA, 16 bp, Homo sapiens
gtgtaagacttcagat

SEQ ID NO: 1802837 - DNA, 22 bp, Homo sapiens
gtgtaagacttcagatttcaaa

SEQ ID NO: 1802838 - DNA, 23 bp, Homo sapiens
gtgtaagacttcagatttcaaat

SEQ ID NO: 1802839 - DNA, 22 bp, Homo sapiens
gtgtaatttaaaattgtgatgt

SEQ ID NO: 1802840 - DNA, 21 bp, Homo sapiens
gtgtagtggaagagcagcctg

SEQ ID NO: 1802841 - DNA, 23 bp, Homo sapiens
gtgtagtggaagagcagcctgat

SEQ ID NO: 1802842 - DNA, 16 bp, Homo sapiens
ggggctgcccgctccc

SEQ ID NO: 1802843 - DNA, 12 bp, Homo sapiens
ggggctgctggg

SEQ ID NO: 1802844 - DNA, 15 bp, Homo sapiens
ggggctgctggggca

SEQ ID NO: 1802845 - DNA, 12 bp, Homo sapiens
gggggctctcca

SEQ ID NO: 1802846 - DNA, 15 bp, Homo sapiens
ggggtcctagcccag

SEQ ID NO: 1802847 - DNA, 13 bp, Homo sapiens
ggggtctgtgctg

SEQ ID NO: 1802848 - DNA, 20 bp, Homo sapiens
ggggtctgtgctgtgcctgc

SEQ ID NO: 1802849 - DNA, 23 bp, Homo sapiens
ggggtctgtgtgtttatgtgtgt

SEQ ID NO: 1802850 - DNA, 18 bp, Homo sapiens
gggtccgcaccagctgct

SEQ ID NO: 1802851 - DNA, 23 bp, Homo sapiens
gggtccgcaccagctgctctgcc

SEQ ID NO: 1802852 - DNA, 14 bp, Homo sapiens
gggtcctagcccag

SEQ ID NO: 1802853 - DNA, 19 bp, Homo sapiens
gggtcctgcaatctccagg

SEQ ID NO: 1802854 - DNA, 23 bp, Homo sapiens
gggtctgaaggaatagccagaga

SEQ ID NO: 1802855 - DNA, 15 bp, Homo sapiens
gggtctgtgctgtgc

SEQ ID NO: 1802856 - DNA, 19 bp, Homo sapiens
gggtctgtgctgtgcctgc

SEQ ID NO: 1802857 - DNA, 13 bp, Homo sapiens
gggtgaggtaggc

SEQ ID NO: 1802858 - DNA, 18 bp, Homo sapiens
gggtgaggtaggcgggaa

SEQ ID NO: 1802859 - DNA, 20 bp, Homo sapiens
gggtggacgcaattgtggga

SEQ ID NO: 1802860 - DNA, 22 bp, Homo sapiens
gggtggaggaaggtgctgagct

SEQ ID NO: 1802861 - DNA, 16 bp, Homo sapiens
gggtggcacctcctga

SEQ ID NO: 1802862 - DNA, 17 bp, Homo sapiens
gggtggcacctcctgag

SEQ ID NO: 1802863 - DNA, 18 bp, Homo sapiens
gggtggcacctcctgaga

SEQ ID NO: 1802864 - DNA, 18 bp, Homo sapiens
gggtggcccatcccccct

SEQ ID NO: 1802865 - DNA, 12 bp, Homo sapiens
gggtgggcctgg

SEQ ID NO: 1802866 - DNA, 14 bp, Homo sapiens
gggtgggcctggcc

SEQ ID NO: 1802867 - DNA, 13 bp, Homo sapiens
gggttgaaggcag

SEQ ID NO: 1802868 - DNA, 22 bp, Homo sapiens
gggttgaaggcagtctgaaccc

SEQ ID NO: 1802869 - DNA, 23 bp, Homo sapiens
ggtaaacattcctccagcctccc

SEQ ID NO: 1802870 - DNA, 15 bp, Homo sapiens
ggtaatgcacatcct

SEQ ID NO: 1802871 - DNA, 20 bp, Homo sapiens
ggtaccaggtctcctccacc

SEQ ID NO: 1802872 - DNA, 16 bp, Homo sapiens
ggtactgcacattttg

SEQ ID NO: 1802873 - DNA, 21 bp, Homo sapiens
ggtacttcctcctgatggcca

SEQ ID NO: 1802874 - DNA, 14 bp, Homo sapiens
ggtagaaattttta

SEQ ID NO: 1802875 - DNA, 21 bp, Homo sapiens
ggtagatcgcttgagcccagg

SEQ ID NO: 1802876 - DNA, 22 bp, Homo sapiens
ggtagatcgcttgagcccagga

SEQ ID NO: 1802877 - DNA, 11 bp, Homo sapiens
ggtaggccctt

SEQ ID NO: 1802878 - DNA, 14 bp, Homo sapiens
ggtaggcccttgtc

SEQ ID NO: 1802879 - DNA, 19 bp, Homo sapiens
ggtaggcccttgtcctgcc

SEQ ID NO: 1802880 - DNA, 22 bp, Homo sapiens
ggtaggcccttgtcctgccagc

SEQ ID NO: 1802881 - DNA, 20 bp, Homo sapiens
ggtatgaacttgaggacaca

SEQ ID NO: 1802882 - DNA, 21 bp, Homo sapiens
ggtatgaacttgaggacacat

SEQ ID NO: 1802883 - DNA, 22 bp, Homo sapiens
ggtatgaacttgaggacacatg

SEQ ID NO: 1802884 - DNA, 16 bp, Homo sapiens
ggtccaggaaggcagc

SEQ ID NO: 1802885 - DNA, 20 bp, Homo sapiens
ggtccaggaaggcagctgct

SEQ ID NO: 1802886 - DNA, 14 bp, Homo sapiens
ggaggaaggtgctg

SEQ ID NO: 1802887 - DNA, 15 bp, Homo sapiens
ggaggaaggtgctga

SEQ ID NO: 1802888 - DNA, 17 bp, Homo sapiens
ggaggaggtgccaacag

SEQ ID NO: 1802889 - DNA, 17 bp, Homo sapiens
ggaggcaccagctctgt

SEQ ID NO: 1802890 - DNA, 21 bp, Homo sapiens
ggaggcaccagctctgtggcc

SEQ ID NO: 1802891 - DNA, 15 bp, Homo sapiens
ggaggccaaggcagg

SEQ ID NO: 1802892 - DNA, 22 bp, Homo sapiens
ggaggccaccccaaaccccagc

SEQ ID NO: 1802893 - DNA, 13 bp, Homo sapiens
ggagggcagagcc

SEQ ID NO: 1802894 - DNA, 17 bp, Homo sapiens
ggagggcagagccatgg

SEQ ID NO: 1802895 - DNA, 23 bp, Homo sapiens
ggagggcagagccatgggcctgg

SEQ ID NO: 1802896 - DNA, 18 bp, Homo sapiens
ggaggggcccgcttgcct

SEQ ID NO: 1802897 - DNA, 22 bp, Homo sapiens
ggaggggcccgcttgcctcggc

SEQ ID NO: 1802898 - DNA, 16 bp, Homo sapiens
ggagggggcgctcagg

SEQ ID NO: 1802899 - DNA, 23 bp, Homo sapiens
ggagtcagtaggtccaagggcca

SEQ ID NO: 1802900 - DNA, 12 bp, Homo sapiens
ggagtgcagtgg

SEQ ID NO: 1802901 - DNA, 22 bp, Homo sapiens
ggagtgtgtaatttaaaattgt

SEQ ID NO: 1802902 - DNA, 19 bp, Homo sapiens
ggagttgagtacagtgagg

SEQ ID NO: 1802903 - DNA, 15 bp, Homo sapiens
ggagttgtattttga

SEQ ID NO: 1802904 - DNA, 17 bp, Homo sapiens
ggagtttgagacaagcc

SEQ ID NO: 1802905 - DNA, 15 bp, Homo sapiens
ggatagatgtgtgga

SEQ ID NO: 1802906 - DNA, 11 bp, Homo sapiens
ggatctgtttg

SEQ ID NO: 1802907 - DNA, 19 bp, Homo sapiens
ggatggggagaatggtcaa

SEQ ID NO: 1802908 - DNA, 17 bp, Homo sapiens
ggatgtgtggggcatgg

SEQ ID NO: 1802909 - DNA, 20 bp, Homo sapiens
ggcaaagaactgccccatct

SEQ ID NO: 1802910 - DNA, 14 bp, Homo sapiens
ggcaagcccctcag

SEQ ID NO: 1802911 - DNA, 16 bp, Homo sapiens
ggcaagcccctcagcc

SEQ ID NO: 1802912 - DNA, 19 bp, Homo sapiens
ggcaagcccctcagccctt

SEQ ID NO: 1802913 - DNA, 22 bp, Homo sapiens
ggcaagcccctcagcccttgcc

SEQ ID NO: 1802914 - DNA, 20 bp, Homo sapiens
ggcacaccactgccctgcct

SEQ ID NO: 1802915 - DNA, 23 bp, Homo sapiens
ggcacaccactgccctgcctgcc

SEQ ID NO: 1802916 - DNA, 23 bp, Homo sapiens
ggcacagttgtctattctgagcc

SEQ ID NO: 1802917 - DNA, 24 bp, Homo sapiens
ggcaccactagggtcctggccctc

SEQ ID NO: 1802918 - DNA, 14 bp, Homo sapiens
ggcacccccatgct

SEQ ID NO: 1802919 - DNA, 17 bp, Homo sapiens
ggcacccccatgctgcc

SEQ ID NO: 1802920 - DNA, 17 bp, Homo sapiens
ggcaccggcgctgcagg

SEQ ID NO: 1802921 - DNA, 13 bp, Homo sapiens
ggcacctcctgag

SEQ ID NO: 1802922 - DNA, 12 bp, Homo sapiens
ggcacctggcct

SEQ ID NO: 1802923 - DNA, 15 bp, Homo sapiens
ggcacctggcctgct

SEQ ID NO: 1802924 - DNA, 17 bp, Homo sapiens
ggcacctggcctgctgg

SEQ ID NO: 1802925 - DNA, 18 bp, Homo sapiens
ggcacctggcctgctggg

SEQ ID NO: 1802926 - DNA, 16 bp, Homo sapiens
ggcactgctgggtggc

SEQ ID NO: 1802927 - DNA, 20 bp, Homo sapiens
ggcactgctgggtggcccat

SEQ ID NO: 1802928 - DNA, 22 bp, Homo sapiens
ggcactgctgggtggcccatcc

SEQ ID NO: 1802929 - DNA, 16 bp, Homo sapiens
ggcactggtggcatcg

SEQ ID NO: 1802930 - DNA, 17 bp, Homo sapiens
ggcagaaaagaggagac

SEQ ID NO: 1802931 - DNA, 22 bp, Homo sapiens
ggcagaaaagaggagaccctgg

SEQ ID NO: 1802932 - DNA, 16 bp, Homo sapiens
ggcagagaaggcctct

SEQ ID NO: 1802933 - DNA, 13 bp, Homo sapiens
ggcagagccatgg

SEQ ID NO: 1802934 - DNA, 14 bp, Homo sapiens
ggcagagccatggg

SEQ ID NO: 1802935 - DNA, 18 bp, Homo sapiens
ggcagagccatgggcctg

SEQ ID NO: 1802936 - DNA, 19 bp, Homo sapiens
ggcagagccatgggcctgg

SEQ ID NO: 1802937 - DNA, 23 bp, Homo sapiens
ggcagagccatgggcctgggcct

SEQ ID NO: 1802938 - DNA, 20 bp, Homo sapiens
ggcagagggaatgttccctg

SEQ ID NO: 1802939 - DNA, 18 bp, Homo sapiens
ggcagaggggcagccgct

SEQ ID NO: 1802940 - DNA, 11 bp, Homo sapiens
ggcagccatgc

SEQ ID NO: 1802941 - DNA, 12 bp, Homo sapiens
ggcagccatgcc

SEQ ID NO: 1802942 - DNA, 13 bp, Homo sapiens
ggcagccatgcct

SEQ ID NO: 1802943 - DNA, 16 bp, Homo sapiens
ggcagccatgcctcat

SEQ ID NO: 1802944 - DNA, 18 bp, Homo sapiens
ggcagccccgttttgggg

SEQ ID NO: 1802945 - DNA, 19 bp, Homo sapiens
gggccagaaggagggcaga

SEQ ID NO: 1802946 - DNA, 14 bp, Homo sapiens
gggccatactggcc

SEQ ID NO: 1802947 - DNA, 12 bp, Homo sapiens
gggcccagctgt

SEQ ID NO: 1802948 - DNA, 22 bp, Homo sapiens
gggcccagctgtagccatggct

SEQ ID NO: 1802949 - DNA, 13 bp, Homo sapiens
gggccccacctac

SEQ ID NO: 1802950 - DNA, 21 bp, Homo sapiens
gggccccagatctgcctgggc

SEQ ID NO: 1802951 - DNA, 17 bp, Homo sapiens
gggccccatgctctgcc

SEQ ID NO: 1802952 - DNA, 18 bp, Homo sapiens
gggccccatgctctgccc

SEQ ID NO: 1802953 - DNA, 19 bp, Homo sapiens
gggccccatgctctgcccc

SEQ ID NO: 1802954 - DNA, 17 bp, Homo sapiens
gggccccggggctggca

SEQ ID NO: 1802955 - DNA, 13 bp, Homo sapiens
gggcccctccctc

SEQ ID NO: 1802956 - DNA, 20 bp, Homo sapiens
gggcccctccctctgcccca

SEQ ID NO: 1802957 - DNA, 13 bp, Homo sapiens
gggcccgcttgcc

SEQ ID NO: 1802958 - DNA, 20 bp, Homo sapiens
gggcccgttgtctccctggc

SEQ ID NO: 1802959 - DNA, 22 bp, Homo sapiens
gggcccgttgtctccctggccc

SEQ ID NO: 1802960 - DNA, 23 bp, Homo sapiens
gggcccgttgtctccctggccct

SEQ ID NO: 1802961 - DNA, 15 bp, Homo sapiens
gggcccttggggcct

SEQ ID NO: 1802962 - DNA, 16 bp, Homo sapiens
gggcccttggggcctg

SEQ ID NO: 1802963 - DNA, 21 bp, Homo sapiens
gggccggccaggtgggcgggc

SEQ ID NO: 1802964 - DNA, 22 bp, Homo sapiens
gggcctatcagtgtgcccccca

SEQ ID NO: 1802965 - DNA, 16 bp, Homo sapiens
gggcctggcctgagct

SEQ ID NO: 1802966 - DNA, 17 bp, Homo sapiens
gggcctggcctgagctg

SEQ ID NO: 1802967 - DNA, 17 bp, Homo sapiens
gggcctggcttgctcca

SEQ ID NO: 1802968 - DNA, 23 bp, Homo sapiens
gggcctggcttgctccagggtct

SEQ ID NO: 1802969 - DNA, 22 bp, Homo sapiens
gggcctgggggcagtgactggc

SEQ ID NO: 1802970 - DNA, 17 bp, Homo sapiens
gggcctgtgcagcagcc

SEQ ID NO: 1802971 - DNA, 21 bp, Homo sapiens
gggcctgtgcagcagcccagc

SEQ ID NO: 1802972 - DNA, 17 bp, Homo sapiens
gggcgctcaggacccag

SEQ ID NO: 1802973 - DNA, 19 bp, Homo sapiens
gggcgctcaggacccaggc

SEQ ID NO: 1802974 - DNA, 22 bp, Homo sapiens
gggcgctcaggacccaggccct

SEQ ID NO: 1802975 - DNA, 14 bp, Homo sapiens
gggctactggcagc

SEQ ID NO: 1802976 - DNA, 22 bp, Homo sapiens
gggctactggcagctcctctcc

SEQ ID NO: 1802977 - DNA, 17 bp, Homo sapiens
gggctagtgtgagtggc

SEQ ID NO: 1802978 - DNA, 16 bp, Homo sapiens
gggctatggcaagggg

SEQ ID NO: 1802979 - DNA, 13 bp, Homo sapiens
gggctatttctct

SEQ ID NO: 1802980 - DNA, 13 bp, Homo sapiens
gggctcagggctg

SEQ ID NO: 1802981 - DNA, 14 bp, Homo sapiens
gggctcagggctgg

SEQ ID NO: 1802982 - DNA, 16 bp, Homo sapiens
gggctccagcatccag

SEQ ID NO: 1802983 - DNA, 20 bp, Homo sapiens
gggctccagcatccagcctg

SEQ ID NO: 1802984 - DNA, 21 bp, Homo sapiens
gggctccagcatccagcctgt

SEQ ID NO: 1802985 - DNA, 14 bp, Homo sapiens
gggctcctggctgc

SEQ ID NO: 1802986 - DNA, 17 bp, Homo sapiens
gggctcgtggccttccc

SEQ ID NO: 1802987 - DNA, 21 bp, Homo sapiens
gggctctgccctccctccttc

SEQ ID NO: 1802988 - DNA, 19 bp, Homo sapiens
gggctctgtgggctgcact

SEQ ID NO: 1802989 - DNA, 23 bp, Homo sapiens
gggctgacacctaccatgctgct

SEQ ID NO: 1802990 - DNA, 18 bp, Homo sapiens
gggctgcactctgtgccc

SEQ ID NO: 1802991 - DNA, 19 bp, Homo sapiens
gggctgcactctgtgccca

SEQ ID NO: 1802992 - DNA, 22 bp, Homo sapiens
gggctgcccctgtaggttgctt

SEQ ID NO: 1802993 - DNA, 17 bp, Homo sapiens
gggctggagtgcgctct

SEQ ID NO: 1802994 - DNA, 16 bp, Homo sapiens
gggctggcaagcaggg

SEQ ID NO: 1802995 - DNA, 19 bp, Homo sapiens
gggctgggttggcgcaccc

SEQ ID NO: 1802996 - DNA, 23 bp, Homo sapiens
gggctgggttggcgcaccctccc

SEQ ID NO: 1802997 - DNA, 14 bp, Homo sapiens
ggggaagagcacag

SEQ ID NO: 1802998 - DNA, 19 bp, Homo sapiens
ggggagcacttgcgtcctg

SEQ ID NO: 1802999 - DNA, 15 bp, Homo sapiens
ggggcacaccactgc

SEQ ID NO: 1803000 - DNA, 21 bp, Homo sapiens
ggggcacaccactgccctgcc

SEQ ID NO: 1803001 - DNA, 22 bp, Homo sapiens
ggggcacaccactgccctgcct

SEQ ID NO: 1803002 - DNA, 18 bp, Homo sapiens
ggggcaggccctgcactg

SEQ ID NO: 1803003 - DNA, 18 bp, Homo sapiens
ggggccccggggctggca

SEQ ID NO: 1803004 - DNA, 23 bp, Homo sapiens
ggggcccgcttgcctcggctcct

SEQ ID NO: 1803005 - DNA, 19 bp, Homo sapiens
ggggcccgttgtctccctg

SEQ ID NO: 1803006 - DNA, 18 bp, Homo sapiens
ggggcccttggggcctgg

SEQ ID NO: 1803007 - DNA, 20 bp, Homo sapiens
ggggcgctcaggacccaggc

SEQ ID NO: 1803008 - DNA, 21 bp, Homo sapiens
ggggcgctcaggacccaggcc

SEQ ID NO: 1803009 - DNA, 18 bp, Homo sapiens
ggggctcgtggccttccc

SEQ ID NO: 1803010 - DNA, 24 bp, Homo sapiens
ggggctctccaaaggggctgctgg

SEQ ID NO: 1803011 - DNA, 19 bp, Homo sapiens
ggggctgcacctcctaccc

SEQ ID NO: 1803012 - DNA, 20 bp, Homo sapiens
gcagtgcctcgaggcaccgg

SEQ ID NO: 1803013 - DNA, 11 bp, Homo sapiens
gcagtgggtcc

SEQ ID NO: 1803014 - DNA, 21 bp, Homo sapiens
gcatatttctatgttgtaata

SEQ ID NO: 1803015 - DNA, 15 bp, Homo sapiens
gcatcaggcactggt

SEQ ID NO: 1803016 - DNA, 18 bp, Homo sapiens
gcatcaggcactggtggc

SEQ ID NO: 1803017 - DNA, 17 bp, Homo sapiens
gcatccagcctgtgtgt

SEQ ID NO: 1803018 - DNA, 15 bp, Homo sapiens
gcatcgtagaagaga

SEQ ID NO: 1803019 - DNA, 18 bp, Homo sapiens
gcatcgtgacccttcagg

SEQ ID NO: 1803020 - DNA, 19 bp, Homo sapiens
gcatcgtgacccttcaggg

SEQ ID NO: 1803021 - DNA, 15 bp, Homo sapiens
gcatgccccctcgtg

SEQ ID NO: 1803022 - DNA, 20 bp, Homo sapiens
gcatgccccctcgtgccagt

SEQ ID NO: 1803023 - DNA, 22 bp, Homo sapiens
gcatggttccttccctgggaag

SEQ ID NO: 1803024 - DNA, 15 bp, Homo sapiens
gcatgtgtgcctgtg

SEQ ID NO: 1803025 - DNA, 15 bp, Homo sapiens
gcattccatgaccag

SEQ ID NO: 1803026 - DNA, 16 bp, Homo sapiens
gcattgggctgacacc

SEQ ID NO: 1803027 - DNA, 21 bp, Homo sapiens
gcatttggtaggaagcctgag

SEQ ID NO: 1803028 - DNA, 16 bp, Homo sapiens
gccaaagcaaaagaag

SEQ ID NO: 1803029 - DNA, 21 bp, Homo sapiens
gccaaagcaaaagaagtaaaa

SEQ ID NO: 1803030 - DNA, 23 bp, Homo sapiens
gccaactaagccctcgaaccaag

SEQ ID NO: 1803031 - DNA, 15 bp, Homo sapiens
gccaaggctctcccc

SEQ ID NO: 1803032 - DNA, 18 bp, Homo sapiens
gccaaggctctcccctct

SEQ ID NO: 1803033 - DNA, 19 bp, Homo sapiens
gccaaggctctcccctctc

SEQ ID NO: 1803034 - DNA, 15 bp, Homo sapiens
gccaagtttttcaga

SEQ ID NO: 1803035 - DNA, 16 bp, Homo sapiens
gccaagtttttcagaa

SEQ ID NO: 1803036 - DNA, 22 bp, Homo sapiens
gccacaaatcaaagcaagggct

SEQ ID NO: 1803037 - DNA, 23 bp, Homo sapiens
gccacaaatcaaagcaagggctc

SEQ ID NO: 1803038 - DNA, 16 bp, Homo sapiens
gccacaccaagctgtg

SEQ ID NO: 1803039 - DNA, 17 bp, Homo sapiens
gccacaccaagctgtgc

SEQ ID NO: 1803040 - DNA, 19 bp, Homo sapiens
gccacaccaagctgtgcca

SEQ ID NO: 1803041 - DNA, 23 bp, Homo sapiens
gccacaccaagctgtgccaccct

SEQ ID NO: 1803042 - DNA, 16 bp, Homo sapiens
gccacacccaggaagg

SEQ ID NO: 1803043 - DNA, 19 bp, Homo sapiens
gccaccacgtctgccaggc

SEQ ID NO: 1803044 - DNA, 16 bp, Homo sapiens
gccaccccaaacccca

SEQ ID NO: 1803045 - DNA, 12 bp, Homo sapiens
gccacctgtctg

SEQ ID NO: 1803046 - DNA, 13 bp, Homo sapiens
gccactccctgag

SEQ ID NO: 1803047 - DNA, 15 bp, Homo sapiens
gccactccctgagct

SEQ ID NO: 1803048 - DNA, 20 bp, Homo sapiens
gccactccctgagctttggg

SEQ ID NO: 1803049 - DNA, 13 bp, Homo sapiens
gccactcctgtcc

SEQ ID NO: 1803050 - DNA, 17 bp, Homo sapiens
gccactcctgtcccgcc

SEQ ID NO: 1803051 - DNA, 18 bp, Homo sapiens
gccactcctgtcccgcct

SEQ ID NO: 1803052 - DNA, 22 bp, Homo sapiens
gccactcgcagtcgcaggatcc

SEQ ID NO: 1803053 - DNA, 16 bp, Homo sapiens
gccactgccaggcacc

SEQ ID NO: 1803054 - DNA, 18 bp, Homo sapiens
gccactgccaggcacctg

SEQ ID NO: 1803055 - DNA, 19 bp, Homo sapiens
gccactgccaggcacctgg

SEQ ID NO: 1803056 - DNA, 21 bp, Homo sapiens
gccactgccaggcacctggcc

SEQ ID NO: 1803057 - DNA, 23 bp, Homo sapiens
gccactgccaggcacctggcctg

SEQ ID NO: 1803058 - DNA, 16 bp, Homo sapiens
gccacttatttccatg

SEQ ID NO: 1803059 - DNA, 20 bp, Homo sapiens
gccacttcttaaaggcctgg

SEQ ID NO: 1803060 - DNA, 14 bp, Homo sapiens
gccagaaggagggc

SEQ ID NO: 1803061 - DNA, 18 bp, Homo sapiens
gccagaaggagggcagag

SEQ ID NO: 1803062 - DNA, 21 bp, Homo sapiens
gccagaaggagggcagagcca

SEQ ID NO: 1803063 - DNA, 15 bp, Homo sapiens
gccagagaggagcac

SEQ ID NO: 1803064 - DNA, 23 bp, Homo sapiens
gccagagaggagcacctgaaccc

SEQ ID NO: 1803065 - DNA, 14 bp, Homo sapiens
gccagagagggccc

SEQ ID NO: 1803066 - DNA, 15 bp, Homo sapiens
gccagagagggccca

SEQ ID NO: 1803067 - DNA, 20 bp, Homo sapiens
gccagagagggcccagctgt

SEQ ID NO: 1803068 - DNA, 24 bp, Homo sapiens
gccagagagggcccagctgtagcc

SEQ ID NO: 1803069 - DNA, 15 bp, Homo sapiens
gccagagctggaagg

SEQ ID NO: 1803070 - DNA, 22 bp, Homo sapiens
gccagagctggaaggcagggca

SEQ ID NO: 1803071 - DNA, 23 bp, Homo sapiens
gccagagctggaaggcagggcag

SEQ ID NO: 1803072 - DNA, 15 bp, Homo sapiens
gccagccccacagcc

SEQ ID NO: 1803073 - DNA, 18 bp, Homo sapiens
gccagccccacagcccac

SEQ ID NO: 1803074 - DNA, 19 bp, Homo sapiens
gccagccccacagcccacg

SEQ ID NO: 1803075 - DNA, 21 bp, Homo sapiens
gccagcccttccctggccccg

SEQ ID NO: 1803076 - DNA, 15 bp, Homo sapiens
gccagcctgggactc

SEQ ID NO: 1803077 - DNA, 21 bp, Homo sapiens
gccagcctgggactcccagtg

SEQ ID NO: 1803078 - DNA, 16 bp, Homo sapiens
gccaggagtctgtgct

SEQ ID NO: 1803079 - DNA, 23 bp, Homo sapiens
gccaggcacctggcctgctggga

SEQ ID NO: 1803080 - DNA, 18 bp, Homo sapiens
gccaggcccatctcaggt

SEQ ID NO: 1803081 - DNA, 23 bp, Homo sapiens
gccaggcccatctcaggtgccac

SEQ ID NO: 1803082 - DNA, 19 bp, Homo sapiens
gccaggtgggcgggcagca

SEQ ID NO: 1803083 - DNA, 14 bp, Homo sapiens
gccagtcgcgctgc

SEQ ID NO: 1803084 - DNA, 18 bp, Homo sapiens
gccagtcttgcctaggcc

SEQ ID NO: 1803085 - DNA, 21 bp, Homo sapiens
gccagtgaagtccttcagtga

SEQ ID NO: 1803086 - DNA, 18 bp, Homo sapiens
gccatacattaaggagca

SEQ ID NO: 1803087 - DNA, 18 bp, Homo sapiens
gccatactggcctcgcct

SEQ ID NO: 1803088 - DNA, 19 bp, Homo sapiens
gccatactggcctcgcctg

SEQ ID NO: 1803089 - DNA, 21 bp, Homo sapiens
gccatactggcctcgcctggc

SEQ ID NO: 1803090 - DNA, 13 bp, Homo sapiens
gccatagccccat

SEQ ID NO: 1803091 - DNA, 21 bp, Homo sapiens
gccatattttaaaaaatcaaa

SEQ ID NO: 1803092 - DNA, 14 bp, Homo sapiens
gccatgccactgcc

SEQ ID NO: 1803093 - DNA, 22 bp, Homo sapiens
gccatgccactgccaggcacct

SEQ ID NO: 1803094 - DNA, 23 bp, Homo sapiens
gccatgccactgccaggcacctg

SEQ ID NO: 1803095 - DNA, 19 bp, Homo sapiens
gccatgctcaacccccctc

SEQ ID NO: 1803096 - DNA, 21 bp, Homo sapiens
gccatgctcaacccccctccc

SEQ ID NO: 1803097 - DNA, 13 bp, Homo sapiens
gccatggctcagg

SEQ ID NO: 1803098 - DNA, 14 bp, Homo sapiens
gccatggctcaggc

SEQ ID NO: 1803099 - DNA, 20 bp, Homo sapiens
gccatggctcaggcaagccc

SEQ ID NO: 1803100 - DNA, 21 bp, Homo sapiens
gccatggctcaggcaagcccc

SEQ ID NO: 1803101 - DNA, 19 bp, Homo sapiens
gccatggcttccaaggtgg

SEQ ID NO: 1803102 - DNA, 15 bp, Homo sapiens
gccatgtcttgttca

SEQ ID NO: 1803103 - DNA, 12 bp, Homo sapiens
gccatgtgtcat

SEQ ID NO: 1803104 - DNA, 16 bp, Homo sapiens
gcccaccgcatgcccc

SEQ ID NO: 1803105 - DNA, 17 bp, Homo sapiens
gcccaccgcatgccccc

SEQ ID NO: 1803106 - DNA, 18 bp, Homo sapiens
gcccaccgcatgccccct

SEQ ID NO: 1803107 - DNA, 14 bp, Homo sapiens
gcccacgtcctgtc

SEQ ID NO: 1803108 - DNA, 12 bp, Homo sapiens
gcccagctcccc

SEQ ID NO: 1803109 - DNA, 16 bp, Homo sapiens
gccgcctcgcccaccg

SEQ ID NO: 1803110 - DNA, 17 bp, Homo sapiens
gccgctaggagagactg

SEQ ID NO: 1803111 - DNA, 18 bp, Homo sapiens
gccgctaggagagactga

SEQ ID NO: 1803112 - DNA, 19 bp, Homo sapiens
gccgctaggagagactgaa

SEQ ID NO: 1803113 - DNA, 16 bp, Homo sapiens
gccgtccatggcacca

SEQ ID NO: 1803114 - DNA, 17 bp, Homo sapiens
gccgtccatggcaccag

SEQ ID NO: 1803115 - DNA, 20 bp, Homo sapiens
gccgtccatggcaccagccc

SEQ ID NO: 1803116 - DNA, 21 bp, Homo sapiens
gccgtccatggcaccagcccc

SEQ ID NO: 1803117 - DNA, 14 bp, Homo sapiens
gccgtctgactcca

SEQ ID NO: 1803118 - DNA, 16 bp, Homo sapiens
gccgtctgactccaga

SEQ ID NO: 1803119 - DNA, 21 bp, Homo sapiens
gccgtctgactccagagtctg

SEQ ID NO: 1803120 - DNA, 15 bp, Homo sapiens
gccgttccccttggc

SEQ ID NO: 1803121 - DNA, 14 bp, Homo sapiens
gcctatcagtgtgc

SEQ ID NO: 1803122 - DNA, 15 bp, Homo sapiens
gcctatcagtgtgcc

SEQ ID NO: 1803123 - DNA, 16 bp, Homo sapiens
gcctatccatcctgcg

SEQ ID NO: 1803124 - DNA, 13 bp, Homo sapiens
gcctcactggctg

SEQ ID NO: 1803125 - DNA, 14 bp, Homo sapiens
gcctcactggctgg

SEQ ID NO: 1803126 - DNA, 22 bp, Homo sapiens
gcctcactggctggggcagagg

SEQ ID NO: 1803127 - DNA, 17 bp, Homo sapiens
gcctcatccctcggaag

SEQ ID NO: 1803128 - DNA, 14 bp, Homo sapiens
gcctccactcccac

SEQ ID NO: 1803129 - DNA, 19 bp, Homo sapiens
gcctccactcccccacctg

SEQ ID NO: 1803130 - DNA, 23 bp, Homo sapiens
gcctccagagccagcctgggact

SEQ ID NO: 1803131 - DNA, 12 bp, Homo sapiens
gcctccagcctc

SEQ ID NO: 1803132 - DNA, 20 bp, Homo sapiens
gcctccagcctctcccggct

SEQ ID NO: 1803133 - DNA, 22 bp, Homo sapiens
gcctccagcctctcccggctgc

SEQ ID NO: 1803134 - DNA, 23 bp, Homo sapiens
gcctccagcctctcccggctgcc

SEQ ID NO: 1803135 - DNA, 19 bp, Homo sapiens
gcctcccaataaagctgga

SEQ ID NO: 1803136 - DNA, 13 bp, Homo sapiens
gcctcccacagtg

SEQ ID NO: 1803137 - DNA, 16 bp, Homo sapiens
gcctcccacagtgact

SEQ ID NO: 1803138 - DNA, 17 bp, Homo sapiens
gcctcccctcccctggg

SEQ ID NO: 1803139 - DNA, 20 bp, Homo sapiens
gcctcccctcccctggggac

SEQ ID NO: 1803140 - DNA, 19 bp, Homo sapiens
gcctccgtttatgggcctt

SEQ ID NO: 1803141 - DNA, 22 bp, Homo sapiens
gcctccgtttatgggccttgct

SEQ ID NO: 1803142 - DNA, 14 bp, Homo sapiens
gctcaggcaagccc

SEQ ID NO: 1803143 - DNA, 20 bp, Homo sapiens
gctcaggcaagcccctcagc

SEQ ID NO: 1803144 - DNA, 23 bp, Homo sapiens
gctcaggcaagcccctcagccct

SEQ ID NO: 1803145 - DNA, 16 bp, Homo sapiens
gctcagggaccacagc

SEQ ID NO: 1803146 - DNA, 23 bp, Homo sapiens
gctcagggctggagtgcgctctt

SEQ ID NO: 1803147 - DNA, 22 bp, Homo sapiens
gctcatggcgtaatgggcctgc

SEQ ID NO: 1803148 - DNA, 12 bp, Homo sapiens
gctccacagtgt

SEQ ID NO: 1803149 - DNA, 13 bp, Homo sapiens
gctccagcatcca

SEQ ID NO: 1803150 - DNA, 16 bp, Homo sapiens
gctccagcatccagcc

SEQ ID NO: 1803151 - DNA, 17 bp, Homo sapiens
gctccagcatccagcct

SEQ ID NO: 1803152 - DNA, 14 bp, Homo sapiens
gctccagggtcttg

SEQ ID NO: 1803153 - DNA, 22 bp, Homo sapiens
gctccagggtcttgggctactg

SEQ ID NO: 1803154 - DNA, 23 bp, Homo sapiens
gctccagggtcttgggctactgg

SEQ ID NO: 1803155 - DNA, 16 bp, Homo sapiens
gctcccacagcttcct

SEQ ID NO: 1803156 - DNA, 18 bp, Homo sapiens
gctcccacagcttcctga

SEQ ID NO: 1803157 - DNA, 22 bp, Homo sapiens
gctcccacagcttcctgagggc

SEQ ID NO: 1803158 - DNA, 13 bp, Homo sapiens
gctcccagtgtct

SEQ ID NO: 1803159 - DNA, 23 bp, Homo sapiens
gctcccagtgtcttcctgtgggg

SEQ ID NO: 1803160 - DNA, 12 bp, Homo sapiens
gctccccacgag

SEQ ID NO: 1803161 - DNA, 23 bp, Homo sapiens
gctccccacgagtcacctgcaag

SEQ ID NO: 1803162 - DNA, 24 bp, Homo sapiens
gctccccacgagtcacctgcaagc

SEQ ID NO: 1803163 - DNA, 22 bp, Homo sapiens
gctccctcaaatgacagaccta

SEQ ID NO: 1803164 - DNA, 11 bp, Homo sapiens
gctcctgctgc

SEQ ID NO: 1803165 - DNA, 14 bp, Homo sapiens
gctcctgctgcacc

SEQ ID NO: 1803166 - DNA, 15 bp, Homo sapiens
gctcctgctgcacca

SEQ ID NO: 1803167 - DNA, 12 bp, Homo sapiens
gctcctggctgc

SEQ ID NO: 1803168 - DNA, 15 bp, Homo sapiens
gctcctggctgccag

SEQ ID NO: 1803169 - DNA, 18 bp, Homo sapiens
gctcctggctgccaggcg

SEQ ID NO: 1803170 - DNA, 19 bp, Homo sapiens
gctcctggctgccaggcgt

SEQ ID NO: 1803171 - DNA, 12 bp, Homo sapiens
gctcgtgcagta

SEQ ID NO: 1803172 - DNA, 13 bp, Homo sapiens
gctcgtggccttc

SEQ ID NO: 1803173 - DNA, 14 bp, Homo sapiens
gctctagccaggag

SEQ ID NO: 1803174 - DNA, 24 bp, Homo sapiens
gctctagccaggagtctgtgctct

SEQ ID NO: 1803175 - DNA, 19 bp, Homo sapiens
gctctagctggcaggacac

SEQ ID NO: 1803176 - DNA, 14 bp, Homo sapiens
gctctcaagtgaaa

SEQ ID NO: 1803177 - DNA, 17 bp, Homo sapiens
gctctccaaaggggctg

SEQ ID NO: 1803178 - DNA, 22 bp, Homo sapiens
gctctcccctctcgccccatcc

SEQ ID NO: 1803179 - DNA, 18 bp, Homo sapiens
gctctcctaccccacctc

SEQ ID NO: 1803180 - DNA, 14 bp, Homo sapiens
gctctgccccaagc

SEQ ID NO: 1803181 - DNA, 20 bp, Homo sapiens
gctctggcggcttcctgtcc

SEQ ID NO: 1803182 - DNA, 15 bp, Homo sapiens
gctctgggctcaggg

SEQ ID NO: 1803183 - DNA, 20 bp, Homo sapiens
gctctgggctcagggctgga

SEQ ID NO: 1803184 - DNA, 12 bp, Homo sapiens
gctctgtggcct

SEQ ID NO: 1803185 - DNA, 14 bp, Homo sapiens
gctctgtggcctgt

SEQ ID NO: 1803186 - DNA, 17 bp, Homo sapiens
gctctgtggcctgtgtc

SEQ ID NO: 1803187 - DNA, 20 bp, Homo sapiens
gctctgtggcctgtgtccag

SEQ ID NO: 1803188 - DNA, 14 bp, Homo sapiens
gctctgtgggctgc

SEQ ID NO: 1803189 - DNA, 23 bp, Homo sapiens
gctcttcaagctgtcccctctgt

SEQ ID NO: 1803190 - DNA, 24 bp, Homo sapiens
gctcttcaagctgtcccctctgtc

SEQ ID NO: 1803191 - DNA, 20 bp, Homo sapiens
gctcttcctggacctgagtc

SEQ ID NO: 1803192 - DNA, 19 bp, Homo sapiens
gctcttctgtatgtgacaa

SEQ ID NO: 1803193 - DNA, 15 bp, Homo sapiens
gctcttggtccctgg

SEQ ID NO: 1803194 - DNA, 20 bp, Homo sapiens
gctcttggtccctggtccct

SEQ ID NO: 1803195 - DNA, 24 bp, Homo sapiens
gctcttttggtggggagcacttgc

SEQ ID NO: 1803196 - DNA, 20 bp, Homo sapiens
gctgaaaaacacaacttgtg

SEQ ID NO: 1803197 - DNA, 13 bp, Homo sapiens
gctgaaaaagaaa

SEQ ID NO: 1803198 - DNA, 15 bp, Homo sapiens
gctgaaaaagaaaaa

SEQ ID NO: 1803199 - DNA, 20 bp, Homo sapiens
gctgacacctaccatgctgc

SEQ ID NO: 1803200 - DNA, 22 bp, Homo sapiens
gctgacacctaccatgctgctt

SEQ ID NO: 1803201 - DNA, 16 bp, Homo sapiens
gctgacagtcctctcc

SEQ ID NO: 1803202 - DNA, 14 bp, Homo sapiens
gctgagctggccta

SEQ ID NO: 1803203 - DNA, 16 bp, Homo sapiens
gctgagcttagccttg

SEQ ID NO: 1803204 - DNA, 18 bp, Homo sapiens
gctgagtccctccatgca

SEQ ID NO: 1803205 - DNA, 20 bp, Homo sapiens
gctgatttccaggcccctga

SEQ ID NO: 1803206 - DNA, 21 bp, Homo sapiens
gctgatttccaggcccctgag

SEQ ID NO: 1803207 - DNA, 22 bp, Homo sapiens
gctgatttccaggcccctgagg

SEQ ID NO: 1803208 - DNA, 23 bp, Homo sapiens
gctgatttccaggcccctgagga

SEQ ID NO: 1803209 - DNA, 14 bp, Homo sapiens
gctgcactctgtgc

SEQ ID NO: 1803210 - DNA, 18 bp, Homo sapiens
gctgcactctgtgcccat

SEQ ID NO: 1803211 - DNA, 22 bp, Homo sapiens
gctgcactctgtgcccatgggc

SEQ ID NO: 1803212 - DNA, 20 bp, Homo sapiens
ggaagagggcagtacctggg

SEQ ID NO: 1803213 - DNA, 17 bp, Homo sapiens
ggaagccgtctgactcc

SEQ ID NO: 1803214 - DNA, 19 bp, Homo sapiens
ggaagctgtactcagagca

SEQ ID NO: 1803215 - DNA, 23 bp, Homo sapiens
ggaagctgtactcagagcagagc

SEQ ID NO: 1803216 - DNA, 14 bp, Homo sapiens
ggaaggcagctgct

SEQ ID NO: 1803217 - DNA, 16 bp, Homo sapiens
ggaatagccagagagg

SEQ ID NO: 1803218 - DNA, 21 bp, Homo sapiens
ggaatagccagagaggagcac

SEQ ID NO: 1803219 - DNA, 20 bp, Homo sapiens
ggaatgcagggaagagggca

SEQ ID NO: 1803220 - DNA, 19 bp, Homo sapiens
ggaatgttccctgcaccct

SEQ ID NO: 1803221 - DNA, 13 bp, Homo sapiens
ggaattacatttt

SEQ ID NO: 1803222 - DNA, 16 bp, Homo sapiens
ggaattcagcaccctg

SEQ ID NO: 1803223 - DNA, 23 bp, Homo sapiens
ggaattttctttcatacattata

SEQ ID NO: 1803224 - DNA, 14 bp, Homo sapiens
ggacaacctgcccc

SEQ ID NO: 1803225 - DNA, 17 bp, Homo sapiens
ggacacatcccggcctc

SEQ ID NO: 1803226 - DNA, 22 bp, Homo sapiens
ggacacatcccggcctcttcca

SEQ ID NO: 1803227 - DNA, 12 bp, Homo sapiens
ggacacatgtcc

SEQ ID NO: 1803228 - DNA, 13 bp, Homo sapiens
ggacacctgccct

SEQ ID NO: 1803229 - DNA, 19 bp, Homo sapiens
ggacagtatttgtggggag

SEQ ID NO: 1803230 - DNA, 14 bp, Homo sapiens
ggacagttggcaga

SEQ ID NO: 1803231 - DNA, 18 bp, Homo sapiens
ggacagttggcagagaag

SEQ ID NO: 1803232 - DNA, 20 bp, Homo sapiens
ggaccacagcaaggcacctg

SEQ ID NO: 1803233 - DNA, 20 bp, Homo sapiens
ggacccaccaaactgcacac

SEQ ID NO: 1803234 - DNA, 22 bp, Homo sapiens
ggacccacccatcttcctgctg

SEQ ID NO: 1803235 - DNA, 22 bp, Homo sapiens
ggacccagctactctgtccagg

SEQ ID NO: 1803236 - DNA, 11 bp, Homo sapiens
ggacccaggcc

SEQ ID NO: 1803237 - DNA, 14 bp, Homo sapiens
ggacccaggccctc

SEQ ID NO: 1803238 - DNA, 18 bp, Homo sapiens
ggacccaggccctccatg

SEQ ID NO: 1803239 - DNA, 15 bp, Homo sapiens
ggaccgggtgggcct

SEQ ID NO: 1803240 - DNA, 16 bp, Homo sapiens
ggaccgggtgggcctg

SEQ ID NO: 1803241 - DNA, 17 bp, Homo sapiens
ggaccgggtgggcctgg

SEQ ID NO: 1803242 - DNA, 20 bp, Homo sapiens
ggaccgggtgggcctggcct

SEQ ID NO: 1803243 - DNA, 13 bp, Homo sapiens
ggacggggccggc

SEQ ID NO: 1803244 - DNA, 19 bp, Homo sapiens
ggactggtggcccctgcct

SEQ ID NO: 1803245 - DNA, 20 bp, Homo sapiens
ggagaaggaaaaagaaagta

SEQ ID NO: 1803246 - DNA, 15 bp, Homo sapiens
ggagaccgcttcacc

SEQ ID NO: 1803247 - DNA, 19 bp, Homo sapiens
ggagaccgcttcacccctg

SEQ ID NO: 1803248 - DNA, 19 bp, Homo sapiens
ggagagactgaaagcagca

SEQ ID NO: 1803249 - DNA, 20 bp, Homo sapiens
ggagagactgaaagcagcag

SEQ ID NO: 1803250 - DNA, 22 bp, Homo sapiens
ggagagactgaaagcagcagct

SEQ ID NO: 1803251 - DNA, 22 bp, Homo sapiens
ggagagagcagcttctgccact

SEQ ID NO: 1803252 - DNA, 21 bp, Homo sapiens
ggagagtggttgttgccaact

SEQ ID NO: 1803253 - DNA, 19 bp, Homo sapiens
ggagagttctttgctgccc

SEQ ID NO: 1803254 - DNA, 22 bp, Homo sapiens
ggagagttctttgctgcccctg

SEQ ID NO: 1803255 - DNA, 13 bp, Homo sapiens
ggagcaaacagct

SEQ ID NO: 1803256 - DNA, 22 bp, Homo sapiens
ggagcacctgaaccccatgggc

SEQ ID NO: 1803257 - DNA, 20 bp, Homo sapiens
ggagcacttgcgtcctgcag

SEQ ID NO: 1803258 - DNA, 21 bp, Homo sapiens
ggagcacttgcgtcctgcaga

SEQ ID NO: 1803259 - DNA, 15 bp, Homo sapiens
ggagcatttttcaga

SEQ ID NO: 1803260 - DNA, 16 bp, Homo sapiens
ggagcatttttcagag

SEQ ID NO: 1803261 - DNA, 15 bp, Homo sapiens
ggagcccgtgcagta

SEQ ID NO: 1803262 - DNA, 17 bp, Homo sapiens
ggagctgatttccaggc

SEQ ID NO: 1803263 - DNA, 23 bp, Homo sapiens
gaggggcaggccctgcactgtcc

SEQ ID NO: 1803264 - DNA, 20 bp, Homo sapiens
gagggggcgctcaggaccca

SEQ ID NO: 1803265 - DNA, 15 bp, Homo sapiens
gaggggtgcacccac

SEQ ID NO: 1803266 - DNA, 23 bp, Homo sapiens
gagggttgggcgtgctacctgca

SEQ ID NO: 1803267 - DNA, 15 bp, Homo sapiens
gaggtgagaccacct

SEQ ID NO: 1803268 - DNA, 16 bp, Homo sapiens
gaggtgggcagctggg

SEQ ID NO: 1803269 - DNA, 17 bp, Homo sapiens
gaggtgggcagctgggc

SEQ ID NO: 1803270 - DNA, 18 bp, Homo sapiens
gaggtgggcagctgggcc

SEQ ID NO: 1803271 - DNA, 21 bp, Homo sapiens
gaggttaaggtgggtccagga

SEQ ID NO: 1803272 - DNA, 14 bp, Homo sapiens
gaggttatctgcct

SEQ ID NO: 1803273 - DNA, 15 bp, Homo sapiens
gaggttatctgcctg

SEQ ID NO: 1803274 - DNA, 18 bp, Homo sapiens
gaggttatctgcctggcc

SEQ ID NO: 1803275 - DNA, 18 bp, Homo sapiens
gagtatgtacgtacgtat

SEQ ID NO: 1803276 - DNA, 17 bp, Homo sapiens
gagtattaagaatgcag

SEQ ID NO: 1803277 - DNA, 15 bp, Homo sapiens
gagtcaactggctgg

SEQ ID NO: 1803278 - DNA, 12 bp, Homo sapiens
gagtcacctgca

SEQ ID NO: 1803279 - DNA, 17 bp, Homo sapiens
gagtcacctgcaagccc

SEQ ID NO: 1803280 - DNA, 22 bp, Homo sapiens
gagtcacctgcaagccccaggg

SEQ ID NO: 1803281 - DNA, 23 bp, Homo sapiens
gagtcacctgcaagccccagggc

SEQ ID NO: 1803282 - DNA, 16 bp, Homo sapiens
gagtcattaccacgcc

SEQ ID NO: 1803283 - DNA, 14 bp, Homo sapiens
gagtctgtgctctt

SEQ ID NO: 1803284 - DNA, 19 bp, Homo sapiens
gagtgaaagggctatggca

SEQ ID NO: 1803285 - DNA, 24 bp, Homo sapiens
gagtgacctcacttctggcactgt

SEQ ID NO: 1803286 - DNA, 18 bp, Homo sapiens
gagtgaggcttccaggct

SEQ ID NO: 1803287 - DNA, 19 bp, Homo sapiens
gagtgaggcttccaggctc

SEQ ID NO: 1803288 - DNA, 21 bp, Homo sapiens
gagtgcgctcttggtccctgg

SEQ ID NO: 1803289 - DNA, 23 bp, Homo sapiens
gagtgcgctcttggtccctggtc

SEQ ID NO: 1803290 - DNA, 13 bp, Homo sapiens
gagtggaatgcag

SEQ ID NO: 1803291 - DNA, 16 bp, Homo sapiens
gagtggaatgcaggga

SEQ ID NO: 1803292 - DNA, 18 bp, Homo sapiens
gagtggcagccatgcctc

SEQ ID NO: 1803293 - DNA, 19 bp, Homo sapiens
gagtggcagccatgcctca

SEQ ID NO: 1803294 - DNA, 13 bp, Homo sapiens
gagtgtgtaattt

SEQ ID NO: 1803295 - DNA, 19 bp, Homo sapiens
gagttacttgtctgaggcc

SEQ ID NO: 1803296 - DNA, 15 bp, Homo sapiens
gagtttctttcagat

SEQ ID NO: 1803297 - DNA, 17 bp, Homo sapiens
gagtttgagacaagccc

SEQ ID NO: 1803298 - DNA, 20 bp, Homo sapiens
gagtttgagacaagccctgg

SEQ ID NO: 1803299 - DNA, 15 bp, Homo sapiens
gataaattacattaa

SEQ ID NO: 1803300 - DNA, 12 bp, Homo sapiens
gatacagaatga

SEQ ID NO: 1803301 - DNA, 13 bp, Homo sapiens
gatagatgtgtgg

SEQ ID NO: 1803302 - DNA, 18 bp, Homo sapiens
gatatacttaagttatgt

SEQ ID NO: 1803303 - DNA, 19 bp, Homo sapiens
gatatggcatcgttgcatt

SEQ ID NO: 1803304 - DNA, 17 bp, Homo sapiens
gatattgttataaataa

SEQ ID NO: 1803305 - DNA, 14 bp, Homo sapiens
gatccgctgccacc

SEQ ID NO: 1803306 - DNA, 14 bp, Homo sapiens
gatcgcttgagccc

SEQ ID NO: 1803307 - DNA, 16 bp, Homo sapiens
gatcgcttgagcccag

SEQ ID NO: 1803308 - DNA, 17 bp, Homo sapiens
gatcgcttgagcccagg

SEQ ID NO: 1803309 - DNA, 19 bp, Homo sapiens
gatctgatggtgagctggg

SEQ ID NO: 1803310 - DNA, 12 bp, Homo sapiens
gatctgcctggg

SEQ ID NO: 1803311 - DNA, 14 bp, Homo sapiens
gatctgcctgggcc

SEQ ID NO: 1803312 - DNA, 18 bp, Homo sapiens
gatctgcctgggcctgtg

SEQ ID NO: 1803313 - DNA, 21 bp, Homo sapiens
gatctggggactgagtgtggg

SEQ ID NO: 1803314 - DNA, 21 bp, Homo sapiens
gatgagatttgccagcacagg

SEQ ID NO: 1803315 - DNA, 18 bp, Homo sapiens
gatgatttcagaaggaga

SEQ ID NO: 1803316 - DNA, 12 bp, Homo sapiens
gatgctgggctg

SEQ ID NO: 1803317 - DNA, 20 bp, Homo sapiens
gatggaccgggtgggcctgg

SEQ ID NO: 1803318 - DNA, 16 bp, Homo sapiens
gatggagtgttttagt

SEQ ID NO: 1803319 - DNA, 20 bp, Homo sapiens
gatggcaaagaaggagagca

SEQ ID NO: 1803320 - DNA, 14 bp, Homo sapiens
gatggccaagagca

SEQ ID NO: 1803321 - DNA, 15 bp, Homo sapiens
gatggccaagagcat

SEQ ID NO: 1803322 - DNA, 22 bp, Homo sapiens
gatggccaagggggtggacgca

SEQ ID NO: 1803323 - DNA, 18 bp, Homo sapiens
gatgggcattgggctgac

SEQ ID NO: 1803324 - DNA, 22 bp, Homo sapiens
gatgggcattgggctgacacct

SEQ ID NO: 1803325 - DNA, 21 bp, Homo sapiens
gatgggctgtttcgtgtagtg

SEQ ID NO: 1803326 - DNA, 13 bp, Homo sapiens
gatggtgagctgg

SEQ ID NO: 1803327 - DNA, 21 bp, Homo sapiens
gatgtgtcctgataagctgag

SEQ ID NO: 1803328 - DNA, 13 bp, Homo sapiens
gatgtgtggggca

SEQ ID NO: 1803329 - DNA, 16 bp, Homo sapiens
gatgtgtggggcatgg

SEQ ID NO: 1803330 - DNA, 16 bp, Homo sapiens
gattaaagagattgtg

SEQ ID NO: 1803331 - DNA, 13 bp, Homo sapiens
gattcctgggcct

SEQ ID NO: 1803332 - DNA, 15 bp, Homo sapiens
gattcctgggcctgt

SEQ ID NO: 1803333 - DNA, 18 bp, Homo sapiens
gatttcaaggccatattt

SEQ ID NO: 1803334 - DNA, 22 bp, Homo sapiens
gatttcaaggccatattttaaa

SEQ ID NO: 1803335 - DNA, 12 bp, Homo sapiens
gatttccaggcc

SEQ ID NO: 1803336 - DNA, 17 bp, Homo sapiens
gatttccaggcccctga

SEQ ID NO: 1803337 - DNA, 18 bp, Homo sapiens
gatttccaggcccctgag

SEQ ID NO: 1803338 - DNA, 18 bp, Homo sapiens
gatttcccgtggccccag

SEQ ID NO: 1803339 - DNA, 20 bp, Homo sapiens
gatttctaagttaaatcatt

SEQ ID NO: 1803340 - DNA, 17 bp, Homo sapiens
gatttcttcgctgctct

SEQ ID NO: 1803341 - DNA, 24 bp, Homo sapiens
gatttcttcgctgctctagctggc

SEQ ID NO: 1803342 - DNA, 12 bp, Homo sapiens
gatttgccagca

SEQ ID NO: 1803343 - DNA, 15 bp, Homo sapiens
gatttgccagcacag

SEQ ID NO: 1803344 - DNA, 20 bp, Homo sapiens
gatttgccagcacaggggcc

SEQ ID NO: 1803345 - DNA, 20 bp, Homo sapiens
gatttggggctcagagtggg

SEQ ID NO: 1803346 - DNA, 14 bp, Homo sapiens
gattttcttttgtt

SEQ ID NO: 1803347 - DNA, 18 bp, Homo sapiens
gcaaaacacgcaagggca

SEQ ID NO: 1803348 - DNA, 18 bp, Homo sapiens
gcaaaagccaagaaagta

SEQ ID NO: 1803349 - DNA, 15 bp, Homo sapiens
gcaaaatttctgtat

SEQ ID NO: 1803350 - DNA, 17 bp, Homo sapiens
gcaaagaactgccccat

SEQ ID NO: 1803351 - DNA, 18 bp, Homo sapiens
gcaaatattagcaaagaa

SEQ ID NO: 1803352 - DNA, 13 bp, Homo sapiens
gcaacccctgtac

SEQ ID NO: 1803353 - DNA, 21 bp, Homo sapiens
gcaacccctgtacccagctcc

SEQ ID NO: 1803354 - DNA, 16 bp, Homo sapiens
gcaactagccaaggct

SEQ ID NO: 1803355 - DNA, 13 bp, Homo sapiens
gcaactccttact

SEQ ID NO: 1803356 - DNA, 13 bp, Homo sapiens
gcaagagaacatt

SEQ ID NO: 1803357 - DNA, 13 bp, Homo sapiens
gcaagcagggaaa

SEQ ID NO: 1803358 - DNA, 22 bp, Homo sapiens
gcaagcagggaaagctccacgg

SEQ ID NO: 1803359 - DNA, 19 bp, Homo sapiens
gcaagccccagggcctggg

SEQ ID NO: 1803360 - DNA, 16 bp, Homo sapiens
gcaaggaggctggctg

SEQ ID NO: 1803361 - DNA, 10 bp, Homo sapiens
gcaagggctc

SEQ ID NO: 1803362 - DNA, 11 bp, Homo sapiens
gcaagggctcc

SEQ ID NO: 1803363 - DNA, 15 bp, Homo sapiens
gcaagggctccagca

SEQ ID NO: 1803364 - DNA, 19 bp, Homo sapiens
gcaagggctccagcatcca

SEQ ID NO: 1803365 - DNA, 20 bp, Homo sapiens
gcaagggctccagcatccag

SEQ ID NO: 1803366 - DNA, 22 bp, Homo sapiens
gcaagggggtgtcatctgagga

SEQ ID NO: 1803367 - DNA, 17 bp, Homo sapiens
gaccacagtgggtggca

SEQ ID NO: 1803368 - DNA, 16 bp, Homo sapiens
gaccagaaacagggac

SEQ ID NO: 1803369 - DNA, 19 bp, Homo sapiens
gacccaccaaactgcacac

SEQ ID NO: 1803370 - DNA, 21 bp, Homo sapiens
gacccacccatcttcctgctg

SEQ ID NO: 1803371 - DNA, 15 bp, Homo sapiens
gacccagctactctg

SEQ ID NO: 1803372 - DNA, 18 bp, Homo sapiens
gacccagctactctgtcc

SEQ ID NO: 1803373 - DNA, 11 bp, Homo sapiens
gacccaggccc

SEQ ID NO: 1803374 - DNA, 13 bp, Homo sapiens
gacccaggccctc

SEQ ID NO: 1803375 - DNA, 18 bp, Homo sapiens
gacccaggccctccatgg

SEQ ID NO: 1803376 - DNA, 17 bp, Homo sapiens
gaccccttttcagcttc

SEQ ID NO: 1803377 - DNA, 20 bp, Homo sapiens
gaccccttttcagcttctgc

SEQ ID NO: 1803378 - DNA, 11 bp, Homo sapiens
gaccctggaat

SEQ ID NO: 1803379 - DNA, 22 bp, Homo sapiens
gaccctggaattcagcaccctg

SEQ ID NO: 1803380 - DNA, 15 bp, Homo sapiens
gacccttcagggcca

SEQ ID NO: 1803381 - DNA, 14 bp, Homo sapiens
gaccgcttcacccc

SEQ ID NO: 1803382 - DNA, 16 bp, Homo sapiens
gaccgcttcacccctg

SEQ ID NO: 1803383 - DNA, 19 bp, Homo sapiens
gaccgcttcacccctgcac

SEQ ID NO: 1803384 - DNA, 17 bp, Homo sapiens
gaccgggtgggcctggc

SEQ ID NO: 1803385 - DNA, 21 bp, Homo sapiens
gacctgagtcggccccacatg

SEQ ID NO: 1803386 - DNA, 17 bp, Homo sapiens
gactccagaatctgctg

SEQ ID NO: 1803387 - DNA, 15 bp, Homo sapiens
gactccagagtctga

SEQ ID NO: 1803388 - DNA, 19 bp, Homo sapiens
gactcgggctcctgtgccc

SEQ ID NO: 1803389 - DNA, 14 bp, Homo sapiens
gactgaaagcagca

SEQ ID NO: 1803390 - DNA, 13 bp, Homo sapiens
gactgaaggggca

SEQ ID NO: 1803391 - DNA, 24 bp, Homo sapiens
gactgaaggggcacaccactgccc

SEQ ID NO: 1803392 - DNA, 14 bp, Homo sapiens
gactgcccccagaa

SEQ ID NO: 1803393 - DNA, 20 bp, Homo sapiens
gactggagtgaggcttccag

SEQ ID NO: 1803394 - DNA, 23 bp, Homo sapiens
gactggagtgaggcttccaggct

SEQ ID NO: 1803395 - DNA, 23 bp, Homo sapiens
gactggcaggtgcagatgggctg

SEQ ID NO: 1803396 - DNA, 22 bp, Homo sapiens
gactgggttccccacagtgaca

SEQ ID NO: 1803397 - DNA, 17 bp, Homo sapiens
gacttcagatttcaaat

SEQ ID NO: 1803398 - DNA, 18 bp, Homo sapiens
gacttcagatttcaaatt

SEQ ID NO: 1803399 - DNA, 17 bp, Homo sapiens
gacttcaggggctgccc

SEQ ID NO: 1803400 - DNA, 20 bp, Homo sapiens
gacttcaggggctgcccgct

SEQ ID NO: 1803401 - DNA, 13 bp, Homo sapiens
gacttcaggtgga

SEQ ID NO: 1803402 - DNA, 12 bp, Homo sapiens
gacttcctctgg

SEQ ID NO: 1803403 - DNA, 18 bp, Homo sapiens
gacttcctggggccccgc

SEQ ID NO: 1803404 - DNA, 19 bp, Homo sapiens
gacttctggaaggctggct

SEQ ID NO: 1803405 - DNA, 15 bp, Homo sapiens
gactttcctttgcac

SEQ ID NO: 1803406 - DNA, 20 bp, Homo sapiens
gagaaacaaataaactagtc

SEQ ID NO: 1803407 - DNA, 15 bp, Homo sapiens
gagaaagaaagggaa

SEQ ID NO: 1803408 - DNA, 16 bp, Homo sapiens
gagaaatcacaggggc

SEQ ID NO: 1803409 - DNA, 22 bp, Homo sapiens
gagaagccagctttcctcatca

SEQ ID NO: 1803410 - DNA, 15 bp, Homo sapiens
gagaaggaaaaagaa

SEQ ID NO: 1803411 - DNA, 21 bp, Homo sapiens
gagaagtttcgaggggtcctc

SEQ ID NO: 1803412 - DNA, 16 bp, Homo sapiens
gagaattgcaaaacta

SEQ ID NO: 1803413 - DNA, 14 bp, Homo sapiens
gagacaagccctgg

SEQ ID NO: 1803414 - DNA, 16 bp, Homo sapiens
gagacaagccctggca

SEQ ID NO: 1803415 - DNA, 13 bp, Homo sapiens
gagaccctggaat

SEQ ID NO: 1803416 - DNA, 18 bp, Homo sapiens
gagaccctggaattcagc

SEQ ID NO: 1803417 - DNA, 20 bp, Homo sapiens
gagaccgcttcacccctgca

SEQ ID NO: 1803418 - DNA, 19 bp, Homo sapiens
gagactccagaatctgctg

SEQ ID NO: 1803419 - DNA, 23 bp, Homo sapiens
gagactccagaatctgctgttgc

SEQ ID NO: 1803420 - DNA, 13 bp, Homo sapiens
gagactcttaaat

SEQ ID NO: 1803421 - DNA, 20 bp, Homo sapiens
gagactgaaagcagcagcta

SEQ ID NO: 1803422 - DNA, 21 bp, Homo sapiens
gagactgaaagcagcagctag

SEQ ID NO: 1803423 - DNA, 13 bp, Homo sapiens
gagagaaaagaaa

SEQ ID NO: 1803424 - DNA, 17 bp, Homo sapiens
gagagggcccagctgta

SEQ ID NO: 1803425 - DNA, 21 bp, Homo sapiens
gagagggcccagctgtagcca

SEQ ID NO: 1803426 - DNA, 14 bp, Homo sapiens
gagaggggtttggg

SEQ ID NO: 1803427 - DNA, 15 bp, Homo sapiens
gagatggccatgctc

SEQ ID NO: 1803428 - DNA, 18 bp, Homo sapiens
gagatttgccagcacagg

SEQ ID NO: 1803429 - DNA, 16 bp, Homo sapiens
gagcaaatgagggagg

SEQ ID NO: 1803430 - DNA, 18 bp, Homo sapiens
gagcaacccctgtaccca

SEQ ID NO: 1803431 - DNA, 21 bp, Homo sapiens
gagcaacccctgtacccagct

SEQ ID NO: 1803432 - DNA, 15 bp, Homo sapiens
gagcaagagaacatt

SEQ ID NO: 1803433 - DNA, 13 bp, Homo sapiens
gagcaagccggca

SEQ ID NO: 1803434 - DNA, 20 bp, Homo sapiens
gagcaagccggcaagcgagc

SEQ ID NO: 1803435 - DNA, 12 bp, Homo sapiens
gagcacagccct

SEQ ID NO: 1803436 - DNA, 14 bp, Homo sapiens
gagcacagccctcc

SEQ ID NO: 1803437 - DNA, 15 bp, Homo sapiens
gagcacagccctccc

SEQ ID NO: 1803438 - DNA, 16 bp, Homo sapiens
gagcacagccctggga

SEQ ID NO: 1803439 - DNA, 14 bp, Homo sapiens
gagcactggccaga

SEQ ID NO: 1803440 - DNA, 16 bp, Homo sapiens
gagcactggccagaga

SEQ ID NO: 1803441 - DNA, 18 bp, Homo sapiens
gagcactggccagagagg

SEQ ID NO: 1803442 - DNA, 22 bp, Homo sapiens
gagcactggccagagagggccc

SEQ ID NO: 1803443 - DNA, 16 bp, Homo sapiens
gagcacttgcgtcctg

SEQ ID NO: 1803444 - DNA, 14 bp, Homo sapiens
gagcagcctgatgg

SEQ ID NO: 1803445 - DNA, 20 bp, Homo sapiens
gagcagcttctgccacttcc

SEQ ID NO: 1803446 - DNA, 15 bp, Homo sapiens
gagcatcgtgaccct

SEQ ID NO: 1803447 - DNA, 19 bp, Homo sapiens
gagcatcgtgacccttcag

SEQ ID NO: 1803448 - DNA, 14 bp, Homo sapiens
gagccagcctggga

SEQ ID NO: 1803449 - DNA, 15 bp, Homo sapiens
gagccatgggcctgg

SEQ ID NO: 1803450 - DNA, 17 bp, Homo sapiens
gagccatgggcctgggc

SEQ ID NO: 1803451 - DNA, 12 bp, Homo sapiens
gagcccaggccg

SEQ ID NO: 1803452 - DNA, 13 bp, Homo sapiens
gagcccctcccca

SEQ ID NO: 1803453 - DNA, 15 bp, Homo sapiens
gagcccctccccagc

SEQ ID NO: 1803454 - DNA, 22 bp, Homo sapiens
gagctcttcaagctgtcccctc

SEQ ID NO: 1803455 - DNA, 17 bp, Homo sapiens
gagctgatttccaggcc

SEQ ID NO: 1803456 - DNA, 17 bp, Homo sapiens
gagctggaaggcagggc

SEQ ID NO: 1803457 - DNA, 14 bp, Homo sapiens
gagctggggccaca

SEQ ID NO: 1803458 - DNA, 19 bp, Homo sapiens
gagcttagccttgtgccct

SEQ ID NO: 1803459 - DNA, 18 bp, Homo sapiens
gaggaaggtgctgagctt

SEQ ID NO: 1803460 - DNA, 13 bp, Homo sapiens
gaggacacatgtc

SEQ ID NO: 1803461 - DNA, 22 bp, Homo sapiens
gaggacagtatttgtggggagg

SEQ ID NO: 1803462 - DNA, 17 bp, Homo sapiens
gaggagcacctgaaccc

SEQ ID NO: 1803463 - DNA, 13 bp, Homo sapiens
gaggcaccagctc

SEQ ID NO: 1803464 - DNA, 15 bp, Homo sapiens
gaggcaccagctctg

SEQ ID NO: 1803465 - DNA, 19 bp, Homo sapiens
gaggcaccagctctgtggc

SEQ ID NO: 1803466 - DNA, 20 bp, Homo sapiens
gaggcaccagctctgtggcc

SEQ ID NO: 1803467 - DNA, 21 bp, Homo sapiens
gaggcaccagctctgtggcct

SEQ ID NO: 1803468 - DNA, 22 bp, Homo sapiens
gaggcaccagctctgtggcctg

SEQ ID NO: 1803469 - DNA, 17 bp, Homo sapiens
gaggcaccggcgctgca

SEQ ID NO: 1803470 - DNA, 18 bp, Homo sapiens
gaggcaccggcgctgcag

SEQ ID NO: 1803471 - DNA, 12 bp, Homo sapiens
gaggccaaggca

SEQ ID NO: 1803472 - DNA, 22 bp, Homo sapiens
gaggccaccccaaaccccagcc

SEQ ID NO: 1803473 - DNA, 14 bp, Homo sapiens
gaggccccaggccc

SEQ ID NO: 1803474 - DNA, 22 bp, Homo sapiens
gaggcctctcattccagaggaa

SEQ ID NO: 1803475 - DNA, 13 bp, Homo sapiens
gaggcctgatgct

SEQ ID NO: 1803476 - DNA, 15 bp, Homo sapiens
gaggcctgatgctgc

SEQ ID NO: 1803477 - DNA, 16 bp, Homo sapiens
gaggcttccaggctct

SEQ ID NO: 1803478 - DNA, 20 bp, Homo sapiens
gaggcttccaggctcttcct

SEQ ID NO: 1803479 - DNA, 18 bp, Homo sapiens
cttttcagcttctgctgg

SEQ ID NO: 1803480 - DNA, 23 bp, Homo sapiens
cttttcagcttctgctgggctgg

SEQ ID NO: 1803481 - DNA, 16 bp, Homo sapiens
cttttccaggatcctg

SEQ ID NO: 1803482 - DNA, 14 bp, Homo sapiens
cttttgcctggctg

SEQ ID NO: 1803483 - DNA, 16 bp, Homo sapiens
cttttgtccccagggc

SEQ ID NO: 1803484 - DNA, 17 bp, Homo sapiens
cttttgtcctgttattt

SEQ ID NO: 1803485 - DNA, 16 bp, Homo sapiens
cttttgttttcttcat

SEQ ID NO: 1803486 - DNA, 13 bp, Homo sapiens
gaaaaagaaaaaa

SEQ ID NO: 1803487 - DNA, 17 bp, Homo sapiens
gaaaagaaagctgcttt

SEQ ID NO: 1803488 - DNA, 11 bp, Homo sapiens
gaaaagagaga

SEQ ID NO: 1803489 - DNA, 18 bp, Homo sapiens
gaaaagcaattgccctgt

SEQ ID NO: 1803490 - DNA, 17 bp, Homo sapiens
gaaacaaatttttttct

SEQ ID NO: 1803491 - DNA, 18 bp, Homo sapiens
gaaacattccgaagaggg

SEQ ID NO: 1803492 - DNA, 19 bp, Homo sapiens
gaaacattccgaagaggga

SEQ ID NO: 1803493 - DNA, 12 bp, Homo sapiens
gaaactggctga

SEQ ID NO: 1803494 - DNA, 16 bp, Homo sapiens
gaaagaaaagaccctg

SEQ ID NO: 1803495 - DNA, 19 bp, Homo sapiens
gaaagacttgaatttagtt

SEQ ID NO: 1803496 - DNA, 19 bp, Homo sapiens
gaaagcctcctgccccctg

SEQ ID NO: 1803497 - DNA, 22 bp, Homo sapiens
gaaagcctcctgccccctgcca

SEQ ID NO: 1803498 - DNA, 21 bp, Homo sapiens
gaaagctgctttcgaataaag

SEQ ID NO: 1803499 - DNA, 24 bp, Homo sapiens
gaaataagaaacacaaatgtaaaa

SEQ ID NO: 1803500 - DNA, 17 bp, Homo sapiens
gaaatcacaggggcggg

SEQ ID NO: 1803501 - DNA, 18 bp, Homo sapiens
gaaatccccccttcagaa

SEQ ID NO: 1803502 - DNA, 13 bp, Homo sapiens
gaaatgagtctgt

SEQ ID NO: 1803503 - DNA, 21 bp, Homo sapiens
gaaattcaacctgtgtcttat

SEQ ID NO: 1803504 - DNA, 18 bp, Homo sapiens
gaacaagtcacagctgca

SEQ ID NO: 1803505 - DNA, 19 bp, Homo sapiens
gaacacaataatgtgtcct

SEQ ID NO: 1803506 - DNA, 14 bp, Homo sapiens
gaacacactcagca

SEQ ID NO: 1803507 - DNA, 14 bp, Homo sapiens
gaaccaaggcagcc

SEQ ID NO: 1803508 - DNA, 17 bp, Homo sapiens
gaaccaaggcagcctcc

SEQ ID NO: 1803509 - DNA, 20 bp, Homo sapiens
gaaccaaggcagcctccaga

SEQ ID NO: 1803510 - DNA, 23 bp, Homo sapiens
gaaccaaggcagcctccagagcc

SEQ ID NO: 1803511 - DNA, 17 bp, Homo sapiens
gaaccagagctggaaca

SEQ ID NO: 1803512 - DNA, 17 bp, Homo sapiens
gaaccagggaggagagg

SEQ ID NO: 1803513 - DNA, 16 bp, Homo sapiens
gaaccccatgggcttg

SEQ ID NO: 1803514 - DNA, 19 bp, Homo sapiens
gaaccccatgggcttggac

SEQ ID NO: 1803515 - DNA, 17 bp, Homo sapiens
gaacccttgtgcttggt

SEQ ID NO: 1803516 - DNA, 19 bp, Homo sapiens
gaacctagtactctctgct

SEQ ID NO: 1803517 - DNA, 20 bp, Homo sapiens
gaacgcaccccactgggaga

SEQ ID NO: 1803518 - DNA, 13 bp, Homo sapiens
gaactagactttc

SEQ ID NO: 1803519 - DNA, 17 bp, Homo sapiens
gaactagactttccttt

SEQ ID NO: 1803520 - DNA, 22 bp, Homo sapiens
gaactagactttcctttgcacc

SEQ ID NO: 1803521 - DNA, 13 bp, Homo sapiens
gaactattagagc

SEQ ID NO: 1803522 - DNA, 12 bp, Homo sapiens
gaactgccccat

SEQ ID NO: 1803523 - DNA, 17 bp, Homo sapiens
gaactgctgggcttggc

SEQ ID NO: 1803524 - DNA, 17 bp, Homo sapiens
gaacttacacttggagc

SEQ ID NO: 1803525 - DNA, 14 bp, Homo sapiens
gaagaaaaatgttt

SEQ ID NO: 1803526 - DNA, 23 bp, Homo sapiens
gaagaagtaaactggatactgta

SEQ ID NO: 1803527 - DNA, 13 bp, Homo sapiens
gaagagcacagcc

SEQ ID NO: 1803528 - DNA, 12 bp, Homo sapiens
gaagagcagcct

SEQ ID NO: 1803529 - DNA, 21 bp, Homo sapiens
gaagagggaatggatggggag

SEQ ID NO: 1803530 - DNA, 19 bp, Homo sapiens
gaagcagtgcctcgaggca

SEQ ID NO: 1803531 - DNA, 20 bp, Homo sapiens
gaagcagtgcctcgaggcac

SEQ ID NO: 1803532 - DNA, 19 bp, Homo sapiens
gaagctgtactcagagcag

SEQ ID NO: 1803533 - DNA, 21 bp, Homo sapiens
gaagctgtactcagagcagag

SEQ ID NO: 1803534 - DNA, 19 bp, Homo sapiens
gaaggaatagccagagagg

SEQ ID NO: 1803535 - DNA, 23 bp, Homo sapiens
gaaggaatagccagagaggagca

SEQ ID NO: 1803536 - DNA, 14 bp, Homo sapiens
gaaggagggcagag

SEQ ID NO: 1803537 - DNA, 15 bp, Homo sapiens
gaaggagggcagagc

SEQ ID NO: 1803538 - DNA, 20 bp, Homo sapiens
gaaggagggcagagccatgg

SEQ ID NO: 1803539 - DNA, 17 bp, Homo sapiens
gaaggcagggcagaggg

SEQ ID NO: 1803540 - DNA, 17 bp, Homo sapiens
gaaggcagtctgaaccc

SEQ ID NO: 1803541 - DNA, 17 bp, Homo sapiens
gaaggcatatttccaat

SEQ ID NO: 1803542 - DNA, 14 bp, Homo sapiens
gaaggctggctgag

SEQ ID NO: 1803543 - DNA, 23 bp, Homo sapiens
gaagggaaagcgggcagccccgt

SEQ ID NO: 1803544 - DNA, 20 bp, Homo sapiens
gaaggggccccggggctggc

SEQ ID NO: 1803545 - DNA, 23 bp, Homo sapiens
gaaggggccccggggctggcaag

SEQ ID NO: 1803546 - DNA, 20 bp, Homo sapiens
gaagtaaactggatactgta

SEQ ID NO: 1803547 - DNA, 21 bp, Homo sapiens
gaagtccttcagtgagcccct

SEQ ID NO: 1803548 - DNA, 17 bp, Homo sapiens
gaagtgttgtggagaaa

SEQ ID NO: 1803549 - DNA, 13 bp, Homo sapiens
gaagttcaagtga

SEQ ID NO: 1803550 - DNA, 18 bp, Homo sapiens
gaataaaaattgatgaga

SEQ ID NO: 1803551 - DNA, 14 bp, Homo sapiens
gaataaagtgaata

SEQ ID NO: 1803552 - DNA, 20 bp, Homo sapiens
gaataagtgccaggatggaa

SEQ ID NO: 1803553 - DNA, 16 bp, Homo sapiens
gaatacacttacagtt

SEQ ID NO: 1803554 - DNA, 19 bp, Homo sapiens
gaatatgagaaatacagaa

SEQ ID NO: 1803555 - DNA, 15 bp, Homo sapiens
gaatctgctgttgcc

SEQ ID NO: 1803556 - DNA, 13 bp, Homo sapiens
gaatcttactcct

SEQ ID NO: 1803557 - DNA, 21 bp, Homo sapiens
gaatgatagtaataggataca

SEQ ID NO: 1803558 - DNA, 18 bp, Homo sapiens
gaatgcagattcctgggc

SEQ ID NO: 1803559 - DNA, 20 bp, Homo sapiens
gaatgcagattcctgggcct

SEQ ID NO: 1803560 - DNA, 21 bp, Homo sapiens
gaatgcagattcctgggcctg

SEQ ID NO: 1803561 - DNA, 21 bp, Homo sapiens
gaatgcagggaagagggcagt

SEQ ID NO: 1803562 - DNA, 20 bp, Homo sapiens
gaatggatggggagaatggt

SEQ ID NO: 1803563 - DNA, 17 bp, Homo sapiens
gaatgtgattttaaaga

SEQ ID NO: 1803564 - DNA, 19 bp, Homo sapiens
gaatgtgattttaaagagt

SEQ ID NO: 1803565 - DNA, 16 bp, Homo sapiens
gaattcagcaccctgg

SEQ ID NO: 1803566 - DNA, 17 bp, Homo sapiens
gaattcagcaccctggg

SEQ ID NO: 1803567 - DNA, 18 bp, Homo sapiens
gaattcagcaccctgggt

SEQ ID NO: 1803568 - DNA, 18 bp, Homo sapiens
gaattctgcaactagcca

SEQ ID NO: 1803569 - DNA, 23 bp, Homo sapiens
gaattcttcaacagggaaaacag

SEQ ID NO: 1803570 - DNA, 23 bp, Homo sapiens
gaattgctaattctgagggaatt

SEQ ID NO: 1803571 - DNA, 20 bp, Homo sapiens
gaatttgtaagcaacttgct

SEQ ID NO: 1803572 - DNA, 18 bp, Homo sapiens
gaattttaagttctatca

SEQ ID NO: 1803573 - DNA, 14 bp, Homo sapiens
gaattttcccactg

SEQ ID NO: 1803574 - DNA, 19 bp, Homo sapiens
gaattttctttcatacatt

SEQ ID NO: 1803575 - DNA, 20 bp, Homo sapiens
gaattttctttcatacatta

SEQ ID NO: 1803576 - DNA, 13 bp, Homo sapiens
gacaaaagtttca

SEQ ID NO: 1803577 - DNA, 15 bp, Homo sapiens
gacaacatttttgta

SEQ ID NO: 1803578 - DNA, 22 bp, Homo sapiens
gacaacatttttgtacattatg

SEQ ID NO: 1803579 - DNA, 14 bp, Homo sapiens
gacaagaagctgct

SEQ ID NO: 1803580 - DNA, 14 bp, Homo sapiens
gacaagccctggca

SEQ ID NO: 1803581 - DNA, 15 bp, Homo sapiens
gacaatactgctgcc

SEQ ID NO: 1803582 - DNA, 16 bp, Homo sapiens
gacacatcccggcctc

SEQ ID NO: 1803583 - DNA, 17 bp, Homo sapiens
gacacatcccggcctct

SEQ ID NO: 1803584 - DNA, 11 bp, Homo sapiens
gacacctgccc

SEQ ID NO: 1803585 - DNA, 12 bp, Homo sapiens
gacacctgccct

SEQ ID NO: 1803586 - DNA, 14 bp, Homo sapiens
gacacctgccctgc

SEQ ID NO: 1803587 - DNA, 12 bp, Homo sapiens
gacactgctgca

SEQ ID NO: 1803588 - DNA, 17 bp, Homo sapiens
gacagagaaggcagcag

SEQ ID NO: 1803589 - DNA, 13 bp, Homo sapiens
gacaggccctccc

SEQ ID NO: 1803590 - DNA, 16 bp, Homo sapiens
gacagtattctcagtg

SEQ ID NO: 1803591 - DNA, 15 bp, Homo sapiens
gacagtcctctccac

SEQ ID NO: 1803592 - DNA, 24 bp, Homo sapiens
gacagtcctctccacctagtggct

SEQ ID NO: 1803593 - DNA, 15 bp, Homo sapiens
gacagtctcaaattt

SEQ ID NO: 1803594 - DNA, 23 bp, Homo sapiens
gacattatatttgagtttctttc

SEQ ID NO: 1803595 - DNA, 17 bp, Homo sapiens
gaccaaattgcttctag

SEQ ID NO: 1803596 - DNA, 11 bp, Homo sapiens
gaccacagcaa

SEQ ID NO: 1803597 - DNA, 17 bp, Homo sapiens
aaaaacaacaaatactt

SEQ ID NO: 1803598 - DNA, 18 bp, Homo sapiens
aaaaagattatatatcat

SEQ ID NO: 1803599 - DNA, 14 bp, Homo sapiens
aaaaagtaacacac

SEQ ID NO: 1803600 - DNA, 22 bp, Homo sapiens
aaaaatgtttgtactttttaat

SEQ ID NO: 1803601 - DNA, 14 bp, Homo sapiens
aaaacaaaaataaa

SEQ ID NO: 1803602 - DNA, 16 bp, Homo sapiens
aaaacaaaaataaata

SEQ ID NO: 1803603 - DNA, 12 bp, Homo sapiens
aaaacaaccaaa

SEQ ID NO: 1803604 - DNA, 18 bp, Homo sapiens
aaaacacaacattttaat

SEQ ID NO: 1803605 - DNA, 18 bp, Homo sapiens
aaaacagctagcttgaaa

SEQ ID NO: 1803606 - DNA, 16 bp, Homo sapiens
aaaacatacttcaaaa

SEQ ID NO: 1803607 - DNA, 21 bp, Homo sapiens
aaaacttattaacaactgtga

SEQ ID NO: 1803608 - DNA, 16 bp, Homo sapiens
aaaagaaaaaaaattt

SEQ ID NO: 1803609 - DNA, 10 bp, Homo sapiens
aaaagaaagc

SEQ ID NO: 1803610 - DNA, 23 bp, Homo sapiens
aaaagaatttgtgacattttaaa

SEQ ID NO: 1803611 - DNA, 22 bp, Homo sapiens
aaaagattatatatcataaagt

SEQ ID NO: 1803612 - DNA, 11 bp, Homo sapiens
aaaagctaatt

SEQ ID NO: 1803613 - DNA, 12 bp, Homo sapiens
aaaaggaaaatg

SEQ ID NO: 1803614 - DNA, 20 bp, Homo sapiens
aaaagtggggctaaatgaag

SEQ ID NO: 1803615 - DNA, 20 bp, Homo sapiens
aaaagtttcacaacagattt

SEQ ID NO: 1803616 - DNA, 9 bp, Homo sapiens
aaactggct

SEQ ID NO: 1803617 - DNA, 20 bp, Homo sapiens
aaacttattaacaactgtga

SEQ ID NO: 1803618 - DNA, 13 bp, Homo sapiens
aaacttgacccag

SEQ ID NO: 1803619 - DNA, 21 bp, Homo sapiens
aaagaaagggaaactggctga

SEQ ID NO: 1803620 - DNA, 23 bp, Homo sapiens
aaagaaatccccccttcagaaca

SEQ ID NO: 1803621 - DNA, 14 bp, Homo sapiens
aaagaactgcccca

SEQ ID NO: 1803622 - DNA, 13 bp, Homo sapiens
aaagaagcttcat

SEQ ID NO: 1803623 - DNA, 15 bp, Homo sapiens
aaagagccagaagtt

SEQ ID NO: 1803624 - DNA, 22 bp, Homo sapiens
aaagagccatgtgtcatgtaat

SEQ ID NO: 1803625 - DNA, 20 bp, Homo sapiens
aaagaggatgatttcagaag

SEQ ID NO: 1803626 - DNA, 19 bp, Homo sapiens
aaagagttattcaaatgaa

SEQ ID NO: 1803627 - DNA, 20 bp, Homo sapiens
aaagagttattcaaatgaag

SEQ ID NO: 1803628 - DNA, 14 bp, Homo sapiens
aaagatggagttgt

SEQ ID NO: 1803629 - DNA, 12 bp, Homo sapiens
aaagattatata

SEQ ID NO: 1803630 - DNA, 15 bp, Homo sapiens
aaagattatatatca

SEQ ID NO: 1803631 - DNA, 15 bp, Homo sapiens
aaagcaaaagaagta

SEQ ID NO: 1803632 - DNA, 20 bp, Homo sapiens
aaagcagcagctaggactga

SEQ ID NO: 1803633 - DNA, 19 bp, Homo sapiens
aaagctggacaagaagctg

SEQ ID NO: 1803634 - DNA, 12 bp, Homo sapiens
aaaggaaaaaag

SEQ ID NO: 1803635 - DNA, 14 bp, Homo sapiens
aaaggcttctccac

SEQ ID NO: 1803636 - DNA, 15 bp, Homo sapiens
aaagggcagtaaagt

SEQ ID NO: 1803637 - DNA, 13 bp, Homo sapiens
aaaggggctgctg

SEQ ID NO: 1803638 - DNA, 15 bp, Homo sapiens
aaaggggctgctggg

SEQ ID NO: 1803639 - DNA, 20 bp, Homo sapiens
aaaggtgtaagacttcagat

SEQ ID NO: 1803640 - DNA, 22 bp, Homo sapiens
aaaggtttcactgttcatgaat

SEQ ID NO: 1803641 - DNA, 16 bp, Homo sapiens
aaagtaattttgtgaa

SEQ ID NO: 1803642 - DNA, 21 bp, Homo sapiens
aaagtatgccttcctgtttaa

SEQ ID NO: 1803643 - DNA, 17 bp, Homo sapiens
aaagtctcctgtatcat

SEQ ID NO: 1803644 - DNA, 16 bp, Homo sapiens
aaagtgtagcaccctg

SEQ ID NO: 1803645 - DNA, 21 bp, Homo sapiens
aaagtttcacaacagatttct

SEQ ID NO: 1803646 - DNA, 22 bp, Homo sapiens
aaagtttcacaacagatttcta

SEQ ID NO: 1803647 - DNA, 18 bp, Homo sapiens
aaataaagctgtgacagt

SEQ ID NO: 1803648 - DNA, 23 bp, Homo sapiens
aaataacacagatattgttataa

SEQ ID NO: 1803649 - DNA, 15 bp, Homo sapiens
aaatagcacatgatt

SEQ ID NO: 1803650 - DNA, 18 bp, Homo sapiens
aaatagtgtgtccatgca

SEQ ID NO: 1803651 - DNA, 23 bp, Homo sapiens
aaatattgctctaattcttttca

SEQ ID NO: 1803652 - DNA, 15 bp, Homo sapiens
aaatcattttcatta

SEQ ID NO: 1803653 - DNA, 19 bp, Homo sapiens
aaatcattttcattaaaag

SEQ ID NO: 1803654 - DNA, 19 bp, Homo sapiens
aaatctgacagtctcaaat

SEQ ID NO: 1803655 - DNA, 17 bp, Homo sapiens
aaatctggcaaagttat

SEQ ID NO: 1803656 - DNA, 17 bp, Homo sapiens
aaatgattgttttagaa

SEQ ID NO: 1803657 - DNA, 20 bp, Homo sapiens
aaatgattgttttagaagtt

SEQ ID NO: 1803658 - DNA, 13 bp, Homo sapiens
aaatgcattatgt

SEQ ID NO: 1803659 - DNA, 15 bp, Homo sapiens
aaatgcccagttcac

SEQ ID NO: 1803660 - DNA, 15 bp, Homo sapiens
aaatgcccatttcga

SEQ ID NO: 1803661 - DNA, 14 bp, Homo sapiens
aaatgctttgtgac

SEQ ID NO: 1803662 - DNA, 16 bp, Homo sapiens
aaatggaaaagagaga

SEQ ID NO: 1803663 - DNA, 17 bp, Homo sapiens
aaatgtaaaaatgaagg

SEQ ID NO: 1803664 - DNA, 18 bp, Homo sapiens
aaatgtaaaaatgaagga

SEQ ID NO: 1803665 - DNA, 21 bp, Homo sapiens
aaatgtaaaaatgaaggaatt

SEQ ID NO: 1803666 - DNA, 17 bp, Homo sapiens
aaatgtaaaagtactct

SEQ ID NO: 1803667 - DNA, 21 bp, Homo sapiens
aaatgtttgtactttttaatg

SEQ ID NO: 1803668 - DNA, 13 bp, Homo sapiens
aaattaatctttc

SEQ ID NO: 1803669 - DNA, 20 bp, Homo sapiens
aaattcaacctgtgtcttat

SEQ ID NO: 1803670 - DNA, 13 bp, Homo sapiens
aaattctcaaaat

SEQ ID NO: 1803671 - DNA, 12 bp, Homo sapiens
aaattgtgatgt

SEQ ID NO: 1803672 - DNA, 14 bp, Homo sapiens
aaatttatataaaa

SEQ ID NO: 1803673 - DNA, 18 bp, Homo sapiens
aaattttactgacagaaa

SEQ ID NO: 1803674 - DNA, 17 bp, Homo sapiens
aacaactgtgaatatga

SEQ ID NO: 1803675 - DNA, 20 bp, Homo sapiens
aacaagtcacagctgcagct

SEQ ID NO: 1803676 - DNA, 21 bp, Homo sapiens
aacaagtcacagctgcagctg

SEQ ID NO: 1803677 - DNA, 16 bp, Homo sapiens
aacaatgtcagaaact

SEQ ID NO: 1803678 - DNA, 17 bp, Homo sapiens
aacaattaattttctat

SEQ ID NO: 1803679 - DNA, 20 bp, Homo sapiens
aacactgaagtgcttgcaga

SEQ ID NO: 1803680 - DNA, 20 bp, Homo sapiens
aacagagggaccaaattgct

SEQ ID NO: 1803681 - DNA, 23 bp, Homo sapiens
aacagagggaccaaattgcttct

SEQ ID NO: 1803682 - DNA, 14 bp, Homo sapiens
aacagatttctaag

SEQ ID NO: 1803683 - DNA, 17 bp, Homo sapiens
aacagggacaaagaaat

SEQ ID NO: 1803684 - DNA, 13 bp, Homo sapiens
aacatatgatact

SEQ ID NO: 1803685 - DNA, 18 bp, Homo sapiens
aacatgcaacaaaaatgt

SEQ ID NO: 1803686 - DNA, 18 bp, Homo sapiens
aacatggtacactgcatc

SEQ ID NO: 1803687 - DNA, 19 bp, Homo sapiens
aacattcctccagcctccc

SEQ ID NO: 1803688 - DNA, 20 bp, Homo sapiens
aacattcctccagcctcccc

SEQ ID NO: 1803689 - DNA, 21 bp, Homo sapiens
aacattcctccagcctcccct

SEQ ID NO: 1803690 - DNA, 17 bp, Homo sapiens
aacatttttgtacatta

SEQ ID NO: 1803691 - DNA, 15 bp, Homo sapiens
aaccaaggcagcctc

SEQ ID NO: 1803692 - DNA, 22 bp, Homo sapiens
aaccaaggcagcctccagagcc

SEQ ID NO: 1803693 - DNA, 17 bp, Homo sapiens
aaccagggaggagagga

SEQ ID NO: 1803694 - DNA, 19 bp, Homo sapiens
aacccccagcacccgggct

SEQ ID NO: 1803695 - DNA, 12 bp, Homo sapiens
aacccccctccc

SEQ ID NO: 1803696 - DNA, 13 bp, Homo sapiens
aacccccctccca

SEQ ID NO: 1803697 - DNA, 18 bp, Homo sapiens
aaccccgcggtgctctgg

SEQ ID NO: 1803698 - DNA, 21 bp, Homo sapiens
aaccccgcggtgctctggcgg

SEQ ID NO: 1803699 - DNA, 13 bp, Homo sapiens
aacccctgtaccc

SEQ ID NO: 1803700 - DNA, 13 bp, Homo sapiens
aacctagtactct

SEQ ID NO: 1803701 - DNA, 23 bp, Homo sapiens
aacctcacactactgtatttcat

SEQ ID NO: 1803702 - DNA, 20 bp, Homo sapiens
aacctctaatttattttgtc

SEQ ID NO: 1803703 - DNA, 17 bp, Homo sapiens
aacctgaattattccaa

SEQ ID NO: 1803704 - DNA, 22 bp, Homo sapiens
aacctgcccctccccagccctt

SEQ ID NO: 1803705 - DNA, 22 bp, Homo sapiens
aaccttcatgatgaattacttc

SEQ ID NO: 1803706 - DNA, 23 bp, Homo sapiens
aacgaaggggccccggggctggc

SEQ ID NO: 1803707 - DNA, 14 bp, Homo sapiens
aacgagcactggcc

SEQ ID NO: 1803708 - DNA, 16 bp, Homo sapiens
aacgagcactggccag

SEQ ID NO: 1803709 - DNA, 19 bp, Homo sapiens
aactaaataacacagatat

SEQ ID NO: 1803710 - DNA, 16 bp, Homo sapiens
aactagactttccttt

SEQ ID NO: 1803711 - DNA, 16 bp, Homo sapiens
aactccactctccttc

SEQ ID NO: 1803712 - DNA, 15 bp, Homo sapiens
aactccaggggcacc

SEQ ID NO: 1803713 - DNA, 17 bp, Homo sapiens
aactccaggggcaccta

SEQ ID NO: 1803714 - DNA, 14 bp, Homo sapiens
aactctattatgga

SEQ ID NO: 1803715 - DNA, 23 bp, Homo sapiens
aactgatggaccgggtgggcctg

SEQ ID NO: 1803716 - DNA, 17 bp, Homo sapiens
aactgcacacacagctc

SEQ ID NO: 1803717 - DNA, 13 bp, Homo sapiens
aactgctgagcca

SEQ ID NO: 1803718 - DNA, 20 bp, Homo sapiens
aactgctgttaattgattaa

SEQ ID NO: 1803719 - DNA, 16 bp, Homo sapiens
aactgtgaatatgaga

SEQ ID NO: 1803720 - DNA, 15 bp, Homo sapiens
aacttaaacaatttc

SEQ ID NO: 1803721 - DNA, 19 bp, Homo sapiens
aacttattaacaactgtga

SEQ ID NO: 1803722 - DNA, 17 bp, Homo sapiens
aacttgaggacacatgt

SEQ ID NO: 1803723 - DNA, 19 bp, Homo sapiens
aacttgaggacacatgtcc

SEQ ID NO: 1803724 - DNA, 14 bp, Homo sapiens
aactttatatgaag

SEQ ID NO: 1803725 - DNA, 18 bp, Homo sapiens
aagaaaaatataaaaaca

SEQ ID NO: 1803726 - DNA, 14 bp, Homo sapiens
aagaaaaatatgag

SEQ ID NO: 1803727 - DNA, 13 bp, Homo sapiens
aagaaagctgctt

SEQ ID NO: 1803728 - DNA, 14 bp, Homo sapiens
aagaaagctgcttt

SEQ ID NO: 1803729 - DNA, 19 bp, Homo sapiens
aagaagctaaaatgaaaaa

SEQ ID NO: 1803730 - DNA, 23 bp, Homo sapiens
aagaagtaaactggatactgtac

SEQ ID NO: 1803731 - DNA, 20 bp, Homo sapiens
aagacccagtgtaaagaata

SEQ ID NO: 1803732 - DNA, 14 bp, Homo sapiens
aagaccctgagact

SEQ ID NO: 1803733 - DNA, 17 bp, Homo sapiens
aagacgtggctctgggt

SEQ ID NO: 1803734 - DNA, 19 bp, Homo sapiens
aagacttcagatttcaaat

SEQ ID NO: 1803735 - DNA, 18 bp, Homo sapiens
accgcttcacccctgcac

SEQ ID NO: 1803736 - DNA, 19 bp, Homo sapiens
accgcttcacccctgcact

SEQ ID NO: 1803737 - DNA, 14 bp, Homo sapiens
accggcgctgcagg

SEQ ID NO: 1803738 - DNA, 14 bp, Homo sapiens
accgggtgggcctg

SEQ ID NO: 1803739 - DNA, 18 bp, Homo sapiens
accgggtgggcctggcct

SEQ ID NO: 1803740 - DNA, 19 bp, Homo sapiens
accgggtgggcctggcctg

SEQ ID NO: 1803741 - DNA, 21 bp, Homo sapiens
accgggtgggcctggcctgag

SEQ ID NO: 1803742 - DNA, 13 bp, Homo sapiens
accgtagcctccg

SEQ ID NO: 1803743 - DNA, 20 bp, Homo sapiens
acctaattgtggtagaaatt

SEQ ID NO: 1803744 - DNA, 14 bp, Homo sapiens
acctaccatgctgc

SEQ ID NO: 1803745 - DNA, 16 bp, Homo sapiens
acctaccatgctgctt

SEQ ID NO: 1803746 - DNA, 20 bp, Homo sapiens
acctacttgtgactgaaggg

SEQ ID NO: 1803747 - DNA, 18 bp, Homo sapiens
acctagtactctctgctc

SEQ ID NO: 1803748 - DNA, 22 bp, Homo sapiens
acctagtggctgtccagtgccc

SEQ ID NO: 1803749 - DNA, 18 bp, Homo sapiens
acctatacctatgtgaaa

SEQ ID NO: 1803750 - DNA, 18 bp, Homo sapiens
acctatgtgaaactctat

SEQ ID NO: 1803751 - DNA, 15 bp, Homo sapiens
acctcacactactgt

SEQ ID NO: 1803752 - DNA, 18 bp, Homo sapiens
acctcacactactgtatt

SEQ ID NO: 1803753 - DNA, 23 bp, Homo sapiens
acctcatgcctggcccccctcca

SEQ ID NO: 1803754 - DNA, 19 bp, Homo sapiens
acctcctagaggtgggcag

SEQ ID NO: 1803755 - DNA, 23 bp, Homo sapiens
acctcctagaggtgggcagctgg

SEQ ID NO: 1803756 - DNA, 19 bp, Homo sapiens
acctgacaatggcagctag

SEQ ID NO: 1803757 - DNA, 22 bp, Homo sapiens
acctgacaatggcagctagact

SEQ ID NO: 1803758 - DNA, 16 bp, Homo sapiens
acctgcaagccccagg

SEQ ID NO: 1803759 - DNA, 17 bp, Homo sapiens
acctgcaagccccaggg

SEQ ID NO: 1803760 - DNA, 21 bp, Homo sapiens
acctgcaagccccagggcctg

SEQ ID NO: 1803761 - DNA, 23 bp, Homo sapiens
acctgcaagccccagggcctggg

SEQ ID NO: 1803762 - DNA, 20 bp, Homo sapiens
acctgcaccgccccttctcc

SEQ ID NO: 1803763 - DNA, 12 bp, Homo sapiens
acctgccctgcc

SEQ ID NO: 1803764 - DNA, 17 bp, Homo sapiens
acctgccctgccctgcc

SEQ ID NO: 1803765 - DNA, 21 bp, Homo sapiens
acctgccctgccctgccacct

SEQ ID NO: 1803766 - DNA, 22 bp, Homo sapiens
acctgccctgccctgccacctg

SEQ ID NO: 1803767 - DNA, 23 bp, Homo sapiens
acctgccctgccctgccacctgt

SEQ ID NO: 1803768 - DNA, 19 bp, Homo sapiens
acctgcctatccatcctgc

SEQ ID NO: 1803769 - DNA, 12 bp, Homo sapiens
acctggcctgct

SEQ ID NO: 1803770 - DNA, 13 bp, Homo sapiens
acctggcctgctg

SEQ ID NO: 1803771 - DNA, 23 bp, Homo sapiens
acctgggaaaggacccacccatc

SEQ ID NO: 1803772 - DNA, 14 bp, Homo sapiens
acctgtctgtctgt

SEQ ID NO: 1803773 - DNA, 20 bp, Homo sapiens
acctgtctgtctgtctgtcc

SEQ ID NO: 1803774 - DNA, 13 bp, Homo sapiens
accttcaaataat

SEQ ID NO: 1803775 - DNA, 15 bp, Homo sapiens
acctttttttctctc

SEQ ID NO: 1803776 - DNA, 14 bp, Homo sapiens
acgagcactggcca

SEQ ID NO: 1803777 - DNA, 19 bp, Homo sapiens
acgagcactggccagagag

SEQ ID NO: 1803778 - DNA, 17 bp, Homo sapiens
acgagtcacctgcaagc

SEQ ID NO: 1803779 - DNA, 18 bp, Homo sapiens
acgagtcacctgcaagcc

SEQ ID NO: 1803780 - DNA, 18 bp, Homo sapiens
acgcaagggcatcaggca

SEQ ID NO: 1803781 - DNA, 20 bp, Homo sapiens
acgcaagggcatcaggcact

SEQ ID NO: 1803782 - DNA, 21 bp, Homo sapiens
acgcaagggcatcaggcactg

SEQ ID NO: 1803783 - DNA, 21 bp, Homo sapiens
acgcaattgtgggatgtcctc

SEQ ID NO: 1803784 - DNA, 14 bp, Homo sapiens
acggggccggccag

SEQ ID NO: 1803785 - DNA, 15 bp, Homo sapiens
acggtgcgtggctgt

SEQ ID NO: 1803786 - DNA, 19 bp, Homo sapiens
acggtgcgtggctgtggca

SEQ ID NO: 1803787 - DNA, 22 bp, Homo sapiens
acgtagatttttgctcttctgt

SEQ ID NO: 1803788 - DNA, 15 bp, Homo sapiens
acgtcctgtcagtgc

SEQ ID NO: 1803789 - DNA, 21 bp, Homo sapiens
acgtcctgtcagtgccgccgc

SEQ ID NO: 1803790 - DNA, 14 bp, Homo sapiens
acgtctgccaggcc

SEQ ID NO: 1803791 - DNA, 19 bp, Homo sapiens
acgtctgccaggcccatct

SEQ ID NO: 1803792 - DNA, 12 bp, Homo sapiens
acgtgtgaggat

SEQ ID NO: 1803793 - DNA, 16 bp, Homo sapiens
acgtgttcaaaaattt

SEQ ID NO: 1803794 - DNA, 19 bp, Homo sapiens
acgtgttcaaaaatttctg

SEQ ID NO: 1803795 - DNA, 16 bp, Homo sapiens
actaaaatcgtattct

SEQ ID NO: 1803796 - DNA, 22 bp, Homo sapiens
actaagccatgccatgcccagg

SEQ ID NO: 1803797 - DNA, 21 bp, Homo sapiens
actaagccctcgaaccaaggc

SEQ ID NO: 1803798 - DNA, 17 bp, Homo sapiens
actaagctttctccttt

SEQ ID NO: 1803799 - DNA, 20 bp, Homo sapiens
actacctttgtccaggcctg

SEQ ID NO: 1803800 - DNA, 22 bp, Homo sapiens
actactgataacgtattttgat

SEQ ID NO: 1803801 - DNA, 15 bp, Homo sapiens
actactgtatttcat

SEQ ID NO: 1803802 - DNA, 12 bp, Homo sapiens
actagccaaggc

SEQ ID NO: 1803803 - DNA, 23 bp, Homo sapiens
actagtaataatgtaatactgta

SEQ ID NO: 1803804 - DNA, 13 bp, Homo sapiens
actagtgcctaga

SEQ ID NO: 1803805 - DNA, 16 bp, Homo sapiens
actatatttatttatg

SEQ ID NO: 1803806 - DNA, 18 bp, Homo sapiens
actatatttatttatgta

SEQ ID NO: 1803807 - DNA, 14 bp, Homo sapiens
actattaaatgttg

SEQ ID NO: 1803808 - DNA, 15 bp, Homo sapiens
actattcaatgcaat

SEQ ID NO: 1803809 - DNA, 16 bp, Homo sapiens
actattcaatgcaatg

SEQ ID NO: 1803810 - DNA, 16 bp, Homo sapiens
actattttgaagaaaa

SEQ ID NO: 1803811 - DNA, 19 bp, Homo sapiens
actcaccagggtccgcacc

SEQ ID NO: 1803812 - DNA, 14 bp, Homo sapiens
actcagagcagagc

SEQ ID NO: 1803813 - DNA, 14 bp, Homo sapiens
actcagcagcagag

SEQ ID NO: 1803814 - DNA, 16 bp, Homo sapiens
actcagcagcagagag

SEQ ID NO: 1803815 - DNA, 14 bp, Homo sapiens
actccactctcctt

SEQ ID NO: 1803816 - DNA, 16 bp, Homo sapiens
actccactctccttcg

SEQ ID NO: 1803817 - DNA, 17 bp, Homo sapiens
actccagaatctgctgt

SEQ ID NO: 1803818 - DNA, 14 bp, Homo sapiens
actccaggggcacc

SEQ ID NO: 1803819 - DNA, 15 bp, Homo sapiens
actccaggggcacct

SEQ ID NO: 1803820 - DNA, 16 bp, Homo sapiens
actcccacttccctga

SEQ ID NO: 1803821 - DNA, 14 bp, Homo sapiens
actcccccacctga

SEQ ID NO: 1803822 - DNA, 11 bp, Homo sapiens
actcccttcct

SEQ ID NO: 1803823 - DNA, 15 bp, Homo sapiens
actcccttcctggcc

SEQ ID NO: 1803824 - DNA, 16 bp, Homo sapiens
actcccttcctggcct

SEQ ID NO: 1803825 - DNA, 12 bp, Homo sapiens
actcctgtcccg

SEQ ID NO: 1803826 - DNA, 17 bp, Homo sapiens
actcgggctcctgtgcc

SEQ ID NO: 1803827 - DNA, 20 bp, Homo sapiens
actctatactcaatcaagca

SEQ ID NO: 1803828 - DNA, 14 bp, Homo sapiens
actctatagacttt

SEQ ID NO: 1803829 - DNA, 12 bp, Homo sapiens
actctgagccca

SEQ ID NO: 1803830 - DNA, 15 bp, Homo sapiens
actctgagcccaggc

SEQ ID NO: 1803831 - DNA, 17 bp, Homo sapiens
actctgagcccaggccg

SEQ ID NO: 1803832 - DNA, 18 bp, Homo sapiens
actctgagcccaggccgt

SEQ ID NO: 1803833 - DNA, 14 bp, Homo sapiens
actctgtccaggcc

SEQ ID NO: 1803834 - DNA, 15 bp, Homo sapiens
actctgtccaggcca

SEQ ID NO: 1803835 - DNA, 12 bp, Homo sapiens
actctgtgccca

SEQ ID NO: 1803836 - DNA, 15 bp, Homo sapiens
actctgtgcccatgg

SEQ ID NO: 1803837 - DNA, 24 bp, Homo sapiens
actctgtgcccatgggcactgctg

SEQ ID NO: 1803838 - DNA, 13 bp, Homo sapiens
actctttttgtac

SEQ ID NO: 1803839 - DNA, 15 bp, Homo sapiens
actgaaagcagcagc

SEQ ID NO: 1803840 - DNA, 21 bp, Homo sapiens
actgaaccgacttttctaaag

SEQ ID NO: 1803841 - DNA, 16 bp, Homo sapiens
actgaaggggcacacc

SEQ ID NO: 1803842 - DNA, 20 bp, Homo sapiens
actgaagtgcttgcagatca

SEQ ID NO: 1803843 - DNA, 14 bp, Homo sapiens
actgaccccctccc

SEQ ID NO: 1803844 - DNA, 16 bp, Homo sapiens
actgaccccctcccct

SEQ ID NO: 1803845 - DNA, 14 bp, Homo sapiens
actgatactattca

SEQ ID NO: 1803846 - DNA, 15 bp, Homo sapiens
actgatactattcaa

SEQ ID NO: 1803847 - DNA, 19 bp, Homo sapiens
actgatactattcaatgca

SEQ ID NO: 1803848 - DNA, 22 bp, Homo sapiens
actgatggaccgggtgggcctg

SEQ ID NO: 1803849 - DNA, 18 bp, Homo sapiens
actgcacacacagctcct

SEQ ID NO: 1803850 - DNA, 18 bp, Homo sapiens
actgcaccccctcctgct

SEQ ID NO: 1803851 - DNA, 21 bp, Homo sapiens
actgcaccccctcctgctgca

SEQ ID NO: 1803852 - DNA, 16 bp, Homo sapiens
actgccaaaacaatgc

SEQ ID NO: 1803853 - DNA, 22 bp, Homo sapiens
actgccagactgaaccagagct

SEQ ID NO: 1803854 - DNA, 17 bp, Homo sapiens
acaggggcaggcctggg

SEQ ID NO: 1803855 - DNA, 19 bp, Homo sapiens
acaggggcggggcaggaat

SEQ ID NO: 1803856 - DNA, 17 bp, Homo sapiens
acagtatcttcaaaaat

SEQ ID NO: 1803857 - DNA, 18 bp, Homo sapiens
acagtcctcacagcctct

SEQ ID NO: 1803858 - DNA, 22 bp, Homo sapiens
acagtcctcacagcctctccct

SEQ ID NO: 1803859 - DNA, 23 bp, Homo sapiens
acagtcctctccacctagtggct

SEQ ID NO: 1803860 - DNA, 15 bp, Homo sapiens
acagtctcaaatttt

SEQ ID NO: 1803861 - DNA, 13 bp, Homo sapiens
acagtgacagtca

SEQ ID NO: 1803862 - DNA, 11 bp, Homo sapiens
acagtgcagtt

SEQ ID NO: 1803863 - DNA, 18 bp, Homo sapiens
acagtgcccagctaattt

SEQ ID NO: 1803864 - DNA, 15 bp, Homo sapiens
acagtgctgcttctc

SEQ ID NO: 1803865 - DNA, 16 bp, Homo sapiens
acagtgggtggcacct

SEQ ID NO: 1803866 - DNA, 21 bp, Homo sapiens
acagtgttaggcctggcacag

SEQ ID NO: 1803867 - DNA, 23 bp, Homo sapiens
acagtgttaggcctggcacagtg

SEQ ID NO: 1803868 - DNA, 21 bp, Homo sapiens
acagttggcagagaaggcctc

SEQ ID NO: 1803869 - DNA, 20 bp, Homo sapiens
acagttgtctattctgagcc

SEQ ID NO: 1803870 - DNA, 12 bp, Homo sapiens
acataaaggtat

SEQ ID NO: 1803871 - DNA, 17 bp, Homo sapiens
acatacttcaaaaatgt

SEQ ID NO: 1803872 - DNA, 23 bp, Homo sapiens
acatatatgtatatgtatatcta

SEQ ID NO: 1803873 - DNA, 18 bp, Homo sapiens
acatcattcattcactgt

SEQ ID NO: 1803874 - DNA, 23 bp, Homo sapiens
acatcctcattcactaagccatg

SEQ ID NO: 1803875 - DNA, 14 bp, Homo sapiens
acatctggcatggc

SEQ ID NO: 1803876 - DNA, 12 bp, Homo sapiens
acatgattttct

SEQ ID NO: 1803877 - DNA, 16 bp, Homo sapiens
acatgcaacaaaaatg

SEQ ID NO: 1803878 - DNA, 17 bp, Homo sapiens
acatgcaacaaaaatgt

SEQ ID NO: 1803879 - DNA, 20 bp, Homo sapiens
acattaaaatagcacatgat

SEQ ID NO: 1803880 - DNA, 21 bp, Homo sapiens
acattaaaatagcacatgatt

SEQ ID NO: 1803881 - DNA, 14 bp, Homo sapiens
acattaaattaaat

SEQ ID NO: 1803882 - DNA, 14 bp, Homo sapiens
acattaaggagcag

SEQ ID NO: 1803883 - DNA, 13 bp, Homo sapiens
acattatgttatt

SEQ ID NO: 1803884 - DNA, 17 bp, Homo sapiens
acattcctccagcctcc

SEQ ID NO: 1803885 - DNA, 15 bp, Homo sapiens
acattcctctgcagc

SEQ ID NO: 1803886 - DNA, 22 bp, Homo sapiens
acattgaatatcagttgacaga

SEQ ID NO: 1803887 - DNA, 14 bp, Homo sapiens
acattttcctgtgt

SEQ ID NO: 1803888 - DNA, 20 bp, Homo sapiens
acattttgtacaaagatatg

SEQ ID NO: 1803889 - DNA, 16 bp, Homo sapiens
accaaattgcttctag

SEQ ID NO: 1803890 - DNA, 15 bp, Homo sapiens
accaacagcttttcc

SEQ ID NO: 1803891 - DNA, 12 bp, Homo sapiens
accaacccagcc

SEQ ID NO: 1803892 - DNA, 13 bp, Homo sapiens
accaacccagccg

SEQ ID NO: 1803893 - DNA, 16 bp, Homo sapiens
accaacccagccgctg

SEQ ID NO: 1803894 - DNA, 12 bp, Homo sapiens
accaagctgtgc

SEQ ID NO: 1803895 - DNA, 13 bp, Homo sapiens
accaagctgtgcc

SEQ ID NO: 1803896 - DNA, 18 bp, Homo sapiens
accaagctgtgccaccct

SEQ ID NO: 1803897 - DNA, 19 bp, Homo sapiens
accaagctgtgccaccctg

SEQ ID NO: 1803898 - DNA, 23 bp, Homo sapiens
accaagctgtgccaccctgggct

SEQ ID NO: 1803899 - DNA, 15 bp, Homo sapiens
accaaggcagcctcc

SEQ ID NO: 1803900 - DNA, 22 bp, Homo sapiens
accaaggcagcctccagagcca

SEQ ID NO: 1803901 - DNA, 19 bp, Homo sapiens
accacagcaaggcacctgc

SEQ ID NO: 1803902 - DNA, 19 bp, Homo sapiens
accacagtgggtggcacct

SEQ ID NO: 1803903 - DNA, 21 bp, Homo sapiens
accacagtgggtggcacctcc

SEQ ID NO: 1803904 - DNA, 23 bp, Homo sapiens
accaccctatcatcagttaggat

SEQ ID NO: 1803905 - DNA, 23 bp, Homo sapiens
accacctctcaatattcaataaa

SEQ ID NO: 1803906 - DNA, 19 bp, Homo sapiens
accactagggtcctggccc

SEQ ID NO: 1803907 - DNA, 21 bp, Homo sapiens
accactagggtcctggccctc

SEQ ID NO: 1803908 - DNA, 13 bp, Homo sapiens
accactccagaga

SEQ ID NO: 1803909 - DNA, 17 bp, Homo sapiens
accactgccctgcctgc

SEQ ID NO: 1803910 - DNA, 18 bp, Homo sapiens
accactgccctgcctgcc

SEQ ID NO: 1803911 - DNA, 16 bp, Homo sapiens
accagaacgcacccca

SEQ ID NO: 1803912 - DNA, 12 bp, Homo sapiens
accagcaggtgt

SEQ ID NO: 1803913 - DNA, 13 bp, Homo sapiens
accagcaggtgtg

SEQ ID NO: 1803914 - DNA, 15 bp, Homo sapiens
accagccccctggat

SEQ ID NO: 1803915 - DNA, 19 bp, Homo sapiens
accagccccctggatgggc

SEQ ID NO: 1803916 - DNA, 19 bp, Homo sapiens
accagctctgtggcctgtg

SEQ ID NO: 1803917 - DNA, 14 bp, Homo sapiens
accagggaggagag

SEQ ID NO: 1803918 - DNA, 17 bp, Homo sapiens
accaggggcaggcacag

SEQ ID NO: 1803919 - DNA, 19 bp, Homo sapiens
accaggggcaggcacagca

SEQ ID NO: 1803920 - DNA, 20 bp, Homo sapiens
accaggggcaggcacagcac

SEQ ID NO: 1803921 - DNA, 13 bp, Homo sapiens
accataaaaagag

SEQ ID NO: 1803922 - DNA, 16 bp, Homo sapiens
accataaaaagaggat

SEQ ID NO: 1803923 - DNA, 22 bp, Homo sapiens
accatgctgctttttggcacag

SEQ ID NO: 1803924 - DNA, 12 bp, Homo sapiens
accattggctgc

SEQ ID NO: 1803925 - DNA, 20 bp, Homo sapiens
accatttgtattaccattac

SEQ ID NO: 1803926 - DNA, 21 bp, Homo sapiens
acccacccatcttcctgctgc

SEQ ID NO: 1803927 - DNA, 22 bp, Homo sapiens
acccacccatcttcctgctgct

SEQ ID NO: 1803928 - DNA, 23 bp, Homo sapiens
acccacccatcttcctgctgctg

SEQ ID NO: 1803929 - DNA, 22 bp, Homo sapiens
acccagctactctgtccaggcc

SEQ ID NO: 1803930 - DNA, 16 bp, Homo sapiens
acccaggccctccatg

SEQ ID NO: 1803931 - DNA, 17 bp, Homo sapiens
acccaggccctccatgg

SEQ ID NO: 1803932 - DNA, 20 bp, Homo sapiens
acccaggccctccatgggct

SEQ ID NO: 1803933 - DNA, 22 bp, Homo sapiens
acccaggccctccatgggctag

SEQ ID NO: 1803934 - DNA, 13 bp, Homo sapiens
acccaggctgcac

SEQ ID NO: 1803935 - DNA, 16 bp, Homo sapiens
acccaggctgcactgc

SEQ ID NO: 1803936 - DNA, 21 bp, Homo sapiens
acccagtcttatttttctagt

SEQ ID NO: 1803937 - DNA, 21 bp, Homo sapiens
acccagtgctgccatgccact

SEQ ID NO: 1803938 - DNA, 15 bp, Homo sapiens
acccagtgtaaagaa

SEQ ID NO: 1803939 - DNA, 22 bp, Homo sapiens
acccagtgtaaagaataaatga

SEQ ID NO: 1803940 - DNA, 16 bp, Homo sapiens
acccatcttcctgctg

SEQ ID NO: 1803941 - DNA, 20 bp, Homo sapiens
acccatcttcctgctgctgt

SEQ ID NO: 1803942 - DNA, 19 bp, Homo sapiens
acccattcccccatgtggc

SEQ ID NO: 1803943 - DNA, 13 bp, Homo sapiens
accccagccccaa

SEQ ID NO: 1803944 - DNA, 13 bp, Homo sapiens
accccatctgccc

SEQ ID NO: 1803945 - DNA, 21 bp, Homo sapiens
acccccagcacccgggctcag

SEQ ID NO: 1803946 - DNA, 13 bp, Homo sapiens
acccccagcccac

SEQ ID NO: 1803947 - DNA, 14 bp, Homo sapiens
acccccagcccaca

SEQ ID NO: 1803948 - DNA, 16 bp, Homo sapiens
acccccagcccacaga

SEQ ID NO: 1803949 - DNA, 17 bp, Homo sapiens
acccccagcccacagag

SEQ ID NO: 1803950 - DNA, 13 bp, Homo sapiens
acccccctcccag

SEQ ID NO: 1803951 - DNA, 14 bp, Homo sapiens
acccccctcccaga

SEQ ID NO: 1803952 - DNA, 18 bp, Homo sapiens
acccccctcccagacagg

SEQ ID NO: 1803953 - DNA, 15 bp, Homo sapiens
acccccgcccaggct

SEQ ID NO: 1803954 - DNA, 19 bp, Homo sapiens
acccccgcccaggctggcc

SEQ ID NO: 1803955 - DNA, 20 bp, Homo sapiens
acccccgcccaggctggcca

SEQ ID NO: 1803956 - DNA, 15 bp, Homo sapiens
accccctcctgctgc

SEQ ID NO: 1803957 - DNA, 15 bp, Homo sapiens
accccgcagcccgtg

SEQ ID NO: 1803958 - DNA, 18 bp, Homo sapiens
accccgcggtgctctggc

SEQ ID NO: 1803959 - DNA, 19 bp, Homo sapiens
accccgcggtgctctggcg

SEQ ID NO: 1803960 - DNA, 14 bp, Homo sapiens
acccctcccagctg

SEQ ID NO: 1803961 - DNA, 22 bp, Homo sapiens
acccctcccagctgacagtcct

SEQ ID NO: 1803962 - DNA, 17 bp, Homo sapiens
acccctgtacccagctc

SEQ ID NO: 1803963 - DNA, 19 bp, Homo sapiens
acccctgtacccagctcct

SEQ ID NO: 1803964 - DNA, 17 bp, Homo sapiens
accccttttcagcttct

SEQ ID NO: 1803965 - DNA, 16 bp, Homo sapiens
acccgccttttataaa

SEQ ID NO: 1803966 - DNA, 12 bp, Homo sapiens
acccgggctcag

SEQ ID NO: 1803967 - DNA, 14 bp, Homo sapiens
accctatcatcagt

SEQ ID NO: 1803968 - DNA, 12 bp, Homo sapiens
accctcccctcc

SEQ ID NO: 1803969 - DNA, 13 bp, Homo sapiens
accctcccctccc

SEQ ID NO: 1803970 - DNA, 17 bp, Homo sapiens
acccttgtgcttggtgg

SEQ ID NO: 1803971 - DNA, 21 bp, Homo sapiens
accgagaggaaaaaggcttct

SEQ ID NO: 1803972 - DNA, 14 bp, Homo sapiens
accgcatgccccct

SEQ ID NO: 1803973 - DNA, 13 bp, Homo sapiens
ggctggccagccc

SEQ ID NO: 1803974 - DNA, 18 bp, Homo sapiens
ggctggccagccccacag

SEQ ID NO: 1803975 - DNA, 12 bp, Homo sapiens
ggctggctgggg

SEQ ID NO: 1803976 - DNA, 13 bp, Homo sapiens
ggctggggcagag

SEQ ID NO: 1803977 - DNA, 22 bp, Homo sapiens
ggctggggcagaggggcagccg

SEQ ID NO: 1803978 - DNA, 16 bp, Homo sapiens
ggctgggttggcgcac

SEQ ID NO: 1803979 - DNA, 19 bp, Homo sapiens
ggctgggttggcgcaccct

SEQ ID NO: 1803980 - DNA, 17 bp, Homo sapiens
ggctgtggaggcctgat

SEQ ID NO: 1803981 - DNA, 22 bp, Homo sapiens
ggcttccaaggtggtctgctcg

SEQ ID NO: 1803982 - DNA, 14 bp, Homo sapiens
ggcttccaggctct

SEQ ID NO: 1803983 - DNA, 17 bp, Homo sapiens
ggcttccaggctcttcc

SEQ ID NO: 1803984 - DNA, 19 bp, Homo sapiens
ggcttcctccgtccaccca

SEQ ID NO: 1803985 - DNA, 20 bp, Homo sapiens
ggcttcctccgtccacccag

SEQ ID NO: 1803986 - DNA, 12 bp, Homo sapiens
ggcttcctgtcc

SEQ ID NO: 1803987 - DNA, 18 bp, Homo sapiens
ggcttcctgtccactctc

SEQ ID NO: 1803988 - DNA, 14 bp, Homo sapiens
ggcttgctccaggg

SEQ ID NO: 1803989 - DNA, 15 bp, Homo sapiens
ggcttgctccagggt

SEQ ID NO: 1803990 - DNA, 24 bp, Homo sapiens
ggctttctccggggtctgtgctgt

SEQ ID NO: 1803991 - DNA, 15 bp, Homo sapiens
ggctttgcaggctct

SEQ ID NO: 1803992 - DNA, 19 bp, Homo sapiens
gggaaaggatggagtgttt

SEQ ID NO: 1803993 - DNA, 17 bp, Homo sapiens
gggaaccccgcagcccg

SEQ ID NO: 1803994 - DNA, 18 bp, Homo sapiens
gggaaccccgcagcccgt

SEQ ID NO: 1803995 - DNA, 20 bp, Homo sapiens
gggaacctagtactctctgc

SEQ ID NO: 1803996 - DNA, 18 bp, Homo sapiens
gggaactccactctcctt

SEQ ID NO: 1803997 - DNA, 16 bp, Homo sapiens
gggaagagcacagccc

SEQ ID NO: 1803998 - DNA, 20 bp, Homo sapiens
gggaagagcacagccctccc

SEQ ID NO: 1803999 - DNA, 22 bp, Homo sapiens
gggaagagcacagccctcccgc

SEQ ID NO: 1804000 - DNA, 16 bp, Homo sapiens
gggaatgttccctgca

SEQ ID NO: 1804001 - DNA, 20 bp, Homo sapiens
gggacagaaaagaaagctgc

SEQ ID NO: 1804002 - DNA, 22 bp, Homo sapiens
gggaccacagcaaggcacctgc

SEQ ID NO: 1804003 - DNA, 23 bp, Homo sapiens
gggaccacagcaaggcacctgca

SEQ ID NO: 1804004 - DNA, 22 bp, Homo sapiens
gggacccagctactctgtccag

SEQ ID NO: 1804005 - DNA, 22 bp, Homo sapiens
gggagaatgtcagtatgtggaa

SEQ ID NO: 1804006 - DNA, 14 bp, Homo sapiens
gggagatggtcagt

SEQ ID NO: 1804007 - DNA, 15 bp, Homo sapiens
gggagatggtcagtg

SEQ ID NO: 1804008 - DNA, 23 bp, Homo sapiens
gggagcacttgcgtcctgcagag

SEQ ID NO: 1804009 - DNA, 12 bp, Homo sapiens
gggaggcaccag

SEQ ID NO: 1804010 - DNA, 16 bp, Homo sapiens
gggaggccaaggcagg

SEQ ID NO: 1804011 - DNA, 19 bp, Homo sapiens
gggaggccaaggcaggtag

SEQ ID NO: 1804012 - DNA, 20 bp, Homo sapiens
gggagttgagtcacaagagg

SEQ ID NO: 1804013 - DNA, 14 bp, Homo sapiens
gggatgtctctcat

SEQ ID NO: 1804014 - DNA, 20 bp, Homo sapiens
gggatttcttcgctgctcta

SEQ ID NO: 1804015 - DNA, 17 bp, Homo sapiens
gggcacaccactgccct

SEQ ID NO: 1804016 - DNA, 18 bp, Homo sapiens
gggcacaccactgccctg

SEQ ID NO: 1804017 - DNA, 20 bp, Homo sapiens
gggcacaccactgccctgcc

SEQ ID NO: 1804018 - DNA, 22 bp, Homo sapiens
gggcacaccactgccctgcctg

SEQ ID NO: 1804019 - DNA, 22 bp, Homo sapiens
gggcacctatgagatggccatg

SEQ ID NO: 1804020 - DNA, 21 bp, Homo sapiens
gggcactgctgggtggcccat

SEQ ID NO: 1804021 - DNA, 14 bp, Homo sapiens
gggcagagccatgg

SEQ ID NO: 1804022 - DNA, 15 bp, Homo sapiens
gggcagagccatggg

SEQ ID NO: 1804023 - DNA, 16 bp, Homo sapiens
gggcagagccatgggc

SEQ ID NO: 1804024 - DNA, 14 bp, Homo sapiens
gggcagagggaatg

SEQ ID NO: 1804025 - DNA, 22 bp, Homo sapiens
gggcagagggaatgttccctgc

SEQ ID NO: 1804026 - DNA, 13 bp, Homo sapiens
gggcagaggggca

SEQ ID NO: 1804027 - DNA, 14 bp, Homo sapiens
gggcagaggggcag

SEQ ID NO: 1804028 - DNA, 15 bp, Homo sapiens
gggcagaggggcagc

SEQ ID NO: 1804029 - DNA, 13 bp, Homo sapiens
gggcagcacagca

SEQ ID NO: 1804030 - DNA, 23 bp, Homo sapiens
gggcagccccgttttggggacgt

SEQ ID NO: 1804031 - DNA, 22 bp, Homo sapiens
gggcagccgctaggagagactg

SEQ ID NO: 1804032 - DNA, 21 bp, Homo sapiens
gggcaggccctgcactgtcct

SEQ ID NO: 1804033 - DNA, 23 bp, Homo sapiens
gggcaggccctgcactgtcctgc

SEQ ID NO: 1804034 - DNA, 11 bp, Homo sapiens
gggcaggcctg

SEQ ID NO: 1804035 - DNA, 12 bp, Homo sapiens
gggcaggcctgg

SEQ ID NO: 1804036 - DNA, 21 bp, Homo sapiens
gggcaggcctgggacccagct

SEQ ID NO: 1804037 - DNA, 23 bp, Homo sapiens
gggcaggcctgggacccagctac

SEQ ID NO: 1804038 - DNA, 17 bp, Homo sapiens
gggcatcaggcactggt

SEQ ID NO: 1804039 - DNA, 21 bp, Homo sapiens
gggcatccacccagtgctgcc

SEQ ID NO: 1804040 - DNA, 22 bp, Homo sapiens
gggcatccacccagtgctgcca

SEQ ID NO: 1804041 - DNA, 19 bp, Homo sapiens
gggcatggttccttccctg

SEQ ID NO: 1804042 - DNA, 23 bp, Homo sapiens
gggcattgggctgacacctacca

SEQ ID NO: 1804043 - DNA, 20 bp, Homo sapiens
gggccagaaggagggcagag

SEQ ID NO: 1804044 - DNA, 21 bp, Homo sapiens
gggccagaaggagggcagagc

SEQ ID NO: 1804045 - DNA, 16 bp, Homo sapiens
gggccatactggcctc

SEQ ID NO: 1804046 - DNA, 16 bp, Homo sapiens
gggcccagctgtagcc

SEQ ID NO: 1804047 - DNA, 22 bp, Homo sapiens
gggcccataatagttagccctc

SEQ ID NO: 1804048 - DNA, 22 bp, Homo sapiens
gggccccacctacttgtgactg

SEQ ID NO: 1804049 - DNA, 13 bp, Homo sapiens
gggccccagatct

SEQ ID NO: 1804050 - DNA, 19 bp, Homo sapiens
gggccccagatctgcctgg

SEQ ID NO: 1804051 - DNA, 23 bp, Homo sapiens
gggccccagatctgcctgggcct

SEQ ID NO: 1804052 - DNA, 24 bp, Homo sapiens
gggccccagatctgcctgggcctg

SEQ ID NO: 1804053 - DNA, 12 bp, Homo sapiens
gggccccatgct

SEQ ID NO: 1804054 - DNA, 13 bp, Homo sapiens
gggccccatgctc

SEQ ID NO: 1804055 - DNA, 16 bp, Homo sapiens
gggccccatgctctgc

SEQ ID NO: 1804056 - DNA, 21 bp, Homo sapiens
gggccccggggctggcaagca

SEQ ID NO: 1804057 - DNA, 15 bp, Homo sapiens
gggcccctccctctg

SEQ ID NO: 1804058 - DNA, 17 bp, Homo sapiens
gggcccctccctctgcc

SEQ ID NO: 1804059 - DNA, 18 bp, Homo sapiens
gggcccctccctctgccc

SEQ ID NO: 1804060 - DNA, 19 bp, Homo sapiens
gggcccctccctctgcccc

SEQ ID NO: 1804061 - DNA, 17 bp, Homo sapiens
gggcccttggggcctgg

SEQ ID NO: 1804062 - DNA, 14 bp, Homo sapiens
gggcctatcagtgt

SEQ ID NO: 1804063 - DNA, 18 bp, Homo sapiens
gggcctatcagtgtgccc

SEQ ID NO: 1804064 - DNA, 20 bp, Homo sapiens
gggcctatcagtgtgccccc

SEQ ID NO: 1804065 - DNA, 15 bp, Homo sapiens
gggcctgcccaatgc

SEQ ID NO: 1804066 - DNA, 18 bp, Homo sapiens
gggcctgcttttccagga

SEQ ID NO: 1804067 - DNA, 13 bp, Homo sapiens
gggcctggcctga

SEQ ID NO: 1804068 - DNA, 20 bp, Homo sapiens
gggcctggcttgctccaggg

SEQ ID NO: 1804069 - DNA, 15 bp, Homo sapiens
gggcctgggcctgct

SEQ ID NO: 1804070 - DNA, 20 bp, Homo sapiens
gggcctgggggcagtgactg

SEQ ID NO: 1804071 - DNA, 16 bp, Homo sapiens
gggcctgtcccccaag

SEQ ID NO: 1804072 - DNA, 12 bp, Homo sapiens
gggcgctcagga

SEQ ID NO: 1804073 - DNA, 15 bp, Homo sapiens
gggcgctcaggaccc

SEQ ID NO: 1804074 - DNA, 12 bp, Homo sapiens
gggcggggcagg

SEQ ID NO: 1804075 - DNA, 16 bp, Homo sapiens
gggcggggcaggaatg

SEQ ID NO: 1804076 - DNA, 13 bp, Homo sapiens
gggctaaatgaag

SEQ ID NO: 1804077 - DNA, 20 bp, Homo sapiens
gggctaattctgggaaggga

SEQ ID NO: 1804078 - DNA, 21 bp, Homo sapiens
gggctaattctgggaagggag

SEQ ID NO: 1804079 - DNA, 17 bp, Homo sapiens
gggctactggcagctcc

SEQ ID NO: 1804080 - DNA, 19 bp, Homo sapiens
gggctactggcagctcctc

SEQ ID NO: 1804081 - DNA, 19 bp, Homo sapiens
gggctagtgtgagtggcag

SEQ ID NO: 1804082 - DNA, 23 bp, Homo sapiens
gggctagtgtgagtggcagccat

SEQ ID NO: 1804083 - DNA, 18 bp, Homo sapiens
gggctcagagtggggtag

SEQ ID NO: 1804084 - DNA, 13 bp, Homo sapiens
gggctccagcatc

SEQ ID NO: 1804085 - DNA, 23 bp, Homo sapiens
gggctccagcatccagcctgtgt

SEQ ID NO: 1804086 - DNA, 17 bp, Homo sapiens
gggctcctggctgccag

SEQ ID NO: 1804087 - DNA, 18 bp, Homo sapiens
gggctcctggctgccagg

SEQ ID NO: 1804088 - DNA, 19 bp, Homo sapiens
gggctcctggctgccaggc

SEQ ID NO: 1804089 - DNA, 14 bp, Homo sapiens
gggctcctgtgccc

SEQ ID NO: 1804090 - DNA, 15 bp, Homo sapiens
gggctcctgtgccct

SEQ ID NO: 1804091 - DNA, 22 bp, Homo sapiens
tatttcattatctgtactgaaa

SEQ ID NO: 1804092 - DNA, 16 bp, Homo sapiens
tatttccacataaagg

SEQ ID NO: 1804093 - DNA, 18 bp, Homo sapiens
tatttccacataaaggta

SEQ ID NO: 1804094 - DNA, 22 bp, Homo sapiens
tatttgtaaatttatgtgatgg

SEQ ID NO: 1804095 - DNA, 18 bp, Homo sapiens
tattttaaaaaatcaaaa

SEQ ID NO: 1804096 - DNA, 12 bp, Homo sapiens
tattttccaaag

SEQ ID NO: 1804097 - DNA, 22 bp, Homo sapiens
tattttctgagtagcatatata

SEQ ID NO: 1804098 - DNA, 20 bp, Homo sapiens
tattttcttatgtaagtttg

SEQ ID NO: 1804099 - DNA, 20 bp, Homo sapiens
tattttgaagaaaacacaac

SEQ ID NO: 1804100 - DNA, 14 bp, Homo sapiens
tattttgacaaaaa

SEQ ID NO: 1804101 - DNA, 21 bp, Homo sapiens
tatttttgcactggaatatct

SEQ ID NO: 1804102 - DNA, 21 bp, Homo sapiens
tattttttaaatttacagaat

SEQ ID NO: 1804103 - DNA, 15 bp, Homo sapiens
tattttttatttcca

SEQ ID NO: 1804104 - DNA, 18 bp, Homo sapiens
tattttttatttccacat

SEQ ID NO: 1804105 - DNA, 16 bp, Homo sapiens
tcaaaaggcactgtga

SEQ ID NO: 1804106 - DNA, 18 bp, Homo sapiens
tcaaaaggcactgtgaac

SEQ ID NO: 1804107 - DNA, 18 bp, Homo sapiens
tcaaaatacgtgttcaaa

SEQ ID NO: 1804108 - DNA, 14 bp, Homo sapiens
tcaaaatcaaagtt

SEQ ID NO: 1804109 - DNA, 13 bp, Homo sapiens
tcaaatttttcat

SEQ ID NO: 1804110 - DNA, 21 bp, Homo sapiens
tcaaatttttcatctcttcaa

SEQ ID NO: 1804111 - DNA, 12 bp, Homo sapiens
tcaacccccctc

SEQ ID NO: 1804112 - DNA, 14 bp, Homo sapiens
tcaacccccctccc

SEQ ID NO: 1804113 - DNA, 20 bp, Homo sapiens
tcaagaaaaatataaaaaca

SEQ ID NO: 1804114 - DNA, 15 bp, Homo sapiens
tcaagaaatgagtct

SEQ ID NO: 1804115 - DNA, 17 bp, Homo sapiens
tcaagatgtttatctga

SEQ ID NO: 1804116 - DNA, 15 bp, Homo sapiens
tcaagcaacagcact

SEQ ID NO: 1804117 - DNA, 22 bp, Homo sapiens
tcaagcagacgtgagtgtgact

SEQ ID NO: 1804118 - DNA, 22 bp, Homo sapiens
tcaaggccatattttaaaaaat

SEQ ID NO: 1804119 - DNA, 19 bp, Homo sapiens
tcaaggcctcccacagtga

SEQ ID NO: 1804120 - DNA, 11 bp, Homo sapiens
tcaagtctgtg

SEQ ID NO: 1804121 - DNA, 15 bp, Homo sapiens
tcaagtgatctttca

SEQ ID NO: 1804122 - DNA, 20 bp, Homo sapiens
tcaataactttatatgaagt

SEQ ID NO: 1804123 - DNA, 22 bp, Homo sapiens
tcaataccccaagtccacctgc

SEQ ID NO: 1804124 - DNA, 14 bp, Homo sapiens
tcaatatcattact

SEQ ID NO: 1804125 - DNA, 16 bp, Homo sapiens
tcaatattcaataaag

SEQ ID NO: 1804126 - DNA, 13 bp, Homo sapiens
tcaatcaagcaaa

SEQ ID NO: 1804127 - DNA, 15 bp, Homo sapiens
tcaatgcaatgaaaa

SEQ ID NO: 1804128 - DNA, 17 bp, Homo sapiens
tcacaacagatttctaa

SEQ ID NO: 1804129 - DNA, 19 bp, Homo sapiens
tcacaacagatttctaagt

SEQ ID NO: 1804130 - DNA, 20 bp, Homo sapiens
tcacaacagatttctaagtt

SEQ ID NO: 1804131 - DNA, 22 bp, Homo sapiens
tcacactactgtatttcattat

SEQ ID NO: 1804132 - DNA, 15 bp, Homo sapiens
tcacagcctctccct

SEQ ID NO: 1804133 - DNA, 13 bp, Homo sapiens
tcacagctgcagc

SEQ ID NO: 1804134 - DNA, 19 bp, Homo sapiens
tcacaggggcggggcagga

SEQ ID NO: 1804135 - DNA, 19 bp, Homo sapiens
tcaccaggggcaggcacag

SEQ ID NO: 1804136 - DNA, 23 bp, Homo sapiens
tcacctcttatgcacacctccca

SEQ ID NO: 1804137 - DNA, 15 bp, Homo sapiens
tcacctgcaagcccc

SEQ ID NO: 1804138 - DNA, 17 bp, Homo sapiens
tcacctgcaagccccag

SEQ ID NO: 1804139 - DNA, 21 bp, Homo sapiens
tcacctgcaagccccagggcc

SEQ ID NO: 1804140 - DNA, 17 bp, Homo sapiens
tcactagtcaagaaaaa

SEQ ID NO: 1804141 - DNA, 11 bp, Homo sapiens
tcactggctgg

SEQ ID NO: 1804142 - DNA, 20 bp, Homo sapiens
tcactgtatagtaatcattg

SEQ ID NO: 1804143 - DNA, 22 bp, Homo sapiens
tcacttctggcactgtgactac

SEQ ID NO: 1804144 - DNA, 21 bp, Homo sapiens
tcagaaagtttgaagcaccat

SEQ ID NO: 1804145 - DNA, 15 bp, Homo sapiens
tcagaaattctcaaa

SEQ ID NO: 1804146 - DNA, 21 bp, Homo sapiens
tcagaacagaggcatttaaaa

SEQ ID NO: 1804147 - DNA, 15 bp, Homo sapiens
tcagacttacttact

SEQ ID NO: 1804148 - DNA, 19 bp, Homo sapiens
tcagagctcttcaagctgt

SEQ ID NO: 1804149 - DNA, 21 bp, Homo sapiens
tcagagctcttcaagctgtcc

SEQ ID NO: 1804150 - DNA, 14 bp, Homo sapiens
tcagagttttctaa

SEQ ID NO: 1804151 - DNA, 13 bp, Homo sapiens
tcagatttcaaat

SEQ ID NO: 1804152 - DNA, 14 bp, Homo sapiens
tcagatttcaaatt

SEQ ID NO: 1804153 - DNA, 15 bp, Homo sapiens
tcagatttcaaatta

SEQ ID NO: 1804154 - DNA, 22 bp, Homo sapiens
tcagatttgccttattggcagc

SEQ ID NO: 1804155 - DNA, 13 bp, Homo sapiens
tcagcaccctggg

SEQ ID NO: 1804156 - DNA, 15 bp, Homo sapiens
tcagcaccctgggtg

SEQ ID NO: 1804157 - DNA, 22 bp, Homo sapiens
tcagcttatgggatccttgtct

SEQ ID NO: 1804158 - DNA, 14 bp, Homo sapiens
tcagcttctgctgg

SEQ ID NO: 1804159 - DNA, 23 bp, Homo sapiens
tcagcttctgctgggctggggcc

SEQ ID NO: 1804160 - DNA, 17 bp, Homo sapiens
tcaggaaaagcctctgt

SEQ ID NO: 1804161 - DNA, 19 bp, Homo sapiens
tcaggaaaagcctctgtgt

SEQ ID NO: 1804162 - DNA, 14 bp, Homo sapiens
tcaggcactggtgg

SEQ ID NO: 1804163 - DNA, 16 bp, Homo sapiens
tcaggcactggtggca

SEQ ID NO: 1804164 - DNA, 13 bp, Homo sapiens
tcagggaccacag

SEQ ID NO: 1804165 - DNA, 18 bp, Homo sapiens
tcagggagacaggcaggg

SEQ ID NO: 1804166 - DNA, 23 bp, Homo sapiens
tcagggccagaaggagggcagag

SEQ ID NO: 1804167 - DNA, 12 bp, Homo sapiens
tcagggctggag

SEQ ID NO: 1804168 - DNA, 14 bp, Homo sapiens
tcaggggctgcccg

SEQ ID NO: 1804169 - DNA, 22 bp, Homo sapiens
tcaggtaaaatattttccaaag

SEQ ID NO: 1804170 - DNA, 13 bp, Homo sapiens
tcaggtaggccct

SEQ ID NO: 1804171 - DNA, 21 bp, Homo sapiens
tcaggtaggcccttgtcctgc

SEQ ID NO: 1804172 - DNA, 13 bp, Homo sapiens
tcaggtgccactc

SEQ ID NO: 1804173 - DNA, 19 bp, Homo sapiens
tcaggtgccactccctgag

SEQ ID NO: 1804174 - DNA, 17 bp, Homo sapiens
tcagtacacttcctgtg

SEQ ID NO: 1804175 - DNA, 20 bp, Homo sapiens
tcagtaggtccaagggccat

SEQ ID NO: 1804176 - DNA, 16 bp, Homo sapiens
tcagtatgtggaagtg

SEQ ID NO: 1804177 - DNA, 15 bp, Homo sapiens
tcagtcagttcccgg

SEQ ID NO: 1804178 - DNA, 21 bp, Homo sapiens
tcagtgccgccgcctcgccca

SEQ ID NO: 1804179 - DNA, 17 bp, Homo sapiens
tcagtgtacccccgccc

SEQ ID NO: 1804180 - DNA, 22 bp, Homo sapiens
tcagtgtgccccccatcctggc

SEQ ID NO: 1804181 - DNA, 17 bp, Homo sapiens
tcagtgtggagaggggt

SEQ ID NO: 1804182 - DNA, 14 bp, Homo sapiens
tcagttcccggagc

SEQ ID NO: 1804183 - DNA, 22 bp, Homo sapiens
tcagttcccggagcacagccct

SEQ ID NO: 1804184 - DNA, 16 bp, Homo sapiens
tcataaatttatggtt

SEQ ID NO: 1804185 - DNA, 12 bp, Homo sapiens
tcatacattata

SEQ ID NO: 1804186 - DNA, 14 bp, Homo sapiens
tcatcactccctgg

SEQ ID NO: 1804187 - DNA, 21 bp, Homo sapiens
tcatcattggccctcattcca

SEQ ID NO: 1804188 - DNA, 22 bp, Homo sapiens
tcatccttatgagactcttaaa

SEQ ID NO: 1804189 - DNA, 11 bp, Homo sapiens
tcatctgagga

SEQ ID NO: 1804190 - DNA, 16 bp, Homo sapiens
tcatctggggacctgg

SEQ ID NO: 1804191 - DNA, 17 bp, Homo sapiens
tcatctggggacctggt

SEQ ID NO: 1804192 - DNA, 22 bp, Homo sapiens
tcatgatagaaggctatgggga

SEQ ID NO: 1804193 - DNA, 17 bp, Homo sapiens
tcatgccaaagcaaaag

SEQ ID NO: 1804194 - DNA, 22 bp, Homo sapiens
tcatgcctggcccccctccagg

SEQ ID NO: 1804195 - DNA, 23 bp, Homo sapiens
tcatgcctggcccccctccaggc

SEQ ID NO: 1804196 - DNA, 20 bp, Homo sapiens
tcatggcgtaatgggcctgc

SEQ ID NO: 1804197 - DNA, 15 bp, Homo sapiens
tcattaaaaggaaaa

SEQ ID NO: 1804198 - DNA, 20 bp, Homo sapiens
tcattatagtaaatctatga

SEQ ID NO: 1804199 - DNA, 20 bp, Homo sapiens
tcattcaaatgaactttaaa

SEQ ID NO: 1804200 - DNA, 14 bp, Homo sapiens
tcattcactgtata

SEQ ID NO: 1804201 - DNA, 14 bp, Homo sapiens
tcattccaagcact

SEQ ID NO: 1804202 - DNA, 15 bp, Homo sapiens
tcattccaagcactt

SEQ ID NO: 1804203 - DNA, 16 bp, Homo sapiens
tcattccaagcacttt

SEQ ID NO: 1804204 - DNA, 16 bp, Homo sapiens
tcattgttaaaaaaca

SEQ ID NO: 1804205 - DNA, 17 bp, Homo sapiens
tcattgttaaaaaacaa

SEQ ID NO: 1804206 - DNA, 17 bp, Homo sapiens
tcatttaatatttttca

SEQ ID NO: 1804207 - DNA, 20 bp, Homo sapiens
tcatttaatatttttcaaaa

SEQ ID NO: 1804208 - DNA, 22 bp, Homo sapiens
tcatttaccataaaaatccttc

SEQ ID NO: 1804209 - DNA, 16 bp, Homo sapiens
gggctctccaaagggg

SEQ ID NO: 1804210 - DNA, 18 bp, Homo sapiens
gggctctccaaaggggct

SEQ ID NO: 1804211 - DNA, 21 bp, Homo sapiens
gggctctccaaaggggctgct

SEQ ID NO: 1804212 - DNA, 16 bp, Homo sapiens
gggctctgccctccct

SEQ ID NO: 1804213 - DNA, 11 bp, Homo sapiens
gggctctgtgg

SEQ ID NO: 1804214 - DNA, 14 bp, Homo sapiens
gggctctgtgggct

SEQ ID NO: 1804215 - DNA, 16 bp, Homo sapiens
gggctctgtgggctgc

SEQ ID NO: 1804216 - DNA, 15 bp, Homo sapiens
gggctgacacctacc

SEQ ID NO: 1804217 - DNA, 14 bp, Homo sapiens
gggctgactgggac

SEQ ID NO: 1804218 - DNA, 14 bp, Homo sapiens
gggctgcccgctcc

SEQ ID NO: 1804219 - DNA, 15 bp, Homo sapiens
gggctgcccgctccc

SEQ ID NO: 1804220 - DNA, 19 bp, Homo sapiens
gggctgcccgctcccagtg

SEQ ID NO: 1804221 - DNA, 14 bp, Homo sapiens
gggctgctggggca

SEQ ID NO: 1804222 - DNA, 13 bp, Homo sapiens
gggctggcaagca

SEQ ID NO: 1804223 - DNA, 15 bp, Homo sapiens
gggctggcaagcagg

SEQ ID NO: 1804224 - DNA, 22 bp, Homo sapiens
gggctgggtgcgaccccatctg

SEQ ID NO: 1804225 - DNA, 21 bp, Homo sapiens
gggctgggttggcgcaccctc

SEQ ID NO: 1804226 - DNA, 16 bp, Homo sapiens
gggcttggacttcctg

SEQ ID NO: 1804227 - DNA, 21 bp, Homo sapiens
gggcttggacttcctggggcc

SEQ ID NO: 1804228 - DNA, 15 bp, Homo sapiens
gggctttgcaggctc

SEQ ID NO: 1804229 - DNA, 18 bp, Homo sapiens
gggctttgcaggctctgg

SEQ ID NO: 1804230 - DNA, 19 bp, Homo sapiens
gggctttgcaggctctggg

SEQ ID NO: 1804231 - DNA, 20 bp, Homo sapiens
gggctttgcaggctctgggc

SEQ ID NO: 1804232 - DNA, 22 bp, Homo sapiens
ggggacctggtttgaatggaga

SEQ ID NO: 1804233 - DNA, 17 bp, Homo sapiens
ggggataccataaaaag

SEQ ID NO: 1804234 - DNA, 13 bp, Homo sapiens
ggggatagatgtg

SEQ ID NO: 1804235 - DNA, 15 bp, Homo sapiens
ggggcaaggtctcct

SEQ ID NO: 1804236 - DNA, 16 bp, Homo sapiens
ggggcacaccactgcc

SEQ ID NO: 1804237 - DNA, 19 bp, Homo sapiens
ggggcacaccactgccctg

SEQ ID NO: 1804238 - DNA, 20 bp, Homo sapiens
ggggcacaccactgccctgc

SEQ ID NO: 1804239 - DNA, 15 bp, Homo sapiens
ggggcaggcacagca

SEQ ID NO: 1804240 - DNA, 13 bp, Homo sapiens
ggggcaggccctg

SEQ ID NO: 1804241 - DNA, 12 bp, Homo sapiens
ggggcaggcctg

SEQ ID NO: 1804242 - DNA, 16 bp, Homo sapiens
ggggcaggcctgggac

SEQ ID NO: 1804243 - DNA, 15 bp, Homo sapiens
ggggccccagatctg

SEQ ID NO: 1804244 - DNA, 17 bp, Homo sapiens
ggggccccagatctgcc

SEQ ID NO: 1804245 - DNA, 18 bp, Homo sapiens
ggggccccagatctgcct

SEQ ID NO: 1804246 - DNA, 20 bp, Homo sapiens
ggggccccagatctgcctgg

SEQ ID NO: 1804247 - DNA, 21 bp, Homo sapiens
ggggccccagatctgcctggg

SEQ ID NO: 1804248 - DNA, 16 bp, Homo sapiens
ggggccccggggctgg

SEQ ID NO: 1804249 - DNA, 15 bp, Homo sapiens
ggggcccgcttgcct

SEQ ID NO: 1804250 - DNA, 20 bp, Homo sapiens
ggggcccgttgtctccctgg

SEQ ID NO: 1804251 - DNA, 22 bp, Homo sapiens
ggggcccgttgtctccctggcc

SEQ ID NO: 1804252 - DNA, 23 bp, Homo sapiens
ggggcccgttgtctccctggccc

SEQ ID NO: 1804253 - DNA, 20 bp, Homo sapiens
ggggcccttggggcctggct

SEQ ID NO: 1804254 - DNA, 21 bp, Homo sapiens
ggggcccttggggcctggctt

SEQ ID NO: 1804255 - DNA, 19 bp, Homo sapiens
ggggcctatcagtgtgccc

SEQ ID NO: 1804256 - DNA, 11 bp, Homo sapiens
ggggcctggct

SEQ ID NO: 1804257 - DNA, 14 bp, Homo sapiens
ggggcctggcttgc

SEQ ID NO: 1804258 - DNA, 19 bp, Homo sapiens
ggggcctggcttgctccag

SEQ ID NO: 1804259 - DNA, 12 bp, Homo sapiens
ggggcgctcagg

SEQ ID NO: 1804260 - DNA, 22 bp, Homo sapiens
ggggcgctcaggacccaggccc

SEQ ID NO: 1804261 - DNA, 23 bp, Homo sapiens
ggggctctgccctccctccttcc

SEQ ID NO: 1804262 - DNA, 15 bp, Homo sapiens
ggggctgcacctcct

SEQ ID NO: 1804263 - DNA, 20 bp, Homo sapiens
tcgtgccagtcgcgctgcct

SEQ ID NO: 1804264 - DNA, 21 bp, Homo sapiens
tcgtgccagtcgcgctgcctg

SEQ ID NO: 1804265 - DNA, 22 bp, Homo sapiens
tcgtgccagtcgcgctgcctgt

SEQ ID NO: 1804266 - DNA, 16 bp, Homo sapiens
tcgtggacacctgccc

SEQ ID NO: 1804267 - DNA, 17 bp, Homo sapiens
tcgtggacacctgccct

SEQ ID NO: 1804268 - DNA, 19 bp, Homo sapiens
tcgtggacacctgccctgc

SEQ ID NO: 1804269 - DNA, 20 bp, Homo sapiens
tcgtgtagtggaagagcagc

SEQ ID NO: 1804270 - DNA, 23 bp, Homo sapiens
tcgtgtagtggaagagcagcctg

SEQ ID NO: 1804271 - DNA, 12 bp, Homo sapiens
tctaaacaatga

SEQ ID NO: 1804272 - DNA, 14 bp, Homo sapiens
tctaaacaatgaat

SEQ ID NO: 1804273 - DNA, 21 bp, Homo sapiens
tctaaacaatgaattcttcaa

SEQ ID NO: 1804274 - DNA, 15 bp, Homo sapiens
tctaaatgcccagtt

SEQ ID NO: 1804275 - DNA, 24 bp, Homo sapiens
tctaacatatgatactgatgccat

SEQ ID NO: 1804276 - DNA, 16 bp, Homo sapiens
tctaagttaaatcatt

SEQ ID NO: 1804277 - DNA, 16 bp, Homo sapiens
tctaatccatgtgctg

SEQ ID NO: 1804278 - DNA, 16 bp, Homo sapiens
tctaattcttttcaaa

SEQ ID NO: 1804279 - DNA, 21 bp, Homo sapiens
tctacacatatatgtatatgt

SEQ ID NO: 1804280 - DNA, 13 bp, Homo sapiens
tctacctgagcat

SEQ ID NO: 1804281 - DNA, 14 bp, Homo sapiens
tctacctgagcatt

SEQ ID NO: 1804282 - DNA, 22 bp, Homo sapiens
tctacctgagcattcaggcagc

SEQ ID NO: 1804283 - DNA, 15 bp, Homo sapiens
tctagaaaatgaaaa

SEQ ID NO: 1804284 - DNA, 14 bp, Homo sapiens
tactctgaaaagca

SEQ ID NO: 1804285 - DNA, 12 bp, Homo sapiens
tactctgagccc

SEQ ID NO: 1804286 - DNA, 16 bp, Homo sapiens
tactctgagcccaggc

SEQ ID NO: 1804287 - DNA, 18 bp, Homo sapiens
tactctgagcccaggccg

SEQ ID NO: 1804288 - DNA, 11 bp, Homo sapiens
tactctgtcca

SEQ ID NO: 1804289 - DNA, 22 bp, Homo sapiens
tactcttaatctcacttcatca

SEQ ID NO: 1804290 - DNA, 17 bp, Homo sapiens
tactgaaccactttgat

SEQ ID NO: 1804291 - DNA, 20 bp, Homo sapiens
tactgatactattcaatgca

SEQ ID NO: 1804292 - DNA, 22 bp, Homo sapiens
tactgatactattcaatgcaat

SEQ ID NO: 1804293 - DNA, 14 bp, Homo sapiens
tactggcctcgcct

SEQ ID NO: 1804294 - DNA, 14 bp, Homo sapiens
tactgtatttcatt

SEQ ID NO: 1804295 - DNA, 13 bp, Homo sapiens
tacttactgttaa

SEQ ID NO: 1804296 - DNA, 18 bp, Homo sapiens
tacttatttacctataaa

SEQ ID NO: 1804297 - DNA, 13 bp, Homo sapiens
tacttcctcctga

SEQ ID NO: 1804298 - DNA, 16 bp, Homo sapiens
tacttgtctgaggcct

SEQ ID NO: 1804299 - DNA, 18 bp, Homo sapiens
tacttgtctgaggcctca

SEQ ID NO: 1804300 - DNA, 16 bp, Homo sapiens
tagaaacaccattcat

SEQ ID NO: 1804301 - DNA, 23 bp, Homo sapiens
tagaaagaaaagaccctgagact

SEQ ID NO: 1804302 - DNA, 13 bp, Homo sapiens
tagaaccttctaa

SEQ ID NO: 1804303 - DNA, 14 bp, Homo sapiens
tagaagaagtgtgt

SEQ ID NO: 1804304 - DNA, 11 bp, Homo sapiens
tagaagttaaa

SEQ ID NO: 1804305 - DNA, 15 bp, Homo sapiens
tagaataatttctcc

SEQ ID NO: 1804306 - DNA, 22 bp, Homo sapiens
tagaatgtttctatttccataa

SEQ ID NO: 1804307 - DNA, 15 bp, Homo sapiens
tagacaaaagtttca

SEQ ID NO: 1804308 - DNA, 21 bp, Homo sapiens
tagacatttgctatgagctgg

SEQ ID NO: 1804309 - DNA, 15 bp, Homo sapiens
tagagagggggctct

SEQ ID NO: 1804310 - DNA, 21 bp, Homo sapiens
tagatctgatggtgagctggg

SEQ ID NO: 1804311 - DNA, 18 bp, Homo sapiens
tagcacatgattttcttt

SEQ ID NO: 1804312 - DNA, 21 bp, Homo sapiens
tagccaggagtctgtgctctt

SEQ ID NO: 1804313 - DNA, 20 bp, Homo sapiens
tagccatggctcaggcaagc

SEQ ID NO: 1804314 - DNA, 18 bp, Homo sapiens
tagccgtccatggcacca

SEQ ID NO: 1804315 - DNA, 20 bp, Homo sapiens
tagcctccgtttatgggcct

SEQ ID NO: 1804316 - DNA, 22 bp, Homo sapiens
tagcctccgtttatgggccttg

SEQ ID NO: 1804317 - DNA, 22 bp, Homo sapiens
tagccttgccttttaaaagaaa

SEQ ID NO: 1804318 - DNA, 14 bp, Homo sapiens
tagccttgtgccct

SEQ ID NO: 1804319 - DNA, 18 bp, Homo sapiens
tagccttgtgccctgccc

SEQ ID NO: 1804320 - DNA, 18 bp, Homo sapiens
tagctgaaagagtatgta

SEQ ID NO: 1804321 - DNA, 16 bp, Homo sapiens
tccagagtctgagccc

SEQ ID NO: 1804322 - DNA, 14 bp, Homo sapiens
tccagcctcccctc

SEQ ID NO: 1804323 - DNA, 16 bp, Homo sapiens
tccagcctcccctccc

SEQ ID NO: 1804324 - DNA, 20 bp, Homo sapiens
tccagcctcccctcccctgg

SEQ ID NO: 1804325 - DNA, 17 bp, Homo sapiens
tccagcctctcccggct

SEQ ID NO: 1804326 - DNA, 19 bp, Homo sapiens
tccagcctctcccggctgc

SEQ ID NO: 1804327 - DNA, 21 bp, Homo sapiens
tccagcctctcccggctgcct

SEQ ID NO: 1804328 - DNA, 13 bp, Homo sapiens
tccagcctgtgtg

SEQ ID NO: 1804329 - DNA, 12 bp, Homo sapiens
tccaggaaggca

SEQ ID NO: 1804330 - DNA, 19 bp, Homo sapiens
tccaggaaggcagctgctc

SEQ ID NO: 1804331 - DNA, 23 bp, Homo sapiens
tccaggaaggcagctgctcttag

SEQ ID NO: 1804332 - DNA, 15 bp, Homo sapiens
tccaggatcctgcag

SEQ ID NO: 1804333 - DNA, 19 bp, Homo sapiens
tccaggatcctgcaggaac

SEQ ID NO: 1804334 - DNA, 17 bp, Homo sapiens
tccaggcatgctggcct

SEQ ID NO: 1804335 - DNA, 16 bp, Homo sapiens
tccaggccactgtggc

SEQ ID NO: 1804336 - DNA, 17 bp, Homo sapiens
tccaggccactgtggcc

SEQ ID NO: 1804337 - DNA, 19 bp, Homo sapiens
tccaggccactgtggccag

SEQ ID NO: 1804338 - DNA, 17 bp, Homo sapiens
tccaggcccctgaggac

SEQ ID NO: 1804339 - DNA, 20 bp, Homo sapiens
tccaggcccctgaggactgg

SEQ ID NO: 1804340 - DNA, 21 bp, Homo sapiens
tccaggcccctgaggactgga

SEQ ID NO: 1804341 - DNA, 20 bp, Homo sapiens
tccaggctcttcctggacct

SEQ ID NO: 1804342 - DNA, 13 bp, Homo sapiens
tccagggtcttgg

SEQ ID NO: 1804343 - DNA, 16 bp, Homo sapiens
tccagggtcttgggct

SEQ ID NO: 1804344 - DNA, 17 bp, Homo sapiens
tccagggtcttgggcta

SEQ ID NO: 1804345 - DNA, 22 bp, Homo sapiens
tccagggtcttgggctactggc

SEQ ID NO: 1804346 - DNA, 16 bp, Homo sapiens
tccaggtggggtgagg

SEQ ID NO: 1804347 - DNA, 23 bp, Homo sapiens
tccagtgggaggtgagaccacct

SEQ ID NO: 1804348 - DNA, 13 bp, Homo sapiens
tccagtttccaaa

SEQ ID NO: 1804349 - DNA, 14 bp, Homo sapiens
tccagtttccaaag

SEQ ID NO: 1804350 - DNA, 21 bp, Homo sapiens
tccatatggagcatttttcag

SEQ ID NO: 1804351 - DNA, 13 bp, Homo sapiens
tccatggcaccag

SEQ ID NO: 1804352 - DNA, 15 bp, Homo sapiens
tccatggcaccagcc

SEQ ID NO: 1804353 - DNA, 20 bp, Homo sapiens
tccatgggctagtgtgagtg

SEQ ID NO: 1804354 - DNA, 23 bp, Homo sapiens
tcccaaggagctgatttccaggc

SEQ ID NO: 1804355 - DNA, 19 bp, Homo sapiens
tcccaccagaacgcacccc

SEQ ID NO: 1804356 - DNA, 22 bp, Homo sapiens
tcccaccagaacgcaccccact

SEQ ID NO: 1804357 - DNA, 16 bp, Homo sapiens
tcccactgcaccccct

SEQ ID NO: 1804358 - DNA, 23 bp, Homo sapiens
tcccagacaggccctccctgtct

SEQ ID NO: 1804359 - DNA, 19 bp, Homo sapiens
tcccagaggttatctgcct

SEQ ID NO: 1804360 - DNA, 21 bp, Homo sapiens
tcccagaggttatctgcctgg

SEQ ID NO: 1804361 - DNA, 22 bp, Homo sapiens
tcccagaggttatctgcctggc

SEQ ID NO: 1804362 - DNA, 24 bp, Homo sapiens
tcccagcgtttagtttctagaggc

SEQ ID NO: 1804363 - DNA, 16 bp, Homo sapiens
tcccagctgacagtcc

SEQ ID NO: 1804364 - DNA, 17 bp, Homo sapiens
tcccagctgacagtcct

SEQ ID NO: 1804365 - DNA, 20 bp, Homo sapiens
tcccagctgacagtcctctc

SEQ ID NO: 1804366 - DNA, 18 bp, Homo sapiens
tcccaggtaagcaggagg

SEQ ID NO: 1804367 - DNA, 17 bp, Homo sapiens
tcccagtgtcttcctgt

SEQ ID NO: 1804368 - DNA, 14 bp, Homo sapiens
tcccatggccttcc

SEQ ID NO: 1804369 - DNA, 16 bp, Homo sapiens
tcccatggccttccct

SEQ ID NO: 1804370 - DNA, 21 bp, Homo sapiens
tccccacagtcctcacagcct

SEQ ID NO: 1804371 - DNA, 18 bp, Homo sapiens
tccccacgagtcacctgc

SEQ ID NO: 1804372 - DNA, 21 bp, Homo sapiens
tccccacgagtcacctgcaag

SEQ ID NO: 1804373 - DNA, 22 bp, Homo sapiens
tccccacgagtcacctgcaagc

SEQ ID NO: 1804374 - DNA, 17 bp, Homo sapiens
tccccagccagcccttc

SEQ ID NO: 1804375 - DNA, 19 bp, Homo sapiens
tccccagccagcccttccc

SEQ ID NO: 1804376 - DNA, 13 bp, Homo sapiens
tccccagcccttc

SEQ ID NO: 1804377 - DNA, 17 bp, Homo sapiens
tccccagcccttctgcc

SEQ ID NO: 1804378 - DNA, 19 bp, Homo sapiens
tccccagcccttctgcctt

SEQ ID NO: 1804379 - DNA, 22 bp, Homo sapiens
tccccagcccttctgcctttct

SEQ ID NO: 1804380 - DNA, 16 bp, Homo sapiens
tccccaggcctccagc

SEQ ID NO: 1804381 - DNA, 11 bp, Homo sapiens
tccccagggcc

SEQ ID NO: 1804382 - DNA, 14 bp, Homo sapiens
tccccagggcccct

SEQ ID NO: 1804383 - DNA, 16 bp, Homo sapiens
tccccagggcccctcc

SEQ ID NO: 1804384 - DNA, 22 bp, Homo sapiens
tccccagggcccctccctctgc

SEQ ID NO: 1804385 - DNA, 12 bp, Homo sapiens
tcccccacctga

SEQ ID NO: 1804386 - DNA, 23 bp, Homo sapiens
tcccccacctgacaatggcagct

SEQ ID NO: 1804387 - DNA, 15 bp, Homo sapiens
tcccccagagccact

SEQ ID NO: 1804388 - DNA, 20 bp, Homo sapiens
tcccccgacactgctgcacc

SEQ ID NO: 1804389 - DNA, 17 bp, Homo sapiens
tcccccgcagtccccag

SEQ ID NO: 1804390 - DNA, 22 bp, Homo sapiens
tcccccgcagtccccagccctt

SEQ ID NO: 1804391 - DNA, 20 bp, Homo sapiens
tccccgagggatgatgccac

SEQ ID NO: 1804392 - DNA, 13 bp, Homo sapiens
tcccctccctgcc

SEQ ID NO: 1804393 - DNA, 15 bp, Homo sapiens
tcccctccctgcctg

SEQ ID NO: 1804394 - DNA, 16 bp, Homo sapiens
tcccctccctgcctgc

SEQ ID NO: 1804395 - DNA, 19 bp, Homo sapiens
tcccctccctgcctgctcc

SEQ ID NO: 1804396 - DNA, 14 bp, Homo sapiens
tcccctcctacccc

SEQ ID NO: 1804397 - DNA, 18 bp, Homo sapiens
tcccctctcgccccatcc

SEQ ID NO: 1804398 - DNA, 21 bp, Homo sapiens
tcccctcttgccccaaccccc

SEQ ID NO: 1804399 - DNA, 16 bp, Homo sapiens
tccccttggcttcctc

SEQ ID NO: 1804400 - DNA, 16 bp, Homo sapiens
tccccttttgcctggc

SEQ ID NO: 1804401 - DNA, 18 bp, Homo sapiens
tccccttttgcctggctg

SEQ ID NO: 1804402 - DNA, 21 bp, Homo sapiens
tccccttttgcctggctgtgg

SEQ ID NO: 1804403 - DNA, 15 bp, Homo sapiens
tcccgccccttcccc

SEQ ID NO: 1804404 - DNA, 17 bp, Homo sapiens
tcccggagcacagccct

SEQ ID NO: 1804405 - DNA, 18 bp, Homo sapiens
tcccggagcacagccctg

SEQ ID NO: 1804406 - DNA, 19 bp, Homo sapiens
tcccggagcacagccctgg

SEQ ID NO: 1804407 - DNA, 15 bp, Homo sapiens
tcccggctgcctgcc

SEQ ID NO: 1804408 - DNA, 17 bp, Homo sapiens
tcccggtgacacatcca

SEQ ID NO: 1804409 - DNA, 17 bp, Homo sapiens
tcccgtctactcattcc

SEQ ID NO: 1804410 - DNA, 22 bp, Homo sapiens
tgactcagtgtctgcctttaaa

SEQ ID NO: 1804411 - DNA, 13 bp, Homo sapiens
tgactccagagtc

SEQ ID NO: 1804412 - DNA, 18 bp, Homo sapiens
tgactccagagtctgagc

SEQ ID NO: 1804413 - DNA, 19 bp, Homo sapiens
tgactccagagtctgagcc

SEQ ID NO: 1804414 - DNA, 21 bp, Homo sapiens
tgactccagagtctgagcccc

SEQ ID NO: 1804415 - DNA, 15 bp, Homo sapiens
tgactcgggctcctg

SEQ ID NO: 1804416 - DNA, 20 bp, Homo sapiens
tgactcgggctcctgtgccc

SEQ ID NO: 1804417 - DNA, 21 bp, Homo sapiens
tgactcgggctcctgtgccct

SEQ ID NO: 1804418 - DNA, 19 bp, Homo sapiens
tgactgaaggggcacacca

SEQ ID NO: 1804419 - DNA, 11 bp, Homo sapiens
tgactggcagg

SEQ ID NO: 1804420 - DNA, 12 bp, Homo sapiens
tgactggcaggt

SEQ ID NO: 1804421 - DNA, 18 bp, Homo sapiens
tgagaacaagtcacagct

SEQ ID NO: 1804422 - DNA, 23 bp, Homo sapiens
tgagaacaagtcacagctgcagc

SEQ ID NO: 1804423 - DNA, 14 bp, Homo sapiens
tgagaattgcaaaa

SEQ ID NO: 1804424 - DNA, 17 bp, Homo sapiens
tgagaattgcaaaacta

SEQ ID NO: 1804425 - DNA, 12 bp, Homo sapiens
tgagaccacctc

SEQ ID NO: 1804426 - DNA, 18 bp, Homo sapiens
tccgtccacccaggctgc

SEQ ID NO: 1804427 - DNA, 15 bp, Homo sapiens
tcctacccctcccag

SEQ ID NO: 1804428 - DNA, 17 bp, Homo sapiens
tcctacccctcccagct

SEQ ID NO: 1804429 - DNA, 17 bp, Homo sapiens
tcctaccctcccaccag

SEQ ID NO: 1804430 - DNA, 18 bp, Homo sapiens
tcctagaggtgggcagct

SEQ ID NO: 1804431 - DNA, 21 bp, Homo sapiens
tcctagaggtgggcagctggg

SEQ ID NO: 1804432 - DNA, 13 bp, Homo sapiens
tcctagtatatta

SEQ ID NO: 1804433 - DNA, 23 bp, Homo sapiens
tcctagtatattagtttgattta

SEQ ID NO: 1804434 - DNA, 12 bp, Homo sapiens
tcctcacagcct

SEQ ID NO: 1804435 - DNA, 18 bp, Homo sapiens
tcctcacagcctctccct

SEQ ID NO: 1804436 - DNA, 13 bp, Homo sapiens
tcctcacctggtt

SEQ ID NO: 1804437 - DNA, 21 bp, Homo sapiens
tcctcattttactaaaatcgt

SEQ ID NO: 1804438 - DNA, 18 bp, Homo sapiens
tcctccacagtgctgctt

SEQ ID NO: 1804439 - DNA, 19 bp, Homo sapiens
tcctccacagtgctgcttc

SEQ ID NO: 1804440 - DNA, 17 bp, Homo sapiens
tcctccagcctcccctc

SEQ ID NO: 1804441 - DNA, 18 bp, Homo sapiens
tcctcctccacagtgctg

SEQ ID NO: 1804442 - DNA, 20 bp, Homo sapiens
tcctcctgatggccaagagc

SEQ ID NO: 1804443 - DNA, 17 bp, Homo sapiens
tcctctccacctagtgg

SEQ ID NO: 1804444 - DNA, 19 bp, Homo sapiens
tcctctccacctagtggct

SEQ ID NO: 1804445 - DNA, 22 bp, Homo sapiens
tcctctccttgggctcctggct

SEQ ID NO: 1804446 - DNA, 23 bp, Homo sapiens
tcctctccttgggctcctggctg

SEQ ID NO: 1804447 - DNA, 19 bp, Homo sapiens
tcctcttaccgtagcctcc

SEQ ID NO: 1804448 - DNA, 21 bp, Homo sapiens
tcctcttggtgtcgtttccct

SEQ ID NO: 1804449 - DNA, 23 bp, Homo sapiens
tcctgacgccctgcgttggagcc

SEQ ID NO: 1804450 - DNA, 16 bp, Homo sapiens
tcctgacttcaggggc

SEQ ID NO: 1804451 - DNA, 20 bp, Homo sapiens
tcctgagaaggcgaggagag

SEQ ID NO: 1804452 - DNA, 23 bp, Homo sapiens
tcctgagaaggcgaggagagtgg

SEQ ID NO: 1804453 - DNA, 13 bp, Homo sapiens
tcctgatggccaa

SEQ ID NO: 1804454 - DNA, 14 bp, Homo sapiens
tcctgatggccaag

SEQ ID NO: 1804455 - DNA, 15 bp, Homo sapiens
tcctgcaatctccag

SEQ ID NO: 1804456 - DNA, 21 bp, Homo sapiens
tcctgcaatctccagggctgc

SEQ ID NO: 1804457 - DNA, 23 bp, Homo sapiens
tcctgcaggaacgagcactggcc

SEQ ID NO: 1804458 - DNA, 10 bp, Homo sapiens
tcctgccagc

SEQ ID NO: 1804459 - DNA, 12 bp, Homo sapiens
tcctgccagctg

SEQ ID NO: 1804460 - DNA, 15 bp, Homo sapiens
tcctgccccctgcca

SEQ ID NO: 1804461 - DNA, 16 bp, Homo sapiens
tcctgccccctgccag

SEQ ID NO: 1804462 - DNA, 18 bp, Homo sapiens
tcctgctccacagtgttg

SEQ ID NO: 1804463 - DNA, 13 bp, Homo sapiens
tcctgctgcacca

SEQ ID NO: 1804464 - DNA, 15 bp, Homo sapiens
tcctgctgcctaata

SEQ ID NO: 1804465 - DNA, 13 bp, Homo sapiens
tcctgctgctgta

SEQ ID NO: 1804466 - DNA, 22 bp, Homo sapiens
tcctgctgctgtaactgctgag

SEQ ID NO: 1804467 - DNA, 15 bp, Homo sapiens
tcctggacctgagtc

SEQ ID NO: 1804468 - DNA, 17 bp, Homo sapiens
tcctggcccatcagtgt

SEQ ID NO: 1804469 - DNA, 18 bp, Homo sapiens
tcctggcccatcagtgta

SEQ ID NO: 1804470 - DNA, 12 bp, Homo sapiens
tcctggccctct

SEQ ID NO: 1804471 - DNA, 22 bp, Homo sapiens
tcctggcctcactggctggggc

SEQ ID NO: 1804472 - DNA, 14 bp, Homo sapiens
tcctggctgccagg

SEQ ID NO: 1804473 - DNA, 17 bp, Homo sapiens
tcctggggccccgctgg

SEQ ID NO: 1804474 - DNA, 12 bp, Homo sapiens
tcctgtccactc

SEQ ID NO: 1804475 - DNA, 21 bp, Homo sapiens
tcctgtccactctcggggccc

SEQ ID NO: 1804476 - DNA, 13 bp, Homo sapiens
tcctgtcccagag

SEQ ID NO: 1804477 - DNA, 22 bp, Homo sapiens
tcctgtcccgccttcctcctcc

SEQ ID NO: 1804478 - DNA, 22 bp, Homo sapiens
tcctgtgggggaagagcacagc

SEQ ID NO: 1804479 - DNA, 14 bp, Homo sapiens
tccttactctgagc

SEQ ID NO: 1804480 - DNA, 18 bp, Homo sapiens
tccttactctgagcccag

SEQ ID NO: 1804481 - DNA, 22 bp, Homo sapiens
tccttactctgagcccaggccg

SEQ ID NO: 1804482 - DNA, 23 bp, Homo sapiens
tccttcagagctcttcaagctgt

SEQ ID NO: 1804483 - DNA, 19 bp, Homo sapiens
tccttcagtgagcccctcc

SEQ ID NO: 1804484 - DNA, 20 bp, Homo sapiens
tccttcagtgagcccctccc

SEQ ID NO: 1804485 - DNA, 18 bp, Homo sapiens
tccttccctgggaaggct

SEQ ID NO: 1804486 - DNA, 20 bp, Homo sapiens
tccttggcacccccatgctg

SEQ ID NO: 1804487 - DNA, 12 bp, Homo sapiens
tccttgggctcc

SEQ ID NO: 1804488 - DNA, 14 bp, Homo sapiens
tccttgggctcctg

SEQ ID NO: 1804489 - DNA, 15 bp, Homo sapiens
tccttgggctcctgg

SEQ ID NO: 1804490 - DNA, 20 bp, Homo sapiens
tcctttgcaccatgtgaagt

SEQ ID NO: 1804491 - DNA, 21 bp, Homo sapiens
tccttttgcaacaagacaaag

SEQ ID NO: 1804492 - DNA, 20 bp, Homo sapiens
tccttttgtccccagggccc

SEQ ID NO: 1804493 - DNA, 21 bp, Homo sapiens
tcgaaacctgtccataaagta

SEQ ID NO: 1804494 - DNA, 12 bp, Homo sapiens
tcgaaccaaggc

SEQ ID NO: 1804495 - DNA, 22 bp, Homo sapiens
tcgaaccaaggcagcctccaga

SEQ ID NO: 1804496 - DNA, 15 bp, Homo sapiens
tcgaatttttattat

SEQ ID NO: 1804497 - DNA, 21 bp, Homo sapiens
tcgaggcaccggcgctgcagg

SEQ ID NO: 1804498 - DNA, 18 bp, Homo sapiens
tcgcaggatccgctgcca

SEQ ID NO: 1804499 - DNA, 14 bp, Homo sapiens
tcgcctggcctgag

SEQ ID NO: 1804500 - DNA, 13 bp, Homo sapiens
tcgcgctgcctgt

SEQ ID NO: 1804501 - DNA, 16 bp, Homo sapiens
tcgcgctgcctgtgtg

SEQ ID NO: 1804502 - DNA, 14 bp, Homo sapiens
tcgctgatgctggg

SEQ ID NO: 1804503 - DNA, 16 bp, Homo sapiens
tcgctgatgctgggct

SEQ ID NO: 1804504 - DNA, 18 bp, Homo sapiens
tcgctgatgctgggctgg

SEQ ID NO: 1804505 - DNA, 19 bp, Homo sapiens
tcgctgatgctgggctggg

SEQ ID NO: 1804506 - DNA, 20 bp, Homo sapiens
tcgctgatgctgggctgggt

SEQ ID NO: 1804507 - DNA, 22 bp, Homo sapiens
tcgctgatgctgggctgggtgc

SEQ ID NO: 1804508 - DNA, 14 bp, Homo sapiens
tcgcttgagcccag

SEQ ID NO: 1804509 - DNA, 20 bp, Homo sapiens
tcggactgcccccagaaagc

SEQ ID NO: 1804510 - DNA, 19 bp, Homo sapiens
tcggccccacatgggaacc

SEQ ID NO: 1804511 - DNA, 16 bp, Homo sapiens
tcggctcctgctgcac

SEQ ID NO: 1804512 - DNA, 15 bp, Homo sapiens
tcgggctcctgtgcc

SEQ ID NO: 1804513 - DNA, 16 bp, Homo sapiens
tcgggctcctgtgccc

SEQ ID NO: 1804514 - DNA, 17 bp, Homo sapiens
tcgggctcctgtgccct

SEQ ID NO: 1804515 - DNA, 22 bp, Homo sapiens
tcggggcccttggggcctggct

SEQ ID NO: 1804516 - DNA, 18 bp, Homo sapiens
tcgtgacccttcagggcc

SEQ ID NO: 1804517 - DNA, 20 bp, Homo sapiens
tcgtgacccttcagggccag

SEQ ID NO: 1804518 - DNA, 19 bp, Homo sapiens
tcgtgccagtcgcgctgcc

SEQ ID NO: 1804519 - DNA, 20 bp, Homo sapiens
ttctcccccgacactgctgc

SEQ ID NO: 1804520 - DNA, 16 bp, Homo sapiens
ttctcccctccaagtg

SEQ ID NO: 1804521 - DNA, 16 bp, Homo sapiens
ttctccggggtctgtg

SEQ ID NO: 1804522 - DNA, 17 bp, Homo sapiens
ttctccggggtctgtgc

SEQ ID NO: 1804523 - DNA, 19 bp, Homo sapiens
ttctccggggtctgtgctg

SEQ ID NO: 1804524 - DNA, 13 bp, Homo sapiens
ttctcctttttct

SEQ ID NO: 1804525 - DNA, 18 bp, Homo sapiens
ttctgaagctagaaacaa

SEQ ID NO: 1804526 - DNA, 21 bp, Homo sapiens
ttctgaagctagaaacaatct

SEQ ID NO: 1804527 - DNA, 19 bp, Homo sapiens
ttctgcaactagccaaggc

SEQ ID NO: 1804528 - DNA, 21 bp, Homo sapiens
ttctgggaagggagagttctt

SEQ ID NO: 1804529 - DNA, 18 bp, Homo sapiens
ttctggtggcagtaacat

SEQ ID NO: 1804530 - DNA, 16 bp, Homo sapiens
ttctgtccagtttcca

SEQ ID NO: 1804531 - DNA, 18 bp, Homo sapiens
ttctgtccagtttccaaa

SEQ ID NO: 1804532 - DNA, 20 bp, Homo sapiens
ttcttcaacagggaaaacag

SEQ ID NO: 1804533 - DNA, 20 bp, Homo sapiens
ttcttcgctgctctagctgg

SEQ ID NO: 1804534 - DNA, 22 bp, Homo sapiens
ttcttgggggaggccaccccaa

SEQ ID NO: 1804535 - DNA, 16 bp, Homo sapiens
ttcttggtatgatcat

SEQ ID NO: 1804536 - DNA, 16 bp, Homo sapiens
ttctttcatacattat

SEQ ID NO: 1804537 - DNA, 17 bp, Homo sapiens
ttctttcatacattata

SEQ ID NO: 1804538 - DNA, 19 bp, Homo sapiens
ttgaaaacttgctgaaaaa

SEQ ID NO: 1804539 - DNA, 16 bp, Homo sapiens
ttgaaggcagtctgaa

SEQ ID NO: 1804540 - DNA, 17 bp, Homo sapiens
ttgaattttcccactgc

SEQ ID NO: 1804541 - DNA, 15 bp, Homo sapiens
ttgacaaaaatgttt

SEQ ID NO: 1804542 - DNA, 18 bp, Homo sapiens
ttgacccaggtggctagc

SEQ ID NO: 1804543 - DNA, 14 bp, Homo sapiens
ttgaggacacatgt

SEQ ID NO: 1804544 - DNA, 18 bp, Homo sapiens
ttgagtacagtgaggagg

SEQ ID NO: 1804545 - DNA, 19 bp, Homo sapiens
ttgagtacagtgaggaggg

SEQ ID NO: 1804546 - DNA, 19 bp, Homo sapiens
ttgatcaaaatcaaaaggt

SEQ ID NO: 1804547 - DNA, 14 bp, Homo sapiens
ttgatttaatatct

SEQ ID NO: 1804548 - DNA, 20 bp, Homo sapiens
ttgcaaaactagacaaaagt

SEQ ID NO: 1804549 - DNA, 21 bp, Homo sapiens
ttgcaacaataattcatcaag

SEQ ID NO: 1804550 - DNA, 15 bp, Homo sapiens
ttgcaacaatgcaaa

SEQ ID NO: 1804551 - DNA, 16 bp, Homo sapiens
ttgcacatcattcatt

SEQ ID NO: 1804552 - DNA, 20 bp, Homo sapiens
ttgcacatcattcattcact

SEQ ID NO: 1804553 - DNA, 16 bp, Homo sapiens
ttgccaactaagccct

SEQ ID NO: 1804554 - DNA, 17 bp, Homo sapiens
ttgccaactaagccctc

SEQ ID NO: 1804555 - DNA, 17 bp, Homo sapiens
ttgccaaggctctcccc

SEQ ID NO: 1804556 - DNA, 21 bp, Homo sapiens
ttgccagcacaggggccccag

SEQ ID NO: 1804557 - DNA, 14 bp, Homo sapiens
ttgcccccatccct

SEQ ID NO: 1804558 - DNA, 15 bp, Homo sapiens
ttgcctcggctcctg

SEQ ID NO: 1804559 - DNA, 16 bp, Homo sapiens
ttgcctcggctcctgc

SEQ ID NO: 1804560 - DNA, 18 bp, Homo sapiens
ttgcctcggctcctgctg

SEQ ID NO: 1804561 - DNA, 16 bp, Homo sapiens
ttgcctggctgtggag

SEQ ID NO: 1804562 - DNA, 20 bp, Homo sapiens
ttgcctggctgtggaggcct

SEQ ID NO: 1804563 - DNA, 21 bp, Homo sapiens
ttgcctggctgtggaggcctg

SEQ ID NO: 1804564 - DNA, 14 bp, Homo sapiens
ttgcgtcctgcaga

SEQ ID NO: 1804565 - DNA, 20 bp, Homo sapiens
ttgctatgagctggggatgt

SEQ ID NO: 1804566 - DNA, 21 bp, Homo sapiens
ttgctgcccctgtctggaaga

SEQ ID NO: 1804567 - DNA, 14 bp, Homo sapiens
ttggaattttaagt

SEQ ID NO: 1804568 - DNA, 11 bp, Homo sapiens
ttggagccact

SEQ ID NO: 1804569 - DNA, 12 bp, Homo sapiens
ttggagccactc

SEQ ID NO: 1804570 - DNA, 16 bp, Homo sapiens
ttggataccccattaa

SEQ ID NO: 1804571 - DNA, 18 bp, Homo sapiens
ttggcagagaaggcctct

SEQ ID NO: 1804572 - DNA, 15 bp, Homo sapiens
ttgggaggccaaggc

SEQ ID NO: 1804573 - DNA, 17 bp, Homo sapiens
ttgggaggccaaggcag

SEQ ID NO: 1804574 - DNA, 17 bp, Homo sapiens
ttgggccatactggcct

SEQ ID NO: 1804575 - DNA, 15 bp, Homo sapiens
ttgggctactggcag

SEQ ID NO: 1804576 - DNA, 17 bp, Homo sapiens
ttgggctactggcagct

SEQ ID NO: 1804577 - DNA, 20 bp, Homo sapiens
ttgggctactggcagctcct

SEQ ID NO: 1804578 - DNA, 24 bp, Homo sapiens
ttgggctactggcagctcctctcc

SEQ ID NO: 1804579 - DNA, 17 bp, Homo sapiens
ttgggctcctggctgcc

SEQ ID NO: 1804580 - DNA, 20 bp, Homo sapiens
ttgggctttgcaggctctgg

SEQ ID NO: 1804581 - DNA, 18 bp, Homo sapiens
ttggggacagttggcaga

SEQ ID NO: 1804582 - DNA, 12 bp, Homo sapiens
ttggggcctggc

SEQ ID NO: 1804583 - DNA, 20 bp, Homo sapiens
ttggtaggaagcctgaggca

SEQ ID NO: 1804584 - DNA, 15 bp, Homo sapiens
ttggtccctggtccc

SEQ ID NO: 1804585 - DNA, 16 bp, Homo sapiens
ttgtaaaaatactgtt

SEQ ID NO: 1804586 - DNA, 14 bp, Homo sapiens
ttgtaattattgtg

SEQ ID NO: 1804587 - DNA, 17 bp, Homo sapiens
ttgtacattatgttatt

SEQ ID NO: 1804588 - DNA, 20 bp, Homo sapiens
ttgtacattatgttattgga

SEQ ID NO: 1804589 - DNA, 21 bp, Homo sapiens
ttgtacattatgttattggaa

SEQ ID NO: 1804590 - DNA, 19 bp, Homo sapiens
ttgtacccttgttattatc

SEQ ID NO: 1804591 - DNA, 20 bp, Homo sapiens
ttgtacttttggcatgaaag

SEQ ID NO: 1804592 - DNA, 15 bp, Homo sapiens
ttgtatggctctcaa

SEQ ID NO: 1804593 - DNA, 22 bp, Homo sapiens
ttgtatggctctcaagtgaaag

SEQ ID NO: 1804594 - DNA, 16 bp, Homo sapiens
ttgtccttcctgtgcc

SEQ ID NO: 1804595 - DNA, 18 bp, Homo sapiens
ttgtctattctgagcctt

SEQ ID NO: 1804596 - DNA, 19 bp, Homo sapiens
ttgtctattctgagccttg

SEQ ID NO: 1804597 - DNA, 12 bp, Homo sapiens
ttgtctccctgg

SEQ ID NO: 1804598 - DNA, 20 bp, Homo sapiens
ttgtgaaattcaacctgtgt

SEQ ID NO: 1804599 - DNA, 16 bp, Homo sapiens
ttgtgactattaaatg

SEQ ID NO: 1804600 - DNA, 13 bp, Homo sapiens
ttgtgtgtgggag

SEQ ID NO: 1804601 - DNA, 13 bp, Homo sapiens
ttgttcatcattg

SEQ ID NO: 1804602 - DNA, 19 bp, Homo sapiens
ttgttcctgtgtattctca

SEQ ID NO: 1804603 - DNA, 14 bp, Homo sapiens
tgggcctggcctga

SEQ ID NO: 1804604 - DNA, 18 bp, Homo sapiens
tgggcctggcctgagctg

SEQ ID NO: 1804605 - DNA, 23 bp, Homo sapiens
tgggcctggcctgagctggggcc

SEQ ID NO: 1804606 - DNA, 17 bp, Homo sapiens
tgggcctgtgcagcagc

SEQ ID NO: 1804607 - DNA, 18 bp, Homo sapiens
tgggcctgtgcagcagcc

SEQ ID NO: 1804608 - DNA, 21 bp, Homo sapiens
tgggcctgtgcagcagcccag

SEQ ID NO: 1804609 - DNA, 22 bp, Homo sapiens
tgggcctgtgcagcagcccagc

SEQ ID NO: 1804610 - DNA, 17 bp, Homo sapiens
tgggccttgctttgggc

SEQ ID NO: 1804611 - DNA, 13 bp, Homo sapiens
tgggctcagggct

SEQ ID NO: 1804612 - DNA, 14 bp, Homo sapiens
tgggctcagggctg

SEQ ID NO: 1804613 - DNA, 16 bp, Homo sapiens
tgggctcagggctgga

SEQ ID NO: 1804614 - DNA, 16 bp, Homo sapiens
tgggctcctggctgcc

SEQ ID NO: 1804615 - DNA, 19 bp, Homo sapiens
tgggctcctggctgccagg

SEQ ID NO: 1804616 - DNA, 18 bp, Homo sapiens
tgggctgcactctgtgcc

SEQ ID NO: 1804617 - DNA, 19 bp, Homo sapiens
tgggctgcactctgtgccc

SEQ ID NO: 1804618 - DNA, 20 bp, Homo sapiens
tgggctgcactctgtgccca

SEQ ID NO: 1804619 - DNA, 21 bp, Homo sapiens
tgggctgcactctgtgcccat

SEQ ID NO: 1804620 - DNA, 22 bp, Homo sapiens
tgggctgcactctgtgcccatg

SEQ ID NO: 1804621 - DNA, 14 bp, Homo sapiens
tgggctttgcaggc

SEQ ID NO: 1804622 - DNA, 16 bp, Homo sapiens
tgggctttgcaggctc

SEQ ID NO: 1804623 - DNA, 17 bp, Homo sapiens
tgggctttgcaggctct

SEQ ID NO: 1804624 - DNA, 18 bp, Homo sapiens
tgggctttgcaggctctg

SEQ ID NO: 1804625 - DNA, 19 bp, Homo sapiens
tgggctttgcaggctctgg

SEQ ID NO: 1804626 - DNA, 22 bp, Homo sapiens
tgggctttgcaggctctgggct

SEQ ID NO: 1804627 - DNA, 17 bp, Homo sapiens
tggggacagttggcaga

SEQ ID NO: 1804628 - DNA, 18 bp, Homo sapiens
tggggacagttggcagag

SEQ ID NO: 1804629 - DNA, 19 bp, Homo sapiens
tggggacagttggcagaga

SEQ ID NO: 1804630 - DNA, 21 bp, Homo sapiens
tggggacgccaaggaggtggg

SEQ ID NO: 1804631 - DNA, 20 bp, Homo sapiens
tggggagcacttgcgtcctg

SEQ ID NO: 1804632 - DNA, 20 bp, Homo sapiens
tggggatagatgtgtggaca

SEQ ID NO: 1804633 - DNA, 14 bp, Homo sapiens
tggggcagaggggc

SEQ ID NO: 1804634 - DNA, 16 bp, Homo sapiens
tggggcagaggggcag

SEQ ID NO: 1804635 - DNA, 21 bp, Homo sapiens
tggggcagaggggcagccgct

SEQ ID NO: 1804636 - DNA, 23 bp, Homo sapiens
tggggcatggttccttccctggg

SEQ ID NO: 1804637 - DNA, 15 bp, Homo sapiens
tggggcatgtgtgcc

SEQ ID NO: 1804638 - DNA, 16 bp, Homo sapiens
tggggcatgtgtgcct

SEQ ID NO: 1804639 - DNA, 22 bp, Homo sapiens
tggggcatgtgtgcctgtggca

SEQ ID NO: 1804640 - DNA, 16 bp, Homo sapiens
tggggccccgctggga

SEQ ID NO: 1804641 - DNA, 14 bp, Homo sapiens
tggggcctggcttg

SEQ ID NO: 1804642 - DNA, 16 bp, Homo sapiens
tggggctaaatgaagt

SEQ ID NO: 1804643 - DNA, 15 bp, Homo sapiens
tggggtaggttggga

SEQ ID NO: 1804644 - DNA, 21 bp, Homo sapiens
tggggtcctagcccagtgctt

SEQ ID NO: 1804645 - DNA, 19 bp, Homo sapiens
tgggtccaggaaggcagct

SEQ ID NO: 1804646 - DNA, 22 bp, Homo sapiens
tgggtcccacttcccctcctac

SEQ ID NO: 1804647 - DNA, 23 bp, Homo sapiens
tgggtcctgcaatctccagggct

SEQ ID NO: 1804648 - DNA, 23 bp, Homo sapiens
tgggtgcgaccccatctgcccag

SEQ ID NO: 1804649 - DNA, 15 bp, Homo sapiens
tgggtggcccatccc

SEQ ID NO: 1804650 - DNA, 22 bp, Homo sapiens
tgggtgttgaccactccagaga

SEQ ID NO: 1804651 - DNA, 15 bp, Homo sapiens
tgggttggcgcaccc

SEQ ID NO: 1804652 - DNA, 17 bp, Homo sapiens
tgggttggcgcaccctc

SEQ ID NO: 1804653 - DNA, 23 bp, Homo sapiens
tgggttggcgcaccctcccctcc

SEQ ID NO: 1804654 - DNA, 17 bp, Homo sapiens
tgggtttggatctccaa

SEQ ID NO: 1804655 - DNA, 19 bp, Homo sapiens
tgggttttattgtccttca

SEQ ID NO: 1804656 - DNA, 24 bp, Homo sapiens
tggtaaacattcctccagcctccc

SEQ ID NO: 1804657 - DNA, 16 bp, Homo sapiens
tggtaagcagaggctt

SEQ ID NO: 1804658 - DNA, 18 bp, Homo sapiens
tggtaccaggtctcctcc

SEQ ID NO: 1804659 - DNA, 22 bp, Homo sapiens
tggtgaccccttttcagcttct

SEQ ID NO: 1804660 - DNA, 13 bp, Homo sapiens
tggtgagctggga

SEQ ID NO: 1804661 - DNA, 15 bp, Homo sapiens
tggtgagctgggaag

SEQ ID NO: 1804662 - DNA, 18 bp, Homo sapiens
tggtgagctgggaagctg

SEQ ID NO: 1804663 - DNA, 21 bp, Homo sapiens
tggtgtcgcgccttctccccc

SEQ ID NO: 1804664 - DNA, 16 bp, Homo sapiens
tggtgttactaaagtc

SEQ ID NO: 1804665 - DNA, 15 bp, Homo sapiens
tggttgttgccaact

SEQ ID NO: 1804666 - DNA, 23 bp, Homo sapiens
tggtttcctcattttactaaaat

SEQ ID NO: 1804667 - DNA, 22 bp, Homo sapiens
tgtaaaagtactctgaaaagca

SEQ ID NO: 1804668 - DNA, 14 bp, Homo sapiens
tgtaaaataagtat

SEQ ID NO: 1804669 - DNA, 16 bp, Homo sapiens
tgtaaatttatgtgat

SEQ ID NO: 1804670 - DNA, 17 bp, Homo sapiens
tgtaaatttatgtgatg

SEQ ID NO: 1804671 - DNA, 12 bp, Homo sapiens
tgtaactgctga

SEQ ID NO: 1804672 - DNA, 22 bp, Homo sapiens
tgtaagaagctaaaatgaaaaa

SEQ ID NO: 1804673 - DNA, 16 bp, Homo sapiens
tgtaagacttcagatt

SEQ ID NO: 1804674 - DNA, 15 bp, Homo sapiens
tgtaagcaacttgct

SEQ ID NO: 1804675 - DNA, 22 bp, Homo sapiens
tgtaatgggatctatttttgca

SEQ ID NO: 1804676 - DNA, 11 bp, Homo sapiens
tgtaattattg

SEQ ID NO: 1804677 - DNA, 14 bp, Homo sapiens
tgtaattattgtga

SEQ ID NO: 1804678 - DNA, 20 bp, Homo sapiens
tgtaatttaaaattgtgatg

SEQ ID NO: 1804679 - DNA, 22 bp, Homo sapiens
tgtaatttaaaattgtgatgtg

SEQ ID NO: 1804680 - DNA, 19 bp, Homo sapiens
tgtacccccgcccaggctg

SEQ ID NO: 1804681 - DNA, 22 bp, Homo sapiens
tgtacccttccacctcctagag

SEQ ID NO: 1804682 - DNA, 19 bp, Homo sapiens
tgtactcagagcagagcaa

SEQ ID NO: 1804683 - DNA, 14 bp, Homo sapiens
tgtactgaaagcaa

SEQ ID NO: 1804684 - DNA, 15 bp, Homo sapiens
tgtactgaaagcaaa

SEQ ID NO: 1804685 - DNA, 22 bp, Homo sapiens
tgtactgaaagcaaatgctttg

SEQ ID NO: 1804686 - DNA, 23 bp, Homo sapiens
tgtactgatactattcaatgcaa

SEQ ID NO: 1804687 - DNA, 19 bp, Homo sapiens
tgtagccatggctcaggca

SEQ ID NO: 1804688 - DNA, 11 bp, Homo sapiens
tgtaggttgct

SEQ ID NO: 1804689 - DNA, 23 bp, Homo sapiens
tgtagtaataaaaagtaacacac

SEQ ID NO: 1804690 - DNA, 20 bp, Homo sapiens
tgtagtggaagagcagcctg

SEQ ID NO: 1804691 - DNA, 21 bp, Homo sapiens
tgtagtggaagagcagcctga

SEQ ID NO: 1804692 - DNA, 18 bp, Homo sapiens
tgtataagctactcactt

SEQ ID NO: 1804693 - DNA, 12 bp, Homo sapiens
tgtatatagttt

SEQ ID NO: 1804694 - DNA, 17 bp, Homo sapiens
tgtatatgtatatctat

SEQ ID NO: 1804695 - DNA, 18 bp, Homo sapiens
tgtatattccctgtggaa

SEQ ID NO: 1804696 - DNA, 16 bp, Homo sapiens
tgtatggctctcaagt

SEQ ID NO: 1804697 - DNA, 20 bp, Homo sapiens
tgtatgtgggggtctgtgtg

SEQ ID NO: 1804698 - DNA, 16 bp, Homo sapiens
tgtattaccattactt

SEQ ID NO: 1804699 - DNA, 18 bp, Homo sapiens
tgtattcccacccctgga

SEQ ID NO: 1804700 - DNA, 22 bp, Homo sapiens
tgtcacccttaggccagcacca

SEQ ID NO: 1804701 - DNA, 12 bp, Homo sapiens
ttaaaaaacaac

SEQ ID NO: 1804702 - DNA, 12 bp, Homo sapiens
ttaaaaaatcaa

SEQ ID NO: 1804703 - DNA, 23 bp, Homo sapiens
ttaaaaatgcacacctcatgagt

SEQ ID NO: 1804704 - DNA, 18 bp, Homo sapiens
ttaaaatagcacatgatt

SEQ ID NO: 1804705 - DNA, 18 bp, Homo sapiens
ttaaaattgtgatgtgtc

SEQ ID NO: 1804706 - DNA, 22 bp, Homo sapiens
ttaaaccagactctgttgcaat

SEQ ID NO: 1804707 - DNA, 20 bp, Homo sapiens
ttaaatatacttagatcctg

SEQ ID NO: 1804708 - DNA, 19 bp, Homo sapiens
ttaaatgttgcacatcatt

SEQ ID NO: 1804709 - DNA, 20 bp, Homo sapiens
ttaaatgttgcacatcattc

SEQ ID NO: 1804710 - DNA, 18 bp, Homo sapiens
ttaaatttacagaatatt

SEQ ID NO: 1804711 - DNA, 20 bp, Homo sapiens
ttaacaattaattttctatg

SEQ ID NO: 1804712 - DNA, 19 bp, Homo sapiens
ttaagaggctttggcccaa

SEQ ID NO: 1804713 - DNA, 17 bp, Homo sapiens
ttaagtctcagtacact

SEQ ID NO: 1804714 - DNA, 19 bp, Homo sapiens
ttaagttctatcagtgact

SEQ ID NO: 1804715 - DNA, 20 bp, Homo sapiens
ttaagttctatcagtgactt

SEQ ID NO: 1804716 - DNA, 19 bp, Homo sapiens
ttaataatttttgctgaat

SEQ ID NO: 1804717 - DNA, 16 bp, Homo sapiens
ttaatacagattgaaa

SEQ ID NO: 1804718 - DNA, 17 bp, Homo sapiens
ttaatatctgagaagtg

SEQ ID NO: 1804719 - DNA, 15 bp, Homo sapiens
ttaatatttttcaaa

SEQ ID NO: 1804720 - DNA, 16 bp, Homo sapiens
ttaatatttttcaaaa

SEQ ID NO: 1804721 - DNA, 14 bp, Homo sapiens
ttaatctcacttca

SEQ ID NO: 1804722 - DNA, 14 bp, Homo sapiens
ttaatctttctata

SEQ ID NO: 1804723 - DNA, 23 bp, Homo sapiens
ttaatctttctatattttttaaa

SEQ ID NO: 1804724 - DNA, 17 bp, Homo sapiens
ttaatgttatttggaat

SEQ ID NO: 1804725 - DNA, 14 bp, Homo sapiens
ctcatgcctggccc

SEQ ID NO: 1804726 - DNA, 22 bp, Homo sapiens
ctcatgcctggcccccctccag

SEQ ID NO: 1804727 - DNA, 23 bp, Homo sapiens
ctcatgcctggcccccctccagg

SEQ ID NO: 1804728 - DNA, 23 bp, Homo sapiens
ctcatggcgtaatgggcctgccc

SEQ ID NO: 1804729 - DNA, 13 bp, Homo sapiens
ctcattccccggg

SEQ ID NO: 1804730 - DNA, 23 bp, Homo sapiens
ctcattccccggggcgtttcttt

SEQ ID NO: 1804731 - DNA, 18 bp, Homo sapiens
ctcatttaatatttttca

SEQ ID NO: 1804732 - DNA, 14 bp, Homo sapiens
ctccaaaggggctg

SEQ ID NO: 1804733 - DNA, 16 bp, Homo sapiens
ctccaaaggggctgct

SEQ ID NO: 1804734 - DNA, 22 bp, Homo sapiens
ctccaaaggggctgctggggca

SEQ ID NO: 1804735 - DNA, 15 bp, Homo sapiens
ctccacagtgctgct

SEQ ID NO: 1804736 - DNA, 15 bp, Homo sapiens
ctccacctagtggct

SEQ ID NO: 1804737 - DNA, 22 bp, Homo sapiens
ctccacctagtggctgtccagt

SEQ ID NO: 1804738 - DNA, 23 bp, Homo sapiens
ctccacctagtggctgtccagtg

SEQ ID NO: 1804739 - DNA, 21 bp, Homo sapiens
ctccacggtgcgtggctgtgg

SEQ ID NO: 1804740 - DNA, 23 bp, Homo sapiens
ctccacggtgcgtggctgtggca

SEQ ID NO: 1804741 - DNA, 13 bp, Homo sapiens
ctccactcccact

SEQ ID NO: 1804742 - DNA, 13 bp, Homo sapiens
ctccactccccca

SEQ ID NO: 1804743 - DNA, 16 bp, Homo sapiens
ctccactcccccacct

SEQ ID NO: 1804744 - DNA, 17 bp, Homo sapiens
ctccactcccccacctg

SEQ ID NO: 1804745 - DNA, 13 bp, Homo sapiens
ctccactctcctt

SEQ ID NO: 1804746 - DNA, 20 bp, Homo sapiens
ctccactctccttcgtgtct

SEQ ID NO: 1804747 - DNA, 16 bp, Homo sapiens
ctccagaatctgctgt

SEQ ID NO: 1804748 - DNA, 17 bp, Homo sapiens
ctccagagccagcctgg

SEQ ID NO: 1804749 - DNA, 21 bp, Homo sapiens
ctccagagccagcctgggact

SEQ ID NO: 1804750 - DNA, 15 bp, Homo sapiens
ctccagagtctgagc

SEQ ID NO: 1804751 - DNA, 19 bp, Homo sapiens
ctccagagtctgagccccc

SEQ ID NO: 1804752 - DNA, 13 bp, Homo sapiens
ctccagcatccag

SEQ ID NO: 1804753 - DNA, 15 bp, Homo sapiens
ctccagcctcccctc

SEQ ID NO: 1804754 - DNA, 16 bp, Homo sapiens
ctccagcctcccctcc

SEQ ID NO: 1804755 - DNA, 17 bp, Homo sapiens
ctccagcctctcccggc

SEQ ID NO: 1804756 - DNA, 19 bp, Homo sapiens
ctccagcctctcccggctg

SEQ ID NO: 1804757 - DNA, 24 bp, Homo sapiens
ctccagcctctcccggctgcctgc

SEQ ID NO: 1804758 - DNA, 16 bp, Homo sapiens
ctccaggcatgctggc

SEQ ID NO: 1804759 - DNA, 17 bp, Homo sapiens
ctccaggcatgctggcc

SEQ ID NO: 1804760 - DNA, 18 bp, Homo sapiens
ctccagggcccccaccga

SEQ ID NO: 1804761 - DNA, 15 bp, Homo sapiens
ctccagggctgcccc

SEQ ID NO: 1804762 - DNA, 18 bp, Homo sapiens
ctccagggctgcccctgt

SEQ ID NO: 1804763 - DNA, 13 bp, Homo sapiens
ctccagggtcttg

SEQ ID NO: 1804764 - DNA, 16 bp, Homo sapiens
ctccagggtcttgggc

SEQ ID NO: 1804765 - DNA, 17 bp, Homo sapiens
ctccagggtcttgggct

SEQ ID NO: 1804766 - DNA, 17 bp, Homo sapiens
ctccatgggctagtgtg

SEQ ID NO: 1804767 - DNA, 17 bp, Homo sapiens
ctccattggtgttgaca

SEQ ID NO: 1804768 - DNA, 16 bp, Homo sapiens
ctcccaataaagctgg

SEQ ID NO: 1804769 - DNA, 16 bp, Homo sapiens
ctcccaccccggcctc

SEQ ID NO: 1804770 - DNA, 19 bp, Homo sapiens
ctcccaccccggcctccac

SEQ ID NO: 1804771 - DNA, 13 bp, Homo sapiens
ctcccagacaggc

SEQ ID NO: 1804772 - DNA, 11 bp, Homo sapiens
ctcccagctga

SEQ ID NO: 1804773 - DNA, 13 bp, Homo sapiens
ctccccacagtcc

SEQ ID NO: 1804774 - DNA, 19 bp, Homo sapiens
ctccccacagtcctcacag

SEQ ID NO: 1804775 - DNA, 16 bp, Homo sapiens
ctccccacgagtcacc

SEQ ID NO: 1804776 - DNA, 20 bp, Homo sapiens
ctccccacgagtcacctgca

SEQ ID NO: 1804777 - DNA, 21 bp, Homo sapiens
ctccccagccagcccttccct

SEQ ID NO: 1804778 - DNA, 13 bp, Homo sapiens
ctccccaggcctc

SEQ ID NO: 1804779 - DNA, 18 bp, Homo sapiens
atgggcttggacttcctg

SEQ ID NO: 1804780 - DNA, 19 bp, Homo sapiens
atgggcttggacttcctgg

SEQ ID NO: 1804781 - DNA, 20 bp, Homo sapiens
atggggatagatgtgtggac

SEQ ID NO: 1804782 - DNA, 16 bp, Homo sapiens
atggtagactgtgaca

SEQ ID NO: 1804783 - DNA, 16 bp, Homo sapiens
atggtgagctgggaag

SEQ ID NO: 1804784 - DNA, 11 bp, Homo sapiens
atggtgcctga

SEQ ID NO: 1804785 - DNA, 22 bp, Homo sapiens
atggtgcctgattcggctgtct

SEQ ID NO: 1804786 - DNA, 13 bp, Homo sapiens
atggttccttccc

SEQ ID NO: 1804787 - DNA, 19 bp, Homo sapiens
atggttccttccctgggaa

SEQ ID NO: 1804788 - DNA, 18 bp, Homo sapiens
atgtaaaaatgaaggaat

SEQ ID NO: 1804789 - DNA, 14 bp, Homo sapiens
atgtaaatagatga

SEQ ID NO: 1804790 - DNA, 12 bp, Homo sapiens
atgtaatactga

SEQ ID NO: 1804791 - DNA, 23 bp, Homo sapiens
atgtaatactgtagaaatattgc

SEQ ID NO: 1804792 - DNA, 22 bp, Homo sapiens
atgtacctatgtgagtttcaga

SEQ ID NO: 1804793 - DNA, 17 bp, Homo sapiens
atgtagaataaatgaag

SEQ ID NO: 1804794 - DNA, 19 bp, Homo sapiens
atgtatatctatatctcta

SEQ ID NO: 1804795 - DNA, 14 bp, Homo sapiens
atgtatatgtatat

SEQ ID NO: 1804796 - DNA, 17 bp, Homo sapiens
atgtatatgtatatcta

SEQ ID NO: 1804797 - DNA, 13 bp, Homo sapiens
atgtatggcatgt

SEQ ID NO: 1804798 - DNA, 17 bp, Homo sapiens
atgtcaataactttata

SEQ ID NO: 1804799 - DNA, 19 bp, Homo sapiens
atgtcaataactttatatg

SEQ ID NO: 1804800 - DNA, 13 bp, Homo sapiens
atgtcagtatgtg

SEQ ID NO: 1804801 - DNA, 13 bp, Homo sapiens
atgtgacaacatt

SEQ ID NO: 1804802 - DNA, 23 bp, Homo sapiens
atgtgacaacatttttgtacatt

SEQ ID NO: 1804803 - DNA, 15 bp, Homo sapiens
atgtgagtttcagaa

SEQ ID NO: 1804804 - DNA, 20 bp, Homo sapiens
atgtgatggtcaggatctca

SEQ ID NO: 1804805 - DNA, 15 bp, Homo sapiens
atgtgcctgcaccag

SEQ ID NO: 1804806 - DNA, 17 bp, Homo sapiens
atgtgcctgcaccagga

SEQ ID NO: 1804807 - DNA, 14 bp, Homo sapiens
atgtgctgctgtgg

SEQ ID NO: 1804808 - DNA, 15 bp, Homo sapiens
atgtggaagtgtggg

SEQ ID NO: 1804809 - DNA, 16 bp, Homo sapiens
atgtggaagtgtgggt

SEQ ID NO: 1804810 - DNA, 18 bp, Homo sapiens
atgtgggggtctgtgtgt

SEQ ID NO: 1804811 - DNA, 19 bp, Homo sapiens
atgtgtcatgtaatactga

SEQ ID NO: 1804812 - DNA, 23 bp, Homo sapiens
atgtgtgtgtgttgtgtgtggga

SEQ ID NO: 1804813 - DNA, 23 bp, Homo sapiens
atgttattggaattttctttcat

SEQ ID NO: 1804814 - DNA, 18 bp, Homo sapiens
atgttgcacatcattcat

SEQ ID NO: 1804815 - DNA, 20 bp, Homo sapiens
atgttgcacatcattcattc

SEQ ID NO: 1804816 - DNA, 19 bp, Homo sapiens
atgtttacagaggacagta

SEQ ID NO: 1804817 - DNA, 18 bp, Homo sapiens
atgtttctatttccataa

SEQ ID NO: 1804818 - DNA, 17 bp, Homo sapiens
attaaaaggaaaaaaga

SEQ ID NO: 1804819 - DNA, 19 bp, Homo sapiens
attaaaaggaaaaaagaaa

SEQ ID NO: 1804820 - DNA, 23 bp, Homo sapiens
attaaagagattgtgcgttcaaa

SEQ ID NO: 1804821 - DNA, 22 bp, Homo sapiens
attaaatgttgcacatcattca

SEQ ID NO: 1804822 - DNA, 17 bp, Homo sapiens
attaacaactgtgaata

SEQ ID NO: 1804823 - DNA, 21 bp, Homo sapiens
attaacgctaaaggtgtaaga

SEQ ID NO: 1804824 - DNA, 18 bp, Homo sapiens
attacattttatatgtga

SEQ ID NO: 1804825 - DNA, 13 bp, Homo sapiens
attactaacttct

SEQ ID NO: 1804826 - DNA, 18 bp, Homo sapiens
attagcaaagaagcttca

SEQ ID NO: 1804827 - DNA, 13 bp, Homo sapiens
attagtattcagg

SEQ ID NO: 1804828 - DNA, 17 bp, Homo sapiens
attagtattcaggcact

SEQ ID NO: 1804829 - DNA, 18 bp, Homo sapiens
attagtattcaggcactg

SEQ ID NO: 1804830 - DNA, 22 bp, Homo sapiens
attagtgccaagtttttcagaa

SEQ ID NO: 1804831 - DNA, 16 bp, Homo sapiens
attatagtaaatctat

SEQ ID NO: 1804832 - DNA, 20 bp, Homo sapiens
attatataacccactgctga

SEQ ID NO: 1804833 - DNA, 16 bp, Homo sapiens
attatctactagtaat

SEQ ID NO: 1804834 - DNA, 17 bp, Homo sapiens
attatgttattggaatt

SEQ ID NO: 1804835 - DNA, 20 bp, Homo sapiens
attatgttattggaattttc

SEQ ID NO: 1804836 - DNA, 18 bp, Homo sapiens
attattgatcaaaatcaa

SEQ ID NO: 1804837 - DNA, 13 bp, Homo sapiens
attcaaatgaagg

SEQ ID NO: 1804838 - DNA, 14 bp, Homo sapiens
attcaacctgtgtc

SEQ ID NO: 1804839 - DNA, 18 bp, Homo sapiens
attcaacctgtgtcttat

SEQ ID NO: 1804840 - DNA, 17 bp, Homo sapiens
attcaagcaacagcact

SEQ ID NO: 1804841 - DNA, 13 bp, Homo sapiens
attcaataaagct

SEQ ID NO: 1804842 - DNA, 13 bp, Homo sapiens
attcaatgcaatg

SEQ ID NO: 1804843 - DNA, 15 bp, Homo sapiens
attcaatgcaatgca

SEQ ID NO: 1804844 - DNA, 21 bp, Homo sapiens
attcaatgcaatgcaattcaa

SEQ ID NO: 1804845 - DNA, 20 bp, Homo sapiens
attcactaagccatgccatg

SEQ ID NO: 1804846 - DNA, 21 bp, Homo sapiens
attcagcaccctgggtgccat

SEQ ID NO: 1804847 - DNA, 19 bp, Homo sapiens
attcaggaaaagcctctgt

SEQ ID NO: 1804848 - DNA, 15 bp, Homo sapiens
attcaggcactgaga

SEQ ID NO: 1804849 - DNA, 16 bp, Homo sapiens
attcaggcagcactga

SEQ ID NO: 1804850 - DNA, 14 bp, Homo sapiens
attcatcaagtaat

SEQ ID NO: 1804851 - DNA, 15 bp, Homo sapiens
attcatgctttctcc

SEQ ID NO: 1804852 - DNA, 17 bp, Homo sapiens
attcatggcttatgctt

SEQ ID NO: 1804853 - DNA, 22 bp, Homo sapiens
attccacagtgcccagctaatt

SEQ ID NO: 1804854 - DNA, 20 bp, Homo sapiens
attcccactaagctttctcc

SEQ ID NO: 1804855 - DNA, 21 bp, Homo sapiens
attcccactaagctttctcct

SEQ ID NO: 1804856 - DNA, 22 bp, Homo sapiens
attcccactaagctttctcctt

SEQ ID NO: 1804857 - DNA, 20 bp, Homo sapiens
attcccatggtagactgtga

SEQ ID NO: 1804858 - DNA, 21 bp, Homo sapiens
attcccatggtagactgtgac

SEQ ID NO: 1804859 - DNA, 20 bp, Homo sapiens
attccccggggcgtttcttt

SEQ ID NO: 1804860 - DNA, 16 bp, Homo sapiens
attcctccagcctccc

SEQ ID NO: 1804861 - DNA, 17 bp, Homo sapiens
attcctcccccagagcc

SEQ ID NO: 1804862 - DNA, 14 bp, Homo sapiens
attcctctaaaact

SEQ ID NO: 1804863 - DNA, 13 bp, Homo sapiens
attcctgggcctg

SEQ ID NO: 1804864 - DNA, 21 bp, Homo sapiens
attcctttacaactaaataac

SEQ ID NO: 1804865 - DNA, 15 bp, Homo sapiens
attctaattcttcat

SEQ ID NO: 1804866 - DNA, 19 bp, Homo sapiens
attctacacatatatgtat

SEQ ID NO: 1804867 - DNA, 24 bp, Homo sapiens
attctacacatatatgtatatgta

SEQ ID NO: 1804868 - DNA, 15 bp, Homo sapiens
attctgggaagggag

SEQ ID NO: 1804869 - DNA, 18 bp, Homo sapiens
attcttcaacagggaaaa

SEQ ID NO: 1804870 - DNA, 12 bp, Homo sapiens
attcttcattat

SEQ ID NO: 1804871 - DNA, 23 bp, Homo sapiens
attcttcattatagtaaatctat

SEQ ID NO: 1804872 - DNA, 15 bp, Homo sapiens
attcttttcaaaatt

SEQ ID NO: 1804873 - DNA, 19 bp, Homo sapiens
attcttttcaaaattgttg

SEQ ID NO: 1804874 - DNA, 21 bp, Homo sapiens
attgaaaggacctcttctgaa

SEQ ID NO: 1804875 - DNA, 19 bp, Homo sapiens
attgaaggagaaaatgcat

SEQ ID NO: 1804876 - DNA, 15 bp, Homo sapiens
attgactaaagccat

SEQ ID NO: 1804877 - DNA, 15 bp, Homo sapiens
attgatcaaaatcaa

SEQ ID NO: 1804878 - DNA, 19 bp, Homo sapiens
attgcctcttgcaggctga

SEQ ID NO: 1804879 - DNA, 18 bp, Homo sapiens
attgcggcctgttgggca

SEQ ID NO: 1804880 - DNA, 15 bp, Homo sapiens
attgctaattctgag

SEQ ID NO: 1804881 - DNA, 12 bp, Homo sapiens
attggaattttc

SEQ ID NO: 1804882 - DNA, 17 bp, Homo sapiens
attggaattttctttca

SEQ ID NO: 1804883 - DNA, 18 bp, Homo sapiens
attggcagcaggtgctgc

SEQ ID NO: 1804884 - DNA, 20 bp, Homo sapiens
attggctcccaactcctccc

SEQ ID NO: 1804885 - DNA, 12 bp, Homo sapiens
attggtgttgac

SEQ ID NO: 1804886 - DNA, 16 bp, Homo sapiens
attgtaccagaactat

SEQ ID NO: 1804887 - DNA, 13 bp, Homo sapiens
attgtccttcaga

SEQ ID NO: 1804888 - DNA, 14 bp, Homo sapiens
attgtccttcagag

SEQ ID NO: 1804889 - DNA, 23 bp, Homo sapiens
attgtgatttcccgtggccccag

SEQ ID NO: 1804890 - DNA, 16 bp, Homo sapiens
attgtggtagaaattt

SEQ ID NO: 1804891 - DNA, 23 bp, Homo sapiens
attgtggtagaaatttttaccaa

SEQ ID NO: 1804892 - DNA, 21 bp, Homo sapiens
attgttgcatcccccttagaa

SEQ ID NO: 1804893 - DNA, 22 bp, Homo sapiens
attgttgtgggctttctccggg

SEQ ID NO: 1804894 - DNA, 21 bp, Homo sapiens
attgtttggggaagttcaagt

SEQ ID NO: 1804895 - DNA, 19 bp, Homo sapiens
caagctgtcccctctgtca

SEQ ID NO: 1804896 - DNA, 14 bp, Homo sapiens
caagctgtgccacc

SEQ ID NO: 1804897 - DNA, 18 bp, Homo sapiens
caagctgtgccaccctgg

SEQ ID NO: 1804898 - DNA, 20 bp, Homo sapiens
caagctgtgccaccctgggc

SEQ ID NO: 1804899 - DNA, 18 bp, Homo sapiens
caaggacaacctgcccct

SEQ ID NO: 1804900 - DNA, 20 bp, Homo sapiens
caaggacaacctgcccctcc

SEQ ID NO: 1804901 - DNA, 23 bp, Homo sapiens
caaggacaacctgcccctcccca

SEQ ID NO: 1804902 - DNA, 21 bp, Homo sapiens
caaggagctgatttccaggcc

SEQ ID NO: 1804903 - DNA, 19 bp, Homo sapiens
caaggaggctggctggggc

SEQ ID NO: 1804904 - DNA, 21 bp, Homo sapiens
caaggaggctggctggggcct

SEQ ID NO: 1804905 - DNA, 15 bp, Homo sapiens
caaggcacctgcagg

SEQ ID NO: 1804906 - DNA, 17 bp, Homo sapiens
caaggcagcctccagag

SEQ ID NO: 1804907 - DNA, 21 bp, Homo sapiens
caaggcagcctccagagccag

SEQ ID NO: 1804908 - DNA, 16 bp, Homo sapiens
caaggcctcccacagt

SEQ ID NO: 1804909 - DNA, 15 bp, Homo sapiens
caagggacagaaaag

SEQ ID NO: 1804910 - DNA, 16 bp, Homo sapiens
caagggcatcaggcac

SEQ ID NO: 1804911 - DNA, 23 bp, Homo sapiens
caagggcatcaggcactggtggc

SEQ ID NO: 1804912 - DNA, 23 bp, Homo sapiens
caagggctccagcatccagcctg

SEQ ID NO: 1804913 - DNA, 21 bp, Homo sapiens
caaggtctccttactctgagc

SEQ ID NO: 1804914 - DNA, 22 bp, Homo sapiens
caaggtctccttactctgagcc

SEQ ID NO: 1804915 - DNA, 22 bp, Homo sapiens
caaggtgtctttgaaggaaagc

SEQ ID NO: 1804916 - DNA, 22 bp, Homo sapiens
caaggttactcagcagcagaga

SEQ ID NO: 1804917 - DNA, 17 bp, Homo sapiens
caagtaatcatggccag

SEQ ID NO: 1804918 - DNA, 16 bp, Homo sapiens
caagtcacagctgcag

SEQ ID NO: 1804919 - DNA, 17 bp, Homo sapiens
caagtcacagctgcagc

SEQ ID NO: 1804920 - DNA, 23 bp, Homo sapiens
caagtcacagctgcagctgggcc

SEQ ID NO: 1804921 - DNA, 13 bp, Homo sapiens
caagtctgtgaaa

SEQ ID NO: 1804922 - DNA, 15 bp, Homo sapiens
caagtttttcagaaa

SEQ ID NO: 1804923 - DNA, 17 bp, Homo sapiens
caagtttttcagaaagt

SEQ ID NO: 1804924 - DNA, 14 bp, Homo sapiens
caataaagctggac

SEQ ID NO: 1804925 - DNA, 15 bp, Homo sapiens
caataactttatatg

SEQ ID NO: 1804926 - DNA, 19 bp, Homo sapiens
caataactttatatgaagt

SEQ ID NO: 1804927 - DNA, 14 bp, Homo sapiens
caataattcatcaa

SEQ ID NO: 1804928 - DNA, 18 bp, Homo sapiens
caatactgggcagccttt

SEQ ID NO: 1804929 - DNA, 14 bp, Homo sapiens
caatatcattacta

SEQ ID NO: 1804930 - DNA, 20 bp, Homo sapiens
caatatcattactaacttct

SEQ ID NO: 1804931 - DNA, 15 bp, Homo sapiens
caatattcaataaag

SEQ ID NO: 1804932 - DNA, 17 bp, Homo sapiens
caatattcaataaagct

SEQ ID NO: 1804933 - DNA, 16 bp, Homo sapiens
caatattgattttaaa

SEQ ID NO: 1804934 - DNA, 15 bp, Homo sapiens
caatcaaatattttt

SEQ ID NO: 1804935 - DNA, 20 bp, Homo sapiens
caatctccagggctgcccct

SEQ ID NO: 1804936 - DNA, 14 bp, Homo sapiens
caatgaaaacaaaa

SEQ ID NO: 1804937 - DNA, 16 bp, Homo sapiens
caatgagtgtgccaga

SEQ ID NO: 1804938 - DNA, 16 bp, Homo sapiens
caatgcaatgaaaaca

SEQ ID NO: 1804939 - DNA, 17 bp, Homo sapiens
caatgcaatgaaaacaa

SEQ ID NO: 1804940 - DNA, 18 bp, Homo sapiens
caatgcaatgaaaacaaa

SEQ ID NO: 1804941 - DNA, 16 bp, Homo sapiens
caatgcaattcaatgc

SEQ ID NO: 1804942 - DNA, 14 bp, Homo sapiens
caatgtcagaaact

SEQ ID NO: 1804943 - DNA, 20 bp, Homo sapiens
caattcattgttaaaaaaca

SEQ ID NO: 1804944 - DNA, 17 bp, Homo sapiens
cacaaaataaagctgtg

SEQ ID NO: 1804945 - DNA, 20 bp, Homo sapiens
cacaaaataaagctgtgaca

SEQ ID NO: 1804946 - DNA, 18 bp, Homo sapiens
cacaacctcctcctccag

SEQ ID NO: 1804947 - DNA, 21 bp, Homo sapiens
cacaagtctaaacaatgaatt

SEQ ID NO: 1804948 - DNA, 13 bp, Homo sapiens
cacaattcattgt

SEQ ID NO: 1804949 - DNA, 16 bp, Homo sapiens
cacaattcattgttaa

SEQ ID NO: 1804950 - DNA, 20 bp, Homo sapiens
cacacattgtgcttggcccc

SEQ ID NO: 1804951 - DNA, 16 bp, Homo sapiens
cacaccactgccctgc

SEQ ID NO: 1804952 - DNA, 17 bp, Homo sapiens
cacaccactgccctgcc

SEQ ID NO: 1804953 - DNA, 18 bp, Homo sapiens
cacaccactgccctgcct

SEQ ID NO: 1804954 - DNA, 20 bp, Homo sapiens
cacaccactgccctgcctgc

SEQ ID NO: 1804955 - DNA, 13 bp, Homo sapiens
cacacccaggaag

SEQ ID NO: 1804956 - DNA, 12 bp, Homo sapiens
cacactactgta

SEQ ID NO: 1804957 - DNA, 23 bp, Homo sapiens
cacagagcctgaatttgtaagca

SEQ ID NO: 1804958 - DNA, 20 bp, Homo sapiens
cacagatattgttataaata

SEQ ID NO: 1804959 - DNA, 16 bp, Homo sapiens
cacagcaaggaggctg

SEQ ID NO: 1804960 - DNA, 18 bp, Homo sapiens
cacagcaaggaggctggc

SEQ ID NO: 1804961 - DNA, 20 bp, Homo sapiens
cacagcccacgtcctgtcag

SEQ ID NO: 1804962 - DNA, 11 bp, Homo sapiens
cacagccctcc

SEQ ID NO: 1804963 - DNA, 12 bp, Homo sapiens
cacagccctccc

SEQ ID NO: 1804964 - DNA, 12 bp, Homo sapiens
cacagccctggg

SEQ ID NO: 1804965 - DNA, 14 bp, Homo sapiens
cacagccctgggag

SEQ ID NO: 1804966 - DNA, 15 bp, Homo sapiens
cacagccctgggagg

SEQ ID NO: 1804967 - DNA, 16 bp, Homo sapiens
cacagccctgggaggg

SEQ ID NO: 1804968 - DNA, 15 bp, Homo sapiens
cacagcctctccctt

SEQ ID NO: 1804969 - DNA, 12 bp, Homo sapiens
cacagctgcagc

SEQ ID NO: 1804970 - DNA, 19 bp, Homo sapiens
cacagctgcagctgggccc

SEQ ID NO: 1804971 - DNA, 15 bp, Homo sapiens
cacagcttcctgagg

SEQ ID NO: 1804972 - DNA, 15 bp, Homo sapiens
cacagggaaatactg

SEQ ID NO: 1804973 - DNA, 15 bp, Homo sapiens
cacagggatccgact

SEQ ID NO: 1804974 - DNA, 22 bp, Homo sapiens
cacaggggcaaagaactgcccc

SEQ ID NO: 1804975 - DNA, 13 bp, Homo sapiens
cacaggggcaggc

SEQ ID NO: 1804976 - DNA, 15 bp, Homo sapiens
cacaggggcaggcct

SEQ ID NO: 1804977 - DNA, 17 bp, Homo sapiens
cacaggggcaggcctgg

SEQ ID NO: 1804978 - DNA, 18 bp, Homo sapiens
cacaggggcaggcctggg

SEQ ID NO: 1804979 - DNA, 19 bp, Homo sapiens
cacaggggcaggcctggga

SEQ ID NO: 1804980 - DNA, 20 bp, Homo sapiens
cacaggggcaggcctgggac

SEQ ID NO: 1804981 - DNA, 19 bp, Homo sapiens
cacaggggccccagatctg

SEQ ID NO: 1804982 - DNA, 18 bp, Homo sapiens
cacaggggcggggcagga

SEQ ID NO: 1804983 - DNA, 22 bp, Homo sapiens
cacagtattatttctccatccc

SEQ ID NO: 1804984 - DNA, 16 bp, Homo sapiens
cacagtcctcacagcc

SEQ ID NO: 1804985 - DNA, 11 bp, Homo sapiens
cacagtgctgc

SEQ ID NO: 1804986 - DNA, 12 bp, Homo sapiens
cacagtgctgct

SEQ ID NO: 1804987 - DNA, 17 bp, Homo sapiens
cacagtgctgcttctct

SEQ ID NO: 1804988 - DNA, 15 bp, Homo sapiens
cacagtgggtggcac

SEQ ID NO: 1804989 - DNA, 13 bp, Homo sapiens
cacagtttagaac

SEQ ID NO: 1804990 - DNA, 18 bp, Homo sapiens
cacagtttagaacagagg

SEQ ID NO: 1804991 - DNA, 20 bp, Homo sapiens
cacagtttagaacagaggga

SEQ ID NO: 1804992 - DNA, 20 bp, Homo sapiens
cacataaaggtatttagaat

SEQ ID NO: 1804993 - DNA, 20 bp, Homo sapiens
cacatataaaagttaaacta

SEQ ID NO: 1804994 - DNA, 18 bp, Homo sapiens
cacatcattcattcactg

SEQ ID NO: 1804995 - DNA, 21 bp, Homo sapiens
cacatcccggcctcttccacc

SEQ ID NO: 1804996 - DNA, 18 bp, Homo sapiens
cacattgtgcttggcccc

SEQ ID NO: 1804997 - DNA, 19 bp, Homo sapiens
cacattttgtacaaagata

SEQ ID NO: 1804998 - DNA, 20 bp, Homo sapiens
cacattttgtacaaagatat

SEQ ID NO: 1804999 - DNA, 21 bp, Homo sapiens
caccaaactgcacacacagct

SEQ ID NO: 1805000 - DNA, 17 bp, Homo sapiens
caccaacccagccgctg

SEQ ID NO: 1805001 - DNA, 18 bp, Homo sapiens
caccacgtctgccaggcc

SEQ ID NO: 1805002 - DNA, 13 bp, Homo sapiens
caccactagggtc

SEQ ID NO: 1805003 - DNA, 24 bp, Homo sapiens
caccagccccctggatgggcattg

SEQ ID NO: 1805004 - DNA, 11 bp, Homo sapiens
caccagctctg

SEQ ID NO: 1805005 - DNA, 22 bp, Homo sapiens
caccagctctgtggcctgtgtc

SEQ ID NO: 1805006 - DNA, 16 bp, Homo sapiens
caccagctgctctgcc

SEQ ID NO: 1805007 - DNA, 16 bp, Homo sapiens
caccaggggcaggcac

SEQ ID NO: 1805008 - DNA, 18 bp, Homo sapiens
caccaggggcaggcacag

SEQ ID NO: 1805009 - DNA, 21 bp, Homo sapiens
caccagggtccgcaccagctg

SEQ ID NO: 1805010 - DNA, 21 bp, Homo sapiens
caccatggtgtgtcatgctca

SEQ ID NO: 1805011 - DNA, 16 bp, Homo sapiens
cagctgacagtcctct

SEQ ID NO: 1805012 - DNA, 15 bp, Homo sapiens
cagctgcagctgggc

SEQ ID NO: 1805013 - DNA, 17 bp, Homo sapiens
cagctgcagctgggccc

SEQ ID NO: 1805014 - DNA, 10 bp, Homo sapiens
cagctgcctt

SEQ ID NO: 1805015 - DNA, 18 bp, Homo sapiens
cagctgccttcctcatcc

SEQ ID NO: 1805016 - DNA, 15 bp, Homo sapiens
cagctgctctgcccc

SEQ ID NO: 1805017 - DNA, 17 bp, Homo sapiens
cagctgctctgcccctt

SEQ ID NO: 1805018 - DNA, 21 bp, Homo sapiens
cagctgctctgccccttgggc

SEQ ID NO: 1805019 - DNA, 20 bp, Homo sapiens
cagctgctcttagtgcccgc

SEQ ID NO: 1805020 - DNA, 12 bp, Homo sapiens
cagctgggcccc

SEQ ID NO: 1805021 - DNA, 13 bp, Homo sapiens
cagctgggcccca

SEQ ID NO: 1805022 - DNA, 19 bp, Homo sapiens
cagctgggccccacctact

SEQ ID NO: 1805023 - DNA, 19 bp, Homo sapiens
cagctgggccccatgctct

SEQ ID NO: 1805024 - DNA, 15 bp, Homo sapiens
cagctgtagccatgg

SEQ ID NO: 1805025 - DNA, 17 bp, Homo sapiens
cagctgtagccatggct

SEQ ID NO: 1805026 - DNA, 21 bp, Homo sapiens
cagctgtagccatggctcagg

SEQ ID NO: 1805027 - DNA, 21 bp, Homo sapiens
cagcttatgggatccttgtct

SEQ ID NO: 1805028 - DNA, 14 bp, Homo sapiens
cagcttctgctggg

SEQ ID NO: 1805029 - DNA, 17 bp, Homo sapiens
caggaaaagcctctgtg

SEQ ID NO: 1805030 - DNA, 16 bp, Homo sapiens
caggaacgagcactgg

SEQ ID NO: 1805031 - DNA, 20 bp, Homo sapiens
caggaacgagcactggccag

SEQ ID NO: 1805032 - DNA, 18 bp, Homo sapiens
caggaaggcagctgctct

SEQ ID NO: 1805033 - DNA, 19 bp, Homo sapiens
caggaaggcagctgctctt

SEQ ID NO: 1805034 - DNA, 22 bp, Homo sapiens
caggaagggaaagcgggcagcc

SEQ ID NO: 1805035 - DNA, 19 bp, Homo sapiens
caggacacatcccggcctc

SEQ ID NO: 1805036 - DNA, 20 bp, Homo sapiens
caggacacatcccggcctct

SEQ ID NO: 1805037 - DNA, 12 bp, Homo sapiens
caggacccaggc

SEQ ID NO: 1805038 - DNA, 18 bp, Homo sapiens
caggacccaggccctcca

SEQ ID NO: 1805039 - DNA, 21 bp, Homo sapiens
caggagtccctgccatcatgt

SEQ ID NO: 1805040 - DNA, 14 bp, Homo sapiens
caggagtctgtgct

SEQ ID NO: 1805041 - DNA, 23 bp, Homo sapiens
caggagtttgagacaagccctgg

SEQ ID NO: 1805042 - DNA, 16 bp, Homo sapiens
caggatccgctgccac

SEQ ID NO: 1805043 - DNA, 18 bp, Homo sapiens
caggatccgctgccacca

SEQ ID NO: 1805044 - DNA, 13 bp, Homo sapiens
caggatcctgcag

SEQ ID NO: 1805045 - DNA, 13 bp, Homo sapiens
caggcaagcccct

SEQ ID NO: 1805046 - DNA, 16 bp, Homo sapiens
caggcaagcccctcag

SEQ ID NO: 1805047 - DNA, 17 bp, Homo sapiens
caggcaagcccctcagc

SEQ ID NO: 1805048 - DNA, 18 bp, Homo sapiens
caggcaagcccctcagcc

SEQ ID NO: 1805049 - DNA, 20 bp, Homo sapiens
caggcaagcccctcagccct

SEQ ID NO: 1805050 - DNA, 22 bp, Homo sapiens
caggcaagcccctcagcccttg

SEQ ID NO: 1805051 - DNA, 14 bp, Homo sapiens
caggcacctggcct

SEQ ID NO: 1805052 - DNA, 17 bp, Homo sapiens
caggcacctggcctgct

SEQ ID NO: 1805053 - DNA, 18 bp, Homo sapiens
caggcacctggcctgctg

SEQ ID NO: 1805054 - DNA, 19 bp, Homo sapiens
caggcacctggcctgctgg

SEQ ID NO: 1805055 - DNA, 20 bp, Homo sapiens
caggcactgagaatgatagt

SEQ ID NO: 1805056 - DNA, 14 bp, Homo sapiens
caggcactggtggc

SEQ ID NO: 1805057 - DNA, 17 bp, Homo sapiens
caggcactggtggcatc

SEQ ID NO: 1805058 - DNA, 13 bp, Homo sapiens
caggcagggaggg

SEQ ID NO: 1805059 - DNA, 14 bp, Homo sapiens
caggcagggagggc

SEQ ID NO: 1805060 - DNA, 14 bp, Homo sapiens
caggcatgctggcc

SEQ ID NO: 1805061 - DNA, 15 bp, Homo sapiens
caggcatgctggcct

SEQ ID NO: 1805062 - DNA, 14 bp, Homo sapiens
caggccactgtggc

SEQ ID NO: 1805063 - DNA, 16 bp, Homo sapiens
caggccactgtggcca

SEQ ID NO: 1805064 - DNA, 12 bp, Homo sapiens
caggccagaaaa

SEQ ID NO: 1805065 - DNA, 14 bp, Homo sapiens
caggccatcttcca

SEQ ID NO: 1805066 - DNA, 15 bp, Homo sapiens
caggccatcttccag

SEQ ID NO: 1805067 - DNA, 16 bp, Homo sapiens
caggcccatctcaggt

SEQ ID NO: 1805068 - DNA, 21 bp, Homo sapiens
caggcccatctcaggtgccac

SEQ ID NO: 1805069 - DNA, 15 bp, Homo sapiens
caggcccctgaggac

SEQ ID NO: 1805070 - DNA, 20 bp, Homo sapiens
caggcccctgaggactggag

SEQ ID NO: 1805071 - DNA, 19 bp, Homo sapiens
caggccctccatgggctag

SEQ ID NO: 1805072 - DNA, 20 bp, Homo sapiens
caggccctccatgggctagt

SEQ ID NO: 1805073 - DNA, 21 bp, Homo sapiens
caggccctccatgggctagtg

SEQ ID NO: 1805074 - DNA, 15 bp, Homo sapiens
caggccctccctgtc

SEQ ID NO: 1805075 - DNA, 18 bp, Homo sapiens
caggccctgcactgtcct

SEQ ID NO: 1805076 - DNA, 19 bp, Homo sapiens
caggccgttccccttggct

SEQ ID NO: 1805077 - DNA, 23 bp, Homo sapiens
caggccgttccccttggcttcct

SEQ ID NO: 1805078 - DNA, 11 bp, Homo sapiens
caggcctccag

SEQ ID NO: 1805079 - DNA, 11 bp, Homo sapiens
caggcctggga

SEQ ID NO: 1805080 - DNA, 17 bp, Homo sapiens
caggcctgggacccagc

SEQ ID NO: 1805081 - DNA, 15 bp, Homo sapiens
caggccttgagcaca

SEQ ID NO: 1805082 - DNA, 17 bp, Homo sapiens
caggcgttggtgccact

SEQ ID NO: 1805083 - DNA, 20 bp, Homo sapiens
caggctctgggctcagggct

SEQ ID NO: 1805084 - DNA, 18 bp, Homo sapiens
caggctcttcctggacct

SEQ ID NO: 1805085 - DNA, 21 bp, Homo sapiens
caggctcttcctggacctgag

SEQ ID NO: 1805086 - DNA, 23 bp, Homo sapiens
caggctcttcctggacctgagtc

SEQ ID NO: 1805087 - DNA, 13 bp, Homo sapiens
caggctgcactgc

SEQ ID NO: 1805088 - DNA, 20 bp, Homo sapiens
caggctgcactgcagtgatg

SEQ ID NO: 1805089 - DNA, 18 bp, Homo sapiens
caggctggccagccccac

SEQ ID NO: 1805090 - DNA, 19 bp, Homo sapiens
caggctggccagccccaca

SEQ ID NO: 1805091 - DNA, 20 bp, Homo sapiens
caggctggccagccccacag

SEQ ID NO: 1805092 - DNA, 21 bp, Homo sapiens
caggctggccagccccacagc

SEQ ID NO: 1805093 - DNA, 16 bp, Homo sapiens
cagggaaagctccacg

SEQ ID NO: 1805094 - DNA, 17 bp, Homo sapiens
cagggaaagctccacgg

SEQ ID NO: 1805095 - DNA, 22 bp, Homo sapiens
cagggaagagggcagtacctgg

SEQ ID NO: 1805096 - DNA, 17 bp, Homo sapiens
cagggaccacagcaagg

SEQ ID NO: 1805097 - DNA, 19 bp, Homo sapiens
cagggatgctatctcgcta

SEQ ID NO: 1805098 - DNA, 16 bp, Homo sapiens
cagggccagaaggagg

SEQ ID NO: 1805099 - DNA, 19 bp, Homo sapiens
cagggccagaaggagggca

SEQ ID NO: 1805100 - DNA, 20 bp, Homo sapiens
cagggcctgggggcagtgac

SEQ ID NO: 1805101 - DNA, 16 bp, Homo sapiens
cagggctgaggcctct

SEQ ID NO: 1805102 - DNA, 15 bp, Homo sapiens
cagggctgcccctgt

SEQ ID NO: 1805103 - DNA, 23 bp, Homo sapiens
cagggctgcccctgtaggttgct

SEQ ID NO: 1805104 - DNA, 18 bp, Homo sapiens
cagggctggagtgcgctc

SEQ ID NO: 1805105 - DNA, 15 bp, Homo sapiens
caggggcaggcacag

SEQ ID NO: 1805106 - DNA, 16 bp, Homo sapiens
caggggcaggcacagc

SEQ ID NO: 1805107 - DNA, 13 bp, Homo sapiens
caggggcaggcct

SEQ ID NO: 1805108 - DNA, 16 bp, Homo sapiens
caggggcaggcctggg

SEQ ID NO: 1805109 - DNA, 21 bp, Homo sapiens
caggggccccagatctgcctg

SEQ ID NO: 1805110 - DNA, 23 bp, Homo sapiens
caggggccccagatctgcctggg

SEQ ID NO: 1805111 - DNA, 24 bp, Homo sapiens
caggggccccagatctgcctgggc

SEQ ID NO: 1805112 - DNA, 13 bp, Homo sapiens
caggggcggggca

SEQ ID NO: 1805113 - DNA, 15 bp, Homo sapiens
caggggcggggcagg

SEQ ID NO: 1805114 - DNA, 17 bp, Homo sapiens
caggggcggggcaggaa

SEQ ID NO: 1805115 - DNA, 18 bp, Homo sapiens
caggggctgcccgctccc

SEQ ID NO: 1805116 - DNA, 19 bp, Homo sapiens
caggggctgcccgctccca

SEQ ID NO: 1805117 - DNA, 17 bp, Homo sapiens
cagggtccgcaccagct

SEQ ID NO: 1805118 - DNA, 18 bp, Homo sapiens
cagggtccgcaccagctg

SEQ ID NO: 1805119 - DNA, 15 bp, Homo sapiens
cagggtcttgggcta

SEQ ID NO: 1805120 - DNA, 23 bp, Homo sapiens
caggtaaaatattttccaaagag

SEQ ID NO: 1805121 - DNA, 17 bp, Homo sapiens
caggtacttcctcctga

SEQ ID NO: 1805122 - DNA, 20 bp, Homo sapiens
caggtacttcctcctgatgg

SEQ ID NO: 1805123 - DNA, 23 bp, Homo sapiens
caggtacttcctcctgatggcca

SEQ ID NO: 1805124 - DNA, 19 bp, Homo sapiens
caggtagatcgcttgagcc

SEQ ID NO: 1805125 - DNA, 23 bp, Homo sapiens
caggtagatcgcttgagcccagg

SEQ ID NO: 1805126 - DNA, 12 bp, Homo sapiens
caggtaggccct

SEQ ID NO: 1805127 - DNA, 23 bp, Homo sapiens
aaagttatggtttcctcatttta

SEQ ID NO: 1805128 - DNA, 17 bp, Homo sapiens
aaataaagctgtgacag

SEQ ID NO: 1805129 - DNA, 18 bp, Homo sapiens
aaataacacagatattgt

SEQ ID NO: 1805130 - DNA, 14 bp, Homo sapiens
aaatacttccatat

SEQ ID NO: 1805131 - DNA, 14 bp, Homo sapiens
aaatataagtaatg

SEQ ID NO: 1805132 - DNA, 24 bp, Homo sapiens
aaatatatagcttgaaagcagtta

SEQ ID NO: 1805133 - DNA, 14 bp, Homo sapiens
aaatcaaagttatg

SEQ ID NO: 1805134 - DNA, 23 bp, Homo sapiens
aaatcaaagttatggtttcctca

SEQ ID NO: 1805135 - DNA, 17 bp, Homo sapiens
aaatccccccttcagaa

SEQ ID NO: 1805136 - DNA, 21 bp, Homo sapiens
aaatgctattgttgtgggctt

SEQ ID NO: 1805137 - DNA, 15 bp, Homo sapiens
aaatgtaaaaatgaa

SEQ ID NO: 1805138 - DNA, 16 bp, Homo sapiens
aaatgtaaaaatgaag

SEQ ID NO: 1805139 - DNA, 19 bp, Homo sapiens
aaatgtaaaaatgaaggaa

SEQ ID NO: 1805140 - DNA, 18 bp, Homo sapiens
aaatgttgcacatcattc

SEQ ID NO: 1805141 - DNA, 15 bp, Homo sapiens
aaattaatctttcta

SEQ ID NO: 1805142 - DNA, 13 bp, Homo sapiens
aaatttacagaat

SEQ ID NO: 1805143 - DNA, 17 bp, Homo sapiens
aaatttactgtgagact

SEQ ID NO: 1805144 - DNA, 19 bp, Homo sapiens
aacaagcaaggatatcaga

SEQ ID NO: 1805145 - DNA, 16 bp, Homo sapiens
aacaagtcacagctgc

SEQ ID NO: 1805146 - DNA, 12 bp, Homo sapiens
aacaagttgcct

SEQ ID NO: 1805147 - DNA, 14 bp, Homo sapiens
aacaatgaattctt

SEQ ID NO: 1805148 - DNA, 12 bp, Homo sapiens
aacaatggagat

SEQ ID NO: 1805149 - DNA, 14 bp, Homo sapiens
aacaatgtcagaaa

SEQ ID NO: 1805150 - DNA, 22 bp, Homo sapiens
aacaattaattttctatgaatt

SEQ ID NO: 1805151 - DNA, 19 bp, Homo sapiens
aacacaagaattacactaa

SEQ ID NO: 1805152 - DNA, 15 bp, Homo sapiens
aacagaggcatttaa

SEQ ID NO: 1805153 - DNA, 19 bp, Homo sapiens
aacagagggaccaaattgc

SEQ ID NO: 1805154 - DNA, 13 bp, Homo sapiens
aacagatttctaa

SEQ ID NO: 1805155 - DNA, 23 bp, Homo sapiens
aacagcactttctgtagtaataa

SEQ ID NO: 1805156 - DNA, 16 bp, Homo sapiens
aacagctagcttgaaa

SEQ ID NO: 1805157 - DNA, 20 bp, Homo sapiens
aacagctagcttgaaaactt

SEQ ID NO: 1805158 - DNA, 21 bp, Homo sapiens
aacagctagcttgaaaacttg

SEQ ID NO: 1805159 - DNA, 18 bp, Homo sapiens
aacagcttttcccaggag

SEQ ID NO: 1805160 - DNA, 21 bp, Homo sapiens
aacagcttttcccaggagacc

SEQ ID NO: 1805161 - DNA, 14 bp, Homo sapiens
aacagggaaaacag

SEQ ID NO: 1805162 - DNA, 13 bp, Homo sapiens
aacattcctccag

SEQ ID NO: 1805163 - DNA, 16 bp, Homo sapiens
aacattcctccagcct

SEQ ID NO: 1805164 - DNA, 16 bp, Homo sapiens
aacattgaatatcagt

SEQ ID NO: 1805165 - DNA, 15 bp, Homo sapiens
aacatttgtaaaaat

SEQ ID NO: 1805166 - DNA, 13 bp, Homo sapiens
aaccaaggcagcc

SEQ ID NO: 1805167 - DNA, 20 bp, Homo sapiens
aacccactgctgaaaaagaa

SEQ ID NO: 1805168 - DNA, 19 bp, Homo sapiens
aacccagatcgctgtgtta

SEQ ID NO: 1805169 - DNA, 10 bp, Homo sapiens
aacccagccg

SEQ ID NO: 1805170 - DNA, 13 bp, Homo sapiens
aaccccatgggct

SEQ ID NO: 1805171 - DNA, 19 bp, Homo sapiens
aacccccagcccacagagc

SEQ ID NO: 1805172 - DNA, 17 bp, Homo sapiens
aaccccgcggtgctctg

SEQ ID NO: 1805173 - DNA, 19 bp, Homo sapiens
aaccccgcggtgctctggc

SEQ ID NO: 1805174 - DNA, 21 bp, Homo sapiens
aacccctgtacccagctcctt

SEQ ID NO: 1805175 - DNA, 15 bp, Homo sapiens
aacctaattgtggta

SEQ ID NO: 1805176 - DNA, 20 bp, Homo sapiens
aacctcacactactgtattt

SEQ ID NO: 1805177 - DNA, 18 bp, Homo sapiens
aacgagcactggccagag

SEQ ID NO: 1805178 - DNA, 13 bp, Homo sapiens
aacgtattttgat

SEQ ID NO: 1805179 - DNA, 14 bp, Homo sapiens
aacgtattttgatg

SEQ ID NO: 1805180 - DNA, 22 bp, Homo sapiens
aacgtattttgatgttttgtac

SEQ ID NO: 1805181 - DNA, 15 bp, Homo sapiens
aacgttttaataatt

SEQ ID NO: 1805182 - DNA, 15 bp, Homo sapiens
aactagacaaaagtt

SEQ ID NO: 1805183 - DNA, 16 bp, Homo sapiens
aactagacaaaagttt

SEQ ID NO: 1805184 - DNA, 21 bp, Homo sapiens
aactagactttcctttgcacc

SEQ ID NO: 1805185 - DNA, 17 bp, Homo sapiens
aactgatggaccgggtg

SEQ ID NO: 1805186 - DNA, 22 bp, Homo sapiens
aactgatggaccgggtgggcct

SEQ ID NO: 1805187 - DNA, 10 bp, Homo sapiens
aactgctgag

SEQ ID NO: 1805188 - DNA, 15 bp, Homo sapiens
aactgtcttgagaga

SEQ ID NO: 1805189 - DNA, 22 bp, Homo sapiens
aactgtcttgagagaaaagaaa

SEQ ID NO: 1805190 - DNA, 23 bp, Homo sapiens
aactgtcttgagagaaaagaaaa

SEQ ID NO: 1805191 - DNA, 23 bp, Homo sapiens
aattgcaacaatgcaaaagccaa

SEQ ID NO: 1805192 - DNA, 16 bp, Homo sapiens
aattgcctcttgcagg

SEQ ID NO: 1805193 - DNA, 23 bp, Homo sapiens
aattgttgcatcccccttagaat

SEQ ID NO: 1805194 - DNA, 17 bp, Homo sapiens
aatttaaccagcaacat

SEQ ID NO: 1805195 - DNA, 16 bp, Homo sapiens
aatttatagaataatt

SEQ ID NO: 1805196 - DNA, 19 bp, Homo sapiens
aatttatagaataatttct

SEQ ID NO: 1805197 - DNA, 14 bp, Homo sapiens
aatttgaaacacaa

SEQ ID NO: 1805198 - DNA, 20 bp, Homo sapiens
aattttctttcatacattat

SEQ ID NO: 1805199 - DNA, 16 bp, Homo sapiens
aattttgtatgtcaat

SEQ ID NO: 1805200 - DNA, 21 bp, Homo sapiens
aatttttattatttgttttcc

SEQ ID NO: 1805201 - DNA, 21 bp, Homo sapiens
aattttttacattttcctgtg

SEQ ID NO: 1805202 - DNA, 23 bp, Homo sapiens
aattttttacattttcctgtgta

SEQ ID NO: 1805203 - DNA, 15 bp, Homo sapiens
acaaaaaccagcagg

SEQ ID NO: 1805204 - DNA, 14 bp, Homo sapiens
acaaaattccatta

SEQ ID NO: 1805205 - DNA, 21 bp, Homo sapiens
acaacagatttctaagttaaa

SEQ ID NO: 1805206 - DNA, 15 bp, Homo sapiens
acaacctgcccctcc

SEQ ID NO: 1805207 - DNA, 18 bp, Homo sapiens
acaacctgcccctcccca

SEQ ID NO: 1805208 - DNA, 15 bp, Homo sapiens
acaactgtgaatatg

SEQ ID NO: 1805209 - DNA, 13 bp, Homo sapiens
acaataattcatc

SEQ ID NO: 1805210 - DNA, 14 bp, Homo sapiens
acaataattcatca

SEQ ID NO: 1805211 - DNA, 12 bp, Homo sapiens
acaatggcagct

SEQ ID NO: 1805212 - DNA, 17 bp, Homo sapiens
acaatggggtgggccca

SEQ ID NO: 1805213 - DNA, 11 bp, Homo sapiens
acaattcattg

SEQ ID NO: 1805214 - DNA, 22 bp, Homo sapiens
acaattcattgttaaaaaacaa

SEQ ID NO: 1805215 - DNA, 11 bp, Homo sapiens
acacacagctc

SEQ ID NO: 1805216 - DNA, 15 bp, Homo sapiens
acacactcagcagcc

SEQ ID NO: 1805217 - DNA, 19 bp, Homo sapiens
acacactcagcagccccct

SEQ ID NO: 1805218 - DNA, 13 bp, Homo sapiens
acacagatattgt

SEQ ID NO: 1805219 - DNA, 17 bp, Homo sapiens
acacattgtgcttggcc

SEQ ID NO: 1805220 - DNA, 18 bp, Homo sapiens
acaccaagctgtgccacc

SEQ ID NO: 1805221 - DNA, 21 bp, Homo sapiens
acaccaagctgtgccaccctg

SEQ ID NO: 1805222 - DNA, 22 bp, Homo sapiens
acaccaagctgtgccaccctgg

SEQ ID NO: 1805223 - DNA, 11 bp, Homo sapiens
acaccactgcc

SEQ ID NO: 1805224 - DNA, 15 bp, Homo sapiens
acaccactgccctgc

SEQ ID NO: 1805225 - DNA, 15 bp, Homo sapiens
acacccaggaaggga

SEQ ID NO: 1805226 - DNA, 12 bp, Homo sapiens
acacctgccctg

SEQ ID NO: 1805227 - DNA, 13 bp, Homo sapiens
acacctgccctgc

SEQ ID NO: 1805228 - DNA, 14 bp, Homo sapiens
acacctgccctgcc

SEQ ID NO: 1805229 - DNA, 18 bp, Homo sapiens
acacctgccctgccctgc

SEQ ID NO: 1805230 - DNA, 23 bp, Homo sapiens
acacgcaagggcatcaggcactg

SEQ ID NO: 1805231 - DNA, 20 bp, Homo sapiens
acactactgtatttcattat

SEQ ID NO: 1805232 - DNA, 16 bp, Homo sapiens
acactgcatctcaaga

SEQ ID NO: 1805233 - DNA, 18 bp, Homo sapiens
acactgcggggcttggct

SEQ ID NO: 1805234 - DNA, 19 bp, Homo sapiens
acactgcggggcttggctg

SEQ ID NO: 1805235 - DNA, 11 bp, Homo sapiens
acactgctgca

SEQ ID NO: 1805236 - DNA, 14 bp, Homo sapiens
acactgctgcacca

SEQ ID NO: 1805237 - DNA, 17 bp, Homo sapiens
acacttggagcccgtgc

SEQ ID NO: 1805238 - DNA, 18 bp, Homo sapiens
acactttgccaaggctct

SEQ ID NO: 1805239 - DNA, 22 bp, Homo sapiens
acagagcctgaatttgtaagca

SEQ ID NO: 1805240 - DNA, 23 bp, Homo sapiens
acagaggacagtatttgtgggga

SEQ ID NO: 1805241 - DNA, 20 bp, Homo sapiens
acagagttggtgttcataat

SEQ ID NO: 1805242 - DNA, 15 bp, Homo sapiens
acagatttctaagtt

SEQ ID NO: 1805243 - DNA, 17 bp, Homo sapiens
acagcaaggaggctggc

SEQ ID NO: 1805244 - DNA, 15 bp, Homo sapiens
acagcccacgtcctg

SEQ ID NO: 1805245 - DNA, 16 bp, Homo sapiens
acagcccacgtcctgt

SEQ ID NO: 1805246 - DNA, 19 bp, Homo sapiens
acagcccacgtcctgtcag

SEQ ID NO: 1805247 - DNA, 18 bp, Homo sapiens
acagccctcccgcccctt

SEQ ID NO: 1805248 - DNA, 18 bp, Homo sapiens
aacatttttgtacattat

SEQ ID NO: 1805249 - DNA, 22 bp, Homo sapiens
aaccaaacctcacactactgta

SEQ ID NO: 1805250 - DNA, 14 bp, Homo sapiens
aaccaaggcagcct

SEQ ID NO: 1805251 - DNA, 11 bp, Homo sapiens
aaccagcaggt

SEQ ID NO: 1805252 - DNA, 14 bp, Homo sapiens
aacccagccgctgc

SEQ ID NO: 1805253 - DNA, 14 bp, Homo sapiens
aaccccaagacagt

SEQ ID NO: 1805254 - DNA, 20 bp, Homo sapiens
aaccccgcggtgctctggcg

SEQ ID NO: 1805255 - DNA, 22 bp, Homo sapiens
aaccccgcggtgctctggcggc

SEQ ID NO: 1805256 - DNA, 14 bp, Homo sapiens
aaccgcttgccata

SEQ ID NO: 1805257 - DNA, 21 bp, Homo sapiens
aacctagtactctctgctcta

SEQ ID NO: 1805258 - DNA, 19 bp, Homo sapiens
aacctctaatttattttgt

SEQ ID NO: 1805259 - DNA, 16 bp, Homo sapiens
aacctgtccataaagt

SEQ ID NO: 1805260 - DNA, 17 bp, Homo sapiens
aacctgtccataaagta

SEQ ID NO: 1805261 - DNA, 21 bp, Homo sapiens
aacctgtccataaagtaattt

SEQ ID NO: 1805262 - DNA, 15 bp, Homo sapiens
aacgagcactggcca

SEQ ID NO: 1805263 - DNA, 19 bp, Homo sapiens
aacgagcactggccagaga

SEQ ID NO: 1805264 - DNA, 18 bp, Homo sapiens
aacgctaaaggtgtaaga

SEQ ID NO: 1805265 - DNA, 13 bp, Homo sapiens
aactaagccctcg

SEQ ID NO: 1805266 - DNA, 18 bp, Homo sapiens
aactctatactcaatcaa

SEQ ID NO: 1805267 - DNA, 20 bp, Homo sapiens
aactgattagtattcaggca

SEQ ID NO: 1805268 - DNA, 19 bp, Homo sapiens
aactgcacacacagctcct

SEQ ID NO: 1805269 - DNA, 19 bp, Homo sapiens
aactgcacactatttccct

SEQ ID NO: 1805270 - DNA, 12 bp, Homo sapiens
aactgctgagcc

SEQ ID NO: 1805271 - DNA, 16 bp, Homo sapiens
aactgctgagccactc

SEQ ID NO: 1805272 - DNA, 22 bp, Homo sapiens
aactgcttaagtggatctgttt

SEQ ID NO: 1805273 - DNA, 11 bp, Homo sapiens
aactggctggc

SEQ ID NO: 1805274 - DNA, 17 bp, Homo sapiens
aactggctggccagtct

SEQ ID NO: 1805275 - DNA, 11 bp, Homo sapiens
aactgtgaata

SEQ ID NO: 1805276 - DNA, 18 bp, Homo sapiens
aactgtgaatatgagaaa

SEQ ID NO: 1805277 - DNA, 18 bp, Homo sapiens
aacttacacttggagccc

SEQ ID NO: 1805278 - DNA, 20 bp, Homo sapiens
aacttattaacaactgtgaa

SEQ ID NO: 1805279 - DNA, 22 bp, Homo sapiens
aacttattaacaactgtgaata

SEQ ID NO: 1805280 - DNA, 18 bp, Homo sapiens
aacttgaggacacatgtc

SEQ ID NO: 1805281 - DNA, 14 bp, Homo sapiens
aagaaaagaccctg

SEQ ID NO: 1805282 - DNA, 20 bp, Homo sapiens
aagaaagggaaactggctga

SEQ ID NO: 1805283 - DNA, 13 bp, Homo sapiens
aagaactgcccca

SEQ ID NO: 1805284 - DNA, 23 bp, Homo sapiens
aagaactgccccatctcctccca

SEQ ID NO: 1805285 - DNA, 19 bp, Homo sapiens
aagaagtgtgtcaccctta

SEQ ID NO: 1805286 - DNA, 16 bp, Homo sapiens
aagaataaatgaatct

SEQ ID NO: 1805287 - DNA, 22 bp, Homo sapiens
aagaatcaacagccaaactgct

SEQ ID NO: 1805288 - DNA, 21 bp, Homo sapiens
aagaatgcagattcctgggcc

SEQ ID NO: 1805289 - DNA, 13 bp, Homo sapiens
aagaccctgagac

SEQ ID NO: 1805290 - DNA, 14 bp, Homo sapiens
aagacttcagattt

SEQ ID NO: 1805291 - DNA, 15 bp, Homo sapiens
aagacttcagatttc

SEQ ID NO: 1805292 - DNA, 16 bp, Homo sapiens
aagacttcagatttca

SEQ ID NO: 1805293 - DNA, 17 bp, Homo sapiens
aagacttcagatttcaa

SEQ ID NO: 1805294 - DNA, 18 bp, Homo sapiens
aagacttcagatttcaaa

SEQ ID NO: 1805295 - DNA, 16 bp, Homo sapiens
aagagagattggattt

SEQ ID NO: 1805296 - DNA, 14 bp, Homo sapiens
aagagatgtggcaa

SEQ ID NO: 1805297 - DNA, 12 bp, Homo sapiens
aagagcagcctg

SEQ ID NO: 1805298 - DNA, 13 bp, Homo sapiens
aagagcagcctga

SEQ ID NO: 1805299 - DNA, 14 bp, Homo sapiens
aagaggagaccctg

SEQ ID NO: 1805300 - DNA, 19 bp, Homo sapiens
aagagttattcaaatgaag

SEQ ID NO: 1805301 - DNA, 18 bp, Homo sapiens
aagatgagatttgccagc

SEQ ID NO: 1805302 - DNA, 17 bp, Homo sapiens
aagatggagttgtattt

SEQ ID NO: 1805303 - DNA, 23 bp, Homo sapiens
aagatggagttgtattttgacaa

SEQ ID NO: 1805304 - DNA, 21 bp, Homo sapiens
aagatggcttatttgtataat

SEQ ID NO: 1805305 - DNA, 15 bp, Homo sapiens
aagatgtaagaagct

SEQ ID NO: 1805306 - DNA, 20 bp, Homo sapiens
aagattatatatcataaagt

SEQ ID NO: 1805307 - DNA, 21 bp, Homo sapiens
aagattatatatcataaagta

SEQ ID NO: 1805308 - DNA, 15 bp, Homo sapiens
aagcaacttgcttct

SEQ ID NO: 1805309 - DNA, 16 bp, Homo sapiens
aagcaagggctccagc

SEQ ID NO: 1805310 - DNA, 17 bp, Homo sapiens
aagcaattgccctgtaa

SEQ ID NO: 1805311 - DNA, 22 bp, Homo sapiens
aagcactgtttaactgggagtg

SEQ ID NO: 1805312 - DNA, 14 bp, Homo sapiens
aagcagaggctttg

SEQ ID NO: 1805313 - DNA, 11 bp, Homo sapiens
aagcagccagc

SEQ ID NO: 1805314 - DNA, 12 bp, Homo sapiens
aagcagccagcc

SEQ ID NO: 1805315 - DNA, 12 bp, Homo sapiens
aagcagtgcctc

SEQ ID NO: 1805316 - DNA, 14 bp, Homo sapiens
aagcagtgcctcga

SEQ ID NO: 1805317 - DNA, 20 bp, Homo sapiens
aagcagtgcctcgaggcacc

SEQ ID NO: 1805318 - DNA, 14 bp, Homo sapiens
aagccaagaaagta

SEQ ID NO: 1805319 - DNA, 15 bp, Homo sapiens
aagccatttgtctgt

SEQ ID NO: 1805320 - DNA, 18 bp, Homo sapiens
aagccccagggcctgggg

SEQ ID NO: 1805321 - DNA, 20 bp, Homo sapiens
aagcccctcagcccttgccc

SEQ ID NO: 1805322 - DNA, 18 bp, Homo sapiens
aagccgtctgactccaga

SEQ ID NO: 1805323 - DNA, 20 bp, Homo sapiens
aagcctctgtgtcactggct

SEQ ID NO: 1805324 - DNA, 21 bp, Homo sapiens
aagcctctgtgtcactggctg

SEQ ID NO: 1805325 - DNA, 23 bp, Homo sapiens
aagcctctgtgtcactggctgcc

SEQ ID NO: 1805326 - DNA, 18 bp, Homo sapiens
aagcgagcacagtattat

SEQ ID NO: 1805327 - DNA, 12 bp, Homo sapiens
aagcgggcagcc

SEQ ID NO: 1805328 - DNA, 15 bp, Homo sapiens
aagcgggcagccccg

SEQ ID NO: 1805329 - DNA, 21 bp, Homo sapiens
aagctagaaacaatctatagt

SEQ ID NO: 1805330 - DNA, 14 bp, Homo sapiens
aagctcagaataga

SEQ ID NO: 1805331 - DNA, 21 bp, Homo sapiens
aagctccacggtgcgtggctg

SEQ ID NO: 1805332 - DNA, 12 bp, Homo sapiens
aagctgctctgc

SEQ ID NO: 1805333 - DNA, 20 bp, Homo sapiens
aagctgtactcagagcagag

SEQ ID NO: 1805334 - DNA, 16 bp, Homo sapiens
aagctgtgccaccctg

SEQ ID NO: 1805335 - DNA, 20 bp, Homo sapiens
aagctgtgccaccctgggct

SEQ ID NO: 1805336 - DNA, 19 bp, Homo sapiens
aagctgtttttgtgctctt

SEQ ID NO: 1805337 - DNA, 12 bp, Homo sapiens
aagctttctcct

SEQ ID NO: 1805338 - DNA, 14 bp, Homo sapiens
aaggaaaaaagaaa

SEQ ID NO: 1805339 - DNA, 17 bp, Homo sapiens
aaggaatagccagagag

SEQ ID NO: 1805340 - DNA, 21 bp, Homo sapiens
aaggaatagccagagaggagc

SEQ ID NO: 1805341 - DNA, 23 bp, Homo sapiens
aaggaattacattttatatgtga

SEQ ID NO: 1805342 - DNA, 13 bp, Homo sapiens
aaggacccaccca

SEQ ID NO: 1805343 - DNA, 24 bp, Homo sapiens
aaggacccacccatcttcctgctg

SEQ ID NO: 1805344 - DNA, 15 bp, Homo sapiens
aaggagcagggtcct

SEQ ID NO: 1805345 - DNA, 20 bp, Homo sapiens
aaggagctgatttccaggcc

SEQ ID NO: 1805346 - DNA, 16 bp, Homo sapiens
aaggagggcagagcca

SEQ ID NO: 1805347 - DNA, 17 bp, Homo sapiens
aaggagggcagagccat

SEQ ID NO: 1805348 - DNA, 18 bp, Homo sapiens
aaggcactgtgaactatt

SEQ ID NO: 1805349 - DNA, 13 bp, Homo sapiens
aaggcagcaggcg

SEQ ID NO: 1805350 - DNA, 14 bp, Homo sapiens
aaggcagcattcca

SEQ ID NO: 1805351 - DNA, 11 bp, Homo sapiens
aaggcagcctc

SEQ ID NO: 1805352 - DNA, 13 bp, Homo sapiens
aaggcagcctcca

SEQ ID NO: 1805353 - DNA, 17 bp, Homo sapiens
aaggcagcctccagagc

SEQ ID NO: 1805354 - DNA, 18 bp, Homo sapiens
aaggcagcctccagagcc

SEQ ID NO: 1805355 - DNA, 19 bp, Homo sapiens
aaggcagcctccagagcca

SEQ ID NO: 1805356 - DNA, 13 bp, Homo sapiens
aaggcagctgctc

SEQ ID NO: 1805357 - DNA, 23 bp, Homo sapiens
aaggcagtgaacacactcagcag

SEQ ID NO: 1805358 - DNA, 13 bp, Homo sapiens
aaggcctcccaca

SEQ ID NO: 1805359 - DNA, 15 bp, Homo sapiens
aaggcctcccacagt

SEQ ID NO: 1805360 - DNA, 16 bp, Homo sapiens
aaggcctcttgtgctc

SEQ ID NO: 1805361 - DNA, 22 bp, Homo sapiens
aaggcctggaaccagggaggag

SEQ ID NO: 1805362 - DNA, 12 bp, Homo sapiens
aaggctctcccc

SEQ ID NO: 1805363 - DNA, 23 bp, Homo sapiens
aaggctctcccctctcgccccat

SEQ ID NO: 1805364 - DNA, 19 bp, Homo sapiens
aagggacagtattctcagt

SEQ ID NO: 1805365 - DNA, 16 bp, Homo sapiens
acctgtccataaagta

SEQ ID NO: 1805366 - DNA, 12 bp, Homo sapiens
acctgtctgtct

SEQ ID NO: 1805367 - DNA, 19 bp, Homo sapiens
acctttttttctctcctaa

SEQ ID NO: 1805368 - DNA, 20 bp, Homo sapiens
acgagtcacctgcaagcccc

SEQ ID NO: 1805369 - DNA, 19 bp, Homo sapiens
acgccctgcgttggagcca

SEQ ID NO: 1805370 - DNA, 22 bp, Homo sapiens
acgccctgcgttggagccactc

SEQ ID NO: 1805371 - DNA, 18 bp, Homo sapiens
acggggccggccaggtgg

SEQ ID NO: 1805372 - DNA, 16 bp, Homo sapiens
acggggtggctgaaag

SEQ ID NO: 1805373 - DNA, 18 bp, Homo sapiens
acggtgcgtggctgtggc

SEQ ID NO: 1805374 - DNA, 16 bp, Homo sapiens
acggtttatgctgggc

SEQ ID NO: 1805375 - DNA, 16 bp, Homo sapiens
acgtctgccaggccca

SEQ ID NO: 1805376 - DNA, 19 bp, Homo sapiens
acgtgaacgttttaataat

SEQ ID NO: 1805377 - DNA, 17 bp, Homo sapiens
acgtgtctttagaactc

SEQ ID NO: 1805378 - DNA, 11 bp, Homo sapiens
actaaaagaat

SEQ ID NO: 1805379 - DNA, 17 bp, Homo sapiens
actaaagccatttgtct

SEQ ID NO: 1805380 - DNA, 18 bp, Homo sapiens
actaaatgatattcatat

SEQ ID NO: 1805381 - DNA, 20 bp, Homo sapiens
actaacttcttccacttttt

SEQ ID NO: 1805382 - DNA, 16 bp, Homo sapiens
actaagctttctcctt

SEQ ID NO: 1805383 - DNA, 15 bp, Homo sapiens
actaatacttactgt

SEQ ID NO: 1805384 - DNA, 14 bp, Homo sapiens
actactatggctgt

SEQ ID NO: 1805385 - DNA, 22 bp, Homo sapiens
actagggtcctggccctcttct

SEQ ID NO: 1805386 - DNA, 14 bp, Homo sapiens
actagtcaagaaaa

SEQ ID NO: 1805387 - DNA, 14 bp, Homo sapiens
actatggctgttta

SEQ ID NO: 1805388 - DNA, 15 bp, Homo sapiens
actattgtttgggga

SEQ ID NO: 1805389 - DNA, 13 bp, Homo sapiens
actattttgaaga

SEQ ID NO: 1805390 - DNA, 13 bp, Homo sapiens
actcaaggcctcc

SEQ ID NO: 1805391 - DNA, 14 bp, Homo sapiens
actcaccagggtcc

SEQ ID NO: 1805392 - DNA, 21 bp, Homo sapiens
actcaccagggtccgcaccag

SEQ ID NO: 1805393 - DNA, 17 bp, Homo sapiens
actcagcagcagagagc

SEQ ID NO: 1805394 - DNA, 21 bp, Homo sapiens
actcagcagcagagagccctg

SEQ ID NO: 1805395 - DNA, 21 bp, Homo sapiens
actcagtgtctgcctttaaat

SEQ ID NO: 1805396 - DNA, 23 bp, Homo sapiens
actccagaatctgctgttgccat

SEQ ID NO: 1805397 - DNA, 11 bp, Homo sapiens
actccagagaa

SEQ ID NO: 1805398 - DNA, 14 bp, Homo sapiens
actccagagtctga

SEQ ID NO: 1805399 - DNA, 14 bp, Homo sapiens
actcccacttccct

SEQ ID NO: 1805400 - DNA, 19 bp, Homo sapiens
actcctgtcccgccttcct

SEQ ID NO: 1805401 - DNA, 15 bp, Homo sapiens
actcgatgaatgtgt

SEQ ID NO: 1805402 - DNA, 15 bp, Homo sapiens
actcgggctcctgtg

SEQ ID NO: 1805403 - DNA, 18 bp, Homo sapiens
actcgggctcctgtgccc

SEQ ID NO: 1805404 - DNA, 16 bp, Homo sapiens
actctatactcaatca

SEQ ID NO: 1805405 - DNA, 23 bp, Homo sapiens
actctattatggaacccaatgga

SEQ ID NO: 1805406 - DNA, 22 bp, Homo sapiens
actctccttcgtgtctctccca

SEQ ID NO: 1805407 - DNA, 23 bp, Homo sapiens
actctccttcgtgtctctcccac

SEQ ID NO: 1805408 - DNA, 23 bp, Homo sapiens
actctcggggcccttggggcctg

SEQ ID NO: 1805409 - DNA, 12 bp, Homo sapiens
actctctgctct

SEQ ID NO: 1805410 - DNA, 13 bp, Homo sapiens
actctctgctcta

SEQ ID NO: 1805411 - DNA, 14 bp, Homo sapiens
actctctgctctag

SEQ ID NO: 1805412 - DNA, 15 bp, Homo sapiens
actctctgctctagc

SEQ ID NO: 1805413 - DNA, 16 bp, Homo sapiens
actctctgctctagcc

SEQ ID NO: 1805414 - DNA, 18 bp, Homo sapiens
actctctgctctagccag

SEQ ID NO: 1805415 - DNA, 13 bp, Homo sapiens
actctgtgcccat

SEQ ID NO: 1805416 - DNA, 21 bp, Homo sapiens
actctgtgcccatgggcactg

SEQ ID NO: 1805417 - DNA, 23 bp, Homo sapiens
actctgtgcccatgggcactgct

SEQ ID NO: 1805418 - DNA, 15 bp, Homo sapiens
actcttaagcaatgg

SEQ ID NO: 1805419 - DNA, 16 bp, Homo sapiens
actgaaagcaaatgct

SEQ ID NO: 1805420 - DNA, 16 bp, Homo sapiens
actgaaagcagcagct

SEQ ID NO: 1805421 - DNA, 19 bp, Homo sapiens
actgaaagcagcagctagg

SEQ ID NO: 1805422 - DNA, 22 bp, Homo sapiens
actgaaccagagctggaacaca

SEQ ID NO: 1805423 - DNA, 18 bp, Homo sapiens
actgaccccctcccctga

SEQ ID NO: 1805424 - DNA, 16 bp, Homo sapiens
actgatactattcaat

SEQ ID NO: 1805425 - DNA, 18 bp, Homo sapiens
actgatactattcaatgc

SEQ ID NO: 1805426 - DNA, 21 bp, Homo sapiens
actgatactattcaatgcaat

SEQ ID NO: 1805427 - DNA, 22 bp, Homo sapiens
actgatactattcaatgcaatg

SEQ ID NO: 1805428 - DNA, 20 bp, Homo sapiens
actgatggaccgggtgggcc

SEQ ID NO: 1805429 - DNA, 21 bp, Homo sapiens
actgatggaccgggtgggcct

SEQ ID NO: 1805430 - DNA, 23 bp, Homo sapiens
actgatggaccgggtgggcctgg

SEQ ID NO: 1805431 - DNA, 15 bp, Homo sapiens
actgcacacacagct

SEQ ID NO: 1805432 - DNA, 16 bp, Homo sapiens
actgcacacacagctc

SEQ ID NO: 1805433 - DNA, 17 bp, Homo sapiens
actgcacacacagctcc

SEQ ID NO: 1805434 - DNA, 17 bp, Homo sapiens
actgcaccccctcctgc

SEQ ID NO: 1805435 - DNA, 20 bp, Homo sapiens
actgcaccccctcctgctgc

SEQ ID NO: 1805436 - DNA, 22 bp, Homo sapiens
actgcaccccctcctgctgcag

SEQ ID NO: 1805437 - DNA, 12 bp, Homo sapiens
actgccaggcac

SEQ ID NO: 1805438 - DNA, 13 bp, Homo sapiens
actgccaggcacc

SEQ ID NO: 1805439 - DNA, 15 bp, Homo sapiens
actgccaggcacctg

SEQ ID NO: 1805440 - DNA, 16 bp, Homo sapiens
actgccaggcacctgg

SEQ ID NO: 1805441 - DNA, 19 bp, Homo sapiens
actgccaggcacctggcct

SEQ ID NO: 1805442 - DNA, 20 bp, Homo sapiens
actgcccccagaaagcctcc

SEQ ID NO: 1805443 - DNA, 22 bp, Homo sapiens
actgcccccagaaagcctcctg

SEQ ID NO: 1805444 - DNA, 14 bp, Homo sapiens
actgccctgcctgc

SEQ ID NO: 1805445 - DNA, 16 bp, Homo sapiens
actgccctgcctgccc

SEQ ID NO: 1805446 - DNA, 18 bp, Homo sapiens
actgccctgcctgcccac

SEQ ID NO: 1805447 - DNA, 16 bp, Homo sapiens
actgctgaaaaagaaa

SEQ ID NO: 1805448 - DNA, 17 bp, Homo sapiens
actgctgaaaaagaaaa

SEQ ID NO: 1805449 - DNA, 19 bp, Homo sapiens
actgctgaaaaagaaaaaa

SEQ ID NO: 1805450 - DNA, 22 bp, Homo sapiens
actgctgaaaaagaaaaaaatg

SEQ ID NO: 1805451 - DNA, 13 bp, Homo sapiens
actgctgggtggc

SEQ ID NO: 1805452 - DNA, 18 bp, Homo sapiens
actgctgggtggcccatc

SEQ ID NO: 1805453 - DNA, 14 bp, Homo sapiens
actggaatatctga

SEQ ID NO: 1805454 - DNA, 16 bp, Homo sapiens
actggaatatctgaga

SEQ ID NO: 1805455 - DNA, 19 bp, Homo sapiens
actggagtgaggcttccag

SEQ ID NO: 1805456 - DNA, 14 bp, Homo sapiens
actggatactgtac

SEQ ID NO: 1805457 - DNA, 16 bp, Homo sapiens
actggatactgtactg

SEQ ID NO: 1805458 - DNA, 11 bp, Homo sapiens
actggcagctc

SEQ ID NO: 1805459 - DNA, 13 bp, Homo sapiens
actggcagctcct

SEQ ID NO: 1805460 - DNA, 13 bp, Homo sapiens
actggcaggtgca

SEQ ID NO: 1805461 - DNA, 21 bp, Homo sapiens
actggcaggtgcagatgggct

SEQ ID NO: 1805462 - DNA, 17 bp, Homo sapiens
actggccagagagggcc

SEQ ID NO: 1805463 - DNA, 21 bp, Homo sapiens
actggccagagagggcccagc

SEQ ID NO: 1805464 - DNA, 12 bp, Homo sapiens
actggccccacc

SEQ ID NO: 1805465 - DNA, 9 bp, Homo sapiens
actggctga

SEQ ID NO: 1805466 - DNA, 14 bp, Homo sapiens
actggctgcctcca

SEQ ID NO: 1805467 - DNA, 16 bp, Homo sapiens
actggctgcctccact

SEQ ID NO: 1805468 - DNA, 17 bp, Homo sapiens
actggctgcctccactc

SEQ ID NO: 1805469 - DNA, 21 bp, Homo sapiens
actggctgcctccactcccac

SEQ ID NO: 1805470 - DNA, 15 bp, Homo sapiens
actggtttacaaata

SEQ ID NO: 1805471 - DNA, 23 bp, Homo sapiens
actgtactgatactattcaatgc

SEQ ID NO: 1805472 - DNA, 13 bp, Homo sapiens
actgtatagtaat

SEQ ID NO: 1805473 - DNA, 17 bp, Homo sapiens
actgtatagtaatcatt

SEQ ID NO: 1805474 - DNA, 14 bp, Homo sapiens
actgtatttcatta

SEQ ID NO: 1805475 - DNA, 16 bp, Homo sapiens
actgtatttcattatc

SEQ ID NO: 1805476 - DNA, 23 bp, Homo sapiens
actgtatttcattatctgtactg

SEQ ID NO: 1805477 - DNA, 20 bp, Homo sapiens
actgtgacacagctgagctg

SEQ ID NO: 1805478 - DNA, 12 bp, Homo sapiens
actgtgagactg

SEQ ID NO: 1805479 - DNA, 15 bp, Homo sapiens
actgtggccagagct

SEQ ID NO: 1805480 - DNA, 22 bp, Homo sapiens
actgtggccagagctggaaggc

SEQ ID NO: 1805481 - DNA, 20 bp, Homo sapiens
acttacatctttgtttacca

SEQ ID NO: 1805482 - DNA, 15 bp, Homo sapiens
aggatgatttcagaa

SEQ ID NO: 1805483 - DNA, 16 bp, Homo sapiens
aggatgtggatggagg

SEQ ID NO: 1805484 - DNA, 15 bp, Homo sapiens
aggattcatggctta

SEQ ID NO: 1805485 - DNA, 21 bp, Homo sapiens
aggcaaaacacgcaagggcat

SEQ ID NO: 1805486 - DNA, 15 bp, Homo sapiens
aggcaagcccctcag

SEQ ID NO: 1805487 - DNA, 17 bp, Homo sapiens
aggcaagcccctcagcc

SEQ ID NO: 1805488 - DNA, 18 bp, Homo sapiens
aggcaagcccctcagccc

SEQ ID NO: 1805489 - DNA, 14 bp, Homo sapiens
aggcaccagctctg

SEQ ID NO: 1805490 - DNA, 20 bp, Homo sapiens
aggcaccagctctgtggcct

SEQ ID NO: 1805491 - DNA, 14 bp, Homo sapiens
aggcaccggcgctg

SEQ ID NO: 1805492 - DNA, 19 bp, Homo sapiens
aggcacctggcctgctggg

SEQ ID NO: 1805493 - DNA, 12 bp, Homo sapiens
aggcactgtgaa

SEQ ID NO: 1805494 - DNA, 14 bp, Homo sapiens
aggcagcctccaga

SEQ ID NO: 1805495 - DNA, 15 bp, Homo sapiens
aggcagcctccagag

SEQ ID NO: 1805496 - DNA, 20 bp, Homo sapiens
aggcagcctccagagccagc

SEQ ID NO: 1805497 - DNA, 23 bp, Homo sapiens
aggcagctgctcttagtgcccgc

SEQ ID NO: 1805498 - DNA, 16 bp, Homo sapiens
aggcagggcagaggga

SEQ ID NO: 1805499 - DNA, 15 bp, Homo sapiens
aggcagtctgaaccc

SEQ ID NO: 1805500 - DNA, 21 bp, Homo sapiens
aggcagtgaacacactcagca

SEQ ID NO: 1805501 - DNA, 13 bp, Homo sapiens
aggcatatttcca

SEQ ID NO: 1805502 - DNA, 15 bp, Homo sapiens
aggcatatttccaat

SEQ ID NO: 1805503 - DNA, 18 bp, Homo sapiens
aggcatgctggcctccca

SEQ ID NO: 1805504 - DNA, 17 bp, Homo sapiens
aggcatttaaaatggaa

SEQ ID NO: 1805505 - DNA, 20 bp, Homo sapiens
aggcatttaaaatggaaaag

SEQ ID NO: 1805506 - DNA, 13 bp, Homo sapiens
aggccaccccaaa

SEQ ID NO: 1805507 - DNA, 14 bp, Homo sapiens
aggccactgtggcc

SEQ ID NO: 1805508 - DNA, 19 bp, Homo sapiens
aggccactgtggccagagc

SEQ ID NO: 1805509 - DNA, 18 bp, Homo sapiens
aggccatattttaaaaaa

SEQ ID NO: 1805510 - DNA, 16 bp, Homo sapiens
aggcccagccgcagga

SEQ ID NO: 1805511 - DNA, 12 bp, Homo sapiens
aggcccatctca

SEQ ID NO: 1805512 - DNA, 12 bp, Homo sapiens
aggcccctgagg

SEQ ID NO: 1805513 - DNA, 13 bp, Homo sapiens
aggcccctgagga

SEQ ID NO: 1805514 - DNA, 16 bp, Homo sapiens
aggccctccatgggct

SEQ ID NO: 1805515 - DNA, 15 bp, Homo sapiens
aggccctccctgtct

SEQ ID NO: 1805516 - DNA, 16 bp, Homo sapiens
aggccctccctgtctc

SEQ ID NO: 1805517 - DNA, 19 bp, Homo sapiens
aggccctgcactgtcctgc

SEQ ID NO: 1805518 - DNA, 24 bp, Homo sapiens
aggccctgcactgtcctgctccac

SEQ ID NO: 1805519 - DNA, 13 bp, Homo sapiens
aggcccttgtcct

SEQ ID NO: 1805520 - DNA, 14 bp, Homo sapiens
aggcccttgtcctg

SEQ ID NO: 1805521 - DNA, 15 bp, Homo sapiens
aggcccttgtcctgc

SEQ ID NO: 1805522 - DNA, 21 bp, Homo sapiens
aggcccttgtcctgccagctg

SEQ ID NO: 1805523 - DNA, 22 bp, Homo sapiens
aggccgttccccttggcttcct

SEQ ID NO: 1805524 - DNA, 15 bp, Homo sapiens
aggcctcatccctcg

SEQ ID NO: 1805525 - DNA, 16 bp, Homo sapiens
aggcctcatccctcgg

SEQ ID NO: 1805526 - DNA, 14 bp, Homo sapiens
aggcctccagcctc

SEQ ID NO: 1805527 - DNA, 16 bp, Homo sapiens
aggcctcccacagtga

SEQ ID NO: 1805528 - DNA, 18 bp, Homo sapiens
aggcctggaaccagggag

SEQ ID NO: 1805529 - DNA, 15 bp, Homo sapiens
aggcctggcacagtg

SEQ ID NO: 1805530 - DNA, 16 bp, Homo sapiens
aggcctggcacagtgt

SEQ ID NO: 1805531 - DNA, 18 bp, Homo sapiens
aggcctggcacagtgtct

SEQ ID NO: 1805532 - DNA, 23 bp, Homo sapiens
aggcctggcacagtgtctgggct

SEQ ID NO: 1805533 - DNA, 17 bp, Homo sapiens
aggcctgggacccagct

SEQ ID NO: 1805534 - DNA, 18 bp, Homo sapiens
aggcctgggacccagcta

SEQ ID NO: 1805535 - DNA, 15 bp, Homo sapiens
aggcgaggagagtgg

SEQ ID NO: 1805536 - DNA, 21 bp, Homo sapiens
aggcggcctttgttgctcagc

SEQ ID NO: 1805537 - DNA, 14 bp, Homo sapiens
aggcgttggtgcca

SEQ ID NO: 1805538 - DNA, 21 bp, Homo sapiens
aggctaagatgagatttgcca

SEQ ID NO: 1805539 - DNA, 19 bp, Homo sapiens
aggctatggggatagatgt

SEQ ID NO: 1805540 - DNA, 11 bp, Homo sapiens
aggctctcccc

SEQ ID NO: 1805541 - DNA, 14 bp, Homo sapiens
aggctctgggctca

SEQ ID NO: 1805542 - DNA, 20 bp, Homo sapiens
aggctctgggctcagggctg

SEQ ID NO: 1805543 - DNA, 22 bp, Homo sapiens
aggctctgggctcagggctgga

SEQ ID NO: 1805544 - DNA, 20 bp, Homo sapiens
aggctcttcctggacctgag

SEQ ID NO: 1805545 - DNA, 13 bp, Homo sapiens
aggctggccagcc

SEQ ID NO: 1805546 - DNA, 22 bp, Homo sapiens
aggctggccagccccacagccc

SEQ ID NO: 1805547 - DNA, 18 bp, Homo sapiens
aggctggctgagtggaat

SEQ ID NO: 1805548 - DNA, 13 bp, Homo sapiens
aggctggctgggg

SEQ ID NO: 1805549 - DNA, 13 bp, Homo sapiens
aggcttccaggct

SEQ ID NO: 1805550 - DNA, 20 bp, Homo sapiens
aggctttggggtcctagccc

SEQ ID NO: 1805551 - DNA, 16 bp, Homo sapiens
agggaagagggcagta

SEQ ID NO: 1805552 - DNA, 19 bp, Homo sapiens
agggaccaaattgcttcta

SEQ ID NO: 1805553 - DNA, 23 bp, Homo sapiens
agggagggggcgctcaggaccca

SEQ ID NO: 1805554 - DNA, 24 bp, Homo sapiens
agggagggggcgctcaggacccag

SEQ ID NO: 1805555 - DNA, 22 bp, Homo sapiens
agggatgctatctcgctagcca

SEQ ID NO: 1805556 - DNA, 23 bp, Homo sapiens
agggatgctatctcgctagccat

SEQ ID NO: 1805557 - DNA, 23 bp, Homo sapiens
agggcagagccatgggcctgggc

SEQ ID NO: 1805558 - DNA, 17 bp, Homo sapiens
agggccagaaggagggc

SEQ ID NO: 1805559 - DNA, 19 bp, Homo sapiens
agggcccctccctctgccc

SEQ ID NO: 1805560 - DNA, 14 bp, Homo sapiens
agggcctgggggca

SEQ ID NO: 1805561 - DNA, 18 bp, Homo sapiens
agggctccagcatccagc

SEQ ID NO: 1805562 - DNA, 12 bp, Homo sapiens
agggctgcccct

SEQ ID NO: 1805563 - DNA, 14 bp, Homo sapiens
agggctgcccctgt

SEQ ID NO: 1805564 - DNA, 21 bp, Homo sapiens
agggctggagacttcctctgg

SEQ ID NO: 1805565 - DNA, 20 bp, Homo sapiens
agggcttggggctgcacctc

SEQ ID NO: 1805566 - DNA, 21 bp, Homo sapiens
agggcttggggctgcacctcc

SEQ ID NO: 1805567 - DNA, 22 bp, Homo sapiens
agggcttggggctgcacctcct

SEQ ID NO: 1805568 - DNA, 19 bp, Homo sapiens
aggggcaaagaactgcccc

SEQ ID NO: 1805569 - DNA, 21 bp, Homo sapiens
aggggcacaccactgccctgc

SEQ ID NO: 1805570 - DNA, 23 bp, Homo sapiens
aggggcacaccactgccctgcct

SEQ ID NO: 1805571 - DNA, 13 bp, Homo sapiens
aggggcagccgct

SEQ ID NO: 1805572 - DNA, 17 bp, Homo sapiens
aggggcaggcacagcac

SEQ ID NO: 1805573 - DNA, 19 bp, Homo sapiens
aggggcaggccctgcactg

SEQ ID NO: 1805574 - DNA, 15 bp, Homo sapiens
aggggcaggcctggg

SEQ ID NO: 1805575 - DNA, 16 bp, Homo sapiens
aggggcaggcctggga

SEQ ID NO: 1805576 - DNA, 17 bp, Homo sapiens
aggggcaggcctgggac

SEQ ID NO: 1805577 - DNA, 15 bp, Homo sapiens
aggggccccagatct

SEQ ID NO: 1805578 - DNA, 16 bp, Homo sapiens
aggggcccgcttgcct

SEQ ID NO: 1805579 - DNA, 21 bp, Homo sapiens
aggggcccgttgtctccctgg

SEQ ID NO: 1805580 - DNA, 17 bp, Homo sapiens
aggggctgcccgctccc

SEQ ID NO: 1805581 - DNA, 20 bp, Homo sapiens
aggggctgcccgctcccagt

SEQ ID NO: 1805582 - DNA, 16 bp, Homo sapiens
aggggctgctggggca

SEQ ID NO: 1805583 - DNA, 15 bp, Homo sapiens
agggggcgctcagga

SEQ ID NO: 1805584 - DNA, 23 bp, Homo sapiens
agggggcgctcaggacccaggcc

SEQ ID NO: 1805585 - DNA, 11 bp, Homo sapiens
agggggctctc

SEQ ID NO: 1805586 - DNA, 22 bp, Homo sapiens
agggggctctccaaaggggctg

SEQ ID NO: 1805587 - DNA, 23 bp, Homo sapiens
agggtccgcaccagctgctctgc

SEQ ID NO: 1805588 - DNA, 24 bp, Homo sapiens
agggtccgcaccagctgctctgcc

SEQ ID NO: 1805589 - DNA, 18 bp, Homo sapiens
agggtcttgggctactgg

SEQ ID NO: 1805590 - DNA, 19 bp, Homo sapiens
agggtggaggaaggtgctg

SEQ ID NO: 1805591 - DNA, 23 bp, Homo sapiens
agggtggaggaaggtgctgagct

SEQ ID NO: 1805592 - DNA, 17 bp, Homo sapiens
aggtaaaatattttcca

SEQ ID NO: 1805593 - DNA, 19 bp, Homo sapiens
aggtaagcaggaggaggtg

SEQ ID NO: 1805594 - DNA, 17 bp, Homo sapiens
aggtaattccttagaga

SEQ ID NO: 1805595 - DNA, 13 bp, Homo sapiens
aggtacttcctcc

SEQ ID NO: 1805596 - DNA, 20 bp, Homo sapiens
aggtagatcgcttgagccca

SEQ ID NO: 1805597 - DNA, 12 bp, Homo sapiens
aggtctcctcca

SEQ ID NO: 1805598 - DNA, 15 bp, Homo sapiens
agttctttgctgccc

SEQ ID NO: 1805599 - DNA, 17 bp, Homo sapiens
agttctttgctgcccct

SEQ ID NO: 1805600 - DNA, 22 bp, Homo sapiens
agttgatgtgggaagaagtaaa

SEQ ID NO: 1805601 - DNA, 18 bp, Homo sapiens
agttgattgcgagaattt

SEQ ID NO: 1805602 - DNA, 23 bp, Homo sapiens
agttgtatcagcacgtgtggcct

SEQ ID NO: 1805603 - DNA, 19 bp, Homo sapiens
agttgtattttgacaaaaa

SEQ ID NO: 1805604 - DNA, 22 bp, Homo sapiens
agttgtattttgacaaaaatgt

SEQ ID NO: 1805605 - DNA, 19 bp, Homo sapiens
agttgtctattctgagcct

SEQ ID NO: 1805606 - DNA, 17 bp, Homo sapiens
agtttagaacagaggga

SEQ ID NO: 1805607 - DNA, 17 bp, Homo sapiens
agtttcacaacagattt

SEQ ID NO: 1805608 - DNA, 12 bp, Homo sapiens
agtttcagaaat

SEQ ID NO: 1805609 - DNA, 19 bp, Homo sapiens
agtttcagaaattctcaaa

SEQ ID NO: 1805610 - DNA, 21 bp, Homo sapiens
agtttcagaaattctcaaaat

SEQ ID NO: 1805611 - DNA, 16 bp, Homo sapiens
agtttctagaggcctc

SEQ ID NO: 1805612 - DNA, 17 bp, Homo sapiens
agtttctagaggcctca

SEQ ID NO: 1805613 - DNA, 20 bp, Homo sapiens
agtttgagacaagccctggc

SEQ ID NO: 1805614 - DNA, 16 bp, Homo sapiens
agtttgatttaatatc

SEQ ID NO: 1805615 - DNA, 15 bp, Homo sapiens
agtttgcatatcagt

SEQ ID NO: 1805616 - DNA, 17 bp, Homo sapiens
agtttgtggtaaaaaga

SEQ ID NO: 1805617 - DNA, 15 bp, Homo sapiens
agtttttcagaaagt

SEQ ID NO: 1805618 - DNA, 18 bp, Homo sapiens
ataaaaaatggtgcctga

SEQ ID NO: 1805619 - DNA, 22 bp, Homo sapiens
ataaaaagaggatgatttcaga

SEQ ID NO: 1805620 - DNA, 11 bp, Homo sapiens
ataaagctgga

SEQ ID NO: 1805621 - DNA, 21 bp, Homo sapiens
ataaagctggacaagaagctg

SEQ ID NO: 1805622 - DNA, 23 bp, Homo sapiens
ataaagctggacaagaagctgct

SEQ ID NO: 1805623 - DNA, 14 bp, Homo sapiens
ataaaggtatttag

SEQ ID NO: 1805624 - DNA, 13 bp, Homo sapiens
ataaatgcccagc

SEQ ID NO: 1805625 - DNA, 21 bp, Homo sapiens
ataaatgtaaaaatgaaggaa

SEQ ID NO: 1805626 - DNA, 16 bp, Homo sapiens
ataacacagatattgt

SEQ ID NO: 1805627 - DNA, 16 bp, Homo sapiens
ataaccttcatgatga

SEQ ID NO: 1805628 - DNA, 14 bp, Homo sapiens
ataagctgttctgg

SEQ ID NO: 1805629 - DNA, 19 bp, Homo sapiens
ataatggtgttactaaagt

SEQ ID NO: 1805630 - DNA, 19 bp, Homo sapiens
ataatttttgctgaattcc

SEQ ID NO: 1805631 - DNA, 23 bp, Homo sapiens
atacaaaagttcaacctcttaca

SEQ ID NO: 1805632 - DNA, 15 bp, Homo sapiens
atacagaatttatag

SEQ ID NO: 1805633 - DNA, 17 bp, Homo sapiens
atacagaatttatagaa

SEQ ID NO: 1805634 - DNA, 13 bp, Homo sapiens
atacagattgaaa

SEQ ID NO: 1805635 - DNA, 15 bp, Homo sapiens
atacattaaggagca

SEQ ID NO: 1805636 - DNA, 11 bp, Homo sapiens
atacctatgtg

SEQ ID NO: 1805637 - DNA, 14 bp, Homo sapiens
atacctatgtgaaa

SEQ ID NO: 1805638 - DNA, 15 bp, Homo sapiens
atacgtgttcaaaaa

SEQ ID NO: 1805639 - DNA, 14 bp, Homo sapiens
atactattcaatgc

SEQ ID NO: 1805640 - DNA, 15 bp, Homo sapiens
atactattcaatgca

SEQ ID NO: 1805641 - DNA, 15 bp, Homo sapiens
atactgtttcactaa

SEQ ID NO: 1805642 - DNA, 21 bp, Homo sapiens
atacttccatatggagcattt

SEQ ID NO: 1805643 - DNA, 16 bp, Homo sapiens
atagaataatttctcc

SEQ ID NO: 1805644 - DNA, 21 bp, Homo sapiens
atagatctgatggtgagctgg

SEQ ID NO: 1805645 - DNA, 14 bp, Homo sapiens
atagatgtgtggac

SEQ ID NO: 1805646 - DNA, 17 bp, Homo sapiens
atagcacatgattttct

SEQ ID NO: 1805647 - DNA, 13 bp, Homo sapiens
atagccagagagg

SEQ ID NO: 1805648 - DNA, 16 bp, Homo sapiens
atagccagagaggagc

SEQ ID NO: 1805649 - DNA, 22 bp, Homo sapiens
atagccagagaggagcacctga

SEQ ID NO: 1805650 - DNA, 17 bp, Homo sapiens
ataggataaattacatt

SEQ ID NO: 1805651 - DNA, 22 bp, Homo sapiens
atagtaataggatacaatgtat

SEQ ID NO: 1805652 - DNA, 16 bp, Homo sapiens
atagtaatcattgact

SEQ ID NO: 1805653 - DNA, 17 bp, Homo sapiens
atagtaatcattgacta

SEQ ID NO: 1805654 - DNA, 20 bp, Homo sapiens
atataatgagtcacaaaata

SEQ ID NO: 1805655 - DNA, 14 bp, Homo sapiens
atatatattaaaat

SEQ ID NO: 1805656 - DNA, 15 bp, Homo sapiens
atatatcataaagta

SEQ ID NO: 1805657 - DNA, 19 bp, Homo sapiens
atatattctacacatatat

SEQ ID NO: 1805658 - DNA, 17 bp, Homo sapiens
atatatttactaaaaga

SEQ ID NO: 1805659 - DNA, 18 bp, Homo sapiens
atatcagaatcgctaata

SEQ ID NO: 1805660 - DNA, 17 bp, Homo sapiens
atatcagagctgggaaa

SEQ ID NO: 1805661 - DNA, 18 bp, Homo sapiens
atatcaggtaaaatattt

SEQ ID NO: 1805662 - DNA, 18 bp, Homo sapiens
atatcagttgacagaatg

SEQ ID NO: 1805663 - DNA, 13 bp, Homo sapiens
atatcattactaa

SEQ ID NO: 1805664 - DNA, 18 bp, Homo sapiens
atatctatatctctaaac

SEQ ID NO: 1805665 - DNA, 23 bp, Homo sapiens
atatctattattataaaaataat

SEQ ID NO: 1805666 - DNA, 17 bp, Homo sapiens
atatctgagaagtgtat

SEQ ID NO: 1805667 - DNA, 18 bp, Homo sapiens
atatctgagaagtgtata

SEQ ID NO: 1805668 - DNA, 17 bp, Homo sapiens
atatctgtttgcttcta

SEQ ID NO: 1805669 - DNA, 22 bp, Homo sapiens
atatggagcatttttcagagtt

SEQ ID NO: 1805670 - DNA, 22 bp, Homo sapiens
atatgtagccttgccttttaaa

SEQ ID NO: 1805671 - DNA, 13 bp, Homo sapiens
atatgtatatcta

SEQ ID NO: 1805672 - DNA, 16 bp, Homo sapiens
atatgtatatgtatat

SEQ ID NO: 1805673 - DNA, 20 bp, Homo sapiens
atattcaataaagctgctga

SEQ ID NO: 1805674 - DNA, 16 bp, Homo sapiens
atattgagacattaat

SEQ ID NO: 1805675 - DNA, 23 bp, Homo sapiens
atattgctctaattcttttcaaa

SEQ ID NO: 1805676 - DNA, 21 bp, Homo sapiens
atatttgagtttctttcagat

SEQ ID NO: 1805677 - DNA, 15 bp, Homo sapiens
atattttaaaaaatc

SEQ ID NO: 1805678 - DNA, 20 bp, Homo sapiens
atattttaaaaaatcaaaag

SEQ ID NO: 1805679 - DNA, 19 bp, Homo sapiens
atattttctgagtagcata

SEQ ID NO: 1805680 - DNA, 12 bp, Homo sapiens
atatttttcaaa

SEQ ID NO: 1805681 - DNA, 21 bp, Homo sapiens
atattttttaaatttacagaa

SEQ ID NO: 1805682 - DNA, 20 bp, Homo sapiens
atattttttgagtgtatgct

SEQ ID NO: 1805683 - DNA, 21 bp, Homo sapiens
atcaaaaggcactgtgaacta

SEQ ID NO: 1805684 - DNA, 20 bp, Homo sapiens
atcaaagcaagggctccagc

SEQ ID NO: 1805685 - DNA, 12 bp, Homo sapiens
atcaacagccaa

SEQ ID NO: 1805686 - DNA, 15 bp, Homo sapiens
atcacaggggcgggg

SEQ ID NO: 1805687 - DNA, 14 bp, Homo sapiens
atcagcctgtgcca

SEQ ID NO: 1805688 - DNA, 22 bp, Homo sapiens
atcaggaaaggaagatgtaaga

SEQ ID NO: 1805689 - DNA, 16 bp, Homo sapiens
atcaggcactggtggc

SEQ ID NO: 1805690 - DNA, 16 bp, Homo sapiens
atcaggccattgtccc

SEQ ID NO: 1805691 - DNA, 15 bp, Homo sapiens
atcaggtaaaatatt

SEQ ID NO: 1805692 - DNA, 21 bp, Homo sapiens
atcaggtaaaatattttccaa

SEQ ID NO: 1805693 - DNA, 15 bp, Homo sapiens
atcagtgtgcccccc

SEQ ID NO: 1805694 - DNA, 22 bp, Homo sapiens
atcagtgtgccccccatcctgg

SEQ ID NO: 1805695 - DNA, 13 bp, Homo sapiens
atcagttgacaga

SEQ ID NO: 1805696 - DNA, 17 bp, Homo sapiens
atcattactaacttctt

SEQ ID NO: 1805697 - DNA, 20 bp, Homo sapiens
atcattggtatctgatatct

SEQ ID NO: 1805698 - DNA, 22 bp, Homo sapiens
atcattggtatctgatatctgt

SEQ ID NO: 1805699 - DNA, 13 bp, Homo sapiens
atccacccagtgc

SEQ ID NO: 1805700 - DNA, 14 bp, Homo sapiens
atccacccagtgct

SEQ ID NO: 1805701 - DNA, 14 bp, Homo sapiens
atcccccctcacca

SEQ ID NO: 1805702 - DNA, 23 bp, Homo sapiens
atcccccttagaatgtttctatt

SEQ ID NO: 1805703 - DNA, 17 bp, Homo sapiens
atcccctccctgcctgc

SEQ ID NO: 1805704 - DNA, 22 bp, Homo sapiens
atccctcggaagccgtctgact

SEQ ID NO: 1805705 - DNA, 18 bp, Homo sapiens
atccctgcttgcccgctc

SEQ ID NO: 1805706 - DNA, 13 bp, Homo sapiens
atccgctgccacc

SEQ ID NO: 1805707 - DNA, 14 bp, Homo sapiens
atccgctgccacca

SEQ ID NO: 1805708 - DNA, 23 bp, Homo sapiens
atccgctgccaccacgtctgcca

SEQ ID NO: 1805709 - DNA, 19 bp, Homo sapiens
atcctgcaggaacgagcac

SEQ ID NO: 1805710 - DNA, 21 bp, Homo sapiens
atcctgcaggaacgagcactg

SEQ ID NO: 1805711 - DNA, 23 bp, Homo sapiens
atcctgcaggaacgagcactggc

SEQ ID NO: 1805712 - DNA, 14 bp, Homo sapiens
atcctgctttgatt

SEQ ID NO: 1805713 - DNA, 23 bp, Homo sapiens
atccttatgagactcttaaatat

SEQ ID NO: 1805714 - DNA, 18 bp, Homo sapiens
cccaaggttactcagcag

SEQ ID NO: 1805715 - DNA, 22 bp, Homo sapiens
cccaagtagtagtgtcttccta

SEQ ID NO: 1805716 - DNA, 15 bp, Homo sapiens
cccaataaagctgga

SEQ ID NO: 1805717 - DNA, 16 bp, Homo sapiens
cccaatgcctataaaa

SEQ ID NO: 1805718 - DNA, 12 bp, Homo sapiens
cccacagagcct

SEQ ID NO: 1805719 - DNA, 11 bp, Homo sapiens
cccacagccca

SEQ ID NO: 1805720 - DNA, 21 bp, Homo sapiens
cccacagtcctcacagcctct

SEQ ID NO: 1805721 - DNA, 22 bp, Homo sapiens
cccacagtgactcgggctcctg

SEQ ID NO: 1805722 - DNA, 23 bp, Homo sapiens
cccacagtgactcgggctcctgt

SEQ ID NO: 1805723 - DNA, 22 bp, Homo sapiens
cccacccatcttcctgctgctg

SEQ ID NO: 1805724 - DNA, 20 bp, Homo sapiens
cccaccctcgtggacacctg

SEQ ID NO: 1805725 - DNA, 22 bp, Homo sapiens
cccaccctcgtggacacctgcc

SEQ ID NO: 1805726 - DNA, 23 bp, Homo sapiens
cccacctcatgcctggcccccct

SEQ ID NO: 1805727 - DNA, 13 bp, Homo sapiens
cccacctcctgca

SEQ ID NO: 1805728 - DNA, 17 bp, Homo sapiens
cccacgagtcacctgca

SEQ ID NO: 1805729 - DNA, 17 bp, Homo sapiens
cccacgtcctgtcagtg

SEQ ID NO: 1805730 - DNA, 19 bp, Homo sapiens
cccactaagctttctcctt

SEQ ID NO: 1805731 - DNA, 20 bp, Homo sapiens
cccactaagctttctccttt

SEQ ID NO: 1805732 - DNA, 22 bp, Homo sapiens
cccactaagctttctcctttga

SEQ ID NO: 1805733 - DNA, 19 bp, Homo sapiens
cccactgcaccccctcctg

SEQ ID NO: 1805734 - DNA, 19 bp, Homo sapiens
cccactgctgaaaaagaaa

SEQ ID NO: 1805735 - DNA, 16 bp, Homo sapiens
cccactgtaacaatac

SEQ ID NO: 1805736 - DNA, 14 bp, Homo sapiens
cccacttcccctcc

SEQ ID NO: 1805737 - DNA, 20 bp, Homo sapiens
cccacttccctgacactgcg

SEQ ID NO: 1805738 - DNA, 24 bp, Homo sapiens
cccacttccctgacactgcggggc

SEQ ID NO: 1805739 - DNA, 15 bp, Homo sapiens
cccagaaagcctcct

SEQ ID NO: 1805740 - DNA, 17 bp, Homo sapiens
cccagaggttatctgcc

SEQ ID NO: 1805741 - DNA, 18 bp, Homo sapiens
cccagaggttatctgcct

SEQ ID NO: 1805742 - DNA, 22 bp, Homo sapiens
cccagaggttatctgcctggcc

SEQ ID NO: 1805743 - DNA, 17 bp, Homo sapiens
cccagatctgcctgggc

SEQ ID NO: 1805744 - DNA, 20 bp, Homo sapiens
cccagatctgcctgggcctg

SEQ ID NO: 1805745 - DNA, 19 bp, Homo sapiens
cccagcacaattcattgtt

SEQ ID NO: 1805746 - DNA, 21 bp, Homo sapiens
cccagcacccgggctcaggga

SEQ ID NO: 1805747 - DNA, 12 bp, Homo sapiens
cccagccagccc

SEQ ID NO: 1805748 - DNA, 15 bp, Homo sapiens
cccagccagcccttc

SEQ ID NO: 1805749 - DNA, 13 bp, Homo sapiens
cccagcccacaga

SEQ ID NO: 1805750 - DNA, 17 bp, Homo sapiens
cccagcccacagagcct

SEQ ID NO: 1805751 - DNA, 14 bp, Homo sapiens
cccagccccaactc

SEQ ID NO: 1805752 - DNA, 15 bp, Homo sapiens
cccagccccaactcc

SEQ ID NO: 1805753 - DNA, 13 bp, Homo sapiens
cccagcctggccc

SEQ ID NO: 1805754 - DNA, 14 bp, Homo sapiens
cccagcctggccca

SEQ ID NO: 1805755 - DNA, 18 bp, Homo sapiens
cccagcctggcccagctc

SEQ ID NO: 1805756 - DNA, 20 bp, Homo sapiens
cccagcctggcccagctccc

SEQ ID NO: 1805757 - DNA, 22 bp, Homo sapiens
cccagcctggcccagctccccc

SEQ ID NO: 1805758 - DNA, 24 bp, Homo sapiens
cccagcgtttagtttctagaggcc

SEQ ID NO: 1805759 - DNA, 16 bp, Homo sapiens
cccagctactctgtcc

SEQ ID NO: 1805760 - DNA, 16 bp, Homo sapiens
cccagctcccccggga

SEQ ID NO: 1805761 - DNA, 23 bp, Homo sapiens
cccagctccttttgtccccaggg

SEQ ID NO: 1805762 - DNA, 19 bp, Homo sapiens
cccagctgacagtcctctc

SEQ ID NO: 1805763 - DNA, 22 bp, Homo sapiens
cccagctgacagtcctctccac

SEQ ID NO: 1805764 - DNA, 14 bp, Homo sapiens
cccagctgtagcca

SEQ ID NO: 1805765 - DNA, 20 bp, Homo sapiens
cccagctgtagccatggctc

SEQ ID NO: 1805766 - DNA, 24 bp, Homo sapiens
cccagctgtagccatggctcaggc

SEQ ID NO: 1805767 - DNA, 12 bp, Homo sapiens
cccagcttcctg

SEQ ID NO: 1805768 - DNA, 12 bp, Homo sapiens
cccaggaaggga

SEQ ID NO: 1805769 - DNA, 17 bp, Homo sapiens
cccaggacggggccggc

SEQ ID NO: 1805770 - DNA, 20 bp, Homo sapiens
cccaggagtttgagacaagc

SEQ ID NO: 1805771 - DNA, 23 bp, Homo sapiens
cccaggagtttgagacaagccct

SEQ ID NO: 1805772 - DNA, 13 bp, Homo sapiens
cccaggccctcca

SEQ ID NO: 1805773 - DNA, 18 bp, Homo sapiens
cccaggccctccatgggc

SEQ ID NO: 1805774 - DNA, 17 bp, Homo sapiens
cccaggcctccagcctc

SEQ ID NO: 1805775 - DNA, 19 bp, Homo sapiens
cccaggcctccagcctctc

SEQ ID NO: 1805776 - DNA, 14 bp, Homo sapiens
cccaggctgcactg

SEQ ID NO: 1805777 - DNA, 19 bp, Homo sapiens
cccaggctggagtgcagtg

SEQ ID NO: 1805778 - DNA, 17 bp, Homo sapiens
cccaggctggccagccc

SEQ ID NO: 1805779 - DNA, 22 bp, Homo sapiens
cccaggctggccagccccacag

SEQ ID NO: 1805780 - DNA, 18 bp, Homo sapiens
cccagggcctgggggcag

SEQ ID NO: 1805781 - DNA, 19 bp, Homo sapiens
cccaggtaagcaggaggag

SEQ ID NO: 1805782 - DNA, 13 bp, Homo sapiens
cccagtgctgcca

SEQ ID NO: 1805783 - DNA, 16 bp, Homo sapiens
cccagtgctgccatgc

SEQ ID NO: 1805784 - DNA, 19 bp, Homo sapiens
cccagtgctgccatgccac

SEQ ID NO: 1805785 - DNA, 22 bp, Homo sapiens
cccagtgctgccatgccactgc

SEQ ID NO: 1805786 - DNA, 22 bp, Homo sapiens
cccagtgtaaagaataaatgaa

SEQ ID NO: 1805787 - DNA, 20 bp, Homo sapiens
cccagtgtcttcctgtgggg

SEQ ID NO: 1805788 - DNA, 12 bp, Homo sapiens
cccatccctgct

SEQ ID NO: 1805789 - DNA, 13 bp, Homo sapiens
cccatcctggccc

SEQ ID NO: 1805790 - DNA, 17 bp, Homo sapiens
cccatcctggcccatca

SEQ ID NO: 1805791 - DNA, 18 bp, Homo sapiens
cccatcctggcccatcag

SEQ ID NO: 1805792 - DNA, 18 bp, Homo sapiens
cccatctcaggtgccact

SEQ ID NO: 1805793 - DNA, 19 bp, Homo sapiens
cccatctccccaggcctcc

SEQ ID NO: 1805794 - DNA, 22 bp, Homo sapiens
cccatctccccaggcctccagc

SEQ ID NO: 1805795 - DNA, 15 bp, Homo sapiens
cccatctgcccagga

SEQ ID NO: 1805796 - DNA, 12 bp, Homo sapiens
cccatgctctgc

SEQ ID NO: 1805797 - DNA, 16 bp, Homo sapiens
cccatgctgccttcag

SEQ ID NO: 1805798 - DNA, 19 bp, Homo sapiens
cccatgctgccttcaggga

SEQ ID NO: 1805799 - DNA, 17 bp, Homo sapiens
cccatggtagactgtga

SEQ ID NO: 1805800 - DNA, 16 bp, Homo sapiens
cccatgtggctgaaga

SEQ ID NO: 1805801 - DNA, 21 bp, Homo sapiens
cccattcccccatgtggctga

SEQ ID NO: 1805802 - DNA, 14 bp, Homo sapiens
cccattcctcacct

SEQ ID NO: 1805803 - DNA, 17 bp, Homo sapiens
ccccaaaagtacttacc

SEQ ID NO: 1805804 - DNA, 15 bp, Homo sapiens
ccccaaaccccagcc

SEQ ID NO: 1805805 - DNA, 15 bp, Homo sapiens
ccccaagcagccagc

SEQ ID NO: 1805806 - DNA, 21 bp, Homo sapiens
ccccacagcccacgtcctgtc

SEQ ID NO: 1805807 - DNA, 12 bp, Homo sapiens
ccccacagtcct

SEQ ID NO: 1805808 - DNA, 21 bp, Homo sapiens
ccccaccctcgtggacacctg

SEQ ID NO: 1805809 - DNA, 22 bp, Homo sapiens
ccccaccctcgtggacacctgc

SEQ ID NO: 1805810 - DNA, 20 bp, Homo sapiens
ccccacgagtcacctgcaag

SEQ ID NO: 1805811 - DNA, 13 bp, Homo sapiens
ccccactgggaga

SEQ ID NO: 1805812 - DNA, 14 bp, Homo sapiens
ccccagaaagcctc

SEQ ID NO: 1805813 - DNA, 16 bp, Homo sapiens
ccccagaaagcctcct

SEQ ID NO: 1805814 - DNA, 17 bp, Homo sapiens
ccccagaaagcctcctg

SEQ ID NO: 1805815 - DNA, 15 bp, Homo sapiens
ccccagagccactac

SEQ ID NO: 1805816 - DNA, 16 bp, Homo sapiens
ccccagccagcccttc

SEQ ID NO: 1805817 - DNA, 23 bp, Homo sapiens
ccccagccagcccttccctggcc

SEQ ID NO: 1805818 - DNA, 11 bp, Homo sapiens
ccccagcctgg

SEQ ID NO: 1805819 - DNA, 15 bp, Homo sapiens
ccccaggcctccagc

SEQ ID NO: 1805820 - DNA, 11 bp, Homo sapiens
ccccagggccc

SEQ ID NO: 1805821 - DNA, 21 bp, Homo sapiens
ccccagggcccctccctctgc

SEQ ID NO: 1805822 - DNA, 12 bp, Homo sapiens
ccccagggcctg

SEQ ID NO: 1805823 - DNA, 14 bp, Homo sapiens
ccccatcctggccc

SEQ ID NO: 1805824 - DNA, 17 bp, Homo sapiens
ccccatcctggcccatc

SEQ ID NO: 1805825 - DNA, 17 bp, Homo sapiens
ccccatctccccaggcc

SEQ ID NO: 1805826 - DNA, 18 bp, Homo sapiens
ccccatctgcccaggacg

SEQ ID NO: 1805827 - DNA, 22 bp, Homo sapiens
ccccatgctctgccccaagccc

SEQ ID NO: 1805828 - DNA, 14 bp, Homo sapiens
ccccatgctgcctt

SEQ ID NO: 1805829 - DNA, 12 bp, Homo sapiens
ccccatgggctt

SEQ ID NO: 1805830 - DNA, 21 bp, Homo sapiens
cctgcaccctggaaaggggag

SEQ ID NO: 1805831 - DNA, 15 bp, Homo sapiens
cctgcactgtcctgc

SEQ ID NO: 1805832 - DNA, 19 bp, Homo sapiens
cctgcagaggaccacagtg

SEQ ID NO: 1805833 - DNA, 22 bp, Homo sapiens
cctgcaggaacgagcactggcc

SEQ ID NO: 1805834 - DNA, 12 bp, Homo sapiens
cctgccacctgt

SEQ ID NO: 1805835 - DNA, 16 bp, Homo sapiens
cctgccacctgtctgt

SEQ ID NO: 1805836 - DNA, 12 bp, Homo sapiens
cctgccagctgc

SEQ ID NO: 1805837 - DNA, 15 bp, Homo sapiens
cctgccagctgcctt

SEQ ID NO: 1805838 - DNA, 20 bp, Homo sapiens
cctgccagtgaagtccttca

SEQ ID NO: 1805839 - DNA, 22 bp, Homo sapiens
cctgcccaatgctttgggaggc

SEQ ID NO: 1805840 - DNA, 23 bp, Homo sapiens
cctgcccccatctccccaggcct

SEQ ID NO: 1805841 - DNA, 15 bp, Homo sapiens
cctgccccctgccag

SEQ ID NO: 1805842 - DNA, 23 bp, Homo sapiens
cctgccccgtcggactgccccca

SEQ ID NO: 1805843 - DNA, 12 bp, Homo sapiens
cctgccctgcca

SEQ ID NO: 1805844 - DNA, 17 bp, Homo sapiens
cctgccctgccacctgt

SEQ ID NO: 1805845 - DNA, 21 bp, Homo sapiens
cctgccctgccacctgtctgt

SEQ ID NO: 1805846 - DNA, 14 bp, Homo sapiens
cctgcctgcccact

SEQ ID NO: 1805847 - DNA, 13 bp, Homo sapiens
cctgcgttggagc

SEQ ID NO: 1805848 - DNA, 14 bp, Homo sapiens
cctgcgttggagcc

SEQ ID NO: 1805849 - DNA, 20 bp, Homo sapiens
cctgcgttggagccactcct

SEQ ID NO: 1805850 - DNA, 21 bp, Homo sapiens
cctgcgttggagccactcctg

SEQ ID NO: 1805851 - DNA, 19 bp, Homo sapiens
cctgctagagcaacccctg

SEQ ID NO: 1805852 - DNA, 15 bp, Homo sapiens
cctgctccacagtgt

SEQ ID NO: 1805853 - DNA, 23 bp, Homo sapiens
cctgctgcagaggggcaggccct

SEQ ID NO: 1805854 - DNA, 11 bp, Homo sapiens
cctgctgctgt

SEQ ID NO: 1805855 - DNA, 19 bp, Homo sapiens
cctgctgtcccctcttgcc

SEQ ID NO: 1805856 - DNA, 21 bp, Homo sapiens
cctgcttgcccgctcccacag

SEQ ID NO: 1805857 - DNA, 21 bp, Homo sapiens
cctgctttgattccctctgat

SEQ ID NO: 1805858 - DNA, 14 bp, Homo sapiens
cctggaaaggggag

SEQ ID NO: 1805859 - DNA, 21 bp, Homo sapiens
cctggaaccagggaggagagg

SEQ ID NO: 1805860 - DNA, 16 bp, Homo sapiens
cctggaattcagcacc

SEQ ID NO: 1805861 - DNA, 21 bp, Homo sapiens
cctggaattcagcaccctggg

SEQ ID NO: 1805862 - DNA, 13 bp, Homo sapiens
cctggacctgagt

SEQ ID NO: 1805863 - DNA, 22 bp, Homo sapiens
cctggactggtggcccctgcct

SEQ ID NO: 1805864 - DNA, 16 bp, Homo sapiens
cctggatgggcattgg

SEQ ID NO: 1805865 - DNA, 17 bp, Homo sapiens
cctggatgggcattggg

SEQ ID NO: 1805866 - DNA, 15 bp, Homo sapiens
cctggcacagtgtct

SEQ ID NO: 1805867 - DNA, 19 bp, Homo sapiens
cctggcacagtgtctgggc

SEQ ID NO: 1805868 - DNA, 22 bp, Homo sapiens
cctggcacagtgtctgggctga

SEQ ID NO: 1805869 - DNA, 16 bp, Homo sapiens
cctggcccccctccag

SEQ ID NO: 1805870 - DNA, 18 bp, Homo sapiens
cctggcccccctccaggc

SEQ ID NO: 1805871 - DNA, 23 bp, Homo sapiens
cctggcccccctccaggcatgct

SEQ ID NO: 1805872 - DNA, 22 bp, Homo sapiens
cctggccctcaaggcctcccac

SEQ ID NO: 1805873 - DNA, 23 bp, Homo sapiens
cctggccctcaaggcctcccaca

SEQ ID NO: 1805874 - DNA, 16 bp, Homo sapiens
cctggcctcaagcaat

SEQ ID NO: 1805875 - DNA, 13 bp, Homo sapiens
cctggcctgctgg

SEQ ID NO: 1805876 - DNA, 14 bp, Homo sapiens
cctggcctgctggg

SEQ ID NO: 1805877 - DNA, 14 bp, Homo sapiens
cctggcctggctcc

SEQ ID NO: 1805878 - DNA, 16 bp, Homo sapiens
cctggctccccacgag

SEQ ID NO: 1805879 - DNA, 13 bp, Homo sapiens
cctggctgccagg

SEQ ID NO: 1805880 - DNA, 14 bp, Homo sapiens
cctggctgccaggc

SEQ ID NO: 1805881 - DNA, 18 bp, Homo sapiens
cctggctgtggaggcctg

SEQ ID NO: 1805882 - DNA, 15 bp, Homo sapiens
cctggcttgctccag

SEQ ID NO: 1805883 - DNA, 17 bp, Homo sapiens
cctggcttgctccaggg

SEQ ID NO: 1805884 - DNA, 15 bp, Homo sapiens
cctgggactcccagt

SEQ ID NO: 1805885 - DNA, 18 bp, Homo sapiens
cctgggactcccagtgaa

SEQ ID NO: 1805886 - DNA, 12 bp, Homo sapiens
cctgggcctgct

SEQ ID NO: 1805887 - DNA, 13 bp, Homo sapiens
cctgggcctgctt

SEQ ID NO: 1805888 - DNA, 21 bp, Homo sapiens
cctgggcctgcttttccagga

SEQ ID NO: 1805889 - DNA, 13 bp, Homo sapiens
cctgggcctgtcc

SEQ ID NO: 1805890 - DNA, 20 bp, Homo sapiens
cctgggcctgtcccccaagg

SEQ ID NO: 1805891 - DNA, 13 bp, Homo sapiens
cctgggcctgtgc

SEQ ID NO: 1805892 - DNA, 12 bp, Homo sapiens
cctggggccccg

SEQ ID NO: 1805893 - DNA, 13 bp, Homo sapiens
cctggggccccgc

SEQ ID NO: 1805894 - DNA, 16 bp, Homo sapiens
cctgggggcagtgact

SEQ ID NO: 1805895 - DNA, 19 bp, Homo sapiens
cctgggggcagtgactggc

SEQ ID NO: 1805896 - DNA, 21 bp, Homo sapiens
cctgggggcagtgactggcag

SEQ ID NO: 1805897 - DNA, 22 bp, Homo sapiens
cctgggtgccattcccagcgtt

SEQ ID NO: 1805898 - DNA, 17 bp, Homo sapiens
cctggtaagcagaggct

SEQ ID NO: 1805899 - DNA, 15 bp, Homo sapiens
cctggtccctcgtcc

SEQ ID NO: 1805900 - DNA, 14 bp, Homo sapiens
cctggtgacccctt

SEQ ID NO: 1805901 - DNA, 20 bp, Homo sapiens
cctggttgacccaaaaatgt

SEQ ID NO: 1805902 - DNA, 15 bp, Homo sapiens
cctgtactaaggagc

SEQ ID NO: 1805903 - DNA, 16 bp, Homo sapiens
cctgtcagaggctaag

SEQ ID NO: 1805904 - DNA, 16 bp, Homo sapiens
cctgtccataaagtaa

SEQ ID NO: 1805905 - DNA, 14 bp, Homo sapiens
cctgtcccgccttc

SEQ ID NO: 1805906 - DNA, 21 bp, Homo sapiens
cctgtctccagggcccccacc

SEQ ID NO: 1805907 - DNA, 17 bp, Homo sapiens
cctgtctccatgataac

SEQ ID NO: 1805908 - DNA, 18 bp, Homo sapiens
cctgtctccatgataact

SEQ ID NO: 1805909 - DNA, 13 bp, Homo sapiens
cctgtctggaaga

SEQ ID NO: 1805910 - DNA, 19 bp, Homo sapiens
cctgtctggaagacgtggc

SEQ ID NO: 1805911 - DNA, 20 bp, Homo sapiens
cctgtctgtctgtctgtccc

SEQ ID NO: 1805912 - DNA, 18 bp, Homo sapiens
cctgtgactatggctctg

SEQ ID NO: 1805913 - DNA, 13 bp, Homo sapiens
cctgtgcagcagc

SEQ ID NO: 1805914 - DNA, 14 bp, Homo sapiens
cctgtgcagcagcc

SEQ ID NO: 1805915 - DNA, 17 bp, Homo sapiens
cctgtgcagcagcccag

SEQ ID NO: 1805916 - DNA, 21 bp, Homo sapiens
cctgtggcagaaaagaggaga

SEQ ID NO: 1805917 - DNA, 20 bp, Homo sapiens
cctgtgggggaagagcacag

SEQ ID NO: 1805918 - DNA, 23 bp, Homo sapiens
cctgtgggggaagagcacagccc

SEQ ID NO: 1805919 - DNA, 16 bp, Homo sapiens
cctgtgtccagcagct

SEQ ID NO: 1805920 - DNA, 18 bp, Homo sapiens
cctgttgggcagagctgg

SEQ ID NO: 1805921 - DNA, 19 bp, Homo sapiens
cctgttgggcagagctgga

SEQ ID NO: 1805922 - DNA, 12 bp, Homo sapiens
ccttaaaaatgc

SEQ ID NO: 1805923 - DNA, 20 bp, Homo sapiens
ccttactctgagcccaggcc

SEQ ID NO: 1805924 - DNA, 22 bp, Homo sapiens
ccttactctgagcccaggccgt

SEQ ID NO: 1805925 - DNA, 21 bp, Homo sapiens
ccttacttcggttcctctgat

SEQ ID NO: 1805926 - DNA, 15 bp, Homo sapiens
ccttattcaggaaaa

SEQ ID NO: 1805927 - DNA, 18 bp, Homo sapiens
ccttcagaacagaggcat

SEQ ID NO: 1805928 - DNA, 16 bp, Homo sapiens
ccttcagcatctcact

SEQ ID NO: 1805929 - DNA, 16 bp, Homo sapiens
ccttcagggagacagg

SEQ ID NO: 1805930 - DNA, 16 bp, Homo sapiens
ccttcagtgagcccct

SEQ ID NO: 1805931 - DNA, 19 bp, Homo sapiens
ccttcagtgagcccctccc

SEQ ID NO: 1805932 - DNA, 23 bp, Homo sapiens
ccttcagtgagcccctccccagc

SEQ ID NO: 1805933 - DNA, 12 bp, Homo sapiens
ccttccacctcc

SEQ ID NO: 1805934 - DNA, 12 bp, Homo sapiens
ccttcccctccc

SEQ ID NO: 1805935 - DNA, 14 bp, Homo sapiens
ccttcccctccctg

SEQ ID NO: 1805936 - DNA, 15 bp, Homo sapiens
ccttcccctccctgt

SEQ ID NO: 1805937 - DNA, 12 bp, Homo sapiens
ccttcctcatcc

SEQ ID NO: 1805938 - DNA, 13 bp, Homo sapiens
ccttcctcatccc

SEQ ID NO: 1805939 - DNA, 14 bp, Homo sapiens
ccttcctcctccac

SEQ ID NO: 1805940 - DNA, 16 bp, Homo sapiens
ccttcctcctccacag

SEQ ID NO: 1805941 - DNA, 23 bp, Homo sapiens
ccttcctcctccacagtgctgct

SEQ ID NO: 1805942 - DNA, 12 bp, Homo sapiens
ccttcctggcct

SEQ ID NO: 1805943 - DNA, 18 bp, Homo sapiens
ccttcctggcctcactgg

SEQ ID NO: 1805944 - DNA, 20 bp, Homo sapiens
ccttcctggcctcactggct

SEQ ID NO: 1805945 - DNA, 13 bp, Homo sapiens
ccttcgtgtctct

SEQ ID NO: 1805946 - DNA, 22 bp, Homo sapiens
ccttctaatccatgtgctgctg

SEQ ID NO: 1805947 - DNA, 19 bp, Homo sapiens
ctagtgtgagtggcagcca

SEQ ID NO: 1805948 - DNA, 12 bp, Homo sapiens
ctataaaatgcc

SEQ ID NO: 1805949 - DNA, 17 bp, Homo sapiens
ctatacctatgtgaaac

SEQ ID NO: 1805950 - DNA, 21 bp, Homo sapiens
ctatagagagggggctctcca

SEQ ID NO: 1805951 - DNA, 20 bp, Homo sapiens
ctatagttatacatcttcat

SEQ ID NO: 1805952 - DNA, 21 bp, Homo sapiens
ctatagttatacatcttcatt

SEQ ID NO: 1805953 - DNA, 14 bp, Homo sapiens
ctatatctctaaac

SEQ ID NO: 1805954 - DNA, 15 bp, Homo sapiens
ctatatctctaaact

SEQ ID NO: 1805955 - DNA, 19 bp, Homo sapiens
ctatattccgggtgccatt

SEQ ID NO: 1805956 - DNA, 23 bp, Homo sapiens
ctatcagtgtgccccccatcctg

SEQ ID NO: 1805957 - DNA, 14 bp, Homo sapiens
ctatctgtgattcc

SEQ ID NO: 1805958 - DNA, 21 bp, Homo sapiens
ctatgaattgctaattctgag

SEQ ID NO: 1805959 - DNA, 17 bp, Homo sapiens
ctatgtgagtttcagaa

SEQ ID NO: 1805960 - DNA, 15 bp, Homo sapiens
ctattgttgtgggct

SEQ ID NO: 1805961 - DNA, 16 bp, Homo sapiens
ctatttctctccccac

SEQ ID NO: 1805962 - DNA, 12 bp, Homo sapiens
ctcaaaaagttt

SEQ ID NO: 1805963 - DNA, 21 bp, Homo sapiens
ctcaaaatacgtgttcaaaaa

SEQ ID NO: 1805964 - DNA, 14 bp, Homo sapiens
ctcaaatttttcat

SEQ ID NO: 1805965 - DNA, 14 bp, Homo sapiens
ctcaacccccctcc

SEQ ID NO: 1805966 - DNA, 18 bp, Homo sapiens
ctcaacccccctcccaga

SEQ ID NO: 1805967 - DNA, 15 bp, Homo sapiens
ctcaaggcctcccac

SEQ ID NO: 1805968 - DNA, 16 bp, Homo sapiens
ctcaatattcaataaa

SEQ ID NO: 1805969 - DNA, 14 bp, Homo sapiens
ctcaatttgaaaca

SEQ ID NO: 1805970 - DNA, 20 bp, Homo sapiens
ctcacactactgtatttcat

SEQ ID NO: 1805971 - DNA, 23 bp, Homo sapiens
ctcacactactgtatttcattat

SEQ ID NO: 1805972 - DNA, 13 bp, Homo sapiens
ctcacagcctctc

SEQ ID NO: 1805973 - DNA, 17 bp, Homo sapiens
ctcacagcctctccctt

SEQ ID NO: 1805974 - DNA, 18 bp, Homo sapiens
ctcacagcctctccctta

SEQ ID NO: 1805975 - DNA, 23 bp, Homo sapiens
ctcaccaggggcaggcacagcac

SEQ ID NO: 1805976 - DNA, 22 bp, Homo sapiens
ctcaccagggtccgcaccagct

SEQ ID NO: 1805977 - DNA, 13 bp, Homo sapiens
ctcacctggttga

SEQ ID NO: 1805978 - DNA, 16 bp, Homo sapiens
ctcacctggttgaccc

SEQ ID NO: 1805979 - DNA, 16 bp, Homo sapiens
ctcaccttttcccggg

SEQ ID NO: 1805980 - DNA, 17 bp, Homo sapiens
ctcacgctcccccgcag

SEQ ID NO: 1805981 - DNA, 18 bp, Homo sapiens
ctcacgctcccccgcagt

SEQ ID NO: 1805982 - DNA, 12 bp, Homo sapiens
ctcactggctgg

SEQ ID NO: 1805983 - DNA, 17 bp, Homo sapiens
ctcactggtttacaaat

SEQ ID NO: 1805984 - DNA, 16 bp, Homo sapiens
ctcagcaaggggctct

SEQ ID NO: 1805985 - DNA, 19 bp, Homo sapiens
ctcagcagcagagagccct

SEQ ID NO: 1805986 - DNA, 11 bp, Homo sapiens
ctcagcagccc

SEQ ID NO: 1805987 - DNA, 13 bp, Homo sapiens
ctcagcagccccc

SEQ ID NO: 1805988 - DNA, 19 bp, Homo sapiens
ctcagcagccccctgcccg

SEQ ID NO: 1805989 - DNA, 14 bp, Homo sapiens
ctcagcccttgccc

SEQ ID NO: 1805990 - DNA, 13 bp, Homo sapiens
ctcaggcaagccc

SEQ ID NO: 1805991 - DNA, 23 bp, Homo sapiens
ctcaggcaagcccctcagccctt

SEQ ID NO: 1805992 - DNA, 20 bp, Homo sapiens
ctcaggcctgactctcagca

SEQ ID NO: 1805993 - DNA, 17 bp, Homo sapiens
ctcagggaccacagcaa

SEQ ID NO: 1805994 - DNA, 18 bp, Homo sapiens
ctcagggaccacagcaag

SEQ ID NO: 1805995 - DNA, 16 bp, Homo sapiens
ctcagggctggagtgc

SEQ ID NO: 1805996 - DNA, 13 bp, Homo sapiens
ctcaggtgccact

SEQ ID NO: 1805997 - DNA, 19 bp, Homo sapiens
ctcaggtgccactccctga

SEQ ID NO: 1805998 - DNA, 18 bp, Homo sapiens
ctcagtacacttcctgtg

SEQ ID NO: 1805999 - DNA, 22 bp, Homo sapiens
ctcagtcagttcccggagcaca

SEQ ID NO: 1806000 - DNA, 19 bp, Homo sapiens
ctcatgacattatatttga

SEQ ID NO: 1806001 - DNA, 21 bp, Homo sapiens
ctcatgagtctacctgagcat

SEQ ID NO: 1806002 - DNA, 18 bp, Homo sapiens
ctcatgccacaccttctt

SEQ ID NO: 1806003 - DNA, 16 bp, Homo sapiens
ctcatgcctggccccc

SEQ ID NO: 1806004 - DNA, 22 bp, Homo sapiens
ctcatggcgtaatgggcctgcc

SEQ ID NO: 1806005 - DNA, 21 bp, Homo sapiens
ctcattcactaagccatgcca

SEQ ID NO: 1806006 - DNA, 15 bp, Homo sapiens
ctcattccagaggaa

SEQ ID NO: 1806007 - DNA, 17 bp, Homo sapiens
ctcattccagaggaagg

SEQ ID NO: 1806008 - DNA, 20 bp, Homo sapiens
ctcattggggttgcaacaat

SEQ ID NO: 1806009 - DNA, 17 bp, Homo sapiens
ctcatttaatatttttc

SEQ ID NO: 1806010 - DNA, 21 bp, Homo sapiens
ctcatttaatatttttcaaaa

SEQ ID NO: 1806011 - DNA, 18 bp, Homo sapiens
ctccaaaggggctgctgg

SEQ ID NO: 1806012 - DNA, 19 bp, Homo sapiens
ctccaaaggggctgctggg

SEQ ID NO: 1806013 - DNA, 20 bp, Homo sapiens
ctccaaaggggctgctgggg

SEQ ID NO: 1806014 - DNA, 12 bp, Homo sapiens
ctccacagtgct

SEQ ID NO: 1806015 - DNA, 14 bp, Homo sapiens
ctccacagtgctgc

SEQ ID NO: 1806016 - DNA, 16 bp, Homo sapiens
ctccacagtgctgctt

SEQ ID NO: 1806017 - DNA, 20 bp, Homo sapiens
ctccaccgccatggcttcca

SEQ ID NO: 1806018 - DNA, 21 bp, Homo sapiens
ctccacctagtggctgtccag

SEQ ID NO: 1806019 - DNA, 17 bp, Homo sapiens
ctccacggtgcgtggct

SEQ ID NO: 1806020 - DNA, 19 bp, Homo sapiens
ctccacggtgcgtggctgt

SEQ ID NO: 1806021 - DNA, 21 bp, Homo sapiens
ctccactctccttcgtgtctc

SEQ ID NO: 1806022 - DNA, 17 bp, Homo sapiens
ctccagaatctgctgtt

SEQ ID NO: 1806023 - DNA, 18 bp, Homo sapiens
ctccagaatctgctgttg

SEQ ID NO: 1806024 - DNA, 20 bp, Homo sapiens
ctccagaatctgctgttgcc

SEQ ID NO: 1806025 - DNA, 22 bp, Homo sapiens
ctccagaatctgctgttgccat

SEQ ID NO: 1806026 - DNA, 11 bp, Homo sapiens
ctccagagcca

SEQ ID NO: 1806027 - DNA, 18 bp, Homo sapiens
ctccagagccagcctggg

SEQ ID NO: 1806028 - DNA, 16 bp, Homo sapiens
ctccagagtctgagcc

SEQ ID NO: 1806029 - DNA, 18 bp, Homo sapiens
ctccagagtctgagcccc

SEQ ID NO: 1806030 - DNA, 17 bp, Homo sapiens
ctccagcatccagcctg

SEQ ID NO: 1806031 - DNA, 18 bp, Homo sapiens
ctccagcatccagcctgt

SEQ ID NO: 1806032 - DNA, 19 bp, Homo sapiens
ctccagcatccagcctgtg

SEQ ID NO: 1806033 - DNA, 21 bp, Homo sapiens
ctccagcatccagcctgtgtg

SEQ ID NO: 1806034 - DNA, 14 bp, Homo sapiens
ctccagcctcccct

SEQ ID NO: 1806035 - DNA, 21 bp, Homo sapiens
ctccagcctcccctcccctgg

SEQ ID NO: 1806036 - DNA, 15 bp, Homo sapiens
ctccagcctctcccg

SEQ ID NO: 1806037 - DNA, 16 bp, Homo sapiens
ctccagcctctcccgg

SEQ ID NO: 1806038 - DNA, 19 bp, Homo sapiens
ctccaggcatgctggcctc

SEQ ID NO: 1806039 - DNA, 13 bp, Homo sapiens
ctccagggccccc

SEQ ID NO: 1806040 - DNA, 18 bp, Homo sapiens
ctccagggtcttgggcta

SEQ ID NO: 1806041 - DNA, 21 bp, Homo sapiens
ctccagggtcttgggctactg

SEQ ID NO: 1806042 - DNA, 23 bp, Homo sapiens
ctccagggtcttgggctactggc

SEQ ID NO: 1806043 - DNA, 16 bp, Homo sapiens
ctccatcccctccctg

SEQ ID NO: 1806044 - DNA, 17 bp, Homo sapiens
ctcccaataaagctgga

SEQ ID NO: 1806045 - DNA, 16 bp, Homo sapiens
ctcccacagcttcctg

SEQ ID NO: 1806046 - DNA, 11 bp, Homo sapiens
ctcccacagtg

SEQ ID NO: 1806047 - DNA, 12 bp, Homo sapiens
ctcccacagtga

SEQ ID NO: 1806048 - DNA, 14 bp, Homo sapiens
ctcccacagtgact

SEQ ID NO: 1806049 - DNA, 22 bp, Homo sapiens
ctcccacagtgactcgggctcc

SEQ ID NO: 1806050 - DNA, 20 bp, Homo sapiens
ctcccaccccggcctccact

SEQ ID NO: 1806051 - DNA, 19 bp, Homo sapiens
ctcccacttccctgacact

SEQ ID NO: 1806052 - DNA, 16 bp, Homo sapiens
ctcccagacaggccct

SEQ ID NO: 1806053 - DNA, 17 bp, Homo sapiens
ctcccagacaggccctc

SEQ ID NO: 1806054 - DNA, 18 bp, Homo sapiens
ctcccagctgacagtcct

SEQ ID NO: 1806055 - DNA, 20 bp, Homo sapiens
ctcccagctgacagtcctct

SEQ ID NO: 1806056 - DNA, 21 bp, Homo sapiens
ctcccagctgacagtcctctc

SEQ ID NO: 1806057 - DNA, 23 bp, Homo sapiens
ctcccagctgacagtcctctcca

SEQ ID NO: 1806058 - DNA, 20 bp, Homo sapiens
ctcccagtgtcttcctgtgg

SEQ ID NO: 1806059 - DNA, 17 bp, Homo sapiens
ctcccatggccttccct

SEQ ID NO: 1806060 - DNA, 21 bp, Homo sapiens
ctccccacagtcctcacagcc

SEQ ID NO: 1806061 - DNA, 22 bp, Homo sapiens
ctccccacagtcctcacagcct

SEQ ID NO: 1806062 - DNA, 24 bp, Homo sapiens
ctccccacgagtcacctgcaagcc

SEQ ID NO: 1806063 - DNA, 15 bp, Homo sapiens
ctgcacttcagacac

SEQ ID NO: 1806064 - DNA, 19 bp, Homo sapiens
ctgcagaggaccacagtgg

SEQ ID NO: 1806065 - DNA, 21 bp, Homo sapiens
ctgcagaggaccacagtgggt

SEQ ID NO: 1806066 - DNA, 13 bp, Homo sapiens
ctgcagaggggca

SEQ ID NO: 1806067 - DNA, 14 bp, Homo sapiens
ctgcagaggggcag

SEQ ID NO: 1806068 - DNA, 23 bp, Homo sapiens
ctgcagaggggcaggccctgcac

SEQ ID NO: 1806069 - DNA, 16 bp, Homo sapiens
ctgcagctgggcccca

SEQ ID NO: 1806070 - DNA, 20 bp, Homo sapiens
ctgcagctgggccccatgct

SEQ ID NO: 1806071 - DNA, 24 bp, Homo sapiens
ctgcagctgggccccatgctctgc

SEQ ID NO: 1806072 - DNA, 14 bp, Homo sapiens
ctgccaccacgtct

SEQ ID NO: 1806073 - DNA, 16 bp, Homo sapiens
ctgccaccacgtctgc

SEQ ID NO: 1806074 - DNA, 17 bp, Homo sapiens
ctgccaccacgtctgcc

SEQ ID NO: 1806075 - DNA, 18 bp, Homo sapiens
ctgccaccacgtctgcca

SEQ ID NO: 1806076 - DNA, 14 bp, Homo sapiens
ctgccacctgtctg

SEQ ID NO: 1806077 - DNA, 15 bp, Homo sapiens
ctgccacctgtctgt

SEQ ID NO: 1806078 - DNA, 13 bp, Homo sapiens
ctgccacttccca

SEQ ID NO: 1806079 - DNA, 14 bp, Homo sapiens
ctgccagctgcctt

SEQ ID NO: 1806080 - DNA, 23 bp, Homo sapiens
ctgccagctgccttcctcatccc

SEQ ID NO: 1806081 - DNA, 14 bp, Homo sapiens
ctgccaggcacctg

SEQ ID NO: 1806082 - DNA, 18 bp, Homo sapiens
ctgccaggcacctggcct

SEQ ID NO: 1806083 - DNA, 19 bp, Homo sapiens
ctgccaggcacctggcctg

SEQ ID NO: 1806084 - DNA, 16 bp, Homo sapiens
ctgccaggcccatctc

SEQ ID NO: 1806085 - DNA, 23 bp, Homo sapiens
ctgccaggcccatctcaggtgcc

SEQ ID NO: 1806086 - DNA, 15 bp, Homo sapiens
ctgccatgccactgc

SEQ ID NO: 1806087 - DNA, 16 bp, Homo sapiens
ctgccatgccactgcc

SEQ ID NO: 1806088 - DNA, 20 bp, Homo sapiens
ctgccatgccactgccaggc

SEQ ID NO: 1806089 - DNA, 21 bp, Homo sapiens
ctgccatgccactgccaggca

SEQ ID NO: 1806090 - DNA, 24 bp, Homo sapiens
ctgccatgccactgccaggcacct

SEQ ID NO: 1806091 - DNA, 23 bp, Homo sapiens
ctgcccacttagccgtccatggc

SEQ ID NO: 1806092 - DNA, 19 bp, Homo sapiens
ctgccccaagcagccagcc

SEQ ID NO: 1806093 - DNA, 19 bp, Homo sapiens
ctgcccccagaaagcctcc

SEQ ID NO: 1806094 - DNA, 23 bp, Homo sapiens
ctgcccccagaaagcctcctgcc

SEQ ID NO: 1806095 - DNA, 14 bp, Homo sapiens
ctgcccccatctcc

SEQ ID NO: 1806096 - DNA, 19 bp, Homo sapiens
ctgcccccatctccccagg

SEQ ID NO: 1806097 - DNA, 21 bp, Homo sapiens
ctgcccccatctccccaggcc

SEQ ID NO: 1806098 - DNA, 18 bp, Homo sapiens
ctgccccgttccctgtca

SEQ ID NO: 1806099 - DNA, 19 bp, Homo sapiens
ctgccccgttccctgtcag

SEQ ID NO: 1806100 - DNA, 20 bp, Homo sapiens
ctgccccgttccctgtcaga

SEQ ID NO: 1806101 - DNA, 22 bp, Homo sapiens
ctgccccgttccctgtcagagg

SEQ ID NO: 1806102 - DNA, 17 bp, Homo sapiens
ctgcccctgtaggttgc

SEQ ID NO: 1806103 - DNA, 13 bp, Homo sapiens
ctgcccgctccca

SEQ ID NO: 1806104 - DNA, 15 bp, Homo sapiens
ctgcccgctcccagt

SEQ ID NO: 1806105 - DNA, 17 bp, Homo sapiens
ctgcccgctcccagtgt

SEQ ID NO: 1806106 - DNA, 19 bp, Homo sapiens
ctgcccgctcccagtgtct

SEQ ID NO: 1806107 - DNA, 18 bp, Homo sapiens
ctgccctccctccttcct

SEQ ID NO: 1806108 - DNA, 13 bp, Homo sapiens
ctgccctgccacc

SEQ ID NO: 1806109 - DNA, 17 bp, Homo sapiens
ctgccctgccacctgtc

SEQ ID NO: 1806110 - DNA, 20 bp, Homo sapiens
ctgccctgccacctgtctgt

SEQ ID NO: 1806111 - DNA, 21 bp, Homo sapiens
ctgccctgccacctgtctgtc

SEQ ID NO: 1806112 - DNA, 11 bp, Homo sapiens
ctgccctgccc

SEQ ID NO: 1806113 - DNA, 14 bp, Homo sapiens
ctgccctgccctgc

SEQ ID NO: 1806114 - DNA, 12 bp, Homo sapiens
ctgccctgcctg

SEQ ID NO: 1806115 - DNA, 17 bp, Homo sapiens
ctgccctgcctgcccac

SEQ ID NO: 1806116 - DNA, 11 bp, Homo sapiens
ctgcctaataa

SEQ ID NO: 1806117 - DNA, 16 bp, Homo sapiens
ctgcctcagcctctca

SEQ ID NO: 1806118 - DNA, 13 bp, Homo sapiens
ctgcctccactcc

SEQ ID NO: 1806119 - DNA, 19 bp, Homo sapiens
ctgcctccactcccacttc

SEQ ID NO: 1806120 - DNA, 17 bp, Homo sapiens
ctgcctgccgcccaaag

SEQ ID NO: 1806121 - DNA, 16 bp, Homo sapiens
ctgcctgccttggcct

SEQ ID NO: 1806122 - DNA, 16 bp, Homo sapiens
ctgcctgctccttggc

SEQ ID NO: 1806123 - DNA, 13 bp, Homo sapiens
ctgcctgggcctg

SEQ ID NO: 1806124 - DNA, 17 bp, Homo sapiens
ctgcctgggcctgtgca

SEQ ID NO: 1806125 - DNA, 21 bp, Homo sapiens
ctgcctgggcctgtgcagcag

SEQ ID NO: 1806126 - DNA, 24 bp, Homo sapiens
ctgcctgggcctgtgcagcagccc

SEQ ID NO: 1806127 - DNA, 15 bp, Homo sapiens
ctgccttcagggaga

SEQ ID NO: 1806128 - DNA, 16 bp, Homo sapiens
ctgccttcctcatccc

SEQ ID NO: 1806129 - DNA, 19 bp, Homo sapiens
ctgccttctcccctccaag

SEQ ID NO: 1806130 - DNA, 17 bp, Homo sapiens
ctgcctttctcccccga

SEQ ID NO: 1806131 - DNA, 20 bp, Homo sapiens
ctgcgagctccttgggtcct

SEQ ID NO: 1806132 - DNA, 13 bp, Homo sapiens
ctgctaccctccc

SEQ ID NO: 1806133 - DNA, 19 bp, Homo sapiens
ctgctaccctccctgctgt

SEQ ID NO: 1806134 - DNA, 14 bp, Homo sapiens
ctgctagagcaacc

SEQ ID NO: 1806135 - DNA, 20 bp, Homo sapiens
ctgctcagagtctatcaaca

SEQ ID NO: 1806136 - DNA, 22 bp, Homo sapiens
ctgctcagagtctatcaacatt

SEQ ID NO: 1806137 - DNA, 18 bp, Homo sapiens
ctgctccttggcaccccc

SEQ ID NO: 1806138 - DNA, 19 bp, Homo sapiens
ctgctccttggcaccccca

SEQ ID NO: 1806139 - DNA, 21 bp, Homo sapiens
ctgctccttggcacccccatg

SEQ ID NO: 1806140 - DNA, 22 bp, Homo sapiens
ctgctccttggcacccccatgc

SEQ ID NO: 1806141 - DNA, 16 bp, Homo sapiens
ctgctcgaagaacaat

SEQ ID NO: 1806142 - DNA, 17 bp, Homo sapiens
ctgctcgaagaacaatg

SEQ ID NO: 1806143 - DNA, 15 bp, Homo sapiens
ctgctcgggcccagg

SEQ ID NO: 1806144 - DNA, 14 bp, Homo sapiens
ctgctctagccagg

SEQ ID NO: 1806145 - DNA, 17 bp, Homo sapiens
ctgctctagccaggagt

SEQ ID NO: 1806146 - DNA, 23 bp, Homo sapiens
ctgctctagccaggagtctgtgc

SEQ ID NO: 1806147 - DNA, 16 bp, Homo sapiens
ctgctctagctggcag

SEQ ID NO: 1806148 - DNA, 18 bp, Homo sapiens
ctgctctagctggcagga

SEQ ID NO: 1806149 - DNA, 11 bp, Homo sapiens
ctgctctgccc

SEQ ID NO: 1806150 - DNA, 15 bp, Homo sapiens
ctgctcttagtgccc

SEQ ID NO: 1806151 - DNA, 19 bp, Homo sapiens
ctgctcttagtgcccgcct

SEQ ID NO: 1806152 - DNA, 14 bp, Homo sapiens
ctgctgagccactc

SEQ ID NO: 1806153 - DNA, 22 bp, Homo sapiens
ctgctgagccactcgcagtcgc

SEQ ID NO: 1806154 - DNA, 18 bp, Homo sapiens
ctgctgcaccaacccagc

SEQ ID NO: 1806155 - DNA, 19 bp, Homo sapiens
ctgctgcaccaacccagcc

SEQ ID NO: 1806156 - DNA, 21 bp, Homo sapiens
ctgctgcaccagagtgaaagg

SEQ ID NO: 1806157 - DNA, 18 bp, Homo sapiens
ctgctgcagaggggcagg

SEQ ID NO: 1806158 - DNA, 21 bp, Homo sapiens
ctgctgcagaggggcaggccc

SEQ ID NO: 1806159 - DNA, 22 bp, Homo sapiens
ctgctgcagaggggcaggccct

SEQ ID NO: 1806160 - DNA, 17 bp, Homo sapiens
ctgctgcctaataaaga

SEQ ID NO: 1806161 - DNA, 22 bp, Homo sapiens
ctgctgcctaataaagagactg

SEQ ID NO: 1806162 - DNA, 23 bp, Homo sapiens
ctgctgctgtaactgctgagcca

SEQ ID NO: 1806163 - DNA, 11 bp, Homo sapiens
ctgctgggaac

SEQ ID NO: 1806164 - DNA, 12 bp, Homo sapiens
ctgctggggcat

SEQ ID NO: 1806165 - DNA, 18 bp, Homo sapiens
ctgctggggcatgtgtgc

SEQ ID NO: 1806166 - DNA, 15 bp, Homo sapiens
ctgctgggtggccca

SEQ ID NO: 1806167 - DNA, 16 bp, Homo sapiens
ctgctgggtggcccat

SEQ ID NO: 1806168 - DNA, 17 bp, Homo sapiens
ctgctgggtggcccatc

SEQ ID NO: 1806169 - DNA, 17 bp, Homo sapiens
ctgctgtaactgctgag

SEQ ID NO: 1806170 - DNA, 19 bp, Homo sapiens
ctgctgtaactgctgagcc

SEQ ID NO: 1806171 - DNA, 23 bp, Homo sapiens
ctgctgtaactgctgagccactc

SEQ ID NO: 1806172 - DNA, 20 bp, Homo sapiens
ctgctgttgccatagcccca

SEQ ID NO: 1806173 - DNA, 18 bp, Homo sapiens
ctgcttaagtggatctgt

SEQ ID NO: 1806174 - DNA, 22 bp, Homo sapiens
ctgcttaagtggatctgtttgt

SEQ ID NO: 1806175 - DNA, 16 bp, Homo sapiens
ctgcttgcccgctccc

SEQ ID NO: 1806176 - DNA, 19 bp, Homo sapiens
ctgcttgcccgctcccaca

SEQ ID NO: 1806177 - DNA, 17 bp, Homo sapiens
ctgctttcgaataaagt

SEQ ID NO: 1806178 - DNA, 16 bp, Homo sapiens
ctgcttttccaggatc

SEQ ID NO: 1806179 - DNA, 21 bp, Homo sapiens
gaaaagcctctgtgtcactgg

SEQ ID NO: 1806180 - DNA, 18 bp, Homo sapiens
gaaaaggttttattttgt

SEQ ID NO: 1806181 - DNA, 13 bp, Homo sapiens
gaaaatgaaaaga

SEQ ID NO: 1806182 - DNA, 18 bp, Homo sapiens
gaaacagggacaaagaaa

SEQ ID NO: 1806183 - DNA, 23 bp, Homo sapiens
gaaacccagatcgctgtgttact

SEQ ID NO: 1806184 - DNA, 18 bp, Homo sapiens
gaaacctgtccataaagt

SEQ ID NO: 1806185 - DNA, 19 bp, Homo sapiens
gaaacctgtccataaagta

SEQ ID NO: 1806186 - DNA, 12 bp, Homo sapiens
gaaagaaaagac

SEQ ID NO: 1806187 - DNA, 12 bp, Homo sapiens
gaaagcagcagc

SEQ ID NO: 1806188 - DNA, 14 bp, Homo sapiens
gaaagcagcagcta

SEQ ID NO: 1806189 - DNA, 22 bp, Homo sapiens
gaaagcagcagctaggactgag

SEQ ID NO: 1806190 - DNA, 15 bp, Homo sapiens
gaaagcctcctgccc

SEQ ID NO: 1806191 - DNA, 23 bp, Homo sapiens
gaaagctaagtcttgtctcattt

SEQ ID NO: 1806192 - DNA, 19 bp, Homo sapiens
gaaagctgctctgctcaga

SEQ ID NO: 1806193 - DNA, 12 bp, Homo sapiens
gaaagctgcttt

SEQ ID NO: 1806194 - DNA, 21 bp, Homo sapiens
gaaaggaagatgtaagaagct

SEQ ID NO: 1806195 - DNA, 13 bp, Homo sapiens
gaaaggacccacc

SEQ ID NO: 1806196 - DNA, 21 bp, Homo sapiens
gaaaggatggagtgttttagt

SEQ ID NO: 1806197 - DNA, 23 bp, Homo sapiens
gaaatactgtattgaatatttta

SEQ ID NO: 1806198 - DNA, 15 bp, Homo sapiens
gaaatgggagatggt

SEQ ID NO: 1806199 - DNA, 20 bp, Homo sapiens
gaaattcaacctgtgtctta

SEQ ID NO: 1806200 - DNA, 20 bp, Homo sapiens
gaaatttactgtgagactgt

SEQ ID NO: 1806201 - DNA, 18 bp, Homo sapiens
gaaattttactgacagaa

SEQ ID NO: 1806202 - DNA, 22 bp, Homo sapiens
gaaattttactgacagaaatgc

SEQ ID NO: 1806203 - DNA, 19 bp, Homo sapiens
gaacaagtcacagctgcag

SEQ ID NO: 1806204 - DNA, 13 bp, Homo sapiens
gaacaatgaatgc

SEQ ID NO: 1806205 - DNA, 15 bp, Homo sapiens
gaacacactcagcag

SEQ ID NO: 1806206 - DNA, 17 bp, Homo sapiens
gaacacactcagcagcc

SEQ ID NO: 1806207 - DNA, 14 bp, Homo sapiens
gaacagaggcattt

SEQ ID NO: 1806208 - DNA, 17 bp, Homo sapiens
gaacagaggcatttaaa

SEQ ID NO: 1806209 - DNA, 16 bp, Homo sapiens
gaaccaaggcagcctc

SEQ ID NO: 1806210 - DNA, 22 bp, Homo sapiens
gaaccgacttttctaaagctct

SEQ ID NO: 1806211 - DNA, 22 bp, Homo sapiens
gaacgagcactggccagagagg

SEQ ID NO: 1806212 - DNA, 13 bp, Homo sapiens
gaacgcaccccac

SEQ ID NO: 1806213 - DNA, 21 bp, Homo sapiens
gaactattttgaagaaaacac

SEQ ID NO: 1806214 - DNA, 18 bp, Homo sapiens
gaactgccccatctcctc

SEQ ID NO: 1806215 - DNA, 19 bp, Homo sapiens
gaacttacacttggagccc

SEQ ID NO: 1806216 - DNA, 21 bp, Homo sapiens
gaacttacacttggagcccgt

SEQ ID NO: 1806217 - DNA, 21 bp, Homo sapiens
gaacttgaggacacatgtcca

SEQ ID NO: 1806218 - DNA, 19 bp, Homo sapiens
gaagccgtctgactccaga

SEQ ID NO: 1806219 - DNA, 19 bp, Homo sapiens
gaagcctgaggcaaaaact

SEQ ID NO: 1806220 - DNA, 14 bp, Homo sapiens
gaagctagaaacaa

SEQ ID NO: 1806221 - DNA, 18 bp, Homo sapiens
gaaggaatagccagagag

SEQ ID NO: 1806222 - DNA, 14 bp, Homo sapiens
gaaggaattacatt

SEQ ID NO: 1806223 - DNA, 21 bp, Homo sapiens
gaaggagggcagagccatggg

SEQ ID NO: 1806224 - DNA, 18 bp, Homo sapiens
gaaggatggcatctccat

SEQ ID NO: 1806225 - DNA, 14 bp, Homo sapiens
gaaggcagcattcc

SEQ ID NO: 1806226 - DNA, 15 bp, Homo sapiens
gaaggcagggcagag

SEQ ID NO: 1806227 - DNA, 16 bp, Homo sapiens
gaaggcagtctgaacc

SEQ ID NO: 1806228 - DNA, 21 bp, Homo sapiens
gaaggcctcttgtgctcacgc

SEQ ID NO: 1806229 - DNA, 12 bp, Homo sapiens
gaaggcgaggag

SEQ ID NO: 1806230 - DNA, 14 bp, Homo sapiens
gaaggcgaggagag

SEQ ID NO: 1806231 - DNA, 23 bp, Homo sapiens
gaagggagagttctttgctgccc

SEQ ID NO: 1806232 - DNA, 19 bp, Homo sapiens
gaagggcagggctgaggcc

SEQ ID NO: 1806233 - DNA, 21 bp, Homo sapiens
gaaggggccccggggctggca

SEQ ID NO: 1806234 - DNA, 14 bp, Homo sapiens
gaaggtgctgagct

SEQ ID NO: 1806235 - DNA, 15 bp, Homo sapiens
gaaggtgctgagctt

SEQ ID NO: 1806236 - DNA, 23 bp, Homo sapiens
gaagtccttcagtgagcccctcc

SEQ ID NO: 1806237 - DNA, 20 bp, Homo sapiens
gaagtggtttcctgataaca

SEQ ID NO: 1806238 - DNA, 19 bp, Homo sapiens
gaagtgtgggtctgtgtgt

SEQ ID NO: 1806239 - DNA, 14 bp, Homo sapiens
gaagttaaagtcaa

SEQ ID NO: 1806240 - DNA, 17 bp, Homo sapiens
gaagttaaagtcaatat

SEQ ID NO: 1806241 - DNA, 19 bp, Homo sapiens
gaagttcaagtgatctttc

SEQ ID NO: 1806242 - DNA, 21 bp, Homo sapiens
gaataatttctcctcatttaa

SEQ ID NO: 1806243 - DNA, 16 bp, Homo sapiens
gaatcaagtctgtgaa

SEQ ID NO: 1806244 - DNA, 21 bp, Homo sapiens
gaatctgctgttgccatagcc

SEQ ID NO: 1806245 - DNA, 15 bp, Homo sapiens
gaatggatggggaga

SEQ ID NO: 1806246 - DNA, 13 bp, Homo sapiens
gaatgtcagtatg

SEQ ID NO: 1806247 - DNA, 16 bp, Homo sapiens
gaatgttccctgcacc

SEQ ID NO: 1806248 - DNA, 20 bp, Homo sapiens
gaatgttccctgcaccctgg

SEQ ID NO: 1806249 - DNA, 18 bp, Homo sapiens
gaattaatctagaaaatg

SEQ ID NO: 1806250 - DNA, 14 bp, Homo sapiens
gaattcctttacaa

SEQ ID NO: 1806251 - DNA, 22 bp, Homo sapiens
gaattcctttacaactaaataa

SEQ ID NO: 1806252 - DNA, 18 bp, Homo sapiens
gaattgatgatgcagttt

SEQ ID NO: 1806253 - DNA, 20 bp, Homo sapiens
gaattgcaaaactagacaaa

SEQ ID NO: 1806254 - DNA, 15 bp, Homo sapiens
gaatttatagaataa

SEQ ID NO: 1806255 - DNA, 16 bp, Homo sapiens
gaattttctttcatac

SEQ ID NO: 1806256 - DNA, 18 bp, Homo sapiens
gacaaaaatgtttgtact

SEQ ID NO: 1806257 - DNA, 20 bp, Homo sapiens
gacaacatttttgtacatta

SEQ ID NO: 1806258 - DNA, 15 bp, Homo sapiens
gacaagaagctgcta

SEQ ID NO: 1806259 - DNA, 18 bp, Homo sapiens
gacaagaatggaatagaa

SEQ ID NO: 1806260 - DNA, 12 bp, Homo sapiens
gacaagccctgg

SEQ ID NO: 1806261 - DNA, 15 bp, Homo sapiens
gacaagccctggcaa

SEQ ID NO: 1806262 - DNA, 17 bp, Homo sapiens
gacaagccctggcaaca

SEQ ID NO: 1806263 - DNA, 13 bp, Homo sapiens
gacaatggcagct

SEQ ID NO: 1806264 - DNA, 18 bp, Homo sapiens
gacacatccattgctggc

SEQ ID NO: 1806265 - DNA, 19 bp, Homo sapiens
gacacctaccatgctgctt

SEQ ID NO: 1806266 - DNA, 10 bp, Homo sapiens
gacacctgcc

SEQ ID NO: 1806267 - DNA, 15 bp, Homo sapiens
gacacctgccctgcc

SEQ ID NO: 1806268 - DNA, 20 bp, Homo sapiens
gacactgcggggcttggctg

SEQ ID NO: 1806269 - DNA, 15 bp, Homo sapiens
gacactgctgcacca

SEQ ID NO: 1806270 - DNA, 20 bp, Homo sapiens
gacactgctgcaccagagtg

SEQ ID NO: 1806271 - DNA, 21 bp, Homo sapiens
gacactttgccaaggctctcc

SEQ ID NO: 1806272 - DNA, 18 bp, Homo sapiens
gacagaaatgcaatctcc

SEQ ID NO: 1806273 - DNA, 19 bp, Homo sapiens
gacagagttggtgttcata

SEQ ID NO: 1806274 - DNA, 15 bp, Homo sapiens
gacaggcagggaggg

SEQ ID NO: 1806275 - DNA, 15 bp, Homo sapiens
gacaggccctccctg

SEQ ID NO: 1806276 - DNA, 17 bp, Homo sapiens
gacaggccctccctgtc

SEQ ID NO: 1806277 - DNA, 14 bp, Homo sapiens
gacagtattctcag

SEQ ID NO: 1806278 - DNA, 15 bp, Homo sapiens
gacagtatttgtggg

SEQ ID NO: 1806279 - DNA, 16 bp, Homo sapiens
gacagtcctctccacc

SEQ ID NO: 1806280 - DNA, 17 bp, Homo sapiens
gacagtcctctccacct

SEQ ID NO: 1806281 - DNA, 15 bp, Homo sapiens
gacagtcttttatca

SEQ ID NO: 1806282 - DNA, 13 bp, Homo sapiens
gacagttggcaga

SEQ ID NO: 1806283 - DNA, 14 bp, Homo sapiens
gacagttggcagag

SEQ ID NO: 1806284 - DNA, 15 bp, Homo sapiens
gacagttggcagaga

SEQ ID NO: 1806285 - DNA, 15 bp, Homo sapiens
gacatattcccatgg

SEQ ID NO: 1806286 - DNA, 14 bp, Homo sapiens
gacattccaacaat

SEQ ID NO: 1806287 - DNA, 15 bp, Homo sapiens
gaccaaattgcttct

SEQ ID NO: 1806288 - DNA, 22 bp, Homo sapiens
gaccacagtgggtggcacctcc

SEQ ID NO: 1806289 - DNA, 14 bp, Homo sapiens
gaccactccagaga

SEQ ID NO: 1806290 - DNA, 15 bp, Homo sapiens
gaccactccagagaa

SEQ ID NO: 1806291 - DNA, 18 bp, Homo sapiens
gacccacccatcttcctg

SEQ ID NO: 1806292 - DNA, 16 bp, Homo sapiens
gacccagctactctgt

SEQ ID NO: 1806293 - DNA, 19 bp, Homo sapiens
gacccagctactctgtcca

SEQ ID NO: 1806294 - DNA, 21 bp, Homo sapiens
gacccagctactctgtccagg

SEQ ID NO: 1806295 - DNA, 13 bp, Homo sapiens
gacccaggtggct

SEQ ID NO: 1806296 - DNA, 15 bp, Homo sapiens
gcaggtgcagatggg

SEQ ID NO: 1806297 - DNA, 18 bp, Homo sapiens
gcaggtgcagatgggctg

SEQ ID NO: 1806298 - DNA, 20 bp, Homo sapiens
gcaggtgctgctaccctccc

SEQ ID NO: 1806299 - DNA, 22 bp, Homo sapiens
gcaggtgctgctaccctccctg

SEQ ID NO: 1806300 - DNA, 23 bp, Homo sapiens
gcaggtgctgctaccctccctgc

SEQ ID NO: 1806301 - DNA, 19 bp, Homo sapiens
gcaggtgtggtggctcatg

SEQ ID NO: 1806302 - DNA, 22 bp, Homo sapiens
gcaggttgggccatactggcct

SEQ ID NO: 1806303 - DNA, 23 bp, Homo sapiens
gcagtaacatgcaacaaaaatgt

SEQ ID NO: 1806304 - DNA, 14 bp, Homo sapiens
gcagtccccagccc

SEQ ID NO: 1806305 - DNA, 15 bp, Homo sapiens
gcagtccccagccct

SEQ ID NO: 1806306 - DNA, 16 bp, Homo sapiens
gcagtccccagccctt

SEQ ID NO: 1806307 - DNA, 17 bp, Homo sapiens
gcagtccccagcccttc

SEQ ID NO: 1806308 - DNA, 15 bp, Homo sapiens
gcagtcgcaggatcc

SEQ ID NO: 1806309 - DNA, 14 bp, Homo sapiens
gcagtctgaaccct

SEQ ID NO: 1806310 - DNA, 22 bp, Homo sapiens
gcagtctgaacccttgtgcttg

SEQ ID NO: 1806311 - DNA, 21 bp, Homo sapiens
gcagtgaacacactcagcagc

SEQ ID NO: 1806312 - DNA, 15 bp, Homo sapiens
gcagtgactggcagg

SEQ ID NO: 1806313 - DNA, 14 bp, Homo sapiens
gcagtgatggcgcg

SEQ ID NO: 1806314 - DNA, 19 bp, Homo sapiens
gcagtgcctcgaggcaccg

SEQ ID NO: 1806315 - DNA, 21 bp, Homo sapiens
gcagtgcctcgaggcaccggc

SEQ ID NO: 1806316 - DNA, 21 bp, Homo sapiens
gcagtgggtcccacttcccct

SEQ ID NO: 1806317 - DNA, 15 bp, Homo sapiens
gcagttccatcaggt

SEQ ID NO: 1806318 - DNA, 12 bp, Homo sapiens
gcatcaggcact

SEQ ID NO: 1806319 - DNA, 19 bp, Homo sapiens
gcatcaggcactggtggca

SEQ ID NO: 1806320 - DNA, 16 bp, Homo sapiens
gcatccacccagtgct

SEQ ID NO: 1806321 - DNA, 17 bp, Homo sapiens
gcatccacccagtgctg

SEQ ID NO: 1806322 - DNA, 19 bp, Homo sapiens
gcatccacccagtgctgcc

SEQ ID NO: 1806323 - DNA, 20 bp, Homo sapiens
gcatccacccagtgctgcca

SEQ ID NO: 1806324 - DNA, 21 bp, Homo sapiens
gcatccacccagtgctgccat

SEQ ID NO: 1806325 - DNA, 12 bp, Homo sapiens
gcatccagcctg

SEQ ID NO: 1806326 - DNA, 13 bp, Homo sapiens
gcatccagcctgt

SEQ ID NO: 1806327 - DNA, 15 bp, Homo sapiens
gcatccagcctgtgt

SEQ ID NO: 1806328 - DNA, 16 bp, Homo sapiens
gcatcccccttagaat

SEQ ID NO: 1806329 - DNA, 20 bp, Homo sapiens
gcatgattttaagaggcttt

SEQ ID NO: 1806330 - DNA, 17 bp, Homo sapiens
gcatggttccttccctg

SEQ ID NO: 1806331 - DNA, 13 bp, Homo sapiens
gcatgtgtgcctg

SEQ ID NO: 1806332 - DNA, 14 bp, Homo sapiens
gcatgtgtgcctgt

SEQ ID NO: 1806333 - DNA, 18 bp, Homo sapiens
gcatgtgtgcctgtggca

SEQ ID NO: 1806334 - DNA, 18 bp, Homo sapiens
gcattatatttgtaaatt

SEQ ID NO: 1806335 - DNA, 23 bp, Homo sapiens
gcattcaggcagcactgacaata

SEQ ID NO: 1806336 - DNA, 20 bp, Homo sapiens
gcattggcagcaggtgctgc

SEQ ID NO: 1806337 - DNA, 22 bp, Homo sapiens
gcattttacagtatcttcaaaa

SEQ ID NO: 1806338 - DNA, 13 bp, Homo sapiens
gcatttttcagag

SEQ ID NO: 1806339 - DNA, 14 bp, Homo sapiens
gccaaatgcacaag

SEQ ID NO: 1806340 - DNA, 20 bp, Homo sapiens
gccaacagtgttaggcctgg

SEQ ID NO: 1806341 - DNA, 22 bp, Homo sapiens
gccaacagtgttaggcctggca

SEQ ID NO: 1806342 - DNA, 20 bp, Homo sapiens
gccaagagcatcgtgaccct

SEQ ID NO: 1806343 - DNA, 14 bp, Homo sapiens
gccaaggaggtggg

SEQ ID NO: 1806344 - DNA, 14 bp, Homo sapiens
gccaagtttttcag

SEQ ID NO: 1806345 - DNA, 17 bp, Homo sapiens
gccaagtttttcagaaa

SEQ ID NO: 1806346 - DNA, 23 bp, Homo sapiens
gccaagtttttcagaaagtttga

SEQ ID NO: 1806347 - DNA, 20 bp, Homo sapiens
gccacaaatcaaagcaaggg

SEQ ID NO: 1806348 - DNA, 17 bp, Homo sapiens
gccacacattgtgcttg

SEQ ID NO: 1806349 - DNA, 20 bp, Homo sapiens
gccacacattgtgcttggcc

SEQ ID NO: 1806350 - DNA, 15 bp, Homo sapiens
gccacaccaagctgt

SEQ ID NO: 1806351 - DNA, 21 bp, Homo sapiens
gccacaccaagctgtgccacc

SEQ ID NO: 1806352 - DNA, 18 bp, Homo sapiens
gccacacccaggaaggga

SEQ ID NO: 1806353 - DNA, 17 bp, Homo sapiens
gccaccacgtctgccag

SEQ ID NO: 1806354 - DNA, 18 bp, Homo sapiens
gccaccacgtctgccagg

SEQ ID NO: 1806355 - DNA, 21 bp, Homo sapiens
gccaccacgtctgccaggccc

SEQ ID NO: 1806356 - DNA, 22 bp, Homo sapiens
gccaccccaaaccccagcccca

SEQ ID NO: 1806357 - DNA, 15 bp, Homo sapiens
gccactacctttgtc

SEQ ID NO: 1806358 - DNA, 16 bp, Homo sapiens
gccactacctttgtcc

SEQ ID NO: 1806359 - DNA, 16 bp, Homo sapiens
gccactccctgagctt

SEQ ID NO: 1806360 - DNA, 22 bp, Homo sapiens
gccactcctgtcccgccttcct

SEQ ID NO: 1806361 - DNA, 12 bp, Homo sapiens
gccactgccagg

SEQ ID NO: 1806362 - DNA, 14 bp, Homo sapiens
gccactgccaggca

SEQ ID NO: 1806363 - DNA, 17 bp, Homo sapiens
gccactgccaggcacct

SEQ ID NO: 1806364 - DNA, 22 bp, Homo sapiens
gccactgccaggcacctggcct

SEQ ID NO: 1806365 - DNA, 24 bp, Homo sapiens
gccactgccaggcacctggcctgc

SEQ ID NO: 1806366 - DNA, 15 bp, Homo sapiens
gccactgtggccaga

SEQ ID NO: 1806367 - DNA, 17 bp, Homo sapiens
gccactgtggccagagc

SEQ ID NO: 1806368 - DNA, 18 bp, Homo sapiens
gccactgtggccagagct

SEQ ID NO: 1806369 - DNA, 13 bp, Homo sapiens
gccacttcccagg

SEQ ID NO: 1806370 - DNA, 19 bp, Homo sapiens
gccacttcttaaaggcctg

SEQ ID NO: 1806371 - DNA, 23 bp, Homo sapiens
gccagaaggagggcagagccatg

SEQ ID NO: 1806372 - DNA, 18 bp, Homo sapiens
gccagagaggagcacctg

SEQ ID NO: 1806373 - DNA, 18 bp, Homo sapiens
gccagagagggcccagct

SEQ ID NO: 1806374 - DNA, 19 bp, Homo sapiens
gccagagagggcccagctg

SEQ ID NO: 1806375 - DNA, 20 bp, Homo sapiens
gccagagctggaaggcaggg

SEQ ID NO: 1806376 - DNA, 15 bp, Homo sapiens
gccagcacaggggcc

SEQ ID NO: 1806377 - DNA, 19 bp, Homo sapiens
gccagccagtcttgcctag

SEQ ID NO: 1806378 - DNA, 22 bp, Homo sapiens
gccagccagtcttgcctaggcc

SEQ ID NO: 1806379 - DNA, 14 bp, Homo sapiens
gccagccccacagc

SEQ ID NO: 1806380 - DNA, 16 bp, Homo sapiens
gccagccccacagccc

SEQ ID NO: 1806381 - DNA, 15 bp, Homo sapiens
gccagcccttccctg

SEQ ID NO: 1806382 - DNA, 12 bp, Homo sapiens
gccagcctggga

SEQ ID NO: 1806383 - DNA, 20 bp, Homo sapiens
gccagcctgggactcccagt

SEQ ID NO: 1806384 - DNA, 15 bp, Homo sapiens
gccagctgccttcct

SEQ ID NO: 1806385 - DNA, 22 bp, Homo sapiens
gccagctgccttcctcatcccc

SEQ ID NO: 1806386 - DNA, 15 bp, Homo sapiens
gccaggagtctgtgc

SEQ ID NO: 1806387 - DNA, 19 bp, Homo sapiens
gccaggagtctgtgctctt

SEQ ID NO: 1806388 - DNA, 15 bp, Homo sapiens
gccaggcacctggcc

SEQ ID NO: 1806389 - DNA, 16 bp, Homo sapiens
gccaggcacctggcct

SEQ ID NO: 1806390 - DNA, 18 bp, Homo sapiens
gccaggcacctggcctgc

SEQ ID NO: 1806391 - DNA, 21 bp, Homo sapiens
gccaggcacctggcctgctgg

SEQ ID NO: 1806392 - DNA, 17 bp, Homo sapiens
gccaggcccatctcagg

SEQ ID NO: 1806393 - DNA, 22 bp, Homo sapiens
gccaggcccatctcaggtgcca

SEQ ID NO: 1806394 - DNA, 15 bp, Homo sapiens
gccaggcgttggtgc

SEQ ID NO: 1806395 - DNA, 17 bp, Homo sapiens
gccaggcgttggtgcca

SEQ ID NO: 1806396 - DNA, 20 bp, Homo sapiens
gccaggcgttggtgccactt

SEQ ID NO: 1806397 - DNA, 18 bp, Homo sapiens
gccaggttaggaaggcag

SEQ ID NO: 1806398 - DNA, 15 bp, Homo sapiens
gccagtcgcgctgcc

SEQ ID NO: 1806399 - DNA, 16 bp, Homo sapiens
gccagtcgcgctgcct

SEQ ID NO: 1806400 - DNA, 19 bp, Homo sapiens
gccagtcttgcctaggcca

SEQ ID NO: 1806401 - DNA, 20 bp, Homo sapiens
gccagtcttgcctaggccaa

SEQ ID NO: 1806402 - DNA, 18 bp, Homo sapiens
gccagtgaagtccttcag

SEQ ID NO: 1806403 - DNA, 14 bp, Homo sapiens
gccagtggctggat

SEQ ID NO: 1806404 - DNA, 19 bp, Homo sapiens
gccatatattttctgagta

SEQ ID NO: 1806405 - DNA, 17 bp, Homo sapiens
gccatcttccaggtggg

SEQ ID NO: 1806406 - DNA, 15 bp, Homo sapiens
gccatgccactgcca

SEQ ID NO: 1806407 - DNA, 16 bp, Homo sapiens
gccatgccactgccag

SEQ ID NO: 1806408 - DNA, 21 bp, Homo sapiens
gccatgccactgccaggcacc

SEQ ID NO: 1806409 - DNA, 15 bp, Homo sapiens
gccatgcctcatgcc

SEQ ID NO: 1806410 - DNA, 21 bp, Homo sapiens
gccatgcgtggctaacatcct

SEQ ID NO: 1806411 - DNA, 22 bp, Homo sapiens
gccatggctcaggcaagcccct

SEQ ID NO: 1806412 - DNA, 16 bp, Homo sapiens
gctttggcccaatgcc

SEQ ID NO: 1806413 - DNA, 21 bp, Homo sapiens
gctttgggaggccaaggcagg

SEQ ID NO: 1806414 - DNA, 20 bp, Homo sapiens
gctttgggctttgcaggctc

SEQ ID NO: 1806415 - DNA, 19 bp, Homo sapiens
gctttggggacagttggca

SEQ ID NO: 1806416 - DNA, 21 bp, Homo sapiens
gctttggggtcctagcccagt

SEQ ID NO: 1806417 - DNA, 14 bp, Homo sapiens
gctttgtgactatt

SEQ ID NO: 1806418 - DNA, 12 bp, Homo sapiens
ggaaaaaagaaa

SEQ ID NO: 1806419 - DNA, 15 bp, Homo sapiens
ggaaaaaagaaaaaa

SEQ ID NO: 1806420 - DNA, 22 bp, Homo sapiens
ggaaaacagctagcttgaaaac

SEQ ID NO: 1806421 - DNA, 14 bp, Homo sapiens
ggaaaagcctctgt

SEQ ID NO: 1806422 - DNA, 13 bp, Homo sapiens
ggaaactggctga

SEQ ID NO: 1806423 - DNA, 24 bp, Homo sapiens
ggaaagctaagtcttgtctcattt

SEQ ID NO: 1806424 - DNA, 19 bp, Homo sapiens
ggaaaggacccacccatct

SEQ ID NO: 1806425 - DNA, 13 bp, Homo sapiens
ggaaatactgtat

SEQ ID NO: 1806426 - DNA, 17 bp, Homo sapiens
ggaaccagggaggagag

SEQ ID NO: 1806427 - DNA, 16 bp, Homo sapiens
ggaacgagcactggcc

SEQ ID NO: 1806428 - DNA, 19 bp, Homo sapiens
ggaacgagcactggccaga

SEQ ID NO: 1806429 - DNA, 14 bp, Homo sapiens
ggaactgctgggct

SEQ ID NO: 1806430 - DNA, 14 bp, Homo sapiens
ggaagagcacagcc

SEQ ID NO: 1806431 - DNA, 16 bp, Homo sapiens
ggaagagcacagccct

SEQ ID NO: 1806432 - DNA, 17 bp, Homo sapiens
ggaagagcacagccctc

SEQ ID NO: 1806433 - DNA, 18 bp, Homo sapiens
ggaagagcacagccctcc

SEQ ID NO: 1806434 - DNA, 15 bp, Homo sapiens
ggaagagcagcctga

SEQ ID NO: 1806435 - DNA, 21 bp, Homo sapiens
ggaagccgtctgactccagag

SEQ ID NO: 1806436 - DNA, 17 bp, Homo sapiens
ggaagctgtactcagag

SEQ ID NO: 1806437 - DNA, 20 bp, Homo sapiens
ggaagctgtactcagagcag

SEQ ID NO: 1806438 - DNA, 15 bp, Homo sapiens
ggaaggcagctgctc

SEQ ID NO: 1806439 - DNA, 16 bp, Homo sapiens
ggaaggcagctgctct

SEQ ID NO: 1806440 - DNA, 17 bp, Homo sapiens
ggaaggcagggcagagg

SEQ ID NO: 1806441 - DNA, 20 bp, Homo sapiens
ggaaggcagggcagagggaa

SEQ ID NO: 1806442 - DNA, 15 bp, Homo sapiens
ggaaggctggctgag

SEQ ID NO: 1806443 - DNA, 12 bp, Homo sapiens
ggaagtgtgggt

SEQ ID NO: 1806444 - DNA, 21 bp, Homo sapiens
ggaagtgtgggtctgtgtgtg

SEQ ID NO: 1806445 - DNA, 14 bp, Homo sapiens
ggaagttcaagtga

SEQ ID NO: 1806446 - DNA, 17 bp, Homo sapiens
ggaatagccagagagga

SEQ ID NO: 1806447 - DNA, 21 bp, Homo sapiens
ggaatgcagggaagagggcag

SEQ ID NO: 1806448 - DNA, 17 bp, Homo sapiens
ggaatgttccctgcacc

SEQ ID NO: 1806449 - DNA, 17 bp, Homo sapiens
ggaattcagcaccctgg

SEQ ID NO: 1806450 - DNA, 20 bp, Homo sapiens
ggaattcagcaccctgggtg

SEQ ID NO: 1806451 - DNA, 21 bp, Homo sapiens
ggaattttctttcatacatta

SEQ ID NO: 1806452 - DNA, 14 bp, Homo sapiens
ggacaagaagctgc

SEQ ID NO: 1806453 - DNA, 13 bp, Homo sapiens
ggacacatgtcca

SEQ ID NO: 1806454 - DNA, 17 bp, Homo sapiens
ggacacctgccctgccc

SEQ ID NO: 1806455 - DNA, 23 bp, Homo sapiens
ggacagttggcagagaaggcctc

SEQ ID NO: 1806456 - DNA, 17 bp, Homo sapiens
ggaccacagtgggtggc

SEQ ID NO: 1806457 - DNA, 21 bp, Homo sapiens
ggaccacagtgggtggcacct

SEQ ID NO: 1806458 - DNA, 18 bp, Homo sapiens
ggacccaccaaactgcac

SEQ ID NO: 1806459 - DNA, 14 bp, Homo sapiens
ggacccagctactc

SEQ ID NO: 1806460 - DNA, 20 bp, Homo sapiens
ggacccagctactctgtcca

SEQ ID NO: 1806461 - DNA, 21 bp, Homo sapiens
ggacccagctactctgtccag

SEQ ID NO: 1806462 - DNA, 23 bp, Homo sapiens
ggacccagctactctgtccaggc

SEQ ID NO: 1806463 - DNA, 12 bp, Homo sapiens
ggacccaggccc

SEQ ID NO: 1806464 - DNA, 21 bp, Homo sapiens
ggaccgggtgggcctggcctg

SEQ ID NO: 1806465 - DNA, 13 bp, Homo sapiens
ggactcccagtga

SEQ ID NO: 1806466 - DNA, 17 bp, Homo sapiens
ggactgcccccagaaag

SEQ ID NO: 1806467 - DNA, 22 bp, Homo sapiens
ggactgcccccagaaagcctcc

SEQ ID NO: 1806468 - DNA, 23 bp, Homo sapiens
ggactgcccccagaaagcctcct

SEQ ID NO: 1806469 - DNA, 14 bp, Homo sapiens
ggacttcctggggc

SEQ ID NO: 1806470 - DNA, 20 bp, Homo sapiens
ggagacaggcagggagggct

SEQ ID NO: 1806471 - DNA, 12 bp, Homo sapiens
ggagaccctgga

SEQ ID NO: 1806472 - DNA, 21 bp, Homo sapiens
ggagaccgcttcacccctgca

SEQ ID NO: 1806473 - DNA, 23 bp, Homo sapiens
ggagaccgcttcacccctgcact

SEQ ID NO: 1806474 - DNA, 21 bp, Homo sapiens
ggagagactgaaagcagcagc

SEQ ID NO: 1806475 - DNA, 18 bp, Homo sapiens
ggagagtggttgttgcca

SEQ ID NO: 1806476 - DNA, 21 bp, Homo sapiens
ggagagttctttgctgcccct

SEQ ID NO: 1806477 - DNA, 15 bp, Homo sapiens
ggagatggtcagtgt

SEQ ID NO: 1806478 - DNA, 15 bp, Homo sapiens
ggagcacagccctgg

SEQ ID NO: 1806479 - DNA, 18 bp, Homo sapiens
ggagcacagccctgggag

SEQ ID NO: 1806480 - DNA, 13 bp, Homo sapiens
ggagcacctgaac

SEQ ID NO: 1806481 - DNA, 14 bp, Homo sapiens
ggagcacctgaacc

SEQ ID NO: 1806482 - DNA, 17 bp, Homo sapiens
ggagcatgattttaaga

SEQ ID NO: 1806483 - DNA, 16 bp, Homo sapiens
ggagccactcctgtcc

SEQ ID NO: 1806484 - DNA, 17 bp, Homo sapiens
ggagccactcctgtccc

SEQ ID NO: 1806485 - DNA, 18 bp, Homo sapiens
ggagccactcctgtcccg

SEQ ID NO: 1806486 - DNA, 20 bp, Homo sapiens
ggagccactcctgtcccgcc

SEQ ID NO: 1806487 - DNA, 22 bp, Homo sapiens
ggagctgatttccaggcccctg

SEQ ID NO: 1806488 - DNA, 18 bp, Homo sapiens
ggaggaaggtgctgagct

SEQ ID NO: 1806489 - DNA, 22 bp, Homo sapiens
ggaggcaccagctctgtggcct

SEQ ID NO: 1806490 - DNA, 13 bp, Homo sapiens
ggaggccaaggca

SEQ ID NO: 1806491 - DNA, 14 bp, Homo sapiens
ggaggcctgatgct

SEQ ID NO: 1806492 - DNA, 12 bp, Homo sapiens
ggagggatttgg

SEQ ID NO: 1806493 - DNA, 12 bp, Homo sapiens
ggagggcagagc

SEQ ID NO: 1806494 - DNA, 18 bp, Homo sapiens
ggagggcagagccatggg

SEQ ID NO: 1806495 - DNA, 18 bp, Homo sapiens
ggagggggcgctcaggac

SEQ ID NO: 1806496 - DNA, 14 bp, Homo sapiens
ggagtcaactggct

SEQ ID NO: 1806497 - DNA, 21 bp, Homo sapiens
ggagtcagtaggtccaagggc

SEQ ID NO: 1806498 - DNA, 19 bp, Homo sapiens
ggagtgaggcttccaggct

SEQ ID NO: 1806499 - DNA, 20 bp, Homo sapiens
ggagtgaggcttccaggctc

SEQ ID NO: 1806500 - DNA, 20 bp, Homo sapiens
ggagtttgagacaagccctg

SEQ ID NO: 1806501 - DNA, 14 bp, Homo sapiens
ggataaattacatt

SEQ ID NO: 1806502 - DNA, 15 bp, Homo sapiens
ggataccccattaaa

SEQ ID NO: 1806503 - DNA, 14 bp, Homo sapiens
ggatagatgtgtgg

SEQ ID NO: 1806504 - DNA, 12 bp, Homo sapiens
ggatcctgcagg

SEQ ID NO: 1806505 - DNA, 21 bp, Homo sapiens
ggatgatttcagaaggagaag

SEQ ID NO: 1806506 - DNA, 17 bp, Homo sapiens
ggatgggcattgggctg

SEQ ID NO: 1806507 - DNA, 13 bp, Homo sapiens
ggatgtctgggcc

SEQ ID NO: 1806508 - DNA, 18 bp, Homo sapiens
ggcaaagaactgccccat

SEQ ID NO: 1806509 - DNA, 15 bp, Homo sapiens
ggcaagcccctcagc

SEQ ID NO: 1806510 - DNA, 18 bp, Homo sapiens
ggcaatgagtgtgccaga

SEQ ID NO: 1806511 - DNA, 14 bp, Homo sapiens
ggcacaccactgcc

SEQ ID NO: 1806512 - DNA, 18 bp, Homo sapiens
ggcacaccactgccctgc

SEQ ID NO: 1806513 - DNA, 22 bp, Homo sapiens
ggcacagacttctggaaggctg

SEQ ID NO: 1806514 - DNA, 18 bp, Homo sapiens
ggcacagtgtctgggctg

SEQ ID NO: 1806515 - DNA, 23 bp, Homo sapiens
ggcaccactagggtcctggccct

SEQ ID NO: 1806516 - DNA, 15 bp, Homo sapiens
ggcaccagccccctg

SEQ ID NO: 1806517 - DNA, 19 bp, Homo sapiens
ggcaccagccccctggatg

SEQ ID NO: 1806518 - DNA, 18 bp, Homo sapiens
ggcaccagctctgtggcc

SEQ ID NO: 1806519 - DNA, 15 bp, Homo sapiens
ggcaccggcgctgca

SEQ ID NO: 1806520 - DNA, 20 bp, Homo sapiens
ggcacctgcaggttgggcca

SEQ ID NO: 1806521 - DNA, 13 bp, Homo sapiens
ggcacctggcctg

SEQ ID NO: 1806522 - DNA, 19 bp, Homo sapiens
ggcacctggcctgctggga

SEQ ID NO: 1806523 - DNA, 12 bp, Homo sapiens
ggcactgctggg

SEQ ID NO: 1806524 - DNA, 14 bp, Homo sapiens
ggcactgctgggtg

SEQ ID NO: 1806525 - DNA, 19 bp, Homo sapiens
ggcactgctgggtggccca

SEQ ID NO: 1806526 - DNA, 15 bp, Homo sapiens
ggcagaaaagaggag

SEQ ID NO: 1806527 - DNA, 16 bp, Homo sapiens
ggcagaaaagaggaga

SEQ ID NO: 1806528 - DNA, 15 bp, Homo sapiens
ggcagagaaggcctc

SEQ ID NO: 1806529 - DNA, 22 bp, Homo sapiens
gggtgcgaccccatctgcccag

SEQ ID NO: 1806530 - DNA, 20 bp, Homo sapiens
gggtggcacctcctgagaag

SEQ ID NO: 1806531 - DNA, 13 bp, Homo sapiens
gggtggcccatcc

SEQ ID NO: 1806532 - DNA, 20 bp, Homo sapiens
gggtgggcctggcctgagct

SEQ ID NO: 1806533 - DNA, 17 bp, Homo sapiens
gggtgtcatctgaggag

SEQ ID NO: 1806534 - DNA, 17 bp, Homo sapiens
gggtgttaaggcagtga

SEQ ID NO: 1806535 - DNA, 17 bp, Homo sapiens
gggttgaaggcagtctg

SEQ ID NO: 1806536 - DNA, 20 bp, Homo sapiens
gggttggcgcaccctcccct

SEQ ID NO: 1806537 - DNA, 22 bp, Homo sapiens
gggttggcgcaccctcccctcc

SEQ ID NO: 1806538 - DNA, 23 bp, Homo sapiens
ggtaaaaagattatatatcataa

SEQ ID NO: 1806539 - DNA, 14 bp, Homo sapiens
ggtacttcctcctg

SEQ ID NO: 1806540 - DNA, 15 bp, Homo sapiens
ggtacttcctcctga

SEQ ID NO: 1806541 - DNA, 18 bp, Homo sapiens
ggtagatcgcttgagccc

SEQ ID NO: 1806542 - DNA, 12 bp, Homo sapiens
ggtaggcccttg

SEQ ID NO: 1806543 - DNA, 23 bp, Homo sapiens
ggtaggcccttgtcctgccagct

SEQ ID NO: 1806544 - DNA, 23 bp, Homo sapiens
ggtatgaacttgaggacacatgt

SEQ ID NO: 1806545 - DNA, 12 bp, Homo sapiens
ggtatgatcatt

SEQ ID NO: 1806546 - DNA, 15 bp, Homo sapiens
ggtccaggaaggcag

SEQ ID NO: 1806547 - DNA, 17 bp, Homo sapiens
ggtccaggaaggcagct

SEQ ID NO: 1806548 - DNA, 21 bp, Homo sapiens
ggtccaggaaggcagctgctc

SEQ ID NO: 1806549 - DNA, 22 bp, Homo sapiens
ggtccctcgtccacaggggcag

SEQ ID NO: 1806550 - DNA, 18 bp, Homo sapiens
ggtccgcaccagctgctc

SEQ ID NO: 1806551 - DNA, 21 bp, Homo sapiens
ggtccgcaccagctgctctgc

SEQ ID NO: 1806552 - DNA, 21 bp, Homo sapiens
ggtcctagcccagtgcttctc

SEQ ID NO: 1806553 - DNA, 19 bp, Homo sapiens
ggtcctgcaatctccaggg

SEQ ID NO: 1806554 - DNA, 14 bp, Homo sapiens
ggtcctggccctct

SEQ ID NO: 1806555 - DNA, 14 bp, Homo sapiens
ggtctcctccaccg

SEQ ID NO: 1806556 - DNA, 18 bp, Homo sapiens
ggtctccttactctgagc

SEQ ID NO: 1806557 - DNA, 21 bp, Homo sapiens
ggtctcgctgatgctgggctg

SEQ ID NO: 1806558 - DNA, 23 bp, Homo sapiens
ggtctcgctgatgctgggctggg

SEQ ID NO: 1806559 - DNA, 21 bp, Homo sapiens
ggtctgaaggaatagccagag

SEQ ID NO: 1806560 - DNA, 19 bp, Homo sapiens
ggtctgctcgggcccaggc

SEQ ID NO: 1806561 - DNA, 22 bp, Homo sapiens
ggtctgctcgggcccaggccat

SEQ ID NO: 1806562 - DNA, 20 bp, Homo sapiens
ggtctgtgctgtgcctgcta

SEQ ID NO: 1806563 - DNA, 11 bp, Homo sapiens
ggtctgtgtgt

SEQ ID NO: 1806564 - DNA, 18 bp, Homo sapiens
ggtcttgggctactggca

SEQ ID NO: 1806565 - DNA, 15 bp, Homo sapiens
ggtgagaccacctct

SEQ ID NO: 1806566 - DNA, 11 bp, Homo sapiens
ggtgagctggg

SEQ ID NO: 1806567 - DNA, 20 bp, Homo sapiens
ggtgaggcagtgggtcccac

SEQ ID NO: 1806568 - DNA, 15 bp, Homo sapiens
ggtgcagccttcccc

SEQ ID NO: 1806569 - DNA, 15 bp, Homo sapiens
ggtgccactccctga

SEQ ID NO: 1806570 - DNA, 16 bp, Homo sapiens
ggtgccactccctgag

SEQ ID NO: 1806571 - DNA, 17 bp, Homo sapiens
ggtgccactccctgagc

SEQ ID NO: 1806572 - DNA, 19 bp, Homo sapiens
ggtgccactccctgagctt

SEQ ID NO: 1806573 - DNA, 23 bp, Homo sapiens
ggtgccacttcttaaaggcctgg

SEQ ID NO: 1806574 - DNA, 21 bp, Homo sapiens
ggtgcctgattcggctgtctc

SEQ ID NO: 1806575 - DNA, 13 bp, Homo sapiens
ggtgcgtggctgt

SEQ ID NO: 1806576 - DNA, 17 bp, Homo sapiens
ggtgcgtggctgtggca

SEQ ID NO: 1806577 - DNA, 19 bp, Homo sapiens
ggtgctctggcggcttcct

SEQ ID NO: 1806578 - DNA, 20 bp, Homo sapiens
ggtgctctggcggcttcctg

SEQ ID NO: 1806579 - DNA, 20 bp, Homo sapiens
ggtgctgacaatactgctgc

SEQ ID NO: 1806580 - DNA, 20 bp, Homo sapiens
ggtgctgctaccctccctgc

SEQ ID NO: 1806581 - DNA, 22 bp, Homo sapiens
ggtggaggaaggtgctgagctt

SEQ ID NO: 1806582 - DNA, 13 bp, Homo sapiens
ggtggcccatccc

SEQ ID NO: 1806583 - DNA, 15 bp, Homo sapiens
ggtgggcctggcctg

SEQ ID NO: 1806584 - DNA, 12 bp, Homo sapiens
ggtggggctcgt

SEQ ID NO: 1806585 - DNA, 20 bp, Homo sapiens
ggtgggtccaggaaggcagc

SEQ ID NO: 1806586 - DNA, 16 bp, Homo sapiens
ggtggtaccaggtctc

SEQ ID NO: 1806587 - DNA, 19 bp, Homo sapiens
ggtggtctgctcgggccca

SEQ ID NO: 1806588 - DNA, 20 bp, Homo sapiens
ggtgtcgcgccttctccccc

SEQ ID NO: 1806589 - DNA, 21 bp, Homo sapiens
ggtgtcgcgccttctcccccc

SEQ ID NO: 1806590 - DNA, 19 bp, Homo sapiens
ggttaaggtgggtccagga

SEQ ID NO: 1806591 - DNA, 16 bp, Homo sapiens
ggttatctgcctggcc

SEQ ID NO: 1806592 - DNA, 21 bp, Homo sapiens
ggttatctgcctggcctggct

SEQ ID NO: 1806593 - DNA, 23 bp, Homo sapiens
ggttccccacagtgacagtcact

SEQ ID NO: 1806594 - DNA, 19 bp, Homo sapiens
ggttgggagaatgtcagta

SEQ ID NO: 1806595 - DNA, 20 bp, Homo sapiens
ggttttattttgtaattatt

SEQ ID NO: 1806596 - DNA, 15 bp, Homo sapiens
gtaaaaagattatat

SEQ ID NO: 1806597 - DNA, 23 bp, Homo sapiens
gtaaacatttgtaaaaatactgt

SEQ ID NO: 1806598 - DNA, 21 bp, Homo sapiens
gtaaactggatactgtactga

SEQ ID NO: 1806599 - DNA, 14 bp, Homo sapiens
gtaaagaataaatg

SEQ ID NO: 1806600 - DNA, 16 bp, Homo sapiens
gtaaagaataaatgaa

SEQ ID NO: 1806601 - DNA, 18 bp, Homo sapiens
gtaaagaataaatgaatc

SEQ ID NO: 1806602 - DNA, 19 bp, Homo sapiens
gtaacaggccttgagcaca

SEQ ID NO: 1806603 - DNA, 12 bp, Homo sapiens
gtaactgctgag

SEQ ID NO: 1806604 - DNA, 14 bp, Homo sapiens
gtaactgctgagcc

SEQ ID NO: 1806605 - DNA, 18 bp, Homo sapiens
gtaactgctgagccactc

SEQ ID NO: 1806606 - DNA, 16 bp, Homo sapiens
gtaagacttcagattt

SEQ ID NO: 1806607 - DNA, 20 bp, Homo sapiens
gtaagacttcagatttcaaa

SEQ ID NO: 1806608 - DNA, 19 bp, Homo sapiens
gtaagcaacttgcttctaa

SEQ ID NO: 1806609 - DNA, 21 bp, Homo sapiens
gtaagtttgcatatcagtcat

SEQ ID NO: 1806610 - DNA, 19 bp, Homo sapiens
gtaataatgtaatactgta

SEQ ID NO: 1806611 - DNA, 18 bp, Homo sapiens
gtaatactgtagaaatat

SEQ ID NO: 1806612 - DNA, 21 bp, Homo sapiens
gtaatgaaggcatatttccaa

SEQ ID NO: 1806613 - DNA, 14 bp, Homo sapiens
gtaatgcacatcct

SEQ ID NO: 1806614 - DNA, 22 bp, Homo sapiens
gtaatgggatctatttttgcac

SEQ ID NO: 1806615 - DNA, 15 bp, Homo sapiens
gtaatgggcctgccc

SEQ ID NO: 1806616 - DNA, 16 bp, Homo sapiens
gtaatgggcctgccca

SEQ ID NO: 1806617 - DNA, 19 bp, Homo sapiens
gtaatttaaaattgtgatg

SEQ ID NO: 1806618 - DNA, 16 bp, Homo sapiens
gtaattttgtgaaaga

SEQ ID NO: 1806619 - DNA, 14 bp, Homo sapiens
gtacacttcctgtg

SEQ ID NO: 1806620 - DNA, 12 bp, Homo sapiens
gtacccagctcc

SEQ ID NO: 1806621 - DNA, 13 bp, Homo sapiens
gtacccagctcct

SEQ ID NO: 1806622 - DNA, 24 bp, Homo sapiens
gtacccagctccttttgtccccag

SEQ ID NO: 1806623 - DNA, 17 bp, Homo sapiens
gtacccccgcccaggct

SEQ ID NO: 1806624 - DNA, 14 bp, Homo sapiens
gtacccttccacct

SEQ ID NO: 1806625 - DNA, 17 bp, Homo sapiens
gtacctggtgacccctt

SEQ ID NO: 1806626 - DNA, 15 bp, Homo sapiens
gtaccttcaaataat

SEQ ID NO: 1806627 - DNA, 15 bp, Homo sapiens
gtactcagagcagag

SEQ ID NO: 1806628 - DNA, 17 bp, Homo sapiens
gtactcagagcagagca

SEQ ID NO: 1806629 - DNA, 19 bp, Homo sapiens
gtactctctgctctagcca

SEQ ID NO: 1806630 - DNA, 22 bp, Homo sapiens
gtactctctgctctagccagga

SEQ ID NO: 1806631 - DNA, 15 bp, Homo sapiens
gtactgatactattc

SEQ ID NO: 1806632 - DNA, 15 bp, Homo sapiens
gtacttcctcctgat

SEQ ID NO: 1806633 - DNA, 18 bp, Homo sapiens
gtacttcctcctgatggc

SEQ ID NO: 1806634 - DNA, 23 bp, Homo sapiens
gtactttttaatgttatttggaa

SEQ ID NO: 1806635 - DNA, 17 bp, Homo sapiens
gtagaataaatgaagaa

SEQ ID NO: 1806636 - DNA, 15 bp, Homo sapiens
gtagagccagaggtc

SEQ ID NO: 1806637 - DNA, 18 bp, Homo sapiens
gtagatcgcttgagccca

SEQ ID NO: 1806638 - DNA, 20 bp, Homo sapiens
gtagatcgcttgagcccagg

SEQ ID NO: 1806639 - DNA, 19 bp, Homo sapiens
gtagatttttgctcttctg

SEQ ID NO: 1806640 - DNA, 22 bp, Homo sapiens
gtagccatggctcaggcaagcc

SEQ ID NO: 1806641 - DNA, 23 bp, Homo sapiens
gtagcctccgtttatgggccttg

SEQ ID NO: 1806642 - DNA, 23 bp, Homo sapiens
gtagccttgccttttaaaagaaa

SEQ ID NO: 1806643 - DNA, 16 bp, Homo sapiens
gtaggaactgctgggc

SEQ ID NO: 1806644 - DNA, 18 bp, Homo sapiens
tagaggtgggcagctggg

SEQ ID NO: 1806645 - DNA, 19 bp, Homo sapiens
tagaggtgggcagctgggc

SEQ ID NO: 1806646 - DNA, 12 bp, Homo sapiens
tagcaactgtgc

SEQ ID NO: 1806647 - DNA, 13 bp, Homo sapiens
tagcacatgattt

SEQ ID NO: 1806648 - DNA, 18 bp, Homo sapiens
tagccaggagtctgtgct

SEQ ID NO: 1806649 - DNA, 19 bp, Homo sapiens
tagccaggagtctgtgctc

SEQ ID NO: 1806650 - DNA, 14 bp, Homo sapiens
tagccatggctcag

SEQ ID NO: 1806651 - DNA, 15 bp, Homo sapiens
tagccatggctcagg

SEQ ID NO: 1806652 - DNA, 23 bp, Homo sapiens
tagccatggctcaggcaagcccc

SEQ ID NO: 1806653 - DNA, 12 bp, Homo sapiens
tagccctcagtc

SEQ ID NO: 1806654 - DNA, 15 bp, Homo sapiens
tagccgtccatggca

SEQ ID NO: 1806655 - DNA, 16 bp, Homo sapiens
tagccgtccatggcac

SEQ ID NO: 1806656 - DNA, 17 bp, Homo sapiens
tagccgtccatggcacc

SEQ ID NO: 1806657 - DNA, 19 bp, Homo sapiens
tagccgtccatggcaccag

SEQ ID NO: 1806658 - DNA, 20 bp, Homo sapiens
tagccgtccatggcaccagc

SEQ ID NO: 1806659 - DNA, 21 bp, Homo sapiens
tagccttgccttttaaaagaa

SEQ ID NO: 1806660 - DNA, 15 bp, Homo sapiens
tagccttgtgccctg

SEQ ID NO: 1806661 - DNA, 15 bp, Homo sapiens
tagctacttttcaga

SEQ ID NO: 1806662 - DNA, 15 bp, Homo sapiens
tagctggcaggacac

SEQ ID NO: 1806663 - DNA, 15 bp, Homo sapiens
taggaactgctgggc

SEQ ID NO: 1806664 - DNA, 22 bp, Homo sapiens
taggagagactgaaagcagcag

SEQ ID NO: 1806665 - DNA, 17 bp, Homo sapiens
taggataaattacatta

SEQ ID NO: 1806666 - DNA, 19 bp, Homo sapiens
taggataaattacattaaa

SEQ ID NO: 1806667 - DNA, 14 bp, Homo sapiens
taggatactcttaa

SEQ ID NO: 1806668 - DNA, 20 bp, Homo sapiens
taggcccttgtcctgccagc

SEQ ID NO: 1806669 - DNA, 13 bp, Homo sapiens
tagtaatttttta

SEQ ID NO: 1806670 - DNA, 18 bp, Homo sapiens
tagtaattttttacattt

SEQ ID NO: 1806671 - DNA, 12 bp, Homo sapiens
tagtaccttcaa

SEQ ID NO: 1806672 - DNA, 16 bp, Homo sapiens
tagtaccttcaaataa

SEQ ID NO: 1806673 - DNA, 19 bp, Homo sapiens
tagtattcaggcactgaga

SEQ ID NO: 1806674 - DNA, 23 bp, Homo sapiens
tagtattcaggcactgagaatga

SEQ ID NO: 1806675 - DNA, 14 bp, Homo sapiens
tagtgcctagaaag

SEQ ID NO: 1806676 - DNA, 16 bp, Homo sapiens
tagtggaagagcagcc

SEQ ID NO: 1806677 - DNA, 19 bp, Homo sapiens
tagtggaagagcagcctga

SEQ ID NO: 1806678 - DNA, 21 bp, Homo sapiens
tagtggaagagcagcctgatg

SEQ ID NO: 1806679 - DNA, 20 bp, Homo sapiens
tagtgtgagtggcagccatg

SEQ ID NO: 1806680 - DNA, 13 bp, Homo sapiens
tagtgtgtccatg

SEQ ID NO: 1806681 - DNA, 15 bp, Homo sapiens
tagttagccctcagt

SEQ ID NO: 1806682 - DNA, 19 bp, Homo sapiens
tagttatacatcttcatta

SEQ ID NO: 1806683 - DNA, 17 bp, Homo sapiens
tataaaaaatggtgcct

SEQ ID NO: 1806684 - DNA, 11 bp, Homo sapiens
tataaaaacaa

SEQ ID NO: 1806685 - DNA, 20 bp, Homo sapiens
tataaaaacaacaaatactt

SEQ ID NO: 1806686 - DNA, 14 bp, Homo sapiens
tataaataaaattg

SEQ ID NO: 1806687 - DNA, 14 bp, Homo sapiens
tataaatgtaaaaa

SEQ ID NO: 1806688 - DNA, 19 bp, Homo sapiens
tatacttagatcctggtaa

SEQ ID NO: 1806689 - DNA, 14 bp, Homo sapiens
tataggataaatta

SEQ ID NO: 1806690 - DNA, 20 bp, Homo sapiens
tataggataaattacattaa

SEQ ID NO: 1806691 - DNA, 16 bp, Homo sapiens
tataggtttattacaa

SEQ ID NO: 1806692 - DNA, 20 bp, Homo sapiens
tatagttatacatcttcatt

SEQ ID NO: 1806693 - DNA, 13 bp, Homo sapiens
tatagttttgaca

SEQ ID NO: 1806694 - DNA, 17 bp, Homo sapiens
tatataacccactgctg

SEQ ID NO: 1806695 - DNA, 13 bp, Homo sapiens
tatatcataaagt

SEQ ID NO: 1806696 - DNA, 17 bp, Homo sapiens
tatatgctcaaccagaa

SEQ ID NO: 1806697 - DNA, 17 bp, Homo sapiens
tatatttactaaaagaa

SEQ ID NO: 1806698 - DNA, 20 bp, Homo sapiens
tatatttgtaaatttatgtg

SEQ ID NO: 1806699 - DNA, 20 bp, Homo sapiens
tatattttttaaatttacag

SEQ ID NO: 1806700 - DNA, 14 bp, Homo sapiens
tatcagcacgtgtg

SEQ ID NO: 1806701 - DNA, 22 bp, Homo sapiens
tatcaggtaaaatattttccaa

SEQ ID NO: 1806702 - DNA, 22 bp, Homo sapiens
tatcagtcatgactagtgccta

SEQ ID NO: 1806703 - DNA, 17 bp, Homo sapiens
tatcagtgacttctgaa

SEQ ID NO: 1806704 - DNA, 13 bp, Homo sapiens
tatcataaagtat

SEQ ID NO: 1806705 - DNA, 14 bp, Homo sapiens
tatcataaagtatg

SEQ ID NO: 1806706 - DNA, 18 bp, Homo sapiens
tatctactagtaataatg

SEQ ID NO: 1806707 - DNA, 17 bp, Homo sapiens
tatctagaaagaaaaga

SEQ ID NO: 1806708 - DNA, 15 bp, Homo sapiens
tatctatatctctaa

SEQ ID NO: 1806709 - DNA, 20 bp, Homo sapiens
tatctcgctagccatatatt

SEQ ID NO: 1806710 - DNA, 19 bp, Homo sapiens
tatctgagaagtgtatata

SEQ ID NO: 1806711 - DNA, 22 bp, Homo sapiens
tatctgagaattgcaaaactag

SEQ ID NO: 1806712 - DNA, 12 bp, Homo sapiens
tatctgcctggc

SEQ ID NO: 1806713 - DNA, 14 bp, Homo sapiens
tatctgcctggcct

SEQ ID NO: 1806714 - DNA, 16 bp, Homo sapiens
tatctgcctggcctgg

SEQ ID NO: 1806715 - DNA, 12 bp, Homo sapiens
tatctgtactga

SEQ ID NO: 1806716 - DNA, 13 bp, Homo sapiens
tatcttcaaaaat

SEQ ID NO: 1806717 - DNA, 22 bp, Homo sapiens
tatcttcaaaaatacagaattt

SEQ ID NO: 1806718 - DNA, 16 bp, Homo sapiens
tatgaacttgaggaca

SEQ ID NO: 1806719 - DNA, 18 bp, Homo sapiens
tatgaacttgaggacaca

SEQ ID NO: 1806720 - DNA, 19 bp, Homo sapiens
tatgaacttgaggacacat

SEQ ID NO: 1806721 - DNA, 22 bp, Homo sapiens
tatgagaacaagtcacagctgc

SEQ ID NO: 1806722 - DNA, 15 bp, Homo sapiens
tatgagactcttaaa

SEQ ID NO: 1806723 - DNA, 15 bp, Homo sapiens
tatgagagaactatt

SEQ ID NO: 1806724 - DNA, 18 bp, Homo sapiens
tatgagatggccatgctc

SEQ ID NO: 1806725 - DNA, 19 bp, Homo sapiens
tatgagatggccatgctca

SEQ ID NO: 1806726 - DNA, 21 bp, Homo sapiens
tatgagatggccatgctcaac

SEQ ID NO: 1806727 - DNA, 14 bp, Homo sapiens
tatgaggtgaaatg

SEQ ID NO: 1806728 - DNA, 20 bp, Homo sapiens
tatgcctgtactaaggagca

SEQ ID NO: 1806729 - DNA, 11 bp, Homo sapiens
tatgctgggca

SEQ ID NO: 1806730 - DNA, 18 bp, Homo sapiens
tatgctgtagctgaaaga

SEQ ID NO: 1806731 - DNA, 11 bp, Homo sapiens
tatggcaaggg

SEQ ID NO: 1806732 - DNA, 18 bp, Homo sapiens
tatggggatagatgtgtg

SEQ ID NO: 1806733 - DNA, 19 bp, Homo sapiens
tatggggatagatgtgtgg

SEQ ID NO: 1806734 - DNA, 21 bp, Homo sapiens
tatggtaggaactgctgggct

SEQ ID NO: 1806735 - DNA, 16 bp, Homo sapiens
tatgtatatgtatatc

SEQ ID NO: 1806736 - DNA, 17 bp, Homo sapiens
tatgtatatgtatatct

SEQ ID NO: 1806737 - DNA, 15 bp, Homo sapiens
tatgtgaaactctat

SEQ ID NO: 1806738 - DNA, 17 bp, Homo sapiens
tatgtgaaactctatta

SEQ ID NO: 1806739 - DNA, 14 bp, Homo sapiens
tatgtgacaacatt

SEQ ID NO: 1806740 - DNA, 16 bp, Homo sapiens
tatgtgacaacatttt

SEQ ID NO: 1806741 - DNA, 22 bp, Homo sapiens
tatgtgacaacatttttgtaca

SEQ ID NO: 1806742 - DNA, 19 bp, Homo sapiens
tatgtggattttgcatgta

SEQ ID NO: 1806743 - DNA, 18 bp, Homo sapiens
tatgtgggggtctgtgtg

SEQ ID NO: 1806744 - DNA, 11 bp, Homo sapiens
tatgtgtgtgt

SEQ ID NO: 1806745 - DNA, 20 bp, Homo sapiens
tatgttattggaattttctt

SEQ ID NO: 1806746 - DNA, 21 bp, Homo sapiens
tattaaaatgcatatttctat

SEQ ID NO: 1806747 - DNA, 23 bp, Homo sapiens
tattaaaatgcatatttctatgt

SEQ ID NO: 1806748 - DNA, 23 bp, Homo sapiens
tattatataacccactgctgaaa

SEQ ID NO: 1806749 - DNA, 23 bp, Homo sapiens
tattatttctccatcccctccct

SEQ ID NO: 1806750 - DNA, 21 bp, Homo sapiens
tattatttctggctttttgaa

SEQ ID NO: 1806751 - DNA, 13 bp, Homo sapiens
tattcaaatgaag

SEQ ID NO: 1806752 - DNA, 24 bp, Homo sapiens
tattcaagcaacagcactttctgt

SEQ ID NO: 1806753 - DNA, 14 bp, Homo sapiens
tattcaataaagct

SEQ ID NO: 1806754 - DNA, 23 bp, Homo sapiens
tattcagctcactggtttacaaa

SEQ ID NO: 1806755 - DNA, 17 bp, Homo sapiens
tattcaggaaaagcctc

SEQ ID NO: 1806756 - DNA, 18 bp, Homo sapiens
tattcaggcactgagaat

SEQ ID NO: 1806757 - DNA, 16 bp, Homo sapiens
tattcatgctttctcc

SEQ ID NO: 1806758 - DNA, 18 bp, Homo sapiens
tattcatgctttctcctt

SEQ ID NO: 1806759 - DNA, 19 bp, Homo sapiens
tattcatgctttctccttt

SEQ ID NO: 1806760 - DNA, 20 bp, Homo sapiens
tattcatgctttctcctttt

SEQ ID NO: 1806761 - DNA, 14 bp, Homo sapiens
tctgcttttgcatc

SEQ ID NO: 1806762 - DNA, 15 bp, Homo sapiens
tctgcttttgcatct

SEQ ID NO: 1806763 - DNA, 18 bp, Homo sapiens
tctgcttttgcatctttg

SEQ ID NO: 1806764 - DNA, 19 bp, Homo sapiens
tctggaagacgtggctctg

SEQ ID NO: 1806765 - DNA, 14 bp, Homo sapiens
tctggaaggctggc

SEQ ID NO: 1806766 - DNA, 17 bp, Homo sapiens
tctggaaggctggctga

SEQ ID NO: 1806767 - DNA, 21 bp, Homo sapiens
tctggcggcttcctgtccact

SEQ ID NO: 1806768 - DNA, 20 bp, Homo sapiens
tctgggaagggagagttctt

SEQ ID NO: 1806769 - DNA, 14 bp, Homo sapiens
tctgggtgaggtag

SEQ ID NO: 1806770 - DNA, 21 bp, Homo sapiens
tctggtaaacattcctccagc

SEQ ID NO: 1806771 - DNA, 20 bp, Homo sapiens
tctggtggcagtaacatgca

SEQ ID NO: 1806772 - DNA, 16 bp, Homo sapiens
tctgtactgaaagcaa

SEQ ID NO: 1806773 - DNA, 12 bp, Homo sapiens
tctgtccaggcc

SEQ ID NO: 1806774 - DNA, 13 bp, Homo sapiens
tctgtccaggcca

SEQ ID NO: 1806775 - DNA, 14 bp, Homo sapiens
tctgtctgtcccaa

SEQ ID NO: 1806776 - DNA, 18 bp, Homo sapiens
tctgtctgtctgtcccaa

SEQ ID NO: 1806777 - DNA, 16 bp, Homo sapiens
tctgtgcccatgggca

SEQ ID NO: 1806778 - DNA, 21 bp, Homo sapiens
tctgtgcccatgggcactgct

SEQ ID NO: 1806779 - DNA, 17 bp, Homo sapiens
tctgtgtcactggctgc

SEQ ID NO: 1806780 - DNA, 18 bp, Homo sapiens
tctgtgtgtgtgtatgtg

SEQ ID NO: 1806781 - DNA, 22 bp, Homo sapiens
tctgtgtgtgtgtatgtggggg

SEQ ID NO: 1806782 - DNA, 18 bp, Homo sapiens
tctgttggtctacagaaa

SEQ ID NO: 1806783 - DNA, 15 bp, Homo sapiens
tcttaaaggcctgga

SEQ ID NO: 1806784 - DNA, 19 bp, Homo sapiens
tcttaatctcacttcatca

SEQ ID NO: 1806785 - DNA, 15 bp, Homo sapiens
tcttaccgtagcctc

SEQ ID NO: 1806786 - DNA, 17 bp, Homo sapiens
tcttaccgtagcctccg

SEQ ID NO: 1806787 - DNA, 17 bp, Homo sapiens
tcttataggtttccact

SEQ ID NO: 1806788 - DNA, 21 bp, Homo sapiens
tcttattcatgctttctcctt

SEQ ID NO: 1806789 - DNA, 22 bp, Homo sapiens
tcttattcatgctttctccttt

SEQ ID NO: 1806790 - DNA, 17 bp, Homo sapiens
tcttcaaaaatacagaa

SEQ ID NO: 1806791 - DNA, 17 bp, Homo sapiens
tcttcattaatactgtg

SEQ ID NO: 1806792 - DNA, 13 bp, Homo sapiens
tcttcatttctct

SEQ ID NO: 1806793 - DNA, 19 bp, Homo sapiens
tcttccaggtggggtgagg

SEQ ID NO: 1806794 - DNA, 12 bp, Homo sapiens
tcttcctgctgc

SEQ ID NO: 1806795 - DNA, 13 bp, Homo sapiens
tcttcctgctgct

SEQ ID NO: 1806796 - DNA, 14 bp, Homo sapiens
tcttcctgctgctg

SEQ ID NO: 1806797 - DNA, 15 bp, Homo sapiens
tcttcctgctgctgt

SEQ ID NO: 1806798 - DNA, 13 bp, Homo sapiens
tcttcctgtgggg

SEQ ID NO: 1806799 - DNA, 19 bp, Homo sapiens
tcttcctgtgggggaagag

SEQ ID NO: 1806800 - DNA, 19 bp, Homo sapiens
tcttcttgtggttgtatat

SEQ ID NO: 1806801 - DNA, 18 bp, Homo sapiens
tcttgagagaaaagaaaa

SEQ ID NO: 1806802 - DNA, 18 bp, Homo sapiens
tcttgccccaacccccag

SEQ ID NO: 1806803 - DNA, 20 bp, Homo sapiens
tcttgccccaacccccagca

SEQ ID NO: 1806804 - DNA, 22 bp, Homo sapiens
tcttgccccaacccccagcacc

SEQ ID NO: 1806805 - DNA, 16 bp, Homo sapiens
tcttgcctaggccaaa

SEQ ID NO: 1806806 - DNA, 16 bp, Homo sapiens
tcttgggaactccact

SEQ ID NO: 1806807 - DNA, 21 bp, Homo sapiens
tcttgggaactccactctcct

SEQ ID NO: 1806808 - DNA, 14 bp, Homo sapiens
tcttgggctactgg

SEQ ID NO: 1806809 - DNA, 19 bp, Homo sapiens
tcttgggctactggcagct

SEQ ID NO: 1806810 - DNA, 15 bp, Homo sapiens
tctttcaatatcatt

SEQ ID NO: 1806811 - DNA, 14 bp, Homo sapiens
tctttcagatcatt

SEQ ID NO: 1806812 - DNA, 17 bp, Homo sapiens
tctttcatacattatat

SEQ ID NO: 1806813 - DNA, 13 bp, Homo sapiens
tctttgctgcccc

SEQ ID NO: 1806814 - DNA, 20 bp, Homo sapiens
tctttgggacacctcagaaa

SEQ ID NO: 1806815 - DNA, 22 bp, Homo sapiens
tctttgggacacctcagaaaac

SEQ ID NO: 1806816 - DNA, 13 bp, Homo sapiens
tctttgttcatca

SEQ ID NO: 1806817 - DNA, 16 bp, Homo sapiens
tctttgttcatcattg

SEQ ID NO: 1806818 - DNA, 12 bp, Homo sapiens
tcttttcaaaat

SEQ ID NO: 1806819 - DNA, 16 bp, Homo sapiens
tcttttgttttcttca

SEQ ID NO: 1806820 - DNA, 18 bp, Homo sapiens
tgaaaaagaaaaaaatga

SEQ ID NO: 1806821 - DNA, 19 bp, Homo sapiens
tgaaaacatttcaaagctg

SEQ ID NO: 1806822 - DNA, 18 bp, Homo sapiens
tgaaaacttgctgaaaaa

SEQ ID NO: 1806823 - DNA, 20 bp, Homo sapiens
tgaaaatgaatagagagtat

SEQ ID NO: 1806824 - DNA, 20 bp, Homo sapiens
tgaaacccagatcgctgtgt

SEQ ID NO: 1806825 - DNA, 13 bp, Homo sapiens
tgaaagagtatgt

SEQ ID NO: 1806826 - DNA, 23 bp, Homo sapiens
tgaaagcaaatgctttgtgacta

SEQ ID NO: 1806827 - DNA, 17 bp, Homo sapiens
tgaaagcagcagctagg

SEQ ID NO: 1806828 - DNA, 15 bp, Homo sapiens
tgaaagggctatggc

SEQ ID NO: 1806829 - DNA, 19 bp, Homo sapiens
tgaaagggctatggcaagg

SEQ ID NO: 1806830 - DNA, 19 bp, Homo sapiens
tgaaatgggagatggtcag

SEQ ID NO: 1806831 - DNA, 12 bp, Homo sapiens
tgaacaaaagct

SEQ ID NO: 1806832 - DNA, 16 bp, Homo sapiens
tgaacacactcagcag

SEQ ID NO: 1806833 - DNA, 13 bp, Homo sapiens
tgaaccagagctg

SEQ ID NO: 1806834 - DNA, 21 bp, Homo sapiens
tgaaccagagctggaacacaa

SEQ ID NO: 1806835 - DNA, 19 bp, Homo sapiens
tgaaccccatgggcttgga

SEQ ID NO: 1806836 - DNA, 16 bp, Homo sapiens
tgaacccttgtgcttg

SEQ ID NO: 1806837 - DNA, 17 bp, Homo sapiens
tgaacccttgtgcttgg

SEQ ID NO: 1806838 - DNA, 15 bp, Homo sapiens
tgaaccgacttttct

SEQ ID NO: 1806839 - DNA, 13 bp, Homo sapiens
tgaacgttttaat

SEQ ID NO: 1806840 - DNA, 16 bp, Homo sapiens
tgaacgttttaataat

SEQ ID NO: 1806841 - DNA, 17 bp, Homo sapiens
tgaacgttttaataatt

SEQ ID NO: 1806842 - DNA, 16 bp, Homo sapiens
tgaacttacacttgga

SEQ ID NO: 1806843 - DNA, 20 bp, Homo sapiens
tgaacttgaggacacatgtc

SEQ ID NO: 1806844 - DNA, 21 bp, Homo sapiens
tgaacttgaggacacatgtcc

SEQ ID NO: 1806845 - DNA, 22 bp, Homo sapiens
tgaacttgaggacacatgtcca

SEQ ID NO: 1806846 - DNA, 19 bp, Homo sapiens
tgaagaaagggaggcccag

SEQ ID NO: 1806847 - DNA, 14 bp, Homo sapiens
tgaaggcagtctga

SEQ ID NO: 1806848 - DNA, 16 bp, Homo sapiens
tgaaggcagtctgaac

SEQ ID NO: 1806849 - DNA, 22 bp, Homo sapiens
tgaaggggcacaccactgccct

SEQ ID NO: 1806850 - DNA, 14 bp, Homo sapiens
tgaatatgagaaat

SEQ ID NO: 1806851 - DNA, 18 bp, Homo sapiens
tgaatatgagaaatacag

SEQ ID NO: 1806852 - DNA, 22 bp, Homo sapiens
tgaatatgagaaatacagaaga

SEQ ID NO: 1806853 - DNA, 23 bp, Homo sapiens
tgaatatgagaaatacagaagaa

SEQ ID NO: 1806854 - DNA, 16 bp, Homo sapiens
tgaattaatctagaaa

SEQ ID NO: 1806855 - DNA, 15 bp, Homo sapiens
tgaattcttcaacag

SEQ ID NO: 1806856 - DNA, 19 bp, Homo sapiens
tgacaacatttttgtacat

SEQ ID NO: 1806857 - DNA, 22 bp, Homo sapiens
tgacaacatttttgtacattat

SEQ ID NO: 1806858 - DNA, 23 bp, Homo sapiens
tgacaacatttttgtacattatg

SEQ ID NO: 1806859 - DNA, 22 bp, Homo sapiens
tgacaatactgctgccttaccc

SEQ ID NO: 1806860 - DNA, 23 bp, Homo sapiens
tgacaatagttatgcctgtacta

SEQ ID NO: 1806861 - DNA, 20 bp, Homo sapiens
tgacacaagtgtattatttc

SEQ ID NO: 1806862 - DNA, 13 bp, Homo sapiens
tgacacctaccat

SEQ ID NO: 1806863 - DNA, 17 bp, Homo sapiens
tgacacctaccatgctg

SEQ ID NO: 1806864 - DNA, 19 bp, Homo sapiens
tgacacctaccatgctgct

SEQ ID NO: 1806865 - DNA, 23 bp, Homo sapiens
tgacactgcggggcttggctgag

SEQ ID NO: 1806866 - DNA, 16 bp, Homo sapiens
tgacagtcctctccac

SEQ ID NO: 1806867 - DNA, 17 bp, Homo sapiens
tgacagtcctctccacc

SEQ ID NO: 1806868 - DNA, 18 bp, Homo sapiens
tgacattttaaaaaacaa

SEQ ID NO: 1806869 - DNA, 15 bp, Homo sapiens
tgaccactccagaga

SEQ ID NO: 1806870 - DNA, 17 bp, Homo sapiens
tgaccactccagagaag

SEQ ID NO: 1806871 - DNA, 17 bp, Homo sapiens
tgacccttcagggccag

SEQ ID NO: 1806872 - DNA, 21 bp, Homo sapiens
tgacccttcagggccagaagg

SEQ ID NO: 1806873 - DNA, 16 bp, Homo sapiens
tgacctcacttctggc

SEQ ID NO: 1806874 - DNA, 22 bp, Homo sapiens
tgacgccctgcgttggagccac

SEQ ID NO: 1806875 - DNA, 15 bp, Homo sapiens
tgactagtgcctaga

SEQ ID NO: 1806876 - DNA, 17 bp, Homo sapiens
tgactagtgcctagaaa

SEQ ID NO: 1806877 - DNA, 22 bp, Homo sapiens
tggcccatcagtgtacccccgc

SEQ ID NO: 1806878 - DNA, 21 bp, Homo sapiens
tggcccatcccccctcaccag

SEQ ID NO: 1806879 - DNA, 15 bp, Homo sapiens
tggcccccctccagg

SEQ ID NO: 1806880 - DNA, 19 bp, Homo sapiens
tggccctcaaggcctccca

SEQ ID NO: 1806881 - DNA, 22 bp, Homo sapiens
tggccctcaaggcctcccacag

SEQ ID NO: 1806882 - DNA, 23 bp, Homo sapiens
tggccctcaaggcctcccacagt

SEQ ID NO: 1806883 - DNA, 13 bp, Homo sapiens
tggcctcactggc

SEQ ID NO: 1806884 - DNA, 14 bp, Homo sapiens
tggcctcgcctggc

SEQ ID NO: 1806885 - DNA, 15 bp, Homo sapiens
tggcctcgcctggcc

SEQ ID NO: 1806886 - DNA, 12 bp, Homo sapiens
tggcctctttgt

SEQ ID NO: 1806887 - DNA, 15 bp, Homo sapiens
tggcctgctgggaac

SEQ ID NO: 1806888 - DNA, 12 bp, Homo sapiens
tggcctggctcc

SEQ ID NO: 1806889 - DNA, 16 bp, Homo sapiens
tggcctgtgtccagca

SEQ ID NO: 1806890 - DNA, 20 bp, Homo sapiens
tggcctgtgtccagcagctg

SEQ ID NO: 1806891 - DNA, 21 bp, Homo sapiens
tggcctgtgtccagcagctgc

SEQ ID NO: 1806892 - DNA, 22 bp, Homo sapiens
tggccttccccttttgcctggc

SEQ ID NO: 1806893 - DNA, 11 bp, Homo sapiens
tggccttccct

SEQ ID NO: 1806894 - DNA, 18 bp, Homo sapiens
tggccttccctccccaca

SEQ ID NO: 1806895 - DNA, 16 bp, Homo sapiens
tggcgcaccctcccct

SEQ ID NO: 1806896 - DNA, 19 bp, Homo sapiens
tggcgcgggaggcaccagc

SEQ ID NO: 1806897 - DNA, 20 bp, Homo sapiens
tggcgcgggaggcaccagct

SEQ ID NO: 1806898 - DNA, 23 bp, Homo sapiens
tggcgcgggaggcaccagctctg

SEQ ID NO: 1806899 - DNA, 18 bp, Homo sapiens
tggcggcttcctgtccac

SEQ ID NO: 1806900 - DNA, 18 bp, Homo sapiens
tggctcaggcaagcccct

SEQ ID NO: 1806901 - DNA, 19 bp, Homo sapiens
tggctcaggcaagcccctc

SEQ ID NO: 1806902 - DNA, 20 bp, Homo sapiens
tggctccattggtgttgaca

SEQ ID NO: 1806903 - DNA, 23 bp, Homo sapiens
tggctccccacgagtcacctgca

SEQ ID NO: 1806904 - DNA, 14 bp, Homo sapiens
tggctgaaagtaaa

SEQ ID NO: 1806905 - DNA, 13 bp, Homo sapiens
tggctgccaggcg

SEQ ID NO: 1806906 - DNA, 22 bp, Homo sapiens
tggctgccaggcgttggtgcca

SEQ ID NO: 1806907 - DNA, 22 bp, Homo sapiens
tggctgccttgtgaaggaatta

SEQ ID NO: 1806908 - DNA, 16 bp, Homo sapiens
tggctgcgctaacccc

SEQ ID NO: 1806909 - DNA, 20 bp, Homo sapiens
tggctggggcctatcagtgt

SEQ ID NO: 1806910 - DNA, 21 bp, Homo sapiens
tggctggggcctatcagtgtg

SEQ ID NO: 1806911 - DNA, 22 bp, Homo sapiens
tggctggggcctatcagtgtgc

SEQ ID NO: 1806912 - DNA, 12 bp, Homo sapiens
tggctgtccagt

SEQ ID NO: 1806913 - DNA, 14 bp, Homo sapiens
tggctgtggaggcc

SEQ ID NO: 1806914 - DNA, 21 bp, Homo sapiens
tggctgtggaggcctgatgct

SEQ ID NO: 1806915 - DNA, 15 bp, Homo sapiens
tggctgtggcacaga

SEQ ID NO: 1806916 - DNA, 16 bp, Homo sapiens
tggcttatttgtataa

SEQ ID NO: 1806917 - DNA, 22 bp, Homo sapiens
tggcttcctccgtccacccagg

SEQ ID NO: 1806918 - DNA, 23 bp, Homo sapiens
tggcttcctccgtccacccaggc

SEQ ID NO: 1806919 - DNA, 12 bp, Homo sapiens
tggcttgctcca

SEQ ID NO: 1806920 - DNA, 14 bp, Homo sapiens
tggcttgctccagg

SEQ ID NO: 1806921 - DNA, 16 bp, Homo sapiens
tggcttgctccagggt

SEQ ID NO: 1806922 - DNA, 17 bp, Homo sapiens
tggcttgctccagggtc

SEQ ID NO: 1806923 - DNA, 19 bp, Homo sapiens
tggcttgctccagggtctt

SEQ ID NO: 1806924 - DNA, 15 bp, Homo sapiens
tggctttttgaatta

SEQ ID NO: 1806925 - DNA, 24 bp, Homo sapiens
tgggaagctgtactcagagcagag

SEQ ID NO: 1806926 - DNA, 19 bp, Homo sapiens
tgggaaggctaagttcagt

SEQ ID NO: 1806927 - DNA, 19 bp, Homo sapiens
tgggaagggagagttcttt

SEQ ID NO: 1806928 - DNA, 23 bp, Homo sapiens
tgggaagggagagttctttgctg

SEQ ID NO: 1806929 - DNA, 13 bp, Homo sapiens
tgggacccagcta

SEQ ID NO: 1806930 - DNA, 15 bp, Homo sapiens
tgggaggccaaggca

SEQ ID NO: 1806931 - DNA, 17 bp, Homo sapiens
tgggaggccaaggcagg

SEQ ID NO: 1806932 - DNA, 19 bp, Homo sapiens
tgggaggccaaggcaggta

SEQ ID NO: 1806933 - DNA, 21 bp, Homo sapiens
tgggagtgaggatgtctgggc

SEQ ID NO: 1806934 - DNA, 13 bp, Homo sapiens
tgggatgtcctct

SEQ ID NO: 1806935 - DNA, 17 bp, Homo sapiens
tgggattaaagagattg

SEQ ID NO: 1806936 - DNA, 15 bp, Homo sapiens
tgggatttcttcgct

SEQ ID NO: 1806937 - DNA, 22 bp, Homo sapiens
tgggcactgctgggtggcccat

SEQ ID NO: 1806938 - DNA, 12 bp, Homo sapiens
tgggcagctggg

SEQ ID NO: 1806939 - DNA, 18 bp, Homo sapiens
tgggcatccacccagtgc

SEQ ID NO: 1806940 - DNA, 15 bp, Homo sapiens
tgggcattgggctga

SEQ ID NO: 1806941 - DNA, 19 bp, Homo sapiens
tgggcattgggctgacacc

SEQ ID NO: 1806942 - DNA, 19 bp, Homo sapiens
tgggccacacccaggaagg

SEQ ID NO: 1806943 - DNA, 20 bp, Homo sapiens
tgggccacacccaggaaggg

SEQ ID NO: 1806944 - DNA, 21 bp, Homo sapiens
tgggccacacccaggaaggga

SEQ ID NO: 1806945 - DNA, 16 bp, Homo sapiens
tgggccatactggcct

SEQ ID NO: 1806946 - DNA, 20 bp, Homo sapiens
tgggccatactggcctcgcc

SEQ ID NO: 1806947 - DNA, 21 bp, Homo sapiens
tgggccccatgctctgcccca

SEQ ID NO: 1806948 - DNA, 19 bp, Homo sapiens
tgggcctgcttttccagga

SEQ ID NO: 1806949 - DNA, 22 bp, Homo sapiens
tgggcctgcttttccaggatcc

SEQ ID NO: 1806950 - DNA, 23 bp, Homo sapiens
tgggcctgcttttccaggatcct

SEQ ID NO: 1806951 - DNA, 16 bp, Homo sapiens
tgggcctggcctgagc

SEQ ID NO: 1806952 - DNA, 20 bp, Homo sapiens
tgggcctggcctgagctggg

SEQ ID NO: 1806953 - DNA, 12 bp, Homo sapiens
tgggcctgggcc

SEQ ID NO: 1806954 - DNA, 16 bp, Homo sapiens
tgggcctgggcctgct

SEQ ID NO: 1806955 - DNA, 12 bp, Homo sapiens
tgggcctgtgca

SEQ ID NO: 1806956 - DNA, 13 bp, Homo sapiens
tgggcctgtgcag

SEQ ID NO: 1806957 - DNA, 19 bp, Homo sapiens
tgggcctgtgcagcagccc

SEQ ID NO: 1806958 - DNA, 20 bp, Homo sapiens
tgggcctgtgcagcagccca

SEQ ID NO: 1806959 - DNA, 14 bp, Homo sapiens
tgggccttgctttg

SEQ ID NO: 1806960 - DNA, 18 bp, Homo sapiens
tgggcgggcagcacagca

SEQ ID NO: 1806961 - DNA, 19 bp, Homo sapiens
tgggcgggcagcacagcaa

SEQ ID NO: 1806962 - DNA, 23 bp, Homo sapiens
tgggctaccccccctcctgctgc

SEQ ID NO: 1806963 - DNA, 13 bp, Homo sapiens
tgggctactggca

SEQ ID NO: 1806964 - DNA, 15 bp, Homo sapiens
tgggctactggcagc

SEQ ID NO: 1806965 - DNA, 18 bp, Homo sapiens
tgggctactggcagctcc

SEQ ID NO: 1806966 - DNA, 21 bp, Homo sapiens
tgggctagtgtgagtggcagc

SEQ ID NO: 1806967 - DNA, 22 bp, Homo sapiens
tgggctagtgtgagtggcagcc

SEQ ID NO: 1806968 - DNA, 15 bp, Homo sapiens
tgggctcagggctgg

SEQ ID NO: 1806969 - DNA, 17 bp, Homo sapiens
tgggctcctggctgcca

SEQ ID NO: 1806970 - DNA, 18 bp, Homo sapiens
tgggctcctggctgccag

SEQ ID NO: 1806971 - DNA, 17 bp, Homo sapiens
tgggctctgtgggctgc

SEQ ID NO: 1806972 - DNA, 21 bp, Homo sapiens
tgggctctgtgggctgcactc

SEQ ID NO: 1806973 - DNA, 13 bp, Homo sapiens
tgggctgacacct

SEQ ID NO: 1806974 - DNA, 17 bp, Homo sapiens
tgggcttggacttcctg

SEQ ID NO: 1806975 - DNA, 22 bp, Homo sapiens
tgggcttggacttcctggggcc

SEQ ID NO: 1806976 - DNA, 15 bp, Homo sapiens
tgggctttgcaggct

SEQ ID NO: 1806977 - DNA, 20 bp, Homo sapiens
tgggctttgcaggctctggg

SEQ ID NO: 1806978 - DNA, 14 bp, Homo sapiens
tggggaagttcaag

SEQ ID NO: 1806979 - DNA, 15 bp, Homo sapiens
tggggaagttcaagt

SEQ ID NO: 1806980 - DNA, 21 bp, Homo sapiens
tggggacagttggcagagaag

SEQ ID NO: 1806981 - DNA, 23 bp, Homo sapiens
tggggacagttggcagagaaggc

SEQ ID NO: 1806982 - DNA, 20 bp, Homo sapiens
tggggacgccaaggaggtgg

SEQ ID NO: 1806983 - DNA, 19 bp, Homo sapiens
tggggacgtgaacgtttta

SEQ ID NO: 1806984 - DNA, 21 bp, Homo sapiens
tggggacgtgaacgttttaat

SEQ ID NO: 1806985 - DNA, 23 bp, Homo sapiens
tggggagcacttgcgtcctgcag

SEQ ID NO: 1806986 - DNA, 14 bp, Homo sapiens
tggggagggatttg

SEQ ID NO: 1806987 - DNA, 17 bp, Homo sapiens
tggggatagatgtgtgg

SEQ ID NO: 1806988 - DNA, 21 bp, Homo sapiens
tggggcatggttccttccctg

SEQ ID NO: 1806989 - DNA, 18 bp, Homo sapiens
tggggcatgtgtgcctgt

SEQ ID NO: 1806990 - DNA, 22 bp, Homo sapiens
tggggcctatcagtgtgccccc

SEQ ID NO: 1806991 - DNA, 11 bp, Homo sapiens
tggggcctggc

SEQ ID NO: 1806992 - DNA, 12 bp, Homo sapiens
tttcatacatta

SEQ ID NO: 1806993 - DNA, 15 bp, Homo sapiens
tttcatacattatat

SEQ ID NO: 1806994 - DNA, 17 bp, Homo sapiens
tttcatacattatattc

SEQ ID NO: 1806995 - DNA, 15 bp, Homo sapiens
tttcatctcttcaat

SEQ ID NO: 1806996 - DNA, 23 bp, Homo sapiens
tttcattatctgtactgaaagca

SEQ ID NO: 1806997 - DNA, 19 bp, Homo sapiens
tttccaggatcctgcagga

SEQ ID NO: 1806998 - DNA, 19 bp, Homo sapiens
tttccaggcccctgaggac

SEQ ID NO: 1806999 - DNA, 14 bp, Homo sapiens
tttccataaggatt

SEQ ID NO: 1807000 - DNA, 22 bp, Homo sapiens
tttccattcatgccaaagcaaa

SEQ ID NO: 1807001 - DNA, 12 bp, Homo sapiens
tttcccactgca

SEQ ID NO: 1807002 - DNA, 16 bp, Homo sapiens
tttcccgtggccccag

SEQ ID NO: 1807003 - DNA, 21 bp, Homo sapiens
tttcccgtggccccagcctgg

SEQ ID NO: 1807004 - DNA, 12 bp, Homo sapiens
tttcctcatttt

SEQ ID NO: 1807005 - DNA, 13 bp, Homo sapiens
tttcctttgcacc

SEQ ID NO: 1807006 - DNA, 17 bp, Homo sapiens
tttcgaataaagtgaat

SEQ ID NO: 1807007 - DNA, 19 bp, Homo sapiens
tttctaaagctctgaacaa

SEQ ID NO: 1807008 - DNA, 20 bp, Homo sapiens
tttctaagttaaatcatttt

SEQ ID NO: 1807009 - DNA, 21 bp, Homo sapiens
tttctaagttaaatcattttc

SEQ ID NO: 1807010 - DNA, 20 bp, Homo sapiens
tttctccatcccctccctgc

SEQ ID NO: 1807011 - DNA, 15 bp, Homo sapiens
tttctcctcatttaa

SEQ ID NO: 1807012 - DNA, 22 bp, Homo sapiens
tttctgagtagcatatataatt

SEQ ID NO: 1807013 - DNA, 19 bp, Homo sapiens
tttctggctttttgaatta

SEQ ID NO: 1807014 - DNA, 17 bp, Homo sapiens
tttcttggtatgatcat

SEQ ID NO: 1807015 - DNA, 16 bp, Homo sapiens
tttctttcagatcatt

SEQ ID NO: 1807016 - DNA, 20 bp, Homo sapiens
tttcttttgttttcttcatt

SEQ ID NO: 1807017 - DNA, 20 bp, Homo sapiens
tttgaagaaaacacaacatt

SEQ ID NO: 1807018 - DNA, 22 bp, Homo sapiens
tttgaatgtgattttaaagagt

SEQ ID NO: 1807019 - DNA, 21 bp, Homo sapiens
tttgaattaatctagaaaatg

SEQ ID NO: 1807020 - DNA, 12 bp, Homo sapiens
tttgacaaaaat

SEQ ID NO: 1807021 - DNA, 23 bp, Homo sapiens
tttgacaaaaatgtttgtacttt

SEQ ID NO: 1807022 - DNA, 15 bp, Homo sapiens
tttgagacaagccct

SEQ ID NO: 1807023 - DNA, 15 bp, Homo sapiens
tttgagtttctttca

SEQ ID NO: 1807024 - DNA, 22 bp, Homo sapiens
tttgagtttctttcagatcatt

SEQ ID NO: 1807025 - DNA, 13 bp, Homo sapiens
tttgatattgaga

SEQ ID NO: 1807026 - DNA, 18 bp, Homo sapiens
tttgcacccatgccatag

SEQ ID NO: 1807027 - DNA, 21 bp, Homo sapiens
tttgcaggctctgggctcagg

SEQ ID NO: 1807028 - DNA, 16 bp, Homo sapiens
tttgcatatcagtcat

SEQ ID NO: 1807029 - DNA, 18 bp, Homo sapiens
tttgccaaggctctcccc

SEQ ID NO: 1807030 - DNA, 20 bp, Homo sapiens
tttgccaaggctctcccctc

SEQ ID NO: 1807031 - DNA, 11 bp, Homo sapiens
tttgcctggct

SEQ ID NO: 1807032 - DNA, 12 bp, Homo sapiens
tttgcctggctg

SEQ ID NO: 1807033 - DNA, 19 bp, Homo sapiens
tttgctgaattcctttaca

SEQ ID NO: 1807034 - DNA, 16 bp, Homo sapiens
tttggacgtgtgagga

SEQ ID NO: 1807035 - DNA, 21 bp, Homo sapiens
tttggagtcagtaggtccaag

SEQ ID NO: 1807036 - DNA, 20 bp, Homo sapiens
tttggatctccaattgcctc

SEQ ID NO: 1807037 - DNA, 14 bp, Homo sapiens
tttgggaggccaag

SEQ ID NO: 1807038 - DNA, 18 bp, Homo sapiens
tttggggaagttcaagtg

SEQ ID NO: 1807039 - DNA, 13 bp, Homo sapiens
tttgtaaaaatac

SEQ ID NO: 1807040 - DNA, 12 bp, Homo sapiens
tttgtaattatt

SEQ ID NO: 1807041 - DNA, 14 bp, Homo sapiens
tttgtaattattgt

SEQ ID NO: 1807042 - DNA, 13 bp, Homo sapiens
tttgtacattatg

SEQ ID NO: 1807043 - DNA, 18 bp, Homo sapiens
tttgtacattatgttatt

SEQ ID NO: 1807044 - DNA, 22 bp, Homo sapiens
tttgtacattatgttattggaa

SEQ ID NO: 1807045 - DNA, 20 bp, Homo sapiens
tttgtccccagggcccctcc

SEQ ID NO: 1807046 - DNA, 17 bp, Homo sapiens
tttgtcctgactgtctg

SEQ ID NO: 1807047 - DNA, 20 bp, Homo sapiens
tttgtcctgactgtctgcta

SEQ ID NO: 1807048 - DNA, 13 bp, Homo sapiens
tttgttttcttca

SEQ ID NO: 1807049 - DNA, 16 bp, Homo sapiens
tttgttttcttcattt

SEQ ID NO: 1807050 - DNA, 20 bp, Homo sapiens
ttttaaagagtgaaaaatga

SEQ ID NO: 1807051 - DNA, 15 bp, Homo sapiens
ttttaacaaaaaagg

SEQ ID NO: 1807052 - DNA, 20 bp, Homo sapiens
ttttacagtatcttcaaaaa

SEQ ID NO: 1807053 - DNA, 20 bp, Homo sapiens
ttttaccaactctatactca

SEQ ID NO: 1807054 - DNA, 17 bp, Homo sapiens
ttttatttccacataaa

SEQ ID NO: 1807055 - DNA, 20 bp, Homo sapiens
ttttatttccacataaaggt

SEQ ID NO: 1807056 - DNA, 20 bp, Homo sapiens
ttttattttgtaattattgt

SEQ ID NO: 1807057 - DNA, 20 bp, Homo sapiens
ttttcagaaagtttgaagca

SEQ ID NO: 1807058 - DNA, 12 bp, Homo sapiens
ttttcagcttct

SEQ ID NO: 1807059 - DNA, 15 bp, Homo sapiens
ttttcagcttctgct

SEQ ID NO: 1807060 - DNA, 20 bp, Homo sapiens
ttttcagcttctgctgggct

SEQ ID NO: 1807061 - DNA, 22 bp, Homo sapiens
ttttcaggtaggcccttgtcct

SEQ ID NO: 1807062 - DNA, 10 bp, Homo sapiens
ttttcctgtg

SEQ ID NO: 1807063 - DNA, 21 bp, Homo sapiens
ttttgaagaaaacacaacatt

SEQ ID NO: 1807064 - DNA, 14 bp, Homo sapiens
ttttgacaaaaatg

SEQ ID NO: 1807065 - DNA, 18 bp, Homo sapiens
ttttgagtgtatgctgta

SEQ ID NO: 1807066 - DNA, 12 bp, Homo sapiens
ttttgcctggct

SEQ ID NO: 1807067 - DNA, 22 bp, Homo sapiens
ttttgcctggctgtggaggcct

SEQ ID NO: 1807068 - DNA, 20 bp, Homo sapiens
ttttgctcttctgtatgtga

SEQ ID NO: 1807069 - DNA, 17 bp, Homo sapiens
ttttgtaattattgtga

SEQ ID NO: 1807070 - DNA, 13 bp, Homo sapiens
ttttgtacattat

SEQ ID NO: 1807071 - DNA, 15 bp, Homo sapiens
ttttgtacattatgt

SEQ ID NO: 1807072 - DNA, 17 bp, Homo sapiens
ttttgtacattatgtta

SEQ ID NO: 1807073 - DNA, 13 bp, Homo sapiens
ttttgttcctgtg

SEQ ID NO: 1807074 - DNA, 14 bp, Homo sapiens
ttttgttttcttca

SEQ ID NO: 1807075 - DNA, 18 bp, Homo sapiens
tttttaaatttacagaat

SEQ ID NO: 1807076 - DNA, 15 bp, Homo sapiens
tttttaattgcaaca

SEQ ID NO: 1807077 - DNA, 18 bp, Homo sapiens
tttttacattttcctgtg

SEQ ID NO: 1807078 - DNA, 13 bp, Homo sapiens
tttttattatttg

SEQ ID NO: 1807079 - DNA, 13 bp, Homo sapiens
tttttcagaaagt

SEQ ID NO: 1807080 - DNA, 16 bp, Homo sapiens
tttttcagaaagtttg

SEQ ID NO: 1807081 - DNA, 22 bp, Homo sapiens
tttttgaattaatctagaaaat

SEQ ID NO: 1807082 - DNA, 14 bp, Homo sapiens
tttttgtacattat

SEQ ID NO: 1807083 - DNA, 16 bp, Homo sapiens
tttttgtacctggtga

SEQ ID NO: 1807084 - DNA, 14 bp, Homo sapiens
tttttgtgaaattc

SEQ ID NO: 1807085 - DNA, 23 bp, Homo sapiens
agagcagcttctgccacttccca

SEQ ID NO: 1807086 - DNA, 19 bp, Homo sapiens
agagcatcgtgacccttca

SEQ ID NO: 1807087 - DNA, 22 bp, Homo sapiens
agagcatcgtgacccttcaggg

SEQ ID NO: 1807088 - DNA, 12 bp, Homo sapiens
agagccagcctg

SEQ ID NO: 1807089 - DNA, 13 bp, Homo sapiens
agagccatgggcc

SEQ ID NO: 1807090 - DNA, 14 bp, Homo sapiens
agagccatgggcct

SEQ ID NO: 1807091 - DNA, 15 bp, Homo sapiens
agagccatgggcctg

SEQ ID NO: 1807092 - DNA, 18 bp, Homo sapiens
agagccatgggcctgggc

SEQ ID NO: 1807093 - DNA, 19 bp, Homo sapiens
agagccatgggcctgggcc

SEQ ID NO: 1807094 - DNA, 15 bp, Homo sapiens
agagccatgtgtcat

SEQ ID NO: 1807095 - DNA, 19 bp, Homo sapiens
agagccctgggtgacttca

SEQ ID NO: 1807096 - DNA, 17 bp, Homo sapiens
agagctcttcaagctgt

SEQ ID NO: 1807097 - DNA, 15 bp, Homo sapiens
agagctggaacacaa

SEQ ID NO: 1807098 - DNA, 14 bp, Homo sapiens
agagctggaaggca

SEQ ID NO: 1807099 - DNA, 16 bp, Homo sapiens
agagctggaaggcagg

SEQ ID NO: 1807100 - DNA, 18 bp, Homo sapiens
agagctgggaaattcatg

SEQ ID NO: 1807101 - DNA, 10 bp, Homo sapiens
agagctgggc

SEQ ID NO: 1807102 - DNA, 20 bp, Homo sapiens
agaggacagtatttgtgggg

SEQ ID NO: 1807103 - DNA, 14 bp, Homo sapiens
agaggagcacctga

SEQ ID NO: 1807104 - DNA, 19 bp, Homo sapiens
agaggcatttaaaatggaa

SEQ ID NO: 1807105 - DNA, 16 bp, Homo sapiens
agaggctaagatgaga

SEQ ID NO: 1807106 - DNA, 17 bp, Homo sapiens
agagggaatggatgggg

SEQ ID NO: 1807107 - DNA, 18 bp, Homo sapiens
agagggaatgttccctgc

SEQ ID NO: 1807108 - DNA, 20 bp, Homo sapiens
agagggcagtacctgggaaa

SEQ ID NO: 1807109 - DNA, 20 bp, Homo sapiens
agagggcccagctgtagcca

SEQ ID NO: 1807110 - DNA, 12 bp, Homo sapiens
agaggtgggcag

SEQ ID NO: 1807111 - DNA, 13 bp, Homo sapiens
agaggtgggcagc

SEQ ID NO: 1807112 - DNA, 20 bp, Homo sapiens
agaggtgggcagctgggccc

SEQ ID NO: 1807113 - DNA, 20 bp, Homo sapiens
agaggttaaggtgggtccag

SEQ ID NO: 1807114 - DNA, 16 bp, Homo sapiens
agaggttatctgcctg

SEQ ID NO: 1807115 - DNA, 19 bp, Homo sapiens
agaggttatctgcctggcc

SEQ ID NO: 1807116 - DNA, 21 bp, Homo sapiens
agaggttatctgcctggcctg

SEQ ID NO: 1807117 - DNA, 14 bp, Homo sapiens
agagtatgtacgta

SEQ ID NO: 1807118 - DNA, 15 bp, Homo sapiens
agagtctatcaacat

SEQ ID NO: 1807119 - DNA, 22 bp, Homo sapiens
agagttattcaaatgaaggtgg

SEQ ID NO: 1807120 - DNA, 18 bp, Homo sapiens
agagttctttgctgcccc

SEQ ID NO: 1807121 - DNA, 15 bp, Homo sapiens
agatatacaaaaaca

SEQ ID NO: 1807122 - DNA, 15 bp, Homo sapiens
agatcgctgtgttac

SEQ ID NO: 1807123 - DNA, 17 bp, Homo sapiens
agatcgcttgagcccag

SEQ ID NO: 1807124 - DNA, 13 bp, Homo sapiens
agatctgcctggg

SEQ ID NO: 1807125 - DNA, 20 bp, Homo sapiens
agatctttttgtgaaattca

SEQ ID NO: 1807126 - DNA, 19 bp, Homo sapiens
agatgagatttgccagcac

SEQ ID NO: 1807127 - DNA, 14 bp, Homo sapiens
agatggccatgctc

SEQ ID NO: 1807128 - DNA, 14 bp, Homo sapiens
agatggggtcttgc

SEQ ID NO: 1807129 - DNA, 23 bp, Homo sapiens
agatggtcagtgtggagaggggt

SEQ ID NO: 1807130 - DNA, 18 bp, Homo sapiens
agattatatatcataaag

SEQ ID NO: 1807131 - DNA, 15 bp, Homo sapiens
agattcctgggcctg

SEQ ID NO: 1807132 - DNA, 16 bp, Homo sapiens
agattcctgggcctgt

SEQ ID NO: 1807133 - DNA, 18 bp, Homo sapiens
agattgtgcgttcaaacc

SEQ ID NO: 1807134 - DNA, 13 bp, Homo sapiens
agatttgccagca

SEQ ID NO: 1807135 - DNA, 15 bp, Homo sapiens
agatttgccagcaca

SEQ ID NO: 1807136 - DNA, 15 bp, Homo sapiens
agcaaaatttctgta

SEQ ID NO: 1807137 - DNA, 17 bp, Homo sapiens
agcaaatgctttgtgac

SEQ ID NO: 1807138 - DNA, 23 bp, Homo sapiens
agcaaatgctttgtgactattaa

SEQ ID NO: 1807139 - DNA, 16 bp, Homo sapiens
agcaacttgcttctaa

SEQ ID NO: 1807140 - DNA, 20 bp, Homo sapiens
agcaaggacaacctgcccct

SEQ ID NO: 1807141 - DNA, 17 bp, Homo sapiens
agcaaggaggctggctg

SEQ ID NO: 1807142 - DNA, 15 bp, Homo sapiens
agcaaggatatcaga

SEQ ID NO: 1807143 - DNA, 13 bp, Homo sapiens
agcaaggcacctg

SEQ ID NO: 1807144 - DNA, 15 bp, Homo sapiens
agcaaggggctctgc

SEQ ID NO: 1807145 - DNA, 13 bp, Homo sapiens
agcacagccctcc

SEQ ID NO: 1807146 - DNA, 12 bp, Homo sapiens
agcacagccctg

SEQ ID NO: 1807147 - DNA, 17 bp, Homo sapiens
agcacagccctgggagg

SEQ ID NO: 1807148 - DNA, 15 bp, Homo sapiens
agcacaggggcccca

SEQ ID NO: 1807149 - DNA, 16 bp, Homo sapiens
agcacaggggccccag

SEQ ID NO: 1807150 - DNA, 12 bp, Homo sapiens
agcaccctgggt

SEQ ID NO: 1807151 - DNA, 13 bp, Homo sapiens
agcaccctgggtg

SEQ ID NO: 1807152 - DNA, 15 bp, Homo sapiens
agcacctgaacccca

SEQ ID NO: 1807153 - DNA, 19 bp, Homo sapiens
agcacttgcgtcctgcaga

SEQ ID NO: 1807154 - DNA, 20 bp, Homo sapiens
agcacttgcgtcctgcagag

SEQ ID NO: 1807155 - DNA, 13 bp, Homo sapiens
agcagcagagagc

SEQ ID NO: 1807156 - DNA, 12 bp, Homo sapiens
agcagccagcca

SEQ ID NO: 1807157 - DNA, 15 bp, Homo sapiens
agcagccagccagtc

SEQ ID NO: 1807158 - DNA, 21 bp, Homo sapiens
agcagccagccagtcttgcct

SEQ ID NO: 1807159 - DNA, 17 bp, Homo sapiens
atgtggcaaagtgctgt

SEQ ID NO: 1807160 - DNA, 20 bp, Homo sapiens
atgtggcaaagtgctgtacc

SEQ ID NO: 1807161 - DNA, 16 bp, Homo sapiens
atgtgggggtctgtgt

SEQ ID NO: 1807162 - DNA, 14 bp, Homo sapiens
atgtgtagttaatt

SEQ ID NO: 1807163 - DNA, 15 bp, Homo sapiens
atgtgtcatgtaata

SEQ ID NO: 1807164 - DNA, 18 bp, Homo sapiens
atgtgtgaattctgcaac

SEQ ID NO: 1807165 - DNA, 15 bp, Homo sapiens
atgtgtgcctgtggc

SEQ ID NO: 1807166 - DNA, 16 bp, Homo sapiens
atgtgtgcctgtggca

SEQ ID NO: 1807167 - DNA, 23 bp, Homo sapiens
atgtgtgcctgtggcagaaaaga

SEQ ID NO: 1807168 - DNA, 10 bp, Homo sapiens
atgtgtgtgt

SEQ ID NO: 1807169 - DNA, 18 bp, Homo sapiens
atgtgtgtgtgttgtgtg

SEQ ID NO: 1807170 - DNA, 22 bp, Homo sapiens
atgtgtgtgtgttgtgtgtggg

SEQ ID NO: 1807171 - DNA, 12 bp, Homo sapiens
atgttattggaa

SEQ ID NO: 1807172 - DNA, 16 bp, Homo sapiens
atgttattggaatttt

SEQ ID NO: 1807173 - DNA, 17 bp, Homo sapiens
atgttattggaattttc

SEQ ID NO: 1807174 - DNA, 18 bp, Homo sapiens
atgttccctgcaccctgg

SEQ ID NO: 1807175 - DNA, 19 bp, Homo sapiens
atgttccctgcaccctgga

SEQ ID NO: 1807176 - DNA, 24 bp, Homo sapiens
attttcttatgtaagtttgcatat

SEQ ID NO: 1807177 - DNA, 16 bp, Homo sapiens
attttctttcatacat

SEQ ID NO: 1807178 - DNA, 18 bp, Homo sapiens
attttctttcatacatta

SEQ ID NO: 1807179 - DNA, 21 bp, Homo sapiens
attttctttcatacattatat

SEQ ID NO: 1807180 - DNA, 17 bp, Homo sapiens
attttgaagaaaacaca

SEQ ID NO: 1807181 - DNA, 18 bp, Homo sapiens
attttggacgtgtgagga

SEQ ID NO: 1807182 - DNA, 22 bp, Homo sapiens
attttgtaattattgtgatttc

SEQ ID NO: 1807183 - DNA, 17 bp, Homo sapiens
attttgtacaaagatat

SEQ ID NO: 1807184 - DNA, 14 bp, Homo sapiens
attttgtatgtcaa

SEQ ID NO: 1807185 - DNA, 14 bp, Homo sapiens
attttgtcgaattt

SEQ ID NO: 1807186 - DNA, 23 bp, Homo sapiens
atttttaccaactctatactcaa

SEQ ID NO: 1807187 - DNA, 11 bp, Homo sapiens
atttttcagag

SEQ ID NO: 1807188 - DNA, 19 bp, Homo sapiens
atttttcagagttttctaa

SEQ ID NO: 1807189 - DNA, 16 bp, Homo sapiens
atttttcatctcttca

SEQ ID NO: 1807190 - DNA, 18 bp, Homo sapiens
atttttcatctcttcaat

SEQ ID NO: 1807191 - DNA, 22 bp, Homo sapiens
atttttctagtcagtaaacatt

SEQ ID NO: 1807192 - DNA, 12 bp, Homo sapiens
atttttctcatg

SEQ ID NO: 1807193 - DNA, 17 bp, Homo sapiens
atttttgaatgtgattt

SEQ ID NO: 1807194 - DNA, 20 bp, Homo sapiens
atttttgcactggaatatct

SEQ ID NO: 1807195 - DNA, 23 bp, Homo sapiens
atttttgctcttctgtatgtgac

SEQ ID NO: 1807196 - DNA, 17 bp, Homo sapiens
atttttgtacattatgt

SEQ ID NO: 1807197 - DNA, 20 bp, Homo sapiens
atttttgtacattatgttat

SEQ ID NO: 1807198 - DNA, 16 bp, Homo sapiens
attttttaaatttaca

SEQ ID NO: 1807199 - DNA, 19 bp, Homo sapiens
attttttaaatttacagaa

SEQ ID NO: 1807200 - DNA, 17 bp, Homo sapiens
attttttacattttcct

SEQ ID NO: 1807201 - DNA, 20 bp, Homo sapiens
attttttacattttcctgtg

SEQ ID NO: 1807202 - DNA, 16 bp, Homo sapiens
attttttatttccaca

SEQ ID NO: 1807203 - DNA, 19 bp, Homo sapiens
caaaaacatacttcaaaaa

SEQ ID NO: 1807204 - DNA, 16 bp, Homo sapiens
caaaaagtttcctttt

SEQ ID NO: 1807205 - DNA, 16 bp, Homo sapiens
caaaaatacagaattt

SEQ ID NO: 1807206 - DNA, 14 bp, Homo sapiens
caaaaatgttccct

SEQ ID NO: 1807207 - DNA, 21 bp, Homo sapiens
caaaaatgttcccttgaccat

SEQ ID NO: 1807208 - DNA, 22 bp, Homo sapiens
caaaaatgttcccttgaccatt

SEQ ID NO: 1807209 - DNA, 14 bp, Homo sapiens
caaaaatgtttgta

SEQ ID NO: 1807210 - DNA, 23 bp, Homo sapiens
caaaaatgtttgtactttttaat

SEQ ID NO: 1807211 - DNA, 20 bp, Homo sapiens
caaaaatttctgcttttgca

SEQ ID NO: 1807212 - DNA, 11 bp, Homo sapiens
caaaacaatgc

SEQ ID NO: 1807213 - DNA, 12 bp, Homo sapiens
caaaagaagtaa

SEQ ID NO: 1807214 - DNA, 16 bp, Homo sapiens
caaaagccaagaaagt

SEQ ID NO: 1807215 - DNA, 24 bp, Homo sapiens
caaaaggtaatgcacatcctcatt

SEQ ID NO: 1807216 - DNA, 13 bp, Homo sapiens
caaaattgttgca

SEQ ID NO: 1807217 - DNA, 13 bp, Homo sapiens
caaaccccagccc

SEQ ID NO: 1807218 - DNA, 18 bp, Homo sapiens
caaaccccagccccaact

SEQ ID NO: 1807219 - DNA, 15 bp, Homo sapiens
caaagaactgcccca

SEQ ID NO: 1807220 - DNA, 22 bp, Homo sapiens
caaagaactgccccatctcctc

SEQ ID NO: 1807221 - DNA, 23 bp, Homo sapiens
caaagagccatgtgtcatgtaat

SEQ ID NO: 1807222 - DNA, 20 bp, Homo sapiens
caaagatatgctaagcagta

SEQ ID NO: 1807223 - DNA, 17 bp, Homo sapiens
caaagcaagggctccag

SEQ ID NO: 1807224 - DNA, 16 bp, Homo sapiens
caaagggcagtaaagt

SEQ ID NO: 1807225 - DNA, 16 bp, Homo sapiens
caaaggggctgctggg

SEQ ID NO: 1807226 - DNA, 17 bp, Homo sapiens
caaaggggctgctgggg

SEQ ID NO: 1807227 - DNA, 20 bp, Homo sapiens
caaaggggctgctggggcat

SEQ ID NO: 1807228 - DNA, 13 bp, Homo sapiens
caaagttatattt

SEQ ID NO: 1807229 - DNA, 14 bp, Homo sapiens
caaagttatattta

SEQ ID NO: 1807230 - DNA, 13 bp, Homo sapiens
caaataaactagt

SEQ ID NO: 1807231 - DNA, 20 bp, Homo sapiens
caaatgagcattagctactt

SEQ ID NO: 1807232 - DNA, 18 bp, Homo sapiens
caaatgtaaaataagtat

SEQ ID NO: 1807233 - DNA, 17 bp, Homo sapiens
caaattaatctttctat

SEQ ID NO: 1807234 - DNA, 23 bp, Homo sapiens
caaattgcttctaggagtcaact

SEQ ID NO: 1807235 - DNA, 13 bp, Homo sapiens
caacaagttgcct

SEQ ID NO: 1807236 - DNA, 16 bp, Homo sapiens
caacaatggggtgggc

SEQ ID NO: 1807237 - DNA, 17 bp, Homo sapiens
caacagatttctaagtt

SEQ ID NO: 1807238 - DNA, 23 bp, Homo sapiens
caacagatttctaagttaaatca

SEQ ID NO: 1807239 - DNA, 18 bp, Homo sapiens
caacagcttttcccagga

SEQ ID NO: 1807240 - DNA, 20 bp, Homo sapiens
caacagcttttcccaggaga

SEQ ID NO: 1807241 - DNA, 20 bp, Homo sapiens
caacagtgttaggcctggca

SEQ ID NO: 1807242 - DNA, 22 bp, Homo sapiens
caacagtgttaggcctggcaca

SEQ ID NO: 1807243 - DNA, 16 bp, Homo sapiens
caacattgaatatcag

SEQ ID NO: 1807244 - DNA, 22 bp, Homo sapiens
caacattgaatatcagttgaca

SEQ ID NO: 1807245 - DNA, 19 bp, Homo sapiens
caacatttttgtacattat

SEQ ID NO: 1807246 - DNA, 21 bp, Homo sapiens
caacatttttgtacattatgt

SEQ ID NO: 1807247 - DNA, 16 bp, Homo sapiens
caacccagccgctgcc

SEQ ID NO: 1807248 - DNA, 17 bp, Homo sapiens
caacccagccgctgccc

SEQ ID NO: 1807249 - DNA, 18 bp, Homo sapiens
caacccagccgctgcccg

SEQ ID NO: 1807250 - DNA, 13 bp, Homo sapiens
caacccccagcac

SEQ ID NO: 1807251 - DNA, 20 bp, Homo sapiens
caacccccagcacccgggct

SEQ ID NO: 1807252 - DNA, 14 bp, Homo sapiens
caacccccctccca

SEQ ID NO: 1807253 - DNA, 15 bp, Homo sapiens
caacccccctcccag

SEQ ID NO: 1807254 - DNA, 18 bp, Homo sapiens
caacccccctcccagaca

SEQ ID NO: 1807255 - DNA, 19 bp, Homo sapiens
caaccccgcggtgctctgg

SEQ ID NO: 1807256 - DNA, 12 bp, Homo sapiens
caacccctgtac

SEQ ID NO: 1807257 - DNA, 13 bp, Homo sapiens
caactccttactt

SEQ ID NO: 1807258 - DNA, 16 bp, Homo sapiens
caactggctggccagt

SEQ ID NO: 1807259 - DNA, 19 bp, Homo sapiens
caactgtgaatatgagaaa

SEQ ID NO: 1807260 - DNA, 13 bp, Homo sapiens
caacttgcttcta

SEQ ID NO: 1807261 - DNA, 14 bp, Homo sapiens
caacttgcttctaa

SEQ ID NO: 1807262 - DNA, 15 bp, Homo sapiens
caacttgcttctaaa

SEQ ID NO: 1807263 - DNA, 22 bp, Homo sapiens
caacttgcttctaaatgcccag

SEQ ID NO: 1807264 - DNA, 21 bp, Homo sapiens
caagaaaaatataaaaacaac

SEQ ID NO: 1807265 - DNA, 15 bp, Homo sapiens
caagatgtttatctg

SEQ ID NO: 1807266 - DNA, 15 bp, Homo sapiens
caagcaaaatttctg

SEQ ID NO: 1807267 - DNA, 19 bp, Homo sapiens
caagcaaggatatcagagc

SEQ ID NO: 1807268 - DNA, 21 bp, Homo sapiens
caagcactttacgctgtctgt

SEQ ID NO: 1807269 - DNA, 12 bp, Homo sapiens
caagcagccagc

SEQ ID NO: 1807270 - DNA, 13 bp, Homo sapiens
caagcagccagcc

SEQ ID NO: 1807271 - DNA, 19 bp, Homo sapiens
caagcagggaaagctccac

SEQ ID NO: 1807272 - DNA, 23 bp, Homo sapiens
caagcagggaaagctccacggtg

SEQ ID NO: 1807273 - DNA, 15 bp, Homo sapiens
caagccccagggcct

SEQ ID NO: 1807274 - DNA, 18 bp, Homo sapiens
caagcccctcagcccttg

SEQ ID NO: 1807275 - DNA, 20 bp, Homo sapiens
caagcccctcagcccttgcc

SEQ ID NO: 1807276 - DNA, 13 bp, Homo sapiens
caagccctggcaa

SEQ ID NO: 1807277 - DNA, 16 bp, Homo sapiens
caaggacaacctgccc

SEQ ID NO: 1807278 - DNA, 22 bp, Homo sapiens
caaggagctgatttccaggccc

SEQ ID NO: 1807279 - DNA, 23 bp, Homo sapiens
caaggagctgatttccaggcccc

SEQ ID NO: 1807280 - DNA, 14 bp, Homo sapiens
caaggaggctggct

SEQ ID NO: 1807281 - DNA, 22 bp, Homo sapiens
atactgtactgatactattcaa

SEQ ID NO: 1807282 - DNA, 18 bp, Homo sapiens
atactgtagaaatattgc

SEQ ID NO: 1807283 - DNA, 16 bp, Homo sapiens
atactgtattgaatat

SEQ ID NO: 1807284 - DNA, 19 bp, Homo sapiens
atagaaggctatggggata

SEQ ID NO: 1807285 - DNA, 12 bp, Homo sapiens
atagagtgaatt

SEQ ID NO: 1807286 - DNA, 13 bp, Homo sapiens
atagatgtgtgga

SEQ ID NO: 1807287 - DNA, 16 bp, Homo sapiens
atagcacatgattttc

SEQ ID NO: 1807288 - DNA, 23 bp, Homo sapiens
atagcacatgattttcttttgtt

SEQ ID NO: 1807289 - DNA, 20 bp, Homo sapiens
atagcatgttcgtattacaa

SEQ ID NO: 1807290 - DNA, 15 bp, Homo sapiens
atagccagagaggag

SEQ ID NO: 1807291 - DNA, 19 bp, Homo sapiens
ataggataaattacattaa

SEQ ID NO: 1807292 - DNA, 12 bp, Homo sapiens
ataggtttccac

SEQ ID NO: 1807293 - DNA, 20 bp, Homo sapiens
atagtaatcattgactaaag

SEQ ID NO: 1807294 - DNA, 14 bp, Homo sapiens
atagtgtgtccatg

SEQ ID NO: 1807295 - DNA, 14 bp, Homo sapiens
atagttagccctca

SEQ ID NO: 1807296 - DNA, 19 bp, Homo sapiens
atagttatacatcttcatt

SEQ ID NO: 1807297 - DNA, 20 bp, Homo sapiens
atagttatacatcttcatta

SEQ ID NO: 1807298 - DNA, 14 bp, Homo sapiens
atataaaaacaaca

SEQ ID NO: 1807299 - DNA, 20 bp, Homo sapiens
atataaaaacaacaaatact

SEQ ID NO: 1807300 - DNA, 22 bp, Homo sapiens
atataaaaacaacaaatacttc

SEQ ID NO: 1807301 - DNA, 24 bp, Homo sapiens
atatagtttgtggtaaaaagatta

SEQ ID NO: 1807302 - DNA, 14 bp, Homo sapiens
atatatgtatatgt

SEQ ID NO: 1807303 - DNA, 20 bp, Homo sapiens
atatatgtatatgtatatct

SEQ ID NO: 1807304 - DNA, 23 bp, Homo sapiens
atatatgtatatgtatatctata

SEQ ID NO: 1807305 - DNA, 19 bp, Homo sapiens
atatatttactaaaagaat

SEQ ID NO: 1807306 - DNA, 12 bp, Homo sapiens
atatcataaagt

SEQ ID NO: 1807307 - DNA, 15 bp, Homo sapiens
atatgaagtattaaa

SEQ ID NO: 1807308 - DNA, 20 bp, Homo sapiens
atatgaagtattaaaatgca

SEQ ID NO: 1807309 - DNA, 17 bp, Homo sapiens
atattagcaaagaagct

SEQ ID NO: 1807310 - DNA, 22 bp, Homo sapiens
atattagtttgatttaatatct

SEQ ID NO: 1807311 - DNA, 14 bp, Homo sapiens
atattcccatggta

SEQ ID NO: 1807312 - DNA, 15 bp, Homo sapiens
atattgattttaaat

SEQ ID NO: 1807313 - DNA, 13 bp, Homo sapiens
atatttactttaa

SEQ ID NO: 1807314 - DNA, 14 bp, Homo sapiens
atatttactttaaa

SEQ ID NO: 1807315 - DNA, 13 bp, Homo sapiens
atatttatttatg

SEQ ID NO: 1807316 - DNA, 20 bp, Homo sapiens
atatttgtaaatttatgtga

SEQ ID NO: 1807317 - DNA, 13 bp, Homo sapiens
atatttttcaaaa

SEQ ID NO: 1807318 - DNA, 14 bp, Homo sapiens
atatttttcaaaat

SEQ ID NO: 1807319 - DNA, 20 bp, Homo sapiens
atcaaaaggtaatgcacatc

SEQ ID NO: 1807320 - DNA, 14 bp, Homo sapiens
atcaaagcaagggc

SEQ ID NO: 1807321 - DNA, 16 bp, Homo sapiens
atcaaatattttttga

SEQ ID NO: 1807322 - DNA, 16 bp, Homo sapiens
atcaacattgaatatc

SEQ ID NO: 1807323 - DNA, 18 bp, Homo sapiens
atcaagcaaaatttctgt

SEQ ID NO: 1807324 - DNA, 12 bp, Homo sapiens
atcaatcaaata

SEQ ID NO: 1807325 - DNA, 18 bp, Homo sapiens
atcacaggggcggggcag

SEQ ID NO: 1807326 - DNA, 19 bp, Homo sapiens
atcactagtcaagaaaaat

SEQ ID NO: 1807327 - DNA, 17 bp, Homo sapiens
atcaggcactggtggca

SEQ ID NO: 1807328 - DNA, 13 bp, Homo sapiens
atcaggccattgt

SEQ ID NO: 1807329 - DNA, 13 bp, Homo sapiens
atcaggtaaaata

SEQ ID NO: 1807330 - DNA, 14 bp, Homo sapiens
atcagtgtgccccc

SEQ ID NO: 1807331 - DNA, 11 bp, Homo sapiens
atcataaagta

SEQ ID NO: 1807332 - DNA, 23 bp, Homo sapiens
atcatgtttacagaggacagtat

SEQ ID NO: 1807333 - DNA, 21 bp, Homo sapiens
atcattcattcactgtatagt

SEQ ID NO: 1807334 - DNA, 18 bp, Homo sapiens
atcattggccctcattcc

SEQ ID NO: 1807335 - DNA, 14 bp, Homo sapiens
atcattttcattaa

SEQ ID NO: 1807336 - DNA, 15 bp, Homo sapiens
atcattttcattaaa

SEQ ID NO: 1807337 - DNA, 21 bp, Homo sapiens
atcattttcattaaaaggaaa

SEQ ID NO: 1807338 - DNA, 16 bp, Homo sapiens
atccacccagtgctgc

SEQ ID NO: 1807339 - DNA, 19 bp, Homo sapiens
atccacccagtgctgccat

SEQ ID NO: 1807340 - DNA, 23 bp, Homo sapiens
atccacccagtgctgccatgcca

SEQ ID NO: 1807341 - DNA, 20 bp, Homo sapiens
atccagcctgtgtgttctgt

SEQ ID NO: 1807342 - DNA, 19 bp, Homo sapiens
atccattgctggcaatgag

SEQ ID NO: 1807343 - DNA, 17 bp, Homo sapiens
atcccccttagaatgtt

SEQ ID NO: 1807344 - DNA, 16 bp, Homo sapiens
atcccctccctgcctg

SEQ ID NO: 1807345 - DNA, 18 bp, Homo sapiens
atcccctccctgcctgct

SEQ ID NO: 1807346 - DNA, 19 bp, Homo sapiens
atcccctccctgcctgctc

SEQ ID NO: 1807347 - DNA, 21 bp, Homo sapiens
atcccctccctgcctgctcct

SEQ ID NO: 1807348 - DNA, 16 bp, Homo sapiens
atcccctcgtcctgtc

SEQ ID NO: 1807349 - DNA, 17 bp, Homo sapiens
atcccctcgtcctgtcc

SEQ ID NO: 1807350 - DNA, 21 bp, Homo sapiens
atcccctcgtcctgtcccaga

SEQ ID NO: 1807351 - DNA, 13 bp, Homo sapiens
atcccggcctctt

SEQ ID NO: 1807352 - DNA, 15 bp, Homo sapiens
atcccggcctcttcc

SEQ ID NO: 1807353 - DNA, 16 bp, Homo sapiens
atcccggcctcttcca

SEQ ID NO: 1807354 - DNA, 17 bp, Homo sapiens
atccctgcttgcccgct

SEQ ID NO: 1807355 - DNA, 23 bp, Homo sapiens
atccctgcttgcccgctcccaca

SEQ ID NO: 1807356 - DNA, 23 bp, Homo sapiens
atccgacttgaattttcccactg

SEQ ID NO: 1807357 - DNA, 14 bp, Homo sapiens
atcctcattcacta

SEQ ID NO: 1807358 - DNA, 22 bp, Homo sapiens
atcctgcaggaacgagcactgg

SEQ ID NO: 1807359 - DNA, 13 bp, Homo sapiens
atcctggcccatc

SEQ ID NO: 1807360 - DNA, 14 bp, Homo sapiens
atcctggcccatca

SEQ ID NO: 1807361 - DNA, 21 bp, Homo sapiens
atcctggtaagaggcaaagaa

SEQ ID NO: 1807362 - DNA, 13 bp, Homo sapiens
atcgtagaagaga

SEQ ID NO: 1807363 - DNA, 18 bp, Homo sapiens
atcgtgacccttcagggc

SEQ ID NO: 1807364 - DNA, 20 bp, Homo sapiens
atcgtgacccttcagggcca

SEQ ID NO: 1807365 - DNA, 21 bp, Homo sapiens
atcgtgacccttcagggccag

SEQ ID NO: 1807366 - DNA, 14 bp, Homo sapiens
atctactagaacct

SEQ ID NO: 1807367 - DNA, 16 bp, Homo sapiens
atctagaaaatgaaaa

SEQ ID NO: 1807368 - DNA, 23 bp, Homo sapiens
atctatagttatacatcttcatt

SEQ ID NO: 1807369 - DNA, 17 bp, Homo sapiens
atctatgagcaactcct

SEQ ID NO: 1807370 - DNA, 12 bp, Homo sapiens
atctatttttgc

SEQ ID NO: 1807371 - DNA, 20 bp, Homo sapiens
atctcacttcatcaatcaaa

SEQ ID NO: 1807372 - DNA, 19 bp, Homo sapiens
atctcatgacattatattt

SEQ ID NO: 1807373 - DNA, 19 bp, Homo sapiens
caggtctcctccaccgcca

SEQ ID NO: 1807374 - DNA, 13 bp, Homo sapiens
caggtgccactcc

SEQ ID NO: 1807375 - DNA, 16 bp, Homo sapiens
caggtgccactccctg

SEQ ID NO: 1807376 - DNA, 13 bp, Homo sapiens
caggtgctgctac

SEQ ID NO: 1807377 - DNA, 19 bp, Homo sapiens
caggtgctgctaccctccc

SEQ ID NO: 1807378 - DNA, 23 bp, Homo sapiens
caggtgctgctaccctccctgct

SEQ ID NO: 1807379 - DNA, 14 bp, Homo sapiens
caggtggagagcac

SEQ ID NO: 1807380 - DNA, 17 bp, Homo sapiens
caggtggggtgaggcag

SEQ ID NO: 1807381 - DNA, 13 bp, Homo sapiens
caggttgggccat

SEQ ID NO: 1807382 - DNA, 16 bp, Homo sapiens
cagtaaacatttgtaa

SEQ ID NO: 1807383 - DNA, 17 bp, Homo sapiens
cagtaacatgcaacaaa

SEQ ID NO: 1807384 - DNA, 15 bp, Homo sapiens
cagtacacttcctgt

SEQ ID NO: 1807385 - DNA, 21 bp, Homo sapiens
cagtacctgggaaaggaccca

SEQ ID NO: 1807386 - DNA, 13 bp, Homo sapiens
cagtatcttcaaa

SEQ ID NO: 1807387 - DNA, 22 bp, Homo sapiens
cagtattatttctccatcccct

SEQ ID NO: 1807388 - DNA, 15 bp, Homo sapiens
cagtcagttcccgga

SEQ ID NO: 1807389 - DNA, 17 bp, Homo sapiens
cagtcagttcccggagc

SEQ ID NO: 1807390 - DNA, 21 bp, Homo sapiens
cagtcagttcccggagcacag

SEQ ID NO: 1807391 - DNA, 23 bp, Homo sapiens
cagtcatgactagtgcctagaaa

SEQ ID NO: 1807392 - DNA, 14 bp, Homo sapiens
cagtccccagccct

SEQ ID NO: 1807393 - DNA, 17 bp, Homo sapiens
cagtcctcacagcctct

SEQ ID NO: 1807394 - DNA, 19 bp, Homo sapiens
cagtcctcacagcctctcc

SEQ ID NO: 1807395 - DNA, 16 bp, Homo sapiens
cagtcgcgctgcctgt

SEQ ID NO: 1807396 - DNA, 17 bp, Homo sapiens
cagtcgcgctgcctgtg

SEQ ID NO: 1807397 - DNA, 17 bp, Homo sapiens
cagtctcaaatttttca

SEQ ID NO: 1807398 - DNA, 15 bp, Homo sapiens
cagtgacagtcactt

SEQ ID NO: 1807399 - DNA, 17 bp, Homo sapiens
cagtgactcgggctcct

SEQ ID NO: 1807400 - DNA, 14 bp, Homo sapiens
cagtgactggcagg

SEQ ID NO: 1807401 - DNA, 17 bp, Homo sapiens
cagtgagcccctcccca

SEQ ID NO: 1807402 - DNA, 21 bp, Homo sapiens
cagtgagcccctccccagcca

SEQ ID NO: 1807403 - DNA, 14 bp, Homo sapiens
cagtgatatactta

SEQ ID NO: 1807404 - DNA, 22 bp, Homo sapiens
cagtgatggcgcgggaggcacc

SEQ ID NO: 1807405 - DNA, 23 bp, Homo sapiens
cagtgatggcgcgggaggcacca

SEQ ID NO: 1807406 - DNA, 18 bp, Homo sapiens
cagtgcccattcctcacc

SEQ ID NO: 1807407 - DNA, 17 bp, Homo sapiens
cagtgccgccgcctcgc

SEQ ID NO: 1807408 - DNA, 12 bp, Homo sapiens
cagtgctgccat

SEQ ID NO: 1807409 - DNA, 15 bp, Homo sapiens
cagtgctgccatgcc

SEQ ID NO: 1807410 - DNA, 20 bp, Homo sapiens
cagtgctgccatgccactgc

SEQ ID NO: 1807411 - DNA, 21 bp, Homo sapiens
cagtgctgccatgccactgcc

SEQ ID NO: 1807412 - DNA, 11 bp, Homo sapiens
cagtgctgctt

SEQ ID NO: 1807413 - DNA, 21 bp, Homo sapiens
cagtgggaggtgagaccacct

SEQ ID NO: 1807414 - DNA, 22 bp, Homo sapiens
cagtgggaggtgagaccacctc

SEQ ID NO: 1807415 - DNA, 15 bp, Homo sapiens
cagtgggtggcacct

SEQ ID NO: 1807416 - DNA, 17 bp, Homo sapiens
cagtgggtggcacctcc

SEQ ID NO: 1807417 - DNA, 19 bp, Homo sapiens
cagtgggtggcacctcctg

SEQ ID NO: 1807418 - DNA, 22 bp, Homo sapiens
cagtgggtggcacctcctgaga

SEQ ID NO: 1807419 - DNA, 11 bp, Homo sapiens
cagtgtaaaga

SEQ ID NO: 1807420 - DNA, 19 bp, Homo sapiens
cagtgtaaagaataaatga

SEQ ID NO: 1807421 - DNA, 20 bp, Homo sapiens
cagtgtaaagaataaatgaa

SEQ ID NO: 1807422 - DNA, 14 bp, Homo sapiens
cagtgtacccccgc

SEQ ID NO: 1807423 - DNA, 20 bp, Homo sapiens
cagtgtacccccgcccaggc

SEQ ID NO: 1807424 - DNA, 22 bp, Homo sapiens
cagtgtacccccgcccaggctg

SEQ ID NO: 1807425 - DNA, 15 bp, Homo sapiens
cagtgtcttcctgtg

SEQ ID NO: 1807426 - DNA, 16 bp, Homo sapiens
cagtgtcttcctgtgg

SEQ ID NO: 1807427 - DNA, 17 bp, Homo sapiens
cagtgtcttcctgtggg

SEQ ID NO: 1807428 - DNA, 20 bp, Homo sapiens
cagtgtgccccccatcctgg

SEQ ID NO: 1807429 - DNA, 23 bp, Homo sapiens
cagtgtgccccccatcctggccc

SEQ ID NO: 1807430 - DNA, 23 bp, Homo sapiens
cagtgtggagaggggtgcaccca

SEQ ID NO: 1807431 - DNA, 17 bp, Homo sapiens
cagtgttaggcctggca

SEQ ID NO: 1807432 - DNA, 22 bp, Homo sapiens
cagtgttaggcctggcacagtg

SEQ ID NO: 1807433 - DNA, 22 bp, Homo sapiens
cagttcacttctttgcagagcc

SEQ ID NO: 1807434 - DNA, 21 bp, Homo sapiens
cagttcattcgctttgtctgt

SEQ ID NO: 1807435 - DNA, 17 bp, Homo sapiens
cagtttctccatcagct

SEQ ID NO: 1807436 - DNA, 12 bp, Homo sapiens
catactggcctc

SEQ ID NO: 1807437 - DNA, 19 bp, Homo sapiens
catactggcctcgcctggc

SEQ ID NO: 1807438 - DNA, 20 bp, Homo sapiens
catactggcctcgcctggcc

SEQ ID NO: 1807439 - DNA, 22 bp, Homo sapiens
catactggcctcgcctggcctg

SEQ ID NO: 1807440 - DNA, 16 bp, Homo sapiens
catacttcaaaaatgt

SEQ ID NO: 1807441 - DNA, 15 bp, Homo sapiens
catagtgagatccca

SEQ ID NO: 1807442 - DNA, 15 bp, Homo sapiens
catatatattaaaat

SEQ ID NO: 1807443 - DNA, 18 bp, Homo sapiens
catatatgtatatgtata

SEQ ID NO: 1807444 - DNA, 20 bp, Homo sapiens
catatatgtatatgtatatc

SEQ ID NO: 1807445 - DNA, 17 bp, Homo sapiens
catatcagtcatgacta

SEQ ID NO: 1807446 - DNA, 20 bp, Homo sapiens
catattcaagcaacagcact

SEQ ID NO: 1807447 - DNA, 13 bp, Homo sapiens
catatttccaata

SEQ ID NO: 1807448 - DNA, 17 bp, Homo sapiens
catatttctatgttgta

SEQ ID NO: 1807449 - DNA, 21 bp, Homo sapiens
catattttaaaaaatcaaaag

SEQ ID NO: 1807450 - DNA, 19 bp, Homo sapiens
catcaagtaatcatggcca

SEQ ID NO: 1807451 - DNA, 17 bp, Homo sapiens
catcactccctggatgt

SEQ ID NO: 1807452 - DNA, 18 bp, Homo sapiens
catcaggtcccccccagg

SEQ ID NO: 1807453 - DNA, 21 bp, Homo sapiens
catcagtcattcccacgcttg

SEQ ID NO: 1807454 - DNA, 23 bp, Homo sapiens
catcagtgtacccccgcccaggc

SEQ ID NO: 1807455 - DNA, 24 bp, Homo sapiens
catcagtgtacccccgcccaggct

SEQ ID NO: 1807456 - DNA, 19 bp, Homo sapiens
catcattcattcactgtat

SEQ ID NO: 1807457 - DNA, 20 bp, Homo sapiens
catcattggccctcattcca

SEQ ID NO: 1807458 - DNA, 14 bp, Homo sapiens
catccacccagtgc

SEQ ID NO: 1807459 - DNA, 14 bp, Homo sapiens
catccagcctgtgt

SEQ ID NO: 1807460 - DNA, 16 bp, Homo sapiens
catcccctccctgcct

SEQ ID NO: 1807461 - DNA, 21 bp, Homo sapiens
catcccggcctcttccaccca

SEQ ID NO: 1807462 - DNA, 19 bp, Homo sapiens
catccctgcttgcccgctc

SEQ ID NO: 1807463 - DNA, 15 bp, Homo sapiens
catcctggcccatca

SEQ ID NO: 1807464 - DNA, 14 bp, Homo sapiens
catcgtagaagaga

SEQ ID NO: 1807465 - DNA, 21 bp, Homo sapiens
catcgtagaagagatgtggca

SEQ ID NO: 1807466 - DNA, 13 bp, Homo sapiens
catcgtgaccctt

SEQ ID NO: 1807467 - DNA, 20 bp, Homo sapiens
catcgtgacccttcagggcc

SEQ ID NO: 1807468 - DNA, 17 bp, Homo sapiens
catctcacttcttcttc

SEQ ID NO: 1807469 - DNA, 13 bp, Homo sapiens
catctcaggtgcc

SEQ ID NO: 1807470 - DNA, 17 bp, Homo sapiens
catctcaggtgccactc

SEQ ID NO: 1807471 - DNA, 14 bp, Homo sapiens
catctccccaggcc

SEQ ID NO: 1807472 - DNA, 15 bp, Homo sapiens
catctccccaggcct

SEQ ID NO: 1807473 - DNA, 19 bp, Homo sapiens
catctccccaggcctccag

SEQ ID NO: 1807474 - DNA, 21 bp, Homo sapiens
catctccccaggcctccagcc

SEQ ID NO: 1807475 - DNA, 23 bp, Homo sapiens
catctcctcccatggccttccct

SEQ ID NO: 1807476 - DNA, 22 bp, Homo sapiens
catctcttcaatcactagtcaa

SEQ ID NO: 1807477 - DNA, 11 bp, Homo sapiens
catctgaggag

SEQ ID NO: 1807478 - DNA, 13 bp, Homo sapiens
catctgcccagga

SEQ ID NO: 1807479 - DNA, 17 bp, Homo sapiens
catctgtacctctgcct

SEQ ID NO: 1807480 - DNA, 13 bp, Homo sapiens
catcttcattaat

SEQ ID NO: 1807481 - DNA, 15 bp, Homo sapiens
catcttcctgctgct

SEQ ID NO: 1807482 - DNA, 16 bp, Homo sapiens
catcttcctgctgctg

SEQ ID NO: 1807483 - DNA, 21 bp, Homo sapiens
catgaatacgtaaactgcgta

SEQ ID NO: 1807484 - DNA, 20 bp, Homo sapiens
catgactagtgcctagaaag

SEQ ID NO: 1807485 - DNA, 23 bp, Homo sapiens
catgactagtgcctagaaagcaa

SEQ ID NO: 1807486 - DNA, 19 bp, Homo sapiens
catgagttggctgggaata

SEQ ID NO: 1807487 - DNA, 15 bp, Homo sapiens
catgcaaaagtgggg

SEQ ID NO: 1807488 - DNA, 13 bp, Homo sapiens
catgcaacaaaaa

SEQ ID NO: 1807489 - DNA, 17 bp, Homo sapiens
catgccactgccaggca

SEQ ID NO: 1807490 - DNA, 23 bp, Homo sapiens
catgccactgccaggcacctggc

SEQ ID NO: 1807491 - DNA, 13 bp, Homo sapiens
catgcctcatgcc

SEQ ID NO: 1807492 - DNA, 17 bp, Homo sapiens
catgcctggcccccctc

SEQ ID NO: 1807493 - DNA, 22 bp, Homo sapiens
catgcctggcccccctccaggc

SEQ ID NO: 1807494 - DNA, 17 bp, Homo sapiens
catgctcaacccccctc

SEQ ID NO: 1807495 - DNA, 22 bp, Homo sapiens
catgctcaacccccctcccaga

SEQ ID NO: 1807496 - DNA, 13 bp, Homo sapiens
catgctctgcccc

SEQ ID NO: 1807497 - DNA, 16 bp, Homo sapiens
catgctctgccccaag

SEQ ID NO: 1807498 - DNA, 19 bp, Homo sapiens
catgctctgccccaagccc

SEQ ID NO: 1807499 - DNA, 14 bp, Homo sapiens
catgctgccttcag

SEQ ID NO: 1807500 - DNA, 15 bp, Homo sapiens
catgctgccttcagg

SEQ ID NO: 1807501 - DNA, 20 bp, Homo sapiens
catgctggcctcccaataaa

SEQ ID NO: 1807502 - DNA, 13 bp, Homo sapiens
catgctttctcct

SEQ ID NO: 1807503 - DNA, 17 bp, Homo sapiens
catggcaccagccccct

SEQ ID NO: 1807504 - DNA, 18 bp, Homo sapiens
catggcaccagccccctg

SEQ ID NO: 1807505 - DNA, 20 bp, Homo sapiens
catggcgtaatgggcctgcc

SEQ ID NO: 1807506 - DNA, 23 bp, Homo sapiens
catggcgtaatgggcctgcccaa

SEQ ID NO: 1807507 - DNA, 13 bp, Homo sapiens
catggctcaggca

SEQ ID NO: 1807508 - DNA, 17 bp, Homo sapiens
catggctcaggcaagcc

SEQ ID NO: 1807509 - DNA, 18 bp, Homo sapiens
catggctcaggcaagccc

SEQ ID NO: 1807510 - DNA, 12 bp, Homo sapiens
catgggcctggg

SEQ ID NO: 1807511 - DNA, 14 bp, Homo sapiens
catgggcctgggcc

SEQ ID NO: 1807512 - DNA, 16 bp, Homo sapiens
catgggcctgggcctg

SEQ ID NO: 1807513 - DNA, 13 bp, Homo sapiens
catgggcttggac

SEQ ID NO: 1807514 - DNA, 20 bp, Homo sapiens
catgggcttggacttcctgg

SEQ ID NO: 1807515 - DNA, 14 bp, Homo sapiens
catggttccttccc

SEQ ID NO: 1807516 - DNA, 20 bp, Homo sapiens
catggttccttccctgggaa

SEQ ID NO: 1807517 - DNA, 18 bp, Homo sapiens
catgtgcctgcaccagga

SEQ ID NO: 1807518 - DNA, 22 bp, Homo sapiens
catgtgcctgcaccaggagaca

SEQ ID NO: 1807519 - DNA, 15 bp, Homo sapiens
catgtggctgaagac

SEQ ID NO: 1807520 - DNA, 14 bp, Homo sapiens
cattaaaaggaaaa

SEQ ID NO: 1807521 - DNA, 18 bp, Homo sapiens
cattaaaaggaaaaaaga

SEQ ID NO: 1807522 - DNA, 22 bp, Homo sapiens
cattaaaaggaaaaaagaaaaa

SEQ ID NO: 1807523 - DNA, 16 bp, Homo sapiens
cattaaatctgacagt

SEQ ID NO: 1807524 - DNA, 23 bp, Homo sapiens
cattaaatctgacagtctcaaat

SEQ ID NO: 1807525 - DNA, 12 bp, Homo sapiens
cattaatactgt

SEQ ID NO: 1807526 - DNA, 15 bp, Homo sapiens
cattaatactgtgtt

SEQ ID NO: 1807527 - DNA, 21 bp, Homo sapiens
cattacctcagtgagaagcca

SEQ ID NO: 1807528 - DNA, 22 bp, Homo sapiens
cattacctcagtgagaagccag

SEQ ID NO: 1807529 - DNA, 18 bp, Homo sapiens
cattactaacttcttcca

SEQ ID NO: 1807530 - DNA, 15 bp, Homo sapiens
cattacttgtataaa

SEQ ID NO: 1807531 - DNA, 15 bp, Homo sapiens
cattatatttgagtt

SEQ ID NO: 1807532 - DNA, 22 bp, Homo sapiens
cattatatttgagtttctttca

SEQ ID NO: 1807533 - DNA, 14 bp, Homo sapiens
cattatctgtactg

SEQ ID NO: 1807534 - DNA, 20 bp, Homo sapiens
cattatgttattggaatttt

SEQ ID NO: 1807535 - DNA, 14 bp, Homo sapiens
cattcaaaaacccc

SEQ ID NO: 1807536 - DNA, 15 bp, Homo sapiens
cattcactaagccat

SEQ ID NO: 1807537 - DNA, 17 bp, Homo sapiens
cattcaggcagcactga

SEQ ID NO: 1807538 - DNA, 18 bp, Homo sapiens
cattcaggtgttctcttc

SEQ ID NO: 1807539 - DNA, 18 bp, Homo sapiens
cattcatgccaaagcaaa

SEQ ID NO: 1807540 - DNA, 14 bp, Homo sapiens
cattcattcactgt

SEQ ID NO: 1807541 - DNA, 13 bp, Homo sapiens
cattccagaggaa

SEQ ID NO: 1807542 - DNA, 20 bp, Homo sapiens
cattcccactaagctttctc

SEQ ID NO: 1807543 - DNA, 23 bp, Homo sapiens
cattcccactaagctttctcctt

SEQ ID NO: 1807544 - DNA, 19 bp, Homo sapiens
cattcccccatgtggctga

SEQ ID NO: 1807545 - DNA, 16 bp, Homo sapiens
cattcctccagcctcc

SEQ ID NO: 1807546 - DNA, 17 bp, Homo sapiens
cattcctccagcctccc

SEQ ID NO: 1807547 - DNA, 18 bp, Homo sapiens
cattcctccagcctcccc

SEQ ID NO: 1807548 - DNA, 14 bp, Homo sapiens
cattggcagcaggt

SEQ ID NO: 1807549 - DNA, 18 bp, Homo sapiens
cattggggttgcaacaat

SEQ ID NO: 1807550 - DNA, 19 bp, Homo sapiens
cattgtgcttggcccctgg

SEQ ID NO: 1807551 - DNA, 20 bp, Homo sapiens
catttaaaaatatatagctt

SEQ ID NO: 1807552 - DNA, 22 bp, Homo sapiens
catttaaaatggaaaagagaga

SEQ ID NO: 1807553 - DNA, 16 bp, Homo sapiens
catttaatatttttca

SEQ ID NO: 1807554 - DNA, 18 bp, Homo sapiens
catttaatatttttcaaa

SEQ ID NO: 1807555 - DNA, 19 bp, Homo sapiens
catttaggatactcttaat

SEQ ID NO: 1807556 - DNA, 19 bp, Homo sapiens
catttagtaccttcaaata

SEQ ID NO: 1807557 - DNA, 16 bp, Homo sapiens
catttcaaagctgagt

SEQ ID NO: 1807558 - DNA, 17 bp, Homo sapiens
catttcttggtatgatc

SEQ ID NO: 1807559 - DNA, 15 bp, Homo sapiens
catttgataaactaa

SEQ ID NO: 1807560 - DNA, 19 bp, Homo sapiens
catttgataaactaaaagc

SEQ ID NO: 1807561 - DNA, 20 bp, Homo sapiens
catttgtcctgactgtctgc

SEQ ID NO: 1807562 - DNA, 14 bp, Homo sapiens
catttgtctgtgtt

SEQ ID NO: 1807563 - DNA, 13 bp, Homo sapiens
cattttaatacag

SEQ ID NO: 1807564 - DNA, 21 bp, Homo sapiens
cattttaatacagattgaaag

SEQ ID NO: 1807565 - DNA, 13 bp, Homo sapiens
cattttactaaaa

SEQ ID NO: 1807566 - DNA, 12 bp, Homo sapiens
cattttcctgtg

SEQ ID NO: 1807567 - DNA, 19 bp, Homo sapiens
cattttgcattagacagat

SEQ ID NO: 1807568 - DNA, 19 bp, Homo sapiens
ccaaacctcacactactgt

SEQ ID NO: 1807569 - DNA, 19 bp, Homo sapiens
ccaaactgcacacacagct

SEQ ID NO: 1807570 - DNA, 15 bp, Homo sapiens
ccaaaggggctgctg

SEQ ID NO: 1807571 - DNA, 21 bp, Homo sapiens
ccaaatgcacaagctcagaat

SEQ ID NO: 1807572 - DNA, 16 bp, Homo sapiens
ccaacaatggggtggg

SEQ ID NO: 1807573 - DNA, 18 bp, Homo sapiens
ccaacaatggggtgggcc

SEQ ID NO: 1807574 - DNA, 21 bp, Homo sapiens
ccaacaatggggtgggcccat

SEQ ID NO: 1807575 - DNA, 21 bp, Homo sapiens
ccaacagtgttaggcctggca

SEQ ID NO: 1807576 - DNA, 23 bp, Homo sapiens
ccaacagtgttaggcctggcaca

SEQ ID NO: 1807577 - DNA, 21 bp, Homo sapiens
ccaacccccagcacccgggct

SEQ ID NO: 1807578 - DNA, 14 bp, Homo sapiens
ccaactaagccctc

SEQ ID NO: 1807579 - DNA, 17 bp, Homo sapiens
ccaactgccagaacatg

SEQ ID NO: 1807580 - DNA, 12 bp, Homo sapiens
ccaagacagtct

SEQ ID NO: 1807581 - DNA, 23 bp, Homo sapiens
ccaagcactttacgctgtctgta

SEQ ID NO: 1807582 - DNA, 13 bp, Homo sapiens
ccaagcagccagc

SEQ ID NO: 1807583 - DNA, 22 bp, Homo sapiens
ccaagctgtgccaccctgggct

SEQ ID NO: 1807584 - DNA, 14 bp, Homo sapiens
ccaaggcagcctcc

SEQ ID NO: 1807585 - DNA, 15 bp, Homo sapiens
ccaaggcagcctcca

SEQ ID NO: 1807586 - DNA, 17 bp, Homo sapiens
ccaaggcagcctccaga

SEQ ID NO: 1807587 - DNA, 18 bp, Homo sapiens
ccaaggcagcctccagag

SEQ ID NO: 1807588 - DNA, 22 bp, Homo sapiens
ccaaggcagcctccagagccag

SEQ ID NO: 1807589 - DNA, 16 bp, Homo sapiens
ccaaggctctcccctc

SEQ ID NO: 1807590 - DNA, 20 bp, Homo sapiens
ccaaggttactcagcagcag

SEQ ID NO: 1807591 - DNA, 22 bp, Homo sapiens
ccaaggttactcagcagcagag

SEQ ID NO: 1807592 - DNA, 23 bp, Homo sapiens
ccaataaagctggacaagaagct

SEQ ID NO: 1807593 - DNA, 17 bp, Homo sapiens
ccaatgctttgggaggc

SEQ ID NO: 1807594 - DNA, 13 bp, Homo sapiens
ccaattgcctctt

SEQ ID NO: 1807595 - DNA, 16 bp, Homo sapiens
ccacaccctcactgct

SEQ ID NO: 1807596 - DNA, 17 bp, Homo sapiens
ccacagcaaggcacctg

SEQ ID NO: 1807597 - DNA, 17 bp, Homo sapiens
ccacagcccacgtcctg

SEQ ID NO: 1807598 - DNA, 21 bp, Homo sapiens
ccacagcccacgtcctgtcag

SEQ ID NO: 1807599 - DNA, 22 bp, Homo sapiens
ccacaggggcaggcctgggacc

SEQ ID NO: 1807600 - DNA, 14 bp, Homo sapiens
ccacagtgacagtc

SEQ ID NO: 1807601 - DNA, 19 bp, Homo sapiens
ccacagtgacagtcacttc

SEQ ID NO: 1807602 - DNA, 21 bp, Homo sapiens
ccacagtgactcgggctcctg

SEQ ID NO: 1807603 - DNA, 19 bp, Homo sapiens
ccacagtgggtggcacctc

SEQ ID NO: 1807604 - DNA, 21 bp, Homo sapiens
ccacagtgttggcgagaggag

SEQ ID NO: 1807605 - DNA, 11 bp, Homo sapiens
ccacataaagg

SEQ ID NO: 1807606 - DNA, 23 bp, Homo sapiens
ccacatttgctgctacttttcct

SEQ ID NO: 1807607 - DNA, 16 bp, Homo sapiens
ccaccaaactgcacac

SEQ ID NO: 1807608 - DNA, 22 bp, Homo sapiens
ccaccaaactgcacacacagct

SEQ ID NO: 1807609 - DNA, 13 bp, Homo sapiens
ccaccacgtctgc

SEQ ID NO: 1807610 - DNA, 20 bp, Homo sapiens
ccaccacgtctgccaggccc

SEQ ID NO: 1807611 - DNA, 21 bp, Homo sapiens
ccaccagaacgcaccccactg

SEQ ID NO: 1807612 - DNA, 14 bp, Homo sapiens
ccacccaggctgca

SEQ ID NO: 1807613 - DNA, 22 bp, Homo sapiens
ccacccaggctgcactgcagtg

SEQ ID NO: 1807614 - DNA, 13 bp, Homo sapiens
ccacccagtgctg

SEQ ID NO: 1807615 - DNA, 17 bp, Homo sapiens
ccacccagtgctgccat

SEQ ID NO: 1807616 - DNA, 20 bp, Homo sapiens
ccacccagtgctgccatgcc

SEQ ID NO: 1807617 - DNA, 18 bp, Homo sapiens
ccacccatcttcctgctg

SEQ ID NO: 1807618 - DNA, 15 bp, Homo sapiens
ccaccccggcctcca

SEQ ID NO: 1807619 - DNA, 17 bp, Homo sapiens
ccaccccggcctccact

SEQ ID NO: 1807620 - DNA, 20 bp, Homo sapiens
ccaccctcgtggacacctgc

SEQ ID NO: 1807621 - DNA, 21 bp, Homo sapiens
ccaccctcgtggacacctgcc

SEQ ID NO: 1807622 - DNA, 18 bp, Homo sapiens
ccaccctgggctctgtgg

SEQ ID NO: 1807623 - DNA, 20 bp, Homo sapiens
ccaccctgggctctgtgggc

SEQ ID NO: 1807624 - DNA, 16 bp, Homo sapiens
ccaccgaggttcccag

SEQ ID NO: 1807625 - DNA, 22 bp, Homo sapiens
ccaccgaggttcccagggctgg

SEQ ID NO: 1807626 - DNA, 14 bp, Homo sapiens
ccaccgccatggct

SEQ ID NO: 1807627 - DNA, 19 bp, Homo sapiens
ccacctacttgtgactgaa

SEQ ID NO: 1807628 - DNA, 23 bp, Homo sapiens
ccacctagtggctgtccagtgcc

SEQ ID NO: 1807629 - DNA, 18 bp, Homo sapiens
ccacctcctagaggtggg

SEQ ID NO: 1807630 - DNA, 23 bp, Homo sapiens
ccacctctcaatattcaataaag

SEQ ID NO: 1807631 - DNA, 20 bp, Homo sapiens
ccacctgacaatggcagcta

SEQ ID NO: 1807632 - DNA, 21 bp, Homo sapiens
ccacctgacaatggcagctag

SEQ ID NO: 1807633 - DNA, 15 bp, Homo sapiens
ccacctgcctatcca

SEQ ID NO: 1807634 - DNA, 20 bp, Homo sapiens
ccacctgcctatccatcctg

SEQ ID NO: 1807635 - DNA, 16 bp, Homo sapiens
ccacgagtcacctgca

SEQ ID NO: 1807636 - DNA, 13 bp, Homo sapiens
ccacggtgcgtgg

SEQ ID NO: 1807637 - DNA, 16 bp, Homo sapiens
ccacggtgcgtggctg

SEQ ID NO: 1807638 - DNA, 19 bp, Homo sapiens
ccacggtgcgtggctgtgg

SEQ ID NO: 1807639 - DNA, 16 bp, Homo sapiens
ccacgtcctgtcagtg

SEQ ID NO: 1807640 - DNA, 17 bp, Homo sapiens
ccacgtctgccaggccc

SEQ ID NO: 1807641 - DNA, 18 bp, Homo sapiens
ccactaagctttctcctt

SEQ ID NO: 1807642 - DNA, 22 bp, Homo sapiens
ccactacctttgtccaggcctg

SEQ ID NO: 1807643 - DNA, 15 bp, Homo sapiens
ccactcaccagggtc

SEQ ID NO: 1807644 - DNA, 16 bp, Homo sapiens
ccactcccccacctga

SEQ ID NO: 1807645 - DNA, 11 bp, Homo sapiens
ccactgcaccc

SEQ ID NO: 1807646 - DNA, 18 bp, Homo sapiens
ccactgcaccccctcctg

SEQ ID NO: 1807647 - DNA, 12 bp, Homo sapiens
ccactgccaggc

SEQ ID NO: 1807648 - DNA, 14 bp, Homo sapiens
ccactgccaggcac

SEQ ID NO: 1807649 - DNA, 18 bp, Homo sapiens
ccactgccaggcacctgg

SEQ ID NO: 1807650 - DNA, 20 bp, Homo sapiens
ccactgccaggcacctggcc

SEQ ID NO: 1807651 - DNA, 23 bp, Homo sapiens
ccactgccaggcacctggcctgc

SEQ ID NO: 1807652 - DNA, 24 bp, Homo sapiens
ccactgccaggcacctggcctgct

SEQ ID NO: 1807653 - DNA, 12 bp, Homo sapiens
ccactgccctgc

SEQ ID NO: 1807654 - DNA, 16 bp, Homo sapiens
ccactgccctgcctgc

SEQ ID NO: 1807655 - DNA, 19 bp, Homo sapiens
ccactgccctgcctgccca

SEQ ID NO: 1807656 - DNA, 21 bp, Homo sapiens
ccactgccctgcctgcccact

SEQ ID NO: 1807657 - DNA, 18 bp, Homo sapiens
ccactgtaacaatactgg

SEQ ID NO: 1807658 - DNA, 16 bp, Homo sapiens
ccactgtggccagagc

SEQ ID NO: 1807659 - DNA, 17 bp, Homo sapiens
ccacttccctgacactg

SEQ ID NO: 1807660 - DNA, 18 bp, Homo sapiens
ccacttcttaaaggcctg

SEQ ID NO: 1807661 - DNA, 19 bp, Homo sapiens
ccagaaagcctcctgcccc

SEQ ID NO: 1807662 - DNA, 16 bp, Homo sapiens
ccagaacgcaccccac

SEQ ID NO: 1807663 - DNA, 19 bp, Homo sapiens
ccagaaggagggcagagcc

SEQ ID NO: 1807664 - DNA, 15 bp, Homo sapiens
ccagaatctgctgtt

SEQ ID NO: 1807665 - DNA, 13 bp, Homo sapiens
ccagacaggccct

SEQ ID NO: 1807666 - DNA, 15 bp, Homo sapiens
ccagacaggccctcc

SEQ ID NO: 1807667 - DNA, 20 bp, Homo sapiens
ccagacaggccctccctgtc

SEQ ID NO: 1807668 - DNA, 21 bp, Homo sapiens
ccagacaggccctccctgtct

SEQ ID NO: 1807669 - DNA, 20 bp, Homo sapiens
ccagagagggcccagctgta

SEQ ID NO: 1807670 - DNA, 20 bp, Homo sapiens
ccagagccactacctttgtc

SEQ ID NO: 1807671 - DNA, 15 bp, Homo sapiens
ccagagccagcctgg

SEQ ID NO: 1807672 - DNA, 19 bp, Homo sapiens
ccagagccagcctgggact

SEQ ID NO: 1807673 - DNA, 17 bp, Homo sapiens
ccagagctggaacacaa

SEQ ID NO: 1807674 - DNA, 13 bp, Homo sapiens
ccagagctggaag

SEQ ID NO: 1807675 - DNA, 15 bp, Homo sapiens
ccagagctggaaggc

SEQ ID NO: 1807676 - DNA, 18 bp, Homo sapiens
ccagagctggaaggcagg

SEQ ID NO: 1807677 - DNA, 20 bp, Homo sapiens
ccagagctggaaggcagggc

SEQ ID NO: 1807678 - DNA, 22 bp, Homo sapiens
ccagagctggaaggcagggcag

SEQ ID NO: 1807679 - DNA, 19 bp, Homo sapiens
ccagaggttatctgcctgg

SEQ ID NO: 1807680 - DNA, 15 bp, Homo sapiens
ccagagtctgagccc

SEQ ID NO: 1807681 - DNA, 21 bp, Homo sapiens
ccagagtgaaagggctatggc

SEQ ID NO: 1807682 - DNA, 15 bp, Homo sapiens
ccagatctgcctggg

SEQ ID NO: 1807683 - DNA, 18 bp, Homo sapiens
ccagatctgcctgggcct

SEQ ID NO: 1807684 - DNA, 22 bp, Homo sapiens
ccagatctgcctgggcctgtgc

SEQ ID NO: 1807685 - DNA, 20 bp, Homo sapiens
ccagcacccgggctcaggga

SEQ ID NO: 1807686 - DNA, 14 bp, Homo sapiens
ccagcatccagcct

SEQ ID NO: 1807687 - DNA, 16 bp, Homo sapiens
ccagcccacagagcct

SEQ ID NO: 1807688 - DNA, 13 bp, Homo sapiens
ccagccccacagc

SEQ ID NO: 1807689 - DNA, 15 bp, Homo sapiens
ccagccccacagccc

SEQ ID NO: 1807690 - DNA, 21 bp, Homo sapiens
ccagccccacagcccacgtcc

SEQ ID NO: 1807691 - DNA, 23 bp, Homo sapiens
ccagccccctggatgggcattgg

SEQ ID NO: 1807692 - DNA, 16 bp, Homo sapiens
ccagcccttccctggc

SEQ ID NO: 1807693 - DNA, 19 bp, Homo sapiens
ccagcccttctgcctttct

SEQ ID NO: 1807694 - DNA, 18 bp, Homo sapiens
ccagccctttgcaggccc

SEQ ID NO: 1807695 - DNA, 21 bp, Homo sapiens
ccagcctcccctcccctgggg

SEQ ID NO: 1807696 - DNA, 13 bp, Homo sapiens
ccagcctctcccg

SEQ ID NO: 1807697 - DNA, 21 bp, Homo sapiens
ccagcctctcccggctgcctg

SEQ ID NO: 1807698 - DNA, 12 bp, Homo sapiens
ccagcctggccc

SEQ ID NO: 1807699 - DNA, 13 bp, Homo sapiens
ccagcctggccca

SEQ ID NO: 1807700 - DNA, 15 bp, Homo sapiens
ccagcctggcccagc

SEQ ID NO: 1807701 - DNA, 20 bp, Homo sapiens
ccagcctggcccagctcccc

SEQ ID NO: 1807702 - DNA, 19 bp, Homo sapiens
ccagcctgggactcccagt

SEQ ID NO: 1807703 - DNA, 15 bp, Homo sapiens
ccagctactctgtcc

SEQ ID NO: 1807704 - DNA, 15 bp, Homo sapiens
ccagctcccccggga

SEQ ID NO: 1807705 - DNA, 16 bp, Homo sapiens
ccagctctgtggcctg

SEQ ID NO: 1807706 - DNA, 21 bp, Homo sapiens
ccagctgacagtcctctccac

SEQ ID NO: 1807707 - DNA, 23 bp, Homo sapiens
ccagctgacagtcctctccacct

SEQ ID NO: 1807708 - DNA, 19 bp, Homo sapiens
ccagctgccttcctcatcc

SEQ ID NO: 1807709 - DNA, 20 bp, Homo sapiens
ccagctgccttcctcatccc

SEQ ID NO: 1807710 - DNA, 12 bp, Homo sapiens
ccagctgctctg

SEQ ID NO: 1807711 - DNA, 16 bp, Homo sapiens
ccagctgctctgcccc

SEQ ID NO: 1807712 - DNA, 18 bp, Homo sapiens
ccagctgtagccatggct

SEQ ID NO: 1807713 - DNA, 22 bp, Homo sapiens
ccagctgtagccatggctcagg

SEQ ID NO: 1807714 - DNA, 13 bp, Homo sapiens
ccaggaaggcagc

SEQ ID NO: 1807715 - DNA, 20 bp, Homo sapiens
ccaggaaggcagctgctctt

SEQ ID NO: 1807716 - DNA, 21 bp, Homo sapiens
ccaggacggggccggccaggt

SEQ ID NO: 1807717 - DNA, 16 bp, Homo sapiens
ccaggagacagacaga

SEQ ID NO: 1807718 - DNA, 14 bp, Homo sapiens
ccaggagtctgtgc

SEQ ID NO: 1807719 - DNA, 23 bp, Homo sapiens
ccaggagtttgagacaagccctg

SEQ ID NO: 1807720 - DNA, 15 bp, Homo sapiens
ccaggatcctgcagg

SEQ ID NO: 1807721 - DNA, 12 bp, Homo sapiens
ccaggcacctgg

SEQ ID NO: 1807722 - DNA, 19 bp, Homo sapiens
ccaggcacctggcctgctg

SEQ ID NO: 1807723 - DNA, 20 bp, Homo sapiens
ccaggcacctggcctgctgg

SEQ ID NO: 1807724 - DNA, 21 bp, Homo sapiens
ccaggcacctggcctgctggg

SEQ ID NO: 1807725 - DNA, 13 bp, Homo sapiens
ccaggcatgctgg

SEQ ID NO: 1807726 - DNA, 12 bp, Homo sapiens
ccaggccactgt

SEQ ID NO: 1807727 - DNA, 17 bp, Homo sapiens
ccaggccactgtggcca

SEQ ID NO: 1807728 - DNA, 13 bp, Homo sapiens
ccaggcccatctc

SEQ ID NO: 1807729 - DNA, 23 bp, Homo sapiens
ccaggcccatctcaggtgccact

SEQ ID NO: 1807730 - DNA, 14 bp, Homo sapiens
ccaggccctccatg

SEQ ID NO: 1807731 - DNA, 15 bp, Homo sapiens
ccaggccctccatgg

SEQ ID NO: 1807732 - DNA, 16 bp, Homo sapiens
ccaggccctccatggg

SEQ ID NO: 1807733 - DNA, 17 bp, Homo sapiens
ccaggccctccatgggc

SEQ ID NO: 1807734 - DNA, 12 bp, Homo sapiens
aaaaaaataata

SEQ ID NO: 1807735 - DNA, 11 bp, Homo sapiens
aaaaaaatgat

SEQ ID NO: 1807736 - DNA, 13 bp, Homo sapiens
aaaaagattatat

SEQ ID NO: 1807737 - DNA, 11 bp, Homo sapiens
aaaaagtatat

SEQ ID NO: 1807738 - DNA, 14 bp, Homo sapiens
aaaaagtatatatt

SEQ ID NO: 1807739 - DNA, 13 bp, Homo sapiens
aaaacttattaac

SEQ ID NO: 1807740 - DNA, 20 bp, Homo sapiens
aaaagagccagaagttgatg

SEQ ID NO: 1807741 - DNA, 13 bp, Homo sapiens
aaaagattatata

SEQ ID NO: 1807742 - DNA, 17 bp, Homo sapiens
aaaagattatatatcat

SEQ ID NO: 1807743 - DNA, 20 bp, Homo sapiens
aaaagattatatatcataaa

SEQ ID NO: 1807744 - DNA, 15 bp, Homo sapiens
aaaaggttttatttt

SEQ ID NO: 1807745 - DNA, 17 bp, Homo sapiens
aaaaggttttattttgt

SEQ ID NO: 1807746 - DNA, 19 bp, Homo sapiens
aaaaggttttattttgtaa

SEQ ID NO: 1807747 - DNA, 11 bp, Homo sapiens
aaaagtatata

SEQ ID NO: 1807748 - DNA, 20 bp, Homo sapiens
actcctgtcccgccttcctc

SEQ ID NO: 1807749 - DNA, 21 bp, Homo sapiens
actcctgtcccgccttcctcc

SEQ ID NO: 1807750 - DNA, 14 bp, Homo sapiens
actcgggctcctgt

SEQ ID NO: 1807751 - DNA, 17 bp, Homo sapiens
actctatactcaatcaa

SEQ ID NO: 1807752 - DNA, 13 bp, Homo sapiens
actctcggggccc

SEQ ID NO: 1807753 - DNA, 14 bp, Homo sapiens
actctcggggccct

SEQ ID NO: 1807754 - DNA, 22 bp, Homo sapiens
actctcggggcccttggggcct

SEQ ID NO: 1807755 - DNA, 19 bp, Homo sapiens
actctctgctctagccagg

SEQ ID NO: 1807756 - DNA, 23 bp, Homo sapiens
actctctgctctagccaggagtc

SEQ ID NO: 1807757 - DNA, 22 bp, Homo sapiens
actctgaaaagcaattgccctg

SEQ ID NO: 1807758 - DNA, 13 bp, Homo sapiens
actctgagcccag

SEQ ID NO: 1807759 - DNA, 16 bp, Homo sapiens
actctgagcccaggcc

SEQ ID NO: 1807760 - DNA, 21 bp, Homo sapiens
actctggaggtttgtttagaa

SEQ ID NO: 1807761 - DNA, 16 bp, Homo sapiens
actctgtccaggccac

SEQ ID NO: 1807762 - DNA, 17 bp, Homo sapiens
actctgtccaggccact

SEQ ID NO: 1807763 - DNA, 18 bp, Homo sapiens
actctgtccaggccactg

SEQ ID NO: 1807764 - DNA, 21 bp, Homo sapiens
actctgtccaggccactgtgg

SEQ ID NO: 1807765 - DNA, 23 bp, Homo sapiens
actctgtccaggccactgtggcc

SEQ ID NO: 1807766 - DNA, 18 bp, Homo sapiens
actctgtgcccatgggca

SEQ ID NO: 1807767 - DNA, 13 bp, Homo sapiens
actcttaaatata

SEQ ID NO: 1807768 - DNA, 19 bp, Homo sapiens
actcttaatctcacttcat

SEQ ID NO: 1807769 - DNA, 20 bp, Homo sapiens
actctttttgtacctggtga

SEQ ID NO: 1807770 - DNA, 22 bp, Homo sapiens
actgaaaacatttcaaagctga

SEQ ID NO: 1807771 - DNA, 18 bp, Homo sapiens
actgaaatagagtgaatt

SEQ ID NO: 1807772 - DNA, 17 bp, Homo sapiens
actgaaccactttgata

SEQ ID NO: 1807773 - DNA, 13 bp, Homo sapiens
actgaaggggcac

SEQ ID NO: 1807774 - DNA, 19 bp, Homo sapiens
actgataacgtattttgat

SEQ ID NO: 1807775 - DNA, 23 bp, Homo sapiens
actgatactattcaatgcaatgc

SEQ ID NO: 1807776 - DNA, 15 bp, Homo sapiens
actgattagtattca

SEQ ID NO: 1807777 - DNA, 19 bp, Homo sapiens
actgcaacttctacctccg

SEQ ID NO: 1807778 - DNA, 15 bp, Homo sapiens
actgcaccccctcct

SEQ ID NO: 1807779 - DNA, 19 bp, Homo sapiens
actgcaccccctcctgctg

SEQ ID NO: 1807780 - DNA, 15 bp, Homo sapiens
actgccaaaacaatg

SEQ ID NO: 1807781 - DNA, 18 bp, Homo sapiens
actgccaggcacctggcc

SEQ ID NO: 1807782 - DNA, 22 bp, Homo sapiens
actgccaggcacctggcctgct

SEQ ID NO: 1807783 - DNA, 14 bp, Homo sapiens
actgccccatctcc

SEQ ID NO: 1807784 - DNA, 15 bp, Homo sapiens
actgccccatctcct

SEQ ID NO: 1807785 - DNA, 23 bp, Homo sapiens
actgcccccagaaagcctcctgc

SEQ ID NO: 1807786 - DNA, 17 bp, Homo sapiens
actgccctgcctgccca

SEQ ID NO: 1807787 - DNA, 14 bp, Homo sapiens
actgctgagccact

SEQ ID NO: 1807788 - DNA, 16 bp, Homo sapiens
actgctgagccactcg

SEQ ID NO: 1807789 - DNA, 20 bp, Homo sapiens
actgctgggtggcccatccc

SEQ ID NO: 1807790 - DNA, 21 bp, Homo sapiens
actggagtgaggcttccaggc

SEQ ID NO: 1807791 - DNA, 13 bp, Homo sapiens
actggatactgta

SEQ ID NO: 1807792 - DNA, 23 bp, Homo sapiens
actggatactgtactgatactat

SEQ ID NO: 1807793 - DNA, 22 bp, Homo sapiens
actggccagagagggcccagct

SEQ ID NO: 1807794 - DNA, 23 bp, Homo sapiens
actggccagtggctggatctgtg

SEQ ID NO: 1807795 - DNA, 12 bp, Homo sapiens
actggctgcctc

SEQ ID NO: 1807796 - DNA, 19 bp, Homo sapiens
actggctgcctccactccc

SEQ ID NO: 1807797 - DNA, 13 bp, Homo sapiens
actggctggggca

SEQ ID NO: 1807798 - DNA, 15 bp, Homo sapiens
actggctggggcaga

SEQ ID NO: 1807799 - DNA, 17 bp, Homo sapiens
actggctggggcagagg

SEQ ID NO: 1807800 - DNA, 14 bp, Homo sapiens
actggtttacaaat

SEQ ID NO: 1807801 - DNA, 12 bp, Homo sapiens
actgtatagtaa

SEQ ID NO: 1807802 - DNA, 18 bp, Homo sapiens
actgtatagtaatcattg

SEQ ID NO: 1807803 - DNA, 19 bp, Homo sapiens
actgtatagtaatcattga

SEQ ID NO: 1807804 - DNA, 15 bp, Homo sapiens
actgtattgaatatt

SEQ ID NO: 1807805 - DNA, 19 bp, Homo sapiens
actgtcctgctccacagtg

SEQ ID NO: 1807806 - DNA, 20 bp, Homo sapiens
actgtcctgctccacagtgt

SEQ ID NO: 1807807 - DNA, 21 bp, Homo sapiens
actgtcttgagagaaaagaaa

SEQ ID NO: 1807808 - DNA, 22 bp, Homo sapiens
actgtcttgagagaaaagaaaa

SEQ ID NO: 1807809 - DNA, 15 bp, Homo sapiens
actgtgaactatttt

SEQ ID NO: 1807810 - DNA, 15 bp, Homo sapiens
actgtgaatatgaga

SEQ ID NO: 1807811 - DNA, 16 bp, Homo sapiens
actgtggccagagctg

SEQ ID NO: 1807812 - DNA, 17 bp, Homo sapiens
actgtggccagagctgg

SEQ ID NO: 1807813 - DNA, 21 bp, Homo sapiens
actgtggccagagctggaagg

SEQ ID NO: 1807814 - DNA, 18 bp, Homo sapiens
actgtttcactaatactt

SEQ ID NO: 1807815 - DNA, 16 bp, Homo sapiens
acttactgttaactgt

SEQ ID NO: 1807816 - DNA, 18 bp, Homo sapiens
acttactgttaactgtct

SEQ ID NO: 1807817 - DNA, 23 bp, Homo sapiens
acttcaaaaatgttaaaccctta

SEQ ID NO: 1807818 - DNA, 13 bp, Homo sapiens
acttcagatttca

SEQ ID NO: 1807819 - DNA, 15 bp, Homo sapiens
acttcagatttcaaa

SEQ ID NO: 1807820 - DNA, 16 bp, Homo sapiens
acttcagatttcaaat

SEQ ID NO: 1807821 - DNA, 16 bp, Homo sapiens
acttcatcaatcaaat

SEQ ID NO: 1807822 - DNA, 19 bp, Homo sapiens
acttcatcaatcaaatatt

SEQ ID NO: 1807823 - DNA, 12 bp, Homo sapiens
acttcctcctga

SEQ ID NO: 1807824 - DNA, 20 bp, Homo sapiens
acttctggaaggctggctga

SEQ ID NO: 1807825 - DNA, 20 bp, Homo sapiens
acttcttaaaggcctggaac

SEQ ID NO: 1807826 - DNA, 19 bp, Homo sapiens
acttgaattttcccactgc

SEQ ID NO: 1807827 - DNA, 17 bp, Homo sapiens
acttgaggacacatgtc

SEQ ID NO: 1807828 - DNA, 15 bp, Homo sapiens
acttgcgtcctgcag

SEQ ID NO: 1807829 - DNA, 16 bp, Homo sapiens
acttgcgtcctgcaga

SEQ ID NO: 1807830 - DNA, 23 bp, Homo sapiens
acttggttccattgttatattgt

SEQ ID NO: 1807831 - DNA, 15 bp, Homo sapiens
actttacgctgtctg

SEQ ID NO: 1807832 - DNA, 18 bp, Homo sapiens
actttacgctgtctgtaa

SEQ ID NO: 1807833 - DNA, 14 bp, Homo sapiens
actttatatgaagt

SEQ ID NO: 1807834 - DNA, 22 bp, Homo sapiens
actttatatgaagtattaaaat

SEQ ID NO: 1807835 - DNA, 17 bp, Homo sapiens
actttgccaaggctctc

SEQ ID NO: 1807836 - DNA, 22 bp, Homo sapiens
acttttctaaagctctgaacaa

SEQ ID NO: 1807837 - DNA, 13 bp, Homo sapiens
acttttgtgaaag

SEQ ID NO: 1807838 - DNA, 18 bp, Homo sapiens
agaaaagaggagaccctg

SEQ ID NO: 1807839 - DNA, 19 bp, Homo sapiens
agaaacagggacaaagaaa

SEQ ID NO: 1807840 - DNA, 15 bp, Homo sapiens
agaaagaaagggaaa

SEQ ID NO: 1807841 - DNA, 12 bp, Homo sapiens
agaaagcctcct

SEQ ID NO: 1807842 - DNA, 21 bp, Homo sapiens
agaaagcctcctgccccctgc

SEQ ID NO: 1807843 - DNA, 15 bp, Homo sapiens
agaaagggaggccca

SEQ ID NO: 1807844 - DNA, 15 bp, Homo sapiens
agaaatacagaagaa

SEQ ID NO: 1807845 - DNA, 22 bp, Homo sapiens
agaaatcacaggggcggggcag

SEQ ID NO: 1807846 - DNA, 19 bp, Homo sapiens
agaaatccccccttcagaa

SEQ ID NO: 1807847 - DNA, 19 bp, Homo sapiens
agaaattctcaaaatacgt

SEQ ID NO: 1807848 - DNA, 23 bp, Homo sapiens
agaaattttactgacagaaatgc

SEQ ID NO: 1807849 - DNA, 17 bp, Homo sapiens
agaacaagtcacagctg

SEQ ID NO: 1807850 - DNA, 18 bp, Homo sapiens
agaacaagtcacagctgc

SEQ ID NO: 1807851 - DNA, 13 bp, Homo sapiens
agaaccttctaat

SEQ ID NO: 1807852 - DNA, 14 bp, Homo sapiens
agaactgccccatc

SEQ ID NO: 1807853 - DNA, 21 bp, Homo sapiens
agaactgccccatctcctccc

SEQ ID NO: 1807854 - DNA, 14 bp, Homo sapiens
agaaggaaaaagaa

SEQ ID NO: 1807855 - DNA, 15 bp, Homo sapiens
agaaggagggcagag

SEQ ID NO: 1807856 - DNA, 16 bp, Homo sapiens
agaaggagggcagagc

SEQ ID NO: 1807857 - DNA, 17 bp, Homo sapiens
agaaggagggcagagcc

SEQ ID NO: 1807858 - DNA, 19 bp, Homo sapiens
agaaggagggcagagccat

SEQ ID NO: 1807859 - DNA, 21 bp, Homo sapiens
agaaggagggcagagccatgg

SEQ ID NO: 1807860 - DNA, 15 bp, Homo sapiens
agaaggatggcatct

SEQ ID NO: 1807861 - DNA, 19 bp, Homo sapiens
agaaggcctcttgtgctca

SEQ ID NO: 1807862 - DNA, 20 bp, Homo sapiens
agaagtaaactggatactgt

SEQ ID NO: 1807863 - DNA, 14 bp, Homo sapiens
agaagttaaagtca

SEQ ID NO: 1807864 - DNA, 19 bp, Homo sapiens
agaagtttcgaggggtcct

SEQ ID NO: 1807865 - DNA, 13 bp, Homo sapiens
agaataaatgaag

SEQ ID NO: 1807866 - DNA, 19 bp, Homo sapiens
ccaggccctccatgggcta

SEQ ID NO: 1807867 - DNA, 14 bp, Homo sapiens
ccaggcctccagcc

SEQ ID NO: 1807868 - DNA, 15 bp, Homo sapiens
ccaggcctccagcct

SEQ ID NO: 1807869 - DNA, 16 bp, Homo sapiens
ccaggcctccagcctc

SEQ ID NO: 1807870 - DNA, 21 bp, Homo sapiens
ccaggcctccagcctctcccg

SEQ ID NO: 1807871 - DNA, 20 bp, Homo sapiens
ccaggcgttggtgccacttc

SEQ ID NO: 1807872 - DNA, 12 bp, Homo sapiens
ccaggctcttcc

SEQ ID NO: 1807873 - DNA, 18 bp, Homo sapiens
ccaggctcttcctggacc

SEQ ID NO: 1807874 - DNA, 19 bp, Homo sapiens
ccaggctcttcctggacct

SEQ ID NO: 1807875 - DNA, 20 bp, Homo sapiens
ccaggctcttcctggacctg

SEQ ID NO: 1807876 - DNA, 22 bp, Homo sapiens
ccaggctcttcctggacctgag

SEQ ID NO: 1807877 - DNA, 12 bp, Homo sapiens
ccaggctgcact

SEQ ID NO: 1807878 - DNA, 13 bp, Homo sapiens
ccaggctgcactg

SEQ ID NO: 1807879 - DNA, 18 bp, Homo sapiens
ccaggctggccagcccca

SEQ ID NO: 1807880 - DNA, 20 bp, Homo sapiens
ccaggctggccagccccaca

SEQ ID NO: 1807881 - DNA, 12 bp, Homo sapiens
ccagggccccca

SEQ ID NO: 1807882 - DNA, 12 bp, Homo sapiens
ccagggcccctc

SEQ ID NO: 1807883 - DNA, 19 bp, Homo sapiens
ccagggcccctccctctgc

SEQ ID NO: 1807884 - DNA, 21 bp, Homo sapiens
ccagggcccctccctctgccc

SEQ ID NO: 1807885 - DNA, 19 bp, Homo sapiens
ccagggcctgggggcagtg

SEQ ID NO: 1807886 - DNA, 17 bp, Homo sapiens
ccagggctggagacttc

SEQ ID NO: 1807887 - DNA, 15 bp, Homo sapiens
ccaggggcaggcaca

SEQ ID NO: 1807888 - DNA, 19 bp, Homo sapiens
ccaggggcaggcacagcac

SEQ ID NO: 1807889 - DNA, 14 bp, Homo sapiens
ccagggtccgcacc

SEQ ID NO: 1807890 - DNA, 21 bp, Homo sapiens
ccagggtccgcaccagctgct

SEQ ID NO: 1807891 - DNA, 23 bp, Homo sapiens
ccagggtccgcaccagctgctct

SEQ ID NO: 1807892 - DNA, 17 bp, Homo sapiens
ccagggtcttgggctac

SEQ ID NO: 1807893 - DNA, 19 bp, Homo sapiens
ccagggtcttgggctactg

SEQ ID NO: 1807894 - DNA, 23 bp, Homo sapiens
ccaggtgggcgggcagcacagca

SEQ ID NO: 1807895 - DNA, 20 bp, Homo sapiens
ccaggtggggtgaggcagtg

SEQ ID NO: 1807896 - DNA, 23 bp, Homo sapiens
ccaggtggggtgaggcagtgggt

SEQ ID NO: 1807897 - DNA, 17 bp, Homo sapiens
ccagtctgggtctgggt

SEQ ID NO: 1807898 - DNA, 19 bp, Homo sapiens
ccagtcttatttttctagt

SEQ ID NO: 1807899 - DNA, 12 bp, Homo sapiens
ccagtcttgcct

SEQ ID NO: 1807900 - DNA, 20 bp, Homo sapiens
ccagtgaacttacacttgga

SEQ ID NO: 1807901 - DNA, 21 bp, Homo sapiens
ccagtgaacttacacttggag

SEQ ID NO: 1807902 - DNA, 23 bp, Homo sapiens
ccagtgaacttacacttggagcc

SEQ ID NO: 1807903 - DNA, 17 bp, Homo sapiens
ccagtgaagtccttcag

SEQ ID NO: 1807904 - DNA, 18 bp, Homo sapiens
ccagtgctgccatgccac

SEQ ID NO: 1807905 - DNA, 21 bp, Homo sapiens
ccagtgctgccatgccactgc

SEQ ID NO: 1807906 - DNA, 20 bp, Homo sapiens
ccagtgggaggtgagaccac

SEQ ID NO: 1807907 - DNA, 23 bp, Homo sapiens
ccagtgggaggtgagaccacctc

SEQ ID NO: 1807908 - DNA, 13 bp, Homo sapiens
ccagtgtcttcct

SEQ ID NO: 1807909 - DNA, 21 bp, Homo sapiens
ccagttcacttctttgcagag

SEQ ID NO: 1807910 - DNA, 18 bp, Homo sapiens
ccataatagttagccctc

SEQ ID NO: 1807911 - DNA, 20 bp, Homo sapiens
ccataatagttagccctcag

SEQ ID NO: 1807912 - DNA, 13 bp, Homo sapiens
ccatactggcctc

SEQ ID NO: 1807913 - DNA, 14 bp, Homo sapiens
ccatactggcctcg

SEQ ID NO: 1807914 - DNA, 17 bp, Homo sapiens
ccatactggcctcgcct

SEQ ID NO: 1807915 - DNA, 18 bp, Homo sapiens
ccatacttttgagagggg

SEQ ID NO: 1807916 - DNA, 19 bp, Homo sapiens
ccatattttaaaaaatcaa

SEQ ID NO: 1807917 - DNA, 22 bp, Homo sapiens
ccatcatgtttacagaggacag

SEQ ID NO: 1807918 - DNA, 19 bp, Homo sapiens
ccatcccccctcaccaggg

SEQ ID NO: 1807919 - DNA, 12 bp, Homo sapiens
ccatcccctccc

SEQ ID NO: 1807920 - DNA, 23 bp, Homo sapiens
ccatccctgcttgcccgctccca

SEQ ID NO: 1807921 - DNA, 18 bp, Homo sapiens
ccatctcctcccatggcc

SEQ ID NO: 1807922 - DNA, 12 bp, Homo sapiens
ccatctgcccag

SEQ ID NO: 1807923 - DNA, 16 bp, Homo sapiens
ccatcttccaggtggg

SEQ ID NO: 1807924 - DNA, 16 bp, Homo sapiens
ccatgaccagaaacag

SEQ ID NO: 1807925 - DNA, 15 bp, Homo sapiens
ccatgccactgccag

SEQ ID NO: 1807926 - DNA, 18 bp, Homo sapiens
ccatgccactgccaggca

SEQ ID NO: 1807927 - DNA, 23 bp, Homo sapiens
ccatgccactgccaggcacctgg

SEQ ID NO: 1807928 - DNA, 22 bp, Homo sapiens
ccatgctcaacccccctcccag

SEQ ID NO: 1807929 - DNA, 23 bp, Homo sapiens
ccatgctcaacccccctcccaga

SEQ ID NO: 1807930 - DNA, 15 bp, Homo sapiens
ccatgctctgcccca

SEQ ID NO: 1807931 - DNA, 19 bp, Homo sapiens
ccatgctctgccccaagcc

SEQ ID NO: 1807932 - DNA, 19 bp, Homo sapiens
ccatgctgccttcagggag

SEQ ID NO: 1807933 - DNA, 20 bp, Homo sapiens
ccatgctgctttttggcaca

SEQ ID NO: 1807934 - DNA, 22 bp, Homo sapiens
ccatgctgctttttggcacagt

SEQ ID NO: 1807935 - DNA, 18 bp, Homo sapiens
ccatggcaccagccccct

SEQ ID NO: 1807936 - DNA, 21 bp, Homo sapiens
ccatggcaccagccccctgga

SEQ ID NO: 1807937 - DNA, 13 bp, Homo sapiens
ccatggctcaggc

SEQ ID NO: 1807938 - DNA, 16 bp, Homo sapiens
ccatggctcaggcaag

SEQ ID NO: 1807939 - DNA, 18 bp, Homo sapiens
ccatggctcaggcaagcc

SEQ ID NO: 1807940 - DNA, 20 bp, Homo sapiens
ccatgggcactgctgggtgg

SEQ ID NO: 1807941 - DNA, 13 bp, Homo sapiens
ccatgggcctggg

SEQ ID NO: 1807942 - DNA, 15 bp, Homo sapiens
ccatgggcctgggcc

SEQ ID NO: 1807943 - DNA, 11 bp, Homo sapiens
ccatgggcttg

SEQ ID NO: 1807944 - DNA, 21 bp, Homo sapiens
ccatgggcttggacttcctgg

SEQ ID NO: 1807945 - DNA, 18 bp, Homo sapiens
ccatgtgcctgcaccagg

SEQ ID NO: 1807946 - DNA, 12 bp, Homo sapiens
ccatgtgctgct

SEQ ID NO: 1807947 - DNA, 15 bp, Homo sapiens
ccatgtgctgctgtg

SEQ ID NO: 1807948 - DNA, 14 bp, Homo sapiens
ccatgtgtcatgta

SEQ ID NO: 1807949 - DNA, 22 bp, Homo sapiens
ccattcctcaccttttcccggg

SEQ ID NO: 1807950 - DNA, 23 bp, Homo sapiens
ccattgctggcaatgagtgtgcc

SEQ ID NO: 1807951 - DNA, 22 bp, Homo sapiens
cccaaccccgcggtgctctggc

SEQ ID NO: 1807952 - DNA, 19 bp, Homo sapiens
cccaactccaggggcacct

SEQ ID NO: 1807953 - DNA, 13 bp, Homo sapiens
cccaagcagccag

SEQ ID NO: 1807954 - DNA, 16 bp, Homo sapiens
cccaagcagccagcca

SEQ ID NO: 1807955 - DNA, 14 bp, Homo sapiens
cccaaggagctgat

SEQ ID NO: 1807956 - DNA, 11 bp, Homo sapiens
cccaataaagc

SEQ ID NO: 1807957 - DNA, 14 bp, Homo sapiens
cccaatgctttggg

SEQ ID NO: 1807958 - DNA, 17 bp, Homo sapiens
cccacagcttcctgagg

SEQ ID NO: 1807959 - DNA, 22 bp, Homo sapiens
cccacagtcctcacagcctctc

SEQ ID NO: 1807960 - DNA, 16 bp, Homo sapiens
cccaccaaactgcaca

SEQ ID NO: 1807961 - DNA, 22 bp, Homo sapiens
cccaccagaacgcaccccactg

SEQ ID NO: 1807962 - DNA, 23 bp, Homo sapiens
ctatattttttaaatttacagaa

SEQ ID NO: 1807963 - DNA, 16 bp, Homo sapiens
ctatcaacattgaata

SEQ ID NO: 1807964 - DNA, 16 bp, Homo sapiens
ctatcagtgacttctg

SEQ ID NO: 1807965 - DNA, 17 bp, Homo sapiens
ctatcagtgacttctga

SEQ ID NO: 1807966 - DNA, 16 bp, Homo sapiens
ctatcagtgtgccccc

SEQ ID NO: 1807967 - DNA, 19 bp, Homo sapiens
ctatctcgctagccatata

SEQ ID NO: 1807968 - DNA, 19 bp, Homo sapiens
ctatgagatggccatgctc

SEQ ID NO: 1807969 - DNA, 22 bp, Homo sapiens
ctatgagatggccatgctcaac

SEQ ID NO: 1807970 - DNA, 20 bp, Homo sapiens
ctatggggatagatgtgtgg

SEQ ID NO: 1807971 - DNA, 21 bp, Homo sapiens
ctatggggatagatgtgtgga

SEQ ID NO: 1807972 - DNA, 16 bp, Homo sapiens
ctatgtgaaactctat

SEQ ID NO: 1807973 - DNA, 23 bp, Homo sapiens
ctatgtgaaactctattatggaa

SEQ ID NO: 1807974 - DNA, 20 bp, Homo sapiens
ctatgtgagtttcagaaatt

SEQ ID NO: 1807975 - DNA, 21 bp, Homo sapiens
ctatgtgagtttcagaaattc

SEQ ID NO: 1807976 - DNA, 22 bp, Homo sapiens
ctattaaatgttgcacatcatt

SEQ ID NO: 1807977 - DNA, 14 bp, Homo sapiens
ctattagcaactgt

SEQ ID NO: 1807978 - DNA, 13 bp, Homo sapiens
ctattcaatgcaa

SEQ ID NO: 1807979 - DNA, 13 bp, Homo sapiens
ctattctgagcct

SEQ ID NO: 1807980 - DNA, 14 bp, Homo sapiens
ctattctgagcctt

SEQ ID NO: 1807981 - DNA, 14 bp, Homo sapiens
ctattgtagagcca

SEQ ID NO: 1807982 - DNA, 14 bp, Homo sapiens
ctatttctctcccc

SEQ ID NO: 1807983 - DNA, 12 bp, Homo sapiens
ctattttgaaga

SEQ ID NO: 1807984 - DNA, 16 bp, Homo sapiens
ctattttgaagaaaac

SEQ ID NO: 1807985 - DNA, 18 bp, Homo sapiens
ctattttgaagaaaacac

SEQ ID NO: 1807986 - DNA, 23 bp, Homo sapiens
ctatttttattttcttatgtaag

SEQ ID NO: 1807987 - DNA, 15 bp, Homo sapiens
ctcaaatttttcatc

SEQ ID NO: 1807988 - DNA, 19 bp, Homo sapiens
ctcaactaacccttaaaaa

SEQ ID NO: 1807989 - DNA, 23 bp, Homo sapiens
ctcaagatgtttatctgacacaa

SEQ ID NO: 1807990 - DNA, 18 bp, Homo sapiens
ctcaaggcctcccacagt

SEQ ID NO: 1807991 - DNA, 20 bp, Homo sapiens
ctcaaggcctcccacagtga

SEQ ID NO: 1807992 - DNA, 17 bp, Homo sapiens
ctcaatattcaataaag

SEQ ID NO: 1807993 - DNA, 18 bp, Homo sapiens
ctcaatattcaataaagc

SEQ ID NO: 1807994 - DNA, 19 bp, Homo sapiens
ctcaatattcaataaagct

SEQ ID NO: 1807995 - DNA, 18 bp, Homo sapiens
ctcaatttgaaacacaag

SEQ ID NO: 1807996 - DNA, 12 bp, Homo sapiens
ctcacacttttt

SEQ ID NO: 1807997 - DNA, 20 bp, Homo sapiens
ctcacagcctctcccttaat

SEQ ID NO: 1807998 - DNA, 10 bp, Homo sapiens
ctcaccaggg

SEQ ID NO: 1807999 - DNA, 20 bp, Homo sapiens
ctcaccaggggcaggcacag

SEQ ID NO: 1808000 - DNA, 12 bp, Homo sapiens
ctcaccagggtc

SEQ ID NO: 1808001 - DNA, 13 bp, Homo sapiens
ctcactggctggg

SEQ ID NO: 1808002 - DNA, 16 bp, Homo sapiens
ctcactggctggggca

SEQ ID NO: 1808003 - DNA, 20 bp, Homo sapiens
ctcactggctggggcagagg

SEQ ID NO: 1808004 - DNA, 16 bp, Homo sapiens
ctcactggtttacaaa

SEQ ID NO: 1808005 - DNA, 12 bp, Homo sapiens
ctcacttcatca

SEQ ID NO: 1808006 - DNA, 11 bp, Homo sapiens
ctcacttctgg

SEQ ID NO: 1808007 - DNA, 14 bp, Homo sapiens
ctcagaacagctga

SEQ ID NO: 1808008 - DNA, 15 bp, Homo sapiens
ctctgccccaagcag

SEQ ID NO: 1808009 - DNA, 20 bp, Homo sapiens
ctctgccccaagcagccagc

SEQ ID NO: 1808010 - DNA, 24 bp, Homo sapiens
ctctgccccaagcagccagccagt

SEQ ID NO: 1808011 - DNA, 14 bp, Homo sapiens
ctctgccccaagcc

SEQ ID NO: 1808012 - DNA, 16 bp, Homo sapiens
ctctgccccaagcccc

SEQ ID NO: 1808013 - DNA, 20 bp, Homo sapiens
ctctgccccttgggcatcca

SEQ ID NO: 1808014 - DNA, 19 bp, Homo sapiens
ctctgctcagagtctatca

SEQ ID NO: 1808015 - DNA, 15 bp, Homo sapiens
ctctgctctagccag

SEQ ID NO: 1808016 - DNA, 16 bp, Homo sapiens
ctctgctctagccagg

SEQ ID NO: 1808017 - DNA, 18 bp, Homo sapiens
ctctgctctagccaggag

SEQ ID NO: 1808018 - DNA, 19 bp, Homo sapiens
ctctgctctagccaggagt

SEQ ID NO: 1808019 - DNA, 15 bp, Homo sapiens
ctctggcggcttcct

SEQ ID NO: 1808020 - DNA, 14 bp, Homo sapiens
ctctgggctcaggg

SEQ ID NO: 1808021 - DNA, 15 bp, Homo sapiens
ctctgggctcagggc

SEQ ID NO: 1808022 - DNA, 20 bp, Homo sapiens
ctctgggctcagggctggag

SEQ ID NO: 1808023 - DNA, 22 bp, Homo sapiens
ctctgggctcagggctggagtg

SEQ ID NO: 1808024 - DNA, 16 bp, Homo sapiens
ctctgtcatcactccc

SEQ ID NO: 1808025 - DNA, 12 bp, Homo sapiens
ctctgtccaggc

SEQ ID NO: 1808026 - DNA, 13 bp, Homo sapiens
ctctgtccaggcc

SEQ ID NO: 1808027 - DNA, 18 bp, Homo sapiens
ctctgtcctgacttcagg

SEQ ID NO: 1808028 - DNA, 12 bp, Homo sapiens
ctctgtgcccat

SEQ ID NO: 1808029 - DNA, 14 bp, Homo sapiens
ctctgtgcccatgg

SEQ ID NO: 1808030 - DNA, 19 bp, Homo sapiens
ctctgtggcctgtgtccag

SEQ ID NO: 1808031 - DNA, 22 bp, Homo sapiens
ctctgtggcctgtgtccagcag

SEQ ID NO: 1808032 - DNA, 14 bp, Homo sapiens
ctctgtgggctgca

SEQ ID NO: 1808033 - DNA, 17 bp, Homo sapiens
ctctgtgggctgcactc

SEQ ID NO: 1808034 - DNA, 13 bp, Homo sapiens
ctctgtgtcactg

SEQ ID NO: 1808035 - DNA, 20 bp, Homo sapiens
ctctgtgtcactggctgcct

SEQ ID NO: 1808036 - DNA, 13 bp, Homo sapiens
ctcttagtgcccg

SEQ ID NO: 1808037 - DNA, 15 bp, Homo sapiens
ctcttagtgcccgcc

SEQ ID NO: 1808038 - DNA, 13 bp, Homo sapiens
ctcttcctggacc

SEQ ID NO: 1808039 - DNA, 18 bp, Homo sapiens
ctcttcctggacctgagt

SEQ ID NO: 1808040 - DNA, 22 bp, Homo sapiens
ctcttcttattcatgctttctc

SEQ ID NO: 1808041 - DNA, 19 bp, Homo sapiens
ctcttgccccaacccccag

SEQ ID NO: 1808042 - DNA, 23 bp, Homo sapiens
ctcttgccccaacccccagcacc

SEQ ID NO: 1808043 - DNA, 23 bp, Homo sapiens
ctcttgggaactccactctcctt

SEQ ID NO: 1808044 - DNA, 12 bp, Homo sapiens
ctctttgttcat

SEQ ID NO: 1808045 - DNA, 19 bp, Homo sapiens
ctctttttgtacctggtga

SEQ ID NO: 1808046 - DNA, 19 bp, Homo sapiens
ctgaaaaacacaacttgtg

SEQ ID NO: 1808047 - DNA, 14 bp, Homo sapiens
ctgaaaaagaaaaa

SEQ ID NO: 1808048 - DNA, 20 bp, Homo sapiens
ctgaaaagcaattgccctgt

SEQ ID NO: 1808049 - DNA, 14 bp, Homo sapiens
ctgaaagcagcagc

SEQ ID NO: 1808050 - DNA, 15 bp, Homo sapiens
ctgaaagcagcagct

SEQ ID NO: 1808051 - DNA, 17 bp, Homo sapiens
ctgaaagcagcagctag

SEQ ID NO: 1808052 - DNA, 18 bp, Homo sapiens
ctgaaagcagcagctagg

SEQ ID NO: 1808053 - DNA, 19 bp, Homo sapiens
ctgaaccagagctggaaca

SEQ ID NO: 1808054 - DNA, 21 bp, Homo sapiens
ctgaaccagagctggaacaca

SEQ ID NO: 1808055 - DNA, 15 bp, Homo sapiens
ctgaaccccatgggc

SEQ ID NO: 1808056 - DNA, 16 bp, Homo sapiens
ctgaaccccatgggct

SEQ ID NO: 1808057 - DNA, 17 bp, Homo sapiens
ctgaaccccatgggctt

SEQ ID NO: 1808058 - DNA, 21 bp, Homo sapiens
ctgaagagaagggcagggctg

SEQ ID NO: 1808059 - DNA, 15 bp, Homo sapiens
ctgaagctagaaaca

SEQ ID NO: 1808060 - DNA, 18 bp, Homo sapiens
ctgcccctccccagccct

SEQ ID NO: 1808061 - DNA, 13 bp, Homo sapiens
ctgcccctgtagg

SEQ ID NO: 1808062 - DNA, 12 bp, Homo sapiens
ctgcccctgtct

SEQ ID NO: 1808063 - DNA, 14 bp, Homo sapiens
ctgcccgctcccag

SEQ ID NO: 1808064 - DNA, 17 bp, Homo sapiens
ctgcccggcgccctctg

SEQ ID NO: 1808065 - DNA, 21 bp, Homo sapiens
ctgcccggcgccctctgtcct

SEQ ID NO: 1808066 - DNA, 17 bp, Homo sapiens
ctgccctccctccttcc

SEQ ID NO: 1808067 - DNA, 15 bp, Homo sapiens
ctgccctgccacctg

SEQ ID NO: 1808068 - DNA, 16 bp, Homo sapiens
ctgccctgccacctgt

SEQ ID NO: 1808069 - DNA, 18 bp, Homo sapiens
ctgcctatccatcctgcg

SEQ ID NO: 1808070 - DNA, 24 bp, Homo sapiens
ctgcctgctccttggcacccccat

SEQ ID NO: 1808071 - DNA, 12 bp, Homo sapiens
ctgcctggcctg

SEQ ID NO: 1808072 - DNA, 19 bp, Homo sapiens
ctgcctggcctggctcccc

SEQ ID NO: 1808073 - DNA, 12 bp, Homo sapiens
ctgcctgggcct

SEQ ID NO: 1808074 - DNA, 16 bp, Homo sapiens
ctgcctgggcctgtgc

SEQ ID NO: 1808075 - DNA, 18 bp, Homo sapiens
ctgcctgggcctgtgcag

SEQ ID NO: 1808076 - DNA, 19 bp, Homo sapiens
ctgcctgggcctgtgcagc

SEQ ID NO: 1808077 - DNA, 13 bp, Homo sapiens
ctgccttcaggga

SEQ ID NO: 1808078 - DNA, 12 bp, Homo sapiens
ctgccttcctca

SEQ ID NO: 1808079 - DNA, 13 bp, Homo sapiens
ctgccttgccatg

SEQ ID NO: 1808080 - DNA, 15 bp, Homo sapiens
ctgcgggtctgaagg

SEQ ID NO: 1808081 - DNA, 17 bp, Homo sapiens
ctgcgggtctgaaggaa

SEQ ID NO: 1808082 - DNA, 19 bp, Homo sapiens
ctgcgtcctgacgccctgc

SEQ ID NO: 1808083 - DNA, 16 bp, Homo sapiens
ctgcgttggagccact

SEQ ID NO: 1808084 - DNA, 17 bp, Homo sapiens
ctgcgttggagccactc

SEQ ID NO: 1808085 - DNA, 22 bp, Homo sapiens
ctgcgttggagccactcctgtc

SEQ ID NO: 1808086 - DNA, 18 bp, Homo sapiens
ctgctaccctccctgctg

SEQ ID NO: 1808087 - DNA, 13 bp, Homo sapiens
ctgctagagcaac

SEQ ID NO: 1808088 - DNA, 19 bp, Homo sapiens
ctgctagagcaacccctgt

SEQ ID NO: 1808089 - DNA, 23 bp, Homo sapiens
ctgctagagcaacccctgtaccc

SEQ ID NO: 1808090 - DNA, 16 bp, Homo sapiens
ctgctccacagtgttg

SEQ ID NO: 1808091 - DNA, 21 bp, Homo sapiens
ctgctccacagtgttggcgag

SEQ ID NO: 1808092 - DNA, 16 bp, Homo sapiens
ctgctccttggcaccc

SEQ ID NO: 1808093 - DNA, 13 bp, Homo sapiens
ctgctcgggccca

SEQ ID NO: 1808094 - DNA, 14 bp, Homo sapiens
ctgctcgggcccag

SEQ ID NO: 1808095 - DNA, 16 bp, Homo sapiens
ctgctcgggcccaggc

SEQ ID NO: 1808096 - DNA, 17 bp, Homo sapiens
ctgctcgggcccaggcc

SEQ ID NO: 1808097 - DNA, 22 bp, Homo sapiens
ctgctcgggcccaggccatctt

SEQ ID NO: 1808098 - DNA, 15 bp, Homo sapiens
ctgctctagccagga

SEQ ID NO: 1808099 - DNA, 17 bp, Homo sapiens
ctgctctagctggcagg

SEQ ID NO: 1808100 - DNA, 22 bp, Homo sapiens
ctgctctagctggcaggacaca

SEQ ID NO: 1808101 - DNA, 12 bp, Homo sapiens
ctgctctgcccc

SEQ ID NO: 1808102 - DNA, 17 bp, Homo sapiens
ctgctcttagtgcccgc

SEQ ID NO: 1808103 - DNA, 12 bp, Homo sapiens
ctgctgagccac

SEQ ID NO: 1808104 - DNA, 20 bp, Homo sapiens
ctgctgcaccaacccagccg

SEQ ID NO: 1808105 - DNA, 14 bp, Homo sapiens
ctgctgcaccagag

SEQ ID NO: 1808106 - DNA, 16 bp, Homo sapiens
ctgctgcaccagagtg

SEQ ID NO: 1808107 - DNA, 17 bp, Homo sapiens
ctgctgcaccagagtga

SEQ ID NO: 1808108 - DNA, 16 bp, Homo sapiens
ctgctgcagaggggca

SEQ ID NO: 1808109 - DNA, 17 bp, Homo sapiens
ctgctgcagaggggcag

SEQ ID NO: 1808110 - DNA, 22 bp, Homo sapiens
ctgctgctgtaactgctgagcc

SEQ ID NO: 1808111 - DNA, 20 bp, Homo sapiens
ctgctgggaaccccgcagcc

SEQ ID NO: 1808112 - DNA, 22 bp, Homo sapiens
ctgctgggaaccccgcagcccg

SEQ ID NO: 1808113 - DNA, 13 bp, Homo sapiens
ctgctgggctggg

SEQ ID NO: 1808114 - DNA, 11 bp, Homo sapiens
ctgctgggctt

SEQ ID NO: 1808115 - DNA, 11 bp, Homo sapiens
ctgctgggtgg

SEQ ID NO: 1808116 - DNA, 12 bp, Homo sapiens
ctgctgggtggc

SEQ ID NO: 1808117 - DNA, 14 bp, Homo sapiens
ctgctgggtggccc

SEQ ID NO: 1808118 - DNA, 18 bp, Homo sapiens
ctgctgggtggcccatcc

SEQ ID NO: 1808119 - DNA, 14 bp, Homo sapiens
ctgctgtcccctct

SEQ ID NO: 1808120 - DNA, 18 bp, Homo sapiens
ctgctgtcccctcttgcc

SEQ ID NO: 1808121 - DNA, 23 bp, Homo sapiens
ctccccacgagtcacctgcaagc

SEQ ID NO: 1808122 - DNA, 17 bp, Homo sapiens
ctccccagccagccctt

SEQ ID NO: 1808123 - DNA, 22 bp, Homo sapiens
ctcccccgacactgctgcacca

SEQ ID NO: 1808124 - DNA, 19 bp, Homo sapiens
ctcccctctcgccccatcc

SEQ ID NO: 1808125 - DNA, 20 bp, Homo sapiens
ctcccctctcgccccatccc

SEQ ID NO: 1808126 - DNA, 17 bp, Homo sapiens
ctcccggctgcctgccg

SEQ ID NO: 1808127 - DNA, 19 bp, Homo sapiens
ctccctccttccttcttgc

SEQ ID NO: 1808128 - DNA, 20 bp, Homo sapiens
ctccctccttccttcttgct

SEQ ID NO: 1808129 - DNA, 20 bp, Homo sapiens
ctccctctgccccaagcagc

SEQ ID NO: 1808130 - DNA, 21 bp, Homo sapiens
ctccctctgccccaagcagcc

SEQ ID NO: 1808131 - DNA, 22 bp, Homo sapiens
ctccctctgccccaagcagcca

SEQ ID NO: 1808132 - DNA, 23 bp, Homo sapiens
ctccctctgccccaagcagccag

SEQ ID NO: 1808133 - DNA, 12 bp, Homo sapiens
ctccctgagctt

SEQ ID NO: 1808134 - DNA, 17 bp, Homo sapiens
ctccctgagctttgggg

SEQ ID NO: 1808135 - DNA, 15 bp, Homo sapiens
ctccctggccctcaa

SEQ ID NO: 1808136 - DNA, 22 bp, Homo sapiens
ctccctgtctccagggccccca

SEQ ID NO: 1808137 - DNA, 14 bp, Homo sapiens
ctcccttcctggcc

SEQ ID NO: 1808138 - DNA, 15 bp, Homo sapiens
ctcccttcctggcct

SEQ ID NO: 1808139 - DNA, 18 bp, Homo sapiens
ctccggggtctgtgctgt

SEQ ID NO: 1808140 - DNA, 21 bp, Homo sapiens
ctccggggtctgtgctgtgcc

SEQ ID NO: 1808141 - DNA, 17 bp, Homo sapiens
ctccgtccacccaggct

SEQ ID NO: 1808142 - DNA, 18 bp, Homo sapiens
ctccgtccacccaggctg

SEQ ID NO: 1808143 - DNA, 20 bp, Homo sapiens
ctccgtttatgggccttgct

SEQ ID NO: 1808144 - DNA, 21 bp, Homo sapiens
ctccgtttatgggccttgctt

SEQ ID NO: 1808145 - DNA, 14 bp, Homo sapiens
ctcctacccctccc

SEQ ID NO: 1808146 - DNA, 16 bp, Homo sapiens
ctcctacccctcccag

SEQ ID NO: 1808147 - DNA, 17 bp, Homo sapiens
ctcctacccctcccagc

SEQ ID NO: 1808148 - DNA, 13 bp, Homo sapiens
ctcctaccctccc

SEQ ID NO: 1808149 - DNA, 19 bp, Homo sapiens
ctcctaccctcccaccaga

SEQ ID NO: 1808150 - DNA, 22 bp, Homo sapiens
ctcctaccctcccaccagaacg

SEQ ID NO: 1808151 - DNA, 13 bp, Homo sapiens
ctcctagaggtgg

SEQ ID NO: 1808152 - DNA, 17 bp, Homo sapiens
ctcctagaggtgggcag

SEQ ID NO: 1808153 - DNA, 16 bp, Homo sapiens
ctcctccacagtgctg

SEQ ID NO: 1808154 - DNA, 19 bp, Homo sapiens
ctcctccacagtgctgctt

SEQ ID NO: 1808155 - DNA, 20 bp, Homo sapiens
ctcctccacagtgctgcttc

SEQ ID NO: 1808156 - DNA, 22 bp, Homo sapiens
ctcctccaccgccatggcttcc

SEQ ID NO: 1808157 - DNA, 16 bp, Homo sapiens
ctcctcccatggcctt

SEQ ID NO: 1808158 - DNA, 20 bp, Homo sapiens
ctcctctccttgggctcctg

SEQ ID NO: 1808159 - DNA, 23 bp, Homo sapiens
ctcctctccttgggctcctggct

SEQ ID NO: 1808160 - DNA, 20 bp, Homo sapiens
ctcctcttaccgtagcctcc

SEQ ID NO: 1808161 - DNA, 20 bp, Homo sapiens
ctcctgaaggtttcctggtc

SEQ ID NO: 1808162 - DNA, 17 bp, Homo sapiens
ctcctgagaaggcgagg

SEQ ID NO: 1808163 - DNA, 21 bp, Homo sapiens
ctcctgagaaggcgaggagag

SEQ ID NO: 1808164 - DNA, 19 bp, Homo sapiens
ctcctgatggccaagagca

SEQ ID NO: 1808165 - DNA, 16 bp, Homo sapiens
ctcctgccccctgcca

SEQ ID NO: 1808166 - DNA, 17 bp, Homo sapiens
ctcctgccccctgccag

SEQ ID NO: 1808167 - DNA, 16 bp, Homo sapiens
ctcctgctgcagaggg

SEQ ID NO: 1808168 - DNA, 21 bp, Homo sapiens
ctcctgctgcctaataaagag

SEQ ID NO: 1808169 - DNA, 14 bp, Homo sapiens
ctcctggctgccag

SEQ ID NO: 1808170 - DNA, 17 bp, Homo sapiens
ctgaaggaatagccaga

SEQ ID NO: 1808171 - DNA, 14 bp, Homo sapiens
ctgaaggggcacac

SEQ ID NO: 1808172 - DNA, 16 bp, Homo sapiens
ctgaaggggcacacca

SEQ ID NO: 1808173 - DNA, 21 bp, Homo sapiens
ctgaaggggcacaccactgcc

SEQ ID NO: 1808174 - DNA, 22 bp, Homo sapiens
ctgaatttgtaagcaacttgct

SEQ ID NO: 1808175 - DNA, 15 bp, Homo sapiens
ctgacaatggcagct

SEQ ID NO: 1808176 - DNA, 16 bp, Homo sapiens
ctgacaatggcagcta

SEQ ID NO: 1808177 - DNA, 23 bp, Homo sapiens
ctgacaatggcagctagactgga

SEQ ID NO: 1808178 - DNA, 17 bp, Homo sapiens
ctgacacctaccatgct

SEQ ID NO: 1808179 - DNA, 21 bp, Homo sapiens
ctgacacctaccatgctgctt

SEQ ID NO: 1808180 - DNA, 21 bp, Homo sapiens
ctgacactgcggggcttggct

SEQ ID NO: 1808181 - DNA, 23 bp, Homo sapiens
ctgacactgcggggcttggctga

SEQ ID NO: 1808182 - DNA, 13 bp, Homo sapiens
ctgacagaaatgc

SEQ ID NO: 1808183 - DNA, 17 bp, Homo sapiens
ctgacagtcctctccac

SEQ ID NO: 1808184 - DNA, 19 bp, Homo sapiens
ctgacagtcctctccacct

SEQ ID NO: 1808185 - DNA, 21 bp, Homo sapiens
ctgacagtcctctccacctag

SEQ ID NO: 1808186 - DNA, 15 bp, Homo sapiens
ctgacagtctcaaat

SEQ ID NO: 1808187 - DNA, 21 bp, Homo sapiens
ctgacgccctgcgttggagcc

SEQ ID NO: 1808188 - DNA, 20 bp, Homo sapiens
ctgactccagagtctgagcc

SEQ ID NO: 1808189 - DNA, 20 bp, Homo sapiens
ctgacttcaggggctgcccg

SEQ ID NO: 1808190 - DNA, 21 bp, Homo sapiens
ctgagaaggcgaggagagtgg

SEQ ID NO: 1808191 - DNA, 16 bp, Homo sapiens
ctgagaagtgtatata

SEQ ID NO: 1808192 - DNA, 14 bp, Homo sapiens
ctgagactccagaa

SEQ ID NO: 1808193 - DNA, 20 bp, Homo sapiens
ctgagactccagaatctgct

SEQ ID NO: 1808194 - DNA, 18 bp, Homo sapiens
ctgagcattcaggcagca

SEQ ID NO: 1808195 - DNA, 22 bp, Homo sapiens
ctgagcattcaggcagcactga

SEQ ID NO: 1808196 - DNA, 13 bp, Homo sapiens
ctgagctggggcc

SEQ ID NO: 1808197 - DNA, 17 bp, Homo sapiens
ctgagcttagccttgtg

SEQ ID NO: 1808198 - DNA, 23 bp, Homo sapiens
ctgaggaagagggactgttcttt

SEQ ID NO: 1808199 - DNA, 14 bp, Homo sapiens
ctgaggactggaga

SEQ ID NO: 1808200 - DNA, 18 bp, Homo sapiens
ctgagggctaattctggg

SEQ ID NO: 1808201 - DNA, 19 bp, Homo sapiens
ctgaggtctcgctgatgct

SEQ ID NO: 1808202 - DNA, 17 bp, Homo sapiens
ctgagtccctccatgca

SEQ ID NO: 1808203 - DNA, 20 bp, Homo sapiens
ctgagtggaatgcagggaag

SEQ ID NO: 1808204 - DNA, 23 bp, Homo sapiens
ctgagtgtgggagtgcagagaaa

SEQ ID NO: 1808205 - DNA, 23 bp, Homo sapiens
ctgagttacttgtctgaggcctc

SEQ ID NO: 1808206 - DNA, 17 bp, Homo sapiens
ctgatactattcaatgc

SEQ ID NO: 1808207 - DNA, 20 bp, Homo sapiens
ctgatactattcaatgcaat

SEQ ID NO: 1808208 - DNA, 20 bp, Homo sapiens
ctgatatctgtttgcttcta

SEQ ID NO: 1808209 - DNA, 12 bp, Homo sapiens
ctgatgctgccc

SEQ ID NO: 1808210 - DNA, 18 bp, Homo sapiens
ctgatgctgggctgggtg

SEQ ID NO: 1808211 - DNA, 21 bp, Homo sapiens
ctgatggaccgggtgggcctg

SEQ ID NO: 1808212 - DNA, 22 bp, Homo sapiens
ctgatggaccgggtgggcctgg

SEQ ID NO: 1808213 - DNA, 15 bp, Homo sapiens
ctgatggccaagagc

SEQ ID NO: 1808214 - DNA, 16 bp, Homo sapiens
ctgatggccaagagca

SEQ ID NO: 1808215 - DNA, 20 bp, Homo sapiens
ctgatggccaagggggtgga

SEQ ID NO: 1808216 - DNA, 21 bp, Homo sapiens
ctgatggccaagggggtggac

SEQ ID NO: 1808217 - DNA, 14 bp, Homo sapiens
ctgatggtgagctg

SEQ ID NO: 1808218 - DNA, 16 bp, Homo sapiens
ctgatggtgagctggg

SEQ ID NO: 1808219 - DNA, 18 bp, Homo sapiens
ctgatggtgagctgggaa

SEQ ID NO: 1808220 - DNA, 13 bp, Homo sapiens
ctgatttccaggc

SEQ ID NO: 1808221 - DNA, 15 bp, Homo sapiens
ctgatttccaggccc

SEQ ID NO: 1808222 - DNA, 16 bp, Homo sapiens
ctgatttccaggcccc

SEQ ID NO: 1808223 - DNA, 17 bp, Homo sapiens
ctgatttccaggcccct

SEQ ID NO: 1808224 - DNA, 19 bp, Homo sapiens
ctgatttccaggcccctga

SEQ ID NO: 1808225 - DNA, 22 bp, Homo sapiens
ctgatttccaggcccctgagga

SEQ ID NO: 1808226 - DNA, 16 bp, Homo sapiens
ctgcaactagccaagg

SEQ ID NO: 1808227 - DNA, 21 bp, Homo sapiens
ctgcaactagccaaggctagt

SEQ ID NO: 1808228 - DNA, 15 bp, Homo sapiens
ctgcaagccccaggg

SEQ ID NO: 1808229 - DNA, 17 bp, Homo sapiens
ctgcaagccccagggcc

SEQ ID NO: 1808230 - DNA, 20 bp, Homo sapiens
ctgcaagccccagggcctgg

SEQ ID NO: 1808231 - DNA, 21 bp, Homo sapiens
ctgcaatctccagggctgccc

SEQ ID NO: 1808232 - DNA, 14 bp, Homo sapiens
ctgcacacacagct

SEQ ID NO: 1808233 - DNA, 23 bp, Homo sapiens
cttgcctcggctcctgctgcacc

SEQ ID NO: 1808234 - DNA, 16 bp, Homo sapiens
cttgcgtcctgcagag

SEQ ID NO: 1808235 - DNA, 18 bp, Homo sapiens
cttgcgtcctgcagagga

SEQ ID NO: 1808236 - DNA, 13 bp, Homo sapiens
cttgctccagggt

SEQ ID NO: 1808237 - DNA, 14 bp, Homo sapiens
cttgctccagggtc

SEQ ID NO: 1808238 - DNA, 17 bp, Homo sapiens
cttgctccagggtcttg

SEQ ID NO: 1808239 - DNA, 21 bp, Homo sapiens
cttgctccagggtcttgggct

SEQ ID NO: 1808240 - DNA, 12 bp, Homo sapiens
cttgctttgggc

SEQ ID NO: 1808241 - DNA, 13 bp, Homo sapiens
cttgctttgggct

SEQ ID NO: 1808242 - DNA, 17 bp, Homo sapiens
cttgctttgggctttgc

SEQ ID NO: 1808243 - DNA, 16 bp, Homo sapiens
cttggacttcctgggg

SEQ ID NO: 1808244 - DNA, 17 bp, Homo sapiens
cttggacttcctggggc

SEQ ID NO: 1808245 - DNA, 18 bp, Homo sapiens
cttggacttcctggggcc

SEQ ID NO: 1808246 - DNA, 19 bp, Homo sapiens
cttggacttcctggggccc

SEQ ID NO: 1808247 - DNA, 15 bp, Homo sapiens
cttggagcccgtgca

SEQ ID NO: 1808248 - DNA, 17 bp, Homo sapiens
cttggcacccccatgct

SEQ ID NO: 1808249 - DNA, 17 bp, Homo sapiens
cttgggctactggcagc

SEQ ID NO: 1808250 - DNA, 13 bp, Homo sapiens
cttgggctcctgg

SEQ ID NO: 1808251 - DNA, 19 bp, Homo sapiens
cttgggctcctggctgcca

SEQ ID NO: 1808252 - DNA, 15 bp, Homo sapiens
cttggggcctggctt

SEQ ID NO: 1808253 - DNA, 16 bp, Homo sapiens
cttggtccctggtccc

SEQ ID NO: 1808254 - DNA, 21 bp, Homo sapiens
cttggtggggctcgtggcctt

SEQ ID NO: 1808255 - DNA, 15 bp, Homo sapiens
cttggtgtcgtttcc

SEQ ID NO: 1808256 - DNA, 17 bp, Homo sapiens
cttgtatggctctcaag

SEQ ID NO: 1808257 - DNA, 16 bp, Homo sapiens
cttgtcctgccagctg

SEQ ID NO: 1808258 - DNA, 19 bp, Homo sapiens
cttgtcctgccagctgcct

SEQ ID NO: 1808259 - DNA, 21 bp, Homo sapiens
cttgtctgaggcctcatccct

SEQ ID NO: 1808260 - DNA, 22 bp, Homo sapiens
cttgtctgaggcctcatccctc

SEQ ID NO: 1808261 - DNA, 12 bp, Homo sapiens
cttgtgactgaa

SEQ ID NO: 1808262 - DNA, 13 bp, Homo sapiens
cttgtgccctgcc

SEQ ID NO: 1808263 - DNA, 16 bp, Homo sapiens
cttgtgctcacgctcc

SEQ ID NO: 1808264 - DNA, 17 bp, Homo sapiens
cttgtgctcacgctccc

SEQ ID NO: 1808265 - DNA, 23 bp, Homo sapiens
cttgtgcttggtggggctcgtgg

SEQ ID NO: 1808266 - DNA, 21 bp, Homo sapiens
cttgtggttgtatatatcagg

SEQ ID NO: 1808267 - DNA, 13 bp, Homo sapiens
cttgttgtggagg

SEQ ID NO: 1808268 - DNA, 17 bp, Homo sapiens
ctttacaactaaataac

SEQ ID NO: 1808269 - DNA, 21 bp, Homo sapiens
ctttactcccttcctggcctc

SEQ ID NO: 1808270 - DNA, 14 bp, Homo sapiens
ctttcatacattat

SEQ ID NO: 1808271 - DNA, 16 bp, Homo sapiens
ctttcatacattatat

SEQ ID NO: 1808272 - DNA, 18 bp, Homo sapiens
ctttcgaataaagtgaat

SEQ ID NO: 1808273 - DNA, 14 bp, Homo sapiens
ctttctccggggtc

SEQ ID NO: 1808274 - DNA, 21 bp, Homo sapiens
ctttctccggggtctgtgctg

SEQ ID NO: 1808275 - DNA, 16 bp, Homo sapiens
ctttgcaggctctggg

SEQ ID NO: 1808276 - DNA, 19 bp, Homo sapiens
ctttgcaggctctgggctc

SEQ ID NO: 1808277 - DNA, 16 bp, Homo sapiens
ctttgccaaggctctc

SEQ ID NO: 1808278 - DNA, 22 bp, Homo sapiens
ctttgccaaggctctcccctct

SEQ ID NO: 1808279 - DNA, 13 bp, Homo sapiens
ctttgccttccaa

SEQ ID NO: 1808280 - DNA, 17 bp, Homo sapiens
ctttgctgcccctgtct

SEQ ID NO: 1808281 - DNA, 17 bp, Homo sapiens
gaacttgaggacacatg

SEQ ID NO: 1808282 - DNA, 19 bp, Homo sapiens
gaacttgaggacacatgtc

SEQ ID NO: 1808283 - DNA, 13 bp, Homo sapiens
gaagaaaacacaa

SEQ ID NO: 1808284 - DNA, 13 bp, Homo sapiens
gaagaagtgtgtc

SEQ ID NO: 1808285 - DNA, 18 bp, Homo sapiens
gaagacccagtgtaaaga

SEQ ID NO: 1808286 - DNA, 23 bp, Homo sapiens
gaagacccagtgtaaagaataaa

SEQ ID NO: 1808287 - DNA, 14 bp, Homo sapiens
gaagagcacagccc

SEQ ID NO: 1808288 - DNA, 22 bp, Homo sapiens
gaagagcagcctgatggccaag

SEQ ID NO: 1808289 - DNA, 16 bp, Homo sapiens
gaagcagtgcctcgag

SEQ ID NO: 1808290 - DNA, 22 bp, Homo sapiens
gaagcagtgcctcgaggcaccg

SEQ ID NO: 1808291 - DNA, 16 bp, Homo sapiens
gaagctgtactcagag

SEQ ID NO: 1808292 - DNA, 22 bp, Homo sapiens
gaagctgtactcagagcagagc

SEQ ID NO: 1808293 - DNA, 15 bp, Homo sapiens
gaaggaatagccaga

SEQ ID NO: 1808294 - DNA, 17 bp, Homo sapiens
gaaggaatagccagaga

SEQ ID NO: 1808295 - DNA, 13 bp, Homo sapiens
gaaggagggcaga

SEQ ID NO: 1808296 - DNA, 16 bp, Homo sapiens
gaaggagggcagagcc

SEQ ID NO: 1808297 - DNA, 12 bp, Homo sapiens
gaaggcagaata

SEQ ID NO: 1808298 - DNA, 13 bp, Homo sapiens
gaaggcagctgct

SEQ ID NO: 1808299 - DNA, 14 bp, Homo sapiens
gaaggcagctgctc

SEQ ID NO: 1808300 - DNA, 15 bp, Homo sapiens
gaaggcagctgctct

SEQ ID NO: 1808301 - DNA, 13 bp, Homo sapiens
gaaggcagggcag

SEQ ID NO: 1808302 - DNA, 19 bp, Homo sapiens
gaaggcctcttgtgctcac

SEQ ID NO: 1808303 - DNA, 13 bp, Homo sapiens
gaaggcgaggaga

SEQ ID NO: 1808304 - DNA, 15 bp, Homo sapiens
gaaggctatggggat

SEQ ID NO: 1808305 - DNA, 15 bp, Homo sapiens
gaaggctggctgagt

SEQ ID NO: 1808306 - DNA, 18 bp, Homo sapiens
gaagggaaagcgggcagc

SEQ ID NO: 1808307 - DNA, 23 bp, Homo sapiens
gaaggggcacaccactgccctgc

SEQ ID NO: 1808308 - DNA, 19 bp, Homo sapiens
gaaggggccccggggctgg

SEQ ID NO: 1808309 - DNA, 22 bp, Homo sapiens
gaaggggccccggggctggcaa

SEQ ID NO: 1808310 - DNA, 22 bp, Homo sapiens
gaaggtgctgagcttagccttg

SEQ ID NO: 1808311 - DNA, 22 bp, Homo sapiens
gaagtattaaaatgcatatttc

SEQ ID NO: 1808312 - DNA, 22 bp, Homo sapiens
gaagtccttcagtgagcccctc

SEQ ID NO: 1808313 - DNA, 18 bp, Homo sapiens
gaagtgtgggtctgtgtg

SEQ ID NO: 1808314 - DNA, 24 bp, Homo sapiens
gaagtgtgggtctgtgtgtgtgta

SEQ ID NO: 1808315 - DNA, 12 bp, Homo sapiens
gaataaatgaag

SEQ ID NO: 1808316 - DNA, 18 bp, Homo sapiens
gaatagccagagaggagc

SEQ ID NO: 1808317 - DNA, 20 bp, Homo sapiens
gaatatctgagaattgcaaa

SEQ ID NO: 1808318 - DNA, 19 bp, Homo sapiens
gaatgcagattcctgggcc

SEQ ID NO: 1808319 - DNA, 14 bp, Homo sapiens
gaatggatggggag

SEQ ID NO: 1808320 - DNA, 19 bp, Homo sapiens
gaatgtcagtatgtggaag

SEQ ID NO: 1808321 - DNA, 14 bp, Homo sapiens
gaatgtgattttaa

SEQ ID NO: 1808322 - DNA, 15 bp, Homo sapiens
gaatgttccctgcac

SEQ ID NO: 1808323 - DNA, 17 bp, Homo sapiens
gaatgttccctgcaccc

SEQ ID NO: 1808324 - DNA, 20 bp, Homo sapiens
gaattcctttacaactaaat

SEQ ID NO: 1808325 - DNA, 15 bp, Homo sapiens
gcaccccctcctgct

SEQ ID NO: 1808326 - DNA, 17 bp, Homo sapiens
gcaccccctcctgctgc

SEQ ID NO: 1808327 - DNA, 16 bp, Homo sapiens
gcacccgggctcaggg

SEQ ID NO: 1808328 - DNA, 18 bp, Homo sapiens
gcaccctggaaaggggag

SEQ ID NO: 1808329 - DNA, 18 bp, Homo sapiens
gcaccggcgctgcaggta

SEQ ID NO: 1808330 - DNA, 22 bp, Homo sapiens
gcacctcctaccctcccaccag

SEQ ID NO: 1808331 - DNA, 16 bp, Homo sapiens
gcacctgaaccccatg

SEQ ID NO: 1808332 - DNA, 24 bp, Homo sapiens
gcacctgaaccccatgggcttgga

SEQ ID NO: 1808333 - DNA, 20 bp, Homo sapiens
gcacctgcaggttgggccat

SEQ ID NO: 1808334 - DNA, 14 bp, Homo sapiens
gcactgcagtgatg

SEQ ID NO: 1808335 - DNA, 13 bp, Homo sapiens
gcactgctgggtg

SEQ ID NO: 1808336 - DNA, 15 bp, Homo sapiens
gcactgctgggtggc

SEQ ID NO: 1808337 - DNA, 17 bp, Homo sapiens
gcactgctgggtggccc

SEQ ID NO: 1808338 - DNA, 22 bp, Homo sapiens
gcactgctgggtggcccatccc

SEQ ID NO: 1808339 - DNA, 18 bp, Homo sapiens
gcactggaatatctgaga

SEQ ID NO: 1808340 - DNA, 13 bp, Homo sapiens
gcactggccagag

SEQ ID NO: 1808341 - DNA, 15 bp, Homo sapiens
gcactggccagagag

SEQ ID NO: 1808342 - DNA, 19 bp, Homo sapiens
gcactggccagagagggcc

SEQ ID NO: 1808343 - DNA, 20 bp, Homo sapiens
gcactggccagagagggccc

SEQ ID NO: 1808344 - DNA, 22 bp, Homo sapiens
gcactggccagagagggcccag

SEQ ID NO: 1808345 - DNA, 23 bp, Homo sapiens
gcactggccagagagggcccagc

SEQ ID NO: 1808346 - DNA, 12 bp, Homo sapiens
gcactgtcctgc

SEQ ID NO: 1808347 - DNA, 15 bp, Homo sapiens
gcactgtcctgctcc

SEQ ID NO: 1808348 - DNA, 17 bp, Homo sapiens
gcactgtcctgctccac

SEQ ID NO: 1808349 - DNA, 21 bp, Homo sapiens
gcactgtcctgctccacagtg

SEQ ID NO: 1808350 - DNA, 15 bp, Homo sapiens
gcactgtgaactatt

SEQ ID NO: 1808351 - DNA, 17 bp, Homo sapiens
gcactgtgaactatttt

SEQ ID NO: 1808352 - DNA, 22 bp, Homo sapiens
gcactgtgaactattttgaaga

SEQ ID NO: 1808353 - DNA, 15 bp, Homo sapiens
gcactttctgtagta

SEQ ID NO: 1808354 - DNA, 21 bp, Homo sapiens
gcacttttaacaaaaaaggaa

SEQ ID NO: 1808355 - DNA, 15 bp, Homo sapiens
gcagaaaagaggaga

SEQ ID NO: 1808356 - DNA, 18 bp, Homo sapiens
gcagagcaaatgagggag

SEQ ID NO: 1808357 - DNA, 15 bp, Homo sapiens
gcagagccatgggcc

SEQ ID NO: 1808358 - DNA, 16 bp, Homo sapiens
gcagaggaccacagtg

SEQ ID NO: 1808359 - DNA, 14 bp, Homo sapiens
gcagaggctttggg

SEQ ID NO: 1808360 - DNA, 22 bp, Homo sapiens
gcagagggaatgttccctgcac

SEQ ID NO: 1808361 - DNA, 16 bp, Homo sapiens
gcagaggggcagccgc

SEQ ID NO: 1808362 - DNA, 18 bp, Homo sapiens
gcagaggggcaggccctg

SEQ ID NO: 1808363 - DNA, 15 bp, Homo sapiens
gcagattcctgggcc

SEQ ID NO: 1808364 - DNA, 17 bp, Homo sapiens
gcagattcctgggcctg

SEQ ID NO: 1808365 - DNA, 18 bp, Homo sapiens
gcagattcctgggcctgt

SEQ ID NO: 1808366 - DNA, 12 bp, Homo sapiens
gcagcacagcaa

SEQ ID NO: 1808367 - DNA, 12 bp, Homo sapiens
gcagcagagagc

SEQ ID NO: 1808368 - DNA, 22 bp, Homo sapiens
gcagcagagagccctgggtgac

SEQ ID NO: 1808369 - DNA, 19 bp, Homo sapiens
gcagcagcccagcttcctg

SEQ ID NO: 1808370 - DNA, 14 bp, Homo sapiens
gcagcaggtgctgc

SEQ ID NO: 1808371 - DNA, 16 bp, Homo sapiens
gcagcaggtgctgcta

SEQ ID NO: 1808372 - DNA, 17 bp, Homo sapiens
gcagcaggtgctgctac

SEQ ID NO: 1808373 - DNA, 19 bp, Homo sapiens
gcagcattccatgaccaga

SEQ ID NO: 1808374 - DNA, 15 bp, Homo sapiens
gcagccagccagtct

SEQ ID NO: 1808375 - DNA, 11 bp, Homo sapiens
gcagccatgcc

SEQ ID NO: 1808376 - DNA, 13 bp, Homo sapiens
gcagccatgcctc

SEQ ID NO: 1808377 - DNA, 14 bp, Homo sapiens
gcagccatgcctca

SEQ ID NO: 1808378 - DNA, 20 bp, Homo sapiens
gcagccatgcctcatgccac

SEQ ID NO: 1808379 - DNA, 16 bp, Homo sapiens
gcagcccagcttcctg

SEQ ID NO: 1808380 - DNA, 17 bp, Homo sapiens
gcagcccagcttcctgg

SEQ ID NO: 1808381 - DNA, 15 bp, Homo sapiens
gcagcccgtgaagca

SEQ ID NO: 1808382 - DNA, 17 bp, Homo sapiens
gcagccgctaggagaga

SEQ ID NO: 1808383 - DNA, 13 bp, Homo sapiens
gcagcctccagag

SEQ ID NO: 1808384 - DNA, 20 bp, Homo sapiens
gcagcctccagagccagcct

SEQ ID NO: 1808385 - DNA, 22 bp, Homo sapiens
gcagcctccagagccagcctgg

SEQ ID NO: 1808386 - DNA, 23 bp, Homo sapiens
gcagcctccagagccagcctggg

SEQ ID NO: 1808387 - DNA, 15 bp, Homo sapiens
gcagccttcccctcc

SEQ ID NO: 1808388 - DNA, 17 bp, Homo sapiens
gcagctagactggagtg

SEQ ID NO: 1808389 - DNA, 14 bp, Homo sapiens
gcagctaggactga

SEQ ID NO: 1808390 - DNA, 14 bp, Homo sapiens
gcagctcctctcct

SEQ ID NO: 1808391 - DNA, 19 bp, Homo sapiens
gcagctcctctccttgggc

SEQ ID NO: 1808392 - DNA, 14 bp, Homo sapiens
gcagctgggcccca

SEQ ID NO: 1808393 - DNA, 16 bp, Homo sapiens
gcagctgggccccatg

SEQ ID NO: 1808394 - DNA, 21 bp, Homo sapiens
gcagctgggccccatgctctg

SEQ ID NO: 1808395 - DNA, 17 bp, Homo sapiens
gcagcttctgccacttc

SEQ ID NO: 1808396 - DNA, 16 bp, Homo sapiens
gcaggaacgagcactg

SEQ ID NO: 1808397 - DNA, 18 bp, Homo sapiens
gcaggaacgagcactggc

SEQ ID NO: 1808398 - DNA, 13 bp, Homo sapiens
gcaggaggaggtg

SEQ ID NO: 1808399 - DNA, 18 bp, Homo sapiens
gcaggatccgctgccacc

SEQ ID NO: 1808400 - DNA, 12 bp, Homo sapiens
gcaggcacagca

SEQ ID NO: 1808401 - DNA, 15 bp, Homo sapiens
gcaggcccagcagac

SEQ ID NO: 1808402 - DNA, 12 bp, Homo sapiens
gcaggccctgca

SEQ ID NO: 1808403 - DNA, 14 bp, Homo sapiens
gcaggccctgcact

SEQ ID NO: 1808404 - DNA, 18 bp, Homo sapiens
gcaggccctgcactgtcc

SEQ ID NO: 1808405 - DNA, 19 bp, Homo sapiens
gcaggcctgggacccagct

SEQ ID NO: 1808406 - DNA, 20 bp, Homo sapiens
gcaggcctgggacccagcta

SEQ ID NO: 1808407 - DNA, 22 bp, Homo sapiens
gcaggcggcctttgttgctcag

SEQ ID NO: 1808408 - DNA, 19 bp, Homo sapiens
gcaggctctgggctcaggg

SEQ ID NO: 1808409 - DNA, 14 bp, Homo sapiens
gcagggaagagggc

SEQ ID NO: 1808410 - DNA, 13 bp, Homo sapiens
gcagggagggctt

SEQ ID NO: 1808411 - DNA, 14 bp, Homo sapiens
gcagggcagaggga

SEQ ID NO: 1808412 - DNA, 15 bp, Homo sapiens
gcagggcagagggaa

SEQ ID NO: 1808413 - DNA, 23 bp, Homo sapiens
gcaggtacttcctcctgatggcc

SEQ ID NO: 1808414 - DNA, 24 bp, Homo sapiens
gcaggtacttcctcctgatggcca

SEQ ID NO: 1808415 - DNA, 21 bp, Homo sapiens
gcaggtgctgctaccctccct

SEQ ID NO: 1808416 - DNA, 13 bp, Homo sapiens
gcaggtgtggtgg

SEQ ID NO: 1808417 - DNA, 19 bp, Homo sapiens
gcagtccccagcccttctg

SEQ ID NO: 1808418 - DNA, 12 bp, Homo sapiens
gcagtcgcagga

SEQ ID NO: 1808419 - DNA, 21 bp, Homo sapiens
gcagtcgcaggatccgctgcc

SEQ ID NO: 1808420 - DNA, 22 bp, Homo sapiens
gcagtcgcaggatccgctgcca

SEQ ID NO: 1808421 - DNA, 18 bp, Homo sapiens
gcagtgcctcgaggcacc

SEQ ID NO: 1808422 - DNA, 18 bp, Homo sapiens
gcagtgggtcccacttcc

SEQ ID NO: 1808423 - DNA, 19 bp, Homo sapiens
gcagtgggtcccacttccc

SEQ ID NO: 1808424 - DNA, 21 bp, Homo sapiens
gcatacacccccacctcctgc

SEQ ID NO: 1808425 - DNA, 17 bp, Homo sapiens
gcatatttccaataact

SEQ ID NO: 1808426 - DNA, 15 bp, Homo sapiens
gcatatttctatgtt

SEQ ID NO: 1808427 - DNA, 13 bp, Homo sapiens
gcatcaggcactg

SEQ ID NO: 1808428 - DNA, 14 bp, Homo sapiens
gcatcaggcactgg

SEQ ID NO: 1808429 - DNA, 17 bp, Homo sapiens
gcatcaggcactggtgg

SEQ ID NO: 1808430 - DNA, 22 bp, Homo sapiens
gcatccacccagtgctgccatg

SEQ ID NO: 1808431 - DNA, 24 bp, Homo sapiens
gcatccacccagtgctgccatgcc

SEQ ID NO: 1808432 - DNA, 14 bp, Homo sapiens
gcatccagcctgtg

SEQ ID NO: 1808433 - DNA, 16 bp, Homo sapiens
gcatccagcctgtgtg

SEQ ID NO: 1808434 - DNA, 15 bp, Homo sapiens
gcatcccccttagaa

SEQ ID NO: 1808435 - DNA, 16 bp, Homo sapiens
gcatcgttgcatttta

SEQ ID NO: 1808436 - DNA, 15 bp, Homo sapiens
gcatctcaagatgtt

SEQ ID NO: 1808437 - DNA, 23 bp, Homo sapiens
gcatctttgggacacctcagaaa

SEQ ID NO: 1808438 - DNA, 23 bp, Homo sapiens
gcatgattttaagaggctttggc

SEQ ID NO: 1808439 - DNA, 12 bp, Homo sapiens
gcatgccccctc

SEQ ID NO: 1808440 - DNA, 19 bp, Homo sapiens
gcatgccccctcgtgccag

SEQ ID NO: 1808441 - DNA, 24 bp, Homo sapiens
gcatgctggcctcccaataaagct

SEQ ID NO: 1808442 - DNA, 18 bp, Homo sapiens
gcatggttccttccctgg

SEQ ID NO: 1808443 - DNA, 16 bp, Homo sapiens
gcatgtgtgcctgtgg

SEQ ID NO: 1808444 - DNA, 11 bp, Homo sapiens
gctctgtggcc

SEQ ID NO: 1808445 - DNA, 22 bp, Homo sapiens
gctctgtggcctgtgtccagca

SEQ ID NO: 1808446 - DNA, 12 bp, Homo sapiens
gctctgtgggct

SEQ ID NO: 1808447 - DNA, 22 bp, Homo sapiens
gctcttagtgcccgcctaggag

SEQ ID NO: 1808448 - DNA, 18 bp, Homo sapiens
gctcttcctggacctgag

SEQ ID NO: 1808449 - DNA, 14 bp, Homo sapiens
gctcttggtccctg

SEQ ID NO: 1808450 - DNA, 21 bp, Homo sapiens
gctcttggtccctggtccctc

SEQ ID NO: 1808451 - DNA, 16 bp, Homo sapiens
gctgaacaatgaatgc

SEQ ID NO: 1808452 - DNA, 11 bp, Homo sapiens
gctgaattcct

SEQ ID NO: 1808453 - DNA, 13 bp, Homo sapiens
gctgaattccttt

SEQ ID NO: 1808454 - DNA, 19 bp, Homo sapiens
gctgacacctaccatgctg

SEQ ID NO: 1808455 - DNA, 16 bp, Homo sapiens
gctgagccactcgcag

SEQ ID NO: 1808456 - DNA, 23 bp, Homo sapiens
gctgagcttagccttgtgccctg

SEQ ID NO: 1808457 - DNA, 14 bp, Homo sapiens
gctgaggcctctca

SEQ ID NO: 1808458 - DNA, 20 bp, Homo sapiens
gctgagtggaatgcagggaa

SEQ ID NO: 1808459 - DNA, 15 bp, Homo sapiens
gctgatttccaggcc

SEQ ID NO: 1808460 - DNA, 17 bp, Homo sapiens
gctgatttccaggcccc

SEQ ID NO: 1808461 - DNA, 18 bp, Homo sapiens
gctgatttccaggcccct

SEQ ID NO: 1808462 - DNA, 17 bp, Homo sapiens
gctgcaagctgctgaag

SEQ ID NO: 1808463 - DNA, 19 bp, Homo sapiens
gctgcaccaacccagccgc

SEQ ID NO: 1808464 - DNA, 21 bp, Homo sapiens
gctgcaccaacccagccgctg

SEQ ID NO: 1808465 - DNA, 23 bp, Homo sapiens
gctgcaccaacccagccgctgcc

SEQ ID NO: 1808466 - DNA, 13 bp, Homo sapiens
gctgcaccagagt

SEQ ID NO: 1808467 - DNA, 14 bp, Homo sapiens
gctgcaccagagtg

SEQ ID NO: 1808468 - DNA, 17 bp, Homo sapiens
gctgcactctgtgccca

SEQ ID NO: 1808469 - DNA, 20 bp, Homo sapiens
gctgcactctgtgcccatgg

SEQ ID NO: 1808470 - DNA, 23 bp, Homo sapiens
gctgcactctgtgcccatgggca

SEQ ID NO: 1808471 - DNA, 12 bp, Homo sapiens
gctgcagctggg

SEQ ID NO: 1808472 - DNA, 13 bp, Homo sapiens
gctgcagctgggc

SEQ ID NO: 1808473 - DNA, 17 bp, Homo sapiens
gctgcatatgagtcttt

SEQ ID NO: 1808474 - DNA, 21 bp, Homo sapiens
gctgccaccacgtctgccagg

SEQ ID NO: 1808475 - DNA, 22 bp, Homo sapiens
gctgccaccacgtctgccaggc

SEQ ID NO: 1808476 - DNA, 22 bp, Homo sapiens
gctgccaggcgttggtgccact

SEQ ID NO: 1808477 - DNA, 14 bp, Homo sapiens
gctgccatgccact

SEQ ID NO: 1808478 - DNA, 19 bp, Homo sapiens
gctgccatgccactgccag

SEQ ID NO: 1808479 - DNA, 22 bp, Homo sapiens
gctgccatgccactgccaggca

SEQ ID NO: 1808480 - DNA, 18 bp, Homo sapiens
gctgccccgttccctgtc

SEQ ID NO: 1808481 - DNA, 19 bp, Homo sapiens
gctgccccgttccctgtca

SEQ ID NO: 1808482 - DNA, 20 bp, Homo sapiens
gctgccccgttccctgtcag

SEQ ID NO: 1808483 - DNA, 22 bp, Homo sapiens
gctgccccgttccctgtcagag

SEQ ID NO: 1808484 - DNA, 19 bp, Homo sapiens
gctgcccctgtaggttgct

SEQ ID NO: 1808485 - DNA, 14 bp, Homo sapiens
gctgcctccactcc

SEQ ID NO: 1808486 - DNA, 18 bp, Homo sapiens
gctgcctccactcccact

SEQ ID NO: 1808487 - DNA, 20 bp, Homo sapiens
gctgcctccactcccacttc

SEQ ID NO: 1808488 - DNA, 21 bp, Homo sapiens
gctgcctccactcccacttcc

SEQ ID NO: 1808489 - DNA, 13 bp, Homo sapiens
gctgcctgccgcc

SEQ ID NO: 1808490 - DNA, 20 bp, Homo sapiens
gctgcctgccgcccaaagag

SEQ ID NO: 1808491 - DNA, 13 bp, Homo sapiens
gctgcctgtgtgg

SEQ ID NO: 1808492 - DNA, 15 bp, Homo sapiens
gctgccttcagggag

SEQ ID NO: 1808493 - DNA, 22 bp, Homo sapiens
gctgcgctaacccccagcccac

SEQ ID NO: 1808494 - DNA, 18 bp, Homo sapiens
gctgctaccctccctgct

SEQ ID NO: 1808495 - DNA, 20 bp, Homo sapiens
gctgctaccctccctgctgt

SEQ ID NO: 1808496 - DNA, 23 bp, Homo sapiens
gctgctaccctccctgctgtccc

SEQ ID NO: 1808497 - DNA, 13 bp, Homo sapiens
gctgctctagctg

SEQ ID NO: 1808498 - DNA, 17 bp, Homo sapiens
gctgctctagctggcag

SEQ ID NO: 1808499 - DNA, 18 bp, Homo sapiens
gctgctcttagtgcccgc

SEQ ID NO: 1808500 - DNA, 17 bp, Homo sapiens
gctgctgtaactgctga

SEQ ID NO: 1808501 - DNA, 19 bp, Homo sapiens
gctgctgtaactgctgagc

SEQ ID NO: 1808502 - DNA, 20 bp, Homo sapiens
gctgctgtaactgctgagcc

SEQ ID NO: 1808503 - DNA, 21 bp, Homo sapiens
gctgctgtaactgctgagcca

SEQ ID NO: 1808504 - DNA, 22 bp, Homo sapiens
gctgctgtaactgctgagccac

SEQ ID NO: 1808505 - DNA, 21 bp, Homo sapiens
gctgctttcgaataaagtgaa

SEQ ID NO: 1808506 - DNA, 18 bp, Homo sapiens
gctgctttttggcacagt

SEQ ID NO: 1808507 - DNA, 20 bp, Homo sapiens
gctggaaggcagggcagagg

SEQ ID NO: 1808508 - DNA, 22 bp, Homo sapiens
gctggaaggcagggcagaggga

SEQ ID NO: 1808509 - DNA, 18 bp, Homo sapiens
gctggacaagaagctgct

SEQ ID NO: 1808510 - DNA, 21 bp, Homo sapiens
gctggcaggacacatcccggc

SEQ ID NO: 1808511 - DNA, 14 bp, Homo sapiens
gctggccagcccca

SEQ ID NO: 1808512 - DNA, 16 bp, Homo sapiens
gctggccagccccaca

SEQ ID NO: 1808513 - DNA, 12 bp, Homo sapiens
gctggccagtct

SEQ ID NO: 1808514 - DNA, 18 bp, Homo sapiens
gctggcctcccaataaag

SEQ ID NO: 1808515 - DNA, 21 bp, Homo sapiens
gctggctgagtggaatgcagg

SEQ ID NO: 1808516 - DNA, 18 bp, Homo sapiens
gctgggaaccccgcagcc

SEQ ID NO: 1808517 - DNA, 23 bp, Homo sapiens
gctgggatttcttcgctgctcta

SEQ ID NO: 1808518 - DNA, 14 bp, Homo sapiens
gctgggccccatgc

SEQ ID NO: 1808519 - DNA, 16 bp, Homo sapiens
gctgggccccatgctc

SEQ ID NO: 1808520 - DNA, 20 bp, Homo sapiens
gctgggccccatgctctgcc

SEQ ID NO: 1808521 - DNA, 21 bp, Homo sapiens
gctgggccccatgctctgccc

SEQ ID NO: 1808522 - DNA, 22 bp, Homo sapiens
gctgggctaccccccctcctgc

SEQ ID NO: 1808523 - DNA, 12 bp, Homo sapiens
gctgggctgggg

SEQ ID NO: 1808524 - DNA, 22 bp, Homo sapiens
gctgggcttggcagcccgggtc

SEQ ID NO: 1808525 - DNA, 24 bp, Homo sapiens
gctggggcagaggggcagccgcta

SEQ ID NO: 1808526 - DNA, 18 bp, Homo sapiens
gctggggcatgtgtgcct

SEQ ID NO: 1808527 - DNA, 20 bp, Homo sapiens
gctggggcctatcagtgtgc

SEQ ID NO: 1808528 - DNA, 21 bp, Homo sapiens
gctgggtggcccatcccccct

SEQ ID NO: 1808529 - DNA, 22 bp, Homo sapiens
gctgggtggcccatcccccctc

SEQ ID NO: 1808530 - DNA, 15 bp, Homo sapiens
gctgtaactgctgag

SEQ ID NO: 1808531 - DNA, 18 bp, Homo sapiens
gctgtaactgctgagcca

SEQ ID NO: 1808532 - DNA, 22 bp, Homo sapiens
gctgtaactgctgagccactcg

SEQ ID NO: 1808533 - DNA, 16 bp, Homo sapiens
gctgtactcagagcag

SEQ ID NO: 1808534 - DNA, 22 bp, Homo sapiens
gctgtagccatggctcaggcaa

SEQ ID NO: 1808535 - DNA, 12 bp, Homo sapiens
gctgtccagtgc

SEQ ID NO: 1808536 - DNA, 18 bp, Homo sapiens
gctgtccagtgcccattc

SEQ ID NO: 1808537 - DNA, 20 bp, Homo sapiens
gctgtcccctcttgccccaa

SEQ ID NO: 1808538 - DNA, 14 bp, Homo sapiens
gctgtgccaccctg

SEQ ID NO: 1808539 - DNA, 22 bp, Homo sapiens
gctgtgccaccctgggctctgt

SEQ ID NO: 1808540 - DNA, 12 bp, Homo sapiens
gctgtgcctgct

SEQ ID NO: 1808541 - DNA, 17 bp, Homo sapiens
gctgtgcctgctagagc

SEQ ID NO: 1808542 - DNA, 18 bp, Homo sapiens
gctgtgcctgctagagca

SEQ ID NO: 1808543 - DNA, 21 bp, Homo sapiens
gctgtgttactaatgatcact

SEQ ID NO: 1808544 - DNA, 17 bp, Homo sapiens
gctgttgccatagcccc

SEQ ID NO: 1808545 - DNA, 20 bp, Homo sapiens
gcttaaacttgacccaggtg

SEQ ID NO: 1808546 - DNA, 12 bp, Homo sapiens
gcttagccttgt

SEQ ID NO: 1808547 - DNA, 20 bp, Homo sapiens
gcttagccttgtgccctgcc

SEQ ID NO: 1808548 - DNA, 14 bp, Homo sapiens
gcttcacccctgca

SEQ ID NO: 1808549 - DNA, 20 bp, Homo sapiens
gcttcacccctgcacttcag

SEQ ID NO: 1808550 - DNA, 21 bp, Homo sapiens
gcttcacccctgcacttcaga

SEQ ID NO: 1808551 - DNA, 19 bp, Homo sapiens
gcttcctgtccactctcgg

SEQ ID NO: 1808552 - DNA, 17 bp, Homo sapiens
gcttctaaatgcccagt

SEQ ID NO: 1808553 - DNA, 23 bp, Homo sapiens
gcttctccacaacctcctcctcc

SEQ ID NO: 1808554 - DNA, 23 bp, Homo sapiens
gcttctcttgggaactccactct

SEQ ID NO: 1808555 - DNA, 12 bp, Homo sapiens
gcttctgccact

SEQ ID NO: 1808556 - DNA, 14 bp, Homo sapiens
gcttctgccacttc

SEQ ID NO: 1808557 - DNA, 16 bp, Homo sapiens
gcttctgccacttccc

SEQ ID NO: 1808558 - DNA, 12 bp, Homo sapiens
gcttctgctggg

SEQ ID NO: 1808559 - DNA, 15 bp, Homo sapiens
gcttctgctgggctg

SEQ ID NO: 1808560 - DNA, 22 bp, Homo sapiens
gcttctgctgggctggggcctg

SEQ ID NO: 1808561 - DNA, 18 bp, Homo sapiens
gcttgcccgctcccacag

SEQ ID NO: 1808562 - DNA, 14 bp, Homo sapiens
gcttgcctcggctc

SEQ ID NO: 1808563 - DNA, 18 bp, Homo sapiens
gcttgcctcggctcctgc

SEQ ID NO: 1808564 - DNA, 22 bp, Homo sapiens
gcttgcctcggctcctgctgca

SEQ ID NO: 1808565 - DNA, 13 bp, Homo sapiens
gcttgctccaggg

SEQ ID NO: 1808566 - DNA, 18 bp, Homo sapiens
gcttggtggggctcgtgg

SEQ ID NO: 1808567 - DNA, 19 bp, Homo sapiens
gctttcctcatcaggccat

SEQ ID NO: 1808568 - DNA, 21 bp, Homo sapiens
gctttgcaggctctgggctca

SEQ ID NO: 1808569 - DNA, 17 bp, Homo sapiens
gctttgtgactattaaa

SEQ ID NO: 1808570 - DNA, 15 bp, Homo sapiens
gcttttccaggatcc

SEQ ID NO: 1808571 - DNA, 14 bp, Homo sapiens
gcttttcccaggag

SEQ ID NO: 1808572 - DNA, 12 bp, Homo sapiens
gcttttgcatct

SEQ ID NO: 1808573 - DNA, 18 bp, Homo sapiens
gcttttttttgagaatac

SEQ ID NO: 1808574 - DNA, 23 bp, Homo sapiens
ggaaaaaagaaaaaaaattttgt

SEQ ID NO: 1808575 - DNA, 11 bp, Homo sapiens
ggaaactggct

SEQ ID NO: 1808576 - DNA, 18 bp, Homo sapiens
ggaaagcgggcagccccg

SEQ ID NO: 1808577 - DNA, 13 bp, Homo sapiens
ggaaaggacccac

SEQ ID NO: 1808578 - DNA, 15 bp, Homo sapiens
ggaaaggacccaccc

SEQ ID NO: 1808579 - DNA, 22 bp, Homo sapiens
ggaaatgctattgttgtgggct

SEQ ID NO: 1808580 - DNA, 16 bp, Homo sapiens
ggaaccccgcagcccg

SEQ ID NO: 1808581 - DNA, 18 bp, Homo sapiens
ggaacctagtactctctg

SEQ ID NO: 1808582 - DNA, 23 bp, Homo sapiens
ggaacctagtactctctgctcta

SEQ ID NO: 1808583 - DNA, 14 bp, Homo sapiens
ggaacgagcactgg

SEQ ID NO: 1808584 - DNA, 21 bp, Homo sapiens
ggaacgagcactggccagaga

SEQ ID NO: 1808585 - DNA, 17 bp, Homo sapiens
ggaactagactttcctt

SEQ ID NO: 1808586 - DNA, 14 bp, Homo sapiens
ggaactccactctc

SEQ ID NO: 1808587 - DNA, 14 bp, Homo sapiens
ggaactcttaagca

SEQ ID NO: 1808588 - DNA, 15 bp, Homo sapiens
ggaactgaccccctc

SEQ ID NO: 1808589 - DNA, 20 bp, Homo sapiens
ggaactgaccccctcccctg

SEQ ID NO: 1808590 - DNA, 20 bp, Homo sapiens
ggaactgctgggcttggcag

SEQ ID NO: 1808591 - DNA, 14 bp, Homo sapiens
ggaagagcagcctg

SEQ ID NO: 1808592 - DNA, 19 bp, Homo sapiens
ggaagagcagcctgatggc

SEQ ID NO: 1808593 - DNA, 21 bp, Homo sapiens
ggaagagggcagtacctggga

SEQ ID NO: 1808594 - DNA, 15 bp, Homo sapiens
ggaagccgtctgact

SEQ ID NO: 1808595 - DNA, 20 bp, Homo sapiens
ggaagccgtctgactccaga

SEQ ID NO: 1808596 - DNA, 21 bp, Homo sapiens
ggaagctgtactcagagcaga

SEQ ID NO: 1808597 - DNA, 12 bp, Homo sapiens
ggaaggcagctg

SEQ ID NO: 1808598 - DNA, 13 bp, Homo sapiens
ggaaggcagctgc

SEQ ID NO: 1808599 - DNA, 18 bp, Homo sapiens
ggaaggcagggcagaggg

SEQ ID NO: 1808600 - DNA, 12 bp, Homo sapiens
ggaaggctggct

SEQ ID NO: 1808601 - DNA, 13 bp, Homo sapiens
ggaaggctggctg

SEQ ID NO: 1808602 - DNA, 14 bp, Homo sapiens
ggaaggctggctga

SEQ ID NO: 1808603 - DNA, 15 bp, Homo sapiens
ggaaggtgctgagct

SEQ ID NO: 1808604 - DNA, 12 bp, Homo sapiens
ggaagttcaagt

SEQ ID NO: 1808605 - DNA, 22 bp, Homo sapiens
ggaagttcaagtgatctttcaa

SEQ ID NO: 1808606 - DNA, 14 bp, Homo sapiens
ggaatagccagaga

SEQ ID NO: 1808607 - DNA, 15 bp, Homo sapiens
ggaatagccagagag

SEQ ID NO: 1808608 - DNA, 20 bp, Homo sapiens
ggaatagccagagaggagca

SEQ ID NO: 1808609 - DNA, 18 bp, Homo sapiens
ggaatgcagggaagaggg

SEQ ID NO: 1808610 - DNA, 17 bp, Homo sapiens
ggaatggatggggagaa

SEQ ID NO: 1808611 - DNA, 18 bp, Homo sapiens
ggaatgttccctgcaccc

SEQ ID NO: 1808612 - DNA, 15 bp, Homo sapiens
ggaattcagcaccct

SEQ ID NO: 1808613 - DNA, 19 bp, Homo sapiens
ggacaacctgcccctcccc

SEQ ID NO: 1808614 - DNA, 20 bp, Homo sapiens
ggacaacctgcccctcccca

SEQ ID NO: 1808615 - DNA, 13 bp, Homo sapiens
ggacaagaagctg

SEQ ID NO: 1808616 - DNA, 15 bp, Homo sapiens
ggacaagaagctgct

SEQ ID NO: 1808617 - DNA, 16 bp, Homo sapiens
ggacaagaagctgcta

SEQ ID NO: 1808618 - DNA, 15 bp, Homo sapiens
ggacacatcccggcc

SEQ ID NO: 1808619 - DNA, 19 bp, Homo sapiens
ggacacatcccggcctctt

SEQ ID NO: 1808620 - DNA, 21 bp, Homo sapiens
ggacacatcccggcctcttcc

SEQ ID NO: 1808621 - DNA, 10 bp, Homo sapiens
ggacacctgc

SEQ ID NO: 1808622 - DNA, 14 bp, Homo sapiens
ggacacctgccctg

SEQ ID NO: 1808623 - DNA, 15 bp, Homo sapiens
ggacacctgccctgc

SEQ ID NO: 1808624 - DNA, 16 bp, Homo sapiens
ggacacctgccctgcc

SEQ ID NO: 1808625 - DNA, 17 bp, Homo sapiens
ggacagtattctcagtg

SEQ ID NO: 1808626 - DNA, 20 bp, Homo sapiens
ggacagtattctcagtgctc

SEQ ID NO: 1808627 - DNA, 15 bp, Homo sapiens
ggacagttggcagag

SEQ ID NO: 1808628 - DNA, 16 bp, Homo sapiens
ggacagttggcagaga

SEQ ID NO: 1808629 - DNA, 15 bp, Homo sapiens
ggaccaaattgcttc

SEQ ID NO: 1808630 - DNA, 20 bp, Homo sapiens
ggaccacagtgggtggcacc

SEQ ID NO: 1808631 - DNA, 10 bp, Homo sapiens
ggacccacca

SEQ ID NO: 1808632 - DNA, 23 bp, Homo sapiens
ggacccacccatcttcctgctgc

SEQ ID NO: 1808633 - DNA, 13 bp, Homo sapiens
ggacccagctact

SEQ ID NO: 1808634 - DNA, 22 bp, Homo sapiens
ggacccaggccctccatgggct

SEQ ID NO: 1808635 - DNA, 19 bp, Homo sapiens
ggaccgggtgggcctggcc

SEQ ID NO: 1808636 - DNA, 16 bp, Homo sapiens
ggacggggccggccag

SEQ ID NO: 1808637 - DNA, 13 bp, Homo sapiens
ggactgaggagtg

SEQ ID NO: 1808638 - DNA, 11 bp, Homo sapiens
ggactgccccc

SEQ ID NO: 1808639 - DNA, 15 bp, Homo sapiens
ggacttcctggggcc

SEQ ID NO: 1808640 - DNA, 12 bp, Homo sapiens
ggagaaggaaaa

SEQ ID NO: 1808641 - DNA, 22 bp, Homo sapiens
ggagaatgtcagtatgtggaag

SEQ ID NO: 1808642 - DNA, 22 bp, Homo sapiens
ggagaccgcttcacccctgcac

SEQ ID NO: 1808643 - DNA, 15 bp, Homo sapiens
ggagagactgaaagc

SEQ ID NO: 1808644 - DNA, 17 bp, Homo sapiens
ggagaggggtgcaccca

SEQ ID NO: 1808645 - DNA, 13 bp, Homo sapiens
ggagcacagccct

SEQ ID NO: 1808646 - DNA, 14 bp, Homo sapiens
ggagcacagccctg

SEQ ID NO: 1808647 - DNA, 15 bp, Homo sapiens
ggagcacctgaaccc

SEQ ID NO: 1808648 - DNA, 18 bp, Homo sapiens
ggagcatttttcagagtt

SEQ ID NO: 1808649 - DNA, 20 bp, Homo sapiens
ggagctgatttccaggcccc

SEQ ID NO: 1808650 - DNA, 23 bp, Homo sapiens
ggaggccaccccaaaccccagcc

SEQ ID NO: 1808651 - DNA, 20 bp, Homo sapiens
ggaggcccagccgcaggaag

SEQ ID NO: 1808652 - DNA, 15 bp, Homo sapiens
ggaggctggctgggg

SEQ ID NO: 1808653 - DNA, 14 bp, Homo sapiens
ggagggcagagcca

SEQ ID NO: 1808654 - DNA, 15 bp, Homo sapiens
ggagggcagagccat

SEQ ID NO: 1808655 - DNA, 18 bp, Homo sapiens
ggagggcttggggctgca

SEQ ID NO: 1808656 - DNA, 13 bp, Homo sapiens
ggaggggcccgct

SEQ ID NO: 1808657 - DNA, 23 bp, Homo sapiens
ggaggggcccgcttgcctcggct

SEQ ID NO: 1808658 - DNA, 21 bp, Homo sapiens
ggagggggcgctcaggaccca

SEQ ID NO: 1808659 - DNA, 17 bp, Homo sapiens
ggaggtgagaccacctc

SEQ ID NO: 1808660 - DNA, 23 bp, Homo sapiens
ggaggtgggccacacccaggaag

SEQ ID NO: 1808661 - DNA, 21 bp, Homo sapiens
ggagtgaggcttccaggctct

SEQ ID NO: 1808662 - DNA, 22 bp, Homo sapiens
ggagtgaggcttccaggctctt

SEQ ID NO: 1808663 - DNA, 16 bp, Homo sapiens
ggagtgcagagaaaga

SEQ ID NO: 1808664 - DNA, 11 bp, Homo sapiens
ggagtgtgtaa

SEQ ID NO: 1808665 - DNA, 18 bp, Homo sapiens
ggagtttgagacaagccc

SEQ ID NO: 1808666 - DNA, 21 bp, Homo sapiens
ggagtttgagacaagccctgg

SEQ ID NO: 1808667 - DNA, 15 bp, Homo sapiens
ggataaattacatta

SEQ ID NO: 1808668 - DNA, 14 bp, Homo sapiens
ggatccgctgccac

SEQ ID NO: 1808669 - DNA, 15 bp, Homo sapiens
ggatccgctgccacc

SEQ ID NO: 1808670 - DNA, 16 bp, Homo sapiens
ggatccgctgccacca

SEQ ID NO: 1808671 - DNA, 13 bp, Homo sapiens
ggatcctgcagga

SEQ ID NO: 1808672 - DNA, 14 bp, Homo sapiens
ggatgatgccacac

SEQ ID NO: 1808673 - DNA, 17 bp, Homo sapiens
ggatggaatgatgggtc

SEQ ID NO: 1808674 - DNA, 23 bp, Homo sapiens
ggatgggcattgggctgacacct

SEQ ID NO: 1808675 - DNA, 23 bp, Homo sapiens
ggatgtcctctttactcccttcc

SEQ ID NO: 1808676 - DNA, 14 bp, Homo sapiens
ggattcagttcatt

SEQ ID NO: 1808677 - DNA, 15 bp, Homo sapiens
ggattcagttcattc

SEQ ID NO: 1808678 - DNA, 19 bp, Homo sapiens
ggatttcttcgctgctcta

SEQ ID NO: 1808679 - DNA, 16 bp, Homo sapiens
ggcaaagaactgcccc

SEQ ID NO: 1808680 - DNA, 23 bp, Homo sapiens
ggcaaagaactgccccatctcct

SEQ ID NO: 1808681 - DNA, 19 bp, Homo sapiens
gttgccaactaagccctcg

SEQ ID NO: 1808682 - DNA, 13 bp, Homo sapiens
gttggagccactc

SEQ ID NO: 1808683 - DNA, 18 bp, Homo sapiens
gttggcagagaaggcctc

SEQ ID NO: 1808684 - DNA, 18 bp, Homo sapiens
gttggcgagaggaggggc

SEQ ID NO: 1808685 - DNA, 19 bp, Homo sapiens
gttgggccatactggcctc

SEQ ID NO: 1808686 - DNA, 20 bp, Homo sapiens
gttgggccatactggcctcg

SEQ ID NO: 1808687 - DNA, 14 bp, Homo sapiens
gttgtatatatcag

SEQ ID NO: 1808688 - DNA, 23 bp, Homo sapiens
taattgtgaataaaaattgatga

SEQ ID NO: 1808689 - DNA, 15 bp, Homo sapiens
taatttaaaattgtg

SEQ ID NO: 1808690 - DNA, 14 bp, Homo sapiens
taatttattttgtc

SEQ ID NO: 1808691 - DNA, 20 bp, Homo sapiens
tacaactaaataacacagat

SEQ ID NO: 1808692 - DNA, 22 bp, Homo sapiens
tacacataagaccgtgtcccaa

SEQ ID NO: 1808693 - DNA, 15 bp, Homo sapiens
tacacatatatgtat

SEQ ID NO: 1808694 - DNA, 13 bp, Homo sapiens
tacacttcctgtg

SEQ ID NO: 1808695 - DNA, 13 bp, Homo sapiens
tacacttggagcc

SEQ ID NO: 1808696 - DNA, 15 bp, Homo sapiens
tacagaagaaaataa

SEQ ID NO: 1808697 - DNA, 17 bp, Homo sapiens
tacagattgaaaggacc

SEQ ID NO: 1808698 - DNA, 17 bp, Homo sapiens
tatctatatctctaaac

SEQ ID NO: 1808699 - DNA, 16 bp, Homo sapiens
tatctgacacaagtgt

SEQ ID NO: 1808700 - DNA, 16 bp, Homo sapiens
tatctgagaagtgtat

SEQ ID NO: 1808701 - DNA, 21 bp, Homo sapiens
tatctgagaattgcaaaacta

SEQ ID NO: 1808702 - DNA, 15 bp, Homo sapiens
tatctgatatctgtt

SEQ ID NO: 1808703 - DNA, 15 bp, Homo sapiens
tatctgcctggcctg

SEQ ID NO: 1808704 - DNA, 18 bp, Homo sapiens
tatctgcctggcctggct

SEQ ID NO: 1808705 - DNA, 21 bp, Homo sapiens
tatctgcctggcctggctccc

SEQ ID NO: 1808706 - DNA, 14 bp, Homo sapiens
tatcttcaaaaata

SEQ ID NO: 1808707 - DNA, 23 bp, Homo sapiens
tatgaacttgaggacacatgtcc

SEQ ID NO: 1808708 - DNA, 19 bp, Homo sapiens
tatgaagtattaaaatgca

SEQ ID NO: 1808709 - DNA, 17 bp, Homo sapiens
tatgagaaatacagaag

SEQ ID NO: 1808710 - DNA, 20 bp, Homo sapiens
tatgagaaatacagaagaaa

SEQ ID NO: 1808711 - DNA, 23 bp, Homo sapiens
tatgagaaatacagaagaaaata

SEQ ID NO: 1808712 - DNA, 23 bp, Homo sapiens
tatgagctggggatgtctctcat

SEQ ID NO: 1808713 - DNA, 14 bp, Homo sapiens
tatgatactgatgc

SEQ ID NO: 1808714 - DNA, 17 bp, Homo sapiens
tatgccttcctgtttaa

SEQ ID NO: 1808715 - DNA, 20 bp, Homo sapiens
tatggagcatttttcagagt

SEQ ID NO: 1808716 - DNA, 17 bp, Homo sapiens
tatggggatagatgtgt

SEQ ID NO: 1808717 - DNA, 20 bp, Homo sapiens
tatggggatagatgtgtgga

SEQ ID NO: 1808718 - DNA, 18 bp, Homo sapiens
tatgtatatgtatatcta

SEQ ID NO: 1808719 - DNA, 18 bp, Homo sapiens
tatgtgagtttcagaaat

SEQ ID NO: 1808720 - DNA, 21 bp, Homo sapiens
tatgtgagtttcagaaattct

SEQ ID NO: 1808721 - DNA, 12 bp, Homo sapiens
tatgtggaagtg

SEQ ID NO: 1808722 - DNA, 23 bp, Homo sapiens
tatgttattggaattttctttca

SEQ ID NO: 1808723 - DNA, 17 bp, Homo sapiens
tatgttgtaatataatg

SEQ ID NO: 1808724 - DNA, 12 bp, Homo sapiens
tattaaaatgca

SEQ ID NO: 1808725 - DNA, 21 bp, Homo sapiens
tattaaatgttgcacatcatt

SEQ ID NO: 1808726 - DNA, 16 bp, Homo sapiens
tattaacaactgtgaa

SEQ ID NO: 1808727 - DNA, 13 bp, Homo sapiens
tattaacgctaaa

SEQ ID NO: 1808728 - DNA, 11 bp, Homo sapiens
tattcaataaa

SEQ ID NO: 1808729 - DNA, 12 bp, Homo sapiens
tattcaataaag

SEQ ID NO: 1808730 - DNA, 12 bp, Homo sapiens
tattcaatgcaa

SEQ ID NO: 1808731 - DNA, 22 bp, Homo sapiens
tattcaatgcaatgcaattcaa

SEQ ID NO: 1808732 - DNA, 20 bp, Homo sapiens
tattctaattcttcattata

SEQ ID NO: 1808733 - DNA, 16 bp, Homo sapiens
tattctatgagaacaa

SEQ ID NO: 1808734 - DNA, 13 bp, Homo sapiens
tattctgagcctt

SEQ ID NO: 1808735 - DNA, 16 bp, Homo sapiens
tattgatcaaaatcaa

SEQ ID NO: 1808736 - DNA, 18 bp, Homo sapiens
tattgatcaaaatcaaaa

SEQ ID NO: 1808737 - DNA, 17 bp, Homo sapiens
tattgctctaattcttt

SEQ ID NO: 1808738 - DNA, 21 bp, Homo sapiens
tattgctctaattcttttcaa

SEQ ID NO: 1808739 - DNA, 14 bp, Homo sapiens
tattggaattttct

SEQ ID NO: 1808740 - DNA, 22 bp, Homo sapiens
tattgtgatttcccgtggcccc

SEQ ID NO: 1808741 - DNA, 14 bp, Homo sapiens
tatttactaaaaga

SEQ ID NO: 1808742 - DNA, 19 bp, Homo sapiens
tatttcattatctgtactg

SEQ ID NO: 1808743 - DNA, 11 bp, Homo sapiens
tatttccatgg

SEQ ID NO: 1808744 - DNA, 18 bp, Homo sapiens
tatttctccatcccctcc

SEQ ID NO: 1808745 - DNA, 13 bp, Homo sapiens
tatttctctcccc

SEQ ID NO: 1808746 - DNA, 13 bp, Homo sapiens
tatttgagtttct

SEQ ID NO: 1808747 - DNA, 16 bp, Homo sapiens
tatttgtaaatttatg

SEQ ID NO: 1808748 - DNA, 16 bp, Homo sapiens
tattttaaaaaatcaa

SEQ ID NO: 1808749 - DNA, 17 bp, Homo sapiens
tattttaaaaaatcaaa

SEQ ID NO: 1808750 - DNA, 23 bp, Homo sapiens
tattttcttatgtaagtttgcat

SEQ ID NO: 1808751 - DNA, 14 bp, Homo sapiens
tattttgaagaaaa

SEQ ID NO: 1808752 - DNA, 17 bp, Homo sapiens
tattttgaagaaaacac

SEQ ID NO: 1808753 - DNA, 23 bp, Homo sapiens
tattttgaagaaaacacaacatt

SEQ ID NO: 1808754 - DNA, 15 bp, Homo sapiens
tattttgacaaaaat

SEQ ID NO: 1808755 - DNA, 14 bp, Homo sapiens
tatttttctagtca

SEQ ID NO: 1808756 - DNA, 23 bp, Homo sapiens
tatttttctagtcagtaaacatt

SEQ ID NO: 1808757 - DNA, 13 bp, Homo sapiens
tattttttgagtg

SEQ ID NO: 1808758 - DNA, 12 bp, Homo sapiens
tcaaaaatttct

SEQ ID NO: 1808759 - DNA, 14 bp, Homo sapiens
tcaaaaatttctgc

SEQ ID NO: 1808760 - DNA, 18 bp, Homo sapiens
tcaaaaggtaatgcacat

SEQ ID NO: 1808761 - DNA, 17 bp, Homo sapiens
tcaaagcaagggctcca

SEQ ID NO: 1808762 - DNA, 16 bp, Homo sapiens
tcaaatattttttgag

SEQ ID NO: 1808763 - DNA, 18 bp, Homo sapiens
tcaaattaatctttctat

SEQ ID NO: 1808764 - DNA, 22 bp, Homo sapiens
tcaaatttttcatctcttcaat

SEQ ID NO: 1808765 - DNA, 16 bp, Homo sapiens
tcaacagggaaaacag

SEQ ID NO: 1808766 - DNA, 24 bp, Homo sapiens
tcaaccagaaaacttagaaataag

SEQ ID NO: 1808767 - DNA, 15 bp, Homo sapiens
tcaacccccctccca

SEQ ID NO: 1808768 - DNA, 16 bp, Homo sapiens
tcaacccccctcccag

SEQ ID NO: 1808769 - DNA, 17 bp, Homo sapiens
tcaacccccctcccaga

SEQ ID NO: 1808770 - DNA, 17 bp, Homo sapiens
tcaaccgcttgccatat

SEQ ID NO: 1808771 - DNA, 22 bp, Homo sapiens
tcaagaaaaatataaaaacaac

SEQ ID NO: 1808772 - DNA, 17 bp, Homo sapiens
tcaagcaaaatttctgt

SEQ ID NO: 1808773 - DNA, 18 bp, Homo sapiens
tcaagcaaaatttctgta

SEQ ID NO: 1808774 - DNA, 20 bp, Homo sapiens
tcaagctgtcccctctgtca

SEQ ID NO: 1808775 - DNA, 21 bp, Homo sapiens
tcaagctgtcccctctgtcat

SEQ ID NO: 1808776 - DNA, 17 bp, Homo sapiens
tcaaggcctcccacagt

SEQ ID NO: 1808777 - DNA, 12 bp, Homo sapiens
tcaagtctgtga

SEQ ID NO: 1808778 - DNA, 18 bp, Homo sapiens
tcaagtgaaagacttgaa

SEQ ID NO: 1808779 - DNA, 16 bp, Homo sapiens
tcaagtgatctttcaa

SEQ ID NO: 1808780 - DNA, 17 bp, Homo sapiens
tcaatattcaataaagc

SEQ ID NO: 1808781 - DNA, 19 bp, Homo sapiens
tcaatattgattttaaata

SEQ ID NO: 1808782 - DNA, 21 bp, Homo sapiens
tcaatcaagcaaaatttctgt

SEQ ID NO: 1808783 - DNA, 14 bp, Homo sapiens
tcaatgcaatgaaa

SEQ ID NO: 1808784 - DNA, 18 bp, Homo sapiens
tcaatgcaatgaaaacaa

SEQ ID NO: 1808785 - DNA, 22 bp, Homo sapiens
tcaatgcaatgaaaacaaaatt

SEQ ID NO: 1808786 - DNA, 23 bp, Homo sapiens
tcaatgcaatgcaattcaatgca

SEQ ID NO: 1808787 - DNA, 15 bp, Homo sapiens
tcaatttgaaacaca

SEQ ID NO: 1808788 - DNA, 17 bp, Homo sapiens
tcaatttgaaacacaag

SEQ ID NO: 1808789 - DNA, 21 bp, Homo sapiens
tcacaaaataaagctgtgaca

SEQ ID NO: 1808790 - DNA, 17 bp, Homo sapiens
tcacaagtctaaacaat

SEQ ID NO: 1808791 - DNA, 18 bp, Homo sapiens
tcacaagtctaaacaatg

SEQ ID NO: 1808792 - DNA, 23 bp, Homo sapiens
tcacactactgtatttcattatc

SEQ ID NO: 1808793 - DNA, 13 bp, Homo sapiens
tcacagcctctcc

SEQ ID NO: 1808794 - DNA, 16 bp, Homo sapiens
tcacagcctctccctt

SEQ ID NO: 1808795 - DNA, 11 bp, Homo sapiens
tcacagctgca

SEQ ID NO: 1808796 - DNA, 17 bp, Homo sapiens
tcacagctgcagctggg

SEQ ID NO: 1808797 - DNA, 20 bp, Homo sapiens
tcacagctgcagctgggccc

SEQ ID NO: 1808798 - DNA, 15 bp, Homo sapiens
tcacaggggcggggc

SEQ ID NO: 1808799 - DNA, 17 bp, Homo sapiens
tcacaggggcggggcag

SEQ ID NO: 1808800 - DNA, 22 bp, Homo sapiens
tcacatataaaagttaaactac

SEQ ID NO: 1808801 - DNA, 21 bp, Homo sapiens
tcaccaggggcaggcacagca

SEQ ID NO: 1808802 - DNA, 13 bp, Homo sapiens
tcacccctgcact

SEQ ID NO: 1808803 - DNA, 23 bp, Homo sapiens
tcaccgagaggaaaaaggcttct

SEQ ID NO: 1808804 - DNA, 13 bp, Homo sapiens
tcacctgcaagcc

SEQ ID NO: 1808805 - DNA, 23 bp, Homo sapiens
tcacctgcaagccccagggcctg

SEQ ID NO: 1808806 - DNA, 12 bp, Homo sapiens
tcactaatactt

SEQ ID NO: 1808807 - DNA, 16 bp, Homo sapiens
tcactagtcaagaaaa

SEQ ID NO: 1808808 - DNA, 20 bp, Homo sapiens
tcactagtcaagaaaaatat

SEQ ID NO: 1808809 - DNA, 14 bp, Homo sapiens
tcactggctgcctc

SEQ ID NO: 1808810 - DNA, 15 bp, Homo sapiens
tcactggctgcctcc

SEQ ID NO: 1808811 - DNA, 17 bp, Homo sapiens
tcactggctgcctccac

SEQ ID NO: 1808812 - DNA, 18 bp, Homo sapiens
tcactggctgcctccact

SEQ ID NO: 1808813 - DNA, 13 bp, Homo sapiens
tcacttttgtgaa

SEQ ID NO: 1808814 - DNA, 22 bp, Homo sapiens
tcagaaagtttgaagcaccatg

SEQ ID NO: 1808815 - DNA, 17 bp, Homo sapiens
tcagaaattctcaaaat

SEQ ID NO: 1808816 - DNA, 22 bp, Homo sapiens
tcagagctcttcaagctgtccc

SEQ ID NO: 1808817 - DNA, 23 bp, Homo sapiens
tcagagctcttcaagctgtcccc

SEQ ID NO: 1808818 - DNA, 18 bp, Homo sapiens
tcagaggctaagatgaga

SEQ ID NO: 1808819 - DNA, 20 bp, Homo sapiens
tcagatcattatcagcctgt

SEQ ID NO: 1808820 - DNA, 14 bp, Homo sapiens
tcagcaccctgggt

SEQ ID NO: 1808821 - DNA, 19 bp, Homo sapiens
tcagcatctcacttcttct

SEQ ID NO: 1808822 - DNA, 21 bp, Homo sapiens
tcagcttctgctgggctgggg

SEQ ID NO: 1808823 - DNA, 22 bp, Homo sapiens
tcagcttctgctgggctggggc

SEQ ID NO: 1808824 - DNA, 16 bp, Homo sapiens
tcaggaaaagcctctg

SEQ ID NO: 1808825 - DNA, 18 bp, Homo sapiens
tcaggaaaagcctctgtg

SEQ ID NO: 1808826 - DNA, 12 bp, Homo sapiens
tcaggacccagg

SEQ ID NO: 1808827 - DNA, 14 bp, Homo sapiens
tcaggacccaggcc

SEQ ID NO: 1808828 - DNA, 15 bp, Homo sapiens
tcaggacccaggccc

SEQ ID NO: 1808829 - DNA, 19 bp, Homo sapiens
tcaggacccaggccctcca

SEQ ID NO: 1808830 - DNA, 22 bp, Homo sapiens
tcaggcaagcccctcagccctt

SEQ ID NO: 1808831 - DNA, 15 bp, Homo sapiens
tcaggcactgagaat

SEQ ID NO: 1808832 - DNA, 17 bp, Homo sapiens
tcaggcactggtggcat

SEQ ID NO: 1808833 - DNA, 14 bp, Homo sapiens
tcaggcagcactga

SEQ ID NO: 1808834 - DNA, 14 bp, Homo sapiens
tcagggaccacagc

SEQ ID NO: 1808835 - DNA, 15 bp, Homo sapiens
tcagggaccacagca

SEQ ID NO: 1808836 - DNA, 16 bp, Homo sapiens
tcagggccagaaggag

SEQ ID NO: 1808837 - DNA, 22 bp, Homo sapiens
tcagggccagaaggagggcaga

SEQ ID NO: 1808838 - DNA, 13 bp, Homo sapiens
tcaggggctgccc

SEQ ID NO: 1808839 - DNA, 16 bp, Homo sapiens
tcaggggctgcccgct

SEQ ID NO: 1808840 - DNA, 21 bp, Homo sapiens
tcaggggctgcccgctcccag

SEQ ID NO: 1808841 - DNA, 22 bp, Homo sapiens
tcaggggctgcccgctcccagt

SEQ ID NO: 1808842 - DNA, 14 bp, Homo sapiens
tcaggtaaaatatt

SEQ ID NO: 1808843 - DNA, 17 bp, Homo sapiens
tcaggtaggcccttgtc

SEQ ID NO: 1808844 - DNA, 21 bp, Homo sapiens
tcaggtgccactccctgagct

SEQ ID NO: 1808845 - DNA, 18 bp, Homo sapiens
tcagtaaacatttgtaaa

SEQ ID NO: 1808846 - DNA, 17 bp, Homo sapiens
tcagtaggtccaagggc

SEQ ID NO: 1808847 - DNA, 14 bp, Homo sapiens
tcagtatgtggaag

SEQ ID NO: 1808848 - DNA, 22 bp, Homo sapiens
tcagtcagttcccggagcacag

SEQ ID NO: 1808849 - DNA, 22 bp, Homo sapiens
tcagtctttaatctgagaggcc

SEQ ID NO: 1808850 - DNA, 18 bp, Homo sapiens
tcagtgagcccctcccca

SEQ ID NO: 1808851 - DNA, 20 bp, Homo sapiens
tcagtgagcccctccccagc

SEQ ID NO: 1808852 - DNA, 23 bp, Homo sapiens
tcagtgagcccctccccagccag

SEQ ID NO: 1808853 - DNA, 23 bp, Homo sapiens
tcagtgccgccgcctcgcccacc

SEQ ID NO: 1808854 - DNA, 13 bp, Homo sapiens
tcagtgtgccccc

SEQ ID NO: 1808855 - DNA, 14 bp, Homo sapiens
tcagtgtgcccccc

SEQ ID NO: 1808856 - DNA, 22 bp, Homo sapiens
tcagttaggattaggtttagaa

SEQ ID NO: 1808857 - DNA, 20 bp, Homo sapiens
tcagttcattcgctttgtct

SEQ ID NO: 1808858 - DNA, 15 bp, Homo sapiens
tcagttcccggagca

SEQ ID NO: 1808859 - DNA, 20 bp, Homo sapiens
tcagttcccggagcacagcc

SEQ ID NO: 1808860 - DNA, 21 bp, Homo sapiens
tcagttcccggagcacagccc

SEQ ID NO: 1808861 - DNA, 23 bp, Homo sapiens
tcagttcccggagcacagccctg

SEQ ID NO: 1808862 - DNA, 19 bp, Homo sapiens
tcatcactccctggatgtg

SEQ ID NO: 1808863 - DNA, 15 bp, Homo sapiens
tcatcccctcgtcct

SEQ ID NO: 1808864 - DNA, 20 bp, Homo sapiens
tcatcccctcgtcctgtccc

SEQ ID NO: 1808865 - DNA, 23 bp, Homo sapiens
tcatgactagtgcctagaaagca

SEQ ID NO: 1808866 - DNA, 23 bp, Homo sapiens
tcatgagtctacctgagcattca

SEQ ID NO: 1808867 - DNA, 20 bp, Homo sapiens
tcatgccaaagcaaaagaag

SEQ ID NO: 1808868 - DNA, 19 bp, Homo sapiens
tcatgcctggcccccctcc

SEQ ID NO: 1808869 - DNA, 19 bp, Homo sapiens
tcatgctcacttttgtgaa

SEQ ID NO: 1808870 - DNA, 20 bp, Homo sapiens
tcatgctcacttttgtgaaa

SEQ ID NO: 1808871 - DNA, 22 bp, Homo sapiens
tcatggcgtaatgggcctgccc

SEQ ID NO: 1808872 - DNA, 17 bp, Homo sapiens
tcatgtttacagaggac

SEQ ID NO: 1808873 - DNA, 22 bp, Homo sapiens
tcattaaaaggaaaaaagaaaa

SEQ ID NO: 1808874 - DNA, 23 bp, Homo sapiens
tcattatctgtactgaaagcaaa

SEQ ID NO: 1808875 - DNA, 17 bp, Homo sapiens
tcattgactaaagccat

SEQ ID NO: 1808876 - DNA, 18 bp, Homo sapiens
tcattggccctcattcca

SEQ ID NO: 1808877 - DNA, 17 bp, Homo sapiens
tcattggggttgcaaca

SEQ ID NO: 1808878 - DNA, 21 bp, Homo sapiens
tcatttaatatttttcaaaat

SEQ ID NO: 1808879 - DNA, 13 bp, Homo sapiens
tcattttcattaa

SEQ ID NO: 1808880 - DNA, 22 bp, Homo sapiens
tccaaaaagatttattaattaa

SEQ ID NO: 1808881 - DNA, 20 bp, Homo sapiens
tccaaagggcagtaaagttt

SEQ ID NO: 1808882 - DNA, 19 bp, Homo sapiens
tccaaaggggctgctgggg

SEQ ID NO: 1808883 - DNA, 21 bp, Homo sapiens
tccaaaggggctgctggggca

SEQ ID NO: 1808884 - DNA, 18 bp, Homo sapiens
tccaacactgaagtgctt

SEQ ID NO: 1808885 - DNA, 23 bp, Homo sapiens
tccaacactgaagtgcttgcaga

SEQ ID NO: 1808886 - DNA, 16 bp, Homo sapiens
tccaagctttgggttg

SEQ ID NO: 1808887 - DNA, 15 bp, Homo sapiens
tccaaggtggtctgc

SEQ ID NO: 1808888 - DNA, 23 bp, Homo sapiens
tccaaggtggtctgctcgggccc

SEQ ID NO: 1808889 - DNA, 17 bp, Homo sapiens
tccacaacctcctcctc

SEQ ID NO: 1808890 - DNA, 15 bp, Homo sapiens
tccacagtgctgctt

SEQ ID NO: 1808891 - DNA, 14 bp, Homo sapiens
tccacccaggctgc

SEQ ID NO: 1808892 - DNA, 22 bp, Homo sapiens
tccacccaggctgcactgcagt

SEQ ID NO: 1808893 - DNA, 23 bp, Homo sapiens
tccacccaggctgcactgcagtg

SEQ ID NO: 1808894 - DNA, 24 bp, Homo sapiens
tccacccaggctgcactgcagtga

SEQ ID NO: 1808895 - DNA, 13 bp, Homo sapiens
tccacccagtgct

SEQ ID NO: 1808896 - DNA, 16 bp, Homo sapiens
tccacccagtgctgcc

SEQ ID NO: 1808897 - DNA, 21 bp, Homo sapiens
tccacccagtgctgccatgcc

SEQ ID NO: 1808898 - DNA, 17 bp, Homo sapiens
tccacctagtggctgtc

SEQ ID NO: 1808899 - DNA, 20 bp, Homo sapiens
tccacctagtggctgtccag

SEQ ID NO: 1808900 - DNA, 22 bp, Homo sapiens
tccacctgcctatccatcctgc

SEQ ID NO: 1808901 - DNA, 19 bp, Homo sapiens
tccactcccccacctgaca

SEQ ID NO: 1808902 - DNA, 16 bp, Homo sapiens
tccactgccaaaacaa

SEQ ID NO: 1808903 - DNA, 12 bp, Homo sapiens
tccactgtgcta

SEQ ID NO: 1808904 - DNA, 19 bp, Homo sapiens
tccactgtgctattacaaa

SEQ ID NO: 1808905 - DNA, 19 bp, Homo sapiens
tccactttttccagaattt

SEQ ID NO: 1808906 - DNA, 16 bp, Homo sapiens
tccagaatttgaatat

SEQ ID NO: 1808907 - DNA, 20 bp, Homo sapiens
tccagaatttgaatattaac

SEQ ID NO: 1808908 - DNA, 17 bp, Homo sapiens
tccagagtctgagcccc

SEQ ID NO: 1808909 - DNA, 13 bp, Homo sapiens
tccagcagctgcg

SEQ ID NO: 1808910 - DNA, 15 bp, Homo sapiens
tccagcatccagcct

SEQ ID NO: 1808911 - DNA, 16 bp, Homo sapiens
tccagcatccagcctg

SEQ ID NO: 1808912 - DNA, 19 bp, Homo sapiens
tccagcatccagcctgtgt

SEQ ID NO: 1808913 - DNA, 20 bp, Homo sapiens
tcctccgtccacccaggctg

SEQ ID NO: 1808914 - DNA, 13 bp, Homo sapiens
tcctcctccacag

SEQ ID NO: 1808915 - DNA, 14 bp, Homo sapiens
tcctctccttgggc

SEQ ID NO: 1808916 - DNA, 20 bp, Homo sapiens
tcctctccttgggctcctgg

SEQ ID NO: 1808917 - DNA, 24 bp, Homo sapiens
tcctctggtaaacattcctccagc

SEQ ID NO: 1808918 - DNA, 13 bp, Homo sapiens
tcctgacgccctg

SEQ ID NO: 1808919 - DNA, 22 bp, Homo sapiens
tcctgacttcaggggctgcccg

SEQ ID NO: 1808920 - DNA, 15 bp, Homo sapiens
tcctgatggccaaga

SEQ ID NO: 1808921 - DNA, 18 bp, Homo sapiens
tcctgcaatctccagggc

SEQ ID NO: 1808922 - DNA, 19 bp, Homo sapiens
tcctgcaatctccagggct

SEQ ID NO: 1808923 - DNA, 20 bp, Homo sapiens
tcctgcaatctccagggctg

SEQ ID NO: 1808924 - DNA, 20 bp, Homo sapiens
tcctgcagaggaccacagtg

SEQ ID NO: 1808925 - DNA, 15 bp, Homo sapiens
tcctgccagctgcct

SEQ ID NO: 1808926 - DNA, 16 bp, Homo sapiens
tcctgccagctgcctt

SEQ ID NO: 1808927 - DNA, 18 bp, Homo sapiens
tcctgccagctgccttcc

SEQ ID NO: 1808928 - DNA, 15 bp, Homo sapiens
tcctgctccacagtg

SEQ ID NO: 1808929 - DNA, 17 bp, Homo sapiens
tcctgctgcaccaaccc

SEQ ID NO: 1808930 - DNA, 22 bp, Homo sapiens
tcctgctgcaccaacccagccg

SEQ ID NO: 1808931 - DNA, 21 bp, Homo sapiens
tcctgctgcagaggggcaggc

SEQ ID NO: 1808932 - DNA, 16 bp, Homo sapiens
tcctgctgcctaataa

SEQ ID NO: 1808933 - DNA, 21 bp, Homo sapiens
tcctgctgcctaataaagaga

SEQ ID NO: 1808934 - DNA, 19 bp, Homo sapiens
tcctgcttaaacttgaccc

SEQ ID NO: 1808935 - DNA, 22 bp, Homo sapiens
tcctggacctgagtcggcccca

SEQ ID NO: 1808936 - DNA, 11 bp, Homo sapiens
tcctggcccat

SEQ ID NO: 1808937 - DNA, 18 bp, Homo sapiens
tatacataaatgcccagc

SEQ ID NO: 1808938 - DNA, 13 bp, Homo sapiens
tataggataaatt

SEQ ID NO: 1808939 - DNA, 18 bp, Homo sapiens
tataggataaattacatt

SEQ ID NO: 1808940 - DNA, 19 bp, Homo sapiens
tataggataaattacatta

SEQ ID NO: 1808941 - DNA, 22 bp, Homo sapiens
tataggataaattacattaaaa

SEQ ID NO: 1808942 - DNA, 20 bp, Homo sapiens
tatataacccactgctgaaa

SEQ ID NO: 1808943 - DNA, 18 bp, Homo sapiens
tatataattttattgctg

SEQ ID NO: 1808944 - DNA, 21 bp, Homo sapiens
tatatattctacacatatatg

SEQ ID NO: 1808945 - DNA, 18 bp, Homo sapiens
tatatcaatgtaacaaaa

SEQ ID NO: 1808946 - DNA, 17 bp, Homo sapiens
tatatctatatctctaa

SEQ ID NO: 1808947 - DNA, 14 bp, Homo sapiens
tatatgtatatcta

SEQ ID NO: 1808948 - DNA, 17 bp, Homo sapiens
tatatgtatatgtatat

SEQ ID NO: 1808949 - DNA, 22 bp, Homo sapiens
tatcccttcttataccctaaga

SEQ ID NO: 1808950 - DNA, 16 bp, Homo sapiens
tctcattccagaggaa

SEQ ID NO: 1808951 - DNA, 22 bp, Homo sapiens
tctccaaaggggctgctggggc

SEQ ID NO: 1808952 - DNA, 14 bp, Homo sapiens
tctccacctagtgg

SEQ ID NO: 1808953 - DNA, 21 bp, Homo sapiens
tctccacctagtggctgtcca

SEQ ID NO: 1808954 - DNA, 21 bp, Homo sapiens
tctccaggcacgggaaacttg

SEQ ID NO: 1808955 - DNA, 17 bp, Homo sapiens
tctccagggcccccacc

SEQ ID NO: 1808956 - DNA, 18 bp, Homo sapiens
tctccagggcccccaccg

SEQ ID NO: 1808957 - DNA, 16 bp, Homo sapiens
tctccagggctgcccc

SEQ ID NO: 1808958 - DNA, 17 bp, Homo sapiens
tctccagggctgcccct

SEQ ID NO: 1808959 - DNA, 15 bp, Homo sapiens
tctccatcccctccc

SEQ ID NO: 1808960 - DNA, 16 bp, Homo sapiens
tctccatcccctccct

SEQ ID NO: 1808961 - DNA, 12 bp, Homo sapiens
tctccccactga

SEQ ID NO: 1808962 - DNA, 14 bp, Homo sapiens
tctccccaggcctc

SEQ ID NO: 1808963 - DNA, 16 bp, Homo sapiens
tctcccccgacactgc

SEQ ID NO: 1808964 - DNA, 15 bp, Homo sapiens
tctcccggctgcctg

SEQ ID NO: 1808965 - DNA, 16 bp, Homo sapiens
tctcccggctgcctgc

SEQ ID NO: 1808966 - DNA, 15 bp, Homo sapiens
tctccggggtctgtg

SEQ ID NO: 1808967 - DNA, 17 bp, Homo sapiens
tctccggggtctgtgct

SEQ ID NO: 1808968 - DNA, 21 bp, Homo sapiens
tctccggggtctgtgctgtgc

SEQ ID NO: 1808969 - DNA, 15 bp, Homo sapiens
tctcctaccccacct

SEQ ID NO: 1808970 - DNA, 16 bp, Homo sapiens
tctcctcccatggcct

SEQ ID NO: 1808971 - DNA, 20 bp, Homo sapiens
tctccttactctgagcccag

SEQ ID NO: 1808972 - DNA, 22 bp, Homo sapiens
tctccttgggctcctggctgcc

SEQ ID NO: 1808973 - DNA, 14 bp, Homo sapiens
tctcgccccatccc

SEQ ID NO: 1808974 - DNA, 18 bp, Homo sapiens
tctcgctgatgctgggct

SEQ ID NO: 1808975 - DNA, 19 bp, Homo sapiens
tctcgctgatgctgggctg

SEQ ID NO: 1808976 - DNA, 20 bp, Homo sapiens
tctcgctgatgctgggctgg

SEQ ID NO: 1808977 - DNA, 22 bp, Homo sapiens
tctcgctgatgctgggctgggt

SEQ ID NO: 1808978 - DNA, 22 bp, Homo sapiens
tgcttctaggagtcaactggct

SEQ ID NO: 1808979 - DNA, 19 bp, Homo sapiens
tgcttctcatagccccggt

SEQ ID NO: 1808980 - DNA, 22 bp, Homo sapiens
tgcttctcttgggaactccact

SEQ ID NO: 1808981 - DNA, 13 bp, Homo sapiens
tgcttgcccgctc

SEQ ID NO: 1808982 - DNA, 19 bp, Homo sapiens
tgctttgggaggccaaggc

SEQ ID NO: 1808983 - DNA, 15 bp, Homo sapiens
tgctttgggctttgc

SEQ ID NO: 1808984 - DNA, 17 bp, Homo sapiens
tgctttgtgactattaa

SEQ ID NO: 1808985 - DNA, 14 bp, Homo sapiens
tggaacacaataat

SEQ ID NO: 1808986 - DNA, 17 bp, Homo sapiens
tggaaccagggaggaga

SEQ ID NO: 1808987 - DNA, 18 bp, Homo sapiens
tggaaccagggaggagag

SEQ ID NO: 1808988 - DNA, 19 bp, Homo sapiens
tggaacccaatggacatat

SEQ ID NO: 1808989 - DNA, 21 bp, Homo sapiens
tggaactgaccccctcccctg

SEQ ID NO: 1808990 - DNA, 13 bp, Homo sapiens
tggaagagcagcc

SEQ ID NO: 1808991 - DNA, 16 bp, Homo sapiens
tggaagagcagcctga

SEQ ID NO: 1808992 - DNA, 18 bp, Homo sapiens
tggaaggcagggcagagg

SEQ ID NO: 1808993 - DNA, 13 bp, Homo sapiens
tggaaggctggct

SEQ ID NO: 1808994 - DNA, 20 bp, Homo sapiens
tggaattcagcaccctgggt

SEQ ID NO: 1808995 - DNA, 13 bp, Homo sapiens
tggaattttaagt

SEQ ID NO: 1808996 - DNA, 17 bp, Homo sapiens
tggaattttaagttcta

SEQ ID NO: 1808997 - DNA, 13 bp, Homo sapiens
tggacaagaagct

SEQ ID NO: 1808998 - DNA, 11 bp, Homo sapiens
tggacacctgc

SEQ ID NO: 1808999 - DNA, 17 bp, Homo sapiens
tggaccgggtgggcctg

SEQ ID NO: 1809000 - DNA, 23 bp, Homo sapiens
tggaccgggtgggcctggcctga

SEQ ID NO: 1809001 - DNA, 14 bp, Homo sapiens
tggacttcctgggg

SEQ ID NO: 1809002 - DNA, 17 bp, Homo sapiens
tggagacttggaagagt

SEQ ID NO: 1809003 - DNA, 16 bp, Homo sapiens
tggagcatttttcaga

SEQ ID NO: 1809004 - DNA, 16 bp, Homo sapiens
tggagccactcctgtc

SEQ ID NO: 1809005 - DNA, 17 bp, Homo sapiens
tggagccactcctgtcc

SEQ ID NO: 1809006 - DNA, 14 bp, Homo sapiens
tggaggaaggtgct

SEQ ID NO: 1809007 - DNA, 16 bp, Homo sapiens
tggaggaaggtgctga

SEQ ID NO: 1809008 - DNA, 19 bp, Homo sapiens
tggaggaaggtgctgagct

SEQ ID NO: 1809009 - DNA, 15 bp, Homo sapiens
tggaggcctgatgct

SEQ ID NO: 1809010 - DNA, 18 bp, Homo sapiens
tggaggcctgatgctgcc

SEQ ID NO: 1809011 - DNA, 19 bp, Homo sapiens
tggaggcctgatgctgccc

SEQ ID NO: 1809012 - DNA, 17 bp, Homo sapiens
tggagtgaggcttccag

SEQ ID NO: 1809013 - DNA, 20 bp, Homo sapiens
tggagtgaggcttccaggct

SEQ ID NO: 1809014 - DNA, 21 bp, Homo sapiens
tggagtgaggcttccaggctc

SEQ ID NO: 1809015 - DNA, 20 bp, Homo sapiens
tggagtgttttagttcttgg

SEQ ID NO: 1809016 - DNA, 21 bp, Homo sapiens
tggagttgtattttgacaaaa

SEQ ID NO: 1809017 - DNA, 12 bp, Homo sapiens
tggatactgtac

SEQ ID NO: 1809018 - DNA, 17 bp, Homo sapiens
tggatggaggtgatgaa

SEQ ID NO: 1809019 - DNA, 15 bp, Homo sapiens
tggcaagcagggaaa

SEQ ID NO: 1809020 - DNA, 21 bp, Homo sapiens
tggcaagcagggaaagctcca

SEQ ID NO: 1809021 - DNA, 20 bp, Homo sapiens
tgtcatgtaatactgaacca

SEQ ID NO: 1809022 - DNA, 19 bp, Homo sapiens
tgtccactctcggggccct

SEQ ID NO: 1809023 - DNA, 15 bp, Homo sapiens
tgtccagtgcccatt

SEQ ID NO: 1809024 - DNA, 23 bp, Homo sapiens
tgtccagtgcccattcctcacct

SEQ ID NO: 1809025 - DNA, 14 bp, Homo sapiens
tgtccagtttccaa

SEQ ID NO: 1809026 - DNA, 12 bp, Homo sapiens
tgtccataaagt

SEQ ID NO: 1809027 - DNA, 23 bp, Homo sapiens
tgtccataaagtaattttgtgaa

SEQ ID NO: 1809028 - DNA, 15 bp, Homo sapiens
tgtcccaaggagctg

SEQ ID NO: 1809029 - DNA, 23 bp, Homo sapiens
tgtcccccaaggttttggagtca

SEQ ID NO: 1809030 - DNA, 14 bp, Homo sapiens
tgtcccccggggca

SEQ ID NO: 1809031 - DNA, 13 bp, Homo sapiens
tgtcccctctgtc

SEQ ID NO: 1809032 - DNA, 14 bp, Homo sapiens
tgtcccctctgtca

SEQ ID NO: 1809033 - DNA, 11 bp, Homo sapiens
tgtcccctctt

SEQ ID NO: 1809034 - DNA, 21 bp, Homo sapiens
tgtcccctcttgccccaaccc

SEQ ID NO: 1809035 - DNA, 22 bp, Homo sapiens
tgtcccgccttcctcctccaca

SEQ ID NO: 1809036 - DNA, 22 bp, Homo sapiens
tgtcctctttactcccttcctg

SEQ ID NO: 1809037 - DNA, 21 bp, Homo sapiens
tgtcctgacttcaggggctgc

SEQ ID NO: 1809038 - DNA, 16 bp, Homo sapiens
tgtcctgccagctgcc

SEQ ID NO: 1809039 - DNA, 22 bp, Homo sapiens
tgtcctgccagctgccttcctc

SEQ ID NO: 1809040 - DNA, 17 bp, Homo sapiens
tgtcctgctccacagtg

SEQ ID NO: 1809041 - DNA, 14 bp, Homo sapiens
tgtccttcagagct

SEQ ID NO: 1809042 - DNA, 15 bp, Homo sapiens
tgtccttcagagctc

SEQ ID NO: 1809043 - DNA, 18 bp, Homo sapiens
tgtccttcagagctcttc

SEQ ID NO: 1809044 - DNA, 21 bp, Homo sapiens
tgtcgaatttttattatttgt

SEQ ID NO: 1809045 - DNA, 14 bp, Homo sapiens
tgtctgaggcctca

SEQ ID NO: 1809046 - DNA, 17 bp, Homo sapiens
tgtctggaagacgtggc

SEQ ID NO: 1809047 - DNA, 12 bp, Homo sapiens
tgtctgggctga

SEQ ID NO: 1809048 - DNA, 22 bp, Homo sapiens
tgtcttcctagtatattagttt

SEQ ID NO: 1809049 - DNA, 20 bp, Homo sapiens
tgtcttgagagaaaagaaaa

SEQ ID NO: 1809050 - DNA, 17 bp, Homo sapiens
tgtgaaactctattatg

SEQ ID NO: 1809051 - DNA, 14 bp, Homo sapiens
tgtgaactattttg

SEQ ID NO: 1809052 - DNA, 12 bp, Homo sapiens
tgtgacaacatt

SEQ ID NO: 1809053 - DNA, 18 bp, Homo sapiens
tgtgactattaaatgttg

SEQ ID NO: 1809054 - DNA, 14 bp, Homo sapiens
tgtgagcgagcaag

SEQ ID NO: 1809055 - DNA, 15 bp, Homo sapiens
tgtgagcgagcaagc

SEQ ID NO: 1809056 - DNA, 14 bp, Homo sapiens
tgtgagtggcagcc

SEQ ID NO: 1809057 - DNA, 19 bp, Homo sapiens
tgtgagtggcagccatgcc

SEQ ID NO: 1809058 - DNA, 14 bp, Homo sapiens
tgtgagtttcagaa

SEQ ID NO: 1809059 - DNA, 15 bp, Homo sapiens
tgtgatttcccgtgg

SEQ ID NO: 1809060 - DNA, 20 bp, Homo sapiens
tgtgatttcccgtggcccca

SEQ ID NO: 1809061 - DNA, 13 bp, Homo sapiens
tgtgcagcagccc

SEQ ID NO: 1809062 - DNA, 15 bp, Homo sapiens
tgtgcagcagcccag

SEQ ID NO: 1809063 - DNA, 18 bp, Homo sapiens
tgtgcagcagcccagctt

SEQ ID NO: 1809064 - DNA, 23 bp, Homo sapiens
tgtgcagcagcccagcttcctgg

SEQ ID NO: 1809065 - DNA, 16 bp, Homo sapiens
tgtgccaccctgggct

SEQ ID NO: 1809066 - DNA, 21 bp, Homo sapiens
tgtgccatgttattcagctca

SEQ ID NO: 1809067 - DNA, 14 bp, Homo sapiens
tgtgcccatgggca

SEQ ID NO: 1809068 - DNA, 18 bp, Homo sapiens
tgtgcccatgggcactgc

SEQ ID NO: 1809069 - DNA, 15 bp, Homo sapiens
tgtgccccccatcct

SEQ ID NO: 1809070 - DNA, 14 bp, Homo sapiens
tgtgcctgcaccag

SEQ ID NO: 1809071 - DNA, 17 bp, Homo sapiens
tgtgcctgcaccaggag

SEQ ID NO: 1809072 - DNA, 17 bp, Homo sapiens
tgtgcctgctagagcaa

SEQ ID NO: 1809073 - DNA, 19 bp, Homo sapiens
tttactcccttcctggcct

SEQ ID NO: 1809074 - DNA, 20 bp, Homo sapiens
tttactcccttcctggcctc

SEQ ID NO: 1809075 - DNA, 15 bp, Homo sapiens
tttactgacagaaat

SEQ ID NO: 1809076 - DNA, 13 bp, Homo sapiens
tttagaacagagg

SEQ ID NO: 1809077 - DNA, 17 bp, Homo sapiens
tttagaagaagtgtgtc

SEQ ID NO: 1809078 - DNA, 21 bp, Homo sapiens
tttaggactgggttccccaca

SEQ ID NO: 1809079 - DNA, 19 bp, Homo sapiens
tttatatgaagtattaaaa

SEQ ID NO: 1809080 - DNA, 12 bp, Homo sapiens
tttatgtgatgg

SEQ ID NO: 1809081 - DNA, 18 bp, Homo sapiens
tttatttccacataaagg

SEQ ID NO: 1809082 - DNA, 15 bp, Homo sapiens
tttcaaaattgttgc

SEQ ID NO: 1809083 - DNA, 18 bp, Homo sapiens
tttcaaattaatctttct

SEQ ID NO: 1809084 - DNA, 17 bp, Homo sapiens
tttcacaacagatttct

SEQ ID NO: 1809085 - DNA, 23 bp, Homo sapiens
tttcagctattagcaactgtgct

SEQ ID NO: 1809086 - DNA, 19 bp, Homo sapiens
tttcagcttctgctgggct

SEQ ID NO: 1809087 - DNA, 20 bp, Homo sapiens
tttcagcttctgctgggctg

SEQ ID NO: 1809088 - DNA, 14 bp, Homo sapiens
tttcatctcttcaa

SEQ ID NO: 1809089 - DNA, 15 bp, Homo sapiens
tttccaaagagccat

SEQ ID NO: 1809090 - DNA, 15 bp, Homo sapiens
tttccactgccaaaa

SEQ ID NO: 1809091 - DNA, 18 bp, Homo sapiens
tttccaggatcctgcagg

SEQ ID NO: 1809092 - DNA, 18 bp, Homo sapiens
tttcccactgcaccccct

SEQ ID NO: 1809093 - DNA, 13 bp, Homo sapiens
tttcccgccaagc

SEQ ID NO: 1809094 - DNA, 18 bp, Homo sapiens
tttcccgtggccccagcc

SEQ ID NO: 1809095 - DNA, 22 bp, Homo sapiens
tttctaaagctctgaacaaaag

SEQ ID NO: 1809096 - DNA, 17 bp, Homo sapiens
tttctaagttaaatcat

SEQ ID NO: 1809097 - DNA, 12 bp, Homo sapiens
tttctatttcca

SEQ ID NO: 1809098 - DNA, 14 bp, Homo sapiens
tttctccatcccct

SEQ ID NO: 1809099 - DNA, 16 bp, Homo sapiens
tttctccatcccctcc

SEQ ID NO: 1809100 - DNA, 17 bp, Homo sapiens
tttctccatcccctccc

SEQ ID NO: 1809101 - DNA, 13 bp, Homo sapiens
tttgaaacacaag

SEQ ID NO: 1809102 - DNA, 12 bp, Homo sapiens
tttgaagaaaac

SEQ ID NO: 1809103 - DNA, 13 bp, Homo sapiens
tttgaagaaaaca

SEQ ID NO: 1809104 - DNA, 18 bp, Homo sapiens
tttgaattaatctagaaa

SEQ ID NO: 1809105 - DNA, 14 bp, Homo sapiens
tttgacaaaaatgt

SEQ ID NO: 1809106 - DNA, 23 bp, Homo sapiens
tttgacctgttgggagtgaggat

SEQ ID NO: 1809107 - DNA, 13 bp, Homo sapiens
tttgcaggctctg

SEQ ID NO: 1809108 - DNA, 16 bp, Homo sapiens
tttgcaggctctgggc

SEQ ID NO: 1809109 - DNA, 20 bp, Homo sapiens
tttgcatatcagtcatgact

SEQ ID NO: 1809110 - DNA, 16 bp, Homo sapiens
tttgcattagacagat

SEQ ID NO: 1809111 - DNA, 15 bp, Homo sapiens
tttggaattttaagt

SEQ ID NO: 1809112 - DNA, 19 bp, Homo sapiens
tttggtaggaagcctgagg

SEQ ID NO: 1809113 - DNA, 17 bp, Homo sapiens
tttgtaaatttatgtga

SEQ ID NO: 1809114 - DNA, 12 bp, Homo sapiens
tttgtacattat

SEQ ID NO: 1809115 - DNA, 20 bp, Homo sapiens
tttgtagcctatgtcttgta

SEQ ID NO: 1809116 - DNA, 18 bp, Homo sapiens
tttgtatgtcaataactt

SEQ ID NO: 1809117 - DNA, 13 bp, Homo sapiens
tttgtattaccat

SEQ ID NO: 1809118 - DNA, 14 bp, Homo sapiens
tttgtccaggcctg

SEQ ID NO: 1809119 - DNA, 16 bp, Homo sapiens
tttgtcgaatttttat

SEQ ID NO: 1809120 - DNA, 22 bp, Homo sapiens
tttgtgctctttgttcatcatt

SEQ ID NO: 1809121 - DNA, 12 bp, Homo sapiens
ttttaaaagaaa

SEQ ID NO: 1809122 - DNA, 13 bp, Homo sapiens
ttttaaaagaaaa

SEQ ID NO: 1809123 - DNA, 20 bp, Homo sapiens
ttttaagaggctttggccca

SEQ ID NO: 1809124 - DNA, 14 bp, Homo sapiens
ttttaattgcaaca

SEQ ID NO: 1809125 - DNA, 15 bp, Homo sapiens
ttttaattgcaacaa

SEQ ID NO: 1809126 - DNA, 21 bp, Homo sapiens
ttttaattgcaacaatgcaaa

SEQ ID NO: 1809127 - DNA, 18 bp, Homo sapiens
ttttacagtatcttcaaa

SEQ ID NO: 1809128 - DNA, 22 bp, Homo sapiens
ttttacagtatcttcaaaaata

SEQ ID NO: 1809129 - DNA, 18 bp, Homo sapiens
ttttactgacagaaatgc

SEQ ID NO: 1809130 - DNA, 16 bp, Homo sapiens
ttttataaaaaatggt

SEQ ID NO: 1809131 - DNA, 13 bp, Homo sapiens
ttttattgctgga

SEQ ID NO: 1809132 - DNA, 20 bp, Homo sapiens
ttttcagctattagcaactg

SEQ ID NO: 1809133 - DNA, 18 bp, Homo sapiens
ttttccactgtgctatta

SEQ ID NO: 1809134 - DNA, 17 bp, Homo sapiens
ttttccagaatttgaat

SEQ ID NO: 1809135 - DNA, 18 bp, Homo sapiens
ttttccagaatttgaata

SEQ ID NO: 1809136 - DNA, 14 bp, Homo sapiens
ttttctttcataca

SEQ ID NO: 1809137 - DNA, 23 bp, Homo sapiens
ttttgacagagttggtgttcata

SEQ ID NO: 1809138 - DNA, 14 bp, Homo sapiens
ttttgcctggctgt

SEQ ID NO: 1809139 - DNA, 20 bp, Homo sapiens
ttttgctgaattcctttaca

SEQ ID NO: 1809140 - DNA, 17 bp, Homo sapiens
ttttggcatgaaagtgc

SEQ ID NO: 1809141 - DNA, 15 bp, Homo sapiens
ttttgtcctgttatt

SEQ ID NO: 1809142 - DNA, 22 bp, Homo sapiens
ttttgtcgaatttttattattt

SEQ ID NO: 1809143 - DNA, 13 bp, Homo sapiens
ttttgtgaaagct

SEQ ID NO: 1809144 - DNA, 13 bp, Homo sapiens
tttttaatgttat

SEQ ID NO: 1809145 - DNA, 19 bp, Homo sapiens
tttttattttcttatgtaa

SEQ ID NO: 1809146 - DNA, 21 bp, Homo sapiens
tttttcaaaatcaaagttatg

SEQ ID NO: 1809147 - DNA, 12 bp, Homo sapiens
tttttcagaaag

SEQ ID NO: 1809148 - DNA, 14 bp, Homo sapiens
tttttcagaaagtt

SEQ ID NO: 1809149 - DNA, 16 bp, Homo sapiens
tttttgttcctgtgta

SEQ ID NO: 1809150 - DNA, 22 bp, Homo sapiens
ttctatgaattgctaattctga

SEQ ID NO: 1809151 - DNA, 12 bp, Homo sapiens
ttctccatcccc

SEQ ID NO: 1809152 - DNA, 20 bp, Homo sapiens
ttctccatcccctccctgcc

SEQ ID NO: 1809153 - DNA, 21 bp, Homo sapiens
ttctccatcccctccctgcct

SEQ ID NO: 1809154 - DNA, 21 bp, Homo sapiens
ttctcccccccggggctgggt

SEQ ID NO: 1809155 - DNA, 18 bp, Homo sapiens
ttctccggggtctgtgct

SEQ ID NO: 1809156 - DNA, 23 bp, Homo sapiens
ttctccggggtctgtgctgtgcc

SEQ ID NO: 1809157 - DNA, 13 bp, Homo sapiens
ttctgagccttga

SEQ ID NO: 1809158 - DNA, 14 bp, Homo sapiens
ttctgccacttccc

SEQ ID NO: 1809159 - DNA, 20 bp, Homo sapiens
ttctgctgggctggggcctg

SEQ ID NO: 1809160 - DNA, 19 bp, Homo sapiens
ttctggaaggctggctgag

SEQ ID NO: 1809161 - DNA, 16 bp, Homo sapiens
ttctggctttttgaat

SEQ ID NO: 1809162 - DNA, 17 bp, Homo sapiens
ttctggctttttgaatt

SEQ ID NO: 1809163 - DNA, 22 bp, Homo sapiens
ttctgggtgttgaccactccag

SEQ ID NO: 1809164 - DNA, 17 bp, Homo sapiens
ttctgtaatggaactga

SEQ ID NO: 1809165 - DNA, 15 bp, Homo sapiens
ttcttaaaggcctgg

SEQ ID NO: 1809166 - DNA, 19 bp, Homo sapiens
ttcttaaaggcctggaacc

SEQ ID NO: 1809167 - DNA, 22 bp, Homo sapiens
ttcttattcatgctttctcctt

SEQ ID NO: 1809168 - DNA, 21 bp, Homo sapiens
ttcttcattatagtaaatcta

SEQ ID NO: 1809169 - DNA, 16 bp, Homo sapiens
ttcttcgctgctctag

SEQ ID NO: 1809170 - DNA, 14 bp, Homo sapiens
ttcttggtatgatc

SEQ ID NO: 1809171 - DNA, 13 bp, Homo sapiens
ttctttgctgccc

SEQ ID NO: 1809172 - DNA, 17 bp, Homo sapiens
ttctttgctgcccctgt

SEQ ID NO: 1809173 - DNA, 19 bp, Homo sapiens
ttcttttgttttcttcatt

SEQ ID NO: 1809174 - DNA, 20 bp, Homo sapiens
ttcttttgttttcttcattt

SEQ ID NO: 1809175 - DNA, 21 bp, Homo sapiens
ttgaaaggacctcttctgaag

SEQ ID NO: 1809176 - DNA, 14 bp, Homo sapiens
ttgaagcaccatgg

SEQ ID NO: 1809177 - DNA, 21 bp, Homo sapiens
ttgaatattttattaaaacat

SEQ ID NO: 1809178 - DNA, 22 bp, Homo sapiens
ttgaatggagattctgattcag

SEQ ID NO: 1809179 - DNA, 17 bp, Homo sapiens
ttgaattaatctagaaa

SEQ ID NO: 1809180 - DNA, 16 bp, Homo sapiens
ttgaattttcccactg

SEQ ID NO: 1809181 - DNA, 18 bp, Homo sapiens
ttgacaaaaatgtttgta

SEQ ID NO: 1809182 - DNA, 21 bp, Homo sapiens
ttgacagagttggtgttcata

SEQ ID NO: 1809183 - DNA, 18 bp, Homo sapiens
ttgaccactccagagaag

SEQ ID NO: 1809184 - DNA, 15 bp, Homo sapiens
ttgaccattggctgc

SEQ ID NO: 1809185 - DNA, 17 bp, Homo sapiens
ttgaccttcccaaggtt

SEQ ID NO: 1809186 - DNA, 20 bp, Homo sapiens
ttgacggtttatgctgggca

SEQ ID NO: 1809187 - DNA, 16 bp, Homo sapiens
ttgactaaagccattt

SEQ ID NO: 1809188 - DNA, 14 bp, Homo sapiens
ttgagacaagccct

SEQ ID NO: 1809189 - DNA, 18 bp, Homo sapiens
ttgagacaagccctggca

SEQ ID NO: 1809190 - DNA, 19 bp, Homo sapiens
ttgagagaaaagaaaaata

SEQ ID NO: 1809191 - DNA, 15 bp, Homo sapiens
ttgatcaaaatcaaa

SEQ ID NO: 1809192 - DNA, 14 bp, Homo sapiens
ttgattttaaatat

SEQ ID NO: 1809193 - DNA, 12 bp, Homo sapiens
ttgcaacaatgc

SEQ ID NO: 1809194 - DNA, 17 bp, Homo sapiens
ttgcaccatgtgaagtg

SEQ ID NO: 1809195 - DNA, 21 bp, Homo sapiens
ttgcaggctctgggctcaggg

SEQ ID NO: 1809196 - DNA, 18 bp, Homo sapiens
ttgcatcccccttagaat

SEQ ID NO: 1809197 - DNA, 22 bp, Homo sapiens
ttgcattttacagtatcttcaa

SEQ ID NO: 1809198 - DNA, 19 bp, Homo sapiens
ttgccaaggctctcccctc

SEQ ID NO: 1809199 - DNA, 14 bp, Homo sapiens
ttgccccaaccccc

SEQ ID NO: 1809200 - DNA, 16 bp, Homo sapiens
ttgccccaacccccag

SEQ ID NO: 1809201 - DNA, 21 bp, Homo sapiens
ttgccccaacccccagcaccc

SEQ ID NO: 1809202 - DNA, 15 bp, Homo sapiens
ttgcccccatccctc

SEQ ID NO: 1809203 - DNA, 17 bp, Homo sapiens
ttgcctcggctcctgct

SEQ ID NO: 1809204 - DNA, 19 bp, Homo sapiens
ttgcctcggctcctgctgc

SEQ ID NO: 1809205 - DNA, 16 bp, Homo sapiens
ttgccttttaaaagaa

SEQ ID NO: 1809206 - DNA, 11 bp, Homo sapiens
ttgctccaggg

SEQ ID NO: 1809207 - DNA, 19 bp, Homo sapiens
ttgctctaattcttttcaa

SEQ ID NO: 1809208 - DNA, 11 bp, Homo sapiens
aacaatgaatg

SEQ ID NO: 1809209 - DNA, 15 bp, Homo sapiens
aacacaacattttaa

SEQ ID NO: 1809210 - DNA, 18 bp, Homo sapiens
aacacaataatgtgtcct

SEQ ID NO: 1809211 - DNA, 19 bp, Homo sapiens
aacagcttttcccaggaga

SEQ ID NO: 1809212 - DNA, 20 bp, Homo sapiens
aacagtgttaggcctggcac

SEQ ID NO: 1809213 - DNA, 22 bp, Homo sapiens
aacagtgttaggcctggcacag

SEQ ID NO: 1809214 - DNA, 14 bp, Homo sapiens
aacatacttcaaaa

SEQ ID NO: 1809215 - DNA, 19 bp, Homo sapiens
aacatgcaacaaaaatgtg

SEQ ID NO: 1809216 - DNA, 21 bp, Homo sapiens
aacatttgtaaaaatactgtt

SEQ ID NO: 1809217 - DNA, 23 bp, Homo sapiens
aacatttgtaaaaatactgtttc

SEQ ID NO: 1809218 - DNA, 19 bp, Homo sapiens
aacatttttgtacattatg

SEQ ID NO: 1809219 - DNA, 14 bp, Homo sapiens
aaccagagctggaa

SEQ ID NO: 1809220 - DNA, 20 bp, Homo sapiens
aaccagagctggaacacaat

SEQ ID NO: 1809221 - DNA, 13 bp, Homo sapiens
aaccagggaggag

SEQ ID NO: 1809222 - DNA, 16 bp, Homo sapiens
aacccagccgctgccc

SEQ ID NO: 1809223 - DNA, 11 bp, Homo sapiens
aaccccagccc

SEQ ID NO: 1809224 - DNA, 13 bp, Homo sapiens
aaccccagcccca

SEQ ID NO: 1809225 - DNA, 23 bp, Homo sapiens
aacccccctcccagacaggccct

SEQ ID NO: 1809226 - DNA, 15 bp, Homo sapiens
aaccccgcagcccgt

SEQ ID NO: 1809227 - DNA, 17 bp, Homo sapiens
aacccctgtacccagct

SEQ ID NO: 1809228 - DNA, 12 bp, Homo sapiens
aaccgacttttc

SEQ ID NO: 1809229 - DNA, 20 bp, Homo sapiens
aacctaattgtggtagaaat

SEQ ID NO: 1809230 - DNA, 18 bp, Homo sapiens
aacctagtactctctgct

SEQ ID NO: 1809231 - DNA, 20 bp, Homo sapiens
aacctagtactctctgctct

SEQ ID NO: 1809232 - DNA, 19 bp, Homo sapiens
tttctccatcccctccctg

SEQ ID NO: 1809233 - DNA, 22 bp, Homo sapiens
tttctccatcccctccctgcct

SEQ ID NO: 1809234 - DNA, 18 bp, Homo sapiens
tttctccggggtctgtgc

SEQ ID NO: 1809235 - DNA, 20 bp, Homo sapiens
tttctccggggtctgtgctg

SEQ ID NO: 1809236 - DNA, 16 bp, Homo sapiens
tttctgtatattccct

SEQ ID NO: 1809237 - DNA, 16 bp, Homo sapiens
tttctttcatacatta

SEQ ID NO: 1809238 - DNA, 17 bp, Homo sapiens
tttctttcatacattat

SEQ ID NO: 1809239 - DNA, 19 bp, Homo sapiens
tttgaagaaaacacaacat

SEQ ID NO: 1809240 - DNA, 17 bp, Homo sapiens
tttgaattaatctagaa

SEQ ID NO: 1809241 - DNA, 19 bp, Homo sapiens
tttgacaaaaatgtttgta

SEQ ID NO: 1809242 - DNA, 22 bp, Homo sapiens
tttgacagagttggtgttcata

SEQ ID NO: 1809243 - DNA, 17 bp, Homo sapiens
tttgagacaagccctgg

SEQ ID NO: 1809244 - DNA, 19 bp, Homo sapiens
tttgagacaagccctggca

SEQ ID NO: 1809245 - DNA, 21 bp, Homo sapiens
tttgatattgagacattaatt

SEQ ID NO: 1809246 - DNA, 22 bp, Homo sapiens
tttgatattgagacattaattt

SEQ ID NO: 1809247 - DNA, 22 bp, Homo sapiens
tttgcaacaagacaaagcaaag

SEQ ID NO: 1809248 - DNA, 18 bp, Homo sapiens
tttgcaggcccagcagac

SEQ ID NO: 1809249 - DNA, 17 bp, Homo sapiens
tttgcaggctctgggct

SEQ ID NO: 1809250 - DNA, 13 bp, Homo sapiens
tttgcctggctgt

SEQ ID NO: 1809251 - DNA, 19 bp, Homo sapiens
tttgctatgagctggggat

SEQ ID NO: 1809252 - DNA, 13 bp, Homo sapiens
tttgctattcaaa

SEQ ID NO: 1809253 - DNA, 17 bp, Homo sapiens
tttgctgaattccttta

SEQ ID NO: 1809254 - DNA, 18 bp, Homo sapiens
tttgctgaattcctttac

SEQ ID NO: 1809255 - DNA, 16 bp, Homo sapiens
tttggaattttaagtt

SEQ ID NO: 1809256 - DNA, 14 bp, Homo sapiens
tttggcatgaaagt

SEQ ID NO: 1809257 - DNA, 17 bp, Homo sapiens
tttggggaagttcaagt

SEQ ID NO: 1809258 - DNA, 17 bp, Homo sapiens
tttgtaaaaatactgtt

SEQ ID NO: 1809259 - DNA, 17 bp, Homo sapiens
tttgtaagcaacttgct

SEQ ID NO: 1809260 - DNA, 19 bp, Homo sapiens
tttgtaagcaacttgcttc

SEQ ID NO: 1809261 - DNA, 20 bp, Homo sapiens
tttgtaagcaacttgcttct

SEQ ID NO: 1809262 - DNA, 15 bp, Homo sapiens
tttgtacattatgtt

SEQ ID NO: 1809263 - DNA, 16 bp, Homo sapiens
tttgtacattatgtta

SEQ ID NO: 1809264 - DNA, 17 bp, Homo sapiens
tttgtactttttaatgt

SEQ ID NO: 1809265 - DNA, 19 bp, Homo sapiens
tttgtagcctatgtcttgt

SEQ ID NO: 1809266 - DNA, 11 bp, Homo sapiens
tttgtggggag

SEQ ID NO: 1809267 - DNA, 15 bp, Homo sapiens
ttttaaaaaatcaaa

SEQ ID NO: 1809268 - DNA, 11 bp, Homo sapiens
ttttaaaagaa

SEQ ID NO: 1809269 - DNA, 17 bp, Homo sapiens
ttttacagtatcttcaa

SEQ ID NO: 1809270 - DNA, 18 bp, Homo sapiens
ttttacattttcctgtgt

SEQ ID NO: 1809271 - DNA, 17 bp, Homo sapiens
ttttacccctgcacagt

SEQ ID NO: 1809272 - DNA, 15 bp, Homo sapiens
ttttacctataccta

SEQ ID NO: 1809273 - DNA, 14 bp, Homo sapiens
ttttactgacagaa

SEQ ID NO: 1809274 - DNA, 15 bp, Homo sapiens
ttttactgacagaaa

SEQ ID NO: 1809275 - DNA, 13 bp, Homo sapiens
ttttattatttgt

SEQ ID NO: 1809276 - DNA, 16 bp, Homo sapiens
ttttattttgtaatta

SEQ ID NO: 1809277 - DNA, 16 bp, Homo sapiens
ttttcagaaagtttga

SEQ ID NO: 1809278 - DNA, 19 bp, Homo sapiens
ttttcagaaagtttgaagc

SEQ ID NO: 1809279 - DNA, 20 bp, Homo sapiens
ttttcatctcttcaatcact

SEQ ID NO: 1809280 - DNA, 13 bp, Homo sapiens
ttttccagaattt

SEQ ID NO: 1809281 - DNA, 19 bp, Homo sapiens
ttttccaggatcctgcagg

SEQ ID NO: 1809282 - DNA, 13 bp, Homo sapiens
ttttcccactgca

SEQ ID NO: 1809283 - DNA, 16 bp, Homo sapiens
ttttctagtcagtaaa

SEQ ID NO: 1809284 - DNA, 18 bp, Homo sapiens
ttttctcagaacagctga

SEQ ID NO: 1809285 - DNA, 14 bp, Homo sapiens
ttttgaagaaaaca

SEQ ID NO: 1809286 - DNA, 13 bp, Homo sapiens
ttttgcctggctg

SEQ ID NO: 1809287 - DNA, 16 bp, Homo sapiens
ttttgctcttctgtat

SEQ ID NO: 1809288 - DNA, 14 bp, Homo sapiens
ttttgctgaattcc

SEQ ID NO: 1809289 - DNA, 16 bp, Homo sapiens
ttttgtccccagggcc

SEQ ID NO: 1809290 - DNA, 16 bp, Homo sapiens
ttttgttcctgtgtat

SEQ ID NO: 1809291 - DNA, 15 bp, Homo sapiens
tttttacattttcct

SEQ ID NO: 1809292 - DNA, 14 bp, Homo sapiens
tttttattatttgt

SEQ ID NO: 1809293 - DNA, 16 bp, Homo sapiens
tttttcaaaatcaaag

SEQ ID NO: 1809294 - DNA, 12 bp, Homo sapiens
tttttcagagtt

SEQ ID NO: 1809295 - DNA, 13 bp, Homo sapiens
tttttgtacatta

SEQ ID NO: 1809296 - DNA, 20 bp, Homo sapiens
tttttgttcctgtgtattct

SEQ ID NO: 1809297 - DNA, 20 bp, Homo sapiens
ttttttaaatttacagaata

SEQ ID NO: 1809298 - DNA, 21 bp, Homo sapiens
ttttttacattttcctgtgta

SEQ ID NO: 1809299 - DNA, 17 bp, Homo sapiens
tgctgtagctgaaagag

SEQ ID NO: 1809300 - DNA, 23 bp, Homo sapiens
tgctgtatccatccatggggctg

SEQ ID NO: 1809301 - DNA, 10 bp, Homo sapiens
tgctgtcccc

SEQ ID NO: 1809302 - DNA, 13 bp, Homo sapiens
tgctgtggcatca

SEQ ID NO: 1809303 - DNA, 17 bp, Homo sapiens
tgctgttgccatagccc

SEQ ID NO: 1809304 - DNA, 21 bp, Homo sapiens
tgcttagttggtgaaacccag

SEQ ID NO: 1809305 - DNA, 15 bp, Homo sapiens
tgcttcgagccatgg

SEQ ID NO: 1809306 - DNA, 18 bp, Homo sapiens
tgcttgcccgctcccaca

SEQ ID NO: 1809307 - DNA, 19 bp, Homo sapiens
tgcttggtggggctcgtgg

SEQ ID NO: 1809308 - DNA, 21 bp, Homo sapiens
tgctttcgaataaagtgaata

SEQ ID NO: 1809309 - DNA, 12 bp, Homo sapiens
tgctttgggctt

SEQ ID NO: 1809310 - DNA, 22 bp, Homo sapiens
tgctttgggctttgcaggctct

SEQ ID NO: 1809311 - DNA, 23 bp, Homo sapiens
tgctttgggctttgcaggctctg

SEQ ID NO: 1809312 - DNA, 15 bp, Homo sapiens
tgctttttggcacag

SEQ ID NO: 1809313 - DNA, 12 bp, Homo sapiens
tggaagagcagc

SEQ ID NO: 1809314 - DNA, 18 bp, Homo sapiens
tggaagagcagcctgatg

SEQ ID NO: 1809315 - DNA, 14 bp, Homo sapiens
tggaaggcagggca

SEQ ID NO: 1809316 - DNA, 20 bp, Homo sapiens
tggaagtgtgggtctgtgtg

SEQ ID NO: 1809317 - DNA, 23 bp, Homo sapiens
tggaagtgtgggtctgtgtgtgt

SEQ ID NO: 1809318 - DNA, 20 bp, Homo sapiens
tggaatgatgggtcagttgt

SEQ ID NO: 1809319 - DNA, 13 bp, Homo sapiens
tggaattcagcac

SEQ ID NO: 1809320 - DNA, 12 bp, Homo sapiens
tggaattttctt

SEQ ID NO: 1809321 - DNA, 20 bp, Homo sapiens
tggaattttctttcatacat

SEQ ID NO: 1809322 - DNA, 23 bp, Homo sapiens
tggaattttctttcatacattat

SEQ ID NO: 1809323 - DNA, 15 bp, Homo sapiens
tggacaagaagctgc

SEQ ID NO: 1809324 - DNA, 17 bp, Homo sapiens
tggacaagaagctgcta

SEQ ID NO: 1809325 - DNA, 12 bp, Homo sapiens
tggacacctgcc

SEQ ID NO: 1809326 - DNA, 20 bp, Homo sapiens
tggacatatgggtttgaact

SEQ ID NO: 1809327 - DNA, 14 bp, Homo sapiens
tggaccgggtgggc

SEQ ID NO: 1809328 - DNA, 18 bp, Homo sapiens
tggaccgggtgggcctgg

SEQ ID NO: 1809329 - DNA, 19 bp, Homo sapiens
tggaccgggtgggcctggc

SEQ ID NO: 1809330 - DNA, 21 bp, Homo sapiens
tggaccgggtgggcctggcct

SEQ ID NO: 1809331 - DNA, 22 bp, Homo sapiens
tggaccgggtgggcctggcctg

SEQ ID NO: 1809332 - DNA, 18 bp, Homo sapiens
tggacctgagtcggcccc

SEQ ID NO: 1809333 - DNA, 22 bp, Homo sapiens
tggacctttcctgaggaagagg

SEQ ID NO: 1809334 - DNA, 17 bp, Homo sapiens
tggactggtggcccctg

SEQ ID NO: 1809335 - DNA, 15 bp, Homo sapiens
tggacttcctggggc

SEQ ID NO: 1809336 - DNA, 23 bp, Homo sapiens
tggagaccgcttcacccctgcac

SEQ ID NO: 1809337 - DNA, 15 bp, Homo sapiens
tggagacttcctctg

SEQ ID NO: 1809338 - DNA, 16 bp, Homo sapiens
tggagattctgattca

SEQ ID NO: 1809339 - DNA, 17 bp, Homo sapiens
tggagcatttttcagag

SEQ ID NO: 1809340 - DNA, 14 bp, Homo sapiens
tggagccactcctg

SEQ ID NO: 1809341 - DNA, 23 bp, Homo sapiens
tggagccactcctgtcccgcctt

SEQ ID NO: 1809342 - DNA, 22 bp, Homo sapiens
tggagcccgtgcagtacaggca

SEQ ID NO: 1809343 - DNA, 13 bp, Homo sapiens
tggaggattcatg

SEQ ID NO: 1809344 - DNA, 14 bp, Homo sapiens
tggaggcctgatgc

SEQ ID NO: 1809345 - DNA, 22 bp, Homo sapiens
tggagtgaggcttccaggctct

SEQ ID NO: 1809346 - DNA, 23 bp, Homo sapiens
tggagtgcgctcttggtccctgg

SEQ ID NO: 1809347 - DNA, 11 bp, Homo sapiens
tggatactgta

SEQ ID NO: 1809348 - DNA, 23 bp, Homo sapiens
tggatgggcattgggctgacacc

SEQ ID NO: 1809349 - DNA, 14 bp, Homo sapiens
tggatgtgtggggc

SEQ ID NO: 1809350 - DNA, 14 bp, Homo sapiens
tggattcccctgga

SEQ ID NO: 1809351 - DNA, 17 bp, Homo sapiens
tggcaagggggtgtcat

SEQ ID NO: 1809352 - DNA, 22 bp, Homo sapiens
tggcacagacttctggaaggct

SEQ ID NO: 1809353 - DNA, 18 bp, Homo sapiens
tggcacagtgtctgggct

SEQ ID NO: 1809354 - DNA, 19 bp, Homo sapiens
tggcacagtgtctgggctg

SEQ ID NO: 1809355 - DNA, 16 bp, Homo sapiens
tggcaccagccccctg

SEQ ID NO: 1809356 - DNA, 18 bp, Homo sapiens
tggcacccccatgctgcc

SEQ ID NO: 1809357 - DNA, 14 bp, Homo sapiens
tggcacctcctgag

SEQ ID NO: 1809358 - DNA, 24 bp, Homo sapiens
tggcagaaaagaggagaccctgga

SEQ ID NO: 1809359 - DNA, 12 bp, Homo sapiens
tggcagagaagg

SEQ ID NO: 1809360 - DNA, 14 bp, Homo sapiens
tggcagagaaggcc

SEQ ID NO: 1809361 - DNA, 13 bp, Homo sapiens
tggcagcaggtgc

SEQ ID NO: 1809362 - DNA, 12 bp, Homo sapiens
tggcagccatgc

SEQ ID NO: 1809363 - DNA, 14 bp, Homo sapiens
tggcagccatgcct

SEQ ID NO: 1809364 - DNA, 21 bp, Homo sapiens
tggcagccatgcctcatgcca

SEQ ID NO: 1809365 - DNA, 16 bp, Homo sapiens
tggcagctagactgga

SEQ ID NO: 1809366 - DNA, 12 bp, Homo sapiens
tggcaggacaca

SEQ ID NO: 1809367 - DNA, 17 bp, Homo sapiens
tggcaggacacatcccg

SEQ ID NO: 1809368 - DNA, 14 bp, Homo sapiens
tggccaagagcatc

SEQ ID NO: 1809369 - DNA, 22 bp, Homo sapiens
tggccactgccccactattttt

SEQ ID NO: 1809370 - DNA, 14 bp, Homo sapiens
tggccagagctgga

SEQ ID NO: 1809371 - DNA, 20 bp, Homo sapiens
tggccagagctggaaggcag

SEQ ID NO: 1809372 - DNA, 23 bp, Homo sapiens
tggccagagctggaaggcagggc

SEQ ID NO: 1809373 - DNA, 12 bp, Homo sapiens
tggccagcccca

SEQ ID NO: 1809374 - DNA, 17 bp, Homo sapiens
tggccagccccacagcc

SEQ ID NO: 1809375 - DNA, 19 bp, Homo sapiens
tggccagccccacagccca

SEQ ID NO: 1809376 - DNA, 13 bp, Homo sapiens
tggcccaatgcct

SEQ ID NO: 1809377 - DNA, 23 bp, Homo sapiens
tggcccatcagtgtacccccgcc

SEQ ID NO: 1809378 - DNA, 15 bp, Homo sapiens
tggcccatcccccct

SEQ ID NO: 1809379 - DNA, 19 bp, Homo sapiens
tggcccatcccccctcacc

SEQ ID NO: 1809380 - DNA, 22 bp, Homo sapiens
tggccccaccctcgtggacacc

SEQ ID NO: 1809381 - DNA, 13 bp, Homo sapiens
tggccccagcctg

SEQ ID NO: 1809382 - DNA, 19 bp, Homo sapiens
tggccccagcctggcccag

SEQ ID NO: 1809383 - DNA, 21 bp, Homo sapiens
tggccccagcctggcccagct

SEQ ID NO: 1809384 - DNA, 22 bp, Homo sapiens
tggccccagcctggcccagctc

SEQ ID NO: 1809385 - DNA, 16 bp, Homo sapiens
tggcccccctccaggc

SEQ ID NO: 1809386 - DNA, 23 bp, Homo sapiens
tgctgctaccctccctgctgtcc

SEQ ID NO: 1809387 - DNA, 20 bp, Homo sapiens
tgctgctgtaactgctgagc

SEQ ID NO: 1809388 - DNA, 21 bp, Homo sapiens
tgctgctgtaactgctgagcc

SEQ ID NO: 1809389 - DNA, 24 bp, Homo sapiens
tgctgctgtaactgctgagccact

SEQ ID NO: 1809390 - DNA, 16 bp, Homo sapiens
tgctgcttctcttggg

SEQ ID NO: 1809391 - DNA, 21 bp, Homo sapiens
tgctggcctcccaataaagct

SEQ ID NO: 1809392 - DNA, 23 bp, Homo sapiens
tgctggcctcccaataaagctgg

SEQ ID NO: 1809393 - DNA, 19 bp, Homo sapiens
tgctgggaaccccgcagcc

SEQ ID NO: 1809394 - DNA, 10 bp, Homo sapiens
tgctgggctg

SEQ ID NO: 1809395 - DNA, 14 bp, Homo sapiens
tgctgggctggggc

SEQ ID NO: 1809396 - DNA, 17 bp, Homo sapiens
tgctgggctggggcctg

SEQ ID NO: 1809397 - DNA, 14 bp, Homo sapiens
tgctgggctgggtg

SEQ ID NO: 1809398 - DNA, 13 bp, Homo sapiens
tgctgggtggccc

SEQ ID NO: 1809399 - DNA, 16 bp, Homo sapiens
tgctgggtggcccatc

SEQ ID NO: 1809400 - DNA, 16 bp, Homo sapiens
tgctgtaactgctgag

SEQ ID NO: 1809401 - DNA, 18 bp, Homo sapiens
tgctgtaactgctgagcc

SEQ ID NO: 1809402 - DNA, 23 bp, Homo sapiens
tgctgtaactgctgagccactcg

SEQ ID NO: 1809403 - DNA, 20 bp, Homo sapiens
tgctgtacccttccacctcc

SEQ ID NO: 1809404 - DNA, 21 bp, Homo sapiens
tgctgtacccttccacctcct

SEQ ID NO: 1809405 - DNA, 15 bp, Homo sapiens
tgctgtagacatttg

SEQ ID NO: 1809406 - DNA, 20 bp, Homo sapiens
tgagggctaattctgggaag

SEQ ID NO: 1809407 - DNA, 22 bp, Homo sapiens
tgagggtgactatggagctgag

SEQ ID NO: 1809408 - DNA, 18 bp, Homo sapiens
tgagtacagtgaggaggg

SEQ ID NO: 1809409 - DNA, 19 bp, Homo sapiens
tgagtacagtgaggagggt

SEQ ID NO: 1809410 - DNA, 15 bp, Homo sapiens
tgagtagcatatata

SEQ ID NO: 1809411 - DNA, 16 bp, Homo sapiens
tgagtcacaaaataaa

SEQ ID NO: 1809412 - DNA, 16 bp, Homo sapiens
tgagtctacctgagca

SEQ ID NO: 1809413 - DNA, 20 bp, Homo sapiens
tgagtctacctgagcattca

SEQ ID NO: 1809414 - DNA, 21 bp, Homo sapiens
tgagtctttaacatcttgaac

SEQ ID NO: 1809415 - DNA, 13 bp, Homo sapiens
tgagtggcagcca

SEQ ID NO: 1809416 - DNA, 16 bp, Homo sapiens
tgagtggcagccatgc

SEQ ID NO: 1809417 - DNA, 18 bp, Homo sapiens
tgagtggcagccatgcct

SEQ ID NO: 1809418 - DNA, 20 bp, Homo sapiens
tgagttacttgtctgaggcc

SEQ ID NO: 1809419 - DNA, 15 bp, Homo sapiens
taacgtattttgatg

SEQ ID NO: 1809420 - DNA, 14 bp, Homo sapiens
taactgctgagcca

SEQ ID NO: 1809421 - DNA, 15 bp, Homo sapiens
taactgctgagccac

SEQ ID NO: 1809422 - DNA, 16 bp, Homo sapiens
taactgctgagccact

SEQ ID NO: 1809423 - DNA, 22 bp, Homo sapiens
taacttaaaagaacatgtatat

SEQ ID NO: 1809424 - DNA, 14 bp, Homo sapiens
taagaggcaaagaa

SEQ ID NO: 1809425 - DNA, 21 bp, Homo sapiens
taagatgaagctgtttttgtg

SEQ ID NO: 1809426 - DNA, 18 bp, Homo sapiens
taagcaatggtaattgtg

SEQ ID NO: 1809427 - DNA, 15 bp, Homo sapiens
taagcaggaggaggt

SEQ ID NO: 1809428 - DNA, 18 bp, Homo sapiens
taagccctcgaaccaagg

SEQ ID NO: 1809429 - DNA, 21 bp, Homo sapiens
taagccctcgaaccaaggcag

SEQ ID NO: 1809430 - DNA, 22 bp, Homo sapiens
taagccctctatacataaatgc

SEQ ID NO: 1809431 - DNA, 16 bp, Homo sapiens
taagctttctcctttg

SEQ ID NO: 1809432 - DNA, 16 bp, Homo sapiens
taaggtgggtccagga

SEQ ID NO: 1809433 - DNA, 20 bp, Homo sapiens
taagtttgcatatcagtcat

SEQ ID NO: 1809434 - DNA, 18 bp, Homo sapiens
taataatgtaatactgta

SEQ ID NO: 1809435 - DNA, 15 bp, Homo sapiens
taataatttttgctg

SEQ ID NO: 1809436 - DNA, 19 bp, Homo sapiens
taataatttttgctgaatt

SEQ ID NO: 1809437 - DNA, 14 bp, Homo sapiens
taatactgtagaaa

SEQ ID NO: 1809438 - DNA, 19 bp, Homo sapiens
taatagttagccctcagtc

SEQ ID NO: 1809439 - DNA, 22 bp, Homo sapiens
taatatctgagaagtgtatata

SEQ ID NO: 1809440 - DNA, 16 bp, Homo sapiens
taatatttttcaaaat

SEQ ID NO: 1809441 - DNA, 16 bp, Homo sapiens
taatctagaaaatgaa

SEQ ID NO: 1809442 - DNA, 22 bp, Homo sapiens
taatctcacttcatcaatcaaa

SEQ ID NO: 1809443 - DNA, 18 bp, Homo sapiens
taatgaaggcatatttcc

SEQ ID NO: 1809444 - DNA, 14 bp, Homo sapiens
gctgcactgcagtg

SEQ ID NO: 1809445 - DNA, 12 bp, Homo sapiens
gctgcagagggg

SEQ ID NO: 1809446 - DNA, 20 bp, Homo sapiens
gctgcagaggggcaggccct

SEQ ID NO: 1809447 - DNA, 21 bp, Homo sapiens
gctgcagaggggcaggccctg

SEQ ID NO: 1809448 - DNA, 21 bp, Homo sapiens
gctgcagctgggccccatgct

SEQ ID NO: 1809449 - DNA, 22 bp, Homo sapiens
gctgcagctgggccccatgctc

SEQ ID NO: 1809450 - DNA, 22 bp, Homo sapiens
gctgcaggtacttcctcctgat

SEQ ID NO: 1809451 - DNA, 19 bp, Homo sapiens
gctgccaccacgtctgcca

SEQ ID NO: 1809452 - DNA, 10 bp, Homo sapiens
gctgccaggc

SEQ ID NO: 1809453 - DNA, 17 bp, Homo sapiens
gctgccatgccactgcc

SEQ ID NO: 1809454 - DNA, 20 bp, Homo sapiens
gctgccatgccactgccagg

SEQ ID NO: 1809455 - DNA, 15 bp, Homo sapiens
gctgcccctgtctgg

SEQ ID NO: 1809456 - DNA, 13 bp, Homo sapiens
gctgcccgctccc

SEQ ID NO: 1809457 - DNA, 15 bp, Homo sapiens
gctgcccgctcccag

SEQ ID NO: 1809458 - DNA, 18 bp, Homo sapiens
gctgcccggcgccctctg

SEQ ID NO: 1809459 - DNA, 20 bp, Homo sapiens
gctgcccggcgccctctgtc

SEQ ID NO: 1809460 - DNA, 15 bp, Homo sapiens
gctgcctccactccc

SEQ ID NO: 1809461 - DNA, 15 bp, Homo sapiens
gctgcctgccgccca

SEQ ID NO: 1809462 - DNA, 15 bp, Homo sapiens
gctgctctagctggc

SEQ ID NO: 1809463 - DNA, 22 bp, Homo sapiens
gctgctctgccccttgggcatc

SEQ ID NO: 1809464 - DNA, 15 bp, Homo sapiens
gctgctggggcatgt

SEQ ID NO: 1809465 - DNA, 17 bp, Homo sapiens
gctgctggggcatgtgt

SEQ ID NO: 1809466 - DNA, 23 bp, Homo sapiens
gctgctggggcatgtgtgcctgt

SEQ ID NO: 1809467 - DNA, 17 bp, Homo sapiens
gctgctttttggcacag

SEQ ID NO: 1809468 - DNA, 17 bp, Homo sapiens
gctggaaggcagggcag

SEQ ID NO: 1809469 - DNA, 16 bp, Homo sapiens
gctggacaagaagctg

SEQ ID NO: 1809470 - DNA, 17 bp, Homo sapiens
gctggacaagaagctgc

SEQ ID NO: 1809471 - DNA, 20 bp, Homo sapiens
gctggagtgcagtggtgcga

SEQ ID NO: 1809472 - DNA, 13 bp, Homo sapiens
gctggatctgtga

SEQ ID NO: 1809473 - DNA, 14 bp, Homo sapiens
gctggcaagcaggg

SEQ ID NO: 1809474 - DNA, 13 bp, Homo sapiens
gctggccagcccc

SEQ ID NO: 1809475 - DNA, 15 bp, Homo sapiens
gctggccagccccac

SEQ ID NO: 1809476 - DNA, 18 bp, Homo sapiens
gctggccagccccacagc

SEQ ID NO: 1809477 - DNA, 23 bp, Homo sapiens
gctggcctcccaataaagctgga

SEQ ID NO: 1809478 - DNA, 22 bp, Homo sapiens
gctgggaagctgtactcagagc

SEQ ID NO: 1809479 - DNA, 23 bp, Homo sapiens
gctgggaagctgtactcagagca

SEQ ID NO: 1809480 - DNA, 20 bp, Homo sapiens
gctgggatttcttcgctgct

SEQ ID NO: 1809481 - DNA, 15 bp, Homo sapiens
gctgggcactgccag

SEQ ID NO: 1809482 - DNA, 14 bp, Homo sapiens
gctgggctgggtgc

SEQ ID NO: 1809483 - DNA, 13 bp, Homo sapiens
gctggggcagagg

SEQ ID NO: 1809484 - DNA, 14 bp, Homo sapiens
gctggggcagaggg

SEQ ID NO: 1809485 - DNA, 18 bp, Homo sapiens
gctggggcagaggggcag

SEQ ID NO: 1809486 - DNA, 19 bp, Homo sapiens
gctggggcagaggggcagc

SEQ ID NO: 1809487 - DNA, 20 bp, Homo sapiens
gctggggcagaggggcagcc

SEQ ID NO: 1809488 - DNA, 23 bp, Homo sapiens
gctgggtgcgaccccatctgccc

SEQ ID NO: 1809489 - DNA, 13 bp, Homo sapiens
gctgggtggccca

SEQ ID NO: 1809490 - DNA, 14 bp, Homo sapiens
gctgtaactgctga

SEQ ID NO: 1809491 - DNA, 16 bp, Homo sapiens
gctgtaactgctgagc

SEQ ID NO: 1809492 - DNA, 12 bp, Homo sapiens
tcaaaaggcact

SEQ ID NO: 1809493 - DNA, 19 bp, Homo sapiens
tcaaaaggcactgtgaact

SEQ ID NO: 1809494 - DNA, 11 bp, Homo sapiens
tcaaaattgtt

SEQ ID NO: 1809495 - DNA, 12 bp, Homo sapiens
tcaaagctgagt

SEQ ID NO: 1809496 - DNA, 17 bp, Homo sapiens
tcaaattaatctttcta

SEQ ID NO: 1809497 - DNA, 15 bp, Homo sapiens
tcaaatttttcatct

SEQ ID NO: 1809498 - DNA, 13 bp, Homo sapiens
tcaacccccctcc

SEQ ID NO: 1809499 - DNA, 20 bp, Homo sapiens
tcaacccccctcccagacag

SEQ ID NO: 1809500 - DNA, 21 bp, Homo sapiens
tcaacccccctcccagacagg

SEQ ID NO: 1809501 - DNA, 17 bp, Homo sapiens
tcaagaaatgagtctgt

SEQ ID NO: 1809502 - DNA, 19 bp, Homo sapiens
gagggaatgttccctgcac

SEQ ID NO: 1809503 - DNA, 20 bp, Homo sapiens
gagggaatgttccctgcacc

SEQ ID NO: 1809504 - DNA, 17 bp, Homo sapiens
gagggatgatgccacac

SEQ ID NO: 1809505 - DNA, 13 bp, Homo sapiens
gagggcagagcca

SEQ ID NO: 1809506 - DNA, 17 bp, Homo sapiens
gagggcagagccatggg

SEQ ID NO: 1809507 - DNA, 12 bp, Homo sapiens
gagggcccagct

SEQ ID NO: 1809508 - DNA, 13 bp, Homo sapiens
gagggcccagctg

SEQ ID NO: 1809509 - DNA, 15 bp, Homo sapiens
gcaggccctgcactg

SEQ ID NO: 1809510 - DNA, 20 bp, Homo sapiens
gcaggccctgcactgtcctg

SEQ ID NO: 1809511 - DNA, 22 bp, Homo sapiens
gcaggcctgggacccagctact

SEQ ID NO: 1809512 - DNA, 11 bp, Homo sapiens
gcaggctctgg

SEQ ID NO: 1809513 - DNA, 14 bp, Homo sapiens
gcaggctctgggct

SEQ ID NO: 1809514 - DNA, 16 bp, Homo sapiens
gcaggctctgggctca

SEQ ID NO: 1809515 - DNA, 20 bp, Homo sapiens
gcaggctctgggctcagggc

SEQ ID NO: 1809516 - DNA, 21 bp, Homo sapiens
gcaggctctgggctcagggct

SEQ ID NO: 1809517 - DNA, 17 bp, Homo sapiens
gcagggaaagctccacg

SEQ ID NO: 1809518 - DNA, 22 bp, Homo sapiens
gcaggtagatcgcttgagccca

SEQ ID NO: 1809519 - DNA, 15 bp, Homo sapiens
gcaggtgctgctacc

SEQ ID NO: 1809520 - DNA, 18 bp, Homo sapiens
gcaggtgtggtggctcat

SEQ ID NO: 1809521 - DNA, 13 bp, Homo sapiens
gcagtccccagcc

SEQ ID NO: 1809522 - DNA, 18 bp, Homo sapiens
gcagtctgaacccttgtg

SEQ ID NO: 1809523 - DNA, 14 bp, Homo sapiens
gcagtgactggcag

SEQ ID NO: 1809524 - DNA, 21 bp, Homo sapiens
gcagtgatggcgcgggaggca

SEQ ID NO: 1809525 - DNA, 17 bp, Homo sapiens
gcagtgcctcgaggcac

SEQ ID NO: 1809526 - DNA, 17 bp, Homo sapiens
gtgtagttaattttatt

SEQ ID NO: 1809527 - DNA, 19 bp, Homo sapiens
gtgtcactggctgcctcca

SEQ ID NO: 1809528 - DNA, 13 bp, Homo sapiens
gtgtccagcagct

SEQ ID NO: 1809529 - DNA, 15 bp, Homo sapiens
gtgtcccaaggagct

SEQ ID NO: 1809530 - DNA, 14 bp, Homo sapiens
gtgtcttcctgtgg

SEQ ID NO: 1809531 - DNA, 17 bp, Homo sapiens
gtgtgaattctgcaact

SEQ ID NO: 1809532 - DNA, 16 bp, Homo sapiens
gtgtgagtggcagcca

SEQ ID NO: 1809533 - DNA, 17 bp, Homo sapiens
gtgtgagtggcagccat

SEQ ID NO: 1809534 - DNA, 21 bp, Homo sapiens
gtgtgagtggcagccatgcct

SEQ ID NO: 1809535 - DNA, 16 bp, Homo sapiens
gtgtgccccccatcct

SEQ ID NO: 1809536 - DNA, 19 bp, Homo sapiens
gtgtgccccccatcctggc

SEQ ID NO: 1809537 - DNA, 14 bp, Homo sapiens
gtgtggagaggggt

SEQ ID NO: 1809538 - DNA, 13 bp, Homo sapiens
gtgtggggcatgg

SEQ ID NO: 1809539 - DNA, 14 bp, Homo sapiens
gtgtgggtctgtgt

SEQ ID NO: 1809540 - DNA, 13 bp, Homo sapiens
gtgtggtggctca

SEQ ID NO: 1809541 - DNA, 12 bp, Homo sapiens
gtgtgtatgtgg

SEQ ID NO: 1809542 - DNA, 13 bp, Homo sapiens
gtgtgtgtatgtg

SEQ ID NO: 1809543 - DNA, 15 bp, Homo sapiens
gtgtgtttatgtgtg

SEQ ID NO: 1809544 - DNA, 16 bp, Homo sapiens
gtgtgtttatgtgtgt

SEQ ID NO: 1809545 - DNA, 16 bp, Homo sapiens
gtgttactaaagtcac

SEQ ID NO: 1809546 - DNA, 24 bp, Homo sapiens
gtgttaggcctggcacagtgtctg

SEQ ID NO: 1809547 - DNA, 16 bp, Homo sapiens
gtgttgtggagaaaag

SEQ ID NO: 1809548 - DNA, 15 bp, Homo sapiens
gtgttgtgtgtggga

SEQ ID NO: 1809549 - DNA, 15 bp, Homo sapiens
gttaaatcattttca

SEQ ID NO: 1809550 - DNA, 16 bp, Homo sapiens
gttaaatcattttcat

SEQ ID NO: 1809551 - DNA, 20 bp, Homo sapiens
gttactcagcagcagagagc

SEQ ID NO: 1809552 - DNA, 17 bp, Homo sapiens
gttacttgtctgaggcc

SEQ ID NO: 1809553 - DNA, 18 bp, Homo sapiens
gttacttgtctgaggcct

SEQ ID NO: 1809554 - DNA, 17 bp, Homo sapiens
gttatctgcctggcctg

SEQ ID NO: 1809555 - DNA, 21 bp, Homo sapiens
gttatctgcctggcctggctc

SEQ ID NO: 1809556 - DNA, 23 bp, Homo sapiens
gttattagtgccaagtttttcag

SEQ ID NO: 1809557 - DNA, 16 bp, Homo sapiens
gttcaaaaatttctgc

SEQ ID NO: 1809558 - DNA, 11 bp, Homo sapiens
gttcatcattg

SEQ ID NO: 1809559 - DNA, 12 bp, Homo sapiens
gttcatgaatac

SEQ ID NO: 1809560 - DNA, 15 bp, Homo sapiens
gttcccggagcacag

SEQ ID NO: 1809561 - DNA, 17 bp, Homo sapiens
gttcccggagcacagcc

SEQ ID NO: 1809562 - DNA, 19 bp, Homo sapiens
gttcccggagcacagccct

SEQ ID NO: 1809563 - DNA, 13 bp, Homo sapiens
gttccctgcaccc

SEQ ID NO: 1809564 - DNA, 14 bp, Homo sapiens
gttccctgcaccct

SEQ ID NO: 1809565 - DNA, 15 bp, Homo sapiens
gttccctgcaccctg

SEQ ID NO: 1809566 - DNA, 16 bp, Homo sapiens
gttccctgtcagaggc

SEQ ID NO: 1809567 - DNA, 14 bp, Homo sapiens
gttcccttgaccat

SEQ ID NO: 1809568 - DNA, 23 bp, Homo sapiens
gttcccttgaccattggctgcgc

SEQ ID NO: 1809569 - DNA, 15 bp, Homo sapiens
gttccttccctggga

SEQ ID NO: 1809570 - DNA, 18 bp, Homo sapiens
gttctgggtgttgaccac

SEQ ID NO: 1809571 - DNA, 13 bp, Homo sapiens
gttgaaggcagtc

SEQ ID NO: 1809572 - DNA, 19 bp, Homo sapiens
gttgatgtgggaagaagta

SEQ ID NO: 1809573 - DNA, 21 bp, Homo sapiens
gttgcaacaataattcatcaa

SEQ ID NO: 1809574 - DNA, 15 bp, Homo sapiens
gttgcacatcattca

SEQ ID NO: 1809575 - DNA, 22 bp, Homo sapiens
gttgctcagcaaggggctctgc

SEQ ID NO: 1809576 - DNA, 20 bp, Homo sapiens
gttggcagagaaggcctctt

SEQ ID NO: 1809577 - DNA, 19 bp, Homo sapiens
gttggcgcaccctcccctc

SEQ ID NO: 1809578 - DNA, 21 bp, Homo sapiens
gttggcgcaccctcccctccc

SEQ ID NO: 1809579 - DNA, 21 bp, Homo sapiens
gttgggagaatgtcagtatgt

SEQ ID NO: 1809580 - DNA, 16 bp, Homo sapiens
gttgggcgtgctacct

SEQ ID NO: 1809581 - DNA, 15 bp, Homo sapiens
gttgtctccctggcc

SEQ ID NO: 1809582 - DNA, 12 bp, Homo sapiens
gttgtgtgtggg

SEQ ID NO: 1809583 - DNA, 13 bp, Homo sapiens
gttgtgtgtggga

SEQ ID NO: 1809584 - DNA, 22 bp, Homo sapiens
gttgttgccaactaagccctcg

SEQ ID NO: 1809585 - DNA, 19 bp, Homo sapiens
gtttaaaaaaagtatatat

SEQ ID NO: 1809586 - DNA, 16 bp, Homo sapiens
gtttagaagaagtgtg

SEQ ID NO: 1809587 - DNA, 20 bp, Homo sapiens
gtttagtttctagaggcctc

SEQ ID NO: 1809588 - DNA, 13 bp, Homo sapiens
gtttatgtgtgtg

SEQ ID NO: 1809589 - DNA, 17 bp, Homo sapiens
gtttcacaacagatttc

SEQ ID NO: 1809590 - DNA, 22 bp, Homo sapiens
gtttcccggtgacacatccatt

SEQ ID NO: 1809591 - DNA, 18 bp, Homo sapiens
gtttccctcccaacagag

SEQ ID NO: 1809592 - DNA, 18 bp, Homo sapiens
gtttcctcattttactaa

SEQ ID NO: 1809593 - DNA, 21 bp, Homo sapiens
gtttggatctccaattgcctc

SEQ ID NO: 1809594 - DNA, 21 bp, Homo sapiens
gttttagaagttaaagtcaat

SEQ ID NO: 1809595 - DNA, 22 bp, Homo sapiens
gttttattgtccttcagagctc

SEQ ID NO: 1809596 - DNA, 14 bp, Homo sapiens
gttttccactgtgc

SEQ ID NO: 1809597 - DNA, 15 bp, Homo sapiens
gttttccactgtgct

SEQ ID NO: 1809598 - DNA, 19 bp, Homo sapiens
gttttctcagaacagctga

SEQ ID NO: 1809599 - DNA, 20 bp, Homo sapiens
gttttctcagaacagctgaa

SEQ ID NO: 1809600 - DNA, 15 bp, Homo sapiens
gtttttcagaaagtt

SEQ ID NO: 1809601 - DNA, 12 bp, Homo sapiens
taaaaagattat

SEQ ID NO: 1809602 - DNA, 19 bp, Homo sapiens
taaaaagattatatatcat

SEQ ID NO: 1809603 - DNA, 16 bp, Homo sapiens
taaaaatactgtttca

SEQ ID NO: 1809604 - DNA, 19 bp, Homo sapiens
taaaaatactgtttcacta

SEQ ID NO: 1809605 - DNA, 17 bp, Homo sapiens
taaaaggaaaaaagaaa

SEQ ID NO: 1809606 - DNA, 22 bp, Homo sapiens
taaaagttaaactacttgtaaa

SEQ ID NO: 1809607 - DNA, 14 bp, Homo sapiens
taaaatattttcca

SEQ ID NO: 1809608 - DNA, 15 bp, Homo sapiens
taaaatattttccaa

SEQ ID NO: 1809609 - DNA, 16 bp, Homo sapiens
taaaatgcatatttct

SEQ ID NO: 1809610 - DNA, 21 bp, Homo sapiens
taaaatgcatatttctatgtt

SEQ ID NO: 1809611 - DNA, 20 bp, Homo sapiens
taaaatgcccatttcgaaga

SEQ ID NO: 1809612 - DNA, 16 bp, Homo sapiens
taaaattgtgatgtgt

SEQ ID NO: 1809613 - DNA, 15 bp, Homo sapiens
taaacattcctccag

SEQ ID NO: 1809614 - DNA, 20 bp, Homo sapiens
taaacattcctccagcctcc

SEQ ID NO: 1809615 - DNA, 23 bp, Homo sapiens
taaacatttgtaaaaatactgtt

SEQ ID NO: 1809616 - DNA, 18 bp, Homo sapiens
taaaccctatctgtgatt

SEQ ID NO: 1809617 - DNA, 21 bp, Homo sapiens
taaacctaattgtggtagaaa

SEQ ID NO: 1809618 - DNA, 22 bp, Homo sapiens
taaactgattagtattcaggca

SEQ ID NO: 1809619 - DNA, 16 bp, Homo sapiens
taaactggatactgta

SEQ ID NO: 1809620 - DNA, 12 bp, Homo sapiens
taaagagttatt

SEQ ID NO: 1809621 - DNA, 21 bp, Homo sapiens
taaagctggacaagaagctgc

SEQ ID NO: 1809622 - DNA, 22 bp, Homo sapiens
taaagctggacaagaagctgct

SEQ ID NO: 1809623 - DNA, 23 bp, Homo sapiens
taaagctggacaagaagctgcta

SEQ ID NO: 1809624 - DNA, 19 bp, Homo sapiens
taaaggcctggaaccaggg

SEQ ID NO: 1809625 - DNA, 15 bp, Homo sapiens
taaagtaattttgtg

SEQ ID NO: 1809626 - DNA, 13 bp, Homo sapiens
taaataacacaga

SEQ ID NO: 1809627 - DNA, 21 bp, Homo sapiens
taaatacacttcctgcttaaa

SEQ ID NO: 1809628 - DNA, 14 bp, Homo sapiens
taaatcattttcat

SEQ ID NO: 1809629 - DNA, 23 bp, Homo sapiens
taaatccttgggagtcattacca

SEQ ID NO: 1809630 - DNA, 23 bp, Homo sapiens
taaatgaagaaagggaggcccag

SEQ ID NO: 1809631 - DNA, 16 bp, Homo sapiens
taaatgaatcttactc

SEQ ID NO: 1809632 - DNA, 21 bp, Homo sapiens
taaatgcccagcacaattcat

SEQ ID NO: 1809633 - DNA, 22 bp, Homo sapiens
taaatgcccagcacaattcatt

SEQ ID NO: 1809634 - DNA, 21 bp, Homo sapiens
taaatgtaaaaatgaaggaat

SEQ ID NO: 1809635 - DNA, 23 bp, Homo sapiens
taaatgttgcacatcattcattc

SEQ ID NO: 1809636 - DNA, 24 bp, Homo sapiens
taaatgttgcacatcattcattca

SEQ ID NO: 1809637 - DNA, 13 bp, Homo sapiens
taaatttatgtga

SEQ ID NO: 1809638 - DNA, 13 bp, Homo sapiens
taacaactgtgaa

SEQ ID NO: 1809639 - DNA, 16 bp, Homo sapiens
taacaactgtgaatat

SEQ ID NO: 1809640 - DNA, 22 bp, Homo sapiens
taacaactgtgaatatgagaaa

SEQ ID NO: 1809641 - DNA, 18 bp, Homo sapiens
taacccccagcccacaga

SEQ ID NO: 1809642 - DNA, 20 bp, Homo sapiens
taacccccagcccacagagc

SEQ ID NO: 1809643 - DNA, 22 bp, Homo sapiens
taacccccagcccacagagcct

SEQ ID NO: 1809644 - DNA, 16 bp, Homo sapiens
gccccaacccccagca

SEQ ID NO: 1809645 - DNA, 15 bp, Homo sapiens
gccccaagcagccag

SEQ ID NO: 1809646 - DNA, 17 bp, Homo sapiens
gccccaagcagccagcc

SEQ ID NO: 1809647 - DNA, 23 bp, Homo sapiens
gccccaagcagccagccagtctt

SEQ ID NO: 1809648 - DNA, 14 bp, Homo sapiens
gccccacagcccac

SEQ ID NO: 1809649 - DNA, 18 bp, Homo sapiens
gccccacagcccacgtcc

SEQ ID NO: 1809650 - DNA, 18 bp, Homo sapiens
gccccagcctggcccagc

SEQ ID NO: 1809651 - DNA, 19 bp, Homo sapiens
gccccagcctggcccagct

SEQ ID NO: 1809652 - DNA, 20 bp, Homo sapiens
gccccagcctggcccagctc

SEQ ID NO: 1809653 - DNA, 13 bp, Homo sapiens
gccccagggcctg

SEQ ID NO: 1809654 - DNA, 14 bp, Homo sapiens
gccccatgctctgc

SEQ ID NO: 1809655 - DNA, 15 bp, Homo sapiens
gccccatgctctgcc

SEQ ID NO: 1809656 - DNA, 21 bp, Homo sapiens
gccccatgctctgccccaagc

SEQ ID NO: 1809657 - DNA, 20 bp, Homo sapiens
gcccccaaccccgcggtgct

SEQ ID NO: 1809658 - DNA, 14 bp, Homo sapiens
gcccccatccctcg

SEQ ID NO: 1809659 - DNA, 21 bp, Homo sapiens
gcccccatccctcggacccac

SEQ ID NO: 1809660 - DNA, 15 bp, Homo sapiens
gcccccatctcccca

SEQ ID NO: 1809661 - DNA, 17 bp, Homo sapiens
gcccccatctccccagg

SEQ ID NO: 1809662 - DNA, 18 bp, Homo sapiens
gcccccatctccccaggc

SEQ ID NO: 1809663 - DNA, 16 bp, Homo sapiens
gccccccatcctggcc

SEQ ID NO: 1809664 - DNA, 19 bp, Homo sapiens
gccccccatcctggcccat

SEQ ID NO: 1809665 - DNA, 12 bp, Homo sapiens
gcccccctccag

SEQ ID NO: 1809666 - DNA, 14 bp, Homo sapiens
gccccctcgtgcca

SEQ ID NO: 1809667 - DNA, 16 bp, Homo sapiens
gccccctcgtgccagt

SEQ ID NO: 1809668 - DNA, 11 bp, Homo sapiens
gccccctgcca

SEQ ID NO: 1809669 - DNA, 13 bp, Homo sapiens
gccccctggatgg

SEQ ID NO: 1809670 - DNA, 15 bp, Homo sapiens
gccccggggctggca

SEQ ID NO: 1809671 - DNA, 17 bp, Homo sapiens
gccccggggctggcaag

SEQ ID NO: 1809672 - DNA, 19 bp, Homo sapiens
gccccgtcggactgccccc

SEQ ID NO: 1809673 - DNA, 22 bp, Homo sapiens
gccccgtcggactgcccccaga

SEQ ID NO: 1809674 - DNA, 21 bp, Homo sapiens
gccccgttccctgtcagaggc

SEQ ID NO: 1809675 - DNA, 21 bp, Homo sapiens
gcccctcagcccttgccccca

SEQ ID NO: 1809676 - DNA, 14 bp, Homo sapiens
gcccctccccagcc

SEQ ID NO: 1809677 - DNA, 15 bp, Homo sapiens
gcccctccccagcca

SEQ ID NO: 1809678 - DNA, 16 bp, Homo sapiens
gcccctccccagccct

SEQ ID NO: 1809679 - DNA, 15 bp, Homo sapiens
gcccctccctctgcc

SEQ ID NO: 1809680 - DNA, 16 bp, Homo sapiens
gcccctccctctgccc

SEQ ID NO: 1809681 - DNA, 21 bp, Homo sapiens
gcccctccctctgccccaagc

SEQ ID NO: 1809682 - DNA, 18 bp, Homo sapiens
gcccctgaggactggaga

SEQ ID NO: 1809683 - DNA, 16 bp, Homo sapiens
gccccttaagggttga

SEQ ID NO: 1809684 - DNA, 18 bp, Homo sapiens
gccccttaagggttgaag

SEQ ID NO: 1809685 - DNA, 21 bp, Homo sapiens
gccccttgggcatccacccag

SEQ ID NO: 1809686 - DNA, 12 bp, Homo sapiens
gcccgctcccag

SEQ ID NO: 1809687 - DNA, 13 bp, Homo sapiens
gcccgctcccagt

SEQ ID NO: 1809688 - DNA, 14 bp, Homo sapiens
gcccgcttgcctcg

SEQ ID NO: 1809689 - DNA, 22 bp, Homo sapiens
gcccgcttgcctcggctcctgc

SEQ ID NO: 1809690 - DNA, 23 bp, Homo sapiens
gcccgcttgcctcggctcctgct

SEQ ID NO: 1809691 - DNA, 14 bp, Homo sapiens
gcccggcgccctct

SEQ ID NO: 1809692 - DNA, 13 bp, Homo sapiens
gcccgtgaagcag

SEQ ID NO: 1809693 - DNA, 18 bp, Homo sapiens
gcccgtgaagcagtgcct

SEQ ID NO: 1809694 - DNA, 12 bp, Homo sapiens
gcccgtgcagta

SEQ ID NO: 1809695 - DNA, 17 bp, Homo sapiens
gcccgtgcagtacaggc

SEQ ID NO: 1809696 - DNA, 18 bp, Homo sapiens
gcccgtgcagtacaggca

SEQ ID NO: 1809697 - DNA, 20 bp, Homo sapiens
gcccgttgtctccctggccc

SEQ ID NO: 1809698 - DNA, 18 bp, Homo sapiens
gccctaggattcctcccc

SEQ ID NO: 1809699 - DNA, 20 bp, Homo sapiens
gccctaggattcctccccca

SEQ ID NO: 1809700 - DNA, 18 bp, Homo sapiens
gccctcaaggcctcccac

SEQ ID NO: 1809701 - DNA, 21 bp, Homo sapiens
gccctcagtcagttcccggag

SEQ ID NO: 1809702 - DNA, 22 bp, Homo sapiens
gccctcagtcagttcccggagc

SEQ ID NO: 1809703 - DNA, 16 bp, Homo sapiens
gccctccatgggctag

SEQ ID NO: 1809704 - DNA, 17 bp, Homo sapiens
gccctcgaaccaaggca

SEQ ID NO: 1809705 - DNA, 21 bp, Homo sapiens
gccctcgaaccaaggcagcct

SEQ ID NO: 1809706 - DNA, 14 bp, Homo sapiens
gccctctgtcctga

SEQ ID NO: 1809707 - DNA, 15 bp, Homo sapiens
gccctctgtcctgac

SEQ ID NO: 1809708 - DNA, 14 bp, Homo sapiens
gccctgcactgtcc

SEQ ID NO: 1809709 - DNA, 18 bp, Homo sapiens
gccctgcactgtcctgct

SEQ ID NO: 1809710 - DNA, 19 bp, Homo sapiens
gccctgcactgtcctgctc

SEQ ID NO: 1809711 - DNA, 21 bp, Homo sapiens
gccctgcactgtcctgctcca

SEQ ID NO: 1809712 - DNA, 20 bp, Homo sapiens
gccctgcccccatctcccca

SEQ ID NO: 1809713 - DNA, 21 bp, Homo sapiens
gccctgcccccatctccccag

SEQ ID NO: 1809714 - DNA, 12 bp, Homo sapiens
gccctgcctgcc

SEQ ID NO: 1809715 - DNA, 16 bp, Homo sapiens
gccctgcctgcccact

SEQ ID NO: 1809716 - DNA, 17 bp, Homo sapiens
gccctgcctgcccactt

SEQ ID NO: 1809717 - DNA, 23 bp, Homo sapiens
gccctgcgttggagccactcctg

SEQ ID NO: 1809718 - DNA, 10 bp, Homo sapiens
gccctggcaa

SEQ ID NO: 1809719 - DNA, 19 bp, Homo sapiens
gccctggcaacatagtgag

SEQ ID NO: 1809720 - DNA, 19 bp, Homo sapiens
gcccttgcccccatccctc

SEQ ID NO: 1809721 - DNA, 16 bp, Homo sapiens
gcccttggggcctggc

SEQ ID NO: 1809722 - DNA, 17 bp, Homo sapiens
gcccttggggcctggct

SEQ ID NO: 1809723 - DNA, 13 bp, Homo sapiens
gcccttgtcctgc

SEQ ID NO: 1809724 - DNA, 15 bp, Homo sapiens
gcccttgtcctgcca

SEQ ID NO: 1809725 - DNA, 15 bp, Homo sapiens
gccctttgcaggccc

SEQ ID NO: 1809726 - DNA, 23 bp, Homo sapiens
gccctttgcaggcccagcagact

SEQ ID NO: 1809727 - DNA, 15 bp, Homo sapiens
gccgcaggaaggcag

SEQ ID NO: 1809728 - DNA, 16 bp, Homo sapiens
gccgccgcctcgccca

SEQ ID NO: 1809729 - DNA, 24 bp, Homo sapiens
gccgccgcctcgcccaccgcatgc

SEQ ID NO: 1809730 - DNA, 20 bp, Homo sapiens
gcgctcaggacccaggccct

SEQ ID NO: 1809731 - DNA, 17 bp, Homo sapiens
gcgctcttggtccctgg

SEQ ID NO: 1809732 - DNA, 20 bp, Homo sapiens
gcgctcttggtccctggtcc

SEQ ID NO: 1809733 - DNA, 20 bp, Homo sapiens
gcggcctgttgggcagagct

SEQ ID NO: 1809734 - DNA, 19 bp, Homo sapiens
gcgggaggcaccagctctg

SEQ ID NO: 1809735 - DNA, 23 bp, Homo sapiens
gcgggaggcaccagctctgtggc

SEQ ID NO: 1809736 - DNA, 21 bp, Homo sapiens
gcgggcagccccgttttgggg

SEQ ID NO: 1809737 - DNA, 13 bp, Homo sapiens
gcggtgctctggc

SEQ ID NO: 1809738 - DNA, 14 bp, Homo sapiens
gcggtgctctggcg

SEQ ID NO: 1809739 - DNA, 14 bp, Homo sapiens
gcgtaatgggcctg

SEQ ID NO: 1809740 - DNA, 15 bp, Homo sapiens
gcgtaatgggcctgc

SEQ ID NO: 1809741 - DNA, 17 bp, Homo sapiens
gcgtaatgggcctgccc

SEQ ID NO: 1809742 - DNA, 13 bp, Homo sapiens
gcgtggctgtggc

SEQ ID NO: 1809743 - DNA, 19 bp, Homo sapiens
gcgtggctgtggcacagac

SEQ ID NO: 1809744 - DNA, 21 bp, Homo sapiens
gctaagatgagatttgccagc

SEQ ID NO: 1809745 - DNA, 22 bp, Homo sapiens
gctaattctttgacctgttggg

SEQ ID NO: 1809746 - DNA, 14 bp, Homo sapiens
gctaccctccctgc

SEQ ID NO: 1809747 - DNA, 17 bp, Homo sapiens
gctaccctccctgctgt

SEQ ID NO: 1809748 - DNA, 19 bp, Homo sapiens
gctaccctccctgctgtcc

SEQ ID NO: 1809749 - DNA, 16 bp, Homo sapiens
gctactctgtccaggc

SEQ ID NO: 1809750 - DNA, 18 bp, Homo sapiens
gctactctgtccaggcca

SEQ ID NO: 1809751 - DNA, 12 bp, Homo sapiens
gctactggcagc

SEQ ID NO: 1809752 - DNA, 16 bp, Homo sapiens
gctactggcagctcct

SEQ ID NO: 1809753 - DNA, 17 bp, Homo sapiens
gctactggcagctcctc

SEQ ID NO: 1809754 - DNA, 12 bp, Homo sapiens
gctagaaacaat

SEQ ID NO: 1809755 - DNA, 16 bp, Homo sapiens
gctagactggagtgag

SEQ ID NO: 1809756 - DNA, 18 bp, Homo sapiens
gctaggactgaggagtgg

SEQ ID NO: 1809757 - DNA, 16 bp, Homo sapiens
gctagtgtgagtggca

SEQ ID NO: 1809758 - DNA, 21 bp, Homo sapiens
gctatggcaagggggtgtcat

SEQ ID NO: 1809759 - DNA, 21 bp, Homo sapiens
gctatggggatagatgtgtgg

SEQ ID NO: 1809760 - DNA, 22 bp, Homo sapiens
gctattgttgtgggctttctcc

SEQ ID NO: 1809761 - DNA, 15 bp, Homo sapiens
gctatttctctcccc

SEQ ID NO: 1809762 - DNA, 13 bp, Homo sapiens
gctcaaaaagttt

SEQ ID NO: 1809763 - DNA, 16 bp, Homo sapiens
gctcacttttgtgaaa

SEQ ID NO: 1809764 - DNA, 20 bp, Homo sapiens
gctcagaatagatctgatgg

SEQ ID NO: 1809765 - DNA, 21 bp, Homo sapiens
gctcagaatagatctgatggt

SEQ ID NO: 1809766 - DNA, 21 bp, Homo sapiens
gctcaggacccaggccctcca

SEQ ID NO: 1809767 - DNA, 21 bp, Homo sapiens
cttattcaggaaaagcctctg

SEQ ID NO: 1809768 - DNA, 13 bp, Homo sapiens
cttcaaataattg

SEQ ID NO: 1809769 - DNA, 23 bp, Homo sapiens
cttcaaataattggctttgcaga

SEQ ID NO: 1809770 - DNA, 15 bp, Homo sapiens
cttcaagctgtcccc

SEQ ID NO: 1809771 - DNA, 13 bp, Homo sapiens
cttcacccctgca

SEQ ID NO: 1809772 - DNA, 14 bp, Homo sapiens
cttcacccctgcac

SEQ ID NO: 1809773 - DNA, 23 bp, Homo sapiens
cttcagaacagaggcatttaaaa

SEQ ID NO: 1809774 - DNA, 11 bp, Homo sapiens
cttcagatttc

SEQ ID NO: 1809775 - DNA, 14 bp, Homo sapiens
cttcagggccagaa

SEQ ID NO: 1809776 - DNA, 17 bp, Homo sapiens
cttcaggggctgcccgc

SEQ ID NO: 1809777 - DNA, 16 bp, Homo sapiens
cttcagtgagcccctc

SEQ ID NO: 1809778 - DNA, 20 bp, Homo sapiens
cttcagtgagcccctcccca

SEQ ID NO: 1809779 - DNA, 21 bp, Homo sapiens
cttcagtgagcccctccccag

SEQ ID NO: 1809780 - DNA, 15 bp, Homo sapiens
cttcatcaatcaaat

SEQ ID NO: 1809781 - DNA, 17 bp, Homo sapiens
cttcatcaatcaaatat

SEQ ID NO: 1809782 - DNA, 21 bp, Homo sapiens
cttccaaggtggtctgctcgg

SEQ ID NO: 1809783 - DNA, 15 bp, Homo sapiens
cttccacctcctaga

SEQ ID NO: 1809784 - DNA, 13 bp, Homo sapiens
cttccaggctctt

SEQ ID NO: 1809785 - DNA, 23 bp, Homo sapiens
cttccaggctcttcctggacctg

SEQ ID NO: 1809786 - DNA, 21 bp, Homo sapiens
cttcccaggtaagcaggagga

SEQ ID NO: 1809787 - DNA, 13 bp, Homo sapiens
cttcccctcctac

SEQ ID NO: 1809788 - DNA, 22 bp, Homo sapiens
cttcccctcctacccctcccag

SEQ ID NO: 1809789 - DNA, 17 bp, Homo sapiens
cttccccttttgcctgg

SEQ ID NO: 1809790 - DNA, 18 bp, Homo sapiens
cttccccttttgcctggc

SEQ ID NO: 1809791 - DNA, 20 bp, Homo sapiens
cttccccttttgcctggctg

SEQ ID NO: 1809792 - DNA, 19 bp, Homo sapiens
cttccctccccacagtcct

SEQ ID NO: 1809793 - DNA, 20 bp, Homo sapiens
cttccctccccacagtcctc

SEQ ID NO: 1809794 - DNA, 13 bp, Homo sapiens
cttccctgggaag

SEQ ID NO: 1809795 - DNA, 15 bp, Homo sapiens
cttccctgggaaggc

SEQ ID NO: 1809796 - DNA, 13 bp, Homo sapiens
cttcctccgtcca

SEQ ID NO: 1809797 - DNA, 18 bp, Homo sapiens
cttcctcctccacagtgc

SEQ ID NO: 1809798 - DNA, 23 bp, Homo sapiens
cttcctcctccacagtgctgctt

SEQ ID NO: 1809799 - DNA, 13 bp, Homo sapiens
cttcctcctgatg

SEQ ID NO: 1809800 - DNA, 21 bp, Homo sapiens
cttcctcctgatggccaagag

SEQ ID NO: 1809801 - DNA, 22 bp, Homo sapiens
cttcctcctgatggccaagagc

SEQ ID NO: 1809802 - DNA, 21 bp, Homo sapiens
cttcctctggtaaacattcct

SEQ ID NO: 1809803 - DNA, 23 bp, Homo sapiens
cttcctgagggctaattctggga

SEQ ID NO: 1809804 - DNA, 12 bp, Homo sapiens
cttcctgctgct

SEQ ID NO: 1809805 - DNA, 14 bp, Homo sapiens
cttcctgctgctgt

SEQ ID NO: 1809806 - DNA, 15 bp, Homo sapiens
cttcctgctgctgta

SEQ ID NO: 1809807 - DNA, 22 bp, Homo sapiens
cttcctgctgctgtaactgctg

SEQ ID NO: 1809808 - DNA, 23 bp, Homo sapiens
cttcctgcttaaacttgacccag

SEQ ID NO: 1809809 - DNA, 13 bp, Homo sapiens
cttcctggacctg

SEQ ID NO: 1809810 - DNA, 15 bp, Homo sapiens
cttcctggacctgag

SEQ ID NO: 1809811 - DNA, 17 bp, Homo sapiens
cttcctggacctgagtc

SEQ ID NO: 1809812 - DNA, 18 bp, Homo sapiens
cttcctggacctgagtcg

SEQ ID NO: 1809813 - DNA, 19 bp, Homo sapiens
cttcctggcctcactggct

SEQ ID NO: 1809814 - DNA, 21 bp, Homo sapiens
cttcctggcctcactggctgg

SEQ ID NO: 1809815 - DNA, 17 bp, Homo sapiens
cttcctggggccccgct

SEQ ID NO: 1809816 - DNA, 23 bp, Homo sapiens
cttcctgtccactctcggggccc

SEQ ID NO: 1809817 - DNA, 17 bp, Homo sapiens
cttcgcaaactgatgga

SEQ ID NO: 1809818 - DNA, 18 bp, Homo sapiens
cttctaaatgcccagttc

SEQ ID NO: 1809819 - DNA, 20 bp, Homo sapiens
cttctaatccatgtgctgct

SEQ ID NO: 1809820 - DNA, 17 bp, Homo sapiens
cttctacctcttggctg

SEQ ID NO: 1809821 - DNA, 22 bp, Homo sapiens
cttctaggagtcaactggctgg

SEQ ID NO: 1809822 - DNA, 14 bp, Homo sapiens
cttctgctgggctg

SEQ ID NO: 1809823 - DNA, 23 bp, Homo sapiens
cttcttattcatgctttctcctt

SEQ ID NO: 1809824 - DNA, 18 bp, Homo sapiens
cttgaaaacttgctgaaa

SEQ ID NO: 1809825 - DNA, 22 bp, Homo sapiens
cttgaaagcagttaaactgatt

SEQ ID NO: 1809826 - DNA, 21 bp, Homo sapiens
cttgagagaaaagaaaaatat

SEQ ID NO: 1809827 - DNA, 14 bp, Homo sapiens
cttgagcccaggag

SEQ ID NO: 1809828 - DNA, 14 bp, Homo sapiens
cttgaggacacatg

SEQ ID NO: 1809829 - DNA, 13 bp, Homo sapiens
cttgccccaaccc

SEQ ID NO: 1809830 - DNA, 19 bp, Homo sapiens
cttgccccaacccccagca

SEQ ID NO: 1809831 - DNA, 14 bp, Homo sapiens
cttgcccccatccc

SEQ ID NO: 1809832 - DNA, 15 bp, Homo sapiens
cttgcccccatccct

SEQ ID NO: 1809833 - DNA, 17 bp, Homo sapiens
cttgcctcggctcctgc

SEQ ID NO: 1809834 - DNA, 21 bp, Homo sapiens
cttgcctcggctcctgctgca

SEQ ID NO: 1809835 - DNA, 17 bp, Homo sapiens
cttgccttttaaaagaa

SEQ ID NO: 1809836 - DNA, 14 bp, Homo sapiens
cttgcgtcctgcag

SEQ ID NO: 1809837 - DNA, 20 bp, Homo sapiens
cttgctccagggtcttgggc

SEQ ID NO: 1809838 - DNA, 15 bp, Homo sapiens
cttgctgaaaaacac

SEQ ID NO: 1809839 - DNA, 15 bp, Homo sapiens
cttgctttgggcttt

SEQ ID NO: 1809840 - DNA, 13 bp, Homo sapiens
cttggacttcctg

SEQ ID NO: 1809841 - DNA, 14 bp, Homo sapiens
cttggacttcctgg

SEQ ID NO: 1809842 - DNA, 18 bp, Homo sapiens
cttggcacccccatgctg

SEQ ID NO: 1809843 - DNA, 19 bp, Homo sapiens
cttgggcatccacccagtg

SEQ ID NO: 1809844 - DNA, 19 bp, Homo sapiens
cttgggctactggcagctc

SEQ ID NO: 1809845 - DNA, 14 bp, Homo sapiens
cttgggctcctggc

SEQ ID NO: 1809846 - DNA, 16 bp, Homo sapiens
cttgggctcctggctg

SEQ ID NO: 1809847 - DNA, 23 bp, Homo sapiens
cttgggctcctggctgccaggcg

SEQ ID NO: 1809848 - DNA, 17 bp, Homo sapiens
cttggggcctggcttgc

SEQ ID NO: 1809849 - DNA, 23 bp, Homo sapiens
cttggggcctggcttgctccagg

SEQ ID NO: 1809850 - DNA, 23 bp, Homo sapiens
cttgggtcctgcaatctccaggg

SEQ ID NO: 1809851 - DNA, 17 bp, Homo sapiens
cttggtccctggtccct

SEQ ID NO: 1809852 - DNA, 13 bp, Homo sapiens
cttggttccattg

SEQ ID NO: 1809853 - DNA, 15 bp, Homo sapiens
cttgtcctgccagct

SEQ ID NO: 1809854 - DNA, 17 bp, Homo sapiens
cttgtcctgccagctgc

SEQ ID NO: 1809855 - DNA, 18 bp, Homo sapiens
cttgtcctgccagctgcc

SEQ ID NO: 1809856 - DNA, 20 bp, Homo sapiens
cttgtcctgccagctgcctt

SEQ ID NO: 1809857 - DNA, 15 bp, Homo sapiens
cttgtctgaggcctc

SEQ ID NO: 1809858 - DNA, 16 bp, Homo sapiens
cttgtctgaggcctca

SEQ ID NO: 1809859 - DNA, 14 bp, Homo sapiens
cttgtgccctgccc

SEQ ID NO: 1809860 - DNA, 17 bp, Homo sapiens
cttgtgccctgccccca

SEQ ID NO: 1809861 - DNA, 21 bp, Homo sapiens
cttgtgccctgcccccatctc

SEQ ID NO: 1809862 - DNA, 23 bp, Homo sapiens
cttgtgctcacgctcccccgcag

SEQ ID NO: 1809863 - DNA, 18 bp, Homo sapiens
cttgtgcttggtggggct

SEQ ID NO: 1809864 - DNA, 24 bp, Homo sapiens
cttgtgcttggtggggctcgtggc

SEQ ID NO: 1809865 - DNA, 21 bp, Homo sapiens
cttgttattatctactagtaa

SEQ ID NO: 1809866 - DNA, 17 bp, Homo sapiens
ctttactcccttcctgg

SEQ ID NO: 1809867 - DNA, 15 bp, Homo sapiens
ctttcaatatcatta

SEQ ID NO: 1809868 - DNA, 12 bp, Homo sapiens
ctttgcaccatg

SEQ ID NO: 1809869 - DNA, 20 bp, Homo sapiens
ctttgcaggctctgggctca

SEQ ID NO: 1809870 - DNA, 23 bp, Homo sapiens
ctttgcaggctctgggctcaggg

SEQ ID NO: 1809871 - DNA, 17 bp, Homo sapiens
ctttgccaaggctctcc

SEQ ID NO: 1809872 - DNA, 15 bp, Homo sapiens
ctttgggaggccaag

SEQ ID NO: 1809873 - DNA, 17 bp, Homo sapiens
ctttgggaggccaaggc

SEQ ID NO: 1809874 - DNA, 23 bp, Homo sapiens
ctttgggaggccaaggcaggtag

SEQ ID NO: 1809875 - DNA, 21 bp, Homo sapiens
ctttgggctttgcaggctctg

SEQ ID NO: 1809876 - DNA, 22 bp, Homo sapiens
ctttggggacagttggcagaga

SEQ ID NO: 1809877 - DNA, 22 bp, Homo sapiens
ctttggggtcctagcccagtgc

SEQ ID NO: 1809878 - DNA, 23 bp, Homo sapiens
ctttggggtcctagcccagtgct

SEQ ID NO: 1809879 - DNA, 15 bp, Homo sapiens
ctttgttcatcattg

SEQ ID NO: 1809880 - DNA, 19 bp, Homo sapiens
cttttaaaactatatttat

SEQ ID NO: 1809881 - DNA, 14 bp, Homo sapiens
cttttaaaagaaaa

SEQ ID NO: 1809882 - DNA, 20 bp, Homo sapiens
cttttacccctgcacagttt

SEQ ID NO: 1809883 - DNA, 16 bp, Homo sapiens
cttttataaacctcta

SEQ ID NO: 1809884 - DNA, 17 bp, Homo sapiens
cttttcagcttctgctg

SEQ ID NO: 1809885 - DNA, 18 bp, Homo sapiens
ctgcaggaacgagcactg

SEQ ID NO: 1809886 - DNA, 24 bp, Homo sapiens
ctgcaggaacgagcactggccaga

SEQ ID NO: 1809887 - DNA, 16 bp, Homo sapiens
ctgcaggtacttcctc

SEQ ID NO: 1809888 - DNA, 20 bp, Homo sapiens
ctgcaggtacttcctcctga

SEQ ID NO: 1809889 - DNA, 23 bp, Homo sapiens
ctgcaggtacttcctcctgatgg

SEQ ID NO: 1809890 - DNA, 15 bp, Homo sapiens
ctgcaggttgggcca

SEQ ID NO: 1809891 - DNA, 12 bp, Homo sapiens
ctgccaaaacaa

SEQ ID NO: 1809892 - DNA, 19 bp, Homo sapiens
ctgccaccacgtctgccag

SEQ ID NO: 1809893 - DNA, 21 bp, Homo sapiens
ctgccaccacgtctgccaggc

SEQ ID NO: 1809894 - DNA, 12 bp, Homo sapiens
ctgccacctgtc

SEQ ID NO: 1809895 - DNA, 17 bp, Homo sapiens
ctgccacctgtctgtct

SEQ ID NO: 1809896 - DNA, 22 bp, Homo sapiens
ctgccagactgaaccagagctg

SEQ ID NO: 1809897 - DNA, 12 bp, Homo sapiens
ctgccagctgcc

SEQ ID NO: 1809898 - DNA, 13 bp, Homo sapiens
ctgccagctgcct

SEQ ID NO: 1809899 - DNA, 17 bp, Homo sapiens
ctgccaggcacctggcc

SEQ ID NO: 1809900 - DNA, 22 bp, Homo sapiens
ctgccaggcacctggcctgctg

SEQ ID NO: 1809901 - DNA, 12 bp, Homo sapiens
ctgccaggccca

SEQ ID NO: 1809902 - DNA, 22 bp, Homo sapiens
ctgccaggcgttggtgccactt

SEQ ID NO: 1809903 - DNA, 23 bp, Homo sapiens
ctgccaggcgttggtgccacttc

SEQ ID NO: 1809904 - DNA, 19 bp, Homo sapiens
ctgccagtgaagtccttca

SEQ ID NO: 1809905 - DNA, 20 bp, Homo sapiens
ctgccagtgaagtccttcag

SEQ ID NO: 1809906 - DNA, 22 bp, Homo sapiens
ctgccatcatgtttacagagga

SEQ ID NO: 1809907 - DNA, 14 bp, Homo sapiens
ctgccatgccactg

SEQ ID NO: 1809908 - DNA, 22 bp, Homo sapiens
ctgccatgccactgccaggcac

SEQ ID NO: 1809909 - DNA, 16 bp, Homo sapiens
ctgcccaatgctttgg

SEQ ID NO: 1809910 - DNA, 19 bp, Homo sapiens
ctgcccacttagccgtcca

SEQ ID NO: 1809911 - DNA, 12 bp, Homo sapiens
ctgccccaagca

SEQ ID NO: 1809912 - DNA, 16 bp, Homo sapiens
ctgccccaagcagcca

SEQ ID NO: 1809913 - DNA, 22 bp, Homo sapiens
ctgccccaagcagccagccagt

SEQ ID NO: 1809914 - DNA, 23 bp, Homo sapiens
ctgccccaagcccccaaccccgc

SEQ ID NO: 1809915 - DNA, 15 bp, Homo sapiens
ctgcccccagaaagc

SEQ ID NO: 1809916 - DNA, 18 bp, Homo sapiens
ctgcccccatctccccag

SEQ ID NO: 1809917 - DNA, 13 bp, Homo sapiens
ctgccccctgcca

SEQ ID NO: 1809918 - DNA, 22 bp, Homo sapiens
ctgccccgtcggactgccccca

SEQ ID NO: 1809919 - DNA, 15 bp, Homo sapiens
ctgccccgttccctg

SEQ ID NO: 1809920 - DNA, 21 bp, Homo sapiens
ctgccccgttccctgtcagag

SEQ ID NO: 1809921 - DNA, 18 bp, Homo sapiens
ctgcccctgtctggaaga

SEQ ID NO: 1809922 - DNA, 18 bp, Homo sapiens
ctgccccttgggcatcca

SEQ ID NO: 1809923 - DNA, 19 bp, Homo sapiens
ctgccccttgggcatccac

SEQ ID NO: 1809924 - DNA, 16 bp, Homo sapiens
ctgcccgctcccagtg

SEQ ID NO: 1809925 - DNA, 16 bp, Homo sapiens
ctgcccggcgccctct

SEQ ID NO: 1809926 - DNA, 20 bp, Homo sapiens
ctgcccggcgccctctgtcc

SEQ ID NO: 1809927 - DNA, 23 bp, Homo sapiens
ctgcccggcgccctctgtcctga

SEQ ID NO: 1809928 - DNA, 11 bp, Homo sapiens
ctgccctgcca

SEQ ID NO: 1809929 - DNA, 18 bp, Homo sapiens
ctgccctgccacctgtct

SEQ ID NO: 1809930 - DNA, 13 bp, Homo sapiens
ctgccctgcctgc

SEQ ID NO: 1809931 - DNA, 16 bp, Homo sapiens
ctgccctgcctgccca

SEQ ID NO: 1809932 - DNA, 18 bp, Homo sapiens
ctgccctgcctgcccact

SEQ ID NO: 1809933 - DNA, 15 bp, Homo sapiens
ctgccgcccaaagag

SEQ ID NO: 1809934 - DNA, 14 bp, Homo sapiens
ctgcctaataaaga

SEQ ID NO: 1809935 - DNA, 15 bp, Homo sapiens
ctgcctaataaagag

SEQ ID NO: 1809936 - DNA, 16 bp, Homo sapiens
ctgcctaataaagaga

SEQ ID NO: 1809937 - DNA, 18 bp, Homo sapiens
ctgcctaataaagagact

SEQ ID NO: 1809938 - DNA, 15 bp, Homo sapiens
ctgcctatccatcct

SEQ ID NO: 1809939 - DNA, 16 bp, Homo sapiens
ctgcctatccatcctg

SEQ ID NO: 1809940 - DNA, 15 bp, Homo sapiens
ctgcctccactccca

SEQ ID NO: 1809941 - DNA, 16 bp, Homo sapiens
ctgcctccactcccac

SEQ ID NO: 1809942 - DNA, 18 bp, Homo sapiens
ctgcctccactcccactt

SEQ ID NO: 1809943 - DNA, 11 bp, Homo sapiens
ctgcctggcct

SEQ ID NO: 1809944 - DNA, 13 bp, Homo sapiens
ctgcctggcctgg

SEQ ID NO: 1809945 - DNA, 22 bp, Homo sapiens
ctgcctgggcctgtgcagcagc

SEQ ID NO: 1809946 - DNA, 23 bp, Homo sapiens
ctgcctgggcctgtgcagcagcc

SEQ ID NO: 1809947 - DNA, 20 bp, Homo sapiens
ctgccttacccgccatacat

SEQ ID NO: 1809948 - DNA, 15 bp, Homo sapiens
ctgcggggcttggct

SEQ ID NO: 1809949 - DNA, 16 bp, Homo sapiens
ctgcgggtctgaagga

SEQ ID NO: 1809950 - DNA, 18 bp, Homo sapiens
ctgcgtaggagagaacag

SEQ ID NO: 1809951 - DNA, 15 bp, Homo sapiens
ctgcgttggagccac

SEQ ID NO: 1809952 - DNA, 19 bp, Homo sapiens
ctgcgttggagccactcct

SEQ ID NO: 1809953 - DNA, 21 bp, Homo sapiens
ctgcgttggagccactcctgt

SEQ ID NO: 1809954 - DNA, 17 bp, Homo sapiens
ctgctaccctccctgct

SEQ ID NO: 1809955 - DNA, 20 bp, Homo sapiens
ctgctaccctccctgctgtc

SEQ ID NO: 1809956 - DNA, 15 bp, Homo sapiens
ctgctagagcaaccc

SEQ ID NO: 1809957 - DNA, 16 bp, Homo sapiens
ctgctagagcaacccc

SEQ ID NO: 1809958 - DNA, 13 bp, Homo sapiens
ctgctccacagtg

SEQ ID NO: 1809959 - DNA, 12 bp, Homo sapiens
ctgctccttggc

SEQ ID NO: 1809960 - DNA, 23 bp, Homo sapiens
ctgctccttggcacccccatgct

SEQ ID NO: 1809961 - DNA, 19 bp, Homo sapiens
ctgctcgggcccaggccat

SEQ ID NO: 1809962 - DNA, 13 bp, Homo sapiens
ctgctctagccag

SEQ ID NO: 1809963 - DNA, 16 bp, Homo sapiens
ctgctctagccaggag

SEQ ID NO: 1809964 - DNA, 14 bp, Homo sapiens
ctgctctagctggc

SEQ ID NO: 1809965 - DNA, 20 bp, Homo sapiens
ctgctctagctggcaggaca

SEQ ID NO: 1809966 - DNA, 13 bp, Homo sapiens
ctgctctgcccct

SEQ ID NO: 1809967 - DNA, 14 bp, Homo sapiens
ctgctctgcccctt

SEQ ID NO: 1809968 - DNA, 23 bp, Homo sapiens
ctgctctgccccttgggcatcca

SEQ ID NO: 1809969 - DNA, 15 bp, Homo sapiens
ctgctgaaaaagaaa

SEQ ID NO: 1809970 - DNA, 16 bp, Homo sapiens
ctgctgaaaaagaaaa

SEQ ID NO: 1809971 - DNA, 17 bp, Homo sapiens
ctgctgaaaaagaaaaa

SEQ ID NO: 1809972 - DNA, 22 bp, Homo sapiens
ctgctgaaaaagaaaaaaatga

SEQ ID NO: 1809973 - DNA, 17 bp, Homo sapiens
ctgctgagccactcgca

SEQ ID NO: 1809974 - DNA, 15 bp, Homo sapiens
ctgctgcaccaaccc

SEQ ID NO: 1809975 - DNA, 17 bp, Homo sapiens
ctgctgcaccaacccag

SEQ ID NO: 1809976 - DNA, 14 bp, Homo sapiens
ctgctgcctaataa

SEQ ID NO: 1809977 - DNA, 10 bp, Homo sapiens
ctgctgctgt

SEQ ID NO: 1809978 - DNA, 21 bp, Homo sapiens
ctgctgctgtaactgctgagc

SEQ ID NO: 1809979 - DNA, 18 bp, Homo sapiens
ctgctgggaaccccgcag

SEQ ID NO: 1809980 - DNA, 19 bp, Homo sapiens
ctgctgggaaccccgcagc

SEQ ID NO: 1809981 - DNA, 12 bp, Homo sapiens
ctgctgggctgg

SEQ ID NO: 1809982 - DNA, 14 bp, Homo sapiens
ctgctgggctgggg

SEQ ID NO: 1809983 - DNA, 18 bp, Homo sapiens
ctgctgggctggggcctg

SEQ ID NO: 1809984 - DNA, 19 bp, Homo sapiens
ctgctgggctggggcctga

SEQ ID NO: 1809985 - DNA, 21 bp, Homo sapiens
ctgctgggctggggcctgatg

SEQ ID NO: 1809986 - DNA, 14 bp, Homo sapiens
ctgctggggcatgt

SEQ ID NO: 1809987 - DNA, 15 bp, Homo sapiens
ctgctggggcatgtg

SEQ ID NO: 1809988 - DNA, 19 bp, Homo sapiens
ctgctggggcatgtgtgcc

SEQ ID NO: 1809989 - DNA, 23 bp, Homo sapiens
ctgctggggcatgtgtgcctgtg

SEQ ID NO: 1809990 - DNA, 18 bp, Homo sapiens
ctgctggggctgcaagct

SEQ ID NO: 1809991 - DNA, 16 bp, Homo sapiens
ctgctgtaactgctga

SEQ ID NO: 1809992 - DNA, 20 bp, Homo sapiens
ctgctgtaactgctgagcca

SEQ ID NO: 1809993 - DNA, 22 bp, Homo sapiens
ctgctgtaactgctgagccact

SEQ ID NO: 1809994 - DNA, 13 bp, Homo sapiens
ctgctgtcccctc

SEQ ID NO: 1809995 - DNA, 13 bp, Homo sapiens
ctgcttttccagg

SEQ ID NO: 1809996 - DNA, 13 bp, Homo sapiens
ctggaaccaggga

SEQ ID NO: 1809997 - DNA, 14 bp, Homo sapiens
ctggaaccagggag

SEQ ID NO: 1809998 - DNA, 20 bp, Homo sapiens
ctggaaccagggaggagagg

SEQ ID NO: 1809999 - DNA, 21 bp, Homo sapiens
ctggaagacgtggctctgggt

SEQ ID NO: 1810000 - DNA, 12 bp, Homo sapiens
ctggaaggcagg

SEQ ID NO: 1810001 - DNA, 13 bp, Homo sapiens
ctggaaggcaggg

SEQ ID NO: 1810002 - DNA, 11 bp, Homo sapiens
cctcccagctg

SEQ ID NO: 1810003 - DNA, 19 bp, Homo sapiens
cctcccagctgacagtcct

SEQ ID NO: 1810004 - DNA, 13 bp, Homo sapiens
cctccccagccag

SEQ ID NO: 1810005 - DNA, 14 bp, Homo sapiens
cctcccctcccctg

SEQ ID NO: 1810006 - DNA, 14 bp, Homo sapiens
cctcccctggggac

SEQ ID NO: 1810007 - DNA, 11 bp, Homo sapiens
cctcccgcccc

SEQ ID NO: 1810008 - DNA, 20 bp, Homo sapiens
cctcccgtctactcattccc

SEQ ID NO: 1810009 - DNA, 15 bp, Homo sapiens
cctccctctgcccca

SEQ ID NO: 1810010 - DNA, 16 bp, Homo sapiens
cctccctgcctgctcc

SEQ ID NO: 1810011 - DNA, 17 bp, Homo sapiens
cctccctgcctgctcct

SEQ ID NO: 1810012 - DNA, 16 bp, Homo sapiens
cctccctgtctccagg

SEQ ID NO: 1810013 - DNA, 18 bp, Homo sapiens
cctccctgtctccagggc

SEQ ID NO: 1810014 - DNA, 17 bp, Homo sapiens
cctccgtccacccaggc

SEQ ID NO: 1810015 - DNA, 18 bp, Homo sapiens
cctccgtccacccaggct

SEQ ID NO: 1810016 - DNA, 20 bp, Homo sapiens
cctccgtccacccaggctgc

SEQ ID NO: 1810017 - DNA, 21 bp, Homo sapiens
cctccgtttatgggccttgct

SEQ ID NO: 1810018 - DNA, 20 bp, Homo sapiens
cctcctacccctcccagctg

SEQ ID NO: 1810019 - DNA, 13 bp, Homo sapiens
cctcctaccctcc

SEQ ID NO: 1810020 - DNA, 23 bp, Homo sapiens
cctcctaccctcccaccagaacg

SEQ ID NO: 1810021 - DNA, 17 bp, Homo sapiens
cctcctccacagtgctg

SEQ ID NO: 1810022 - DNA, 18 bp, Homo sapiens
cctcctccacagtgctgc

SEQ ID NO: 1810023 - DNA, 14 bp, Homo sapiens
cctcctgccccctg

SEQ ID NO: 1810024 - DNA, 18 bp, Homo sapiens
cctcctgccccctgccag

SEQ ID NO: 1810025 - DNA, 12 bp, Homo sapiens
cctcctgctgca

SEQ ID NO: 1810026 - DNA, 20 bp, Homo sapiens
cctcctgctgcagaggggca

SEQ ID NO: 1810027 - DNA, 21 bp, Homo sapiens
cctcctgctgcagaggggcag

SEQ ID NO: 1810028 - DNA, 23 bp, Homo sapiens
cctcctgctgcctaataaagaga

SEQ ID NO: 1810029 - DNA, 15 bp, Homo sapiens
cctcgaggcaccggc

SEQ ID NO: 1810030 - DNA, 22 bp, Homo sapiens
cctcgaggcaccggcgctgcag

SEQ ID NO: 1810031 - DNA, 12 bp, Homo sapiens
cctcgcccaccg

SEQ ID NO: 1810032 - DNA, 14 bp, Homo sapiens
cctcgcctggcctg

SEQ ID NO: 1810033 - DNA, 16 bp, Homo sapiens
cctcgcctggcctgag

SEQ ID NO: 1810034 - DNA, 13 bp, Homo sapiens
cctcggctcctgc

SEQ ID NO: 1810035 - DNA, 19 bp, Homo sapiens
cctcggctcctgctgcacc

SEQ ID NO: 1810036 - DNA, 22 bp, Homo sapiens
cctcggctcctgctgcaccaac

SEQ ID NO: 1810037 - DNA, 14 bp, Homo sapiens
cctcgtcctgtccc

SEQ ID NO: 1810038 - DNA, 16 bp, Homo sapiens
cctcgtcctgtcccag

SEQ ID NO: 1810039 - DNA, 15 bp, Homo sapiens
cctcgtggacacctg

SEQ ID NO: 1810040 - DNA, 16 bp, Homo sapiens
cctcgtggacacctgc

SEQ ID NO: 1810041 - DNA, 18 bp, Homo sapiens
cctctcaatattcaataa

SEQ ID NO: 1810042 - DNA, 22 bp, Homo sapiens
cctctcaatattcaataaagct

SEQ ID NO: 1810043 - DNA, 20 bp, Homo sapiens
cctctccttgggctcctggc

SEQ ID NO: 1810044 - DNA, 23 bp, Homo sapiens
cctctccttgggctcctggctgc

SEQ ID NO: 1810045 - DNA, 16 bp, Homo sapiens
cctctcgccccatccc

SEQ ID NO: 1810046 - DNA, 20 bp, Homo sapiens
cctctcgccccatccctgct

SEQ ID NO: 1810047 - DNA, 21 bp, Homo sapiens
cctctcgccccatccctgctt

SEQ ID NO: 1810048 - DNA, 15 bp, Homo sapiens
cctctgccccaagca

SEQ ID NO: 1810049 - DNA, 16 bp, Homo sapiens
cctctgtcctgacttc

SEQ ID NO: 1810050 - DNA, 22 bp, Homo sapiens
cctctgtcctgacttcaggggc

SEQ ID NO: 1810051 - DNA, 14 bp, Homo sapiens
cctctgtgtcactg

SEQ ID NO: 1810052 - DNA, 19 bp, Homo sapiens
cctctgtgtcactggctgc

SEQ ID NO: 1810053 - DNA, 23 bp, Homo sapiens
cctctgtgtcactggctgcctcc

SEQ ID NO: 1810054 - DNA, 17 bp, Homo sapiens
cctcttaccgtagcctc

SEQ ID NO: 1810055 - DNA, 15 bp, Homo sapiens
cctcttccacccatt

SEQ ID NO: 1810056 - DNA, 15 bp, Homo sapiens
cctcttgcaggctga

SEQ ID NO: 1810057 - DNA, 22 bp, Homo sapiens
cctcttgccccaacccccagca

SEQ ID NO: 1810058 - DNA, 19 bp, Homo sapiens
cctctttactcccttcctg

SEQ ID NO: 1810059 - DNA, 23 bp, Homo sapiens
cctctttactcccttcctggcct

SEQ ID NO: 1810060 - DNA, 18 bp, Homo sapiens
cctgaaccccatgggctt

SEQ ID NO: 1810061 - DNA, 20 bp, Homo sapiens
cctgaaccccatgggcttgg

SEQ ID NO: 1810062 - DNA, 14 bp, Homo sapiens
cctgacaatggcag

SEQ ID NO: 1810063 - DNA, 17 bp, Homo sapiens
cctgacaatggcagcta

SEQ ID NO: 1810064 - DNA, 22 bp, Homo sapiens
cctgacactgcggggcttggct

SEQ ID NO: 1810065 - DNA, 23 bp, Homo sapiens
cctgacttcaggggctgcccgct

SEQ ID NO: 1810066 - DNA, 13 bp, Homo sapiens
cctgagactccag

SEQ ID NO: 1810067 - DNA, 19 bp, Homo sapiens
cctgaggaagagggactgt

SEQ ID NO: 1810068 - DNA, 20 bp, Homo sapiens
cctgagggctaattctggga

SEQ ID NO: 1810069 - DNA, 16 bp, Homo sapiens
cctgaggtctcgctga

SEQ ID NO: 1810070 - DNA, 18 bp, Homo sapiens
cctgagtcggccccacat

SEQ ID NO: 1810071 - DNA, 21 bp, Homo sapiens
cctgagtcggccccacatggg

SEQ ID NO: 1810072 - DNA, 15 bp, Homo sapiens
cctgatgctgccccg

SEQ ID NO: 1810073 - DNA, 16 bp, Homo sapiens
ctctgtgcccatgggc

SEQ ID NO: 1810074 - DNA, 15 bp, Homo sapiens
ctctgtggcctgtgt

SEQ ID NO: 1810075 - DNA, 23 bp, Homo sapiens
ctctgtggcctgtgtccagcagc

SEQ ID NO: 1810076 - DNA, 13 bp, Homo sapiens
ctctgtgggctgc

SEQ ID NO: 1810077 - DNA, 16 bp, Homo sapiens
ctctgtgtcactggct

SEQ ID NO: 1810078 - DNA, 17 bp, Homo sapiens
ctctgtgtcactggctg

SEQ ID NO: 1810079 - DNA, 16 bp, Homo sapiens
ctcttagtgcccgcct

SEQ ID NO: 1810080 - DNA, 21 bp, Homo sapiens
ctcttagtgcccgcctaggag

SEQ ID NO: 1810081 - DNA, 19 bp, Homo sapiens
ctcttcctggacctgagtc

SEQ ID NO: 1810082 - DNA, 11 bp, Homo sapiens
ctcttctgaag

SEQ ID NO: 1810083 - DNA, 20 bp, Homo sapiens
ctcttctgaagctagaaaca

SEQ ID NO: 1810084 - DNA, 17 bp, Homo sapiens
ctcttgcaggctgagtc

SEQ ID NO: 1810085 - DNA, 22 bp, Homo sapiens
ctcttgccccaacccccagcac

SEQ ID NO: 1810086 - DNA, 23 bp, Homo sapiens
ctctttactcccttcctggcctc

SEQ ID NO: 1810087 - DNA, 13 bp, Homo sapiens
ctgaaaaacacaa

SEQ ID NO: 1810088 - DNA, 20 bp, Homo sapiens
ctgaaaacatttcaaagctg

SEQ ID NO: 1810089 - DNA, 21 bp, Homo sapiens
ctgaaaagcaattgccctgta

SEQ ID NO: 1810090 - DNA, 20 bp, Homo sapiens
ctgaaacattccgaagaggg

SEQ ID NO: 1810091 - DNA, 16 bp, Homo sapiens
ctgaaagcagcagcta

SEQ ID NO: 1810092 - DNA, 14 bp, Homo sapiens
ctgaacaatgaatg

SEQ ID NO: 1810093 - DNA, 23 bp, Homo sapiens
ctgaaccagagctggaacacaat

SEQ ID NO: 1810094 - DNA, 18 bp, Homo sapiens
ctgaaccccatgggcttg

SEQ ID NO: 1810095 - DNA, 20 bp, Homo sapiens
ctgaacccttgtgcttggtg

SEQ ID NO: 1810096 - DNA, 13 bp, Homo sapiens
ctgaagctagaaa

SEQ ID NO: 1810097 - DNA, 16 bp, Homo sapiens
ctgaaggaatagccag

SEQ ID NO: 1810098 - DNA, 18 bp, Homo sapiens
ctgaaggaatagccagag

SEQ ID NO: 1810099 - DNA, 19 bp, Homo sapiens
ctgaaggaatagccagaga

SEQ ID NO: 1810100 - DNA, 22 bp, Homo sapiens
ctgaaggggcacaccactgccc

SEQ ID NO: 1810101 - DNA, 23 bp, Homo sapiens
ctgaattcctttacaactaaata

SEQ ID NO: 1810102 - DNA, 18 bp, Homo sapiens
ctgacaatggcagctaga

SEQ ID NO: 1810103 - DNA, 22 bp, Homo sapiens
ctgacaatggcagctagactgg

SEQ ID NO: 1810104 - DNA, 15 bp, Homo sapiens
ctgacacctaccatg

SEQ ID NO: 1810105 - DNA, 20 bp, Homo sapiens
ctgacacctaccatgctgct

SEQ ID NO: 1810106 - DNA, 13 bp, Homo sapiens
ctgacactgcggg

SEQ ID NO: 1810107 - DNA, 16 bp, Homo sapiens
ctgaccccctcccctg

SEQ ID NO: 1810108 - DNA, 13 bp, Homo sapiens
ctgacgccctgcg

SEQ ID NO: 1810109 - DNA, 14 bp, Homo sapiens
ctgacgccctgcgt

SEQ ID NO: 1810110 - DNA, 23 bp, Homo sapiens
ctgactcagtgtctgcctttaaa

SEQ ID NO: 1810111 - DNA, 13 bp, Homo sapiens
ctgactccagagt

SEQ ID NO: 1810112 - DNA, 15 bp, Homo sapiens
ctgactccagagtct

SEQ ID NO: 1810113 - DNA, 22 bp, Homo sapiens
ctgacttcaggggctgcccgct

SEQ ID NO: 1810114 - DNA, 18 bp, Homo sapiens
ctgagaaggcgaggagag

SEQ ID NO: 1810115 - DNA, 16 bp, Homo sapiens
ctgagcattcaggcag

SEQ ID NO: 1810116 - DNA, 17 bp, Homo sapiens
ctgagccactcgcagtc

SEQ ID NO: 1810117 - DNA, 13 bp, Homo sapiens
ctgagcccaggcc

SEQ ID NO: 1810118 - DNA, 15 bp, Homo sapiens
ctgagcccaggccgt

SEQ ID NO: 1810119 - DNA, 19 bp, Homo sapiens
ctgagcccaggccgttccc

SEQ ID NO: 1810120 - DNA, 16 bp, Homo sapiens
ctgagcccccggctag

SEQ ID NO: 1810121 - DNA, 16 bp, Homo sapiens
ctgagctggggccaca

SEQ ID NO: 1810122 - DNA, 21 bp, Homo sapiens
ctgagcttagccttgtgccct

SEQ ID NO: 1810123 - DNA, 16 bp, Homo sapiens
ctgagctttggggaca

SEQ ID NO: 1810124 - DNA, 15 bp, Homo sapiens
ctgaggactggagac

SEQ ID NO: 1810125 - DNA, 22 bp, Homo sapiens
ctgaggagtattaagaatgcag

SEQ ID NO: 1810126 - DNA, 19 bp, Homo sapiens
ctgagtccctccatgcaaa

SEQ ID NO: 1810127 - DNA, 18 bp, Homo sapiens
ctgagtggaatgcaggga

SEQ ID NO: 1810128 - DNA, 12 bp, Homo sapiens
ctgagtgtggga

SEQ ID NO: 1810129 - DNA, 18 bp, Homo sapiens
ctgagttacttgtctgag

SEQ ID NO: 1810130 - DNA, 21 bp, Homo sapiens
ctgagttacttgtctgaggcc

SEQ ID NO: 1810131 - DNA, 15 bp, Homo sapiens
ctgataagctgttct

SEQ ID NO: 1810132 - DNA, 15 bp, Homo sapiens
ctgatactattcaat

SEQ ID NO: 1810133 - DNA, 18 bp, Homo sapiens
ctgatactattcaatgca

SEQ ID NO: 1810134 - DNA, 19 bp, Homo sapiens
ctgatactattcaatgcaa

SEQ ID NO: 1810135 - DNA, 14 bp, Homo sapiens
ctgatgaaaatgaa

SEQ ID NO: 1810136 - DNA, 11 bp, Homo sapiens
ctgatgctgcc

SEQ ID NO: 1810137 - DNA, 13 bp, Homo sapiens
ctgatgctgggct

SEQ ID NO: 1810138 - DNA, 16 bp, Homo sapiens
ctgatgctgggctggg

SEQ ID NO: 1810139 - DNA, 15 bp, Homo sapiens
ccaccctgggctctg

SEQ ID NO: 1810140 - DNA, 18 bp, Homo sapiens
ccaccgcatgccccctcg

SEQ ID NO: 1810141 - DNA, 13 bp, Homo sapiens
ccaccgccatggc

SEQ ID NO: 1810142 - DNA, 18 bp, Homo sapiens
ccaccgccatggcttcca

SEQ ID NO: 1810143 - DNA, 18 bp, Homo sapiens
ccacctagtggctgtcca

SEQ ID NO: 1810144 - DNA, 14 bp, Homo sapiens
ccacctctcaatat

SEQ ID NO: 1810145 - DNA, 18 bp, Homo sapiens
ccacctgacaatggcagc

SEQ ID NO: 1810146 - DNA, 21 bp, Homo sapiens
ccacctgcctatccatcctgc

SEQ ID NO: 1810147 - DNA, 11 bp, Homo sapiens
ccacctgtctg

SEQ ID NO: 1810148 - DNA, 14 bp, Homo sapiens
ccacctgtctgtct

SEQ ID NO: 1810149 - DNA, 18 bp, Homo sapiens
ccacgagtcacctgcaag

SEQ ID NO: 1810150 - DNA, 21 bp, Homo sapiens
ccacgagtcacctgcaagccc

SEQ ID NO: 1810151 - DNA, 15 bp, Homo sapiens
ccacgtcctgtcagt

SEQ ID NO: 1810152 - DNA, 15 bp, Homo sapiens
ccacgtctgccaggc

SEQ ID NO: 1810153 - DNA, 16 bp, Homo sapiens
ccacgtctgccaggcc

SEQ ID NO: 1810154 - DNA, 19 bp, Homo sapiens
ccactaagctttctccttt

SEQ ID NO: 1810155 - DNA, 20 bp, Homo sapiens
ccactagggtcctggccctc

SEQ ID NO: 1810156 - DNA, 22 bp, Homo sapiens
ccactagggtcctggccctctt

SEQ ID NO: 1810157 - DNA, 18 bp, Homo sapiens
ccactatttttattttct

SEQ ID NO: 1810158 - DNA, 21 bp, Homo sapiens
ccactatttttattttcttat

SEQ ID NO: 1810159 - DNA, 17 bp, Homo sapiens
ccactcaccagggtccg

SEQ ID NO: 1810160 - DNA, 11 bp, Homo sapiens
ccactcccact

SEQ ID NO: 1810161 - DNA, 12 bp, Homo sapiens
ccactcccactt

SEQ ID NO: 1810162 - DNA, 17 bp, Homo sapiens
ccactcccccacctgac

SEQ ID NO: 1810163 - DNA, 13 bp, Homo sapiens
ccactccctgagc

SEQ ID NO: 1810164 - DNA, 14 bp, Homo sapiens
ccactcctgtcccg

SEQ ID NO: 1810165 - DNA, 21 bp, Homo sapiens
ccactcctgtcccgccttcct

SEQ ID NO: 1810166 - DNA, 11 bp, Homo sapiens
ccactctcctt

SEQ ID NO: 1810167 - DNA, 13 bp, Homo sapiens
ccactgcaccccc

SEQ ID NO: 1810168 - DNA, 19 bp, Homo sapiens
ccactgcaccccctcctgc

SEQ ID NO: 1810169 - DNA, 13 bp, Homo sapiens
ccactgccaggca

SEQ ID NO: 1810170 - DNA, 17 bp, Homo sapiens
ccactgccaggcacctg

SEQ ID NO: 1810171 - DNA, 21 bp, Homo sapiens
ccactgccaggcacctggcct

SEQ ID NO: 1810172 - DNA, 18 bp, Homo sapiens
ccactgccctgcctgccc

SEQ ID NO: 1810173 - DNA, 14 bp, Homo sapiens
ccactgtggccaga

SEQ ID NO: 1810174 - DNA, 21 bp, Homo sapiens
ccacttagccgtccatggcac

SEQ ID NO: 1810175 - DNA, 14 bp, Homo sapiens
ccacttatttccat

SEQ ID NO: 1810176 - DNA, 23 bp, Homo sapiens
ccacttcccaggtaagcaggagg

SEQ ID NO: 1810177 - DNA, 14 bp, Homo sapiens
ccacttcccctcct

SEQ ID NO: 1810178 - DNA, 19 bp, Homo sapiens
ccacttcccctcctacccc

SEQ ID NO: 1810179 - DNA, 19 bp, Homo sapiens
ccacttcttaaaggcctgg

SEQ ID NO: 1810180 - DNA, 23 bp, Homo sapiens
ccacttcttaaaggcctggaacc

SEQ ID NO: 1810181 - DNA, 15 bp, Homo sapiens
ccactttttccagaa

SEQ ID NO: 1810182 - DNA, 18 bp, Homo sapiens
ccagaacgcaccccactg

SEQ ID NO: 1810183 - DNA, 17 bp, Homo sapiens
ccagaaggagggcagag

SEQ ID NO: 1810184 - DNA, 20 bp, Homo sapiens
ccagaaggagggcagagcca

SEQ ID NO: 1810185 - DNA, 22 bp, Homo sapiens
ccagaaggagggcagagccatg

SEQ ID NO: 1810186 - DNA, 23 bp, Homo sapiens
ccagaaggagggcagagccatgg

SEQ ID NO: 1810187 - DNA, 14 bp, Homo sapiens
ccagagaggagcac

SEQ ID NO: 1810188 - DNA, 19 bp, Homo sapiens
ccagagaggagcacctgaa

SEQ ID NO: 1810189 - DNA, 15 bp, Homo sapiens
ccagagagggcccag

SEQ ID NO: 1810190 - DNA, 18 bp, Homo sapiens
ccagagagggcccagctg

SEQ ID NO: 1810191 - DNA, 19 bp, Homo sapiens
ccagagagggcccagctgt

SEQ ID NO: 1810192 - DNA, 13 bp, Homo sapiens
ccagagccactac

SEQ ID NO: 1810193 - DNA, 12 bp, Homo sapiens
ccagagccagcc

SEQ ID NO: 1810194 - DNA, 14 bp, Homo sapiens
ccagagccagcctg

SEQ ID NO: 1810195 - DNA, 17 bp, Homo sapiens
ccagagccagcctggga

SEQ ID NO: 1810196 - DNA, 18 bp, Homo sapiens
ccagaggttatctgcctg

SEQ ID NO: 1810197 - DNA, 14 bp, Homo sapiens
ccagagtctgagcc

SEQ ID NO: 1810198 - DNA, 18 bp, Homo sapiens
ccagagtctgagcccccg

SEQ ID NO: 1810199 - DNA, 15 bp, Homo sapiens
ccagatcgctgtgtt

SEQ ID NO: 1810200 - DNA, 16 bp, Homo sapiens
ccagatctgcctgggc

SEQ ID NO: 1810201 - DNA, 17 bp, Homo sapiens
ccagatctgcctgggcc

SEQ ID NO: 1810202 - DNA, 19 bp, Homo sapiens
ccagatctgcctgggcctg

SEQ ID NO: 1810203 - DNA, 21 bp, Homo sapiens
ccagatctgcctgggcctgtg

SEQ ID NO: 1810204 - DNA, 13 bp, Homo sapiens
ccagcacaggggc

SEQ ID NO: 1810205 - DNA, 17 bp, Homo sapiens
ccagcacaggggcccca

SEQ ID NO: 1810206 - DNA, 22 bp, Homo sapiens
ccagcacaggggccccagatct

SEQ ID NO: 1810207 - DNA, 16 bp, Homo sapiens
ccagcagacttgagtc

SEQ ID NO: 1810208 - DNA, 12 bp, Homo sapiens
ccagcagctgcg

SEQ ID NO: 1810209 - DNA, 13 bp, Homo sapiens
ccagcatccagcc

SEQ ID NO: 1810210 - DNA, 18 bp, Homo sapiens
ccagcatccagcctgtgt

SEQ ID NO: 1810211 - DNA, 13 bp, Homo sapiens
ccagcccacagag

SEQ ID NO: 1810212 - DNA, 14 bp, Homo sapiens
ccagcccacagagc

SEQ ID NO: 1810213 - DNA, 15 bp, Homo sapiens
ccagcccacagagcc

SEQ ID NO: 1810214 - DNA, 17 bp, Homo sapiens
ccagcccacagagcctg

SEQ ID NO: 1810215 - DNA, 13 bp, Homo sapiens
ccagccccaactc

SEQ ID NO: 1810216 - DNA, 13 bp, Homo sapiens
ccagccccctgga

SEQ ID NO: 1810217 - DNA, 12 bp, Homo sapiens
ccagcccttccc

SEQ ID NO: 1810218 - DNA, 23 bp, Homo sapiens
ccagcccttccctggccccgccg

SEQ ID NO: 1810219 - DNA, 13 bp, Homo sapiens
ccagcccttctgc

SEQ ID NO: 1810220 - DNA, 14 bp, Homo sapiens
ccagccgctgcccg

SEQ ID NO: 1810221 - DNA, 16 bp, Homo sapiens
ccagccgctgcccggc

SEQ ID NO: 1810222 - DNA, 23 bp, Homo sapiens
ccagccgctgcccggcgccctct

SEQ ID NO: 1810223 - DNA, 14 bp, Homo sapiens
ccagcctcccctcc

SEQ ID NO: 1810224 - DNA, 15 bp, Homo sapiens
ccagcctcccctccc

SEQ ID NO: 1810225 - DNA, 16 bp, Homo sapiens
ccagcctctcccggct

SEQ ID NO: 1810226 - DNA, 20 bp, Homo sapiens
ccagcctctcccggctgcct

SEQ ID NO: 1810227 - DNA, 23 bp, Homo sapiens
ccagcctctcccggctgcctgcc

SEQ ID NO: 1810228 - DNA, 14 bp, Homo sapiens
ccagcctggcccag

SEQ ID NO: 1810229 - DNA, 21 bp, Homo sapiens
ccagcgattattgatcaaaat

SEQ ID NO: 1810230 - DNA, 19 bp, Homo sapiens
ccagctactctgtccaggc

SEQ ID NO: 1810231 - DNA, 21 bp, Homo sapiens
ccagctactctgtccaggcca

SEQ ID NO: 1810232 - DNA, 21 bp, Homo sapiens
ccagctcccccgggaggggcc

SEQ ID NO: 1810233 - DNA, 20 bp, Homo sapiens
ccagctccttttgtccccag

SEQ ID NO: 1810234 - DNA, 23 bp, Homo sapiens
ccagctccttttgtccccagggc

SEQ ID NO: 1810235 - DNA, 11 bp, Homo sapiens
ccagctctgtg

SEQ ID NO: 1810236 - DNA, 13 bp, Homo sapiens
ccagctctgtggc

SEQ ID NO: 1810237 - DNA, 19 bp, Homo sapiens
ccagctctgtggcctgtgt

SEQ ID NO: 1810238 - DNA, 22 bp, Homo sapiens
ccagctctgtggcctgtgtcca

SEQ ID NO: 1810239 - DNA, 20 bp, Homo sapiens
ccagctgacagtcctctcca

SEQ ID NO: 1810240 - DNA, 22 bp, Homo sapiens
ccagctgacagtcctctccacc

SEQ ID NO: 1810241 - DNA, 21 bp, Homo sapiens
ccagctgctctgccccttggg

SEQ ID NO: 1810242 - DNA, 17 bp, Homo sapiens
ccagctgtagccatggc

SEQ ID NO: 1810243 - DNA, 19 bp, Homo sapiens
ccagctgtagccatggctc

SEQ ID NO: 1810244 - DNA, 20 bp, Homo sapiens
ccagctgtagccatggctca

SEQ ID NO: 1810245 - DNA, 24 bp, Homo sapiens
ccagctgtagccatggctcaggca

SEQ ID NO: 1810246 - DNA, 15 bp, Homo sapiens
ccagcttcctggtgt

SEQ ID NO: 1810247 - DNA, 17 bp, Homo sapiens
ccaggaaggcagctgct

SEQ ID NO: 1810248 - DNA, 18 bp, Homo sapiens
ccaggaaggcagctgctc

SEQ ID NO: 1810249 - DNA, 19 bp, Homo sapiens
ccaggaaggcagctgctct

SEQ ID NO: 1810250 - DNA, 21 bp, Homo sapiens
ccaggaagggaaagcgggcag

SEQ ID NO: 1810251 - DNA, 20 bp, Homo sapiens
ccaggacggggccggccagg

SEQ ID NO: 1810252 - DNA, 18 bp, Homo sapiens
ccaggagtctgtgctctt

SEQ ID NO: 1810253 - DNA, 17 bp, Homo sapiens
ccaggagtttgagacaa

SEQ ID NO: 1810254 - DNA, 21 bp, Homo sapiens
ccaggagtttgagacaagccc

SEQ ID NO: 1810255 - DNA, 18 bp, Homo sapiens
ccaggatcctgcaggaac

SEQ ID NO: 1810256 - DNA, 14 bp, Homo sapiens
ccaggcacctggcc

SEQ ID NO: 1810257 - DNA, 17 bp, Homo sapiens
ccaggcacctggcctgc

SEQ ID NO: 1810258 - DNA, 17 bp, Homo sapiens
ccaccacgtctgccagg

SEQ ID NO: 1810259 - DNA, 18 bp, Homo sapiens
ccaccacgtctgccaggc

SEQ ID NO: 1810260 - DNA, 19 bp, Homo sapiens
ccaccacgtctgccaggcc

SEQ ID NO: 1810261 - DNA, 22 bp, Homo sapiens
ccaccacgtctgccaggcccat

SEQ ID NO: 1810262 - DNA, 12 bp, Homo sapiens
ccacccaggctg

SEQ ID NO: 1810263 - DNA, 13 bp, Homo sapiens
ccacccaggctgc

SEQ ID NO: 1810264 - DNA, 12 bp, Homo sapiens
ccacccagtgct

SEQ ID NO: 1810265 - DNA, 14 bp, Homo sapiens
ccacccagtgctgc

SEQ ID NO: 1810266 - DNA, 16 bp, Homo sapiens
ccacccagtgctgcca

SEQ ID NO: 1810267 - DNA, 19 bp, Homo sapiens
ccacccagtgctgccatgc

SEQ ID NO: 1810268 - DNA, 15 bp, Homo sapiens
ccacccatcttcctg

SEQ ID NO: 1810269 - DNA, 19 bp, Homo sapiens
ccacccatcttcctgctgc

SEQ ID NO: 1810270 - DNA, 20 bp, Homo sapiens
ccacccatcttcctgctgct

SEQ ID NO: 1810271 - DNA, 22 bp, Homo sapiens
ccacccatcttcctgctgctgt

SEQ ID NO: 1810272 - DNA, 17 bp, Homo sapiens
ccaccctcgtggacacc

SEQ ID NO: 1810273 - DNA, 19 bp, Homo sapiens
ccaccctcgtggacacctg

SEQ ID NO: 1810274 - DNA, 16 bp, Homo sapiens
aagggaaactggctga

SEQ ID NO: 1810275 - DNA, 20 bp, Homo sapiens
aagggaaagcgggcagcccc

SEQ ID NO: 1810276 - DNA, 19 bp, Homo sapiens
aagggacagaaaagaaagc

SEQ ID NO: 1810277 - DNA, 23 bp, Homo sapiens
aagggagagttctttgctgcccc

SEQ ID NO: 1810278 - DNA, 19 bp, Homo sapiens
aagggaggcccagccgcag

SEQ ID NO: 1810279 - DNA, 20 bp, Homo sapiens
aagggaggcccagccgcagg

SEQ ID NO: 1810280 - DNA, 17 bp, Homo sapiens
aagggcatcaggcactg

SEQ ID NO: 1810281 - DNA, 22 bp, Homo sapiens
aagggctccagcatccagcctg

SEQ ID NO: 1810282 - DNA, 24 bp, Homo sapiens
aagggctccagcatccagcctgtg

SEQ ID NO: 1810283 - DNA, 14 bp, Homo sapiens
aaggggcacaccac

SEQ ID NO: 1810284 - DNA, 18 bp, Homo sapiens
aaggggccccggggctgg

SEQ ID NO: 1810285 - DNA, 14 bp, Homo sapiens
aaggggctgctggg

SEQ ID NO: 1810286 - DNA, 21 bp, Homo sapiens
aaggggctgctggggcatgtg

SEQ ID NO: 1810287 - DNA, 15 bp, Homo sapiens
aagggttgaaggcag

SEQ ID NO: 1810288 - DNA, 19 bp, Homo sapiens
aaggtctccttactctgag

SEQ ID NO: 1810289 - DNA, 21 bp, Homo sapiens
aaggtctccttactctgagcc

SEQ ID NO: 1810290 - DNA, 21 bp, Homo sapiens
aaggtgggtccaggaaggcag

SEQ ID NO: 1810291 - DNA, 16 bp, Homo sapiens
aaggttttattttgta

SEQ ID NO: 1810292 - DNA, 19 bp, Homo sapiens
aagtaaactggatactgta

SEQ ID NO: 1810293 - DNA, 16 bp, Homo sapiens
aagtagtagtgtcttc

SEQ ID NO: 1810294 - DNA, 22 bp, Homo sapiens
aagtataggataaattacatta

SEQ ID NO: 1810295 - DNA, 23 bp, Homo sapiens
aagtataggataaattacattaa

SEQ ID NO: 1810296 - DNA, 19 bp, Homo sapiens
aagtcaatattgattttaa

SEQ ID NO: 1810297 - DNA, 22 bp, Homo sapiens
aagtcacagctgcagctgggcc

SEQ ID NO: 1810298 - DNA, 17 bp, Homo sapiens
aagtcacatataaaagt

SEQ ID NO: 1810299 - DNA, 23 bp, Homo sapiens
aagtgcttgcagatcatctgggg

SEQ ID NO: 1810300 - DNA, 21 bp, Homo sapiens
aagtgtattatttctggcttt

SEQ ID NO: 1810301 - DNA, 17 bp, Homo sapiens
aagtgtgggtctgtgtg

SEQ ID NO: 1810302 - DNA, 19 bp, Homo sapiens
aagttaaatcattttcatt

SEQ ID NO: 1810303 - DNA, 17 bp, Homo sapiens
aagttcaagtgatcttt

SEQ ID NO: 1810304 - DNA, 20 bp, Homo sapiens
aagttcaagtgatctttcaa

SEQ ID NO: 1810305 - DNA, 21 bp, Homo sapiens
aagttcaagtgatctttcaat

SEQ ID NO: 1810306 - DNA, 23 bp, Homo sapiens
aagtttcacaacagatttctaag

SEQ ID NO: 1810307 - DNA, 16 bp, Homo sapiens
aagtttgcatatcagt

SEQ ID NO: 1810308 - DNA, 16 bp, Homo sapiens
aataaaaagtaacaca

SEQ ID NO: 1810309 - DNA, 11 bp, Homo sapiens
aataaactagt

SEQ ID NO: 1810310 - DNA, 13 bp, Homo sapiens
aataaatgaatct

SEQ ID NO: 1810311 - DNA, 14 bp, Homo sapiens
aatacagaagaaaa

SEQ ID NO: 1810312 - DNA, 15 bp, Homo sapiens
aatacgtgttcaaaa

SEQ ID NO: 1810313 - DNA, 16 bp, Homo sapiens
aatacgtgttcaaaaa

SEQ ID NO: 1810314 - DNA, 22 bp, Homo sapiens
aatactgaaccactttgatatt

SEQ ID NO: 1810315 - DNA, 17 bp, Homo sapiens
aatactgtagaaatatt

SEQ ID NO: 1810316 - DNA, 19 bp, Homo sapiens
aatactgtgttacctttta

SEQ ID NO: 1810317 - DNA, 19 bp, Homo sapiens
aatacttactgttaactgt

SEQ ID NO: 1810318 - DNA, 22 bp, Homo sapiens
aatacttccatatggagcattt

SEQ ID NO: 1810319 - DNA, 21 bp, Homo sapiens
aatagagagtatgtaatcttt

SEQ ID NO: 1810320 - DNA, 12 bp, Homo sapiens
aatagccagaga

SEQ ID NO: 1810321 - DNA, 15 bp, Homo sapiens
aatagttagccctca

SEQ ID NO: 1810322 - DNA, 16 bp, Homo sapiens
aatataagtaatgaag

SEQ ID NO: 1810323 - DNA, 12 bp, Homo sapiens
aatatcattact

SEQ ID NO: 1810324 - DNA, 19 bp, Homo sapiens
aatatcattactaacttct

SEQ ID NO: 1810325 - DNA, 20 bp, Homo sapiens
aatatctgagaagtgtatat

SEQ ID NO: 1810326 - DNA, 15 bp, Homo sapiens
aatatctgagaattg

SEQ ID NO: 1810327 - DNA, 19 bp, Homo sapiens
aatatgagaaatacagaag

SEQ ID NO: 1810328 - DNA, 15 bp, Homo sapiens
aatattcaataaagc

SEQ ID NO: 1810329 - DNA, 18 bp, Homo sapiens
aatattgctctaattctt

SEQ ID NO: 1810330 - DNA, 18 bp, Homo sapiens
aatatttttcaaaatcaa

SEQ ID NO: 1810331 - DNA, 20 bp, Homo sapiens
aatcaaaaggtaatgcacat

SEQ ID NO: 1810332 - DNA, 20 bp, Homo sapiens
aatcaagtctgtgaaagtct

SEQ ID NO: 1810333 - DNA, 18 bp, Homo sapiens
aatcactagtcaagaaaa

SEQ ID NO: 1810334 - DNA, 20 bp, Homo sapiens
aatcactagtcaagaaaaat

SEQ ID NO: 1810335 - DNA, 20 bp, Homo sapiens
aatcattgactaaagccatt

SEQ ID NO: 1810336 - DNA, 15 bp, Homo sapiens
aatcattttcattaa

SEQ ID NO: 1810337 - DNA, 14 bp, Homo sapiens
aatctagaaaatga

SEQ ID NO: 1810338 - DNA, 19 bp, Homo sapiens
aatctccagggctgcccct

SEQ ID NO: 1810339 - DNA, 20 bp, Homo sapiens
aatctccagggctgcccctg

SEQ ID NO: 1810340 - DNA, 22 bp, Homo sapiens
aatctccagggctgcccctgta

SEQ ID NO: 1810341 - DNA, 16 bp, Homo sapiens
aatctggcaaagttat

SEQ ID NO: 1810342 - DNA, 15 bp, Homo sapiens
aatctttctatattt

SEQ ID NO: 1810343 - DNA, 23 bp, Homo sapiens
aatgaaaacaaaattccattaca

SEQ ID NO: 1810344 - DNA, 21 bp, Homo sapiens
aatgaagacccagtgtaaaga

SEQ ID NO: 1810345 - DNA, 18 bp, Homo sapiens
aatgagtcacaaaataaa

SEQ ID NO: 1810346 - DNA, 20 bp, Homo sapiens
aatgagtctgtttgaaatgc

SEQ ID NO: 1810347 - DNA, 13 bp, Homo sapiens
aatgcaatgaaaa

SEQ ID NO: 1810348 - DNA, 17 bp, Homo sapiens
aatgcagattcctgggc

SEQ ID NO: 1810349 - DNA, 18 bp, Homo sapiens
aatgcagattcctgggcc

SEQ ID NO: 1810350 - DNA, 15 bp, Homo sapiens
aatgcatatttctat

SEQ ID NO: 1810351 - DNA, 17 bp, Homo sapiens
aatgcatatttctatgt

SEQ ID NO: 1810352 - DNA, 18 bp, Homo sapiens
aatgcctataaaatgccc

SEQ ID NO: 1810353 - DNA, 21 bp, Homo sapiens
aatgctattgttgtgggcttt

SEQ ID NO: 1810354 - DNA, 17 bp, Homo sapiens
aatgctttgggaggcca

SEQ ID NO: 1810355 - DNA, 14 bp, Homo sapiens
aatgctttgtgact

SEQ ID NO: 1810356 - DNA, 15 bp, Homo sapiens
aatggaaaagagaga

SEQ ID NO: 1810357 - DNA, 18 bp, Homo sapiens
aatggcagctagactgga

SEQ ID NO: 1810358 - DNA, 19 bp, Homo sapiens
aatggcagctagactggag

SEQ ID NO: 1810359 - DNA, 14 bp, Homo sapiens
aatgggatctattt

SEQ ID NO: 1810360 - DNA, 15 bp, Homo sapiens
aatgggcctgcccaa

SEQ ID NO: 1810361 - DNA, 15 bp, Homo sapiens
aatggggtgggccca

SEQ ID NO: 1810362 - DNA, 10 bp, Homo sapiens
aatggtgcct

SEQ ID NO: 1810363 - DNA, 18 bp, Homo sapiens
aatggtgttactaaagtc

SEQ ID NO: 1810364 - DNA, 19 bp, Homo sapiens
aatggtgttactaaagtca

SEQ ID NO: 1810365 - DNA, 13 bp, Homo sapiens
aatgtaatactgt

SEQ ID NO: 1810366 - DNA, 19 bp, Homo sapiens
aatgtaatactgtagaaat

SEQ ID NO: 1810367 - DNA, 18 bp, Homo sapiens
aatgtacctatgtgagtt

SEQ ID NO: 1810368 - DNA, 14 bp, Homo sapiens
aatgtagtggagag

SEQ ID NO: 1810369 - DNA, 14 bp, Homo sapiens
aatgtatggcatgt

SEQ ID NO: 1810370 - DNA, 14 bp, Homo sapiens
aatgtcagaaactc

SEQ ID NO: 1810371 - DNA, 16 bp, Homo sapiens
aatgtcagtatgtgga

SEQ ID NO: 1810372 - DNA, 23 bp, Homo sapiens
aatgtgagtgacctcacttctgg

SEQ ID NO: 1810373 - DNA, 21 bp, Homo sapiens
aatgttatttggaattttaag

SEQ ID NO: 1810374 - DNA, 21 bp, Homo sapiens
ccctggtgcactggccccacc

SEQ ID NO: 1810375 - DNA, 17 bp, Homo sapiens
ccctgtcagaggctaag

SEQ ID NO: 1810376 - DNA, 20 bp, Homo sapiens
ccctgtctccagggccccca

SEQ ID NO: 1810377 - DNA, 16 bp, Homo sapiens
cccttagaatgtttct

SEQ ID NO: 1810378 - DNA, 18 bp, Homo sapiens
cccttagaatgtttctat

SEQ ID NO: 1810379 - DNA, 12 bp, Homo sapiens
cccttcagggcc

SEQ ID NO: 1810380 - DNA, 19 bp, Homo sapiens
cccttcagggccagaagga

SEQ ID NO: 1810381 - DNA, 13 bp, Homo sapiens
cccttccctggcc

SEQ ID NO: 1810382 - DNA, 13 bp, Homo sapiens
cccttcctggcct

SEQ ID NO: 1810383 - DNA, 14 bp, Homo sapiens
cccttcctggcctc

SEQ ID NO: 1810384 - DNA, 14 bp, Homo sapiens
cccttggcttcctc

SEQ ID NO: 1810385 - DNA, 15 bp, Homo sapiens
cccttgggcatccac

SEQ ID NO: 1810386 - DNA, 15 bp, Homo sapiens
cccttgtcctgccag

SEQ ID NO: 1810387 - DNA, 17 bp, Homo sapiens
cccttgtcctgccagct

SEQ ID NO: 1810388 - DNA, 15 bp, Homo sapiens
cccttttcagcttct

SEQ ID NO: 1810389 - DNA, 18 bp, Homo sapiens
cccttttcagcttctgct

SEQ ID NO: 1810390 - DNA, 14 bp, Homo sapiens
ccgaccccatctca

SEQ ID NO: 1810391 - DNA, 20 bp, Homo sapiens
ccgagggatgatgccacacc

SEQ ID NO: 1810392 - DNA, 15 bp, Homo sapiens
ccgcaccagctgctc

SEQ ID NO: 1810393 - DNA, 17 bp, Homo sapiens
ccgcaccagctgctctg

SEQ ID NO: 1810394 - DNA, 19 bp, Homo sapiens
ccgcaccagctgctctgcc

SEQ ID NO: 1810395 - DNA, 23 bp, Homo sapiens
ccgcagcccgtgaagcagtgcct

SEQ ID NO: 1810396 - DNA, 13 bp, Homo sapiens
ccgcagtccccag

SEQ ID NO: 1810397 - DNA, 17 bp, Homo sapiens
ccgcagtccccagccct

SEQ ID NO: 1810398 - DNA, 18 bp, Homo sapiens
ccgcagtccccagccctt

SEQ ID NO: 1810399 - DNA, 18 bp, Homo sapiens
ccgcatgccccctcgtgc

SEQ ID NO: 1810400 - DNA, 19 bp, Homo sapiens
ccgccatacattaaggagc

SEQ ID NO: 1810401 - DNA, 15 bp, Homo sapiens
ccgccatggcttcca

SEQ ID NO: 1810402 - DNA, 20 bp, Homo sapiens
ccgcccaggctggccagccc

SEQ ID NO: 1810403 - DNA, 22 bp, Homo sapiens
ccgcccaggctggccagcccca

SEQ ID NO: 1810404 - DNA, 14 bp, Homo sapiens
ccgccgcctcgccc

SEQ ID NO: 1810405 - DNA, 15 bp, Homo sapiens
ccgccgcctcgccca

SEQ ID NO: 1810406 - DNA, 14 bp, Homo sapiens
ccgcctcgcccacc

SEQ ID NO: 1810407 - DNA, 14 bp, Homo sapiens
ccgcggtgctctgg

SEQ ID NO: 1810408 - DNA, 16 bp, Homo sapiens
ccgcggtgctctggcg

SEQ ID NO: 1810409 - DNA, 17 bp, Homo sapiens
ccgcggtgctctggcgg

SEQ ID NO: 1810410 - DNA, 21 bp, Homo sapiens
ccgctaggagagactgaaagc

SEQ ID NO: 1810411 - DNA, 15 bp, Homo sapiens
ccgctcccacagctt

SEQ ID NO: 1810412 - DNA, 22 bp, Homo sapiens
ccgctcccacagcttcctgagg

SEQ ID NO: 1810413 - DNA, 15 bp, Homo sapiens
ccgctcccagtgtct

SEQ ID NO: 1810414 - DNA, 20 bp, Homo sapiens
ccgctcccagtgtcttcctg

SEQ ID NO: 1810415 - DNA, 24 bp, Homo sapiens
ccgctgccaccacgtctgccaggc

SEQ ID NO: 1810416 - DNA, 19 bp, Homo sapiens
ccgctgcccggcgccctct

SEQ ID NO: 1810417 - DNA, 20 bp, Homo sapiens
ccgctgcccggcgccctctg

SEQ ID NO: 1810418 - DNA, 14 bp, Homo sapiens
ccgcttcacccctg

SEQ ID NO: 1810419 - DNA, 20 bp, Homo sapiens
ccgcttgcctcggctcctgc

SEQ ID NO: 1810420 - DNA, 21 bp, Homo sapiens
ccgcttgcctcggctcctgct

SEQ ID NO: 1810421 - DNA, 15 bp, Homo sapiens
ccggagcacagccct

SEQ ID NO: 1810422 - DNA, 13 bp, Homo sapiens
ccggccaggtggg

SEQ ID NO: 1810423 - DNA, 14 bp, Homo sapiens
ccggcctcttccac

SEQ ID NO: 1810424 - DNA, 19 bp, Homo sapiens
ccggcgccctctgtcctga

SEQ ID NO: 1810425 - DNA, 15 bp, Homo sapiens
ccgggaggggcccgc

SEQ ID NO: 1810426 - DNA, 16 bp, Homo sapiens
ccgggaggggcccgct

SEQ ID NO: 1810427 - DNA, 19 bp, Homo sapiens
ccggggctggcaagcaggg

SEQ ID NO: 1810428 - DNA, 13 bp, Homo sapiens
ccggggctgggtt

SEQ ID NO: 1810429 - DNA, 14 bp, Homo sapiens
ccggggtctgtgct

SEQ ID NO: 1810430 - DNA, 17 bp, Homo sapiens
ccggggtctgtgctgtg

SEQ ID NO: 1810431 - DNA, 18 bp, Homo sapiens
ccggggtctgtgctgtgc

SEQ ID NO: 1810432 - DNA, 14 bp, Homo sapiens
ccgtccacccaggc

SEQ ID NO: 1810433 - DNA, 17 bp, Homo sapiens
ccgtccacccaggctgc

SEQ ID NO: 1810434 - DNA, 19 bp, Homo sapiens
ccgtccacccaggctgcac

SEQ ID NO: 1810435 - DNA, 21 bp, Homo sapiens
ccgtccacccaggctgcactg

SEQ ID NO: 1810436 - DNA, 14 bp, Homo sapiens
ccgtccatggcacc

SEQ ID NO: 1810437 - DNA, 20 bp, Homo sapiens
ccgtccatggcaccagcccc

SEQ ID NO: 1810438 - DNA, 17 bp, Homo sapiens
ccgtcggactgccccca

SEQ ID NO: 1810439 - DNA, 19 bp, Homo sapiens
ccgtcggactgcccccaga

SEQ ID NO: 1810440 - DNA, 16 bp, Homo sapiens
ccgtgaagcagtgcct

SEQ ID NO: 1810441 - DNA, 23 bp, Homo sapiens
ccgtgaagcagtgcctcgaggca

SEQ ID NO: 1810442 - DNA, 16 bp, Homo sapiens
ccgtggccccagcctg

SEQ ID NO: 1810443 - DNA, 21 bp, Homo sapiens
ccgtggccccagcctggccca

SEQ ID NO: 1810444 - DNA, 18 bp, Homo sapiens
ccgtgtcccaaggagctg

SEQ ID NO: 1810445 - DNA, 18 bp, Homo sapiens
ccgttgtctccctggccc

SEQ ID NO: 1810446 - DNA, 21 bp, Homo sapiens
cctggctccccacgagtcacc

SEQ ID NO: 1810447 - DNA, 16 bp, Homo sapiens
cctggctgccaggcgt

SEQ ID NO: 1810448 - DNA, 13 bp, Homo sapiens
cctggctgtggag

SEQ ID NO: 1810449 - DNA, 18 bp, Homo sapiens
cctggcttgctccagggt

SEQ ID NO: 1810450 - DNA, 20 bp, Homo sapiens
cctggcttgctccagggtct

SEQ ID NO: 1810451 - DNA, 18 bp, Homo sapiens
cctgggaaaggacccacc

SEQ ID NO: 1810452 - DNA, 13 bp, Homo sapiens
cctgggacccagc

SEQ ID NO: 1810453 - DNA, 14 bp, Homo sapiens
cctgggactcccag

SEQ ID NO: 1810454 - DNA, 16 bp, Homo sapiens
cctgggactcccagtg

SEQ ID NO: 1810455 - DNA, 14 bp, Homo sapiens
cctgggcctgtccc

SEQ ID NO: 1810456 - DNA, 15 bp, Homo sapiens
cctgggcctgtcccc

SEQ ID NO: 1810457 - DNA, 16 bp, Homo sapiens
cctgggcctgtgcagc

SEQ ID NO: 1810458 - DNA, 19 bp, Homo sapiens
cctgggcctgtgcagcagc

SEQ ID NO: 1810459 - DNA, 20 bp, Homo sapiens
cctgggcctgtgcagcagcc

SEQ ID NO: 1810460 - DNA, 23 bp, Homo sapiens
cctgggggcagtgactggcaggt

SEQ ID NO: 1810461 - DNA, 18 bp, Homo sapiens
cctgggtgccattcccag

SEQ ID NO: 1810462 - DNA, 23 bp, Homo sapiens
cctgggtggtatagggcgtttgg

SEQ ID NO: 1810463 - DNA, 17 bp, Homo sapiens
cctggtgaccccttttc

SEQ ID NO: 1810464 - DNA, 22 bp, Homo sapiens
cctggtgattctgatgcagcct

SEQ ID NO: 1810465 - DNA, 17 bp, Homo sapiens
cctggtgcactggcccc

SEQ ID NO: 1810466 - DNA, 19 bp, Homo sapiens
cctggtgcactggccccac

SEQ ID NO: 1810467 - DNA, 20 bp, Homo sapiens
cctggtgcactggccccacc

SEQ ID NO: 1810468 - DNA, 17 bp, Homo sapiens
cctgtacccagctcctt

SEQ ID NO: 1810469 - DNA, 13 bp, Homo sapiens
cctgtaggttgct

SEQ ID NO: 1810470 - DNA, 12 bp, Homo sapiens
cctgtcagaggc

SEQ ID NO: 1810471 - DNA, 13 bp, Homo sapiens
cctgtcagtgccg

SEQ ID NO: 1810472 - DNA, 19 bp, Homo sapiens
cctgtcagtgccgccgcct

SEQ ID NO: 1810473 - DNA, 16 bp, Homo sapiens
cctgtcccgccttcct

SEQ ID NO: 1810474 - DNA, 20 bp, Homo sapiens
cctgtgcagcagcccagctt

SEQ ID NO: 1810475 - DNA, 22 bp, Homo sapiens
cctgtgggggaagagcacagcc

SEQ ID NO: 1810476 - DNA, 15 bp, Homo sapiens
cctgtgtccagcagc

SEQ ID NO: 1810477 - DNA, 11 bp, Homo sapiens
cctgtgtctta

SEQ ID NO: 1810478 - DNA, 23 bp, Homo sapiens
cctgttattttttatttccacat

SEQ ID NO: 1810479 - DNA, 19 bp, Homo sapiens
ccttaagggttgaaggcag

SEQ ID NO: 1810480 - DNA, 14 bp, Homo sapiens
ccttactctgagcc

SEQ ID NO: 1810481 - DNA, 17 bp, Homo sapiens
ccttactctgagcccag

SEQ ID NO: 1810482 - DNA, 19 bp, Homo sapiens
ccttactctgagcccaggc

SEQ ID NO: 1810483 - DNA, 20 bp, Homo sapiens
ccttatgagactcttaaata

SEQ ID NO: 1810484 - DNA, 12 bp, Homo sapiens
ccttcagagctc

SEQ ID NO: 1810485 - DNA, 18 bp, Homo sapiens
ccttcagggagacaggca

SEQ ID NO: 1810486 - DNA, 19 bp, Homo sapiens
ccttcagggagacaggcag

SEQ ID NO: 1810487 - DNA, 21 bp, Homo sapiens
ccttcagggagacaggcaggg

SEQ ID NO: 1810488 - DNA, 15 bp, Homo sapiens
ccttcagggccagaa

SEQ ID NO: 1810489 - DNA, 22 bp, Homo sapiens
ccttcagtgagcccctccccag

SEQ ID NO: 1810490 - DNA, 17 bp, Homo sapiens
ccttccacctcctagag

SEQ ID NO: 1810491 - DNA, 13 bp, Homo sapiens
ccttccccgaggg

SEQ ID NO: 1810492 - DNA, 19 bp, Homo sapiens
ccttccccttttgcctggc

SEQ ID NO: 1810493 - DNA, 20 bp, Homo sapiens
ccttccccttttgcctggct

SEQ ID NO: 1810494 - DNA, 18 bp, Homo sapiens
ccttccctccccacagtc

SEQ ID NO: 1810495 - DNA, 15 bp, Homo sapiens
ccttccctggccccg

SEQ ID NO: 1810496 - DNA, 13 bp, Homo sapiens
ccttcctcctcca

SEQ ID NO: 1810497 - DNA, 17 bp, Homo sapiens
ccttcctcctccacagt

SEQ ID NO: 1810498 - DNA, 20 bp, Homo sapiens
ccttcctcctccacagtgct

SEQ ID NO: 1810499 - DNA, 13 bp, Homo sapiens
ccttcctggcctc

SEQ ID NO: 1810500 - DNA, 15 bp, Homo sapiens
ccttcctggcctcac

SEQ ID NO: 1810501 - DNA, 17 bp, Homo sapiens
ccttcctggcctcactg

SEQ ID NO: 1810502 - DNA, 23 bp, Homo sapiens
ccttcctggcctcactggctggg

SEQ ID NO: 1810503 - DNA, 12 bp, Homo sapiens
ccttctccacag

SEQ ID NO: 1810504 - DNA, 22 bp, Homo sapiens
ccttctcccccccggggctggg

SEQ ID NO: 1810505 - DNA, 23 bp, Homo sapiens
ccttctcccccccggggctgggt

SEQ ID NO: 1810506 - DNA, 18 bp, Homo sapiens
ccttgccttttaaaagaa

SEQ ID NO: 1810507 - DNA, 15 bp, Homo sapiens
ccttgctttgggctt

SEQ ID NO: 1810508 - DNA, 22 bp, Homo sapiens
ccttgctttgggctttgcaggc

SEQ ID NO: 1810509 - DNA, 19 bp, Homo sapiens
ccttgggcatccacccagt

SEQ ID NO: 1810510 - DNA, 13 bp, Homo sapiens
ccttgggctcctg

SEQ ID NO: 1810511 - DNA, 21 bp, Homo sapiens
ccttgggctcctggctgccag

SEQ ID NO: 1810512 - DNA, 15 bp, Homo sapiens
ccttggggcctggct

SEQ ID NO: 1810513 - DNA, 16 bp, Homo sapiens
ccttggggcctggctt

SEQ ID NO: 1810514 - DNA, 13 bp, Homo sapiens
ccttgtcctgcca

SEQ ID NO: 1810515 - DNA, 17 bp, Homo sapiens
ccttgtcctgccagctg

SEQ ID NO: 1810516 - DNA, 20 bp, Homo sapiens
ccttgtcctgccagctgcct

SEQ ID NO: 1810517 - DNA, 19 bp, Homo sapiens
ccttgtctttactgacaag

SEQ ID NO: 1810518 - DNA, 13 bp, Homo sapiens
ccttgtgccctgc

SEQ ID NO: 1810519 - DNA, 18 bp, Homo sapiens
ccttgtgccctgccccca

SEQ ID NO: 1810520 - DNA, 24 bp, Homo sapiens
ccttgtgcttggtggggctcgtgg

SEQ ID NO: 1810521 - DNA, 15 bp, Homo sapiens
cctttgcaggcccag

SEQ ID NO: 1810522 - DNA, 20 bp, Homo sapiens
cctttgcaggcccagcagac

SEQ ID NO: 1810523 - DNA, 22 bp, Homo sapiens
cctttgtagcctatgtcttgta

SEQ ID NO: 1810524 - DNA, 21 bp, Homo sapiens
ccttttcagcttctgctgggc

SEQ ID NO: 1810525 - DNA, 16 bp, Homo sapiens
ccttttcccggggagg

SEQ ID NO: 1810526 - DNA, 15 bp, Homo sapiens
ccttttgcctggctg

SEQ ID NO: 1810527 - DNA, 15 bp, Homo sapiens
ccttttgtccccagg

SEQ ID NO: 1810528 - DNA, 14 bp, Homo sapiens
cctttttctacctt

SEQ ID NO: 1810529 - DNA, 19 bp, Homo sapiens
cgaaacctgtccataaagt

SEQ ID NO: 1810530 - DNA, 17 bp, Homo sapiens
cgaaccaaggcagcctc

SEQ ID NO: 1810531 - DNA, 15 bp, Homo sapiens
cgaccccatctgccc

SEQ ID NO: 1810532 - DNA, 16 bp, Homo sapiens
cgaccccatctgccca

SEQ ID NO: 1810533 - DNA, 18 bp, Homo sapiens
cgacttgaattttcccac

SEQ ID NO: 1810534 - DNA, 22 bp, Homo sapiens
cgacttgaattttcccactgca

SEQ ID NO: 1810535 - DNA, 12 bp, Homo sapiens
cgagaattttca

SEQ ID NO: 1810536 - DNA, 17 bp, Homo sapiens
cgagcactggccagaga

SEQ ID NO: 1810537 - DNA, 19 bp, Homo sapiens
cgagcactggccagagagg

SEQ ID NO: 1810538 - DNA, 21 bp, Homo sapiens
cgagcactggccagagagggc

SEQ ID NO: 1810539 - DNA, 21 bp, Homo sapiens
cgagctccttgggtcctgcaa

SEQ ID NO: 1810540 - DNA, 15 bp, Homo sapiens
cgaggcaccggcgct

SEQ ID NO: 1810541 - DNA, 19 bp, Homo sapiens
cgaggcaccggcgctgcag

SEQ ID NO: 1810542 - DNA, 21 bp, Homo sapiens
cgaggcaccggcgctgcaggt

SEQ ID NO: 1810543 - DNA, 13 bp, Homo sapiens
cgagggatgatgc

SEQ ID NO: 1810544 - DNA, 16 bp, Homo sapiens
cgagtcacctgcaagc

SEQ ID NO: 1810545 - DNA, 20 bp, Homo sapiens
cgcaagggcatcaggcactg

SEQ ID NO: 1810546 - DNA, 21 bp, Homo sapiens
cgcaagggcatcaggcactgg

SEQ ID NO: 1810547 - DNA, 21 bp, Homo sapiens
cgcaattgtgggatgtcctct

SEQ ID NO: 1810548 - DNA, 22 bp, Homo sapiens
cgcaattgtgggatgtcctctt

SEQ ID NO: 1810549 - DNA, 18 bp, Homo sapiens
cgcaccagctgctctgcc

SEQ ID NO: 1810550 - DNA, 18 bp, Homo sapiens
cgcaggatccgctgccac

SEQ ID NO: 1810551 - DNA, 20 bp, Homo sapiens
cgcaggatccgctgccacca

SEQ ID NO: 1810552 - DNA, 12 bp, Homo sapiens
cgcagtccccag

SEQ ID NO: 1810553 - DNA, 20 bp, Homo sapiens
cgcatgccccctcgtgccag

SEQ ID NO: 1810554 - DNA, 21 bp, Homo sapiens
cgcccaccgcatgccccctcg

SEQ ID NO: 1810555 - DNA, 15 bp, Homo sapiens
cgcccaggctggcca

SEQ ID NO: 1810556 - DNA, 20 bp, Homo sapiens
cgcccaggctggccagcccc

SEQ ID NO: 1810557 - DNA, 22 bp, Homo sapiens
cgcccaggctggccagccccac

SEQ ID NO: 1810558 - DNA, 22 bp, Homo sapiens
cgccccatccctgcttgcccgc

SEQ ID NO: 1810559 - DNA, 19 bp, Homo sapiens
cgccctgcgttggagccac

SEQ ID NO: 1810560 - DNA, 13 bp, Homo sapiens
cgccgcctcgccc

SEQ ID NO: 1810561 - DNA, 19 bp, Homo sapiens
cgcctcgcccaccgcatgc

SEQ ID NO: 1810562 - DNA, 15 bp, Homo sapiens
cgccttcctcctcca

SEQ ID NO: 1810563 - DNA, 21 bp, Homo sapiens
cgcgggaggcaccagctctgt

SEQ ID NO: 1810564 - DNA, 14 bp, Homo sapiens
cgcggtgctctggc

SEQ ID NO: 1810565 - DNA, 20 bp, Homo sapiens
cgctaggagagactgaaagc

SEQ ID NO: 1810566 - DNA, 14 bp, Homo sapiens
cgctcaggacccag

SEQ ID NO: 1810567 - DNA, 18 bp, Homo sapiens
cgctcccacagcttcctg

SEQ ID NO: 1810568 - DNA, 20 bp, Homo sapiens
cgctcccccgcagtccccag

SEQ ID NO: 1810569 - DNA, 13 bp, Homo sapiens
cgctgatgctggg

SEQ ID NO: 1810570 - DNA, 17 bp, Homo sapiens
cgctgatgctgggctgg

SEQ ID NO: 1810571 - DNA, 21 bp, Homo sapiens
cgctgatgctgggctgggtgc

SEQ ID NO: 1810572 - DNA, 21 bp, Homo sapiens
cgctgccaccacgtctgccag

SEQ ID NO: 1810573 - DNA, 15 bp, Homo sapiens
cgctgccttgccatg

SEQ ID NO: 1810574 - DNA, 16 bp, Homo sapiens
cgctgctctagctggc

SEQ ID NO: 1810575 - DNA, 21 bp, Homo sapiens
cgctgtgttactaatgatcac

SEQ ID NO: 1810576 - DNA, 14 bp, Homo sapiens
cgcttcacccctgc

SEQ ID NO: 1810577 - DNA, 13 bp, Homo sapiens
cgcttgagcccag

SEQ ID NO: 1810578 - DNA, 15 bp, Homo sapiens
cgcttgcctcggctc

SEQ ID NO: 1810579 - DNA, 20 bp, Homo sapiens
cgcttgcctcggctcctgct

SEQ ID NO: 1810580 - DNA, 20 bp, Homo sapiens
cggaaaaggttttattttgt

SEQ ID NO: 1810581 - DNA, 22 bp, Homo sapiens
cggaagccgtctgactccagag

SEQ ID NO: 1810582 - DNA, 18 bp, Homo sapiens
cggactgcccccagaaag

SEQ ID NO: 1810583 - DNA, 18 bp, Homo sapiens
cggagcacagccctggga

SEQ ID NO: 1810584 - DNA, 10 bp, Homo sapiens
cggcctccac

SEQ ID NO: 1810585 - DNA, 21 bp, Homo sapiens
cggcctccactcccccacctg

SEQ ID NO: 1810586 - DNA, 12 bp, Homo sapiens
cggcctcttcca

SEQ ID NO: 1810587 - DNA, 13 bp, Homo sapiens
cggcctcttccac

SEQ ID NO: 1810588 - DNA, 20 bp, Homo sapiens
cggcctgttgggcagagctg

SEQ ID NO: 1810589 - DNA, 17 bp, Homo sapiens
cggcctttgttgctcag

SEQ ID NO: 1810590 - DNA, 13 bp, Homo sapiens
cggctcctgctgc

SEQ ID NO: 1810591 - DNA, 16 bp, Homo sapiens
cggctgtctcagactc

SEQ ID NO: 1810592 - DNA, 15 bp, Homo sapiens
cggcttcctgtccac

SEQ ID NO: 1810593 - DNA, 15 bp, Homo sapiens
cgggaggcaccagct

SEQ ID NO: 1810594 - DNA, 17 bp, Homo sapiens
cgggaggcaccagctct

SEQ ID NO: 1810595 - DNA, 20 bp, Homo sapiens
cgggaggcaccagctctgtg

SEQ ID NO: 1810596 - DNA, 12 bp, Homo sapiens
cgggcagcacag

SEQ ID NO: 1810597 - DNA, 18 bp, Homo sapiens
cgggctcagggaccacag

SEQ ID NO: 1810598 - DNA, 18 bp, Homo sapiens
cggggcccttggggcctg

SEQ ID NO: 1810599 - DNA, 19 bp, Homo sapiens
cggggcccttggggcctgg

SEQ ID NO: 1810600 - DNA, 21 bp, Homo sapiens
cggggcccttggggcctggct

SEQ ID NO: 1810601 - DNA, 16 bp, Homo sapiens
cggggctggcaagcag

SEQ ID NO: 1810602 - DNA, 10 bp, Homo sapiens
cggggctggg

SEQ ID NO: 1810603 - DNA, 15 bp, Homo sapiens
cggggcttggctgag

SEQ ID NO: 1810604 - DNA, 13 bp, Homo sapiens
cggggtctgtgct

SEQ ID NO: 1810605 - DNA, 23 bp, Homo sapiens
cggggtctgtgctgtgcctgcta

SEQ ID NO: 1810606 - DNA, 17 bp, Homo sapiens
cggggtggctgaaagta

SEQ ID NO: 1810607 - DNA, 15 bp, Homo sapiens
cgggtgggcctggcc

SEQ ID NO: 1810608 - DNA, 17 bp, Homo sapiens
cgggtgggcctggcctg

SEQ ID NO: 1810609 - DNA, 19 bp, Homo sapiens
cggtgcgtggctgtggcac

SEQ ID NO: 1810610 - DNA, 12 bp, Homo sapiens
cggtgctctggc

SEQ ID NO: 1810611 - DNA, 14 bp, Homo sapiens
cggtgctctggcgg

SEQ ID NO: 1810612 - DNA, 15 bp, Homo sapiens
cggtgctctggcggc

SEQ ID NO: 1810613 - DNA, 17 bp, Homo sapiens
cggtggtaccaggtctc

SEQ ID NO: 1810614 - DNA, 21 bp, Homo sapiens
cggttcctctgatttcaaggc

SEQ ID NO: 1810615 - DNA, 12 bp, Homo sapiens
cgtagatttttg

SEQ ID NO: 1810616 - DNA, 20 bp, Homo sapiens
cgtattctaattcttcatta

SEQ ID NO: 1810617 - DNA, 21 bp, Homo sapiens
cgtattctaattcttcattat

SEQ ID NO: 1810618 - DNA, 21 bp, Homo sapiens
cgtccacaggggcaggcctgg

SEQ ID NO: 1810619 - DNA, 23 bp, Homo sapiens
cgtccacaggggcaggcctggga

SEQ ID NO: 1810620 - DNA, 14 bp, Homo sapiens
cgtccacccaggct

SEQ ID NO: 1810621 - DNA, 15 bp, Homo sapiens
cgtccacccaggctg

SEQ ID NO: 1810622 - DNA, 20 bp, Homo sapiens
cgtccacccaggctgcactg

SEQ ID NO: 1810623 - DNA, 23 bp, Homo sapiens
cgtccacccaggctgcactgcag

SEQ ID NO: 1810624 - DNA, 16 bp, Homo sapiens
cgtccatggcaccagc

SEQ ID NO: 1810625 - DNA, 17 bp, Homo sapiens
cgtccatggcaccagcc

SEQ ID NO: 1810626 - DNA, 14 bp, Homo sapiens
cgtcctgcagagga

SEQ ID NO: 1810627 - DNA, 21 bp, Homo sapiens
cgtcctgcagaggaccacagt

SEQ ID NO: 1810628 - DNA, 22 bp, Homo sapiens
cgtcggactgcccccagaaagc

SEQ ID NO: 1810629 - DNA, 21 bp, Homo sapiens
cgtctactcattccccggggc

SEQ ID NO: 1810630 - DNA, 16 bp, Homo sapiens
cgtctgactccagagt

SEQ ID NO: 1810631 - DNA, 16 bp, Homo sapiens
cgtgaagcagtgcctc

SEQ ID NO: 1810632 - DNA, 16 bp, Homo sapiens
cgtgacccttcagggc

SEQ ID NO: 1810633 - DNA, 17 bp, Homo sapiens
cgtgacccttcagggcc

SEQ ID NO: 1810634 - DNA, 17 bp, Homo sapiens
cgtgagtgtgacttttt

SEQ ID NO: 1810635 - DNA, 21 bp, Homo sapiens
cgtgccagtcgcgctgcctgt

SEQ ID NO: 1810636 - DNA, 13 bp, Homo sapiens
cgtgctacctgca

SEQ ID NO: 1810637 - DNA, 18 bp, Homo sapiens
cgtggacacctgccctgc

SEQ ID NO: 1810638 - DNA, 19 bp, Homo sapiens
cgtggacacctgccctgcc

SEQ ID NO: 1810639 - DNA, 14 bp, Homo sapiens
cgtggccccagcct

SEQ ID NO: 1810640 - DNA, 19 bp, Homo sapiens
cgtggccccagcctggccc

SEQ ID NO: 1810641 - DNA, 20 bp, Homo sapiens
cgtggccccagcctggccca

SEQ ID NO: 1810642 - DNA, 21 bp, Homo sapiens
cgtggccttccccttttgcct

SEQ ID NO: 1810643 - DNA, 15 bp, Homo sapiens
cgtggctgtggcaca

SEQ ID NO: 1810644 - DNA, 16 bp, Homo sapiens
cgtggctgtggcacag

SEQ ID NO: 1810645 - DNA, 22 bp, Homo sapiens
cgtgtagtggaagagcagcctg

SEQ ID NO: 1810646 - DNA, 14 bp, Homo sapiens
cgtgtcccaaggag

SEQ ID NO: 1810647 - DNA, 14 bp, Homo sapiens
cgtgtctctcccac

SEQ ID NO: 1810648 - DNA, 13 bp, Homo sapiens
cgttggagccact

SEQ ID NO: 1810649 - DNA, 22 bp, Homo sapiens
cgttttaataatttttgctgaa

SEQ ID NO: 1810650 - DNA, 23 bp, Homo sapiens
cgtttttataaaaaatggtgcct

SEQ ID NO: 1810651 - DNA, 17 bp, Homo sapiens
ctaaacaatgaattctt

SEQ ID NO: 1810652 - DNA, 19 bp, Homo sapiens
ctaaagagttattcaaatg

SEQ ID NO: 1810653 - DNA, 22 bp, Homo sapiens
ctaaagagttattcaaatgaag

SEQ ID NO: 1810654 - DNA, 17 bp, Homo sapiens
ctaaatgcccagttcac

SEQ ID NO: 1810655 - DNA, 18 bp, Homo sapiens
ctaaattacagtgcagtt

SEQ ID NO: 1810656 - DNA, 17 bp, Homo sapiens
ctaacccttaaaaatgc

SEQ ID NO: 1810657 - DNA, 20 bp, Homo sapiens
ctaagccctcgaaccaaggc

SEQ ID NO: 1810658 - DNA, 15 bp, Homo sapiens
ctaagctttctcctt

SEQ ID NO: 1810659 - DNA, 13 bp, Homo sapiens
ctaaggagcatga

SEQ ID NO: 1810660 - DNA, 16 bp, Homo sapiens
ctaagttaaatcattt

SEQ ID NO: 1810661 - DNA, 20 bp, Homo sapiens
ctaagttaaatcattttcat

SEQ ID NO: 1810662 - DNA, 11 bp, Homo sapiens
ctaataaagag

SEQ ID NO: 1810663 - DNA, 15 bp, Homo sapiens
ctaataaagagactg

SEQ ID NO: 1810664 - DNA, 14 bp, Homo sapiens
ctaatacttactgt

SEQ ID NO: 1810665 - DNA, 21 bp, Homo sapiens
ctaattctttgacctgttggg

SEQ ID NO: 1810666 - DNA, 17 bp, Homo sapiens
ctaattgtggtagaaat

SEQ ID NO: 1810667 - DNA, 12 bp, Homo sapiens
ctacacatatat

SEQ ID NO: 1810668 - DNA, 21 bp, Homo sapiens
ctaccccccctcctgctgcct

SEQ ID NO: 1810669 - DNA, 11 bp, Homo sapiens
ctacccctccc

SEQ ID NO: 1810670 - DNA, 16 bp, Homo sapiens
ctacccctcccagctg

SEQ ID NO: 1810671 - DNA, 15 bp, Homo sapiens
ctaccctcccaccag

SEQ ID NO: 1810672 - DNA, 16 bp, Homo sapiens
ctaccctccctgctgt

SEQ ID NO: 1810673 - DNA, 23 bp, Homo sapiens
ctaccctccctgctgtcccctct

SEQ ID NO: 1810674 - DNA, 16 bp, Homo sapiens
ctacctgagcattcag

SEQ ID NO: 1810675 - DNA, 16 bp, Homo sapiens
ctactcattccccggg

SEQ ID NO: 1810676 - DNA, 14 bp, Homo sapiens
ctactctgtccagg

SEQ ID NO: 1810677 - DNA, 17 bp, Homo sapiens
cccagcccttctgcctt

SEQ ID NO: 1810678 - DNA, 20 bp, Homo sapiens
cccagcccttctgcctttct

SEQ ID NO: 1810679 - DNA, 10 bp, Homo sapiens
cccagcctgg

SEQ ID NO: 1810680 - DNA, 12 bp, Homo sapiens
cccagcctggcc

SEQ ID NO: 1810681 - DNA, 15 bp, Homo sapiens
cccagcctggcccag

SEQ ID NO: 1810682 - DNA, 16 bp, Homo sapiens
cccagcctggcccagc

SEQ ID NO: 1810683 - DNA, 17 bp, Homo sapiens
cccagcctggcccagct

SEQ ID NO: 1810684 - DNA, 19 bp, Homo sapiens
cccagctactctgtccagg

SEQ ID NO: 1810685 - DNA, 20 bp, Homo sapiens
cccagctactctgtccaggc

SEQ ID NO: 1810686 - DNA, 21 bp, Homo sapiens
cccagctactctgtccaggcc

SEQ ID NO: 1810687 - DNA, 23 bp, Homo sapiens
cccagctactctgtccaggccac

SEQ ID NO: 1810688 - DNA, 19 bp, Homo sapiens
cccagctgtagccatggct

SEQ ID NO: 1810689 - DNA, 21 bp, Homo sapiens
cccagctgtagccatggctca

SEQ ID NO: 1810690 - DNA, 22 bp, Homo sapiens
cccagctgtagccatggctcag

SEQ ID NO: 1810691 - DNA, 23 bp, Homo sapiens
cccagctgtagccatggctcagg

SEQ ID NO: 1810692 - DNA, 15 bp, Homo sapiens
cccaggacggggccg

SEQ ID NO: 1810693 - DNA, 20 bp, Homo sapiens
cccaggccatcttccaggtg

SEQ ID NO: 1810694 - DNA, 21 bp, Homo sapiens
cccaggccatcttccaggtgg

SEQ ID NO: 1810695 - DNA, 12 bp, Homo sapiens
cccaggccctcc

SEQ ID NO: 1810696 - DNA, 16 bp, Homo sapiens
cccaggccctccatgg

SEQ ID NO: 1810697 - DNA, 20 bp, Homo sapiens
cccaggccctccatgggcta

SEQ ID NO: 1810698 - DNA, 21 bp, Homo sapiens
cccaggccgttccccttggct

SEQ ID NO: 1810699 - DNA, 14 bp, Homo sapiens
cccaggcctccagc

SEQ ID NO: 1810700 - DNA, 15 bp, Homo sapiens
cccaggcctccagcc

SEQ ID NO: 1810701 - DNA, 13 bp, Homo sapiens
cccaggctgcact

SEQ ID NO: 1810702 - DNA, 18 bp, Homo sapiens
cccaggctgcactgcagt

SEQ ID NO: 1810703 - DNA, 19 bp, Homo sapiens
cccaggctgcactgcagtg

SEQ ID NO: 1810704 - DNA, 19 bp, Homo sapiens
cccaggctggccagcccca

SEQ ID NO: 1810705 - DNA, 14 bp, Homo sapiens
cccagggcccctcc

SEQ ID NO: 1810706 - DNA, 20 bp, Homo sapiens
cccagggcccctccctctgc

SEQ ID NO: 1810707 - DNA, 21 bp, Homo sapiens
cccagggcccctccctctgcc

SEQ ID NO: 1810708 - DNA, 12 bp, Homo sapiens
cccagggcctgg

SEQ ID NO: 1810709 - DNA, 20 bp, Homo sapiens
cccagggcctgggggcagtg

SEQ ID NO: 1810710 - DNA, 14 bp, Homo sapiens
cccaggtaagcagg

SEQ ID NO: 1810711 - DNA, 17 bp, Homo sapiens
cccaggtaagcaggagg

SEQ ID NO: 1810712 - DNA, 14 bp, Homo sapiens
cccagtgctgccat

SEQ ID NO: 1810713 - DNA, 21 bp, Homo sapiens
cccagtgctgccatgccactg

SEQ ID NO: 1810714 - DNA, 13 bp, Homo sapiens
cccagtgcttctc

SEQ ID NO: 1810715 - DNA, 18 bp, Homo sapiens
cccagtgtcttcctgtgg

SEQ ID NO: 1810716 - DNA, 23 bp, Homo sapiens
cccataatagttagccctcagtc

SEQ ID NO: 1810717 - DNA, 13 bp, Homo sapiens
cccatcagtgtac

SEQ ID NO: 1810718 - DNA, 14 bp, Homo sapiens
cccatcccccctca

SEQ ID NO: 1810719 - DNA, 20 bp, Homo sapiens
cccatcccccctcaccaggg

SEQ ID NO: 1810720 - DNA, 22 bp, Homo sapiens
cccatcccccctcaccaggggc

SEQ ID NO: 1810721 - DNA, 14 bp, Homo sapiens
cccatcctggccca

SEQ ID NO: 1810722 - DNA, 15 bp, Homo sapiens
cccatcctggcccat

SEQ ID NO: 1810723 - DNA, 19 bp, Homo sapiens
cccatctcaggtgccactc

SEQ ID NO: 1810724 - DNA, 14 bp, Homo sapiens
cccatctccccagg

SEQ ID NO: 1810725 - DNA, 12 bp, Homo sapiens
cccatcttcctg

SEQ ID NO: 1810726 - DNA, 18 bp, Homo sapiens
cccatcttcctgctgctg

SEQ ID NO: 1810727 - DNA, 13 bp, Homo sapiens
cccatgctctgcc

SEQ ID NO: 1810728 - DNA, 14 bp, Homo sapiens
cccatgctctgccc

SEQ ID NO: 1810729 - DNA, 15 bp, Homo sapiens
cccatgctctgcccc

SEQ ID NO: 1810730 - DNA, 16 bp, Homo sapiens
cccatgctctgcccca

SEQ ID NO: 1810731 - DNA, 20 bp, Homo sapiens
cccatgctctgccccaagcc

SEQ ID NO: 1810732 - DNA, 15 bp, Homo sapiens
cccatgggcactgct

SEQ ID NO: 1810733 - DNA, 18 bp, Homo sapiens
cccatgggcactgctggg

SEQ ID NO: 1810734 - DNA, 21 bp, Homo sapiens
cccatgggcttggacttcctg

SEQ ID NO: 1810735 - DNA, 19 bp, Homo sapiens
cccatgtgcctgcaccagg

SEQ ID NO: 1810736 - DNA, 22 bp, Homo sapiens
cccatgtgcctgcaccaggaga

SEQ ID NO: 1810737 - DNA, 13 bp, Homo sapiens
cccatgtggctga

SEQ ID NO: 1810738 - DNA, 15 bp, Homo sapiens
cccatgtggctgaag

SEQ ID NO: 1810739 - DNA, 23 bp, Homo sapiens
ccccaacccccagcacccgggct

SEQ ID NO: 1810740 - DNA, 22 bp, Homo sapiens
ccccaaccccgcggtgctctgg

SEQ ID NO: 1810741 - DNA, 23 bp, Homo sapiens
ccccaactccaggggcacctatg

SEQ ID NO: 1810742 - DNA, 13 bp, Homo sapiens
ccccaagcagcca

SEQ ID NO: 1810743 - DNA, 16 bp, Homo sapiens
ccccaagcagccagcc

SEQ ID NO: 1810744 - DNA, 18 bp, Homo sapiens
ccccaagcagccagccag

SEQ ID NO: 1810745 - DNA, 20 bp, Homo sapiens
ccccaaggttttggagtcag

SEQ ID NO: 1810746 - DNA, 11 bp, Homo sapiens
ccccacagccc

SEQ ID NO: 1810747 - DNA, 13 bp, Homo sapiens
ccccacagcccac

SEQ ID NO: 1810748 - DNA, 21 bp, Homo sapiens
ccccacgagtcacctgcaagc

SEQ ID NO: 1810749 - DNA, 15 bp, Homo sapiens
ccccactgggagagc

SEQ ID NO: 1810750 - DNA, 17 bp, Homo sapiens
ccccactgggagagctg

SEQ ID NO: 1810751 - DNA, 21 bp, Homo sapiens
ccccagagccactacctttgt

SEQ ID NO: 1810752 - DNA, 16 bp, Homo sapiens
ccccagatctgcctgg

SEQ ID NO: 1810753 - DNA, 19 bp, Homo sapiens
ccccagatctgcctgggcc

SEQ ID NO: 1810754 - DNA, 15 bp, Homo sapiens
ccccagcacccgggc

SEQ ID NO: 1810755 - DNA, 19 bp, Homo sapiens
ccccagcacccgggctcag

SEQ ID NO: 1810756 - DNA, 13 bp, Homo sapiens
ccccagccagccc

SEQ ID NO: 1810757 - DNA, 14 bp, Homo sapiens
ccccagccagccct

SEQ ID NO: 1810758 - DNA, 18 bp, Homo sapiens
ccccagccagcccttccc

SEQ ID NO: 1810759 - DNA, 13 bp, Homo sapiens
ccccagcccacag

SEQ ID NO: 1810760 - DNA, 18 bp, Homo sapiens
ccccagcccacagagcct

SEQ ID NO: 1810761 - DNA, 14 bp, Homo sapiens
ccccagccccaact

SEQ ID NO: 1810762 - DNA, 11 bp, Homo sapiens
ccccagccctt

SEQ ID NO: 1810763 - DNA, 14 bp, Homo sapiens
ccccagcccttctg

SEQ ID NO: 1810764 - DNA, 15 bp, Homo sapiens
ccccagcccttctgc

SEQ ID NO: 1810765 - DNA, 12 bp, Homo sapiens
ccccagcctggc

SEQ ID NO: 1810766 - DNA, 15 bp, Homo sapiens
ccccagcctggccca

SEQ ID NO: 1810767 - DNA, 18 bp, Homo sapiens
ccccagcctggcccagct

SEQ ID NO: 1810768 - DNA, 21 bp, Homo sapiens
ccccagcctggcccagctccc

SEQ ID NO: 1810769 - DNA, 22 bp, Homo sapiens
ccccagggcccctccctctgcc

SEQ ID NO: 1810770 - DNA, 23 bp, Homo sapiens
ccccagggcccctccctctgccc

SEQ ID NO: 1810771 - DNA, 13 bp, Homo sapiens
ccccagggcctgg

SEQ ID NO: 1810772 - DNA, 14 bp, Homo sapiens
ccccagggcctggg

SEQ ID NO: 1810773 - DNA, 17 bp, Homo sapiens
ccccagggcctgggggc

SEQ ID NO: 1810774 - DNA, 12 bp, Homo sapiens
ccccatccctcg

SEQ ID NO: 1810775 - DNA, 14 bp, Homo sapiens
ccccatctccccag

SEQ ID NO: 1810776 - DNA, 18 bp, Homo sapiens
ccccatctccccaggcct

SEQ ID NO: 1810777 - DNA, 20 bp, Homo sapiens
ccccatctcctcccatggcc

SEQ ID NO: 1810778 - DNA, 17 bp, Homo sapiens
ccccatctgcccaggac

SEQ ID NO: 1810779 - DNA, 14 bp, Homo sapiens
ccccatgctctgcc

SEQ ID NO: 1810780 - DNA, 21 bp, Homo sapiens
ccccatgctctgccccaagcc

SEQ ID NO: 1810781 - DNA, 18 bp, Homo sapiens
ccccatgctgccttcagg

SEQ ID NO: 1810782 - DNA, 15 bp, Homo sapiens
ccccatgggcttgga

SEQ ID NO: 1810783 - DNA, 18 bp, Homo sapiens
ccccatgtgcctgcacca

SEQ ID NO: 1810784 - DNA, 18 bp, Homo sapiens
cccccaaggttttggagt

SEQ ID NO: 1810785 - DNA, 16 bp, Homo sapiens
cccccagaaagcctcc

SEQ ID NO: 1810786 - DNA, 19 bp, Homo sapiens
cccccagaaagcctcctgc

SEQ ID NO: 1810787 - DNA, 20 bp, Homo sapiens
cccccagaaagcctcctgcc

SEQ ID NO: 1810788 - DNA, 13 bp, Homo sapiens
cccccatcctggc

SEQ ID NO: 1810789 - DNA, 15 bp, Homo sapiens
cccccatcctggccc

SEQ ID NO: 1810790 - DNA, 18 bp, Homo sapiens
cccccatctccccaggcc

SEQ ID NO: 1810791 - DNA, 20 bp, Homo sapiens
cccccatctccccaggcctc

SEQ ID NO: 1810792 - DNA, 11 bp, Homo sapiens
cccccatgctg

SEQ ID NO: 1810793 - DNA, 20 bp, Homo sapiens
cccccatgctgccttcaggg

SEQ ID NO: 1810794 - DNA, 13 bp, Homo sapiens
cccccgcccaggc

SEQ ID NO: 1810795 - DNA, 18 bp, Homo sapiens
cccccgggaggggcccgc

SEQ ID NO: 1810796 - DNA, 18 bp, Homo sapiens
ccaggctgcactgcagtg

SEQ ID NO: 1810797 - DNA, 22 bp, Homo sapiens
ccaggctggccagccccacagc

SEQ ID NO: 1810798 - DNA, 23 bp, Homo sapiens
ccaggctggccagccccacagcc

SEQ ID NO: 1810799 - DNA, 18 bp, Homo sapiens
ccagggctcaaaaagttt

SEQ ID NO: 1810800 - DNA, 19 bp, Homo sapiens
ccagggctgcccctgtagg

SEQ ID NO: 1810801 - DNA, 19 bp, Homo sapiens
ccagggctggagacttcct

SEQ ID NO: 1810802 - DNA, 19 bp, Homo sapiens
ccagggtccgcaccagctg

SEQ ID NO: 1810803 - DNA, 22 bp, Homo sapiens
ccagggtccgcaccagctgctc

SEQ ID NO: 1810804 - DNA, 24 bp, Homo sapiens
ccagggtccgcaccagctgctctg

SEQ ID NO: 1810805 - DNA, 23 bp, Homo sapiens
ccagggtcttgggctactggcag

SEQ ID NO: 1810806 - DNA, 15 bp, Homo sapiens
ccaggtctcctccac

SEQ ID NO: 1810807 - DNA, 22 bp, Homo sapiens
ccaggtgggcgggcagcacagc

SEQ ID NO: 1810808 - DNA, 14 bp, Homo sapiens
ccagtcgcgctgcc

SEQ ID NO: 1810809 - DNA, 17 bp, Homo sapiens
ccagtcgcgctgcctgt

SEQ ID NO: 1810810 - DNA, 20 bp, Homo sapiens
ccagtgaagtccttcagtga

SEQ ID NO: 1810811 - DNA, 12 bp, Homo sapiens
ccagtgctgcca

SEQ ID NO: 1810812 - DNA, 14 bp, Homo sapiens
ccagtgctgccatg

SEQ ID NO: 1810813 - DNA, 17 bp, Homo sapiens
ccagtgctgccatgcca

SEQ ID NO: 1810814 - DNA, 19 bp, Homo sapiens
ccagtgctgccatgccact

SEQ ID NO: 1810815 - DNA, 19 bp, Homo sapiens
ccagtgtaaagaataaatg

SEQ ID NO: 1810816 - DNA, 14 bp, Homo sapiens
ccagtgtcttcctg

SEQ ID NO: 1810817 - DNA, 16 bp, Homo sapiens
ccagtgtcttcctgtg

SEQ ID NO: 1810818 - DNA, 13 bp, Homo sapiens
ccagttctgatga

SEQ ID NO: 1810819 - DNA, 19 bp, Homo sapiens
ccataatagttagccctca

SEQ ID NO: 1810820 - DNA, 18 bp, Homo sapiens
ccatactggcctcgcctg

SEQ ID NO: 1810821 - DNA, 20 bp, Homo sapiens
ccatactggcctcgcctggc

SEQ ID NO: 1810822 - DNA, 22 bp, Homo sapiens
ccatatggagcatttttcagag

SEQ ID NO: 1810823 - DNA, 22 bp, Homo sapiens
ccatatgtgtgaattctgcaac

SEQ ID NO: 1810824 - DNA, 22 bp, Homo sapiens
ccatcagtgtacccccgcccag

SEQ ID NO: 1810825 - DNA, 20 bp, Homo sapiens
ccatcatgtttacagaggac

SEQ ID NO: 1810826 - DNA, 18 bp, Homo sapiens
ccatcccctccctgcctg

SEQ ID NO: 1810827 - DNA, 18 bp, Homo sapiens
ccatccctcggacccacc

SEQ ID NO: 1810828 - DNA, 12 bp, Homo sapiens
ccatcctggccc

SEQ ID NO: 1810829 - DNA, 16 bp, Homo sapiens
ccatcctggcccatca

SEQ ID NO: 1810830 - DNA, 17 bp, Homo sapiens
ccatcctggcccatcag

SEQ ID NO: 1810831 - DNA, 17 bp, Homo sapiens
ccatctcaggtgccact

SEQ ID NO: 1810832 - DNA, 22 bp, Homo sapiens
ccatctcaggtgccactccctg

SEQ ID NO: 1810833 - DNA, 12 bp, Homo sapiens
ccatctccccag

SEQ ID NO: 1810834 - DNA, 14 bp, Homo sapiens
ccatctccccaggc

SEQ ID NO: 1810835 - DNA, 17 bp, Homo sapiens
ccatctccccaggcctc

SEQ ID NO: 1810836 - DNA, 20 bp, Homo sapiens
ccatctccccaggcctccag

SEQ ID NO: 1810837 - DNA, 13 bp, Homo sapiens
ccatctgcccagg

SEQ ID NO: 1810838 - DNA, 14 bp, Homo sapiens
ccatcttccaggtg

SEQ ID NO: 1810839 - DNA, 14 bp, Homo sapiens
ccatcttcctgctg

SEQ ID NO: 1810840 - DNA, 15 bp, Homo sapiens
ccatcttcctgctgc

SEQ ID NO: 1810841 - DNA, 16 bp, Homo sapiens
ccatcttcctgctgct

SEQ ID NO: 1810842 - DNA, 18 bp, Homo sapiens
ccatcttcctgctgctgt

SEQ ID NO: 1810843 - DNA, 14 bp, Homo sapiens
ccatgccactgcca

SEQ ID NO: 1810844 - DNA, 16 bp, Homo sapiens
ccatgccactgccagg

SEQ ID NO: 1810845 - DNA, 17 bp, Homo sapiens
ccatgccactgccaggc

SEQ ID NO: 1810846 - DNA, 13 bp, Homo sapiens
ccatgcctcatgc

SEQ ID NO: 1810847 - DNA, 16 bp, Homo sapiens
ccatgcctcatgccac

SEQ ID NO: 1810848 - DNA, 17 bp, Homo sapiens
ccatgctcaacccccct

SEQ ID NO: 1810849 - DNA, 20 bp, Homo sapiens
ccatgctcaacccccctccc

SEQ ID NO: 1810850 - DNA, 21 bp, Homo sapiens
ccatgctcaacccccctccca

SEQ ID NO: 1810851 - DNA, 13 bp, Homo sapiens
ccatgctctgccc

SEQ ID NO: 1810852 - DNA, 17 bp, Homo sapiens
ccatgctctgccccaag

SEQ ID NO: 1810853 - DNA, 17 bp, Homo sapiens
ccatgctgccttcaggg

SEQ ID NO: 1810854 - DNA, 18 bp, Homo sapiens
ccatgctgccttcaggga

SEQ ID NO: 1810855 - DNA, 21 bp, Homo sapiens
ccatgctgctttttggcacag

SEQ ID NO: 1810856 - DNA, 14 bp, Homo sapiens
ccatggcaccagcc

SEQ ID NO: 1810857 - DNA, 12 bp, Homo sapiens
ccatggccttcc

SEQ ID NO: 1810858 - DNA, 14 bp, Homo sapiens
ccatgggcactgct

SEQ ID NO: 1810859 - DNA, 11 bp, Homo sapiens
ccatgggcctg

SEQ ID NO: 1810860 - DNA, 12 bp, Homo sapiens
ccatgggcctgg

SEQ ID NO: 1810861 - DNA, 14 bp, Homo sapiens
ccatggtgtgtcat

SEQ ID NO: 1810862 - DNA, 20 bp, Homo sapiens
ccatgtagaataaatgaaga

SEQ ID NO: 1810863 - DNA, 20 bp, Homo sapiens
ccattacaggggcagtgcct

SEQ ID NO: 1810864 - DNA, 19 bp, Homo sapiens
ccattacttgtataaatac

SEQ ID NO: 1810865 - DNA, 23 bp, Homo sapiens
ccattcatctctaacatatgata

SEQ ID NO: 1810866 - DNA, 18 bp, Homo sapiens
ccattcatgccaaagcaa

SEQ ID NO: 1810867 - DNA, 14 bp, Homo sapiens
ccattcccccatgt

SEQ ID NO: 1810868 - DNA, 17 bp, Homo sapiens
ccattcccccatgtggc

SEQ ID NO: 1810869 - DNA, 13 bp, Homo sapiens
ccattggtgttga

SEQ ID NO: 1810870 - DNA, 12 bp, Homo sapiens
cccaaaccccag

SEQ ID NO: 1810871 - DNA, 14 bp, Homo sapiens
cccaaaccccagcc

SEQ ID NO: 1810872 - DNA, 15 bp, Homo sapiens
cccaaaccccagccc

SEQ ID NO: 1810873 - DNA, 12 bp, Homo sapiens
cccaacccccag

SEQ ID NO: 1810874 - DNA, 14 bp, Homo sapiens
cccaacccccagca

SEQ ID NO: 1810875 - DNA, 15 bp, Homo sapiens
cccaacccccagcac

SEQ ID NO: 1810876 - DNA, 18 bp, Homo sapiens
cccaactccaggggcacc

SEQ ID NO: 1810877 - DNA, 23 bp, Homo sapiens
cccaaggagctgatttccaggcc

SEQ ID NO: 1810878 - DNA, 24 bp, Homo sapiens
cccaatgctttgggaggccaaggc

SEQ ID NO: 1810879 - DNA, 16 bp, Homo sapiens
cccacagagcctgaat

SEQ ID NO: 1810880 - DNA, 15 bp, Homo sapiens
cccacagcccacgtc

SEQ ID NO: 1810881 - DNA, 19 bp, Homo sapiens
cccacagcccacgtcctgt

SEQ ID NO: 1810882 - DNA, 18 bp, Homo sapiens
cccacagcttcctgaggg

SEQ ID NO: 1810883 - DNA, 19 bp, Homo sapiens
cccacagcttcctgagggc

SEQ ID NO: 1810884 - DNA, 21 bp, Homo sapiens
cccaccagaacgcaccccact

SEQ ID NO: 1810885 - DNA, 13 bp, Homo sapiens
cccacccatcttc

SEQ ID NO: 1810886 - DNA, 20 bp, Homo sapiens
cccacccatcttcctgctgc

SEQ ID NO: 1810887 - DNA, 23 bp, Homo sapiens
cccaccctcgtggacacctgccc

SEQ ID NO: 1810888 - DNA, 17 bp, Homo sapiens
cccaccgaggttcccag

SEQ ID NO: 1810889 - DNA, 18 bp, Homo sapiens
cccaccgaggttcccagg

SEQ ID NO: 1810890 - DNA, 19 bp, Homo sapiens
cccaccgaggttcccaggg

SEQ ID NO: 1810891 - DNA, 14 bp, Homo sapiens
cccaccgcatgccc

SEQ ID NO: 1810892 - DNA, 20 bp, Homo sapiens
cccaccgcatgccccctcgt

SEQ ID NO: 1810893 - DNA, 18 bp, Homo sapiens
cccacctcatgcctggcc

SEQ ID NO: 1810894 - DNA, 17 bp, Homo sapiens
cccacctgacaatggca

SEQ ID NO: 1810895 - DNA, 15 bp, Homo sapiens
cccacgagtcacctg

SEQ ID NO: 1810896 - DNA, 18 bp, Homo sapiens
cccacgagtcacctgcaa

SEQ ID NO: 1810897 - DNA, 22 bp, Homo sapiens
cccacgagtcacctgcaagccc

SEQ ID NO: 1810898 - DNA, 16 bp, Homo sapiens
cccactcaccagggtc

SEQ ID NO: 1810899 - DNA, 12 bp, Homo sapiens
cccactgcaccc

SEQ ID NO: 1810900 - DNA, 22 bp, Homo sapiens
cccactgcaccccctcctgctg

SEQ ID NO: 1810901 - DNA, 21 bp, Homo sapiens
cccacttagccgtccatggca

SEQ ID NO: 1810902 - DNA, 19 bp, Homo sapiens
cccacttccctgacactgc

SEQ ID NO: 1810903 - DNA, 20 bp, Homo sapiens
cccagaaagcctcctgcccc

SEQ ID NO: 1810904 - DNA, 18 bp, Homo sapiens
cccagagccactaccttt

SEQ ID NO: 1810905 - DNA, 19 bp, Homo sapiens
cccagaggttatctgcctg

SEQ ID NO: 1810906 - DNA, 20 bp, Homo sapiens
cccagaggttatctgcctgg

SEQ ID NO: 1810907 - DNA, 13 bp, Homo sapiens
cccagatctgcct

SEQ ID NO: 1810908 - DNA, 14 bp, Homo sapiens
cccagatctgcctg

SEQ ID NO: 1810909 - DNA, 16 bp, Homo sapiens
cccagatctgcctggg

SEQ ID NO: 1810910 - DNA, 19 bp, Homo sapiens
cccagatctgcctgggcct

SEQ ID NO: 1810911 - DNA, 17 bp, Homo sapiens
cccagcacaattcattg

SEQ ID NO: 1810912 - DNA, 13 bp, Homo sapiens
cccagccagccct

SEQ ID NO: 1810913 - DNA, 12 bp, Homo sapiens
cccagcccacag

SEQ ID NO: 1810914 - DNA, 16 bp, Homo sapiens
cccagcccacagagcc

SEQ ID NO: 1810915 - DNA, 16 bp, Homo sapiens
ccccctccaggcatgc

SEQ ID NO: 1810916 - DNA, 20 bp, Homo sapiens
ccccctccaggcatgctggc

SEQ ID NO: 1810917 - DNA, 18 bp, Homo sapiens
ccccctcgtgccagtcgc

SEQ ID NO: 1810918 - DNA, 19 bp, Homo sapiens
ccccgcccaggctggccag

SEQ ID NO: 1810919 - DNA, 16 bp, Homo sapiens
ccccgcggtgctctgg

SEQ ID NO: 1810920 - DNA, 13 bp, Homo sapiens
ccccggggctggc

SEQ ID NO: 1810921 - DNA, 15 bp, Homo sapiens
ccccggggctgggtt

SEQ ID NO: 1810922 - DNA, 18 bp, Homo sapiens
ccccggtgtgcggtgcat

SEQ ID NO: 1810923 - DNA, 17 bp, Homo sapiens
ccccgtcggactgcccc

SEQ ID NO: 1810924 - DNA, 19 bp, Homo sapiens
ccccgtcggactgccccca

SEQ ID NO: 1810925 - DNA, 21 bp, Homo sapiens
ccccgttccctgtcagaggct

SEQ ID NO: 1810926 - DNA, 16 bp, Homo sapiens
cccctcaccaggggca

SEQ ID NO: 1810927 - DNA, 20 bp, Homo sapiens
cccctccaggcatgctggcc

SEQ ID NO: 1810928 - DNA, 22 bp, Homo sapiens
cccctcccagacaggccctccc

SEQ ID NO: 1810929 - DNA, 16 bp, Homo sapiens
cccctccccagccagc

SEQ ID NO: 1810930 - DNA, 18 bp, Homo sapiens
cccctccccagccagccc

SEQ ID NO: 1810931 - DNA, 16 bp, Homo sapiens
cccctcccctggggac

SEQ ID NO: 1810932 - DNA, 18 bp, Homo sapiens
cccctcgtcctgtcccag

SEQ ID NO: 1810933 - DNA, 21 bp, Homo sapiens
cccctctgtcatcactccctg

SEQ ID NO: 1810934 - DNA, 13 bp, Homo sapiens
cccctcttgcccc

SEQ ID NO: 1810935 - DNA, 14 bp, Homo sapiens
cccctcttgcccca

SEQ ID NO: 1810936 - DNA, 15 bp, Homo sapiens
cccctcttgccccaa

SEQ ID NO: 1810937 - DNA, 16 bp, Homo sapiens
cccctgaggactggag

SEQ ID NO: 1810938 - DNA, 22 bp, Homo sapiens
cccctgcccgaccccatctcat

SEQ ID NO: 1810939 - DNA, 20 bp, Homo sapiens
cccctggggacgccaaggag

SEQ ID NO: 1810940 - DNA, 16 bp, Homo sapiens
cccctggtaagcagag

SEQ ID NO: 1810941 - DNA, 17 bp, Homo sapiens
ccccttttcagcttctg

SEQ ID NO: 1810942 - DNA, 16 bp, Homo sapiens
ccccttttgcctggct

SEQ ID NO: 1810943 - DNA, 17 bp, Homo sapiens
ccccttttgcctggctg

SEQ ID NO: 1810944 - DNA, 18 bp, Homo sapiens
ccccttttgcctggctgt

SEQ ID NO: 1810945 - DNA, 19 bp, Homo sapiens
ccccttttgcctggctgtg

SEQ ID NO: 1810946 - DNA, 20 bp, Homo sapiens
ccccttttgcctggctgtgg

SEQ ID NO: 1810947 - DNA, 23 bp, Homo sapiens
ccccttttgcctggctgtggagg

SEQ ID NO: 1810948 - DNA, 19 bp, Homo sapiens
cccgaacctcacctgacct

SEQ ID NO: 1810949 - DNA, 14 bp, Homo sapiens
cccgcccaggctgg

SEQ ID NO: 1810950 - DNA, 15 bp, Homo sapiens
cccgcccaggctggc

SEQ ID NO: 1810951 - DNA, 22 bp, Homo sapiens
cccgcccaggctggccagcccc

SEQ ID NO: 1810952 - DNA, 17 bp, Homo sapiens
cccgccttcctcctcca

SEQ ID NO: 1810953 - DNA, 19 bp, Homo sapiens
cccgccttcctcctccaca

SEQ ID NO: 1810954 - DNA, 20 bp, Homo sapiens
cccgcggtgctctggcggct

SEQ ID NO: 1810955 - DNA, 11 bp, Homo sapiens
cccgcttgcct

SEQ ID NO: 1810956 - DNA, 15 bp, Homo sapiens
cccgcttgcctcggc

SEQ ID NO: 1810957 - DNA, 20 bp, Homo sapiens
cccgcttgcctcggctcctg

SEQ ID NO: 1810958 - DNA, 22 bp, Homo sapiens
cccgcttgcctcggctcctgct

SEQ ID NO: 1810959 - DNA, 15 bp, Homo sapiens
cccggagcacagccc

SEQ ID NO: 1810960 - DNA, 20 bp, Homo sapiens
cccggagcacagccctggga

SEQ ID NO: 1810961 - DNA, 17 bp, Homo sapiens
cccggcctcttccaccc

SEQ ID NO: 1810962 - DNA, 16 bp, Homo sapiens
cccggcgccctctgtc

SEQ ID NO: 1810963 - DNA, 18 bp, Homo sapiens
cccggcgccctctgtcct

SEQ ID NO: 1810964 - DNA, 14 bp, Homo sapiens
cccggctgcctgcc

SEQ ID NO: 1810965 - DNA, 13 bp, Homo sapiens
cccgggaggggcc

SEQ ID NO: 1810966 - DNA, 12 bp, Homo sapiens
cccggggctggc

SEQ ID NO: 1810967 - DNA, 23 bp, Homo sapiens
cccggggctggcaagcagggaaa

SEQ ID NO: 1810968 - DNA, 19 bp, Homo sapiens
cccgtcggactgcccccag

SEQ ID NO: 1810969 - DNA, 23 bp, Homo sapiens
cccgtcggactgcccccagaaag

SEQ ID NO: 1810970 - DNA, 15 bp, Homo sapiens
cccgtgaagcagtgc

SEQ ID NO: 1810971 - DNA, 18 bp, Homo sapiens
cccgtgcagtacaggcaa

SEQ ID NO: 1810972 - DNA, 13 bp, Homo sapiens
cccgtggccccag

SEQ ID NO: 1810973 - DNA, 14 bp, Homo sapiens
cccgtggccccagc

SEQ ID NO: 1810974 - DNA, 21 bp, Homo sapiens
cccgtggccccagcctggccc

SEQ ID NO: 1810975 - DNA, 22 bp, Homo sapiens
cccgtggccccagcctggccca

SEQ ID NO: 1810976 - DNA, 16 bp, Homo sapiens
ccctcaaggcctccca

SEQ ID NO: 1810977 - DNA, 13 bp, Homo sapiens
ccctcagcccttg

SEQ ID NO: 1810978 - DNA, 19 bp, Homo sapiens
ccctcagcccttgccccca

SEQ ID NO: 1810979 - DNA, 14 bp, Homo sapiens
ccctccaggcatgc

SEQ ID NO: 1810980 - DNA, 13 bp, Homo sapiens
ccctccatgggct

SEQ ID NO: 1810981 - DNA, 21 bp, Homo sapiens
ccctcccagacaggccctccc

SEQ ID NO: 1810982 - DNA, 20 bp, Homo sapiens
ccctcccagctgacagtcct

SEQ ID NO: 1810983 - DNA, 16 bp, Homo sapiens
ccctccccagccagcc

SEQ ID NO: 1810984 - DNA, 15 bp, Homo sapiens
ccctccccagccctt

SEQ ID NO: 1810985 - DNA, 12 bp, Homo sapiens
ccctcccctccc

SEQ ID NO: 1810986 - DNA, 14 bp, Homo sapiens
ccctcccgcccctt

SEQ ID NO: 1810987 - DNA, 16 bp, Homo sapiens
ccctccctctgcccca

SEQ ID NO: 1810988 - DNA, 14 bp, Homo sapiens
ccctccctgcctgc

SEQ ID NO: 1810989 - DNA, 18 bp, Homo sapiens
ccctccctgcctgctcct

SEQ ID NO: 1810990 - DNA, 14 bp, Homo sapiens
ctgtccagtttcca

SEQ ID NO: 1810991 - DNA, 23 bp, Homo sapiens
ctgtccataaagtaattttgtga

SEQ ID NO: 1810992 - DNA, 11 bp, Homo sapiens
ctgtcccagag

SEQ ID NO: 1810993 - DNA, 23 bp, Homo sapiens
ctgtcccagaggttatctgcctg

SEQ ID NO: 1810994 - DNA, 12 bp, Homo sapiens
ctgtcccctctt

SEQ ID NO: 1810995 - DNA, 17 bp, Homo sapiens
ctgtcccctcttgcccc

SEQ ID NO: 1810996 - DNA, 19 bp, Homo sapiens
ctgtcccctcttgccccaa

SEQ ID NO: 1810997 - DNA, 21 bp, Homo sapiens
ctgtcccgccttcctcctcca

SEQ ID NO: 1810998 - DNA, 20 bp, Homo sapiens
ctgtcctgacttcaggggct

SEQ ID NO: 1810999 - DNA, 13 bp, Homo sapiens
ctgtctcagactc

SEQ ID NO: 1811000 - DNA, 21 bp, Homo sapiens
ctgtctggaagacgtggctct

SEQ ID NO: 1811001 - DNA, 17 bp, Homo sapiens
ctgtctgtctgtcccaa

SEQ ID NO: 1811002 - DNA, 18 bp, Homo sapiens
ctgtcttgagagaaaaga

SEQ ID NO: 1811003 - DNA, 18 bp, Homo sapiens
ctgtgaaagtctcctgta

SEQ ID NO: 1811004 - DNA, 18 bp, Homo sapiens
ctgtgaactattttgaag

SEQ ID NO: 1811005 - DNA, 21 bp, Homo sapiens
ctgtgaactattttgaagaaa

SEQ ID NO: 1811006 - DNA, 22 bp, Homo sapiens
ctgtgaactattttgaagaaaa

SEQ ID NO: 1811007 - DNA, 15 bp, Homo sapiens
ctgtgaatatgagaa

SEQ ID NO: 1811008 - DNA, 18 bp, Homo sapiens
ctgtgacacagctgagct

SEQ ID NO: 1811009 - DNA, 21 bp, Homo sapiens
ctgtgactactatggctgttt

SEQ ID NO: 1811010 - DNA, 13 bp, Homo sapiens
ctgtgcagcagcc

SEQ ID NO: 1811011 - DNA, 15 bp, Homo sapiens
ctgtgcagcagccca

SEQ ID NO: 1811012 - DNA, 16 bp, Homo sapiens
ctgtgcagcagcccag

SEQ ID NO: 1811013 - DNA, 18 bp, Homo sapiens
cttctgccacttcccagg

SEQ ID NO: 1811014 - DNA, 17 bp, Homo sapiens
cttctgctgggctgggg

SEQ ID NO: 1811015 - DNA, 14 bp, Homo sapiens
cttctggaaggctg

SEQ ID NO: 1811016 - DNA, 15 bp, Homo sapiens
cttctggaaggctgg

SEQ ID NO: 1811017 - DNA, 18 bp, Homo sapiens
cttctggaaggctggctg

SEQ ID NO: 1811018 - DNA, 22 bp, Homo sapiens
cttctgtatgtgacaacatttt

SEQ ID NO: 1811019 - DNA, 15 bp, Homo sapiens
cttcttaaaggcctg

SEQ ID NO: 1811020 - DNA, 16 bp, Homo sapiens
cttcttaaaggcctgg

SEQ ID NO: 1811021 - DNA, 17 bp, Homo sapiens
cttcttaaaggcctgga

SEQ ID NO: 1811022 - DNA, 20 bp, Homo sapiens
cttcttcgcaaactgatgga

SEQ ID NO: 1811023 - DNA, 16 bp, Homo sapiens
cttctttgcagagcct

SEQ ID NO: 1811024 - DNA, 17 bp, Homo sapiens
cttgaattttcccactg

SEQ ID NO: 1811025 - DNA, 18 bp, Homo sapiens
cttgaattttcccactgc

SEQ ID NO: 1811026 - DNA, 19 bp, Homo sapiens
cttgaattttcccactgca

SEQ ID NO: 1811027 - DNA, 21 bp, Homo sapiens
cttgaattttcccactgcacc

SEQ ID NO: 1811028 - DNA, 22 bp, Homo sapiens
cttgaattttcccactgcaccc

SEQ ID NO: 1811029 - DNA, 20 bp, Homo sapiens
cttgagagaaaaagtgcccc

SEQ ID NO: 1811030 - DNA, 20 bp, Homo sapiens
cttgagagaaaagaaaaata

SEQ ID NO: 1811031 - DNA, 11 bp, Homo sapiens
cttgagcccag

SEQ ID NO: 1811032 - DNA, 18 bp, Homo sapiens
cttgaggacacatgtcca

SEQ ID NO: 1811033 - DNA, 21 bp, Homo sapiens
cttgccccaacccccagcacc

SEQ ID NO: 1811034 - DNA, 16 bp, Homo sapiens
cttgcccccatccctc

SEQ ID NO: 1811035 - DNA, 18 bp, Homo sapiens
cttgcccccatccctcgg

SEQ ID NO: 1811036 - DNA, 14 bp, Homo sapiens
cttgcccgctccca

SEQ ID NO: 1811037 - DNA, 14 bp, Homo sapiens
cttgcctaggccaa

SEQ ID NO: 1811038 - DNA, 15 bp, Homo sapiens
cttgcctcggctcct

SEQ ID NO: 1811039 - DNA, 15 bp, Homo sapiens
cttgcgtcctgcaga

SEQ ID NO: 1811040 - DNA, 12 bp, Homo sapiens
cttgctccaggg

SEQ ID NO: 1811041 - DNA, 15 bp, Homo sapiens
cttgctccagggtct

SEQ ID NO: 1811042 - DNA, 13 bp, Homo sapiens
cttgctgaaaaac

SEQ ID NO: 1811043 - DNA, 21 bp, Homo sapiens
cttgctttgggctttgcaggc

SEQ ID NO: 1811044 - DNA, 13 bp, Homo sapiens
cttgctttttcaa

SEQ ID NO: 1811045 - DNA, 23 bp, Homo sapiens
cttggacttcctggggccccgct

SEQ ID NO: 1811046 - DNA, 14 bp, Homo sapiens
cttggcacccccat

SEQ ID NO: 1811047 - DNA, 20 bp, Homo sapiens
cttggcacccccatgctgcc

SEQ ID NO: 1811048 - DNA, 23 bp, Homo sapiens
cttggcttcctccgtccacccag

SEQ ID NO: 1811049 - DNA, 17 bp, Homo sapiens
cttgggcatccacccag

SEQ ID NO: 1811050 - DNA, 23 bp, Homo sapiens
cttgggcatccacccagtgctgc

SEQ ID NO: 1811051 - DNA, 24 bp, Homo sapiens
cttgggcatccacccagtgctgcc

SEQ ID NO: 1811052 - DNA, 13 bp, Homo sapiens
cttgggctactgg

SEQ ID NO: 1811053 - DNA, 20 bp, Homo sapiens
cttgggctactggcagctcc

SEQ ID NO: 1811054 - DNA, 21 bp, Homo sapiens
cttgggctactggcagctcct

SEQ ID NO: 1811055 - DNA, 17 bp, Homo sapiens
cttgggctcctggctgc

SEQ ID NO: 1811056 - DNA, 18 bp, Homo sapiens
cttgggctcctggctgcc

SEQ ID NO: 1811057 - DNA, 20 bp, Homo sapiens
cttgggctcctggctgccag

SEQ ID NO: 1811058 - DNA, 22 bp, Homo sapiens
cttgggctcctggctgccaggc

SEQ ID NO: 1811059 - DNA, 13 bp, Homo sapiens
cttggggcctggc

SEQ ID NO: 1811060 - DNA, 13 bp, Homo sapiens
cttggtccctggt

SEQ ID NO: 1811061 - DNA, 20 bp, Homo sapiens
cttgtatggctctcaagtga

SEQ ID NO: 1811062 - DNA, 21 bp, Homo sapiens
cttgtatggctctcaagtgaa

SEQ ID NO: 1811063 - DNA, 22 bp, Homo sapiens
cttgtatggctctcaagtgaaa

SEQ ID NO: 1811064 - DNA, 13 bp, Homo sapiens
cttgtcctgccag

SEQ ID NO: 1811065 - DNA, 17 bp, Homo sapiens
cttgtctgaggcctcat

SEQ ID NO: 1811066 - DNA, 19 bp, Homo sapiens
cttgtctgaggcctcatcc

SEQ ID NO: 1811067 - DNA, 20 bp, Homo sapiens
cttgtctgaggcctcatccc

SEQ ID NO: 1811068 - DNA, 17 bp, Homo sapiens
cttgtctttactgacaa

SEQ ID NO: 1811069 - DNA, 14 bp, Homo sapiens
cttgtgactgaagg

SEQ ID NO: 1811070 - DNA, 18 bp, Homo sapiens
cttgtgactgaaggggca

SEQ ID NO: 1811071 - DNA, 16 bp, Homo sapiens
cttgtgccctgccccc

SEQ ID NO: 1811072 - DNA, 22 bp, Homo sapiens
cttgtgcttggtggggctcgtg

SEQ ID NO: 1811073 - DNA, 19 bp, Homo sapiens
ctttaataagtcattgaaa

SEQ ID NO: 1811074 - DNA, 15 bp, Homo sapiens
ctttacaactaaata

SEQ ID NO: 1811075 - DNA, 21 bp, Homo sapiens
ctttacatttgataaactaaa

SEQ ID NO: 1811076 - DNA, 13 bp, Homo sapiens
ctttaccactatg

SEQ ID NO: 1811077 - DNA, 18 bp, Homo sapiens
ctttacgctgtctgtaat

SEQ ID NO: 1811078 - DNA, 12 bp, Homo sapiens
ctttactccctt

SEQ ID NO: 1811079 - DNA, 18 bp, Homo sapiens
ctttactcccttcctggc

SEQ ID NO: 1811080 - DNA, 19 bp, Homo sapiens
ctttactcccttcctggcc

SEQ ID NO: 1811081 - DNA, 22 bp, Homo sapiens
ctttatatgaagtattaaaatg

SEQ ID NO: 1811082 - DNA, 13 bp, Homo sapiens
ctttcaatatcat

SEQ ID NO: 1811083 - DNA, 14 bp, Homo sapiens
ctttcaatatcatt

SEQ ID NO: 1811084 - DNA, 13 bp, Homo sapiens
ctttcatacatta

SEQ ID NO: 1811085 - DNA, 15 bp, Homo sapiens
ctttcatacattata

SEQ ID NO: 1811086 - DNA, 22 bp, Homo sapiens
ctttcatacattatattcctct

SEQ ID NO: 1811087 - DNA, 13 bp, Homo sapiens
ctttcctttgcac

SEQ ID NO: 1811088 - DNA, 19 bp, Homo sapiens
ctttctcccccgacactgc

SEQ ID NO: 1811089 - DNA, 21 bp, Homo sapiens
ctttctcccccgacactgctg

SEQ ID NO: 1811090 - DNA, 22 bp, Homo sapiens
ctttctcccccgacactgctgc

SEQ ID NO: 1811091 - DNA, 20 bp, Homo sapiens
ctttctccggggtctgtgct

SEQ ID NO: 1811092 - DNA, 12 bp, Homo sapiens
ctttctcctttg

SEQ ID NO: 1811093 - DNA, 12 bp, Homo sapiens
ctttctgtagta

SEQ ID NO: 1811094 - DNA, 23 bp, Homo sapiens
ctttgaaggaaagctaagtcttg

SEQ ID NO: 1811095 - DNA, 14 bp, Homo sapiens
ctttgacctgttgg

SEQ ID NO: 1811096 - DNA, 17 bp, Homo sapiens
ctttgatattgagacat

SEQ ID NO: 1811097 - DNA, 18 bp, Homo sapiens
ctttgcaccatgtgaagt

SEQ ID NO: 1811098 - DNA, 13 bp, Homo sapiens
ctttgcaggctct

SEQ ID NO: 1811099 - DNA, 18 bp, Homo sapiens
ctttgcaggctctgggct

SEQ ID NO: 1811100 - DNA, 23 bp, Homo sapiens
ctttgccaaggctctcccctctc

SEQ ID NO: 1811101 - DNA, 15 bp, Homo sapiens
ctttgctgcccctgt

SEQ ID NO: 1811102 - DNA, 16 bp, Homo sapiens
ctttgctgcccctgtc

SEQ ID NO: 1811103 - DNA, 11 bp, Homo sapiens
ctttggcccaa

SEQ ID NO: 1811104 - DNA, 19 bp, Homo sapiens
ctttgggacacctcagaaa

SEQ ID NO: 1811105 - DNA, 18 bp, Homo sapiens
ctttgggaggccaaggca

SEQ ID NO: 1811106 - DNA, 17 bp, Homo sapiens
ctttgggctttgcaggc

SEQ ID NO: 1811107 - DNA, 19 bp, Homo sapiens
ctttggggacagttggcag

SEQ ID NO: 1811108 - DNA, 21 bp, Homo sapiens
ctttggggacagttggcagag

SEQ ID NO: 1811109 - DNA, 20 bp, Homo sapiens
ctttgggttggagctgttcc

SEQ ID NO: 1811110 - DNA, 11 bp, Homo sapiens
ctttgtagaac

SEQ ID NO: 1811111 - DNA, 19 bp, Homo sapiens
cttttaaaagaaaaagtat

SEQ ID NO: 1811112 - DNA, 22 bp, Homo sapiens
cttttataaacctctaatttat

SEQ ID NO: 1811113 - DNA, 18 bp, Homo sapiens
cttttgcaacaagacaaa

SEQ ID NO: 1811114 - DNA, 13 bp, Homo sapiens
cttttgcctggct

SEQ ID NO: 1811115 - DNA, 15 bp, Homo sapiens
cttttgcctggctgt

SEQ ID NO: 1811116 - DNA, 14 bp, Homo sapiens
cttttgtcccagaa

SEQ ID NO: 1811117 - DNA, 15 bp, Homo sapiens
cttttgtccccaggg

SEQ ID NO: 1811118 - DNA, 12 bp, Homo sapiens
cttttgtgaaag

SEQ ID NO: 1811119 - DNA, 12 bp, Homo sapiens
ctttttccagaa

SEQ ID NO: 1811120 - DNA, 18 bp, Homo sapiens
ctttttgaaaaaagtata

SEQ ID NO: 1811121 - DNA, 14 bp, Homo sapiens
ctttttgtacctgg

SEQ ID NO: 1811122 - DNA, 14 bp, Homo sapiens
ctttttttctctcc

SEQ ID NO: 1811123 - DNA, 19 bp, Homo sapiens
gaaaacctcatttaccata

SEQ ID NO: 1811124 - DNA, 21 bp, Homo sapiens
gaaaacttattaacaactgtg

SEQ ID NO: 1811125 - DNA, 13 bp, Homo sapiens
gaaaagcctctgt

SEQ ID NO: 1811126 - DNA, 14 bp, Homo sapiens
gaaaaggttttatt

SEQ ID NO: 1811127 - DNA, 17 bp, Homo sapiens
gaaaaggttttattttg

SEQ ID NO: 1811128 - DNA, 15 bp, Homo sapiens
gaaaatgcattatgt

SEQ ID NO: 1811129 - DNA, 17 bp, Homo sapiens
gaaacaaataaactagt

SEQ ID NO: 1811130 - DNA, 23 bp, Homo sapiens
ctcaggccgaaggaggagtcagg

SEQ ID NO: 1811131 - DNA, 15 bp, Homo sapiens
ctcagggaccacagc

SEQ ID NO: 1811132 - DNA, 16 bp, Homo sapiens
ctcagggaccacagca

SEQ ID NO: 1811133 - DNA, 11 bp, Homo sapiens
ctcagggctgg

SEQ ID NO: 1811134 - DNA, 15 bp, Homo sapiens
ctcagggctggagtg

SEQ ID NO: 1811135 - DNA, 22 bp, Homo sapiens
ctcagggctggagtgcgctctt

SEQ ID NO: 1811136 - DNA, 16 bp, Homo sapiens
ctcaggtgccactccc

SEQ ID NO: 1811137 - DNA, 23 bp, Homo sapiens
ctcaggtgccactccctgagctt

SEQ ID NO: 1811138 - DNA, 13 bp, Homo sapiens
ctcagtgctctcc

SEQ ID NO: 1811139 - DNA, 20 bp, Homo sapiens
ctcatcccctcgtcctgtcc

SEQ ID NO: 1811140 - DNA, 22 bp, Homo sapiens
ctcatcccctcgtcctgtccca

SEQ ID NO: 1811141 - DNA, 23 bp, Homo sapiens
ctcatgatagaaggctatgggga

SEQ ID NO: 1811142 - DNA, 14 bp, Homo sapiens
ctcatgccacacct

SEQ ID NO: 1811143 - DNA, 17 bp, Homo sapiens
ctcatgccacaccttct

SEQ ID NO: 1811144 - DNA, 20 bp, Homo sapiens
ctcatgcctggcccccctcc

SEQ ID NO: 1811145 - DNA, 20 bp, Homo sapiens
ctcatggcgtaatgggcctg

SEQ ID NO: 1811146 - DNA, 21 bp, Homo sapiens
ctcatggcgtaatgggcctgc

SEQ ID NO: 1811147 - DNA, 22 bp, Homo sapiens
ctcattggggttgcaacaataa

SEQ ID NO: 1811148 - DNA, 18 bp, Homo sapiens
ctcattttactaaaatcg

SEQ ID NO: 1811149 - DNA, 23 bp, Homo sapiens
ctccacagggacacagtctggtg

SEQ ID NO: 1811150 - DNA, 13 bp, Homo sapiens
ctccacagtgctg

SEQ ID NO: 1811151 - DNA, 20 bp, Homo sapiens
ctccacctagtggctgtcca

SEQ ID NO: 1811152 - DNA, 20 bp, Homo sapiens
ctccacggtgcgtggctgtg

SEQ ID NO: 1811153 - DNA, 21 bp, Homo sapiens
ctccactcccccacctgacaa

SEQ ID NO: 1811154 - DNA, 14 bp, Homo sapiens
ctccagaatctgct

SEQ ID NO: 1811155 - DNA, 15 bp, Homo sapiens
ctccagaatctgctg

SEQ ID NO: 1811156 - DNA, 14 bp, Homo sapiens
ctccagagccagcc

SEQ ID NO: 1811157 - DNA, 15 bp, Homo sapiens
ctccagagccagcct

SEQ ID NO: 1811158 - DNA, 19 bp, Homo sapiens
ctccagagccagcctggga

SEQ ID NO: 1811159 - DNA, 20 bp, Homo sapiens
ctccagagccagcctgggac

SEQ ID NO: 1811160 - DNA, 12 bp, Homo sapiens
ctccagagtctg

SEQ ID NO: 1811161 - DNA, 23 bp, Homo sapiens
ctccagagtctgagcccccggct

SEQ ID NO: 1811162 - DNA, 14 bp, Homo sapiens
ctccagcatccagc

SEQ ID NO: 1811163 - DNA, 15 bp, Homo sapiens
ctccagcatccagcc

SEQ ID NO: 1811164 - DNA, 16 bp, Homo sapiens
ctccagcatccagcct

SEQ ID NO: 1811165 - DNA, 20 bp, Homo sapiens
ctccagcatccagcctgtgt

SEQ ID NO: 1811166 - DNA, 18 bp, Homo sapiens
ctccagccacttatttcc

SEQ ID NO: 1811167 - DNA, 13 bp, Homo sapiens
ctccagcctcccc

SEQ ID NO: 1811168 - DNA, 12 bp, Homo sapiens
ctccagcctctc

SEQ ID NO: 1811169 - DNA, 18 bp, Homo sapiens
ctccagcctctcccggct

SEQ ID NO: 1811170 - DNA, 21 bp, Homo sapiens
ctccagcctctcccggctgcc

SEQ ID NO: 1811171 - DNA, 22 bp, Homo sapiens
ctccagcctctcccggctgcct

SEQ ID NO: 1811172 - DNA, 14 bp, Homo sapiens
gacaatggcagcta

SEQ ID NO: 1811173 - DNA, 15 bp, Homo sapiens
gacaatggcagctag

SEQ ID NO: 1811174 - DNA, 17 bp, Homo sapiens
gacaccgtttgtccccc

SEQ ID NO: 1811175 - DNA, 15 bp, Homo sapiens
gacacctaccatgct

SEQ ID NO: 1811176 - DNA, 13 bp, Homo sapiens
gacacctgccctg

SEQ ID NO: 1811177 - DNA, 22 bp, Homo sapiens
gacacctgccctgccctgccac

SEQ ID NO: 1811178 - DNA, 23 bp, Homo sapiens
gacacctgccctgccctgccacc

SEQ ID NO: 1811179 - DNA, 19 bp, Homo sapiens
gacactgcggggcttggct

SEQ ID NO: 1811180 - DNA, 19 bp, Homo sapiens
gacactgctgcaccagagt

SEQ ID NO: 1811181 - DNA, 20 bp, Homo sapiens
gacactttgccaaggctctc

SEQ ID NO: 1811182 - DNA, 19 bp, Homo sapiens
gacaggccctccctgtctc

SEQ ID NO: 1811183 - DNA, 20 bp, Homo sapiens
gacaggccctccctgtctcc

SEQ ID NO: 1811184 - DNA, 14 bp, Homo sapiens
gacagtcacttcct

SEQ ID NO: 1811185 - DNA, 19 bp, Homo sapiens
gaggcctcagtttctccat

SEQ ID NO: 1811186 - DNA, 14 bp, Homo sapiens
gaggcctgatgctg

SEQ ID NO: 1811187 - DNA, 17 bp, Homo sapiens
gaggcctgatgctgccc

SEQ ID NO: 1811188 - DNA, 16 bp, Homo sapiens
gaggctggctggggcc

SEQ ID NO: 1811189 - DNA, 23 bp, Homo sapiens
gaggctttggggtcctagcccag

SEQ ID NO: 1811190 - DNA, 18 bp, Homo sapiens
gagggaccaaattgcttc

SEQ ID NO: 1811191 - DNA, 20 bp, Homo sapiens
gagggagggggcgctcagga

SEQ ID NO: 1811192 - DNA, 16 bp, Homo sapiens
gagggcagagccatgg

SEQ ID NO: 1811193 - DNA, 15 bp, Homo sapiens
gagggcagtacctgg

SEQ ID NO: 1811194 - DNA, 17 bp, Homo sapiens
gagggcagtacctggga

SEQ ID NO: 1811195 - DNA, 17 bp, Homo sapiens
gagggcagtggggagca

SEQ ID NO: 1811196 - DNA, 18 bp, Homo sapiens
gagggcccagctgtagcc

SEQ ID NO: 1811197 - DNA, 22 bp, Homo sapiens
gagggcccagctgtagccatgg

SEQ ID NO: 1811198 - DNA, 16 bp, Homo sapiens
gagggcttggggctgc

SEQ ID NO: 1811199 - DNA, 13 bp, Homo sapiens
gaggggcagccgc

SEQ ID NO: 1811200 - DNA, 23 bp, Homo sapiens
gagggtggaggaaggtgctgagc

SEQ ID NO: 1811201 - DNA, 20 bp, Homo sapiens
gaggtctcgctgatgctggg

SEQ ID NO: 1811202 - DNA, 23 bp, Homo sapiens
gaggtctcgctgatgctgggctg

SEQ ID NO: 1811203 - DNA, 15 bp, Homo sapiens
gaggtgggcagctgg

SEQ ID NO: 1811204 - DNA, 14 bp, Homo sapiens
gaggttaaggtggg

SEQ ID NO: 1811205 - DNA, 16 bp, Homo sapiens
gaggttatctgcctgg

SEQ ID NO: 1811206 - DNA, 20 bp, Homo sapiens
gaggttatctgcctggcctg

SEQ ID NO: 1811207 - DNA, 21 bp, Homo sapiens
gaggttatctgcctggcctgg

SEQ ID NO: 1811208 - DNA, 22 bp, Homo sapiens
gaggtttgtttagaagaagtgt

SEQ ID NO: 1811209 - DNA, 18 bp, Homo sapiens
gagtcagggagagctgaa

SEQ ID NO: 1811210 - DNA, 14 bp, Homo sapiens
gagtccctgccatc

SEQ ID NO: 1811211 - DNA, 12 bp, Homo sapiens
gagtctgagccc

SEQ ID NO: 1811212 - DNA, 13 bp, Homo sapiens
gagtctgagcccc

SEQ ID NO: 1811213 - DNA, 14 bp, Homo sapiens
gagtgaaagggcta

SEQ ID NO: 1811214 - DNA, 22 bp, Homo sapiens
gagtgaaagggctatggcaagg

SEQ ID NO: 1811215 - DNA, 15 bp, Homo sapiens
gagtgaggcttccag

SEQ ID NO: 1811216 - DNA, 20 bp, Homo sapiens
gagtgaggcttccaggctct

SEQ ID NO: 1811217 - DNA, 16 bp, Homo sapiens
gagtgcagagaaagaa

SEQ ID NO: 1811218 - DNA, 21 bp, Homo sapiens
gagtggaatgcagggaagagg

SEQ ID NO: 1811219 - DNA, 13 bp, Homo sapiens
gagtggcagccat

SEQ ID NO: 1811220 - DNA, 16 bp, Homo sapiens
gagtggcagccatgcc

SEQ ID NO: 1811221 - DNA, 18 bp, Homo sapiens
gagtggcattggcagcag

SEQ ID NO: 1811222 - DNA, 22 bp, Homo sapiens
gagtgtgtaatttaaaattgtg

SEQ ID NO: 1811223 - DNA, 18 bp, Homo sapiens
gagttacttgtctgaggc

SEQ ID NO: 1811224 - DNA, 12 bp, Homo sapiens
gagttctttgct

SEQ ID NO: 1811225 - DNA, 22 bp, Homo sapiens
gagttctttgctgcccctgtct

SEQ ID NO: 1811226 - DNA, 12 bp, Homo sapiens
gagtttctttca

SEQ ID NO: 1811227 - DNA, 21 bp, Homo sapiens
gagtttgagacaagccctggc

SEQ ID NO: 1811228 - DNA, 14 bp, Homo sapiens
gataaattacatta

SEQ ID NO: 1811229 - DNA, 15 bp, Homo sapiens
gataaccccaagaca

SEQ ID NO: 1811230 - DNA, 22 bp, Homo sapiens
gataccataaaaagaggatgat

SEQ ID NO: 1811231 - DNA, 22 bp, Homo sapiens
gatatatatttactaaaagaat

SEQ ID NO: 1811232 - DNA, 18 bp, Homo sapiens
gatatcagagctgggaaa

SEQ ID NO: 1811233 - DNA, 20 bp, Homo sapiens
gatatctgtttgcttctaaa

SEQ ID NO: 1811234 - DNA, 21 bp, Homo sapiens
gatattgttataaataaaatt

SEQ ID NO: 1811235 - DNA, 22 bp, Homo sapiens
gatcaaaatcaaaaggtaatgc

SEQ ID NO: 1811236 - DNA, 14 bp, Homo sapiens
gatcattatcagcc

SEQ ID NO: 1811237 - DNA, 20 bp, Homo sapiens
gatcattggtatctgatatc

SEQ ID NO: 1811238 - DNA, 15 bp, Homo sapiens
gatccgctgccacca

SEQ ID NO: 1811239 - DNA, 12 bp, Homo sapiens
gatcctgcagga

SEQ ID NO: 1811240 - DNA, 22 bp, Homo sapiens
gatcctgcaggaacgagcactg

SEQ ID NO: 1811241 - DNA, 23 bp, Homo sapiens
gatcctgcaggaacgagcactgg

SEQ ID NO: 1811242 - DNA, 22 bp, Homo sapiens
gatccttgtctttactgacaag

SEQ ID NO: 1811243 - DNA, 13 bp, Homo sapiens
gatcgctgtgtta

SEQ ID NO: 1811244 - DNA, 18 bp, Homo sapiens
gatctgatggtgagctgg

SEQ ID NO: 1811245 - DNA, 13 bp, Homo sapiens
gatctgcctgggc

SEQ ID NO: 1811246 - DNA, 15 bp, Homo sapiens
gatctgcctgggcct

SEQ ID NO: 1811247 - DNA, 21 bp, Homo sapiens
gatctgcctgggcctgtgcag

SEQ ID NO: 1811248 - DNA, 16 bp, Homo sapiens
gatctttcaatatcat

SEQ ID NO: 1811249 - DNA, 19 bp, Homo sapiens
gatgatttcagaaggagaa

SEQ ID NO: 1811250 - DNA, 21 bp, Homo sapiens
gatgccacaccaagctgtgcc

SEQ ID NO: 1811251 - DNA, 23 bp, Homo sapiens
gatgctgccccgttccctgtcag

SEQ ID NO: 1811252 - DNA, 14 bp, Homo sapiens
gatgctgggctggg

SEQ ID NO: 1811253 - DNA, 15 bp, Homo sapiens
gatgctgggctgggt

SEQ ID NO: 1811254 - DNA, 23 bp, Homo sapiens
gatggaccgggtgggcctggcct

SEQ ID NO: 1811255 - DNA, 13 bp, Homo sapiens
gatggccatgctc

SEQ ID NO: 1811256 - DNA, 13 bp, Homo sapiens
gatggcgcgggag

SEQ ID NO: 1811257 - DNA, 16 bp, Homo sapiens
gatggcgcgggaggca

SEQ ID NO: 1811258 - DNA, 17 bp, Homo sapiens
gatggcgcgggaggcac

SEQ ID NO: 1811259 - DNA, 21 bp, Homo sapiens
gatgggcattgggctgacacc

SEQ ID NO: 1811260 - DNA, 19 bp, Homo sapiens
gatgtggatggaggtgatg

SEQ ID NO: 1811261 - DNA, 13 bp, Homo sapiens
gattatatatcat

SEQ ID NO: 1811262 - DNA, 19 bp, Homo sapiens
gattatatatcataaagta

SEQ ID NO: 1811263 - DNA, 20 bp, Homo sapiens
gattattgatcaaaatcaaa

SEQ ID NO: 1811264 - DNA, 18 bp, Homo sapiens
gattcctcccccagagcc

SEQ ID NO: 1811265 - DNA, 13 bp, Homo sapiens
gattcggctgtct

SEQ ID NO: 1811266 - DNA, 23 bp, Homo sapiens
gattgaaaggacctcttctgaag

SEQ ID NO: 1811267 - DNA, 14 bp, Homo sapiens
gatttccaggcccc

SEQ ID NO: 1811268 - DNA, 15 bp, Homo sapiens
gatttctaagttaaa

SEQ ID NO: 1811269 - DNA, 23 bp, Homo sapiens
gattttcttttgttttcttcatt

SEQ ID NO: 1811270 - DNA, 21 bp, Homo sapiens
gatttttgctcttctgtatgt

SEQ ID NO: 1811271 - DNA, 16 bp, Homo sapiens
gcaaaagaagtaaaag

SEQ ID NO: 1811272 - DNA, 21 bp, Homo sapiens
gcaaaagtggggctaaatgaa

SEQ ID NO: 1811273 - DNA, 23 bp, Homo sapiens
gcaaagtgctgtacccttccacc

SEQ ID NO: 1811274 - DNA, 13 bp, Homo sapiens
gcaaagttatatt

SEQ ID NO: 1811275 - DNA, 15 bp, Homo sapiens
gcaaattagaaacac

SEQ ID NO: 1811276 - DNA, 18 bp, Homo sapiens
gcaacagcactttctgta

SEQ ID NO: 1811277 - DNA, 20 bp, Homo sapiens
gcaacccctgtacccagctc

SEQ ID NO: 1811278 - DNA, 15 bp, Homo sapiens
gcaagccccagggcc

SEQ ID NO: 1811279 - DNA, 16 bp, Homo sapiens
gcaagccccagggcct

SEQ ID NO: 1811280 - DNA, 17 bp, Homo sapiens
gcaagccccagggcctg

SEQ ID NO: 1811281 - DNA, 20 bp, Homo sapiens
gcaagccccagggcctgggg

SEQ ID NO: 1811282 - DNA, 21 bp, Homo sapiens
gcaagccccagggcctggggg

SEQ ID NO: 1811283 - DNA, 14 bp, Homo sapiens
gcaagcccctcagc

SEQ ID NO: 1811284 - DNA, 15 bp, Homo sapiens
gcaagcccctcagcc

SEQ ID NO: 1811285 - DNA, 16 bp, Homo sapiens
gcaagcccctcagccc

SEQ ID NO: 1811286 - DNA, 17 bp, Homo sapiens
gcaagcccctcagccct

SEQ ID NO: 1811287 - DNA, 19 bp, Homo sapiens
gcaagcgagcacagtatta

SEQ ID NO: 1811288 - DNA, 21 bp, Homo sapiens
gcaaggacaacctgcccctcc

SEQ ID NO: 1811289 - DNA, 20 bp, Homo sapiens
gcaaggaggctggctggggc

SEQ ID NO: 1811290 - DNA, 19 bp, Homo sapiens
gcaaggatatcagagctgg

SEQ ID NO: 1811291 - DNA, 18 bp, Homo sapiens
gcaagggcatcaggcact

SEQ ID NO: 1811292 - DNA, 13 bp, Homo sapiens
gcaagggctccag

SEQ ID NO: 1811293 - DNA, 14 bp, Homo sapiens
gcaagggctccagc

SEQ ID NO: 1811294 - DNA, 23 bp, Homo sapiens
gcaagggggtgtcatctgaggag

SEQ ID NO: 1811295 - DNA, 13 bp, Homo sapiens
gcaatgaaaacaa

SEQ ID NO: 1811296 - DNA, 16 bp, Homo sapiens
gcaatgagtgtgccag

SEQ ID NO: 1811297 - DNA, 22 bp, Homo sapiens
gcacaagctcagaatagatctg

SEQ ID NO: 1811298 - DNA, 22 bp, Homo sapiens
gcacaattcattgttaaaaaac

SEQ ID NO: 1811299 - DNA, 20 bp, Homo sapiens
gcccaccgcatgccccctcg

SEQ ID NO: 1811300 - DNA, 12 bp, Homo sapiens
gcctcatccctc

SEQ ID NO: 1811301 - DNA, 13 bp, Homo sapiens
gcctcatgccaca

SEQ ID NO: 1811302 - DNA, 14 bp, Homo sapiens
gcctcatgccacac

SEQ ID NO: 1811303 - DNA, 18 bp, Homo sapiens
gcctcatgccacaccttc

SEQ ID NO: 1811304 - DNA, 15 bp, Homo sapiens
gcctccactcccact

SEQ ID NO: 1811305 - DNA, 13 bp, Homo sapiens
gcctccagagcca

SEQ ID NO: 1811306 - DNA, 14 bp, Homo sapiens
gcctccagagccag

SEQ ID NO: 1811307 - DNA, 15 bp, Homo sapiens
gcctccagagccagc

SEQ ID NO: 1811308 - DNA, 17 bp, Homo sapiens
gcctccagagccagcct

SEQ ID NO: 1811309 - DNA, 19 bp, Homo sapiens
gcctccagagccagcctgg

SEQ ID NO: 1811310 - DNA, 20 bp, Homo sapiens
gcctccagagccagcctggg

SEQ ID NO: 1811311 - DNA, 24 bp, Homo sapiens
gcctccagagccagcctgggactc

SEQ ID NO: 1811312 - DNA, 16 bp, Homo sapiens
gcctccagcctctccc

SEQ ID NO: 1811313 - DNA, 18 bp, Homo sapiens
gcctccagcctctcccgg

SEQ ID NO: 1811314 - DNA, 15 bp, Homo sapiens
gctgctgtggcatca

SEQ ID NO: 1811315 - DNA, 12 bp, Homo sapiens
gctggaacacaa

SEQ ID NO: 1811316 - DNA, 15 bp, Homo sapiens
gctggaaggcagggc

SEQ ID NO: 1811317 - DNA, 18 bp, Homo sapiens
gctggaaggcagggcaga

SEQ ID NO: 1811318 - DNA, 23 bp, Homo sapiens
gctggaaggcagggcagagggaa

SEQ ID NO: 1811319 - DNA, 15 bp, Homo sapiens
gctggacaagaagct

SEQ ID NO: 1811320 - DNA, 19 bp, Homo sapiens
gctggacaagaagctgcta

SEQ ID NO: 1811321 - DNA, 19 bp, Homo sapiens
gctggagacttcctctggt

SEQ ID NO: 1811322 - DNA, 19 bp, Homo sapiens
gctggccagccccacagcc

SEQ ID NO: 1811323 - DNA, 21 bp, Homo sapiens
gctggccagccccacagccca

SEQ ID NO: 1811324 - DNA, 22 bp, Homo sapiens
gctggccagccccacagcccac

SEQ ID NO: 1811325 - DNA, 21 bp, Homo sapiens
gctggcctcccaataaagctg

SEQ ID NO: 1811326 - DNA, 13 bp, Homo sapiens
gctggctgagtgg

SEQ ID NO: 1811327 - DNA, 14 bp, Homo sapiens
gctggctggggcct

SEQ ID NO: 1811328 - DNA, 19 bp, Homo sapiens
gctgggaaccccgcagccc

SEQ ID NO: 1811329 - DNA, 20 bp, Homo sapiens
gctgggaaccccgcagcccg

SEQ ID NO: 1811330 - DNA, 22 bp, Homo sapiens
gctgggaaccccgcagcccgtg

SEQ ID NO: 1811331 - DNA, 19 bp, Homo sapiens
gctgggccccatgctctgc

SEQ ID NO: 1811332 - DNA, 22 bp, Homo sapiens
gctgggccccatgctctgcccc

SEQ ID NO: 1811333 - DNA, 23 bp, Homo sapiens
gctgggccccatgctctgcccca

SEQ ID NO: 1811334 - DNA, 14 bp, Homo sapiens
gctgggctggggcc

SEQ ID NO: 1811335 - DNA, 15 bp, Homo sapiens
gctgggctggggcct

SEQ ID NO: 1811336 - DNA, 13 bp, Homo sapiens
gctggggccacaa

SEQ ID NO: 1811337 - DNA, 21 bp, Homo sapiens
gctggggcctatcagtgtgcc

SEQ ID NO: 1811338 - DNA, 12 bp, Homo sapiens
gctggggcctga

SEQ ID NO: 1811339 - DNA, 15 bp, Homo sapiens
gctggggcctgatgg

SEQ ID NO: 1811340 - DNA, 16 bp, Homo sapiens
gctgggtggcccatcc

SEQ ID NO: 1811341 - DNA, 22 bp, Homo sapiens
gctgggttggcgcaccctcccc

SEQ ID NO: 1811342 - DNA, 14 bp, Homo sapiens
gctgtacccttcca

SEQ ID NO: 1811343 - DNA, 15 bp, Homo sapiens
gctgtacccttccac

SEQ ID NO: 1811344 - DNA, 19 bp, Homo sapiens
gctgtactcagagcagagc

SEQ ID NO: 1811345 - DNA, 15 bp, Homo sapiens
gctgtagccatggct

SEQ ID NO: 1811346 - DNA, 19 bp, Homo sapiens
gctgtagccatggctcagg

SEQ ID NO: 1811347 - DNA, 15 bp, Homo sapiens
gctgtccagtgccca

SEQ ID NO: 1811348 - DNA, 22 bp, Homo sapiens
gctgtctgtaatgggatctatt

SEQ ID NO: 1811349 - DNA, 13 bp, Homo sapiens
gctgtgccaccct

SEQ ID NO: 1811350 - DNA, 15 bp, Homo sapiens
gctgtgccaccctgg

SEQ ID NO: 1811351 - DNA, 17 bp, Homo sapiens
gctgtgccaccctgggc

SEQ ID NO: 1811352 - DNA, 13 bp, Homo sapiens
gctgtgcctgcta

SEQ ID NO: 1811353 - DNA, 15 bp, Homo sapiens
gctgtgcctgctaga

SEQ ID NO: 1811354 - DNA, 16 bp, Homo sapiens
gctgtgcctgctagag

SEQ ID NO: 1811355 - DNA, 20 bp, Homo sapiens
gctgtgcctgctagagcaac

SEQ ID NO: 1811356 - DNA, 14 bp, Homo sapiens
gctgtggaggcctg

SEQ ID NO: 1811357 - DNA, 16 bp, Homo sapiens
gctgtggaggcctgat

SEQ ID NO: 1811358 - DNA, 22 bp, Homo sapiens
gctgtggaggcctgatgctgcc

SEQ ID NO: 1811359 - DNA, 13 bp, Homo sapiens
gctgtggcacaga

SEQ ID NO: 1811360 - DNA, 16 bp, Homo sapiens
gctgttgccatagccc

SEQ ID NO: 1811361 - DNA, 16 bp, Homo sapiens
gcttcacccctgcact

SEQ ID NO: 1811362 - DNA, 18 bp, Homo sapiens
gcttccaaggtggtctgc

SEQ ID NO: 1811363 - DNA, 11 bp, Homo sapiens
gcttccaggct

SEQ ID NO: 1811364 - DNA, 18 bp, Homo sapiens
gcttccaggctcttcctg

SEQ ID NO: 1811365 - DNA, 22 bp, Homo sapiens
gcttcctccgtccacccaggct

SEQ ID NO: 1811366 - DNA, 12 bp, Homo sapiens
gcttcctggtgt

SEQ ID NO: 1811367 - DNA, 13 bp, Homo sapiens
gcttcctgtccac

SEQ ID NO: 1811368 - DNA, 17 bp, Homo sapiens
gcttcctgtccactctc

SEQ ID NO: 1811369 - DNA, 13 bp, Homo sapiens
gcttctgccactt

SEQ ID NO: 1811370 - DNA, 14 bp, Homo sapiens
gcttctgctgggct

SEQ ID NO: 1811371 - DNA, 16 bp, Homo sapiens
gcttctgctgggctgg

SEQ ID NO: 1811372 - DNA, 13 bp, Homo sapiens
gcttgagcccagg

SEQ ID NO: 1811373 - DNA, 14 bp, Homo sapiens
gcttgagcccagga

SEQ ID NO: 1811374 - DNA, 16 bp, Homo sapiens
gcttgagcccaggagt

SEQ ID NO: 1811375 - DNA, 16 bp, Homo sapiens
gcttgcccgctcccac

SEQ ID NO: 1811376 - DNA, 19 bp, Homo sapiens
gcttgcccgctcccacagc

SEQ ID NO: 1811377 - DNA, 15 bp, Homo sapiens
gcttgcctcggctcc

SEQ ID NO: 1811378 - DNA, 17 bp, Homo sapiens
gcttggacttcctgggg

SEQ ID NO: 1811379 - DNA, 19 bp, Homo sapiens
gcttggtggggctcgtggc

SEQ ID NO: 1811380 - DNA, 18 bp, Homo sapiens
gctttctccggggtctgt

SEQ ID NO: 1811381 - DNA, 15 bp, Homo sapiens
gctttgcaggctctg

SEQ ID NO: 1811382 - DNA, 17 bp, Homo sapiens
gctttgcaggctctggg

SEQ ID NO: 1811383 - DNA, 12 bp, Homo sapiens
gctttggcccaa

SEQ ID NO: 1811384 - DNA, 14 bp, Homo sapiens
gctttgggaggcca

SEQ ID NO: 1811385 - DNA, 22 bp, Homo sapiens
gctttgggctttgcaggctctg

SEQ ID NO: 1811386 - DNA, 19 bp, Homo sapiens
gcttttccaggatcctgca

SEQ ID NO: 1811387 - DNA, 20 bp, Homo sapiens
gcttttccaggatcctgcag

SEQ ID NO: 1811388 - DNA, 23 bp, Homo sapiens
gcttttccaggatcctgcaggaa

SEQ ID NO: 1811389 - DNA, 15 bp, Homo sapiens
gctttttggcacagt

SEQ ID NO: 1811390 - DNA, 18 bp, Homo sapiens
ggaaaaggttttattttg

SEQ ID NO: 1811391 - DNA, 17 bp, Homo sapiens
ggaaccccgcagcccgt

SEQ ID NO: 1811392 - DNA, 19 bp, Homo sapiens
ggaaccccgcagcccgtga

SEQ ID NO: 1811393 - DNA, 20 bp, Homo sapiens
ggaacctagtactctctgct

SEQ ID NO: 1811394 - DNA, 22 bp, Homo sapiens
ggaacctagtactctctgctct

SEQ ID NO: 1811395 - DNA, 13 bp, Homo sapiens
ggaacgagcactg

SEQ ID NO: 1811396 - DNA, 22 bp, Homo sapiens
ggaacgagcactggccagagag

SEQ ID NO: 1811397 - DNA, 19 bp, Homo sapiens
ggaactccactctccttcg

SEQ ID NO: 1811398 - DNA, 20 bp, Homo sapiens
ggcgctcaggacccaggccc

SEQ ID NO: 1811399 - DNA, 18 bp, Homo sapiens
ggcggcttcctgtccact

SEQ ID NO: 1811400 - DNA, 15 bp, Homo sapiens
ggcgggcagcacagc

SEQ ID NO: 1811401 - DNA, 12 bp, Homo sapiens
ggcggggcagga

SEQ ID NO: 1811402 - DNA, 16 bp, Homo sapiens
ggcgtaatgggcctgc

SEQ ID NO: 1811403 - DNA, 17 bp, Homo sapiens
ggcgtaatgggcctgcc

SEQ ID NO: 1811404 - DNA, 11 bp, Homo sapiens
ggctaaatgaa

SEQ ID NO: 1811405 - DNA, 23 bp, Homo sapiens
ggctagtgtgagtggcagccatg

SEQ ID NO: 1811406 - DNA, 15 bp, Homo sapiens
ggctcaggcaagccc

SEQ ID NO: 1811407 - DNA, 16 bp, Homo sapiens
ggctcagggaccacag

SEQ ID NO: 1811408 - DNA, 17 bp, Homo sapiens
ggctcagggaccacagc

SEQ ID NO: 1811409 - DNA, 21 bp, Homo sapiens
ggctcatggcgtaatgggcct

SEQ ID NO: 1811410 - DNA, 14 bp, Homo sapiens
ggctccagcatcca

SEQ ID NO: 1811411 - DNA, 18 bp, Homo sapiens
ggctccagcatccagcct

SEQ ID NO: 1811412 - DNA, 20 bp, Homo sapiens
ggctccagcatccagcctgt

SEQ ID NO: 1811413 - DNA, 13 bp, Homo sapiens
ggctccccacgag

SEQ ID NO: 1811414 - DNA, 22 bp, Homo sapiens
ggctccccacgagtcacctgca

SEQ ID NO: 1811415 - DNA, 13 bp, Homo sapiens
ggctcctgctgca

SEQ ID NO: 1811416 - DNA, 14 bp, Homo sapiens
ggctcctgctgcac

SEQ ID NO: 1811417 - DNA, 16 bp, Homo sapiens
ggctcctgctgcacca

SEQ ID NO: 1811418 - DNA, 18 bp, Homo sapiens
ggctcctggctgccaggc

SEQ ID NO: 1811419 - DNA, 17 bp, Homo sapiens
ggctcctgtgcccttat

SEQ ID NO: 1811420 - DNA, 14 bp, Homo sapiens
ggctcgtggccttc

SEQ ID NO: 1811421 - DNA, 21 bp, Homo sapiens
ggctctccaaaggggctgctg

SEQ ID NO: 1811422 - DNA, 23 bp, Homo sapiens
ggctctccaaaggggctgctggg

SEQ ID NO: 1811423 - DNA, 14 bp, Homo sapiens
ggctctgggctcag

SEQ ID NO: 1811424 - DNA, 14 bp, Homo sapiens
ggctctgtgggctg

SEQ ID NO: 1811425 - DNA, 15 bp, Homo sapiens
ggctcttcctggacc

SEQ ID NO: 1811426 - DNA, 16 bp, Homo sapiens
ggctcttcctggacct

SEQ ID NO: 1811427 - DNA, 21 bp, Homo sapiens
ggctgacacctaccatgctgc

SEQ ID NO: 1811428 - DNA, 17 bp, Homo sapiens
ggctgcactctgtgccc

SEQ ID NO: 1811429 - DNA, 19 bp, Homo sapiens
ggctgcactctgtgcccat

SEQ ID NO: 1811430 - DNA, 12 bp, Homo sapiens
ggctgccaggcg

SEQ ID NO: 1811431 - DNA, 21 bp, Homo sapiens
ggctgcccgctcccagtgtct

SEQ ID NO: 1811432 - DNA, 22 bp, Homo sapiens
ggctgcccgctcccagtgtctt

SEQ ID NO: 1811433 - DNA, 12 bp, Homo sapiens
ggctgcctccac

SEQ ID NO: 1811434 - DNA, 10 bp, Homo sapiens
ggctgcctgc

SEQ ID NO: 1811435 - DNA, 16 bp, Homo sapiens
ggctgcctgccgccca

SEQ ID NO: 1811436 - DNA, 16 bp, Homo sapiens
ggctgctggggcatgt

SEQ ID NO: 1811437 - DNA, 14 bp, Homo sapiens
ggctggagtgcgct

SEQ ID NO: 1811438 - DNA, 12 bp, Homo sapiens
ggctggccagcc

SEQ ID NO: 1811439 - DNA, 16 bp, Homo sapiens
tctagaaagaaaagac

SEQ ID NO: 1811440 - DNA, 23 bp, Homo sapiens
tctagaaagaaaagaccctgaga

SEQ ID NO: 1811441 - DNA, 16 bp, Homo sapiens
tctagaggcctcagtt

SEQ ID NO: 1811442 - DNA, 13 bp, Homo sapiens
tctagctggcagg

SEQ ID NO: 1811443 - DNA, 17 bp, Homo sapiens
tctagctggcaggacac

SEQ ID NO: 1811444 - DNA, 22 bp, Homo sapiens
tctagttgattgcgagaatttt

SEQ ID NO: 1811445 - DNA, 12 bp, Homo sapiens
tctatcaacatt

SEQ ID NO: 1811446 - DNA, 17 bp, Homo sapiens
tctatcagtgacttctg

SEQ ID NO: 1811447 - DNA, 23 bp, Homo sapiens
tctatgagaacaagtcacagctg

SEQ ID NO: 1811448 - DNA, 15 bp, Homo sapiens
tctattctgagcctt

SEQ ID NO: 1811449 - DNA, 20 bp, Homo sapiens
tctcaaaatacgtgttcaaa

SEQ ID NO: 1811450 - DNA, 18 bp, Homo sapiens
tctcaaatttttcatctc

SEQ ID NO: 1811451 - DNA, 15 bp, Homo sapiens
tctcaagatgtttat

SEQ ID NO: 1811452 - DNA, 17 bp, Homo sapiens
tctcaagtgaaagactt

SEQ ID NO: 1811453 - DNA, 16 bp, Homo sapiens
tctcaatttgaaacac

SEQ ID NO: 1811454 - DNA, 22 bp, Homo sapiens
tctcaggtgccactccctgagc

SEQ ID NO: 1811455 - DNA, 23 bp, Homo sapiens
tctcaggtgccactccctgagct

SEQ ID NO: 1811456 - DNA, 14 bp, Homo sapiens
tctcagtacacttc

SEQ ID NO: 1811457 - DNA, 19 bp, Homo sapiens
tctcagtacacttcctgtg

SEQ ID NO: 1811458 - DNA, 14 bp, Homo sapiens
tctcagtgctctcc

SEQ ID NO: 1811459 - DNA, 20 bp, Homo sapiens
tctccaaaggggctgctggg

SEQ ID NO: 1811460 - DNA, 24 bp, Homo sapiens
tctccagggctgcccctgtaggtt

SEQ ID NO: 1811461 - DNA, 22 bp, Homo sapiens
tctccatcccctccctgcctgc

SEQ ID NO: 1811462 - DNA, 21 bp, Homo sapiens
tctcccaccccggcctccact

SEQ ID NO: 1811463 - DNA, 13 bp, Homo sapiens
tctccccaggcct

SEQ ID NO: 1811464 - DNA, 18 bp, Homo sapiens
tctcccccgacactgctg

SEQ ID NO: 1811465 - DNA, 14 bp, Homo sapiens
tctcccctctcgcc

SEQ ID NO: 1811466 - DNA, 13 bp, Homo sapiens
tctccggggtctg

SEQ ID NO: 1811467 - DNA, 19 bp, Homo sapiens
tctccggggtctgtgctgt

SEQ ID NO: 1811468 - DNA, 22 bp, Homo sapiens
tctcctaccccacctcatgcct

SEQ ID NO: 1811469 - DNA, 24 bp, Homo sapiens
tctcctaccccacctcatgcctgg

SEQ ID NO: 1811470 - DNA, 14 bp, Homo sapiens
tctcctccaccgcc

SEQ ID NO: 1811471 - DNA, 20 bp, Homo sapiens
tctcctccaccgccatggct

SEQ ID NO: 1811472 - DNA, 18 bp, Homo sapiens
tctcctcccatggccttc

SEQ ID NO: 1811473 - DNA, 15 bp, Homo sapiens
tctcctgtatcattt

SEQ ID NO: 1811474 - DNA, 21 bp, Homo sapiens
tctccttactctgagcccagg

SEQ ID NO: 1811475 - DNA, 14 bp, Homo sapiens
tctccttgggctcc

SEQ ID NO: 1811476 - DNA, 16 bp, Homo sapiens
tctccttgggctcctg

SEQ ID NO: 1811477 - DNA, 23 bp, Homo sapiens
tctccttgggctcctggctgcca

SEQ ID NO: 1811478 - DNA, 14 bp, Homo sapiens
tctcggggcccttg

SEQ ID NO: 1811479 - DNA, 14 bp, Homo sapiens
tctcggtggtacca

SEQ ID NO: 1811480 - DNA, 20 bp, Homo sapiens
tctctaaactgctgttaatt

SEQ ID NO: 1811481 - DNA, 21 bp, Homo sapiens
tctctcccaccccggcctcca

SEQ ID NO: 1811482 - DNA, 16 bp, Homo sapiens
tctctgctctagccag

SEQ ID NO: 1811483 - DNA, 22 bp, Homo sapiens
tctgaacccttgtgcttggtgg

SEQ ID NO: 1811484 - DNA, 17 bp, Homo sapiens
tctgaagctagaaacaa

SEQ ID NO: 1811485 - DNA, 18 bp, Homo sapiens
tctgaagctagaaacaat

SEQ ID NO: 1811486 - DNA, 22 bp, Homo sapiens
tctgaagctagaaacaatctat

SEQ ID NO: 1811487 - DNA, 21 bp, Homo sapiens
tctgaaggaatagccagagag

SEQ ID NO: 1811488 - DNA, 23 bp, Homo sapiens
tctgaaggaatagccagagagga

SEQ ID NO: 1811489 - DNA, 16 bp, Homo sapiens
tctgaatccttagaat

SEQ ID NO: 1811490 - DNA, 22 bp, Homo sapiens
tctgacacaagtgtattatttc

SEQ ID NO: 1811491 - DNA, 17 bp, Homo sapiens
tctgactccagagtctg

SEQ ID NO: 1811492 - DNA, 20 bp, Homo sapiens
tctgactccagagtctgagc

SEQ ID NO: 1811493 - DNA, 16 bp, Homo sapiens
tctgagaagtgtatat

SEQ ID NO: 1811494 - DNA, 14 bp, Homo sapiens
tctgagaattgcaa

SEQ ID NO: 1811495 - DNA, 15 bp, Homo sapiens
tctgagaattgcaaa

SEQ ID NO: 1811496 - DNA, 14 bp, Homo sapiens
tctgagcccaggcc

SEQ ID NO: 1811497 - DNA, 17 bp, Homo sapiens
tctgagccttgagagaa

SEQ ID NO: 1811498 - DNA, 18 bp, Homo sapiens
tctgagccttgagagaaa

SEQ ID NO: 1811499 - DNA, 18 bp, Homo sapiens
tctgaggccccaggccct

SEQ ID NO: 1811500 - DNA, 12 bp, Homo sapiens
tctgaggcctca

SEQ ID NO: 1811501 - DNA, 14 bp, Homo sapiens
tctgataagctgtt

SEQ ID NO: 1811502 - DNA, 16 bp, Homo sapiens
tctgatggtgagctgg

SEQ ID NO: 1811503 - DNA, 17 bp, Homo sapiens
tctgatggtgagctggg

SEQ ID NO: 1811504 - DNA, 13 bp, Homo sapiens
tctgatttcaagg

SEQ ID NO: 1811505 - DNA, 15 bp, Homo sapiens
tctgcaactagccaa

SEQ ID NO: 1811506 - DNA, 16 bp, Homo sapiens
tctgcaactagccaag

SEQ ID NO: 1811507 - DNA, 12 bp, Homo sapiens
tctgccccaagc

SEQ ID NO: 1811508 - DNA, 18 bp, Homo sapiens
tctgccccaagcagccag

SEQ ID NO: 1811509 - DNA, 15 bp, Homo sapiens
tctgccccaagcccc

SEQ ID NO: 1811510 - DNA, 14 bp, Homo sapiens
tctgcctggcctgg

SEQ ID NO: 1811511 - DNA, 15 bp, Homo sapiens
tctgcctggcctggc

SEQ ID NO: 1811512 - DNA, 16 bp, Homo sapiens
tctgcctgggcctgtg

SEQ ID NO: 1811513 - DNA, 21 bp, Homo sapiens
tctgcctgggcctgtgcagca

SEQ ID NO: 1811514 - DNA, 16 bp, Homo sapiens
tctgctcgggcccagg

SEQ ID NO: 1811515 - DNA, 22 bp, Homo sapiens
tctgctcgggcccaggccatct

SEQ ID NO: 1811516 - DNA, 14 bp, Homo sapiens
tctgctctagccag

SEQ ID NO: 1811517 - DNA, 16 bp, Homo sapiens
tctgctctagccagga

SEQ ID NO: 1811518 - DNA, 13 bp, Homo sapiens
tctgctgggctgg

SEQ ID NO: 1811519 - DNA, 17 bp, Homo sapiens
tctgctgttgccatagc

SEQ ID NO: 1811520 - DNA, 18 bp, Homo sapiens
tctgctgttgccatagcc

SEQ ID NO: 1811521 - DNA, 13 bp, Homo sapiens
tctgcttttgcat

SEQ ID NO: 1811522 - DNA, 15 bp, Homo sapiens
tctggaaggctggct

SEQ ID NO: 1811523 - DNA, 16 bp, Homo sapiens
tctggaaggctggctg

SEQ ID NO: 1811524 - DNA, 19 bp, Homo sapiens
tctggaaggctggctgagt

SEQ ID NO: 1811525 - DNA, 18 bp, Homo sapiens
tctggcaaagttatattt

SEQ ID NO: 1811526 - DNA, 16 bp, Homo sapiens
tctggcatggctccct

SEQ ID NO: 1811527 - DNA, 13 bp, Homo sapiens
tctgggaagggag

SEQ ID NO: 1811528 - DNA, 12 bp, Homo sapiens
tctgggctcagg

SEQ ID NO: 1811529 - DNA, 14 bp, Homo sapiens
tctgggctcagggc

SEQ ID NO: 1811530 - DNA, 16 bp, Homo sapiens
tctgggctcagggctg

SEQ ID NO: 1811531 - DNA, 17 bp, Homo sapiens
tctgggctcagggctgg

SEQ ID NO: 1811532 - DNA, 22 bp, Homo sapiens
tctggtatgaacttgaggacac

SEQ ID NO: 1811533 - DNA, 18 bp, Homo sapiens
tctgtactgaaagcaaat

SEQ ID NO: 1811534 - DNA, 23 bp, Homo sapiens
tctgtatattccctgtggaatgt

SEQ ID NO: 1811535 - DNA, 15 bp, Homo sapiens
tctgtcatcactccc

SEQ ID NO: 1811536 - DNA, 16 bp, Homo sapiens
tctgtccaggccactg

SEQ ID NO: 1811537 - DNA, 17 bp, Homo sapiens
tctgtccaggccactgt

SEQ ID NO: 1811538 - DNA, 21 bp, Homo sapiens
tctgtccaggccactgtggcc

SEQ ID NO: 1811539 - DNA, 15 bp, Homo sapiens
tctgtccagtttcca

SEQ ID NO: 1811540 - DNA, 16 bp, Homo sapiens
tctgtcggtgactcct

SEQ ID NO: 1811541 - DNA, 20 bp, Homo sapiens
tctgtcggtgactcctgaag

SEQ ID NO: 1811542 - DNA, 16 bp, Homo sapiens
tctgtctgtcccaaag

SEQ ID NO: 1811543 - DNA, 21 bp, Homo sapiens
tctgtgaaagtctcctgtatc

SEQ ID NO: 1811544 - DNA, 22 bp, Homo sapiens
tctgtgctcttttggtggggag

SEQ ID NO: 1811545 - DNA, 17 bp, Homo sapiens
tctgtgctgtgcctgct

SEQ ID NO: 1811546 - DNA, 19 bp, Homo sapiens
tctgtgctgtgcctgctag

SEQ ID NO: 1811547 - DNA, 20 bp, Homo sapiens
tctgtgctgtgcctgctaga

SEQ ID NO: 1811548 - DNA, 23 bp, Homo sapiens
tctgtgctgtgcctgctagagca

SEQ ID NO: 1811549 - DNA, 12 bp, Homo sapiens
tctgtggcctgt

SEQ ID NO: 1811550 - DNA, 22 bp, Homo sapiens
tctgtggcctgtgtccagcagc

SEQ ID NO: 1811551 - DNA, 16 bp, Homo sapiens
tctgtgggctgcactc

SEQ ID NO: 1811552 - DNA, 21 bp, Homo sapiens
tctgtgggctgcactctgtgc

SEQ ID NO: 1811553 - DNA, 23 bp, Homo sapiens
tctgtgggctgcactctgtgccc

SEQ ID NO: 1811554 - DNA, 22 bp, Homo sapiens
tctgtgtcactggctgcctcca

SEQ ID NO: 1811555 - DNA, 15 bp, Homo sapiens
tgagaccacctctca

SEQ ID NO: 1811556 - DNA, 15 bp, Homo sapiens
tgagatggccatgct

SEQ ID NO: 1811557 - DNA, 14 bp, Homo sapiens
tgagatttgccagc

SEQ ID NO: 1811558 - DNA, 20 bp, Homo sapiens
tgagatttttgttttccact

SEQ ID NO: 1811559 - DNA, 20 bp, Homo sapiens
tgagcaaggacaacctgccc

SEQ ID NO: 1811560 - DNA, 11 bp, Homo sapiens
tgagcattcag

SEQ ID NO: 1811561 - DNA, 12 bp, Homo sapiens
tgagcccaggcc

SEQ ID NO: 1811562 - DNA, 15 bp, Homo sapiens
tgagccttgagagaa

SEQ ID NO: 1811563 - DNA, 19 bp, Homo sapiens
tgaggcagtgggtcccact

SEQ ID NO: 1811564 - DNA, 21 bp, Homo sapiens
tgaggcagtgggtcccacttc

SEQ ID NO: 1811565 - DNA, 13 bp, Homo sapiens
tgaggccccaggc

SEQ ID NO: 1811566 - DNA, 13 bp, Homo sapiens
tgaggcttccagg

SEQ ID NO: 1811567 - DNA, 21 bp, Homo sapiens
tgaggcttccaggctcttcct

SEQ ID NO: 1811568 - DNA, 21 bp, Homo sapiens
tgagggagggggcgctcagga

SEQ ID NO: 1811569 - DNA, 22 bp, Homo sapiens
tgagggagggggcgctcaggac

SEQ ID NO: 1811570 - DNA, 23 bp, Homo sapiens
tgaggtctcgctgatgctgggct

SEQ ID NO: 1811571 - DNA, 16 bp, Homo sapiens
tgagtccctccatgca

SEQ ID NO: 1811572 - DNA, 15 bp, Homo sapiens
tgagtctgaggcccc

SEQ ID NO: 1811573 - DNA, 18 bp, Homo sapiens
tgagtgacctcacttctg

SEQ ID NO: 1811574 - DNA, 14 bp, Homo sapiens
tgagtggaatgcag

SEQ ID NO: 1811575 - DNA, 17 bp, Homo sapiens
tgagtggaatgcaggga

SEQ ID NO: 1811576 - DNA, 19 bp, Homo sapiens
tgagtggaatgcagggaag

SEQ ID NO: 1811577 - DNA, 14 bp, Homo sapiens
tgagtggcagccat

SEQ ID NO: 1811578 - DNA, 14 bp, Homo sapiens
tgagtgtgactttt

SEQ ID NO: 1811579 - DNA, 14 bp, Homo sapiens
tgagttggctggga

SEQ ID NO: 1811580 - DNA, 18 bp, Homo sapiens
tgagtttccagctaagcc

SEQ ID NO: 1811581 - DNA, 15 bp, Homo sapiens
tgataactgcatttg

SEQ ID NO: 1811582 - DNA, 19 bp, Homo sapiens
tgatatctgtttgcttcta

SEQ ID NO: 1811583 - DNA, 21 bp, Homo sapiens
tgatattgagacattaatttg

SEQ ID NO: 1811584 - DNA, 14 bp, Homo sapiens
tgatcaaaatcaaa

SEQ ID NO: 1811585 - DNA, 18 bp, Homo sapiens
tgatcaaaatcaaaaggt

SEQ ID NO: 1811586 - DNA, 12 bp, Homo sapiens
tgatctttcaat

SEQ ID NO: 1811587 - DNA, 21 bp, Homo sapiens
tgatctttcaatatcattact

SEQ ID NO: 1811588 - DNA, 14 bp, Homo sapiens
tgatgatggaaggg

SEQ ID NO: 1811589 - DNA, 17 bp, Homo sapiens
tgatgccacaccaagct

SEQ ID NO: 1811590 - DNA, 15 bp, Homo sapiens
tgatgctgggctggg

SEQ ID NO: 1811591 - DNA, 16 bp, Homo sapiens
tgatgctgggctgggt

SEQ ID NO: 1811592 - DNA, 20 bp, Homo sapiens
tgatgctgggctgggtgcga

SEQ ID NO: 1811593 - DNA, 16 bp, Homo sapiens
tgatggccaagagcat

SEQ ID NO: 1811594 - DNA, 17 bp, Homo sapiens
tgatggccaagagcatc

SEQ ID NO: 1811595 - DNA, 18 bp, Homo sapiens
tgatggcgcgggaggcac

SEQ ID NO: 1811596 - DNA, 15 bp, Homo sapiens
tgatgtgggaagaag

SEQ ID NO: 1811597 - DNA, 11 bp, Homo sapiens
tgatttcaagg

SEQ ID NO: 1811598 - DNA, 15 bp, Homo sapiens
tgatttccaggcccc

SEQ ID NO: 1811599 - DNA, 12 bp, Homo sapiens
tgattttaagag

SEQ ID NO: 1811600 - DNA, 16 bp, Homo sapiens
tgcaaaactagacaaa

SEQ ID NO: 1811601 - DNA, 19 bp, Homo sapiens
tgcaaaagccaagaaagta

SEQ ID NO: 1811602 - DNA, 16 bp, Homo sapiens
tgcaaaagtggggcta

SEQ ID NO: 1811603 - DNA, 22 bp, Homo sapiens
tgcaaaagtggggctaaatgaa

SEQ ID NO: 1811604 - DNA, 23 bp, Homo sapiens
tgcaaaagtggggctaaatgaag

SEQ ID NO: 1811605 - DNA, 22 bp, Homo sapiens
tgcaaagtgttttctcagaaca

SEQ ID NO: 1811606 - DNA, 23 bp, Homo sapiens
tgcaaatattagcaaagaagctt

SEQ ID NO: 1811607 - DNA, 22 bp, Homo sapiens
tgcaacaagacaaagcaaagcc

SEQ ID NO: 1811608 - DNA, 17 bp, Homo sapiens
tgcaactagccaaggct

SEQ ID NO: 1811609 - DNA, 18 bp, Homo sapiens
tgcaagccccagggcctg

SEQ ID NO: 1811610 - DNA, 20 bp, Homo sapiens
tgcaagctgctgaagccagg

SEQ ID NO: 1811611 - DNA, 17 bp, Homo sapiens
tgcaatgcaattcaatg

SEQ ID NO: 1811612 - DNA, 15 bp, Homo sapiens
tgcaattcaatgcaa

SEQ ID NO: 1811613 - DNA, 21 bp, Homo sapiens
tgcaattcaatgcaatgaaaa

SEQ ID NO: 1811614 - DNA, 14 bp, Homo sapiens
tgcacaagctcaga

SEQ ID NO: 1811615 - DNA, 12 bp, Homo sapiens
tgcacacacagc

SEQ ID NO: 1811616 - DNA, 18 bp, Homo sapiens
tgcacagtttagaacaga

SEQ ID NO: 1811617 - DNA, 16 bp, Homo sapiens
tgcacatcattcattc

SEQ ID NO: 1811618 - DNA, 11 bp, Homo sapiens
tgcacatcctc

SEQ ID NO: 1811619 - DNA, 17 bp, Homo sapiens
tgcacatcctcattcac

SEQ ID NO: 1811620 - DNA, 18 bp, Homo sapiens
tgcacatcctcattcact

SEQ ID NO: 1811621 - DNA, 23 bp, Homo sapiens
tgcacattttgtacaaagatatg

SEQ ID NO: 1811622 - DNA, 20 bp, Homo sapiens
tgcaccaacccagccgctgc

SEQ ID NO: 1811623 - DNA, 23 bp, Homo sapiens
tgcaccagagtgaaagggctatg

SEQ ID NO: 1811624 - DNA, 12 bp, Homo sapiens
tgcaccaggaga

SEQ ID NO: 1811625 - DNA, 14 bp, Homo sapiens
tgcaccaggagaca

SEQ ID NO: 1811626 - DNA, 17 bp, Homo sapiens
tgcaccccctcctgctg

SEQ ID NO: 1811627 - DNA, 18 bp, Homo sapiens
tgcacctcctaccctccc

SEQ ID NO: 1811628 - DNA, 21 bp, Homo sapiens
tgcacctcctaccctcccacc

SEQ ID NO: 1811629 - DNA, 21 bp, Homo sapiens
tgcactctgtgcccatgggca

SEQ ID NO: 1811630 - DNA, 19 bp, Homo sapiens
tgcactggtcccaagtagt

SEQ ID NO: 1811631 - DNA, 14 bp, Homo sapiens
tgcactgtcctgct

SEQ ID NO: 1811632 - DNA, 17 bp, Homo sapiens
tgcactgtcctgctcca

SEQ ID NO: 1811633 - DNA, 20 bp, Homo sapiens
tgcactgtcctgctccacag

SEQ ID NO: 1811634 - DNA, 15 bp, Homo sapiens
tgcagagaaagaaag

SEQ ID NO: 1811635 - DNA, 15 bp, Homo sapiens
tgcagaggaccacag

SEQ ID NO: 1811636 - DNA, 21 bp, Homo sapiens
tgcagaggggcaggccctgca

SEQ ID NO: 1811637 - DNA, 14 bp, Homo sapiens
tgcagatgggctgt

SEQ ID NO: 1811638 - DNA, 20 bp, Homo sapiens
tgcagattcctgggcctgtc

SEQ ID NO: 1811639 - DNA, 14 bp, Homo sapiens
tgcagcagcccagc

SEQ ID NO: 1811640 - DNA, 19 bp, Homo sapiens
tgcagcagcccagcttcct

SEQ ID NO: 1811641 - DNA, 20 bp, Homo sapiens
tgcagccttcccctccctgt

SEQ ID NO: 1811642 - DNA, 12 bp, Homo sapiens
tgcagctgggcc

SEQ ID NO: 1811643 - DNA, 14 bp, Homo sapiens
tgcagctgggcccc

SEQ ID NO: 1811644 - DNA, 24 bp, Homo sapiens
tgcagctgggccccatgctctgcc

SEQ ID NO: 1811645 - DNA, 18 bp, Homo sapiens
tgcaggaacgagcactgg

SEQ ID NO: 1811646 - DNA, 21 bp, Homo sapiens
tgcaggaacgagcactggcca

SEQ ID NO: 1811647 - DNA, 22 bp, Homo sapiens
tgcaggaacgagcactggccag

SEQ ID NO: 1811648 - DNA, 16 bp, Homo sapiens
tgcaggcccagcagac

SEQ ID NO: 1811649 - DNA, 17 bp, Homo sapiens
tgcaggcccagcagact

SEQ ID NO: 1811650 - DNA, 11 bp, Homo sapiens
tgcaggctctg

SEQ ID NO: 1811651 - DNA, 12 bp, Homo sapiens
tgcaggctctgg

SEQ ID NO: 1811652 - DNA, 19 bp, Homo sapiens
tgcaggctctgggctcagg

SEQ ID NO: 1811653 - DNA, 20 bp, Homo sapiens
tgcaggctctgggctcaggg

SEQ ID NO: 1811654 - DNA, 15 bp, Homo sapiens
tgcagggaagagggc

SEQ ID NO: 1811655 - DNA, 17 bp, Homo sapiens
tgcagggaagagggcag

SEQ ID NO: 1811656 - DNA, 20 bp, Homo sapiens
tgcagggaagagggcagtac

SEQ ID NO: 1811657 - DNA, 15 bp, Homo sapiens
tgcaggtacttcctc

SEQ ID NO: 1811658 - DNA, 19 bp, Homo sapiens
gcctccagcctctcccggc

SEQ ID NO: 1811659 - DNA, 16 bp, Homo sapiens
gcctcccaataaagct

SEQ ID NO: 1811660 - DNA, 20 bp, Homo sapiens
gcctcccaataaagctggac

SEQ ID NO: 1811661 - DNA, 23 bp, Homo sapiens
gcctcccacagtgactcgggctc

SEQ ID NO: 1811662 - DNA, 16 bp, Homo sapiens
gcctcccctcccctgg

SEQ ID NO: 1811663 - DNA, 19 bp, Homo sapiens
gcctcccctcccctgggga

SEQ ID NO: 1811664 - DNA, 21 bp, Homo sapiens
gcctccgtttatgggccttgc

SEQ ID NO: 1811665 - DNA, 16 bp, Homo sapiens
gcctcctgccccctgc

SEQ ID NO: 1811666 - DNA, 24 bp, Homo sapiens
gcctcctgccccctgccagtgaag

SEQ ID NO: 1811667 - DNA, 15 bp, Homo sapiens
gcctcgaggcaccgg

SEQ ID NO: 1811668 - DNA, 16 bp, Homo sapiens
gcctcgcccaccgcat

SEQ ID NO: 1811669 - DNA, 14 bp, Homo sapiens
gcctcgcctggcct

SEQ ID NO: 1811670 - DNA, 14 bp, Homo sapiens
gcctcggctcctgc

SEQ ID NO: 1811671 - DNA, 12 bp, Homo sapiens
gcctctccctta

SEQ ID NO: 1811672 - DNA, 16 bp, Homo sapiens
gcctctgtgtcactgg

SEQ ID NO: 1811673 - DNA, 19 bp, Homo sapiens
gcctctgtgtcactggctg

SEQ ID NO: 1811674 - DNA, 16 bp, Homo sapiens
gcctcttgcaggctga

SEQ ID NO: 1811675 - DNA, 20 bp, Homo sapiens
gcctcttgtgctcacgctcc

SEQ ID NO: 1811676 - DNA, 14 bp, Homo sapiens
gcctgagctggggc

SEQ ID NO: 1811677 - DNA, 18 bp, Homo sapiens
gcctgagctggggccaca

SEQ ID NO: 1811678 - DNA, 19 bp, Homo sapiens
gcctgagctggggccacaa

SEQ ID NO: 1811679 - DNA, 15 bp, Homo sapiens
gcctgatgctgcccc

SEQ ID NO: 1811680 - DNA, 16 bp, Homo sapiens
gcctgatgctgccccg

SEQ ID NO: 1811681 - DNA, 14 bp, Homo sapiens
gcctgatggccaag

SEQ ID NO: 1811682 - DNA, 19 bp, Homo sapiens
gcctgatggccaagggggt

SEQ ID NO: 1811683 - DNA, 17 bp, Homo sapiens
gcctgattcggctgtct

SEQ ID NO: 1811684 - DNA, 14 bp, Homo sapiens
gcctgcaccaggag

SEQ ID NO: 1811685 - DNA, 17 bp, Homo sapiens
gcctgctagagcaaccc

SEQ ID NO: 1811686 - DNA, 18 bp, Homo sapiens
gcctgctagagcaacccc

SEQ ID NO: 1811687 - DNA, 23 bp, Homo sapiens
gcctgctagagcaacccctgtac

SEQ ID NO: 1811688 - DNA, 13 bp, Homo sapiens
gcctgctgggaac

SEQ ID NO: 1811689 - DNA, 14 bp, Homo sapiens
gcctggcacagtgt

SEQ ID NO: 1811690 - DNA, 11 bp, Homo sapiens
gcctggcccag

SEQ ID NO: 1811691 - DNA, 13 bp, Homo sapiens
gcctggcccagct

SEQ ID NO: 1811692 - DNA, 16 bp, Homo sapiens
gcctggcccagctccc

SEQ ID NO: 1811693 - DNA, 15 bp, Homo sapiens
gcctggcccccctcc

SEQ ID NO: 1811694 - DNA, 17 bp, Homo sapiens
gcctggcccccctccag

SEQ ID NO: 1811695 - DNA, 20 bp, Homo sapiens
gcctggcccccctccaggca

SEQ ID NO: 1811696 - DNA, 14 bp, Homo sapiens
gcctggcctgagct

SEQ ID NO: 1811697 - DNA, 14 bp, Homo sapiens
gcctggcctgaggt

SEQ ID NO: 1811698 - DNA, 12 bp, Homo sapiens
gcctggcctggc

SEQ ID NO: 1811699 - DNA, 14 bp, Homo sapiens
gcctggcctggctc

SEQ ID NO: 1811700 - DNA, 15 bp, Homo sapiens
gcctggcctggctcc

SEQ ID NO: 1811701 - DNA, 24 bp, Homo sapiens
gcctggctgtggaggcctgatgct

SEQ ID NO: 1811702 - DNA, 15 bp, Homo sapiens
gcctggcttgctcca

SEQ ID NO: 1811703 - DNA, 17 bp, Homo sapiens
gcctggcttgctccagg

SEQ ID NO: 1811704 - DNA, 19 bp, Homo sapiens
gcctggcttgctccagggt

SEQ ID NO: 1811705 - DNA, 15 bp, Homo sapiens
gcctgggacccagct

SEQ ID NO: 1811706 - DNA, 16 bp, Homo sapiens
gcctgggacccagcta

SEQ ID NO: 1811707 - DNA, 18 bp, Homo sapiens
gcctgggacccagctact

SEQ ID NO: 1811708 - DNA, 16 bp, Homo sapiens
gcctgggactcccagt

SEQ ID NO: 1811709 - DNA, 17 bp, Homo sapiens
gcctgggactcccagtg

SEQ ID NO: 1811710 - DNA, 12 bp, Homo sapiens
gcctgggcctgc

SEQ ID NO: 1811711 - DNA, 17 bp, Homo sapiens
gcctgggcctgcttttc

SEQ ID NO: 1811712 - DNA, 13 bp, Homo sapiens
gcctgggcctgtg

SEQ ID NO: 1811713 - DNA, 14 bp, Homo sapiens
gcctgggcctgtgc

SEQ ID NO: 1811714 - DNA, 16 bp, Homo sapiens
gcctgggcctgtgcag

SEQ ID NO: 1811715 - DNA, 17 bp, Homo sapiens
gcctgggcctgtgcagc

SEQ ID NO: 1811716 - DNA, 19 bp, Homo sapiens
gcctgggcctgtgcagcag

SEQ ID NO: 1811717 - DNA, 17 bp, Homo sapiens
gcctgtactaaggagca

SEQ ID NO: 1811718 - DNA, 13 bp, Homo sapiens
gcctgtgcagcag

SEQ ID NO: 1811719 - DNA, 16 bp, Homo sapiens
gcctgtgcagcagccc

SEQ ID NO: 1811720 - DNA, 19 bp, Homo sapiens
gcctgtgcagcagcccagc

SEQ ID NO: 1811721 - DNA, 19 bp, Homo sapiens
gcctgtgtccagcagctgc

SEQ ID NO: 1811722 - DNA, 22 bp, Homo sapiens
gccttccccttttgcctggctg

SEQ ID NO: 1811723 - DNA, 15 bp, Homo sapiens
gccttcctcatcccc

SEQ ID NO: 1811724 - DNA, 13 bp, Homo sapiens
gccttcctcctcc

SEQ ID NO: 1811725 - DNA, 19 bp, Homo sapiens
gccttcctcctccacagtg

SEQ ID NO: 1811726 - DNA, 17 bp, Homo sapiens
gccttctcccccccggg

SEQ ID NO: 1811727 - DNA, 14 bp, Homo sapiens
gccttctcctgtct

SEQ ID NO: 1811728 - DNA, 14 bp, Homo sapiens
gcctttctcccccg

SEQ ID NO: 1811729 - DNA, 15 bp, Homo sapiens
gccttttaaaagaaa

SEQ ID NO: 1811730 - DNA, 18 bp, Homo sapiens
gccttttataaacctcta

SEQ ID NO: 1811731 - DNA, 23 bp, Homo sapiens
gcctttttttttttttttttaat

SEQ ID NO: 1811732 - DNA, 17 bp, Homo sapiens
gcgaccccatctgccca

SEQ ID NO: 1811733 - DNA, 21 bp, Homo sapiens
gcgaccccatctgcccaggac

SEQ ID NO: 1811734 - DNA, 15 bp, Homo sapiens
gcgataacttaacaa

SEQ ID NO: 1811735 - DNA, 14 bp, Homo sapiens
gcgattattgatca

SEQ ID NO: 1811736 - DNA, 17 bp, Homo sapiens
gcgattattgatcaaaa

SEQ ID NO: 1811737 - DNA, 21 bp, Homo sapiens
gcgcaccctcccctcccgtct

SEQ ID NO: 1811738 - DNA, 13 bp, Homo sapiens
gcgccttctcccc

SEQ ID NO: 1811739 - DNA, 14 bp, Homo sapiens
gcgcgggaggcacc

SEQ ID NO: 1811740 - DNA, 11 bp, Homo sapiens
gcgctcaggac

SEQ ID NO: 1811741 - DNA, 13 bp, Homo sapiens
gcgctcaggaccc

SEQ ID NO: 1811742 - DNA, 14 bp, Homo sapiens
gcgctcaggaccca

SEQ ID NO: 1811743 - DNA, 17 bp, Homo sapiens
gcgctcaggacccaggc

SEQ ID NO: 1811744 - DNA, 19 bp, Homo sapiens
gcgctcaggacccaggccc

SEQ ID NO: 1811745 - DNA, 21 bp, Homo sapiens
gcgctcaggacccaggccctc

SEQ ID NO: 1811746 - DNA, 14 bp, Homo sapiens
gcgctgcctgtgtg

SEQ ID NO: 1811747 - DNA, 15 bp, Homo sapiens
gcgctgcctgtgtgg

SEQ ID NO: 1811748 - DNA, 19 bp, Homo sapiens
gcgctgcctgtgtggtgtc

SEQ ID NO: 1811749 - DNA, 17 bp, Homo sapiens
gcggcttcctgtccact

SEQ ID NO: 1811750 - DNA, 20 bp, Homo sapiens
gcggcttcctgtccactctc

SEQ ID NO: 1811751 - DNA, 22 bp, Homo sapiens
gcggcttcctgtccactctcgg

SEQ ID NO: 1811752 - DNA, 17 bp, Homo sapiens
gcgggaggcaccagctc

SEQ ID NO: 1811753 - DNA, 18 bp, Homo sapiens
gcgggaggcaccagctct

SEQ ID NO: 1811754 - DNA, 16 bp, Homo sapiens
gcgggcagcacagcaa

SEQ ID NO: 1811755 - DNA, 22 bp, Homo sapiens
gcggtgctctggcggcttcctg

SEQ ID NO: 1811756 - DNA, 18 bp, Homo sapiens
tgccaagtttttcagaaa

SEQ ID NO: 1811757 - DNA, 20 bp, Homo sapiens
tgccaagtttttcagaaagt

SEQ ID NO: 1811758 - DNA, 21 bp, Homo sapiens
tgccaagtttttcagaaagtt

SEQ ID NO: 1811759 - DNA, 20 bp, Homo sapiens
tgccacaccaagctgtgcca

SEQ ID NO: 1811760 - DNA, 21 bp, Homo sapiens
tgccacaccaagctgtgccac

SEQ ID NO: 1811761 - DNA, 20 bp, Homo sapiens
tgccaccacgtctgccaggc

SEQ ID NO: 1811762 - DNA, 21 bp, Homo sapiens
tgccaccacgtctgccaggcc

SEQ ID NO: 1811763 - DNA, 22 bp, Homo sapiens
tgccaccacgtctgccaggccc

SEQ ID NO: 1811764 - DNA, 22 bp, Homo sapiens
tgccaccctgggctctgtgggc

SEQ ID NO: 1811765 - DNA, 10 bp, Homo sapiens
tgccacctgt

SEQ ID NO: 1811766 - DNA, 16 bp, Homo sapiens
tgccacctgtctgtct

SEQ ID NO: 1811767 - DNA, 14 bp, Homo sapiens
tgccactccctgag

SEQ ID NO: 1811768 - DNA, 15 bp, Homo sapiens
tgccactccctgagc

SEQ ID NO: 1811769 - DNA, 12 bp, Homo sapiens
tgccactgccag

SEQ ID NO: 1811770 - DNA, 13 bp, Homo sapiens
tgccactgccagg

SEQ ID NO: 1811771 - DNA, 14 bp, Homo sapiens
tgccactgccaggc

SEQ ID NO: 1811772 - DNA, 15 bp, Homo sapiens
tgccactgccaggca

SEQ ID NO: 1811773 - DNA, 17 bp, Homo sapiens
tgccactgccaggcacc

SEQ ID NO: 1811774 - DNA, 18 bp, Homo sapiens
tgccactgccaggcacct

SEQ ID NO: 1811775 - DNA, 19 bp, Homo sapiens
tgccactgccaggcacctg

SEQ ID NO: 1811776 - DNA, 20 bp, Homo sapiens
tgccactgccaggcacctgg

SEQ ID NO: 1811777 - DNA, 21 bp, Homo sapiens
tgccactgccaggcacctggc

SEQ ID NO: 1811778 - DNA, 21 bp, Homo sapiens
tgccacttcttaaaggcctgg

SEQ ID NO: 1811779 - DNA, 18 bp, Homo sapiens
tgccagactgaaccagag

SEQ ID NO: 1811780 - DNA, 21 bp, Homo sapiens
tgccagcacaggggccccaga

SEQ ID NO: 1811781 - DNA, 22 bp, Homo sapiens
tgccagctgccttcctcatccc

SEQ ID NO: 1811782 - DNA, 18 bp, Homo sapiens
tgccaggatggaatgatg

SEQ ID NO: 1811783 - DNA, 13 bp, Homo sapiens
tgccaggcacctg

SEQ ID NO: 1811784 - DNA, 18 bp, Homo sapiens
tgccaggcacctggcctg

SEQ ID NO: 1811785 - DNA, 23 bp, Homo sapiens
tgccaggcacctggcctgctggg

SEQ ID NO: 1811786 - DNA, 22 bp, Homo sapiens
tgccaggcccatctcaggtgcc

SEQ ID NO: 1811787 - DNA, 23 bp, Homo sapiens
tgccaggcccatctcaggtgcca

SEQ ID NO: 1811788 - DNA, 20 bp, Homo sapiens
tgccaggcgttggtgccact

SEQ ID NO: 1811789 - DNA, 18 bp, Homo sapiens
tgccaggttaggaaggca

SEQ ID NO: 1811790 - DNA, 12 bp, Homo sapiens
tgccagtcgcgc

SEQ ID NO: 1811791 - DNA, 16 bp, Homo sapiens
tgccagtcgcgctgcc

SEQ ID NO: 1811792 - DNA, 18 bp, Homo sapiens
tgccagtcgcgctgcctg

SEQ ID NO: 1811793 - DNA, 21 bp, Homo sapiens
tgccagtcgcgctgcctgtgt

SEQ ID NO: 1811794 - DNA, 15 bp, Homo sapiens
tgccagtgaagtcct

SEQ ID NO: 1811795 - DNA, 14 bp, Homo sapiens
tgccatagccccat

SEQ ID NO: 1811796 - DNA, 13 bp, Homo sapiens
tgccatgccactg

SEQ ID NO: 1811797 - DNA, 18 bp, Homo sapiens
tgccatgccactgccagg

SEQ ID NO: 1811798 - DNA, 23 bp, Homo sapiens
tgccatgtaaaggcctttaataa

SEQ ID NO: 1811799 - DNA, 12 bp, Homo sapiens
tgccattcccac

SEQ ID NO: 1811800 - DNA, 23 bp, Homo sapiens
tgcccacttagccgtccatggca

SEQ ID NO: 1811801 - DNA, 18 bp, Homo sapiens
tgcccatgggcactgctg

SEQ ID NO: 1811802 - DNA, 22 bp, Homo sapiens
tgcccatgggcactgctgggtg

SEQ ID NO: 1811803 - DNA, 15 bp, Homo sapiens
tgcccattcctcacc

SEQ ID NO: 1811804 - DNA, 16 bp, Homo sapiens
tgccccaacccccagc

SEQ ID NO: 1811805 - DNA, 19 bp, Homo sapiens
tgccccaagcagccagcca

SEQ ID NO: 1811806 - DNA, 13 bp, Homo sapiens
tgcccccagaaag

SEQ ID NO: 1811807 - DNA, 15 bp, Homo sapiens
tgcccccatccctcg

SEQ ID NO: 1811808 - DNA, 19 bp, Homo sapiens
tgcccccatctccccaggc

SEQ ID NO: 1811809 - DNA, 23 bp, Homo sapiens
tgccccccatcctggcccatcag

SEQ ID NO: 1811810 - DNA, 13 bp, Homo sapiens
tgccccctcgtgc

SEQ ID NO: 1811811 - DNA, 11 bp, Homo sapiens
tgccccctgcc

SEQ ID NO: 1811812 - DNA, 12 bp, Homo sapiens
tgccccctgcca

SEQ ID NO: 1811813 - DNA, 18 bp, Homo sapiens
tgccccgttccctgtcag

SEQ ID NO: 1811814 - DNA, 19 bp, Homo sapiens
tgccccgttccctgtcaga

SEQ ID NO: 1811815 - DNA, 17 bp, Homo sapiens
tgcccctgtctggaaga

SEQ ID NO: 1811816 - DNA, 12 bp, Homo sapiens
tgccccttgggc

SEQ ID NO: 1811817 - DNA, 18 bp, Homo sapiens
tgcccgcctaggagttga

SEQ ID NO: 1811818 - DNA, 19 bp, Homo sapiens
tgcccgctcccacagcttc

SEQ ID NO: 1811819 - DNA, 16 bp, Homo sapiens
tgcccggcgccctctg

SEQ ID NO: 1811820 - DNA, 21 bp, Homo sapiens
tgcccggcgccctctgtcctg

SEQ ID NO: 1811821 - DNA, 15 bp, Homo sapiens
tgccctccctccttc

SEQ ID NO: 1811822 - DNA, 15 bp, Homo sapiens
tgccctgccacctgt

SEQ ID NO: 1811823 - DNA, 20 bp, Homo sapiens
tgccctgccacctgtctgtc

SEQ ID NO: 1811824 - DNA, 13 bp, Homo sapiens
tgccctgccccca

SEQ ID NO: 1811825 - DNA, 18 bp, Homo sapiens
tgccctgccctgccacct

SEQ ID NO: 1811826 - DNA, 16 bp, Homo sapiens
tgccctgcctgcccac

SEQ ID NO: 1811827 - DNA, 18 bp, Homo sapiens
tgccctgcctgcccactt

SEQ ID NO: 1811828 - DNA, 17 bp, Homo sapiens
tgccctgtaacttatct

SEQ ID NO: 1811829 - DNA, 17 bp, Homo sapiens
tgccgccgcctcgccca

SEQ ID NO: 1811830 - DNA, 15 bp, Homo sapiens
tgcctagaaagcaat

SEQ ID NO: 1811831 - DNA, 13 bp, Homo sapiens
tgcctaggccaaa

SEQ ID NO: 1811832 - DNA, 23 bp, Homo sapiens
tgcctaggccaaatgcacaagct

SEQ ID NO: 1811833 - DNA, 15 bp, Homo sapiens
tgcctatccatcctg

SEQ ID NO: 1811834 - DNA, 15 bp, Homo sapiens
tgcctcatgccacac

SEQ ID NO: 1811835 - DNA, 17 bp, Homo sapiens
tgcctcatgccacacct

SEQ ID NO: 1811836 - DNA, 13 bp, Homo sapiens
tgcctccactccc

SEQ ID NO: 1811837 - DNA, 15 bp, Homo sapiens
tgcctccactcccac

SEQ ID NO: 1811838 - DNA, 17 bp, Homo sapiens
tgcctccactcccactt

SEQ ID NO: 1811839 - DNA, 22 bp, Homo sapiens
tgcctcgaggcaccggcgctgc

SEQ ID NO: 1811840 - DNA, 18 bp, Homo sapiens
tgcctcggctcctgctgc

SEQ ID NO: 1811841 - DNA, 22 bp, Homo sapiens
tgcctcggctcctgctgcacca

SEQ ID NO: 1811842 - DNA, 19 bp, Homo sapiens
tgcctgattcggctgtctc

SEQ ID NO: 1811843 - DNA, 17 bp, Homo sapiens
tgcctgcaccaggagac

SEQ ID NO: 1811844 - DNA, 14 bp, Homo sapiens
tgcctgctagagca

SEQ ID NO: 1811845 - DNA, 18 bp, Homo sapiens
tgcctgctagagcaaccc

SEQ ID NO: 1811846 - DNA, 16 bp, Homo sapiens
tgcctgctccttggca

SEQ ID NO: 1811847 - DNA, 12 bp, Homo sapiens
tgcctggccccc

SEQ ID NO: 1811848 - DNA, 16 bp, Homo sapiens
tgcctggcccccctcc

SEQ ID NO: 1811849 - DNA, 18 bp, Homo sapiens
tgcctggcccccctccag

SEQ ID NO: 1811850 - DNA, 20 bp, Homo sapiens
tgcctggcccccctccaggc

SEQ ID NO: 1811851 - DNA, 21 bp, Homo sapiens
tgcctggcccccctccaggca

SEQ ID NO: 1811852 - DNA, 14 bp, Homo sapiens
tgcctggctgtgga

SEQ ID NO: 1811853 - DNA, 17 bp, Homo sapiens
tgcctggctgtggaggc

SEQ ID NO: 1811854 - DNA, 18 bp, Homo sapiens
tgcctggctgtggaggcc

SEQ ID NO: 1811855 - DNA, 20 bp, Homo sapiens
tgcctggctgtggaggcctg

SEQ ID NO: 1811856 - DNA, 21 bp, Homo sapiens
tgcctggctgtggaggcctga

SEQ ID NO: 1811857 - DNA, 14 bp, Homo sapiens
tgcctgggcctgtg

SEQ ID NO: 1811858 - DNA, 13 bp, Homo sapiens
tgccttcctcatc

SEQ ID NO: 1811859 - DNA, 16 bp, Homo sapiens
tgccttcctcatcccc

SEQ ID NO: 1811860 - DNA, 19 bp, Homo sapiens
tgccttgtgaaggaattat

SEQ ID NO: 1811861 - DNA, 15 bp, Homo sapiens
tgccttttaaaagaa

SEQ ID NO: 1811862 - DNA, 23 bp, Homo sapiens
tgggcactgctgggtggcccatc

SEQ ID NO: 1811863 - DNA, 15 bp, Homo sapiens
tgggcagagctggac

SEQ ID NO: 1811864 - DNA, 14 bp, Homo sapiens
tgggcagctgggcc

SEQ ID NO: 1811865 - DNA, 15 bp, Homo sapiens
tgggcatccacccag

SEQ ID NO: 1811866 - DNA, 19 bp, Homo sapiens
tgggcatccacccagtgct

SEQ ID NO: 1811867 - DNA, 20 bp, Homo sapiens
tgggcatccacccagtgctg

SEQ ID NO: 1811868 - DNA, 22 bp, Homo sapiens
tgggccacacccaggaagggaa

SEQ ID NO: 1811869 - DNA, 24 bp, Homo sapiens
tgggccatactggcctcgcctggc

SEQ ID NO: 1811870 - DNA, 21 bp, Homo sapiens
tgggcccataatagttagccc

SEQ ID NO: 1811871 - DNA, 14 bp, Homo sapiens
tgggccccatgctc

SEQ ID NO: 1811872 - DNA, 19 bp, Homo sapiens
tgggccccatgctctgccc

SEQ ID NO: 1811873 - DNA, 20 bp, Homo sapiens
tgggccccatgctctgcccc

SEQ ID NO: 1811874 - DNA, 18 bp, Homo sapiens
tgggcctgcttttccagg

SEQ ID NO: 1811875 - DNA, 11 bp, Homo sapiens
tgggcctggcc

SEQ ID NO: 1811876 - DNA, 13 bp, Homo sapiens
tgggcctggcctg

SEQ ID NO: 1811877 - DNA, 14 bp, Homo sapiens
ttaattgcaacaat

SEQ ID NO: 1811878 - DNA, 21 bp, Homo sapiens
ttacaaatataggttgtcttg

SEQ ID NO: 1811879 - DNA, 21 bp, Homo sapiens
ttacacttggagcccgtgcag

SEQ ID NO: 1811880 - DNA, 15 bp, Homo sapiens
ttacagaggacagta

SEQ ID NO: 1811881 - DNA, 16 bp, Homo sapiens
ttacagtatcttcaaa

SEQ ID NO: 1811882 - DNA, 15 bp, Homo sapiens
ttacattttcctgtg

SEQ ID NO: 1811883 - DNA, 17 bp, Homo sapiens
ttaccacgccttgacct

SEQ ID NO: 1811884 - DNA, 18 bp, Homo sapiens
ttaccctaaaacatgtgt

SEQ ID NO: 1811885 - DNA, 15 bp, Homo sapiens
ttaccgtagcctccg

SEQ ID NO: 1811886 - DNA, 22 bp, Homo sapiens
ttaccttttaaaatagtaattt

SEQ ID NO: 1811887 - DNA, 12 bp, Homo sapiens
ttactaaagtca

SEQ ID NO: 1811888 - DNA, 21 bp, Homo sapiens
ttactcagcagcagagagccc

SEQ ID NO: 1811889 - DNA, 15 bp, Homo sapiens
ttactctgagcccag

SEQ ID NO: 1811890 - DNA, 17 bp, Homo sapiens
ttactgacagaaatgca

SEQ ID NO: 1811891 - DNA, 15 bp, Homo sapiens
ttagaagaagtgtgt

SEQ ID NO: 1811892 - DNA, 21 bp, Homo sapiens
ttagaatggcctctttgtaga

SEQ ID NO: 1811893 - DNA, 18 bp, Homo sapiens
ttagaatgtttctatttc

SEQ ID NO: 1811894 - DNA, 20 bp, Homo sapiens
ttagaatgtttctatttcca

SEQ ID NO: 1811895 - DNA, 17 bp, Homo sapiens
ttagccttgtgccctgc

SEQ ID NO: 1811896 - DNA, 16 bp, Homo sapiens
ttagcctttgtcccag

SEQ ID NO: 1811897 - DNA, 20 bp, Homo sapiens
ttaggaaggcagcattccat

SEQ ID NO: 1811898 - DNA, 14 bp, Homo sapiens
ttaggactgggttc

SEQ ID NO: 1811899 - DNA, 16 bp, Homo sapiens
ttagtaccttcaaata

SEQ ID NO: 1811900 - DNA, 20 bp, Homo sapiens
ttataaaaaatggtgcctga

SEQ ID NO: 1811901 - DNA, 11 bp, Homo sapiens
ttataaataaa

SEQ ID NO: 1811902 - DNA, 15 bp, Homo sapiens
ttatacatcttcatt

SEQ ID NO: 1811903 - DNA, 21 bp, Homo sapiens
ttatataacccactgctgaaa

SEQ ID NO: 1811904 - DNA, 20 bp, Homo sapiens
ttatatatcataaagtatgc

SEQ ID NO: 1811905 - DNA, 21 bp, Homo sapiens
ttatattcctctaaaactctc

SEQ ID NO: 1811906 - DNA, 14 bp, Homo sapiens
ttatctgatactta

SEQ ID NO: 1811907 - DNA, 14 bp, Homo sapiens
ttatctgcctggcc

SEQ ID NO: 1811908 - DNA, 20 bp, Homo sapiens
ttatctgcctggcctggctc

SEQ ID NO: 1811909 - DNA, 16 bp, Homo sapiens
ttatgagactcttaaa

SEQ ID NO: 1811910 - DNA, 23 bp, Homo sapiens
ttatggcatttagtaccttcaaa

SEQ ID NO: 1811911 - DNA, 16 bp, Homo sapiens
ttatgtaagtttgcat

SEQ ID NO: 1811912 - DNA, 10 bp, Homo sapiens
ttatgtgtgt

SEQ ID NO: 1811913 - DNA, 14 bp, Homo sapiens
ttatgtgtgtgtgt

SEQ ID NO: 1811914 - DNA, 15 bp, Homo sapiens
ttattcaaatgaagg

SEQ ID NO: 1811915 - DNA, 20 bp, Homo sapiens
ttattcaggaaaagcctctg

SEQ ID NO: 1811916 - DNA, 22 bp, Homo sapiens
ttattcaggaaaagcctctgtg

SEQ ID NO: 1811917 - DNA, 21 bp, Homo sapiens
ttattcatgctttctcctttt

SEQ ID NO: 1811918 - DNA, 18 bp, Homo sapiens
ttattgtccttcagagct

SEQ ID NO: 1811919 - DNA, 19 bp, Homo sapiens
ttatttctccatcccctcc

SEQ ID NO: 1811920 - DNA, 13 bp, Homo sapiens
ttatttgtataat

SEQ ID NO: 1811921 - DNA, 15 bp, Homo sapiens
ttatttgttttcccg

SEQ ID NO: 1811922 - DNA, 13 bp, Homo sapiens
ttattttgtaatt

SEQ ID NO: 1811923 - DNA, 18 bp, Homo sapiens
ttattttgtaattattgt

SEQ ID NO: 1811924 - DNA, 15 bp, Homo sapiens
ttcaaaaatttctgc

SEQ ID NO: 1811925 - DNA, 18 bp, Homo sapiens
ttcaaattaatctttcta

SEQ ID NO: 1811926 - DNA, 14 bp, Homo sapiens
ttcaagcaacagca

SEQ ID NO: 1811927 - DNA, 15 bp, Homo sapiens
ttcaatatcattact

SEQ ID NO: 1811928 - DNA, 11 bp, Homo sapiens
ttcaatgcaat

SEQ ID NO: 1811929 - DNA, 16 bp, Homo sapiens
ttcacaacagatttct

SEQ ID NO: 1811930 - DNA, 14 bp, Homo sapiens
ttcactaagccatg

SEQ ID NO: 1811931 - DNA, 14 bp, Homo sapiens
ttcactaccaaatg

SEQ ID NO: 1811932 - DNA, 13 bp, Homo sapiens
ttcagaaggagaa

SEQ ID NO: 1811933 - DNA, 23 bp, Homo sapiens
ttcagatcatttaggatactctt

SEQ ID NO: 1811934 - DNA, 14 bp, Homo sapiens
ttcagatttcaaat

SEQ ID NO: 1811935 - DNA, 17 bp, Homo sapiens
ttcagcaccctgggtgc

SEQ ID NO: 1811936 - DNA, 15 bp, Homo sapiens
ttcagcttctgctgg

SEQ ID NO: 1811937 - DNA, 18 bp, Homo sapiens
ttcaggaaaagcctctgt

SEQ ID NO: 1811938 - DNA, 14 bp, Homo sapiens
ttcaggcactgaga

SEQ ID NO: 1811939 - DNA, 16 bp, Homo sapiens
ttcagggccagaagga

SEQ ID NO: 1811940 - DNA, 23 bp, Homo sapiens
ttcaggggctgcccgctcccagt

SEQ ID NO: 1811941 - DNA, 13 bp, Homo sapiens
ttcaggtaggccc

SEQ ID NO: 1811942 - DNA, 21 bp, Homo sapiens
ttcaggtaggcccttgtcctg

SEQ ID NO: 1811943 - DNA, 17 bp, Homo sapiens
ttcagtgagcccctccc

SEQ ID NO: 1811944 - DNA, 20 bp, Homo sapiens
ttcagtgagcccctccccag

SEQ ID NO: 1811945 - DNA, 12 bp, Homo sapiens
ttcataatttca

SEQ ID NO: 1811946 - DNA, 13 bp, Homo sapiens
ttcatcaatcaaa

SEQ ID NO: 1811947 - DNA, 14 bp, Homo sapiens
ttcatcaatcaaat

SEQ ID NO: 1811948 - DNA, 14 bp, Homo sapiens
ttcatgctttctcc

SEQ ID NO: 1811949 - DNA, 19 bp, Homo sapiens
ttcattatctgtactgaaa

SEQ ID NO: 1811950 - DNA, 13 bp, Homo sapiens
ttccacataaagg

SEQ ID NO: 1811951 - DNA, 17 bp, Homo sapiens
ttccactttttccagaa

SEQ ID NO: 1811952 - DNA, 14 bp, Homo sapiens
ttccagattgttct

SEQ ID NO: 1811953 - DNA, 18 bp, Homo sapiens
ttccaggatcctgcagga

SEQ ID NO: 1811954 - DNA, 11 bp, Homo sapiens
ttccaggcccc

SEQ ID NO: 1811955 - DNA, 13 bp, Homo sapiens
ttccaggcccctg

SEQ ID NO: 1811956 - DNA, 13 bp, Homo sapiens
ttccattgttata

SEQ ID NO: 1811957 - DNA, 19 bp, Homo sapiens
ttcccactaagctttctcc

SEQ ID NO: 1811958 - DNA, 21 bp, Homo sapiens
ttcccactaagctttctcctt

SEQ ID NO: 1811959 - DNA, 19 bp, Homo sapiens
ttcccactgcaccccctcc

SEQ ID NO: 1811960 - DNA, 20 bp, Homo sapiens
ttcccactgcaccccctcct

SEQ ID NO: 1811961 - DNA, 16 bp, Homo sapiens
ttcccagggctggaga

SEQ ID NO: 1811962 - DNA, 17 bp, Homo sapiens
ttcccccatgtggctga

SEQ ID NO: 1811963 - DNA, 20 bp, Homo sapiens
ttccccttttgcctggctgt

SEQ ID NO: 1811964 - DNA, 22 bp, Homo sapiens
ttccccttttgcctggctgtgg

SEQ ID NO: 1811965 - DNA, 13 bp, Homo sapiens
ttcccgtggcccc

SEQ ID NO: 1811966 - DNA, 16 bp, Homo sapiens
ttccctgcaccctgga

SEQ ID NO: 1811967 - DNA, 14 bp, Homo sapiens
ttccctgggaaggc

SEQ ID NO: 1811968 - DNA, 23 bp, Homo sapiens
ttccctgggggcagatatttccc

SEQ ID NO: 1811969 - DNA, 14 bp, Homo sapiens
ttccctgtcagagg

SEQ ID NO: 1811970 - DNA, 12 bp, Homo sapiens
ttcccttgacca

SEQ ID NO: 1811971 - DNA, 14 bp, Homo sapiens
ttcctagtatatta

SEQ ID NO: 1811972 - DNA, 12 bp, Homo sapiens
ttcctccagcct

SEQ ID NO: 1811973 - DNA, 18 bp, Homo sapiens
ttcctccagcctcccctc

SEQ ID NO: 1811974 - DNA, 16 bp, Homo sapiens
ttcctcccccagagcc

SEQ ID NO: 1811975 - DNA, 21 bp, Homo sapiens
ttcctccgtccacccaggctg

SEQ ID NO: 1811976 - DNA, 20 bp, Homo sapiens
ttcctcctccacagtgctgc

SEQ ID NO: 1811977 - DNA, 16 bp, Homo sapiens
ttcctctgatttcaag

SEQ ID NO: 1811978 - DNA, 12 bp, Homo sapiens
ttcctgctgctg

SEQ ID NO: 1811979 - DNA, 23 bp, Homo sapiens
ttcctgctgctgtaactgctgag

SEQ ID NO: 1811980 - DNA, 24 bp, Homo sapiens
ttcctgctgctgtaactgctgagc

SEQ ID NO: 1811981 - DNA, 18 bp, Homo sapiens
ttcctggcctcactggct

SEQ ID NO: 1811982 - DNA, 16 bp, Homo sapiens
ttcctgggcctgtccc

SEQ ID NO: 1811983 - DNA, 19 bp, Homo sapiens
ttcctgtgtaaaaacaaca

SEQ ID NO: 1811984 - DNA, 12 bp, Homo sapiens
ttcctgtgtatt

SEQ ID NO: 1811985 - DNA, 18 bp, Homo sapiens
ttcctttacaactaaata

SEQ ID NO: 1811986 - DNA, 19 bp, Homo sapiens
ttcgctgctctagctggca

SEQ ID NO: 1811987 - DNA, 16 bp, Homo sapiens
ttcgtattacaagaga

SEQ ID NO: 1811988 - DNA, 12 bp, Homo sapiens
ttctaagttaaa

SEQ ID NO: 1811989 - DNA, 14 bp, Homo sapiens
ttctaatccatgtg

SEQ ID NO: 1811990 - DNA, 18 bp, Homo sapiens
ttctaattcttcattata

SEQ ID NO: 1811991 - DNA, 19 bp, Homo sapiens
ttctacacatatatgtata

SEQ ID NO: 1811992 - DNA, 15 bp, Homo sapiens
ttctagaggcctcag

SEQ ID NO: 1811993 - DNA, 16 bp, Homo sapiens
ttctcagaacagctga

SEQ ID NO: 1811994 - DNA, 21 bp, Homo sapiens
ttctcattggggttgcaacaa

SEQ ID NO: 1811995 - DNA, 19 bp, Homo sapiens
ttctccatcccctccctgc

SEQ ID NO: 1811996 - DNA, 23 bp, Homo sapiens
ttctcccccccggggctgggttg

SEQ ID NO: 1811997 - DNA, 20 bp, Homo sapiens
ttgttgctcagcaaggggct

SEQ ID NO: 1811998 - DNA, 17 bp, Homo sapiens
ttgttttcccgccaagc

SEQ ID NO: 1811999 - DNA, 23 bp, Homo sapiens
tttaaaaaacaaaaaccagcagg

SEQ ID NO: 1812000 - DNA, 13 bp, Homo sapiens
tttaaaactatat

SEQ ID NO: 1812001 - DNA, 14 bp, Homo sapiens
tttaaaagtccact

SEQ ID NO: 1812002 - DNA, 23 bp, Homo sapiens
tttaatatctgagaagtgtatat

SEQ ID NO: 1812003 - DNA, 20 bp, Homo sapiens
tttaatatttttcaaaatca

SEQ ID NO: 1812004 - DNA, 21 bp, Homo sapiens
tttaatatttttcaaaatcaa

SEQ ID NO: 1812005 - DNA, 14 bp, Homo sapiens
tttaattgcaacaa

SEQ ID NO: 1812006 - DNA, 12 bp, Homo sapiens
tttacaactaaa

SEQ ID NO: 1812007 - DNA, 16 bp, Homo sapiens
tttacagtatcttcaa

SEQ ID NO: 1812008 - DNA, 20 bp, Homo sapiens
tttacagtatcttcaaaaat

SEQ ID NO: 1812009 - DNA, 13 bp, Homo sapiens
tttacgctgtctg

SEQ ID NO: 1812010 - DNA, 14 bp, Homo sapiens
tttactgacaagaa

SEQ ID NO: 1812011 - DNA, 22 bp, Homo sapiens
tttagaagttaaagtcaatatt

SEQ ID NO: 1812012 - DNA, 14 bp, Homo sapiens
tttagtaccttcaa

SEQ ID NO: 1812013 - DNA, 20 bp, Homo sapiens
tttagtaccttcaaataatt

SEQ ID NO: 1812014 - DNA, 16 bp, Homo sapiens
tttataaacctctaat

SEQ ID NO: 1812015 - DNA, 17 bp, Homo sapiens
tttataaacctctaatt

SEQ ID NO: 1812016 - DNA, 21 bp, Homo sapiens
tttatatgaagtattaaaatg

SEQ ID NO: 1812017 - DNA, 13 bp, Homo sapiens
tttatgggccttg

SEQ ID NO: 1812018 - DNA, 11 bp, Homo sapiens
tttatgtgtgt

SEQ ID NO: 1812019 - DNA, 18 bp, Homo sapiens
tttattttgtaattattg

SEQ ID NO: 1812020 - DNA, 19 bp, Homo sapiens
tttcagaaagtttgaagca

SEQ ID NO: 1812021 - DNA, 12 bp, Homo sapiens
tttcagaaattc

SEQ ID NO: 1812022 - DNA, 17 bp, Homo sapiens
tttcagaaattctcaaa

SEQ ID NO: 1812023 - DNA, 18 bp, Homo sapiens
tttcagaaattctcaaaa

SEQ ID NO: 1812024 - DNA, 16 bp, Homo sapiens
tttcagagttttctaa

SEQ ID NO: 1812025 - DNA, 15 bp, Homo sapiens
tttcagatcatttag

SEQ ID NO: 1812026 - DNA, 14 bp, Homo sapiens
tttccacataaagg

SEQ ID NO: 1812027 - DNA, 16 bp, Homo sapiens
tttccagaatttgaat

SEQ ID NO: 1812028 - DNA, 20 bp, Homo sapiens
tttccagctaagcctgatga

SEQ ID NO: 1812029 - DNA, 17 bp, Homo sapiens
tttcccaggagaccatt

SEQ ID NO: 1812030 - DNA, 20 bp, Homo sapiens
tttcccggtgacacatccat

SEQ ID NO: 1812031 - DNA, 20 bp, Homo sapiens
tttcccgtggccccagcctg

SEQ ID NO: 1812032 - DNA, 19 bp, Homo sapiens
tttcctggtccatctcatt

SEQ ID NO: 1812033 - DNA, 20 bp, Homo sapiens
tttcctgtgtaaacctaatt

SEQ ID NO: 1812034 - DNA, 21 bp, Homo sapiens
tttccttttgcaacaagacaa

SEQ ID NO: 1812035 - DNA, 16 bp, Homo sapiens
tttcgaataaagtgaa

SEQ ID NO: 1812036 - DNA, 19 bp, Homo sapiens
tttcgtgtagtggaagagc

SEQ ID NO: 1812037 - DNA, 23 bp, Homo sapiens
tttctccatcccctccctgcctg

SEQ ID NO: 1812038 - DNA, 21 bp, Homo sapiens
tttctcccccgacactgctgc

SEQ ID NO: 1812039 - DNA, 21 bp, Homo sapiens
tttctgagtagcatatataat

SEQ ID NO: 1812040 - DNA, 13 bp, Homo sapiens
tttcttcgctgct

SEQ ID NO: 1812041 - DNA, 14 bp, Homo sapiens
tttctttcatacat

SEQ ID NO: 1812042 - DNA, 14 bp, Homo sapiens
tttgaatattaacg

SEQ ID NO: 1812043 - DNA, 16 bp, Homo sapiens
tttgagacaagccctg

SEQ ID NO: 1812044 - DNA, 18 bp, Homo sapiens
tttgagacaagccctggc

SEQ ID NO: 1812045 - DNA, 17 bp, Homo sapiens
tttgagtgtatgctgta

SEQ ID NO: 1812046 - DNA, 18 bp, Homo sapiens
tttgatattgagacatta

SEQ ID NO: 1812047 - DNA, 17 bp, Homo sapiens
tttgcaccatgtgaagt

SEQ ID NO: 1812048 - DNA, 22 bp, Homo sapiens
tttgcactggaatatctgagaa

SEQ ID NO: 1812049 - DNA, 12 bp, Homo sapiens
tttgcagagcct

SEQ ID NO: 1812050 - DNA, 12 bp, Homo sapiens
tttgcaggctct

SEQ ID NO: 1812051 - DNA, 14 bp, Homo sapiens
tttgcaggctctgg

SEQ ID NO: 1812052 - DNA, 10 bp, Homo sapiens
tttgccagca

SEQ ID NO: 1812053 - DNA, 22 bp, Homo sapiens
tttgcctggctgtggaggcctg

SEQ ID NO: 1812054 - DNA, 23 bp, Homo sapiens
tttgcctggctgtggaggcctga

SEQ ID NO: 1812055 - DNA, 19 bp, Homo sapiens
tttgctcttctgtatgtga

SEQ ID NO: 1812056 - DNA, 15 bp, Homo sapiens
tttgctgaattcctt

SEQ ID NO: 1812057 - DNA, 13 bp, Homo sapiens
tttgctgcccctg

SEQ ID NO: 1812058 - DNA, 18 bp, Homo sapiens
tttgctgcccctgtctgg

SEQ ID NO: 1812059 - DNA, 17 bp, Homo sapiens
tttgggaggccaaggca

SEQ ID NO: 1812060 - DNA, 21 bp, Homo sapiens
tttgtaagcaacttgcttcta

SEQ ID NO: 1812061 - DNA, 16 bp, Homo sapiens
tttgtactttttaatg

SEQ ID NO: 1812062 - DNA, 16 bp, Homo sapiens
tttgtccccagggccc

SEQ ID NO: 1812063 - DNA, 17 bp, Homo sapiens
tttgtccccagggcccc

SEQ ID NO: 1812064 - DNA, 20 bp, Homo sapiens
tttgtcgaatttttattatt

SEQ ID NO: 1812065 - DNA, 19 bp, Homo sapiens
tttgtggtaaaaagattat

SEQ ID NO: 1812066 - DNA, 13 bp, Homo sapiens
tttgttcatcatt

SEQ ID NO: 1812067 - DNA, 12 bp, Homo sapiens
tttgttcctgtg

SEQ ID NO: 1812068 - DNA, 18 bp, Homo sapiens
tttgttttcttcatttct

SEQ ID NO: 1812069 - DNA, 20 bp, Homo sapiens
ttttaacaaaaaaggaaaat

SEQ ID NO: 1812070 - DNA, 21 bp, Homo sapiens
ttttaatacagattgaaagga

SEQ ID NO: 1812071 - DNA, 13 bp, Homo sapiens
ttttaatgttatt

SEQ ID NO: 1812072 - DNA, 20 bp, Homo sapiens
ttttaattgcaacaatgcaa

SEQ ID NO: 1812073 - DNA, 21 bp, Homo sapiens
ttttactaaaatcgtattcta

SEQ ID NO: 1812074 - DNA, 19 bp, Homo sapiens
ttttataaacctctaattt

SEQ ID NO: 1812075 - DNA, 19 bp, Homo sapiens
ttttatatgtgagcgagca

SEQ ID NO: 1812076 - DNA, 15 bp, Homo sapiens
ttttattttgtaatt

SEQ ID NO: 1812077 - DNA, 21 bp, Homo sapiens
ttttatttttctcatgatgag

SEQ ID NO: 1812078 - DNA, 14 bp, Homo sapiens
ttttcaaaatcaaa

SEQ ID NO: 1812079 - DNA, 24 bp, Homo sapiens
ttttcagaattgaaggagaaaatg

SEQ ID NO: 1812080 - DNA, 17 bp, Homo sapiens
ttttcagagttttctaa

SEQ ID NO: 1812081 - DNA, 17 bp, Homo sapiens
ttttcagcttctgctgg

SEQ ID NO: 1812082 - DNA, 16 bp, Homo sapiens
ttttcatctcttcaat

SEQ ID NO: 1812083 - DNA, 20 bp, Homo sapiens
ttttccaaagagccatgtgt

SEQ ID NO: 1812084 - DNA, 23 bp, Homo sapiens
ttttccaaagagccatgtgtcat

SEQ ID NO: 1812085 - DNA, 20 bp, Homo sapiens
ttttcccactgcaccccctc

SEQ ID NO: 1812086 - DNA, 22 bp, Homo sapiens
ttttcccactgcaccccctcct

SEQ ID NO: 1812087 - DNA, 23 bp, Homo sapiens
ttttctacctttttttctctcct

SEQ ID NO: 1812088 - DNA, 21 bp, Homo sapiens
ttttctagtcagtaaacattt

SEQ ID NO: 1812089 - DNA, 16 bp, Homo sapiens
ttttcttcatttctct

SEQ ID NO: 1812090 - DNA, 21 bp, Homo sapiens
ttttcttttgttttcttcatt

SEQ ID NO: 1812091 - DNA, 19 bp, Homo sapiens
ttttgaaaaaagtatagga

SEQ ID NO: 1812092 - DNA, 19 bp, Homo sapiens
ttttgaattaatctagaaa

SEQ ID NO: 1812093 - DNA, 15 bp, Homo sapiens
ttttgctcttctgta

SEQ ID NO: 1812094 - DNA, 15 bp, Homo sapiens
ttttgctgaattcct

SEQ ID NO: 1812095 - DNA, 16 bp, Homo sapiens
ttttgctgaattcctt

SEQ ID NO: 1812096 - DNA, 15 bp, Homo sapiens
ttttgtaattattgt

SEQ ID NO: 1812097 - DNA, 21 bp, Homo sapiens
tttttaccaactctatactca

SEQ ID NO: 1812098 - DNA, 15 bp, Homo sapiens
tttttatttccacat

SEQ ID NO: 1812099 - DNA, 17 bp, Homo sapiens
tttttcagagttttcta

SEQ ID NO: 1812100 - DNA, 14 bp, Homo sapiens
tttttccagaattt

SEQ ID NO: 1812101 - DNA, 13 bp, Homo sapiens
tttttgagtgtat

SEQ ID NO: 1812102 - DNA, 19 bp, Homo sapiens
tttttgctcttctgtatgt

SEQ ID NO: 1812103 - DNA, 14 bp, Homo sapiens
tttttgttcctgtg

SEQ ID NO: 1812104 - DNA, 17 bp, Homo sapiens
ttttttaattgcaacaa

SEQ ID NO: 1812105 - DNA, 21 bp, Homo sapiens
cggagcacagccctgggaggg

SEQ ID NO: 1812106 - DNA, 12 bp, Homo sapiens
cggctcctgctg

SEQ ID NO: 1812107 - DNA, 14 bp, Homo sapiens
cggctcctgctgca

SEQ ID NO: 1812108 - DNA, 17 bp, Homo sapiens
cggctgcctgccgccca

SEQ ID NO: 1812109 - DNA, 14 bp, Homo sapiens
cggcttcctgtcca

SEQ ID NO: 1812110 - DNA, 16 bp, Homo sapiens
cggcttcctgtccact

SEQ ID NO: 1812111 - DNA, 13 bp, Homo sapiens
cgggaggcaccag

SEQ ID NO: 1812112 - DNA, 14 bp, Homo sapiens
cgggaggggcccgc

SEQ ID NO: 1812113 - DNA, 15 bp, Homo sapiens
cgggaggggcccgct

SEQ ID NO: 1812114 - DNA, 14 bp, Homo sapiens
cgggcagcacagca

SEQ ID NO: 1812115 - DNA, 15 bp, Homo sapiens
cgggcagcacagcaa

SEQ ID NO: 1812116 - DNA, 12 bp, Homo sapiens
cgggcagccccg

SEQ ID NO: 1812117 - DNA, 15 bp, Homo sapiens
cgggcccaggccatc

SEQ ID NO: 1812118 - DNA, 20 bp, Homo sapiens
cgggctcagggaccacagca

SEQ ID NO: 1812119 - DNA, 22 bp, Homo sapiens
cggggaggagagagcagcttct

SEQ ID NO: 1812120 - DNA, 20 bp, Homo sapiens
cggggcccttggggcctggc

SEQ ID NO: 1812121 - DNA, 22 bp, Homo sapiens
cggggcccttggggcctggctt

SEQ ID NO: 1812122 - DNA, 17 bp, Homo sapiens
cggggcgtttctttgcc

SEQ ID NO: 1812123 - DNA, 12 bp, Homo sapiens
cggggctgggtt

SEQ ID NO: 1812124 - DNA, 14 bp, Homo sapiens
cggggtctgtgctg

SEQ ID NO: 1812125 - DNA, 20 bp, Homo sapiens
cggggtctgtgctgtgcctg

SEQ ID NO: 1812126 - DNA, 22 bp, Homo sapiens
cggggtctgtgctgtgcctgct

SEQ ID NO: 1812127 - DNA, 13 bp, Homo sapiens
cgggtgggcctgg

SEQ ID NO: 1812128 - DNA, 23 bp, Homo sapiens
cggtgcatacacccccacctcct

SEQ ID NO: 1812129 - DNA, 23 bp, Homo sapiens
cggttttcagctattagcaactg

SEQ ID NO: 1812130 - DNA, 14 bp, Homo sapiens
cgtccacaggggca

SEQ ID NO: 1812131 - DNA, 19 bp, Homo sapiens
cgtccacaggggcaggcct

SEQ ID NO: 1812132 - DNA, 16 bp, Homo sapiens
cgtccacccaggctgc

SEQ ID NO: 1812133 - DNA, 17 bp, Homo sapiens
cgtcctgacgccctgcg

SEQ ID NO: 1812134 - DNA, 19 bp, Homo sapiens
cgtcctgcagaggaccaca

SEQ ID NO: 1812135 - DNA, 12 bp, Homo sapiens
cgtcctgtccca

SEQ ID NO: 1812136 - DNA, 13 bp, Homo sapiens
cgtcctgtcccag

SEQ ID NO: 1812137 - DNA, 19 bp, Homo sapiens
cgtcggactgcccccagaa

SEQ ID NO: 1812138 - DNA, 15 bp, Homo sapiens
cgtctgccaggccca

SEQ ID NO: 1812139 - DNA, 16 bp, Homo sapiens
cgtctgccaggcccat

SEQ ID NO: 1812140 - DNA, 13 bp, Homo sapiens
cgtgaagcagtgc

SEQ ID NO: 1812141 - DNA, 21 bp, Homo sapiens
cgtgaagcagtgcctcgaggc

SEQ ID NO: 1812142 - DNA, 22 bp, Homo sapiens
cgtgaagcagtgcctcgaggca

SEQ ID NO: 1812143 - DNA, 16 bp, Homo sapiens
cgtgcagtacaggcaa

SEQ ID NO: 1812144 - DNA, 15 bp, Homo sapiens
cgtggacacctgccc

SEQ ID NO: 1812145 - DNA, 12 bp, Homo sapiens
cgtggccccagc

SEQ ID NO: 1812146 - DNA, 22 bp, Homo sapiens
cgtggccccagcctggcccagc

SEQ ID NO: 1812147 - DNA, 15 bp, Homo sapiens
cgtggctaacatcct

SEQ ID NO: 1812148 - DNA, 17 bp, Homo sapiens
cgtggctctgggtgagg

SEQ ID NO: 1812149 - DNA, 17 bp, Homo sapiens
cgtgtcccaaggagctg

SEQ ID NO: 1812150 - DNA, 18 bp, Homo sapiens
cgtgtcccaaggagctga

SEQ ID NO: 1812151 - DNA, 13 bp, Homo sapiens
cgtgtctctccca

SEQ ID NO: 1812152 - DNA, 17 bp, Homo sapiens
cgttagaggagcaacag

SEQ ID NO: 1812153 - DNA, 19 bp, Homo sapiens
cgttccccttggcttcctc

SEQ ID NO: 1812154 - DNA, 20 bp, Homo sapiens
cgttggagccactcctgtcc

SEQ ID NO: 1812155 - DNA, 16 bp, Homo sapiens
cgttgtctccctggcc

SEQ ID NO: 1812156 - DNA, 21 bp, Homo sapiens
cgtttagtttctagaggcctc

SEQ ID NO: 1812157 - DNA, 16 bp, Homo sapiens
cgtttatgggccttgc

SEQ ID NO: 1812158 - DNA, 13 bp, Homo sapiens
ctaaaactctcaa

SEQ ID NO: 1812159 - DNA, 10 bp, Homo sapiens
ctaaaagaat

SEQ ID NO: 1812160 - DNA, 21 bp, Homo sapiens
ctaaagctctgaacaaaagct

SEQ ID NO: 1812161 - DNA, 22 bp, Homo sapiens
ctaaagctctgaacaaaagctt

SEQ ID NO: 1812162 - DNA, 18 bp, Homo sapiens
ctaaatgcccagttcact

SEQ ID NO: 1812163 - DNA, 18 bp, Homo sapiens
ctaacatatgatactgat

SEQ ID NO: 1812164 - DNA, 22 bp, Homo sapiens
ctaacccccagcccacagagcc

SEQ ID NO: 1812165 - DNA, 18 bp, Homo sapiens
ctaacccttaaaaatgca

SEQ ID NO: 1812166 - DNA, 21 bp, Homo sapiens
ctaagatgagatttgccagca

SEQ ID NO: 1812167 - DNA, 22 bp, Homo sapiens
ctaagccctcgaaccaaggcag

SEQ ID NO: 1812168 - DNA, 16 bp, Homo sapiens
ctaagctttctccttt

SEQ ID NO: 1812169 - DNA, 18 bp, Homo sapiens
ctaagtcttgtctcattt

SEQ ID NO: 1812170 - DNA, 16 bp, Homo sapiens
ctaatacttactgtta

SEQ ID NO: 1812171 - DNA, 19 bp, Homo sapiens
ctaatagaaccaagaattc

SEQ ID NO: 1812172 - DNA, 15 bp, Homo sapiens
ctaattctgggaagg

SEQ ID NO: 1812173 - DNA, 15 bp, Homo sapiens
ctaattcttcattat

SEQ ID NO: 1812174 - DNA, 15 bp, Homo sapiens
ctaattcttttcaaa

SEQ ID NO: 1812175 - DNA, 16 bp, Homo sapiens
ctaattcttttcaaaa

SEQ ID NO: 1812176 - DNA, 17 bp, Homo sapiens
ctaattcttttcaaaat

SEQ ID NO: 1812177 - DNA, 14 bp, Homo sapiens
ctacacatatatgt

SEQ ID NO: 1812178 - DNA, 13 bp, Homo sapiens
ctacccctcccag

SEQ ID NO: 1812179 - DNA, 15 bp, Homo sapiens
ctacccctcccagct

SEQ ID NO: 1812180 - DNA, 18 bp, Homo sapiens
ctacccctcccagctgac

SEQ ID NO: 1812181 - DNA, 13 bp, Homo sapiens
ctaccctcccacc

SEQ ID NO: 1812182 - DNA, 20 bp, Homo sapiens
ctaccctccctgctgtcccc

SEQ ID NO: 1812183 - DNA, 17 bp, Homo sapiens
ctactgagtaaacccta

SEQ ID NO: 1812184 - DNA, 11 bp, Homo sapiens
ctactggcagc

SEQ ID NO: 1812185 - DNA, 12 bp, Homo sapiens
ctactggcagct

SEQ ID NO: 1812186 - DNA, 22 bp, Homo sapiens
ctactggcagctcctctccttg

SEQ ID NO: 1812187 - DNA, 23 bp, Homo sapiens
ctactgtatttcattatctgtac

SEQ ID NO: 1812188 - DNA, 22 bp, Homo sapiens
ctagaaagaaaagaccctgaga

SEQ ID NO: 1812189 - DNA, 22 bp, Homo sapiens
ctagagcaacccctgtacccag

SEQ ID NO: 1812190 - DNA, 15 bp, Homo sapiens
ctagaggcctcagtt

SEQ ID NO: 1812191 - DNA, 14 bp, Homo sapiens
ctagaggtgggcag

SEQ ID NO: 1812192 - DNA, 15 bp, Homo sapiens
ctagaggtgggcagc

SEQ ID NO: 1812193 - DNA, 16 bp, Homo sapiens
ctagaggtgggcagct

SEQ ID NO: 1812194 - DNA, 18 bp, Homo sapiens
ctagaggtgggcagctgg

SEQ ID NO: 1812195 - DNA, 21 bp, Homo sapiens
ctagaggtgggcagctgggcc

SEQ ID NO: 1812196 - DNA, 22 bp, Homo sapiens
ctagaggtgggcagctgggccc

SEQ ID NO: 1812197 - DNA, 15 bp, Homo sapiens
ctagcaaattagaaa

SEQ ID NO: 1812198 - DNA, 12 bp, Homo sapiens
ctagccaaggct

SEQ ID NO: 1812199 - DNA, 15 bp, Homo sapiens
ctagccaggagtctg

SEQ ID NO: 1812200 - DNA, 19 bp, Homo sapiens
ctagccaggagtctgtgct

SEQ ID NO: 1812201 - DNA, 20 bp, Homo sapiens
ctagccaggagtctgtgctc

SEQ ID NO: 1812202 - DNA, 22 bp, Homo sapiens
ctagctggcaggacacatcccg

SEQ ID NO: 1812203 - DNA, 12 bp, Homo sapiens
ctaggactgagg

SEQ ID NO: 1812204 - DNA, 15 bp, Homo sapiens
ctaggactgaggagt

SEQ ID NO: 1812205 - DNA, 22 bp, Homo sapiens
ctaggagttgagtacagtgagg

SEQ ID NO: 1812206 - DNA, 17 bp, Homo sapiens
ctaggattcctccccca

SEQ ID NO: 1812207 - DNA, 23 bp, Homo sapiens
ctaggattcctcccccagagcca

SEQ ID NO: 1812208 - DNA, 17 bp, Homo sapiens
ctagggtcctggccctc

SEQ ID NO: 1812209 - DNA, 19 bp, Homo sapiens
ctagtactctctgctctag

SEQ ID NO: 1812210 - DNA, 11 bp, Homo sapiens
ctagtatatta

SEQ ID NO: 1812211 - DNA, 16 bp, Homo sapiens
ctagtcaagaaaaata

SEQ ID NO: 1812212 - DNA, 21 bp, Homo sapiens
ctagtcagtaaacatttgtaa

SEQ ID NO: 1812213 - DNA, 15 bp, Homo sapiens
ctagtggctgtccag

SEQ ID NO: 1812214 - DNA, 19 bp, Homo sapiens
ctagtggctgtccagtgcc

SEQ ID NO: 1812215 - DNA, 16 bp, Homo sapiens
ctagtgtgagtggcag

SEQ ID NO: 1812216 - DNA, 22 bp, Homo sapiens
ctagtgtgagtggcagccatgc

SEQ ID NO: 1812217 - DNA, 23 bp, Homo sapiens
ctagtgtgagtggcagccatgcc

SEQ ID NO: 1812218 - DNA, 20 bp, Homo sapiens
ctataaaatgcccatttcga

SEQ ID NO: 1812219 - DNA, 13 bp, Homo sapiens
ctatacataaatg

SEQ ID NO: 1812220 - DNA, 14 bp, Homo sapiens
ctatacataaatgc

SEQ ID NO: 1812221 - DNA, 19 bp, Homo sapiens
ctatagagagggggctctc

SEQ ID NO: 1812222 - DNA, 22 bp, Homo sapiens
cctgatgctgccccgttccctg

SEQ ID NO: 1812223 - DNA, 12 bp, Homo sapiens
cctgatggccaa

SEQ ID NO: 1812224 - DNA, 13 bp, Homo sapiens
cctgatggccaag

SEQ ID NO: 1812225 - DNA, 17 bp, Homo sapiens
cctgatggccaagagca

SEQ ID NO: 1812226 - DNA, 14 bp, Homo sapiens
cctgcaagccccag

SEQ ID NO: 1812227 - DNA, 15 bp, Homo sapiens
cctgcaatctccagg

SEQ ID NO: 1812228 - DNA, 12 bp, Homo sapiens
cctgcaccagga

SEQ ID NO: 1812229 - DNA, 17 bp, Homo sapiens
cctgcaccaggagacag

SEQ ID NO: 1812230 - DNA, 17 bp, Homo sapiens
cctgcactgtcctgctc

SEQ ID NO: 1812231 - DNA, 23 bp, Homo sapiens
cctgcactgtcctgctccacagt

SEQ ID NO: 1812232 - DNA, 16 bp, Homo sapiens
cctgcagaggaccaca

SEQ ID NO: 1812233 - DNA, 22 bp, Homo sapiens
cctgcagaggaccacagtgggt

SEQ ID NO: 1812234 - DNA, 18 bp, Homo sapiens
cctgcaggaacgagcact

SEQ ID NO: 1812235 - DNA, 20 bp, Homo sapiens
cctgcaggaacgagcactgg

SEQ ID NO: 1812236 - DNA, 16 bp, Homo sapiens
cctgcaggttgggcca

SEQ ID NO: 1812237 - DNA, 21 bp, Homo sapiens
cctgcaggttgggccatactg

SEQ ID NO: 1812238 - DNA, 13 bp, Homo sapiens
cctgccacctgtc

SEQ ID NO: 1812239 - DNA, 14 bp, Homo sapiens
cctgccacctgtct

SEQ ID NO: 1812240 - DNA, 13 bp, Homo sapiens
cctgccagctgcc

SEQ ID NO: 1812241 - DNA, 16 bp, Homo sapiens
cctgccagctgccttc

SEQ ID NO: 1812242 - DNA, 17 bp, Homo sapiens
cctgccagctgccttcc

SEQ ID NO: 1812243 - DNA, 17 bp, Homo sapiens
cctgccagtgaagtcct

SEQ ID NO: 1812244 - DNA, 21 bp, Homo sapiens
cctgccagtgaagtccttcag

SEQ ID NO: 1812245 - DNA, 18 bp, Homo sapiens
cctgccatcatgtttaca

SEQ ID NO: 1812246 - DNA, 13 bp, Homo sapiens
cctgcccaatgct

SEQ ID NO: 1812247 - DNA, 19 bp, Homo sapiens
cctgcccacttagccgtcc

SEQ ID NO: 1812248 - DNA, 15 bp, Homo sapiens
cctgccctgccacct

SEQ ID NO: 1812249 - DNA, 15 bp, Homo sapiens
cctgccctgccctgc

SEQ ID NO: 1812250 - DNA, 16 bp, Homo sapiens
cctgcctatccatcct

SEQ ID NO: 1812251 - DNA, 18 bp, Homo sapiens
cctgcctatccatcctgc

SEQ ID NO: 1812252 - DNA, 22 bp, Homo sapiens
cctgccttggggaaggtctccc

SEQ ID NO: 1812253 - DNA, 20 bp, Homo sapiens
cctgcgtcctgacgccctgc

SEQ ID NO: 1812254 - DNA, 16 bp, Homo sapiens
cctgcgttggagccac

SEQ ID NO: 1812255 - DNA, 18 bp, Homo sapiens
cctgcgttggagccactc

SEQ ID NO: 1812256 - DNA, 23 bp, Homo sapiens
cctgcgttggagccactcctgtc

SEQ ID NO: 1812257 - DNA, 13 bp, Homo sapiens
cctgctagagcaa

SEQ ID NO: 1812258 - DNA, 12 bp, Homo sapiens
cctgctccacag

SEQ ID NO: 1812259 - DNA, 20 bp, Homo sapiens
cctgctccttggcaccccca

SEQ ID NO: 1812260 - DNA, 23 bp, Homo sapiens
cctgctccttggcacccccatgc

SEQ ID NO: 1812261 - DNA, 20 bp, Homo sapiens
cctgctgcaccaacccagcc

SEQ ID NO: 1812262 - DNA, 23 bp, Homo sapiens
cctgctgcaccaacccagccgct

SEQ ID NO: 1812263 - DNA, 14 bp, Homo sapiens
cctgctgcagaggg

SEQ ID NO: 1812264 - DNA, 16 bp, Homo sapiens
cctgctgcagaggggc

SEQ ID NO: 1812265 - DNA, 18 bp, Homo sapiens
cctgctgcagaggggcag

SEQ ID NO: 1812266 - DNA, 22 bp, Homo sapiens
cctgctgggaaccccgcagccc

SEQ ID NO: 1812267 - DNA, 23 bp, Homo sapiens
cctgctgggaaccccgcagcccg

SEQ ID NO: 1812268 - DNA, 22 bp, Homo sapiens
cctgctgtcccctcttgcccca

SEQ ID NO: 1812269 - DNA, 18 bp, Homo sapiens
cctgcttaaacttgaccc

SEQ ID NO: 1812270 - DNA, 22 bp, Homo sapiens
cctgcttgcccgctcccacagc

SEQ ID NO: 1812271 - DNA, 18 bp, Homo sapiens
cctgcttttccaggatcc

SEQ ID NO: 1812272 - DNA, 23 bp, Homo sapiens
cctgcttttccaggatcctgcag

SEQ ID NO: 1812273 - DNA, 18 bp, Homo sapiens
cctggaattcagcaccct

SEQ ID NO: 1812274 - DNA, 22 bp, Homo sapiens
cctggaattcagcaccctgggt

SEQ ID NO: 1812275 - DNA, 16 bp, Homo sapiens
cctggacatattccca

SEQ ID NO: 1812276 - DNA, 20 bp, Homo sapiens
cctggacctgagtcggcccc

SEQ ID NO: 1812277 - DNA, 17 bp, Homo sapiens
cctggactggtggcccc

SEQ ID NO: 1812278 - DNA, 21 bp, Homo sapiens
cctggatgggcattgggctga

SEQ ID NO: 1812279 - DNA, 20 bp, Homo sapiens
cctggatgtgtggggcatgg

SEQ ID NO: 1812280 - DNA, 21 bp, Homo sapiens
cctggcacagtgtctgggctg

SEQ ID NO: 1812281 - DNA, 15 bp, Homo sapiens
cctggcccagctccc

SEQ ID NO: 1812282 - DNA, 16 bp, Homo sapiens
cctggcccagctcccc

SEQ ID NO: 1812283 - DNA, 18 bp, Homo sapiens
cctggcccatcagtgtac

SEQ ID NO: 1812284 - DNA, 17 bp, Homo sapiens
cctggcccccctccagg

SEQ ID NO: 1812285 - DNA, 19 bp, Homo sapiens
cctggcccccctccaggca

SEQ ID NO: 1812286 - DNA, 15 bp, Homo sapiens
cctggcctcactggc

SEQ ID NO: 1812287 - DNA, 17 bp, Homo sapiens
cctggcctcactggctg

SEQ ID NO: 1812288 - DNA, 23 bp, Homo sapiens
cctggcctcactggctggggcag

SEQ ID NO: 1812289 - DNA, 14 bp, Homo sapiens
cctggcctgagctg

SEQ ID NO: 1812290 - DNA, 18 bp, Homo sapiens
cctggcctgagctggggc

SEQ ID NO: 1812291 - DNA, 16 bp, Homo sapiens
cctggcctgaggtctc

SEQ ID NO: 1812292 - DNA, 15 bp, Homo sapiens
cctggcctgctggga

SEQ ID NO: 1812293 - DNA, 18 bp, Homo sapiens
cctggcctgctgggaacc

SEQ ID NO: 1812294 - DNA, 12 bp, Homo sapiens
cctggcctggct

SEQ ID NO: 1812295 - DNA, 13 bp, Homo sapiens
cctggcctggctc

SEQ ID NO: 1812296 - DNA, 16 bp, Homo sapiens
cctggcctggctcccc

SEQ ID NO: 1812297 - DNA, 13 bp, Homo sapiens
cctggctccccac

SEQ ID NO: 1812298 - DNA, 18 bp, Homo sapiens
cctggctccccacgagtc

SEQ ID NO: 1812299 - DNA, 23 bp, Homo sapiens
cctggctccccacgagtcacctg

SEQ ID NO: 1812300 - DNA, 12 bp, Homo sapiens
cctggctgccag

SEQ ID NO: 1812301 - DNA, 15 bp, Homo sapiens
cctggctgccaggcg

SEQ ID NO: 1812302 - DNA, 18 bp, Homo sapiens
cctggctgccaggcgttg

SEQ ID NO: 1812303 - DNA, 14 bp, Homo sapiens
cctggctgtggagg

SEQ ID NO: 1812304 - DNA, 16 bp, Homo sapiens
cctggctgtggaggcc

SEQ ID NO: 1812305 - DNA, 17 bp, Homo sapiens
cctggctgtggaggcct

SEQ ID NO: 1812306 - DNA, 23 bp, Homo sapiens
cctggctgtggaggcctgatgct

SEQ ID NO: 1812307 - DNA, 23 bp, Homo sapiens
cctgggaaaggacccacccatct

SEQ ID NO: 1812308 - DNA, 15 bp, Homo sapiens
cctgggacccagcta

SEQ ID NO: 1812309 - DNA, 17 bp, Homo sapiens
cctgggactcccagtga

SEQ ID NO: 1812310 - DNA, 20 bp, Homo sapiens
cctgggcctgcttttccagg

SEQ ID NO: 1812311 - DNA, 23 bp, Homo sapiens
cctgggcctgcttttccaggatc

SEQ ID NO: 1812312 - DNA, 12 bp, Homo sapiens
cctgggcctgtc

SEQ ID NO: 1812313 - DNA, 14 bp, Homo sapiens
cctgggcctgtgca

SEQ ID NO: 1812314 - DNA, 15 bp, Homo sapiens
cctgggcctgtgcag

SEQ ID NO: 1812315 - DNA, 17 bp, Homo sapiens
cctgggcctgtgcagca

SEQ ID NO: 1812316 - DNA, 21 bp, Homo sapiens
cctgggcctgtgcagcagccc

SEQ ID NO: 1812317 - DNA, 23 bp, Homo sapiens
cctgggcctgtgcagcagcccag

SEQ ID NO: 1812318 - DNA, 15 bp, Homo sapiens
cctgggctctgtggg

SEQ ID NO: 1812319 - DNA, 19 bp, Homo sapiens
cctgggctctgtgggctgc

SEQ ID NO: 1812320 - DNA, 22 bp, Homo sapiens
cctgggctctgtgggctgcact

SEQ ID NO: 1812321 - DNA, 18 bp, Homo sapiens
cctggtaagcagaggctt

SEQ ID NO: 1812322 - DNA, 19 bp, Homo sapiens
cctggtccctcgtccacag

SEQ ID NO: 1812323 - DNA, 13 bp, Homo sapiens
cctgtacccagct

SEQ ID NO: 1812324 - DNA, 14 bp, Homo sapiens
cctgtacccagctc

SEQ ID NO: 1812325 - DNA, 15 bp, Homo sapiens
cctgtacccagctcc

SEQ ID NO: 1812326 - DNA, 16 bp, Homo sapiens
cctgtacccagctcct

SEQ ID NO: 1812327 - DNA, 15 bp, Homo sapiens
cctgtcagtgccgcc

SEQ ID NO: 1812328 - DNA, 14 bp, Homo sapiens
cctgtccataaagt

SEQ ID NO: 1812329 - DNA, 15 bp, Homo sapiens
cctgtccataaagta

SEQ ID NO: 1812330 - DNA, 14 bp, Homo sapiens
cctgtcccagaggt

SEQ ID NO: 1812331 - DNA, 15 bp, Homo sapiens
cctgtcccccaaggt

SEQ ID NO: 1812332 - DNA, 13 bp, Homo sapiens
cctgtcccgcctt

SEQ ID NO: 1812333 - DNA, 22 bp, Homo sapiens
cctgtcccgccttcctcctcca

SEQ ID NO: 1812334 - DNA, 13 bp, Homo sapiens
cctgtctccaggg

SEQ ID NO: 1812335 - DNA, 22 bp, Homo sapiens
cctgtctggaagacgtggctct

SEQ ID NO: 1812336 - DNA, 23 bp, Homo sapiens
cctgtctggaagacgtggctctg

SEQ ID NO: 1812337 - DNA, 22 bp, Homo sapiens
cctgtctgtctgtctgtcccaa

SEQ ID NO: 1812338 - DNA, 21 bp, Homo sapiens
gtacctatgtgagtttcagaa

SEQ ID NO: 1812339 - DNA, 19 bp, Homo sapiens
gtacctgggaaaggaccca

SEQ ID NO: 1812340 - DNA, 21 bp, Homo sapiens
gtacctgggaaaggacccacc

SEQ ID NO: 1812341 - DNA, 14 bp, Homo sapiens
gtaccttcaaataa

SEQ ID NO: 1812342 - DNA, 17 bp, Homo sapiens
gtactctctgctctagc

SEQ ID NO: 1812343 - DNA, 22 bp, Homo sapiens
gtactgatactattcaatgcaa

SEQ ID NO: 1812344 - DNA, 22 bp, Homo sapiens
gtacttacatctttgtttacca

SEQ ID NO: 1812345 - DNA, 19 bp, Homo sapiens
gtacttttggcatgaaagt

SEQ ID NO: 1812346 - DNA, 15 bp, Homo sapiens
gtagaataaatgaag

SEQ ID NO: 1812347 - DNA, 19 bp, Homo sapiens
gtagaataaatgaagaaag

SEQ ID NO: 1812348 - DNA, 17 bp, Homo sapiens
gtagatcgcttgagccc

SEQ ID NO: 1812349 - DNA, 19 bp, Homo sapiens
gtagatcgcttgagcccag

SEQ ID NO: 1812350 - DNA, 15 bp, Homo sapiens
gtagccatggctcag

SEQ ID NO: 1812351 - DNA, 17 bp, Homo sapiens
gtagccatggctcaggc

SEQ ID NO: 1812352 - DNA, 20 bp, Homo sapiens
gtagccatggctcaggcaag

SEQ ID NO: 1812353 - DNA, 19 bp, Homo sapiens
gtagcctccgtttatgggc

SEQ ID NO: 1812354 - DNA, 20 bp, Homo sapiens
gtagcctccgtttatgggcc

SEQ ID NO: 1812355 - DNA, 22 bp, Homo sapiens
gtagcctccgtttatgggcctt

SEQ ID NO: 1812356 - DNA, 14 bp, Homo sapiens
gtaggtccaagggc

SEQ ID NO: 1812357 - DNA, 15 bp, Homo sapiens
gtaggtccaagggcc

SEQ ID NO: 1812358 - DNA, 16 bp, Homo sapiens
gtaggtccaagggcca

SEQ ID NO: 1812359 - DNA, 17 bp, Homo sapiens
gtagtcgtcaagttgca

SEQ ID NO: 1812360 - DNA, 15 bp, Homo sapiens
gtagtggaagagcag

SEQ ID NO: 1812361 - DNA, 16 bp, Homo sapiens
gtagtggaagagcagc

SEQ ID NO: 1812362 - DNA, 20 bp, Homo sapiens
gtagtggaagagcagcctga

SEQ ID NO: 1812363 - DNA, 18 bp, Homo sapiens
gtatatatcaggtaaaat

SEQ ID NO: 1812364 - DNA, 18 bp, Homo sapiens
gtatatctatatctctaa

SEQ ID NO: 1812365 - DNA, 18 bp, Homo sapiens
gtatcgctgccttgccat

SEQ ID NO: 1812366 - DNA, 16 bp, Homo sapiens
gtatgaacttgaggac

SEQ ID NO: 1812367 - DNA, 19 bp, Homo sapiens
gtatgaacttgaggacaca

SEQ ID NO: 1812368 - DNA, 21 bp, Homo sapiens
gtatgtacgtacgtataagac

SEQ ID NO: 1812369 - DNA, 15 bp, Homo sapiens
gtatgtggaagtgtg

SEQ ID NO: 1812370 - DNA, 16 bp, Homo sapiens
gtatgtggaagtgtgg

SEQ ID NO: 1812371 - DNA, 18 bp, Homo sapiens
gtatgtggaagtgtgggt

SEQ ID NO: 1812372 - DNA, 21 bp, Homo sapiens
gtatgtggaagtgtgggtctg

SEQ ID NO: 1812373 - DNA, 19 bp, Homo sapiens
gtatgtgggggtctgtgtg

SEQ ID NO: 1812374 - DNA, 20 bp, Homo sapiens
gtatgtgggggtctgtgtgt

SEQ ID NO: 1812375 - DNA, 23 bp, Homo sapiens
gtattacaagagaaacaaataaa

SEQ ID NO: 1812376 - DNA, 16 bp, Homo sapiens
gtattctaattcttca

SEQ ID NO: 1812377 - DNA, 13 bp, Homo sapiens
gtattttgacaaa

SEQ ID NO: 1812378 - DNA, 15 bp, Homo sapiens
gtcaactggctggcc

SEQ ID NO: 1812379 - DNA, 22 bp, Homo sapiens
gtcaagaaatgagtctgtttga

SEQ ID NO: 1812380 - DNA, 16 bp, Homo sapiens
gtcaataactttatat

SEQ ID NO: 1812381 - DNA, 11 bp, Homo sapiens
gtcacagctgc

SEQ ID NO: 1812382 - DNA, 16 bp, Homo sapiens
gtcacagctgcagctg

SEQ ID NO: 1812383 - DNA, 13 bp, Homo sapiens
gtcacctgcaagc

SEQ ID NO: 1812384 - DNA, 19 bp, Homo sapiens
gtcacctgcaagccccagg

SEQ ID NO: 1812385 - DNA, 23 bp, Homo sapiens
gtcacctgcaagccccagggcct

SEQ ID NO: 1812386 - DNA, 24 bp, Homo sapiens
gtcacctgcaagccccagggcctg

SEQ ID NO: 1812387 - DNA, 17 bp, Homo sapiens
gtcagtaggtccaaggg

SEQ ID NO: 1812388 - DNA, 17 bp, Homo sapiens
gtcagtatgtggaagtg

SEQ ID NO: 1812389 - DNA, 21 bp, Homo sapiens
gtcagtatgtggaagtgtggg

SEQ ID NO: 1812390 - DNA, 23 bp, Homo sapiens
gtcagtgccgccgcctcgcccac

SEQ ID NO: 1812391 - DNA, 22 bp, Homo sapiens
gtcagttcccggagcacagccc

SEQ ID NO: 1812392 - DNA, 14 bp, Homo sapiens
gtcatcactccctg

SEQ ID NO: 1812393 - DNA, 21 bp, Homo sapiens
gtcatgctcacttttgtgaaa

SEQ ID NO: 1812394 - DNA, 16 bp, Homo sapiens
gtcatgtaatactgaa

SEQ ID NO: 1812395 - DNA, 15 bp, Homo sapiens
gtccacctgcctatc

SEQ ID NO: 1812396 - DNA, 20 bp, Homo sapiens
gtccactctcggggcccttg

SEQ ID NO: 1812397 - DNA, 13 bp, Homo sapiens
gtccagcagctgc

SEQ ID NO: 1812398 - DNA, 14 bp, Homo sapiens
gtccagcagctgcg

SEQ ID NO: 1812399 - DNA, 14 bp, Homo sapiens
gtccaggaaggcag

SEQ ID NO: 1812400 - DNA, 18 bp, Homo sapiens
gtccaggaaggcagctgc

SEQ ID NO: 1812401 - DNA, 22 bp, Homo sapiens
gtccaggaaggcagctgctctt

SEQ ID NO: 1812402 - DNA, 14 bp, Homo sapiens
gtccaggccactgt

SEQ ID NO: 1812403 - DNA, 17 bp, Homo sapiens
gtccaggccactgtggc

SEQ ID NO: 1812404 - DNA, 21 bp, Homo sapiens
gtccaggccactgtggccaga

SEQ ID NO: 1812405 - DNA, 16 bp, Homo sapiens
gtgggggtctgtgtgt

SEQ ID NO: 1812406 - DNA, 19 bp, Homo sapiens
gtgggtccaggaaggcagc

SEQ ID NO: 1812407 - DNA, 21 bp, Homo sapiens
gtgggtccaggaaggcagctg

SEQ ID NO: 1812408 - DNA, 22 bp, Homo sapiens
gtgggtccaggaaggcagctgc

SEQ ID NO: 1812409 - DNA, 20 bp, Homo sapiens
gtgggtcccacttcccctcc

SEQ ID NO: 1812410 - DNA, 21 bp, Homo sapiens
gtgggtcccacttcccctcct

SEQ ID NO: 1812411 - DNA, 16 bp, Homo sapiens
gtgggtctgtgtgtgt

SEQ ID NO: 1812412 - DNA, 18 bp, Homo sapiens
gtggtctgctcgggccca

SEQ ID NO: 1812413 - DNA, 15 bp, Homo sapiens
gtgtaaagaataaat

SEQ ID NO: 1812414 - DNA, 19 bp, Homo sapiens
gtgtacccccgcccaggct

SEQ ID NO: 1812415 - DNA, 17 bp, Homo sapiens
gtgtagtggaagagcag

SEQ ID NO: 1812416 - DNA, 13 bp, Homo sapiens
gtgtcactggctg

SEQ ID NO: 1812417 - DNA, 16 bp, Homo sapiens
gtgtcactggctgcct

SEQ ID NO: 1812418 - DNA, 14 bp, Homo sapiens
gtgtccagcagctg

SEQ ID NO: 1812419 - DNA, 19 bp, Homo sapiens
gtgtccagcagctgcgggt

SEQ ID NO: 1812420 - DNA, 22 bp, Homo sapiens
gtgtccagcagctgcgggtctg

SEQ ID NO: 1812421 - DNA, 17 bp, Homo sapiens
gtgtcccaaggagctga

SEQ ID NO: 1812422 - DNA, 19 bp, Homo sapiens
gtgtgagtggcagccatgc

SEQ ID NO: 1812423 - DNA, 20 bp, Homo sapiens
gtgtgccccccatcctggcc

SEQ ID NO: 1812424 - DNA, 13 bp, Homo sapiens
gtgtgcctgtggc

SEQ ID NO: 1812425 - DNA, 15 bp, Homo sapiens
gtgtgcctgtggcag

SEQ ID NO: 1812426 - DNA, 14 bp, Homo sapiens
gtgtggtggctcat

SEQ ID NO: 1812427 - DNA, 13 bp, Homo sapiens
gtgtgtatgtggg

SEQ ID NO: 1812428 - DNA, 16 bp, Homo sapiens
gtgtgtgggagtgtgt

SEQ ID NO: 1812429 - DNA, 14 bp, Homo sapiens
gtgtgtgtatgtgg

SEQ ID NO: 1812430 - DNA, 21 bp, Homo sapiens
gtgtgttctgtaatggaactg

SEQ ID NO: 1812431 - DNA, 17 bp, Homo sapiens
gtgtgttgtgtgtggga

SEQ ID NO: 1812432 - DNA, 14 bp, Homo sapiens
gtgtgtttatgtgt

SEQ ID NO: 1812433 - DNA, 17 bp, Homo sapiens
gtgttaccttttaaaat

SEQ ID NO: 1812434 - DNA, 19 bp, Homo sapiens
gttacttgtctgaggcctc

SEQ ID NO: 1812435 - DNA, 22 bp, Homo sapiens
gttaggattaggtttagaatca

SEQ ID NO: 1812436 - DNA, 13 bp, Homo sapiens
gttaggcctggca

SEQ ID NO: 1812437 - DNA, 15 bp, Homo sapiens
gttaggcctggcaca

SEQ ID NO: 1812438 - DNA, 16 bp, Homo sapiens
gttaggcctggcacag

SEQ ID NO: 1812439 - DNA, 12 bp, Homo sapiens
gttatacatctt

SEQ ID NO: 1812440 - DNA, 18 bp, Homo sapiens
gttatacatcttcattaa

SEQ ID NO: 1812441 - DNA, 18 bp, Homo sapiens
gttatctgcctggcctgg

SEQ ID NO: 1812442 - DNA, 18 bp, Homo sapiens
gttatttggaattttaag

SEQ ID NO: 1812443 - DNA, 21 bp, Homo sapiens
gttcacttctttgcagagcct

SEQ ID NO: 1812444 - DNA, 14 bp, Homo sapiens
gttcataatttcag

SEQ ID NO: 1812445 - DNA, 23 bp, Homo sapiens
gttcatacggggtggctgaaagt

SEQ ID NO: 1812446 - DNA, 17 bp, Homo sapiens
gttccccttggcttcct

SEQ ID NO: 1812447 - DNA, 19 bp, Homo sapiens
gttccccttggcttcctcc

SEQ ID NO: 1812448 - DNA, 18 bp, Homo sapiens
gttcccggagcacagccc

SEQ ID NO: 1812449 - DNA, 20 bp, Homo sapiens
gttcccggagcacagccctg

SEQ ID NO: 1812450 - DNA, 23 bp, Homo sapiens
gttcccggagcacagccctggga

SEQ ID NO: 1812451 - DNA, 16 bp, Homo sapiens
gttccctgcaccctgg

SEQ ID NO: 1812452 - DNA, 20 bp, Homo sapiens
gttccctgtcagaggctaag

SEQ ID NO: 1812453 - DNA, 16 bp, Homo sapiens
gttcctctgatttcaa

SEQ ID NO: 1812454 - DNA, 18 bp, Homo sapiens
gttcctctgatttcaagg

SEQ ID NO: 1812455 - DNA, 9 bp, Homo sapiens
gttcctgtg

SEQ ID NO: 1812456 - DNA, 23 bp, Homo sapiens
gttctggtatgaacttgaggaca

SEQ ID NO: 1812457 - DNA, 21 bp, Homo sapiens
gttctgtaatggaactgaccc

SEQ ID NO: 1812458 - DNA, 15 bp, Homo sapiens
gttcttgggggaggc

SEQ ID NO: 1812459 - DNA, 21 bp, Homo sapiens
gttcttgggggaggccacccc

SEQ ID NO: 1812460 - DNA, 13 bp, Homo sapiens
gttgaccactcca

SEQ ID NO: 1812461 - DNA, 24 bp, Homo sapiens
gttgcacatcattcattcactgta

SEQ ID NO: 1812462 - DNA, 22 bp, Homo sapiens
gttgcagatctttttgtgaaat

SEQ ID NO: 1812463 - DNA, 22 bp, Homo sapiens
gttgcatcccccttagaatgtt

SEQ ID NO: 1812464 - DNA, 18 bp, Homo sapiens
gttgccaactaagccctc

SEQ ID NO: 1812465 - DNA, 12 bp, Homo sapiens
gttggagccact

SEQ ID NO: 1812466 - DNA, 13 bp, Homo sapiens
gttggcagagaag

SEQ ID NO: 1812467 - DNA, 14 bp, Homo sapiens
gttggcagagaagg

SEQ ID NO: 1812468 - DNA, 14 bp, Homo sapiens
gttgggagaatgtc

SEQ ID NO: 1812469 - DNA, 21 bp, Homo sapiens
gttgggccatactggcctcgc

SEQ ID NO: 1812470 - DNA, 13 bp, Homo sapiens
gttggtgccactt

SEQ ID NO: 1812471 - DNA, 18 bp, Homo sapiens
gttgtatcagcacgtgtg

SEQ ID NO: 1812472 - DNA, 20 bp, Homo sapiens
gttgtctattctgagccttg

SEQ ID NO: 1812473 - DNA, 22 bp, Homo sapiens
gttgtctattctgagccttgag

SEQ ID NO: 1812474 - DNA, 14 bp, Homo sapiens
gttgtctccctggc

SEQ ID NO: 1812475 - DNA, 16 bp, Homo sapiens
gttgtctccctggccc

SEQ ID NO: 1812476 - DNA, 19 bp, Homo sapiens
gttgtctccctggccctca

SEQ ID NO: 1812477 - DNA, 12 bp, Homo sapiens
gttgtgggcttt

SEQ ID NO: 1812478 - DNA, 20 bp, Homo sapiens
gttgttgccaactaagccct

SEQ ID NO: 1812479 - DNA, 16 bp, Homo sapiens
aaggctggctgagtgg

SEQ ID NO: 1812480 - DNA, 17 bp, Homo sapiens
aagggaaagcgggcagc

SEQ ID NO: 1812481 - DNA, 15 bp, Homo sapiens
aagggacagaaaaga

SEQ ID NO: 1812482 - DNA, 16 bp, Homo sapiens
aagggcagtaaagttt

SEQ ID NO: 1812483 - DNA, 18 bp, Homo sapiens
aagggcatcaggcactgg

SEQ ID NO: 1812484 - DNA, 14 bp, Homo sapiens
aagggccttctcca

SEQ ID NO: 1812485 - DNA, 21 bp, Homo sapiens
aagggctccagcatccagcct

SEQ ID NO: 1812486 - DNA, 23 bp, Homo sapiens
aagggctccagcatccagcctgt

SEQ ID NO: 1812487 - DNA, 17 bp, Homo sapiens
aaggtaatgcacatcct

SEQ ID NO: 1812488 - DNA, 21 bp, Homo sapiens
aaggtaatgcacatcctcatt

SEQ ID NO: 1812489 - DNA, 20 bp, Homo sapiens
aaggtatttagaatatatta

SEQ ID NO: 1812490 - DNA, 22 bp, Homo sapiens
aaggtctccttactctgagccc

SEQ ID NO: 1812491 - DNA, 23 bp, Homo sapiens
aaggtctccttactctgagccca

SEQ ID NO: 1812492 - DNA, 18 bp, Homo sapiens
aaggttactcagcagcag

SEQ ID NO: 1812493 - DNA, 21 bp, Homo sapiens
aaggttactcagcagcagaga

SEQ ID NO: 1812494 - DNA, 22 bp, Homo sapiens
aaggttactcagcagcagagag

SEQ ID NO: 1812495 - DNA, 15 bp, Homo sapiens
aagtaaaagctaatt

SEQ ID NO: 1812496 - DNA, 23 bp, Homo sapiens
aagtaatgccacacattgtgctt

SEQ ID NO: 1812497 - DNA, 21 bp, Homo sapiens
aagtataggataaattacatt

SEQ ID NO: 1812498 - DNA, 14 bp, Homo sapiens
aagtattaaaatgc

SEQ ID NO: 1812499 - DNA, 17 bp, Homo sapiens
aagtattaaaatgcata

SEQ ID NO: 1812500 - DNA, 16 bp, Homo sapiens
aagtcaatattgattt

SEQ ID NO: 1812501 - DNA, 21 bp, Homo sapiens
aagtcaatattgattttaaat

SEQ ID NO: 1812502 - DNA, 13 bp, Homo sapiens
aagtcacagctgc

SEQ ID NO: 1812503 - DNA, 16 bp, Homo sapiens
aagtcacagctgcagc

SEQ ID NO: 1812504 - DNA, 21 bp, Homo sapiens
aagtcactggccagtggctgg

SEQ ID NO: 1812505 - DNA, 17 bp, Homo sapiens
aagtctaaacaatgaat

SEQ ID NO: 1812506 - DNA, 18 bp, Homo sapiens
aagtgaaagacttgaatt

SEQ ID NO: 1812507 - DNA, 10 bp, Homo sapiens
aagtgtgggt

SEQ ID NO: 1812508 - DNA, 16 bp, Homo sapiens
aagtgttgtggagaaa

SEQ ID NO: 1812509 - DNA, 17 bp, Homo sapiens
aagtgttgtggagaaaa

SEQ ID NO: 1812510 - DNA, 22 bp, Homo sapiens
aagtgttttctcagaacagctg

SEQ ID NO: 1812511 - DNA, 19 bp, Homo sapiens
aagttaaagtcaatattga

SEQ ID NO: 1812512 - DNA, 21 bp, Homo sapiens
aagttaaatcattttcattaa

SEQ ID NO: 1812513 - DNA, 21 bp, Homo sapiens
aagtttcacaacagatttcta

SEQ ID NO: 1812514 - DNA, 13 bp, Homo sapiens
aagtttttcagaa

SEQ ID NO: 1812515 - DNA, 15 bp, Homo sapiens
aataaaaagtaacac

SEQ ID NO: 1812516 - DNA, 14 bp, Homo sapiens
aataaagctgctga

SEQ ID NO: 1812517 - DNA, 11 bp, Homo sapiens
aataaagctgg

SEQ ID NO: 1812518 - DNA, 13 bp, Homo sapiens
aataaagctggac

SEQ ID NO: 1812519 - DNA, 15 bp, Homo sapiens
aataagtcattgaaa

SEQ ID NO: 1812520 - DNA, 16 bp, Homo sapiens
aataatgtaatactgt

SEQ ID NO: 1812521 - DNA, 12 bp, Homo sapiens
aataattcatca

SEQ ID NO: 1812522 - DNA, 23 bp, Homo sapiens
aatacaaaaggcattttatatga

SEQ ID NO: 1812523 - DNA, 13 bp, Homo sapiens
aatacagaagaaa

SEQ ID NO: 1812524 - DNA, 19 bp, Homo sapiens
aatacagaatttatagaat

SEQ ID NO: 1812525 - DNA, 19 bp, Homo sapiens
aatacgtgttcaaaaattt

SEQ ID NO: 1812526 - DNA, 18 bp, Homo sapiens
aatactgaaccactttga

SEQ ID NO: 1812527 - DNA, 21 bp, Homo sapiens
aatactgtgttaccttttaaa

SEQ ID NO: 1812528 - DNA, 15 bp, Homo sapiens
aatactgtttcacta

SEQ ID NO: 1812529 - DNA, 21 bp, Homo sapiens
aatactgtttcactaatactt

SEQ ID NO: 1812530 - DNA, 14 bp, Homo sapiens
aatataaaaacaac

SEQ ID NO: 1812531 - DNA, 17 bp, Homo sapiens
aatataaaaacaacaaa

SEQ ID NO: 1812532 - DNA, 21 bp, Homo sapiens
aatataatgagtcacaaaata

SEQ ID NO: 1812533 - DNA, 20 bp, Homo sapiens
aatatacttagatcctggta

SEQ ID NO: 1812534 - DNA, 23 bp, Homo sapiens
aatatctgagaagtgtatatagt

SEQ ID NO: 1812535 - DNA, 23 bp, Homo sapiens
aatatctgagaattgcaaaacta

SEQ ID NO: 1812536 - DNA, 17 bp, Homo sapiens
aatatgagagaactatt

SEQ ID NO: 1812537 - DNA, 23 bp, Homo sapiens
aatattatataacccactgctga

SEQ ID NO: 1812538 - DNA, 14 bp, Homo sapiens
aattgctaattctg

SEQ ID NO: 1812539 - DNA, 11 bp, Homo sapiens
aattgtgatgt

SEQ ID NO: 1812540 - DNA, 14 bp, Homo sapiens
aattgtgatgtgtc

SEQ ID NO: 1812541 - DNA, 16 bp, Homo sapiens
aattgtggtagaaatt

SEQ ID NO: 1812542 - DNA, 17 bp, Homo sapiens
aatttattttgtcgaat

SEQ ID NO: 1812543 - DNA, 15 bp, Homo sapiens
aatttgaaacacaag

SEQ ID NO: 1812544 - DNA, 23 bp, Homo sapiens
aatttgaaacacaagaattacac

SEQ ID NO: 1812545 - DNA, 20 bp, Homo sapiens
aatttgtaagcaacttgctt

SEQ ID NO: 1812546 - DNA, 22 bp, Homo sapiens
aatttgtaagcaacttgcttct

SEQ ID NO: 1812547 - DNA, 19 bp, Homo sapiens
aatttgtacccttgttatt

SEQ ID NO: 1812548 - DNA, 21 bp, Homo sapiens
aattttctttcatacattata

SEQ ID NO: 1812549 - DNA, 23 bp, Homo sapiens
aattttctttcatacattatatt

SEQ ID NO: 1812550 - DNA, 19 bp, Homo sapiens
aatttttcatctcttcaat

SEQ ID NO: 1812551 - DNA, 13 bp, Homo sapiens
aatttttgctgaa

SEQ ID NO: 1812552 - DNA, 16 bp, Homo sapiens
acaaaagttcaacctc

SEQ ID NO: 1812553 - DNA, 15 bp, Homo sapiens
acaaaagtttcacaa

SEQ ID NO: 1812554 - DNA, 15 bp, Homo sapiens
acaaacaaataaata

SEQ ID NO: 1812555 - DNA, 13 bp, Homo sapiens
acaacattttaat

SEQ ID NO: 1812556 - DNA, 18 bp, Homo sapiens
acaacatttttgtacatt

SEQ ID NO: 1812557 - DNA, 16 bp, Homo sapiens
acaacctgcccctccc

SEQ ID NO: 1812558 - DNA, 13 bp, Homo sapiens
acaactaaataac

SEQ ID NO: 1812559 - DNA, 13 bp, Homo sapiens
acaagaagctgct

SEQ ID NO: 1812560 - DNA, 14 bp, Homo sapiens
acaagaagctgcta

SEQ ID NO: 1812561 - DNA, 16 bp, Homo sapiens
acaagaattacactaa

SEQ ID NO: 1812562 - DNA, 23 bp, Homo sapiens
acaagaggttaaggtgggtccag

SEQ ID NO: 1812563 - DNA, 11 bp, Homo sapiens
acaagccctgg

SEQ ID NO: 1812564 - DNA, 14 bp, Homo sapiens
acaagtcacagctg

SEQ ID NO: 1812565 - DNA, 16 bp, Homo sapiens
acaagtcacagctgca

SEQ ID NO: 1812566 - DNA, 17 bp, Homo sapiens
acaagtcacagctgcag

SEQ ID NO: 1812567 - DNA, 18 bp, Homo sapiens
acaagtcacagctgcagc

SEQ ID NO: 1812568 - DNA, 17 bp, Homo sapiens
acaagtctaaacaatga

SEQ ID NO: 1812569 - DNA, 20 bp, Homo sapiens
acaagtctaaacaatgaatt

SEQ ID NO: 1812570 - DNA, 23 bp, Homo sapiens
acaattcattgttaaaaaacaac

SEQ ID NO: 1812571 - DNA, 22 bp, Homo sapiens
acacatcccggcctcttccacc

SEQ ID NO: 1812572 - DNA, 16 bp, Homo sapiens
acaccaagctgtgcca

SEQ ID NO: 1812573 - DNA, 20 bp, Homo sapiens
acaccaagctgtgccaccct

SEQ ID NO: 1812574 - DNA, 14 bp, Homo sapiens
acaccactgccctg

SEQ ID NO: 1812575 - DNA, 22 bp, Homo sapiens
acaccactgccctgcctgccca

SEQ ID NO: 1812576 - DNA, 13 bp, Homo sapiens
acacccaggaagg

SEQ ID NO: 1812577 - DNA, 15 bp, Homo sapiens
acacctaccatgctg

SEQ ID NO: 1812578 - DNA, 18 bp, Homo sapiens
acacctaccatgctgctt

SEQ ID NO: 1812579 - DNA, 13 bp, Homo sapiens
acacctcagaaaa

SEQ ID NO: 1812580 - DNA, 15 bp, Homo sapiens
acacctgccctgccc

SEQ ID NO: 1812581 - DNA, 17 bp, Homo sapiens
acacctgccctgccctg

SEQ ID NO: 1812582 - DNA, 20 bp, Homo sapiens
acacctgccctgccctgcca

SEQ ID NO: 1812583 - DNA, 22 bp, Homo sapiens
acacctgccctgccctgccacc

SEQ ID NO: 1812584 - DNA, 21 bp, Homo sapiens
acacgcaagggcatcaggcac

SEQ ID NO: 1812585 - DNA, 18 bp, Homo sapiens
acactgaagtgcttgcag

SEQ ID NO: 1812586 - DNA, 19 bp, Homo sapiens
acactgctgcaccagagtg

SEQ ID NO: 1812587 - DNA, 18 bp, Homo sapiens
acacttggagcccgtgca

SEQ ID NO: 1812588 - DNA, 17 bp, Homo sapiens
acactttgccaaggctc

SEQ ID NO: 1812589 - DNA, 21 bp, Homo sapiens
acactttgccaaggctctccc

SEQ ID NO: 1812590 - DNA, 15 bp, Homo sapiens
acagaagaaaataat

SEQ ID NO: 1812591 - DNA, 21 bp, Homo sapiens
acagacactcccacttggcat

SEQ ID NO: 1812592 - DNA, 16 bp, Homo sapiens
acagacttctggaagg

SEQ ID NO: 1812593 - DNA, 23 bp, Homo sapiens
acagacttctggaaggctggctg

SEQ ID NO: 1812594 - DNA, 23 bp, Homo sapiens
acagagggaccaaattgcttcta

SEQ ID NO: 1812595 - DNA, 17 bp, Homo sapiens
acagagttggtgttcat

SEQ ID NO: 1812596 - DNA, 18 bp, Homo sapiens
acagagttggtgttcata

SEQ ID NO: 1812597 - DNA, 21 bp, Homo sapiens
acagatattgttataaataaa

SEQ ID NO: 1812598 - DNA, 16 bp, Homo sapiens
acagcaaggaggctgg

SEQ ID NO: 1812599 - DNA, 18 bp, Homo sapiens
acagcaaggaggctggct

SEQ ID NO: 1812600 - DNA, 20 bp, Homo sapiens
acagcaaggaggctggctgg

SEQ ID NO: 1812601 - DNA, 17 bp, Homo sapiens
acagcccacgtcctgtc

SEQ ID NO: 1812602 - DNA, 12 bp, Homo sapiens
acagccctggga

SEQ ID NO: 1812603 - DNA, 14 bp, Homo sapiens
acagctgcagctgg

SEQ ID NO: 1812604 - DNA, 15 bp, Homo sapiens
acagctgcagctggg

SEQ ID NO: 1812605 - DNA, 17 bp, Homo sapiens
acagcttttcccaggag

SEQ ID NO: 1812606 - DNA, 12 bp, Homo sapiens
acaggccctccc

SEQ ID NO: 1812607 - DNA, 15 bp, Homo sapiens
acaggggcaggcctg

SEQ ID NO: 1812608 - DNA, 22 bp, Homo sapiens
acaggggccccagatctgcctg

SEQ ID NO: 1812609 - DNA, 13 bp, Homo sapiens
acagtatcttcaa

SEQ ID NO: 1812610 - DNA, 19 bp, Homo sapiens
acagtatcttcaaaaatac

SEQ ID NO: 1812611 - DNA, 17 bp, Homo sapiens
acagtattctcagtgct

SEQ ID NO: 1812612 - DNA, 16 bp, Homo sapiens
acagtcctcacagcct

SEQ ID NO: 1812613 - DNA, 21 bp, Homo sapiens
acagtcctcacagcctctccc

SEQ ID NO: 1812614 - DNA, 12 bp, Homo sapiens
acagtgctgctt

SEQ ID NO: 1812615 - DNA, 14 bp, Homo sapiens
acagtgggtggcac

SEQ ID NO: 1812616 - DNA, 21 bp, Homo sapiens
acagtgtctgggctgactggg

SEQ ID NO: 1812617 - DNA, 17 bp, Homo sapiens
acagtgttaggcctggc

SEQ ID NO: 1812618 - DNA, 13 bp, Homo sapiens
acagttggcagag

SEQ ID NO: 1812619 - DNA, 14 bp, Homo sapiens
acagttggcagaga

SEQ ID NO: 1812620 - DNA, 22 bp, Homo sapiens
acagttggcagagaaggcctct

SEQ ID NO: 1812621 - DNA, 21 bp, Homo sapiens
acagttgtctattctgagcct

SEQ ID NO: 1812622 - DNA, 22 bp, Homo sapiens
acagttgtctattctgagcctt

SEQ ID NO: 1812623 - DNA, 14 bp, Homo sapiens
acatatatgtatat

SEQ ID NO: 1812624 - DNA, 17 bp, Homo sapiens
acatatatgtatatgta

SEQ ID NO: 1812625 - DNA, 22 bp, Homo sapiens
acatattcccatggtagactgt

SEQ ID NO: 1812626 - DNA, 16 bp, Homo sapiens
acatcagccttctcct

SEQ ID NO: 1812627 - DNA, 16 bp, Homo sapiens
acatcattcattcact

SEQ ID NO: 1812628 - DNA, 17 bp, Homo sapiens
acatccattgctggcaa

SEQ ID NO: 1812629 - DNA, 15 bp, Homo sapiens
acatcccggcctctt

SEQ ID NO: 1812630 - DNA, 18 bp, Homo sapiens
acatcccggcctcttcca

SEQ ID NO: 1812631 - DNA, 14 bp, Homo sapiens
acatcttcattaat

SEQ ID NO: 1812632 - DNA, 21 bp, Homo sapiens
acatcttcattaatactgtgt

SEQ ID NO: 1812633 - DNA, 16 bp, Homo sapiens
acatgacgtaaaattt

SEQ ID NO: 1812634 - DNA, 13 bp, Homo sapiens
acatgattttctt

SEQ ID NO: 1812635 - DNA, 12 bp, Homo sapiens
acattatatttg

SEQ ID NO: 1812636 - DNA, 16 bp, Homo sapiens
acattatgttattgga

SEQ ID NO: 1812637 - DNA, 21 bp, Homo sapiens
acattatgttattggaatttt

SEQ ID NO: 1812638 - DNA, 13 bp, Homo sapiens
acattcctccagc

SEQ ID NO: 1812639 - DNA, 20 bp, Homo sapiens
acattcctccagcctcccct

SEQ ID NO: 1812640 - DNA, 23 bp, Homo sapiens
acattcctccagcctcccctccc

SEQ ID NO: 1812641 - DNA, 16 bp, Homo sapiens
acattgtgcttggccc

SEQ ID NO: 1812642 - DNA, 14 bp, Homo sapiens
acatttcaaagctg

SEQ ID NO: 1812643 - DNA, 16 bp, Homo sapiens
acatttcaaagctgag

SEQ ID NO: 1812644 - DNA, 22 bp, Homo sapiens
acattttaatacagattgaaag

SEQ ID NO: 1812645 - DNA, 15 bp, Homo sapiens
acatttttgtacatt

SEQ ID NO: 1812646 - DNA, 20 bp, Homo sapiens
acatttttgtacattatgtt

SEQ ID NO: 1812647 - DNA, 13 bp, Homo sapiens
accaaattgcttc

SEQ ID NO: 1812648 - DNA, 23 bp, Homo sapiens
accaaattgcttctaggagtcaa

SEQ ID NO: 1812649 - DNA, 15 bp, Homo sapiens
accaacccagccgct

SEQ ID NO: 1812650 - DNA, 19 bp, Homo sapiens
accaacccagccgctgccc

SEQ ID NO: 1812651 - DNA, 20 bp, Homo sapiens
accaacccagccgctgcccg

SEQ ID NO: 1812652 - DNA, 14 bp, Homo sapiens
accaagctgtgcca

SEQ ID NO: 1812653 - DNA, 12 bp, Homo sapiens
accaaggcagcc

SEQ ID NO: 1812654 - DNA, 17 bp, Homo sapiens
accaaggcagcctccag

SEQ ID NO: 1812655 - DNA, 15 bp, Homo sapiens
agccccacagcccac

SEQ ID NO: 1812656 - DNA, 16 bp, Homo sapiens
agccccacagcccacg

SEQ ID NO: 1812657 - DNA, 17 bp, Homo sapiens
agccccacagcccacgt

SEQ ID NO: 1812658 - DNA, 18 bp, Homo sapiens
agccccacagcccacgtc

SEQ ID NO: 1812659 - DNA, 20 bp, Homo sapiens
agccccacagcccacgtcct

SEQ ID NO: 1812660 - DNA, 14 bp, Homo sapiens
agcccctcagccct

SEQ ID NO: 1812661 - DNA, 15 bp, Homo sapiens
agcccctcagccctt

SEQ ID NO: 1812662 - DNA, 18 bp, Homo sapiens
agcccctcagcccttgcc

SEQ ID NO: 1812663 - DNA, 13 bp, Homo sapiens
agcccctccccag

SEQ ID NO: 1812664 - DNA, 17 bp, Homo sapiens
agcccctccccagccag

SEQ ID NO: 1812665 - DNA, 24 bp, Homo sapiens
agccctcgaaccaaggcagcctcc

SEQ ID NO: 1812666 - DNA, 15 bp, Homo sapiens
agcccttctgccttt

SEQ ID NO: 1812667 - DNA, 18 bp, Homo sapiens
agcccttctgcctttctc

SEQ ID NO: 1812668 - DNA, 21 bp, Homo sapiens
agccctttgcaggcccagcag

SEQ ID NO: 1812669 - DNA, 12 bp, Homo sapiens
agccgctgcccg

SEQ ID NO: 1812670 - DNA, 20 bp, Homo sapiens
agccggcaagcgagcacagt

SEQ ID NO: 1812671 - DNA, 18 bp, Homo sapiens
agccgtccatggcaccag

SEQ ID NO: 1812672 - DNA, 21 bp, Homo sapiens
agccgtccatggcaccagccc

SEQ ID NO: 1812673 - DNA, 22 bp, Homo sapiens
agccgtccatggcaccagcccc

SEQ ID NO: 1812674 - DNA, 20 bp, Homo sapiens
agccgtctgactccagagtc

SEQ ID NO: 1812675 - DNA, 16 bp, Homo sapiens
agcctatgtcttgtat

SEQ ID NO: 1812676 - DNA, 12 bp, Homo sapiens
agcctccagagc

SEQ ID NO: 1812677 - DNA, 14 bp, Homo sapiens
agcctccagagcca

SEQ ID NO: 1812678 - DNA, 12 bp, Homo sapiens
agcctcccctcc

SEQ ID NO: 1812679 - DNA, 13 bp, Homo sapiens
agcctcccctccc

SEQ ID NO: 1812680 - DNA, 16 bp, Homo sapiens
agcctcccctcccctg

SEQ ID NO: 1812681 - DNA, 18 bp, Homo sapiens
agcctccgtttatgggcc

SEQ ID NO: 1812682 - DNA, 19 bp, Homo sapiens
agcctcctgccccctgcca

SEQ ID NO: 1812683 - DNA, 10 bp, Homo sapiens
agcctctccc

SEQ ID NO: 1812684 - DNA, 13 bp, Homo sapiens
agcctctcccggc

SEQ ID NO: 1812685 - DNA, 14 bp, Homo sapiens
agcctctcccggct

SEQ ID NO: 1812686 - DNA, 18 bp, Homo sapiens
agcctctcccggctgcct

SEQ ID NO: 1812687 - DNA, 16 bp, Homo sapiens
agcctggcccagctcc

SEQ ID NO: 1812688 - DNA, 18 bp, Homo sapiens
agcctggcccagctcccc

SEQ ID NO: 1812689 - DNA, 18 bp, Homo sapiens
agcctgggactcccagtg

SEQ ID NO: 1812690 - DNA, 23 bp, Homo sapiens
agcctgtccactaacttgtcttt

SEQ ID NO: 1812691 - DNA, 14 bp, Homo sapiens
agccttcccctccc

SEQ ID NO: 1812692 - DNA, 20 bp, Homo sapiens
agccttgccttttaaaagaa

SEQ ID NO: 1812693 - DNA, 15 bp, Homo sapiens
agccttgtgccctgc

SEQ ID NO: 1812694 - DNA, 18 bp, Homo sapiens
agccttgtgccctgcccc

SEQ ID NO: 1812695 - DNA, 15 bp, Homo sapiens
agctaagcctgatga

SEQ ID NO: 1812696 - DNA, 17 bp, Homo sapiens
agctaagcctgatgatg

SEQ ID NO: 1812697 - DNA, 12 bp, Homo sapiens
agctactctgtc

SEQ ID NO: 1812698 - DNA, 16 bp, Homo sapiens
agctactctgtccagg

SEQ ID NO: 1812699 - DNA, 17 bp, Homo sapiens
agctactctgtccaggc

SEQ ID NO: 1812700 - DNA, 18 bp, Homo sapiens
agctactctgtccaggcc

SEQ ID NO: 1812701 - DNA, 19 bp, Homo sapiens
agctactctgtccaggcca

SEQ ID NO: 1812702 - DNA, 21 bp, Homo sapiens
agctactctgtccaggccact

SEQ ID NO: 1812703 - DNA, 12 bp, Homo sapiens
agctagaaacaa

SEQ ID NO: 1812704 - DNA, 15 bp, Homo sapiens
agctagactggagtg

SEQ ID NO: 1812705 - DNA, 17 bp, Homo sapiens
agctaggactgaggagt

SEQ ID NO: 1812706 - DNA, 21 bp, Homo sapiens
agctcagaatagatctgatgg

SEQ ID NO: 1812707 - DNA, 15 bp, Homo sapiens
agctcctctccttgg

SEQ ID NO: 1812708 - DNA, 19 bp, Homo sapiens
agctccttttgtccccagg

SEQ ID NO: 1812709 - DNA, 22 bp, Homo sapiens
agctgaaacattccgaagaggg

SEQ ID NO: 1812710 - DNA, 14 bp, Homo sapiens
agctgagctggcct

SEQ ID NO: 1812711 - DNA, 21 bp, Homo sapiens
agctgagttacttgtctgagg

SEQ ID NO: 1812712 - DNA, 23 bp, Homo sapiens
agctgagttacttgtctgaggcc

SEQ ID NO: 1812713 - DNA, 15 bp, Homo sapiens
agctgatttccaggc

SEQ ID NO: 1812714 - DNA, 12 bp, Homo sapiens
agctgcagctgg

SEQ ID NO: 1812715 - DNA, 17 bp, Homo sapiens
agctgcagctgggcccc

SEQ ID NO: 1812716 - DNA, 21 bp, Homo sapiens
agctgcagctgggccccatgc

SEQ ID NO: 1812717 - DNA, 17 bp, Homo sapiens
agctgctctgccccttg

SEQ ID NO: 1812718 - DNA, 21 bp, Homo sapiens
agctgctctgccccttgggca

SEQ ID NO: 1812719 - DNA, 17 bp, Homo sapiens
agctggaaggcagggca

SEQ ID NO: 1812720 - DNA, 21 bp, Homo sapiens
agctggaaggcagggcagagg

SEQ ID NO: 1812721 - DNA, 22 bp, Homo sapiens
agctggaaggcagggcagaggg

SEQ ID NO: 1812722 - DNA, 17 bp, Homo sapiens
agctggacaagaagctg

SEQ ID NO: 1812723 - DNA, 17 bp, Homo sapiens
agctggcaggacacatc

SEQ ID NO: 1812724 - DNA, 20 bp, Homo sapiens
agctgggaaattcatgtgga

SEQ ID NO: 1812725 - DNA, 22 bp, Homo sapiens
agctgggccccatgctctgccc

SEQ ID NO: 1812726 - DNA, 14 bp, Homo sapiens
agctgtactcagag

SEQ ID NO: 1812727 - DNA, 17 bp, Homo sapiens
agctgtactcagagcag

SEQ ID NO: 1812728 - DNA, 18 bp, Homo sapiens
agctgtactcagagcaga

SEQ ID NO: 1812729 - DNA, 15 bp, Homo sapiens
agctgtagccatggc

SEQ ID NO: 1812730 - DNA, 19 bp, Homo sapiens
agctgtagccatggctcag

SEQ ID NO: 1812731 - DNA, 20 bp, Homo sapiens
agctgtagccatggctcagg

SEQ ID NO: 1812732 - DNA, 21 bp, Homo sapiens
agctgtagccatggctcaggc

SEQ ID NO: 1812733 - DNA, 13 bp, Homo sapiens
agcttagccttgt

SEQ ID NO: 1812734 - DNA, 22 bp, Homo sapiens
agcttatgggatccttgtcttt

SEQ ID NO: 1812735 - DNA, 16 bp, Homo sapiens
agcttcctgagggcta

SEQ ID NO: 1812736 - DNA, 13 bp, Homo sapiens
agcttctgccact

SEQ ID NO: 1812737 - DNA, 13 bp, Homo sapiens
agcttctgctggg

SEQ ID NO: 1812738 - DNA, 14 bp, Homo sapiens
agcttgaaaacttg

SEQ ID NO: 1812739 - DNA, 17 bp, Homo sapiens
aggaaaagcctctgtgt

SEQ ID NO: 1812740 - DNA, 14 bp, Homo sapiens
aggaacgagcactg

SEQ ID NO: 1812741 - DNA, 16 bp, Homo sapiens
aggaacgagcactggc

SEQ ID NO: 1812742 - DNA, 22 bp, Homo sapiens
aggaacgagcactggccagaga

SEQ ID NO: 1812743 - DNA, 22 bp, Homo sapiens
aggaactcttaagcaatggtaa

SEQ ID NO: 1812744 - DNA, 15 bp, Homo sapiens
aggaagcctgaggca

SEQ ID NO: 1812745 - DNA, 16 bp, Homo sapiens
aggaaggcagcattcc

SEQ ID NO: 1812746 - DNA, 19 bp, Homo sapiens
aggaaggcagcattccatg

SEQ ID NO: 1812747 - DNA, 14 bp, Homo sapiens
aggaaggcagctgc

SEQ ID NO: 1812748 - DNA, 16 bp, Homo sapiens
aggaaggtgctgagct

SEQ ID NO: 1812749 - DNA, 14 bp, Homo sapiens
aggaatagccagag

SEQ ID NO: 1812750 - DNA, 15 bp, Homo sapiens
aggacaacctgcccc

SEQ ID NO: 1812751 - DNA, 13 bp, Homo sapiens
aggacacatcccg

SEQ ID NO: 1812752 - DNA, 23 bp, Homo sapiens
aggacacatcccggcctcttcca

SEQ ID NO: 1812753 - DNA, 22 bp, Homo sapiens
aggacccacccatcttcctgct

SEQ ID NO: 1812754 - DNA, 13 bp, Homo sapiens
aggacccaggccc

SEQ ID NO: 1812755 - DNA, 16 bp, Homo sapiens
aggacccaggccctcc

SEQ ID NO: 1812756 - DNA, 21 bp, Homo sapiens
aggacggggccggccaggtgg

SEQ ID NO: 1812757 - DNA, 14 bp, Homo sapiens
aggactgaggagtg

SEQ ID NO: 1812758 - DNA, 14 bp, Homo sapiens
aggagaccctggaa

SEQ ID NO: 1812759 - DNA, 19 bp, Homo sapiens
aggagagactgaaagcagc

SEQ ID NO: 1812760 - DNA, 20 bp, Homo sapiens
aggagagtggttgttgccaa

SEQ ID NO: 1812761 - DNA, 20 bp, Homo sapiens
aggagctgatttccaggccc

SEQ ID NO: 1812762 - DNA, 22 bp, Homo sapiens
aggagctgatttccaggcccct

SEQ ID NO: 1812763 - DNA, 13 bp, Homo sapiens
aggagggcagagc

SEQ ID NO: 1812764 - DNA, 18 bp, Homo sapiens
aggagggtggaggaaggt

SEQ ID NO: 1812765 - DNA, 21 bp, Homo sapiens
aggagggtggaggaaggtgct

SEQ ID NO: 1812766 - DNA, 22 bp, Homo sapiens
aggagtcaactggctggccagt

SEQ ID NO: 1812767 - DNA, 17 bp, Homo sapiens
aggagtctgtgctcttt

SEQ ID NO: 1812768 - DNA, 18 bp, Homo sapiens
aggatatcagagctggga

SEQ ID NO: 1812769 - DNA, 15 bp, Homo sapiens
aggatccgctgccac

SEQ ID NO: 1812770 - DNA, 16 bp, Homo sapiens
aggatccgctgccacc

SEQ ID NO: 1812771 - DNA, 16 bp, Homo sapiens
aggatcctgcaggaac

SEQ ID NO: 1812772 - DNA, 15 bp, Homo sapiens
ccaccacgtctgcca

SEQ ID NO: 1812773 - DNA, 21 bp, Homo sapiens
ccaccacgtctgccaggccca

SEQ ID NO: 1812774 - DNA, 20 bp, Homo sapiens
ccaccagaacgcaccccact

SEQ ID NO: 1812775 - DNA, 16 bp, Homo sapiens
ccacccaggctgcact

SEQ ID NO: 1812776 - DNA, 17 bp, Homo sapiens
ccacccaggctgcactg

SEQ ID NO: 1812777 - DNA, 21 bp, Homo sapiens
ccacccaggctgcactgcagt

SEQ ID NO: 1812778 - DNA, 15 bp, Homo sapiens
ccacccagtgctgcc

SEQ ID NO: 1812779 - DNA, 21 bp, Homo sapiens
ccacccagtgctgccatgcca

SEQ ID NO: 1812780 - DNA, 22 bp, Homo sapiens
ccacccagtgctgccatgccac

SEQ ID NO: 1812781 - DNA, 16 bp, Homo sapiens
ccacccattcccccat

SEQ ID NO: 1812782 - DNA, 12 bp, Homo sapiens
ccaccctgggct

SEQ ID NO: 1812783 - DNA, 16 bp, Homo sapiens
ccacctagtggctgtc

SEQ ID NO: 1812784 - DNA, 19 bp, Homo sapiens
ccacctagtggctgtccag

SEQ ID NO: 1812785 - DNA, 21 bp, Homo sapiens
ccacctagtggctgtccagtg

SEQ ID NO: 1812786 - DNA, 22 bp, Homo sapiens
ccacctagtggctgtccagtgc

SEQ ID NO: 1812787 - DNA, 19 bp, Homo sapiens
ccacctgacaatggcagct

SEQ ID NO: 1812788 - DNA, 16 bp, Homo sapiens
ccacctgcctatccat

SEQ ID NO: 1812789 - DNA, 12 bp, Homo sapiens
ccacctgtctgt

SEQ ID NO: 1812790 - DNA, 22 bp, Homo sapiens
ccacctgtctgtctgtctgtcc

SEQ ID NO: 1812791 - DNA, 19 bp, Homo sapiens
ccacgagtcacctgcaagc

SEQ ID NO: 1812792 - DNA, 17 bp, Homo sapiens
ccacggtgcgtggctgt

SEQ ID NO: 1812793 - DNA, 20 bp, Homo sapiens
ccacggtgcgtggctgtggc

SEQ ID NO: 1812794 - DNA, 21 bp, Homo sapiens
ccacggtgcgtggctgtggca

SEQ ID NO: 1812795 - DNA, 18 bp, Homo sapiens
ccacgtcctgtcagtgcc

SEQ ID NO: 1812796 - DNA, 17 bp, Homo sapiens
ccactaagctttctcct

SEQ ID NO: 1812797 - DNA, 21 bp, Homo sapiens
ccactaagctttctcctttga

SEQ ID NO: 1812798 - DNA, 21 bp, Homo sapiens
ccactcccacttccctgacac

SEQ ID NO: 1812799 - DNA, 15 bp, Homo sapiens
ccactcccccacctg

SEQ ID NO: 1812800 - DNA, 20 bp, Homo sapiens
ccactcctgtcccgccttcc

SEQ ID NO: 1812801 - DNA, 18 bp, Homo sapiens
ccactcgcagtcgcagga

SEQ ID NO: 1812802 - DNA, 18 bp, Homo sapiens
ccactctcggggcccttg

SEQ ID NO: 1812803 - DNA, 17 bp, Homo sapiens
ccactgcaccccctcct

SEQ ID NO: 1812804 - DNA, 21 bp, Homo sapiens
ccactgcaccccctcctgctg

SEQ ID NO: 1812805 - DNA, 23 bp, Homo sapiens
ccactgcaccccctcctgctgca

SEQ ID NO: 1812806 - DNA, 11 bp, Homo sapiens
ccactgccagg

SEQ ID NO: 1812807 - DNA, 19 bp, Homo sapiens
ccactgccaggcacctggc

SEQ ID NO: 1812808 - DNA, 22 bp, Homo sapiens
ccactgccaggcacctggcctg

SEQ ID NO: 1812809 - DNA, 13 bp, Homo sapiens
ccactgccctgcc

SEQ ID NO: 1812810 - DNA, 17 bp, Homo sapiens
ccactgccctgcctgcc

SEQ ID NO: 1812811 - DNA, 22 bp, Homo sapiens
ccactgctgaaaaagaaaaaaa

SEQ ID NO: 1812812 - DNA, 15 bp, Homo sapiens
ccactgtggccagag

SEQ ID NO: 1812813 - DNA, 18 bp, Homo sapiens
ccactgtggccagagctg

SEQ ID NO: 1812814 - DNA, 19 bp, Homo sapiens
ccactgtggccagagctgg

SEQ ID NO: 1812815 - DNA, 20 bp, Homo sapiens
ccactgtggccagagctgga

SEQ ID NO: 1812816 - DNA, 15 bp, Homo sapiens
ccacttagccgtcca

SEQ ID NO: 1812817 - DNA, 19 bp, Homo sapiens
ccacttagccgtccatggc

SEQ ID NO: 1812818 - DNA, 20 bp, Homo sapiens
ccacttagccgtccatggca

SEQ ID NO: 1812819 - DNA, 17 bp, Homo sapiens
ccacttatttccatgga

SEQ ID NO: 1812820 - DNA, 14 bp, Homo sapiens
ccacttcccaggta

SEQ ID NO: 1812821 - DNA, 22 bp, Homo sapiens
ccactttttccagaatttgaat

SEQ ID NO: 1812822 - DNA, 20 bp, Homo sapiens
ccagaaagcctcctgccccc

SEQ ID NO: 1812823 - DNA, 22 bp, Homo sapiens
ccagaacatggattccactgaa

SEQ ID NO: 1812824 - DNA, 23 bp, Homo sapiens
ccagaacgcaccccactgggaga

SEQ ID NO: 1812825 - DNA, 18 bp, Homo sapiens
ccagaaggagggcagagc

SEQ ID NO: 1812826 - DNA, 23 bp, Homo sapiens
ccagaagttgatgtgggaagaag

SEQ ID NO: 1812827 - DNA, 14 bp, Homo sapiens
ccagaatctgctgt

SEQ ID NO: 1812828 - DNA, 23 bp, Homo sapiens
ccagaatctgctgttgccatagc

SEQ ID NO: 1812829 - DNA, 18 bp, Homo sapiens
ccagacaggccctccctg

SEQ ID NO: 1812830 - DNA, 20 bp, Homo sapiens
ccagactgaaccagagctgg

SEQ ID NO: 1812831 - DNA, 21 bp, Homo sapiens
ccagactgaaccagagctgga

SEQ ID NO: 1812832 - DNA, 20 bp, Homo sapiens
ccagagaggagcacctgaac

SEQ ID NO: 1812833 - DNA, 16 bp, Homo sapiens
ccagagagggcccagc

SEQ ID NO: 1812834 - DNA, 17 bp, Homo sapiens
ccagagagggcccagct

SEQ ID NO: 1812835 - DNA, 21 bp, Homo sapiens
ccagagagggcccagctgtag

SEQ ID NO: 1812836 - DNA, 17 bp, Homo sapiens
ccagagccactaccttt

SEQ ID NO: 1812837 - DNA, 13 bp, Homo sapiens
ccagagccagcct

SEQ ID NO: 1812838 - DNA, 16 bp, Homo sapiens
ccagagccagcctggg

SEQ ID NO: 1812839 - DNA, 18 bp, Homo sapiens
ccagagccagcctgggac

SEQ ID NO: 1812840 - DNA, 20 bp, Homo sapiens
ccagagccagcctgggactc

SEQ ID NO: 1812841 - DNA, 12 bp, Homo sapiens
ccagagctggaa

SEQ ID NO: 1812842 - DNA, 19 bp, Homo sapiens
ccagagctggaaggcaggg

SEQ ID NO: 1812843 - DNA, 21 bp, Homo sapiens
ccagaggttatctgcctggcc

SEQ ID NO: 1812844 - DNA, 22 bp, Homo sapiens
ccagaggttatctgcctggcct

SEQ ID NO: 1812845 - DNA, 22 bp, Homo sapiens
ccagagtgaaagggctatggca

SEQ ID NO: 1812846 - DNA, 14 bp, Homo sapiens
ccagatctgcctgg

SEQ ID NO: 1812847 - DNA, 20 bp, Homo sapiens
ccagatctgcctgggcctgt

SEQ ID NO: 1812848 - DNA, 19 bp, Homo sapiens
ccagattgttctgtccagt

SEQ ID NO: 1812849 - DNA, 16 bp, Homo sapiens
ccagcacaattcattg

SEQ ID NO: 1812850 - DNA, 12 bp, Homo sapiens
ccagcacagggg

SEQ ID NO: 1812851 - DNA, 15 bp, Homo sapiens
ccagcacaggggccc

SEQ ID NO: 1812852 - DNA, 18 bp, Homo sapiens
ccagcacaggggccccag

SEQ ID NO: 1812853 - DNA, 24 bp, Homo sapiens
ccagcacaggggccccagatctgc

SEQ ID NO: 1812854 - DNA, 14 bp, Homo sapiens
ccagcacccgggct

SEQ ID NO: 1812855 - DNA, 17 bp, Homo sapiens
ccagcacccgggctcag

SEQ ID NO: 1812856 - DNA, 24 bp, Homo sapiens
ccagcagctgcgggtctgaaggaa

SEQ ID NO: 1812857 - DNA, 13 bp, Homo sapiens
ccagcaggtgtgg

SEQ ID NO: 1812858 - DNA, 17 bp, Homo sapiens
ccagcaggtgtggtggc

SEQ ID NO: 1812859 - DNA, 15 bp, Homo sapiens
ccagcatccagcctg

SEQ ID NO: 1812860 - DNA, 16 bp, Homo sapiens
ccagcatccagcctgt

SEQ ID NO: 1812861 - DNA, 22 bp, Homo sapiens
ccagccagtcttgcctaggcca

SEQ ID NO: 1812862 - DNA, 14 bp, Homo sapiens
ccagccccacagcc

SEQ ID NO: 1812863 - DNA, 19 bp, Homo sapiens
ccagccccacagcccacgt

SEQ ID NO: 1812864 - DNA, 22 bp, Homo sapiens
ccagccccacagcccacgtcct

SEQ ID NO: 1812865 - DNA, 14 bp, Homo sapiens
ccagccccctggat

SEQ ID NO: 1812866 - DNA, 15 bp, Homo sapiens
ccagccccctggatg

SEQ ID NO: 1812867 - DNA, 13 bp, Homo sapiens
ccagcccttccct

SEQ ID NO: 1812868 - DNA, 14 bp, Homo sapiens
ccagcccttctgcc

SEQ ID NO: 1812869 - DNA, 13 bp, Homo sapiens
ccagcctcccctc

SEQ ID NO: 1812870 - DNA, 17 bp, Homo sapiens
ccagcctcccctcccct

SEQ ID NO: 1812871 - DNA, 16 bp, Homo sapiens
ccagcctggcccagct

SEQ ID NO: 1812872 - DNA, 13 bp, Homo sapiens
ccagcctgtgtgt

SEQ ID NO: 1812873 - DNA, 15 bp, Homo sapiens
ccagcctgtgtgttc

SEQ ID NO: 1812874 - DNA, 23 bp, Homo sapiens
ccagcgtttagtttctagaggcc

SEQ ID NO: 1812875 - DNA, 16 bp, Homo sapiens
ccagctactctgtcca

SEQ ID NO: 1812876 - DNA, 17 bp, Homo sapiens
ccagctactctgtccag

SEQ ID NO: 1812877 - DNA, 18 bp, Homo sapiens
ccagctactctgtccagg

SEQ ID NO: 1812878 - DNA, 22 bp, Homo sapiens
ccagctactctgtccaggccac

SEQ ID NO: 1812879 - DNA, 17 bp, Homo sapiens
ccagctcccccgggagg

SEQ ID NO: 1812880 - DNA, 21 bp, Homo sapiens
ccagctccttttgtccccagg

SEQ ID NO: 1812881 - DNA, 22 bp, Homo sapiens
ccagctccttttgtccccaggg

SEQ ID NO: 1812882 - DNA, 12 bp, Homo sapiens
ccagctctgtgg

SEQ ID NO: 1812883 - DNA, 14 bp, Homo sapiens
ccagctctgtggcc

SEQ ID NO: 1812884 - DNA, 20 bp, Homo sapiens
ccagctctgtggcctgtgtc

SEQ ID NO: 1812885 - DNA, 13 bp, Homo sapiens
ccagctgccttcc

SEQ ID NO: 1812886 - DNA, 13 bp, Homo sapiens
ccagctgctctgc

SEQ ID NO: 1812887 - DNA, 15 bp, Homo sapiens
ccagctgctctgccc

SEQ ID NO: 1812888 - DNA, 16 bp, Homo sapiens
cctatcagtgtgcccc

SEQ ID NO: 1812889 - DNA, 23 bp, Homo sapiens
cctatccatcctgcgagctcctt

SEQ ID NO: 1812890 - DNA, 20 bp, Homo sapiens
cctattttggacgtgtgagg

SEQ ID NO: 1812891 - DNA, 16 bp, Homo sapiens
cctcaactaaccctta

SEQ ID NO: 1812892 - DNA, 16 bp, Homo sapiens
cctcaaggcctcccac

SEQ ID NO: 1812893 - DNA, 17 bp, Homo sapiens
cctcaaggcctcccaca

SEQ ID NO: 1812894 - DNA, 13 bp, Homo sapiens
cctcaccaggggc

SEQ ID NO: 1812895 - DNA, 23 bp, Homo sapiens
cctcaccaggggcaggcacagca

SEQ ID NO: 1812896 - DNA, 13 bp, Homo sapiens
cctcactggctgg

SEQ ID NO: 1812897 - DNA, 14 bp, Homo sapiens
cctcactggctggg

SEQ ID NO: 1812898 - DNA, 16 bp, Homo sapiens
cctcagcccttgcccc

SEQ ID NO: 1812899 - DNA, 18 bp, Homo sapiens
cctcagcccttgccccca

SEQ ID NO: 1812900 - DNA, 21 bp, Homo sapiens
cctcagtcagttcccggagca

SEQ ID NO: 1812901 - DNA, 17 bp, Homo sapiens
cctcatgccacaccttc

SEQ ID NO: 1812902 - DNA, 20 bp, Homo sapiens
cctcatgccacaccttcttc

SEQ ID NO: 1812903 - DNA, 14 bp, Homo sapiens
cctcatgcctggcc

SEQ ID NO: 1812904 - DNA, 22 bp, Homo sapiens
cctcatgcctggcccccctcca

SEQ ID NO: 1812905 - DNA, 16 bp, Homo sapiens
cctcattccaagcact

SEQ ID NO: 1812906 - DNA, 17 bp, Homo sapiens
cctccaccgccatggct

SEQ ID NO: 1812907 - DNA, 19 bp, Homo sapiens
cctccaccgccatggcttc

SEQ ID NO: 1812908 - DNA, 13 bp, Homo sapiens
cctccactcccac

SEQ ID NO: 1812909 - DNA, 11 bp, Homo sapiens
cctccagagcc

SEQ ID NO: 1812910 - DNA, 19 bp, Homo sapiens
cctccagagccagcctggg

SEQ ID NO: 1812911 - DNA, 16 bp, Homo sapiens
cctccagcctctcccg

SEQ ID NO: 1812912 - DNA, 17 bp, Homo sapiens
cctccaggcatgctggc

SEQ ID NO: 1812913 - DNA, 19 bp, Homo sapiens
cctccagttctgatgaggc

SEQ ID NO: 1812914 - DNA, 15 bp, Homo sapiens
cctcccaacagagct

SEQ ID NO: 1812915 - DNA, 16 bp, Homo sapiens
cctcccagctgacagt

SEQ ID NO: 1812916 - DNA, 18 bp, Homo sapiens
cctcccatggccttccct

SEQ ID NO: 1812917 - DNA, 19 bp, Homo sapiens
cctcccatggccttccctc

SEQ ID NO: 1812918 - DNA, 12 bp, Homo sapiens
cctccccagcca

SEQ ID NO: 1812919 - DNA, 17 bp, Homo sapiens
cctccccagccagccct

SEQ ID NO: 1812920 - DNA, 23 bp, Homo sapiens
cctccccagccagcccttccctg

SEQ ID NO: 1812921 - DNA, 15 bp, Homo sapiens
cctcccccagagcca

SEQ ID NO: 1812922 - DNA, 17 bp, Homo sapiens
cctcccccagagccact

SEQ ID NO: 1812923 - DNA, 16 bp, Homo sapiens
cctcccctcccctggg

SEQ ID NO: 1812924 - DNA, 12 bp, Homo sapiens
cctccctccttc

SEQ ID NO: 1812925 - DNA, 17 bp, Homo sapiens
cctccctctgccccaag

SEQ ID NO: 1812926 - DNA, 22 bp, Homo sapiens
cctccctctgccccaagcagcc

SEQ ID NO: 1812927 - DNA, 23 bp, Homo sapiens
cctccctctgccccaagcagcca

SEQ ID NO: 1812928 - DNA, 14 bp, Homo sapiens
cctccctgcctgct

SEQ ID NO: 1812929 - DNA, 15 bp, Homo sapiens
cctccctgcctgctc

SEQ ID NO: 1812930 - DNA, 19 bp, Homo sapiens
cctccctgcctgctccttg

SEQ ID NO: 1812931 - DNA, 20 bp, Homo sapiens
cctccctgctgtcccctctt

SEQ ID NO: 1812932 - DNA, 21 bp, Homo sapiens
cctccctgctgtcccctcttg

SEQ ID NO: 1812933 - DNA, 22 bp, Homo sapiens
cctccctgctgtcccctcttgc

SEQ ID NO: 1812934 - DNA, 16 bp, Homo sapiens
cctccgtccacccagg

SEQ ID NO: 1812935 - DNA, 19 bp, Homo sapiens
cctccgtccacccaggctg

SEQ ID NO: 1812936 - DNA, 18 bp, Homo sapiens
cctccgtttatgggcctt

SEQ ID NO: 1812937 - DNA, 22 bp, Homo sapiens
cctccgtttatgggccttgctt

SEQ ID NO: 1812938 - DNA, 16 bp, Homo sapiens
cctcctacccctccca

SEQ ID NO: 1812939 - DNA, 17 bp, Homo sapiens
cctcctacccctcccag

SEQ ID NO: 1812940 - DNA, 18 bp, Homo sapiens
cctcctacccctcccagc

SEQ ID NO: 1812941 - DNA, 15 bp, Homo sapiens
cctcctaccctccca

SEQ ID NO: 1812942 - DNA, 18 bp, Homo sapiens
cctcctagaggtgggcag

SEQ ID NO: 1812943 - DNA, 21 bp, Homo sapiens
cctcctagaggtgggcagctg

SEQ ID NO: 1812944 - DNA, 14 bp, Homo sapiens
cctcctccacagtg

SEQ ID NO: 1812945 - DNA, 16 bp, Homo sapiens
cctcctgatggccaag

SEQ ID NO: 1812946 - DNA, 13 bp, Homo sapiens
cctcctgccccct

SEQ ID NO: 1812947 - DNA, 15 bp, Homo sapiens
cctcgaaccaaggca

SEQ ID NO: 1812948 - DNA, 17 bp, Homo sapiens
cctcgaaccaaggcagc

SEQ ID NO: 1812949 - DNA, 12 bp, Homo sapiens
cctcgaggcacc

SEQ ID NO: 1812950 - DNA, 23 bp, Homo sapiens
cctcgaggcaccggcgctgcagg

SEQ ID NO: 1812951 - DNA, 18 bp, Homo sapiens
cctcgcctggcctgaggt

SEQ ID NO: 1812952 - DNA, 12 bp, Homo sapiens
cctcggctcctg

SEQ ID NO: 1812953 - DNA, 14 bp, Homo sapiens
cctcgtccacaggg

SEQ ID NO: 1812954 - DNA, 18 bp, Homo sapiens
cctcgtccacaggggcag

SEQ ID NO: 1812955 - DNA, 21 bp, Homo sapiens
cctcgtccacaggggcaggcc

SEQ ID NO: 1812956 - DNA, 15 bp, Homo sapiens
cctcgtcctgtccca

SEQ ID NO: 1812957 - DNA, 13 bp, Homo sapiens
cctcgtgccagtc

SEQ ID NO: 1812958 - DNA, 22 bp, Homo sapiens
cctcgtggacacctgccctgcc

SEQ ID NO: 1812959 - DNA, 20 bp, Homo sapiens
cctctcaatattcaataaag

SEQ ID NO: 1812960 - DNA, 12 bp, Homo sapiens
cctctcccggct

SEQ ID NO: 1812961 - DNA, 14 bp, Homo sapiens
cctctcccggctgc

SEQ ID NO: 1812962 - DNA, 17 bp, Homo sapiens
cctctcccggctgcctg

SEQ ID NO: 1812963 - DNA, 19 bp, Homo sapiens
cctctcccggctgcctgcc

SEQ ID NO: 1812964 - DNA, 20 bp, Homo sapiens
cctctcccggctgcctgccg

SEQ ID NO: 1812965 - DNA, 23 bp, Homo sapiens
cctctcccggctgcctgccgccc

SEQ ID NO: 1812966 - DNA, 21 bp, Homo sapiens
cctctccttgggctcctggct

SEQ ID NO: 1812967 - DNA, 22 bp, Homo sapiens
cctctccttgggctcctggctg

SEQ ID NO: 1812968 - DNA, 19 bp, Homo sapiens
cctctcgccccatccctgc

SEQ ID NO: 1812969 - DNA, 14 bp, Homo sapiens
cctctgatttcaag

SEQ ID NO: 1812970 - DNA, 11 bp, Homo sapiens
cctctgcccca

SEQ ID NO: 1812971 - DNA, 14 bp, Homo sapiens
cctctgccccaagc

SEQ ID NO: 1812972 - DNA, 21 bp, Homo sapiens
cctctggtaaacattcctcca

SEQ ID NO: 1812973 - DNA, 15 bp, Homo sapiens
cctctgtcatcactc

SEQ ID NO: 1812974 - DNA, 21 bp, Homo sapiens
cctctgtcatcactccctgga

SEQ ID NO: 1812975 - DNA, 22 bp, Homo sapiens
cctctgtcatcactccctggat

SEQ ID NO: 1812976 - DNA, 15 bp, Homo sapiens
cctcttgccccaacc

SEQ ID NO: 1812977 - DNA, 15 bp, Homo sapiens
cctcttggctgcctt

SEQ ID NO: 1812978 - DNA, 13 bp, Homo sapiens
cctcttgtgctca

SEQ ID NO: 1812979 - DNA, 15 bp, Homo sapiens
cctgaaccccatggg

SEQ ID NO: 1812980 - DNA, 16 bp, Homo sapiens
cctgaaccccatgggc

SEQ ID NO: 1812981 - DNA, 17 bp, Homo sapiens
cctgaaccccatgggct

SEQ ID NO: 1812982 - DNA, 19 bp, Homo sapiens
cctgaaccccatgggcttg

SEQ ID NO: 1812983 - DNA, 23 bp, Homo sapiens
cctgaaccccatgggcttggact

SEQ ID NO: 1812984 - DNA, 18 bp, Homo sapiens
cctgacaatggcagctag

SEQ ID NO: 1812985 - DNA, 14 bp, Homo sapiens
cctgactctcagca

SEQ ID NO: 1812986 - DNA, 15 bp, Homo sapiens
cctgagactccagaa

SEQ ID NO: 1812987 - DNA, 23 bp, Homo sapiens
cctgagactccagaatctgctgt

SEQ ID NO: 1812988 - DNA, 12 bp, Homo sapiens
cctgagctgggg

SEQ ID NO: 1812989 - DNA, 14 bp, Homo sapiens
cctgagctggggcc

SEQ ID NO: 1812990 - DNA, 16 bp, Homo sapiens
cctgagctggggccac

SEQ ID NO: 1812991 - DNA, 17 bp, Homo sapiens
cctgaggactggagacc

SEQ ID NO: 1812992 - DNA, 14 bp, Homo sapiens
cctgagtcggcccc

SEQ ID NO: 1812993 - DNA, 19 bp, Homo sapiens
cctgataacaagcaaggat

SEQ ID NO: 1812994 - DNA, 19 bp, Homo sapiens
cctgatggccaagagcatc

SEQ ID NO: 1812995 - DNA, 13 bp, Homo sapiens
cctgcaagcccca

SEQ ID NO: 1812996 - DNA, 15 bp, Homo sapiens
cctgcaagccccagg

SEQ ID NO: 1812997 - DNA, 17 bp, Homo sapiens
cctgcaagccccagggc

SEQ ID NO: 1812998 - DNA, 18 bp, Homo sapiens
cctgcaagccccagggcc

SEQ ID NO: 1812999 - DNA, 17 bp, Homo sapiens
cctgcaatctccagggc

SEQ ID NO: 1813000 - DNA, 20 bp, Homo sapiens
cctgcaatctccagggctgc

SEQ ID NO: 1813001 - DNA, 23 bp, Homo sapiens
cctgcaatctccagggctgcccc

SEQ ID NO: 1813002 - DNA, 14 bp, Homo sapiens
cctgcaccaggaga

SEQ ID NO: 1813003 - DNA, 12 bp, Homo sapiens
cctgcaccctgg

SEQ ID NO: 1813004 - DNA, 15 bp, Homo sapiens
cctgcaccctggaaa

SEQ ID NO: 1813005 - DNA, 15 bp, Homo sapiens
ctctgccccaagccc

SEQ ID NO: 1813006 - DNA, 14 bp, Homo sapiens
ctctgccccttggg

SEQ ID NO: 1813007 - DNA, 22 bp, Homo sapiens
ctctgccccttgggcatccacc

SEQ ID NO: 1813008 - DNA, 12 bp, Homo sapiens
ctctgctctagc

SEQ ID NO: 1813009 - DNA, 14 bp, Homo sapiens
ctctgctctagcca

SEQ ID NO: 1813010 - DNA, 23 bp, Homo sapiens
ctctgctctagccaggagtctgt

SEQ ID NO: 1813011 - DNA, 16 bp, Homo sapiens
ctctggcggcttcctg

SEQ ID NO: 1813012 - DNA, 22 bp, Homo sapiens
ctctggcggcttcctgtccact

SEQ ID NO: 1813013 - DNA, 12 bp, Homo sapiens
ctctgggctcag

SEQ ID NO: 1813014 - DNA, 17 bp, Homo sapiens
ctctgggctcagggctg

SEQ ID NO: 1813015 - DNA, 18 bp, Homo sapiens
ctctgggctcagggctgg

SEQ ID NO: 1813016 - DNA, 20 bp, Homo sapiens
ctctggtaaacattcctcca

SEQ ID NO: 1813017 - DNA, 17 bp, Homo sapiens
ctctgtcatcactccct

SEQ ID NO: 1813018 - DNA, 21 bp, Homo sapiens
ctctgtcatcactccctggat

SEQ ID NO: 1813019 - DNA, 14 bp, Homo sapiens
ctctgtccaggcca

SEQ ID NO: 1813020 - DNA, 15 bp, Homo sapiens
ctctgtccaggccac

SEQ ID NO: 1813021 - DNA, 21 bp, Homo sapiens
ctctgtccaggccactgtggc

SEQ ID NO: 1813022 - DNA, 23 bp, Homo sapiens
ctctgtccaggccactgtggcca

SEQ ID NO: 1813023 - DNA, 22 bp, Homo sapiens
ctctgtgcccatgggcactgct

SEQ ID NO: 1813024 - DNA, 23 bp, Homo sapiens
ctctgtgcccatgggcactgctg

SEQ ID NO: 1813025 - DNA, 14 bp, Homo sapiens
ctctgtggcctgtg

SEQ ID NO: 1813026 - DNA, 16 bp, Homo sapiens
ctctgtggcctgtgtc

SEQ ID NO: 1813027 - DNA, 17 bp, Homo sapiens
ctctgtggcctgtgtcc

SEQ ID NO: 1813028 - DNA, 23 bp, Homo sapiens
ctctgtgggctgcactctgtgcc

SEQ ID NO: 1813029 - DNA, 23 bp, Homo sapiens
ctctgtgtcactggctgcctcca

SEQ ID NO: 1813030 - DNA, 22 bp, Homo sapiens
ctctgttgcccaggctggagtg

SEQ ID NO: 1813031 - DNA, 22 bp, Homo sapiens
ctcttacaataagctaaacgca

SEQ ID NO: 1813032 - DNA, 20 bp, Homo sapiens
ctcttagtgcccgcctagga

SEQ ID NO: 1813033 - DNA, 17 bp, Homo sapiens
ctcttatgcacacctcc

SEQ ID NO: 1813034 - DNA, 23 bp, Homo sapiens
ctcttcaatcactagtcaagaaa

SEQ ID NO: 1813035 - DNA, 19 bp, Homo sapiens
ctcttctgaagctagaaac

SEQ ID NO: 1813036 - DNA, 13 bp, Homo sapiens
ctcttgcaggctg

SEQ ID NO: 1813037 - DNA, 14 bp, Homo sapiens
ctcttgccccaacc

SEQ ID NO: 1813038 - DNA, 16 bp, Homo sapiens
ctcttggtccctggtc

SEQ ID NO: 1813039 - DNA, 19 bp, Homo sapiens
ctcttgtgctcacgctccc

SEQ ID NO: 1813040 - DNA, 16 bp, Homo sapiens
ctctttactcccttcc

SEQ ID NO: 1813041 - DNA, 22 bp, Homo sapiens
ctctttactcccttcctggcct

SEQ ID NO: 1813042 - DNA, 16 bp, Homo sapiens
ctctttcactcaggct

SEQ ID NO: 1813043 - DNA, 12 bp, Homo sapiens
ctgaaaaagaaa

SEQ ID NO: 1813044 - DNA, 15 bp, Homo sapiens
ctgaaaacgaagggg

SEQ ID NO: 1813045 - DNA, 17 bp, Homo sapiens
ctgaaaacgaaggggcc

SEQ ID NO: 1813046 - DNA, 22 bp, Homo sapiens
ctgaaacattccgaagagggaa

SEQ ID NO: 1813047 - DNA, 13 bp, Homo sapiens
ctgaaagcagcag

SEQ ID NO: 1813048 - DNA, 19 bp, Homo sapiens
ctgaaagcagcagctagga

SEQ ID NO: 1813049 - DNA, 13 bp, Homo sapiens
ctgaacaaaagct

SEQ ID NO: 1813050 - DNA, 22 bp, Homo sapiens
ctgaaccagagctggaacacaa

SEQ ID NO: 1813051 - DNA, 19 bp, Homo sapiens
ctgaaccccatgggcttgg

SEQ ID NO: 1813052 - DNA, 23 bp, Homo sapiens
ctgaaggaatagccagagaggag

SEQ ID NO: 1813053 - DNA, 20 bp, Homo sapiens
ctgaaggggcacaccactgc

SEQ ID NO: 1813054 - DNA, 16 bp, Homo sapiens
ctgaaggtttcctggt

SEQ ID NO: 1813055 - DNA, 17 bp, Homo sapiens
ctgaaggtttcctggtc

SEQ ID NO: 1813056 - DNA, 12 bp, Homo sapiens
ctgaagtgcttg

SEQ ID NO: 1813057 - DNA, 20 bp, Homo sapiens
ctgaagtgcttgcagatcat

SEQ ID NO: 1813058 - DNA, 16 bp, Homo sapiens
ctgaattcctttacaa

SEQ ID NO: 1813059 - DNA, 19 bp, Homo sapiens
ctgacacctaccatgctgc

SEQ ID NO: 1813060 - DNA, 15 bp, Homo sapiens
ctgaccccctcccct

SEQ ID NO: 1813061 - DNA, 14 bp, Homo sapiens
ctgactccagagtc

SEQ ID NO: 1813062 - DNA, 21 bp, Homo sapiens
ctgactccagagtctgagccc

SEQ ID NO: 1813063 - DNA, 22 bp, Homo sapiens
ctgactccagagtctgagcccc

SEQ ID NO: 1813064 - DNA, 19 bp, Homo sapiens
ctgacttcaggggctgccc

SEQ ID NO: 1813065 - DNA, 21 bp, Homo sapiens
ctgacttcaggggctgcccgc

SEQ ID NO: 1813066 - DNA, 17 bp, Homo sapiens
ctgagaaggcgaggaga

SEQ ID NO: 1813067 - DNA, 17 bp, Homo sapiens
ctgagaagtgtatatag

SEQ ID NO: 1813068 - DNA, 21 bp, Homo sapiens
ctgagactccagaatctgctg

SEQ ID NO: 1813069 - DNA, 22 bp, Homo sapiens
ctgagactccagaatctgctgt

SEQ ID NO: 1813070 - DNA, 14 bp, Homo sapiens
ctgagagagtggca

SEQ ID NO: 1813071 - DNA, 12 bp, Homo sapiens
ctgagaggccac

SEQ ID NO: 1813072 - DNA, 15 bp, Homo sapiens
ctgagcattcaggca

SEQ ID NO: 1813073 - DNA, 15 bp, Homo sapiens
ctgagccactcgcag

SEQ ID NO: 1813074 - DNA, 11 bp, Homo sapiens
ctgagcccagg

SEQ ID NO: 1813075 - DNA, 17 bp, Homo sapiens
ctgagcccccggctagt

SEQ ID NO: 1813076 - DNA, 13 bp, Homo sapiens
ctgagctggccta

SEQ ID NO: 1813077 - DNA, 15 bp, Homo sapiens
ctgagctggggccac

SEQ ID NO: 1813078 - DNA, 18 bp, Homo sapiens
ctgagcttagccttgtgc

SEQ ID NO: 1813079 - DNA, 20 bp, Homo sapiens
ctgagcttagccttgtgccc

SEQ ID NO: 1813080 - DNA, 22 bp, Homo sapiens
ctgagcttagccttgtgccctg

SEQ ID NO: 1813081 - DNA, 24 bp, Homo sapiens
ctgagcttagccttgtgccctgcc

SEQ ID NO: 1813082 - DNA, 17 bp, Homo sapiens
ctgagctttggggacag

SEQ ID NO: 1813083 - DNA, 21 bp, Homo sapiens
ctgagctttggggacagttgg

SEQ ID NO: 1813084 - DNA, 18 bp, Homo sapiens
ctgaggaagagggactgt

SEQ ID NO: 1813085 - DNA, 21 bp, Homo sapiens
ctgaggagtattaagaatgca

SEQ ID NO: 1813086 - DNA, 18 bp, Homo sapiens
ctgaggccattatttcaa

SEQ ID NO: 1813087 - DNA, 15 bp, Homo sapiens
ctgaggcctcatccc

SEQ ID NO: 1813088 - DNA, 22 bp, Homo sapiens
ctgagggctaattctgggaagg

SEQ ID NO: 1813089 - DNA, 14 bp, Homo sapiens
ctgagtcggcccca

SEQ ID NO: 1813090 - DNA, 23 bp, Homo sapiens
ctgagtggaatgcagggaagagg

SEQ ID NO: 1813091 - DNA, 19 bp, Homo sapiens
ctgagttacttgtctgagg

SEQ ID NO: 1813092 - DNA, 24 bp, Homo sapiens
ctgagttacttgtctgaggcctca

SEQ ID NO: 1813093 - DNA, 15 bp, Homo sapiens
ctgatgatggaaggg

SEQ ID NO: 1813094 - DNA, 13 bp, Homo sapiens
ctgatgctgcccc

SEQ ID NO: 1813095 - DNA, 14 bp, Homo sapiens
ctgatgctgccccg

SEQ ID NO: 1813096 - DNA, 14 bp, Homo sapiens
ctgatgctgggctg

SEQ ID NO: 1813097 - DNA, 15 bp, Homo sapiens
ctgatgctgggctgg

SEQ ID NO: 1813098 - DNA, 17 bp, Homo sapiens
ctgatgctgggctgggt

SEQ ID NO: 1813099 - DNA, 19 bp, Homo sapiens
ctgatgctgggctgggtgc

SEQ ID NO: 1813100 - DNA, 15 bp, Homo sapiens
ctgatggccaagggg

SEQ ID NO: 1813101 - DNA, 15 bp, Homo sapiens
ctgatggtgagctgg

SEQ ID NO: 1813102 - DNA, 22 bp, Homo sapiens
ctgattagtattcaggcactga

SEQ ID NO: 1813103 - DNA, 13 bp, Homo sapiens
ctgcaagccccag

SEQ ID NO: 1813104 - DNA, 14 bp, Homo sapiens
ctgcaatctccagg

SEQ ID NO: 1813105 - DNA, 21 bp, Homo sapiens
ctgcacagtttagaacagagg

SEQ ID NO: 1813106 - DNA, 13 bp, Homo sapiens
ctgcaccaaccca

SEQ ID NO: 1813107 - DNA, 22 bp, Homo sapiens
ctgcaccagagtgaaagggcta

SEQ ID NO: 1813108 - DNA, 11 bp, Homo sapiens
ctgcaccagga

SEQ ID NO: 1813109 - DNA, 14 bp, Homo sapiens
ctgcaccaggagac

SEQ ID NO: 1813110 - DNA, 19 bp, Homo sapiens
ctgcaccccctcctgctgc

SEQ ID NO: 1813111 - DNA, 19 bp, Homo sapiens
ctgcacctcctaccctccc

SEQ ID NO: 1813112 - DNA, 24 bp, Homo sapiens
ctgcacctcctaccctcccaccag

SEQ ID NO: 1813113 - DNA, 15 bp, Homo sapiens
ctgcactctgtgccc

SEQ ID NO: 1813114 - DNA, 16 bp, Homo sapiens
ctgcactctgtgccca

SEQ ID NO: 1813115 - DNA, 21 bp, Homo sapiens
ctgcactctgtgcccatgggc

SEQ ID NO: 1813116 - DNA, 12 bp, Homo sapiens
ctgcactgcagt

SEQ ID NO: 1813117 - DNA, 13 bp, Homo sapiens
ctgcactgcagtg

SEQ ID NO: 1813118 - DNA, 18 bp, Homo sapiens
ctgcactgtcctgctcca

SEQ ID NO: 1813119 - DNA, 19 bp, Homo sapiens
ctgcactgtcctgctccac

SEQ ID NO: 1813120 - DNA, 23 bp, Homo sapiens
ctgcactgtcctgctccacagtg

SEQ ID NO: 1813121 - DNA, 19 bp, Homo sapiens
ctgcttttccaggatcctg

SEQ ID NO: 1813122 - DNA, 20 bp, Homo sapiens
ctgcttttccaggatcctgc

SEQ ID NO: 1813123 - DNA, 22 bp, Homo sapiens
ctgcttttccaggatcctgcag

SEQ ID NO: 1813124 - DNA, 24 bp, Homo sapiens
ctgcttttccaggatcctgcagga

SEQ ID NO: 1813125 - DNA, 19 bp, Homo sapiens
ctggaaccagggaggagag

SEQ ID NO: 1813126 - DNA, 18 bp, Homo sapiens
ctggaaggcagggcagag

SEQ ID NO: 1813127 - DNA, 14 bp, Homo sapiens
ctggaaggctggct

SEQ ID NO: 1813128 - DNA, 16 bp, Homo sapiens
ctggaatctactagaa

SEQ ID NO: 1813129 - DNA, 15 bp, Homo sapiens
ctggaattcagcacc

SEQ ID NO: 1813130 - DNA, 23 bp, Homo sapiens
ctggaattcagcaccctgggtgc

SEQ ID NO: 1813131 - DNA, 17 bp, Homo sapiens
ctggacaagaagctgct

SEQ ID NO: 1813132 - DNA, 12 bp, Homo sapiens
ctggaggtttgt

SEQ ID NO: 1813133 - DNA, 18 bp, Homo sapiens
ctggagtgaggcttccag

SEQ ID NO: 1813134 - DNA, 20 bp, Homo sapiens
ctggagtgaggcttccaggc

SEQ ID NO: 1813135 - DNA, 17 bp, Homo sapiens
ctggagtgcgctcttgg

SEQ ID NO: 1813136 - DNA, 23 bp, Homo sapiens
ctggagtgcgctcttggtccctg

SEQ ID NO: 1813137 - DNA, 19 bp, Homo sapiens
ctggcaaagttatatttac

SEQ ID NO: 1813138 - DNA, 22 bp, Homo sapiens
ctggcaacatagtgagatccca

SEQ ID NO: 1813139 - DNA, 16 bp, Homo sapiens
ctggcaagcagggaaa

SEQ ID NO: 1813140 - DNA, 12 bp, Homo sapiens
ctggcacagtgt

SEQ ID NO: 1813141 - DNA, 19 bp, Homo sapiens
ctggcacagtgtctgggct

SEQ ID NO: 1813142 - DNA, 20 bp, Homo sapiens
ctggcacagtgtctgggctg

SEQ ID NO: 1813143 - DNA, 16 bp, Homo sapiens
ctggcagctcctctcc

SEQ ID NO: 1813144 - DNA, 21 bp, Homo sapiens
ctggcagctcctctccttggg

SEQ ID NO: 1813145 - DNA, 24 bp, Homo sapiens
ctggcagctcctctccttgggctc

SEQ ID NO: 1813146 - DNA, 21 bp, Homo sapiens
ctggcaggtgcagatgggctg

SEQ ID NO: 1813147 - DNA, 14 bp, Homo sapiens
ctggccagagaggg

SEQ ID NO: 1813148 - DNA, 21 bp, Homo sapiens
ctggccagagagggcccagct

SEQ ID NO: 1813149 - DNA, 17 bp, Homo sapiens
ctggccagccccacagc

SEQ ID NO: 1813150 - DNA, 21 bp, Homo sapiens
ctggccagtggctggatctgt

SEQ ID NO: 1813151 - DNA, 12 bp, Homo sapiens
ctggcccagctc

SEQ ID NO: 1813152 - DNA, 14 bp, Homo sapiens
ctggcccagctccc

SEQ ID NO: 1813153 - DNA, 12 bp, Homo sapiens
ctggccccaccc

SEQ ID NO: 1813154 - DNA, 15 bp, Homo sapiens
ctggcccccctccag

SEQ ID NO: 1813155 - DNA, 17 bp, Homo sapiens
ctggcccccctccaggc

SEQ ID NO: 1813156 - DNA, 17 bp, Homo sapiens
ctggccctcaaggcctc

SEQ ID NO: 1813157 - DNA, 18 bp, Homo sapiens
ctggccctcaaggcctcc

SEQ ID NO: 1813158 - DNA, 19 bp, Homo sapiens
ctggccctcaaggcctccc

SEQ ID NO: 1813159 - DNA, 24 bp, Homo sapiens
ctggccctcaaggcctcccacagt

SEQ ID NO: 1813160 - DNA, 13 bp, Homo sapiens
ctggccctgtgcc

SEQ ID NO: 1813161 - DNA, 17 bp, Homo sapiens
ctggcctcactggctgg

SEQ ID NO: 1813162 - DNA, 18 bp, Homo sapiens
ctggcctcactggctggg

SEQ ID NO: 1813163 - DNA, 18 bp, Homo sapiens
ctggcctcccaataaagc

SEQ ID NO: 1813164 - DNA, 19 bp, Homo sapiens
ctggcctcccaataaagct

SEQ ID NO: 1813165 - DNA, 16 bp, Homo sapiens
ctggcctcgcctggcc

SEQ ID NO: 1813166 - DNA, 17 bp, Homo sapiens
ctggcctcgcctggcct

SEQ ID NO: 1813167 - DNA, 14 bp, Homo sapiens
ctggcctgagctgg

SEQ ID NO: 1813168 - DNA, 19 bp, Homo sapiens
ctggcctgagctggggcca

SEQ ID NO: 1813169 - DNA, 14 bp, Homo sapiens
ctggcctgctggga

SEQ ID NO: 1813170 - DNA, 23 bp, Homo sapiens
ctggcctgctgggaaccccgcag

SEQ ID NO: 1813171 - DNA, 13 bp, Homo sapiens
ctggcctggctcc

SEQ ID NO: 1813172 - DNA, 20 bp, Homo sapiens
ctggcggcttcctgtccact

SEQ ID NO: 1813173 - DNA, 21 bp, Homo sapiens
ctggctccccacgagtcacct

SEQ ID NO: 1813174 - DNA, 22 bp, Homo sapiens
ctggctccccacgagtcacctg

SEQ ID NO: 1813175 - DNA, 12 bp, Homo sapiens
ctggctgccagg

SEQ ID NO: 1813176 - DNA, 13 bp, Homo sapiens
ctggctggggcct

SEQ ID NO: 1813177 - DNA, 18 bp, Homo sapiens
ctggctggggcctatcag

SEQ ID NO: 1813178 - DNA, 22 bp, Homo sapiens
ctggctggggcctatcagtgtg

SEQ ID NO: 1813179 - DNA, 18 bp, Homo sapiens
ctggctgtggaggcctga

SEQ ID NO: 1813180 - DNA, 13 bp, Homo sapiens
ctggcttgctcca

SEQ ID NO: 1813181 - DNA, 18 bp, Homo sapiens
ctggcttgctccagggtc

SEQ ID NO: 1813182 - DNA, 16 bp, Homo sapiens
ctgggaaaggacccac

SEQ ID NO: 1813183 - DNA, 20 bp, Homo sapiens
ctgggaaaggacccacccat

SEQ ID NO: 1813184 - DNA, 21 bp, Homo sapiens
ctgggaaaggacccacccatc

SEQ ID NO: 1813185 - DNA, 19 bp, Homo sapiens
ctgggaaccccgcagcccg

SEQ ID NO: 1813186 - DNA, 15 bp, Homo sapiens
ctgggaagggagagt

SEQ ID NO: 1813187 - DNA, 13 bp, Homo sapiens
ctgggacccagct

SEQ ID NO: 1813188 - DNA, 23 bp, Homo sapiens
ctgggacccagctactctgtcca

SEQ ID NO: 1813189 - DNA, 20 bp, Homo sapiens
ctgggatttcttcgctgctc

SEQ ID NO: 1813190 - DNA, 14 bp, Homo sapiens
ctgggccccatgct

SEQ ID NO: 1813191 - DNA, 15 bp, Homo sapiens
ctgggccccatgctc

SEQ ID NO: 1813192 - DNA, 16 bp, Homo sapiens
ctgggccccatgctct

SEQ ID NO: 1813193 - DNA, 18 bp, Homo sapiens
ctgggccccatgctctgc

SEQ ID NO: 1813194 - DNA, 21 bp, Homo sapiens
ctgggccccatgctctgcccc

SEQ ID NO: 1813195 - DNA, 22 bp, Homo sapiens
ctgggccccatgctctgcccca

SEQ ID NO: 1813196 - DNA, 19 bp, Homo sapiens
ctgggcctgcttttccagg

SEQ ID NO: 1813197 - DNA, 23 bp, Homo sapiens
ctgggcctgcttttccaggatcc

SEQ ID NO: 1813198 - DNA, 13 bp, Homo sapiens
ctgggcctgtccc

SEQ ID NO: 1813199 - DNA, 14 bp, Homo sapiens
ctgggcctgtcccc

SEQ ID NO: 1813200 - DNA, 14 bp, Homo sapiens
ctgggcctgtgcag

SEQ ID NO: 1813201 - DNA, 18 bp, Homo sapiens
ctgggctaccccccctcc

SEQ ID NO: 1813202 - DNA, 15 bp, Homo sapiens
ctgggctcagggctg

SEQ ID NO: 1813203 - DNA, 16 bp, Homo sapiens
ctgggctcagggctgg

SEQ ID NO: 1813204 - DNA, 14 bp, Homo sapiens
ctgggctctgtggg

SEQ ID NO: 1813205 - DNA, 18 bp, Homo sapiens
ctgggctggggcctgatg

SEQ ID NO: 1813206 - DNA, 12 bp, Homo sapiens
ctgggctgggtg

SEQ ID NO: 1813207 - DNA, 18 bp, Homo sapiens
ctgggctgggtgcgaccc

SEQ ID NO: 1813208 - DNA, 13 bp, Homo sapiens
ctggggcagaggg

SEQ ID NO: 1813209 - DNA, 17 bp, Homo sapiens
ctggggcagaggggcag

SEQ ID NO: 1813210 - DNA, 17 bp, Homo sapiens
ctggggcatgtgtgcct

SEQ ID NO: 1813211 - DNA, 22 bp, Homo sapiens
ctggggccacaaatcaaagcaa

SEQ ID NO: 1813212 - DNA, 18 bp, Homo sapiens
ctggggccccgctgggat

SEQ ID NO: 1813213 - DNA, 13 bp, Homo sapiens
ctgggggcagtga

SEQ ID NO: 1813214 - DNA, 16 bp, Homo sapiens
ctgggggcagtgactg

SEQ ID NO: 1813215 - DNA, 22 bp, Homo sapiens
ctgggtgcgaccccatctgccc

SEQ ID NO: 1813216 - DNA, 12 bp, Homo sapiens
ctgggtggccca

SEQ ID NO: 1813217 - DNA, 13 bp, Homo sapiens
ctgggtggcccat

SEQ ID NO: 1813218 - DNA, 15 bp, Homo sapiens
ctgggtggcccatcc

SEQ ID NO: 1813219 - DNA, 15 bp, Homo sapiens
ctgggtgttgaccac

SEQ ID NO: 1813220 - DNA, 18 bp, Homo sapiens
ctgggttggcgcaccctc

SEQ ID NO: 1813221 - DNA, 20 bp, Homo sapiens
ctggtaaacattcctccagc

SEQ ID NO: 1813222 - DNA, 18 bp, Homo sapiens
ctggtccctcgtccacag

SEQ ID NO: 1813223 - DNA, 19 bp, Homo sapiens
ctggtgcactggccccacc

SEQ ID NO: 1813224 - DNA, 18 bp, Homo sapiens
ctggtggtgcagccttcc

SEQ ID NO: 1813225 - DNA, 13 bp, Homo sapiens
ctggtttacaaat

SEQ ID NO: 1813226 - DNA, 17 bp, Homo sapiens
ctggtttacaaatatag

SEQ ID NO: 1813227 - DNA, 19 bp, Homo sapiens
ctgtaactgctgagccact

SEQ ID NO: 1813228 - DNA, 13 bp, Homo sapiens
ctgtacccagctc

SEQ ID NO: 1813229 - DNA, 13 bp, Homo sapiens
ctgtacccttcca

SEQ ID NO: 1813230 - DNA, 17 bp, Homo sapiens
ctgtacccttccacctc

SEQ ID NO: 1813231 - DNA, 17 bp, Homo sapiens
ctgtactaaggagcatg

SEQ ID NO: 1813232 - DNA, 19 bp, Homo sapiens
ctgtactcagagcagagca

SEQ ID NO: 1813233 - DNA, 18 bp, Homo sapiens
ctgtactgatactattca

SEQ ID NO: 1813234 - DNA, 20 bp, Homo sapiens
ctgtactgatactattcaat

SEQ ID NO: 1813235 - DNA, 14 bp, Homo sapiens
ctgtagccatggct

SEQ ID NO: 1813236 - DNA, 17 bp, Homo sapiens
ctgtagccatggctcag

SEQ ID NO: 1813237 - DNA, 15 bp, Homo sapiens
gagggaatttaacca

SEQ ID NO: 1813238 - DNA, 14 bp, Homo sapiens
gagggcagagccat

SEQ ID NO: 1813239 - DNA, 16 bp, Homo sapiens
gagggcagtacctggg

SEQ ID NO: 1813240 - DNA, 14 bp, Homo sapiens
gagggcccagctgt

SEQ ID NO: 1813241 - DNA, 20 bp, Homo sapiens
gagggcccagctgtagccat

SEQ ID NO: 1813242 - DNA, 13 bp, Homo sapiens
gaggggcaggccc

SEQ ID NO: 1813243 - DNA, 14 bp, Homo sapiens
gaggggcaggccct

SEQ ID NO: 1813244 - DNA, 15 bp, Homo sapiens
gaggggcaggccctg

SEQ ID NO: 1813245 - DNA, 16 bp, Homo sapiens
gagggggcgctcagga

SEQ ID NO: 1813246 - DNA, 19 bp, Homo sapiens
gagggggctatttctctcc

SEQ ID NO: 1813247 - DNA, 14 bp, Homo sapiens
gagggggctctcca

SEQ ID NO: 1813248 - DNA, 13 bp, Homo sapiens
gaggggtctttta

SEQ ID NO: 1813249 - DNA, 12 bp, Homo sapiens
gaggtgggcagc

SEQ ID NO: 1813250 - DNA, 14 bp, Homo sapiens
gaggtgggcagctg

SEQ ID NO: 1813251 - DNA, 17 bp, Homo sapiens
gaggtgggccacaccca

SEQ ID NO: 1813252 - DNA, 23 bp, Homo sapiens
gaggtgggccacacccaggaagg

SEQ ID NO: 1813253 - DNA, 13 bp, Homo sapiens
gaggttatctgcc

SEQ ID NO: 1813254 - DNA, 17 bp, Homo sapiens
gaggttatctgcctggc

SEQ ID NO: 1813255 - DNA, 23 bp, Homo sapiens
gaggttatctgcctggcctggct

SEQ ID NO: 1813256 - DNA, 14 bp, Homo sapiens
gagtcacctgcaag

SEQ ID NO: 1813257 - DNA, 12 bp, Homo sapiens
gagtcggcccca

SEQ ID NO: 1813258 - DNA, 23 bp, Homo sapiens
gagtgacctcacttctggcactg

SEQ ID NO: 1813259 - DNA, 18 bp, Homo sapiens
gagtgaggatgtctgggc

SEQ ID NO: 1813260 - DNA, 13 bp, Homo sapiens
gagtgcagagaaa

SEQ ID NO: 1813261 - DNA, 14 bp, Homo sapiens
gagtggaatgcagg

SEQ ID NO: 1813262 - DNA, 17 bp, Homo sapiens
gagtggaatgcagggaa

SEQ ID NO: 1813263 - DNA, 11 bp, Homo sapiens
gagtggcagcc

SEQ ID NO: 1813264 - DNA, 24 bp, Homo sapiens
gagtggcagccatgcctcatgcca

SEQ ID NO: 1813265 - DNA, 21 bp, Homo sapiens
gagtgtgtaatttaaaattgt

SEQ ID NO: 1813266 - DNA, 21 bp, Homo sapiens
gagttacttgtctgaggcctc

SEQ ID NO: 1813267 - DNA, 17 bp, Homo sapiens
gagttattcaaatgaag

SEQ ID NO: 1813268 - DNA, 19 bp, Homo sapiens
gagttctttgctgcccctg

SEQ ID NO: 1813269 - DNA, 13 bp, Homo sapiens
gagttggctggga

SEQ ID NO: 1813270 - DNA, 22 bp, Homo sapiens
gagtttgagacaagccctggca

SEQ ID NO: 1813271 - DNA, 15 bp, Homo sapiens
gataaactaaaagca

SEQ ID NO: 1813272 - DNA, 18 bp, Homo sapiens
gataacaagcaaggatat

SEQ ID NO: 1813273 - DNA, 18 bp, Homo sapiens
gataaccccaagacagtc

SEQ ID NO: 1813274 - DNA, 12 bp, Homo sapiens
gatactattcaa

SEQ ID NO: 1813275 - DNA, 18 bp, Homo sapiens
gatactattcaatgcaat

SEQ ID NO: 1813276 - DNA, 13 bp, Homo sapiens
gatactgtactga

SEQ ID NO: 1813277 - DNA, 14 bp, Homo sapiens
gatagatgtgtgga

SEQ ID NO: 1813278 - DNA, 22 bp, Homo sapiens
gatagatgtgtggacacattgg

SEQ ID NO: 1813279 - DNA, 21 bp, Homo sapiens
gatatatatttactaaaagaa

SEQ ID NO: 1813280 - DNA, 13 bp, Homo sapiens
gatcaaaatcaaa

SEQ ID NO: 1813281 - DNA, 14 bp, Homo sapiens
gatcatctggggac

SEQ ID NO: 1813282 - DNA, 23 bp, Homo sapiens
gatccgacttgaattttcccact

SEQ ID NO: 1813283 - DNA, 13 bp, Homo sapiens
gatccgctgccac

SEQ ID NO: 1813284 - DNA, 11 bp, Homo sapiens
gatcctgcagg

SEQ ID NO: 1813285 - DNA, 20 bp, Homo sapiens
gatcctgcaggaacgagcac

SEQ ID NO: 1813286 - DNA, 18 bp, Homo sapiens
gatcgcttgagcccagga

SEQ ID NO: 1813287 - DNA, 20 bp, Homo sapiens
gatcgcttgagcccaggagt

SEQ ID NO: 1813288 - DNA, 16 bp, Homo sapiens
gatctatttttgcact

SEQ ID NO: 1813289 - DNA, 17 bp, Homo sapiens
gatctccaattgcctct

SEQ ID NO: 1813290 - DNA, 15 bp, Homo sapiens
gatctgatggtgagc

SEQ ID NO: 1813291 - DNA, 20 bp, Homo sapiens
gatctgatggtgagctggga

SEQ ID NO: 1813292 - DNA, 16 bp, Homo sapiens
gatctgcctgggcctg

SEQ ID NO: 1813293 - DNA, 20 bp, Homo sapiens
gatctgcctgggcctgtgca

SEQ ID NO: 1813294 - DNA, 22 bp, Homo sapiens
gatctgcctgggcctgtgcagc

SEQ ID NO: 1813295 - DNA, 19 bp, Homo sapiens
gatctttttgtgaaattca

SEQ ID NO: 1813296 - DNA, 16 bp, Homo sapiens
gatgagatttgccagc

SEQ ID NO: 1813297 - DNA, 17 bp, Homo sapiens
gatgagatttgccagca

SEQ ID NO: 1813298 - DNA, 20 bp, Homo sapiens
gatgagatttgccagcacag

SEQ ID NO: 1813299 - DNA, 13 bp, Homo sapiens
gatgatgccacac

SEQ ID NO: 1813300 - DNA, 15 bp, Homo sapiens
gatgccacaccaagc

SEQ ID NO: 1813301 - DNA, 22 bp, Homo sapiens
gatgccacaccaagctgtgcca

SEQ ID NO: 1813302 - DNA, 19 bp, Homo sapiens
gatgctgccccgttccctg

SEQ ID NO: 1813303 - DNA, 17 bp, Homo sapiens
gatgctgggctgggtgc

SEQ ID NO: 1813304 - DNA, 21 bp, Homo sapiens
gatggaccgggtgggcctggc

SEQ ID NO: 1813305 - DNA, 16 bp, Homo sapiens
gatggccaagagcatc

SEQ ID NO: 1813306 - DNA, 18 bp, Homo sapiens
gatggccaagggggtgga

SEQ ID NO: 1813307 - DNA, 22 bp, Homo sapiens
gatggccatgctcaacccccct

SEQ ID NO: 1813308 - DNA, 20 bp, Homo sapiens
gatggcgcgggaggcaccag

SEQ ID NO: 1813309 - DNA, 22 bp, Homo sapiens
gatggcgcgggaggcaccagct

SEQ ID NO: 1813310 - DNA, 19 bp, Homo sapiens
gatggcttatttgtataat

SEQ ID NO: 1813311 - DNA, 16 bp, Homo sapiens
gatgggcattgggctg

SEQ ID NO: 1813312 - DNA, 21 bp, Homo sapiens
gatgggtcagttgtatcagca

SEQ ID NO: 1813313 - DNA, 14 bp, Homo sapiens
gatggtgagctggg

SEQ ID NO: 1813314 - DNA, 15 bp, Homo sapiens
gatggtgagctggga

SEQ ID NO: 1813315 - DNA, 17 bp, Homo sapiens
gatgtggcaaagtgctg

SEQ ID NO: 1813316 - DNA, 14 bp, Homo sapiens
gattaaagagattg

SEQ ID NO: 1813317 - DNA, 15 bp, Homo sapiens
gattatatatcataa

SEQ ID NO: 1813318 - DNA, 20 bp, Homo sapiens
gattatatatcataaagtat

SEQ ID NO: 1813319 - DNA, 19 bp, Homo sapiens
gattattgatcaaaatcaa

SEQ ID NO: 1813320 - DNA, 17 bp, Homo sapiens
gattcctcccccagagc

SEQ ID NO: 1813321 - DNA, 22 bp, Homo sapiens
gattgttctgtccagtttccaa

SEQ ID NO: 1813322 - DNA, 21 bp, Homo sapiens
gatttcccgtggccccagcct

SEQ ID NO: 1813323 - DNA, 22 bp, Homo sapiens
gatttctaagttaaatcatttt

SEQ ID NO: 1813324 - DNA, 14 bp, Homo sapiens
gatttgccagcaca

SEQ ID NO: 1813325 - DNA, 22 bp, Homo sapiens
gattttaaagagtgaaaaatga

SEQ ID NO: 1813326 - DNA, 21 bp, Homo sapiens
gatttttgttttccactgtgc

SEQ ID NO: 1813327 - DNA, 17 bp, Homo sapiens
gcaaaactagacaaaag

SEQ ID NO: 1813328 - DNA, 18 bp, Homo sapiens
gcaaaagaagtaaaagct

SEQ ID NO: 1813329 - DNA, 14 bp, Homo sapiens
gcaaaatttctgta

SEQ ID NO: 1813330 - DNA, 15 bp, Homo sapiens
gcaaagaactgcccc

SEQ ID NO: 1813331 - DNA, 16 bp, Homo sapiens
gcaaagaactgcccca

SEQ ID NO: 1813332 - DNA, 16 bp, Homo sapiens
gcaaagtgctgtaccc

SEQ ID NO: 1813333 - DNA, 14 bp, Homo sapiens
gcaaatgagggagg

SEQ ID NO: 1813334 - DNA, 19 bp, Homo sapiens
gcaacaataattcatcaag

SEQ ID NO: 1813335 - DNA, 14 bp, Homo sapiens
gcaacccctgtacc

SEQ ID NO: 1813336 - DNA, 19 bp, Homo sapiens
gcaacccctgtacccagct

SEQ ID NO: 1813337 - DNA, 14 bp, Homo sapiens
gcaacttgcttcta

SEQ ID NO: 1813338 - DNA, 15 bp, Homo sapiens
gcaacttgcttctaa

SEQ ID NO: 1813339 - DNA, 14 bp, Homo sapiens
gcaagaaaaccaca

SEQ ID NO: 1813340 - DNA, 12 bp, Homo sapiens
gcaagcagggaa

SEQ ID NO: 1813341 - DNA, 14 bp, Homo sapiens
gcaagcagggaaag

SEQ ID NO: 1813342 - DNA, 18 bp, Homo sapiens
gcaagcccctcagccctt

SEQ ID NO: 1813343 - DNA, 23 bp, Homo sapiens
gcaagcccctcagcccttgcccc

SEQ ID NO: 1813344 - DNA, 15 bp, Homo sapiens
gcaagcgagcacagt

SEQ ID NO: 1813345 - DNA, 19 bp, Homo sapiens
gcaaggacaacctgcccct

SEQ ID NO: 1813346 - DNA, 14 bp, Homo sapiens
gcaaggaggctggc

SEQ ID NO: 1813347 - DNA, 15 bp, Homo sapiens
gcaagggcatcaggc

SEQ ID NO: 1813348 - DNA, 19 bp, Homo sapiens
gcaagggcatcaggcactg

SEQ ID NO: 1813349 - DNA, 16 bp, Homo sapiens
gcaagggctccagcat

SEQ ID NO: 1813350 - DNA, 22 bp, Homo sapiens
gcaagggctccagcatccagcc

SEQ ID NO: 1813351 - DNA, 23 bp, Homo sapiens
gcaaggtctccttactctgagcc

SEQ ID NO: 1813352 - DNA, 15 bp, Homo sapiens
gcaattcaatgcaat

SEQ ID NO: 1813353 - DNA, 13 bp, Homo sapiens
gcaattgccctgt

SEQ ID NO: 1813354 - DNA, 18 bp, Homo sapiens
gccggccaggtgggcggg

SEQ ID NO: 1813355 - DNA, 14 bp, Homo sapiens
gccgtccatggcac

SEQ ID NO: 1813356 - DNA, 23 bp, Homo sapiens
gccgtccatggcaccagccccct

SEQ ID NO: 1813357 - DNA, 13 bp, Homo sapiens
gcctagaaagcaa

SEQ ID NO: 1813358 - DNA, 19 bp, Homo sapiens
gcctaggccaaatgcacaa

SEQ ID NO: 1813359 - DNA, 21 bp, Homo sapiens
gcctaggccaaatgcacaagc

SEQ ID NO: 1813360 - DNA, 17 bp, Homo sapiens
gcctataaaatgcccat

SEQ ID NO: 1813361 - DNA, 16 bp, Homo sapiens
gcctatcagtgtgccc

SEQ ID NO: 1813362 - DNA, 19 bp, Homo sapiens
gcctatcagtgtgcccccc

SEQ ID NO: 1813363 - DNA, 14 bp, Homo sapiens
gcctatccatcctg

SEQ ID NO: 1813364 - DNA, 19 bp, Homo sapiens
gcctatccatcctgcgagc

SEQ ID NO: 1813365 - DNA, 19 bp, Homo sapiens
gcctcagtttctccatcag

SEQ ID NO: 1813366 - DNA, 13 bp, Homo sapiens
gcctcatccctcg

SEQ ID NO: 1813367 - DNA, 14 bp, Homo sapiens
gcctcatccctcgg

SEQ ID NO: 1813368 - DNA, 24 bp, Homo sapiens
gcctcatccctcggaagccgtctg

SEQ ID NO: 1813369 - DNA, 17 bp, Homo sapiens
gcctcatgccacacctt

SEQ ID NO: 1813370 - DNA, 12 bp, Homo sapiens
gcctccactccc

SEQ ID NO: 1813371 - DNA, 18 bp, Homo sapiens
gcctccactcccacttcc

SEQ ID NO: 1813372 - DNA, 22 bp, Homo sapiens
gcctccactcccacttccctga

SEQ ID NO: 1813373 - DNA, 13 bp, Homo sapiens
gcctccactcccc

SEQ ID NO: 1813374 - DNA, 20 bp, Homo sapiens
gcctccactcccccacctga

SEQ ID NO: 1813375 - DNA, 16 bp, Homo sapiens
gcctccagagccagcc

SEQ ID NO: 1813376 - DNA, 18 bp, Homo sapiens
gcctccagagccagcctg

SEQ ID NO: 1813377 - DNA, 21 bp, Homo sapiens
gcctccagagccagcctggga

SEQ ID NO: 1813378 - DNA, 22 bp, Homo sapiens
gcctccagagccagcctgggac

SEQ ID NO: 1813379 - DNA, 14 bp, Homo sapiens
gcctccagcctctc

SEQ ID NO: 1813380 - DNA, 17 bp, Homo sapiens
gcctcccaataaagctg

SEQ ID NO: 1813381 - DNA, 12 bp, Homo sapiens
gcctcccacagt

SEQ ID NO: 1813382 - DNA, 13 bp, Homo sapiens
gcctcccctcccc

SEQ ID NO: 1813383 - DNA, 21 bp, Homo sapiens
gcctcccctcccctggggacg

SEQ ID NO: 1813384 - DNA, 22 bp, Homo sapiens
gcctcccctcccctggggacgc

SEQ ID NO: 1813385 - DNA, 20 bp, Homo sapiens
gcctccgtttatgggccttg

SEQ ID NO: 1813386 - DNA, 23 bp, Homo sapiens
gcctccgtttatgggccttgctt

SEQ ID NO: 1813387 - DNA, 17 bp, Homo sapiens
gcctcctgccccctgcc

SEQ ID NO: 1813388 - DNA, 18 bp, Homo sapiens
gcctcctgccccctgcca

SEQ ID NO: 1813389 - DNA, 19 bp, Homo sapiens
gcctcctgccccctgccag

SEQ ID NO: 1813390 - DNA, 15 bp, Homo sapiens
gcctcgcccaccgca

SEQ ID NO: 1813391 - DNA, 13 bp, Homo sapiens
gcctcgcctggcc

SEQ ID NO: 1813392 - DNA, 20 bp, Homo sapiens
gcctctcattccagaggaag

SEQ ID NO: 1813393 - DNA, 18 bp, Homo sapiens
gcctctcccggctgcctg

SEQ ID NO: 1813394 - DNA, 20 bp, Homo sapiens
gcctctcccggctgcctgcc

SEQ ID NO: 1813395 - DNA, 22 bp, Homo sapiens
gcctctcccggctgcctgccgc

SEQ ID NO: 1813396 - DNA, 15 bp, Homo sapiens
gcctctgtgtcactg

SEQ ID NO: 1813397 - DNA, 22 bp, Homo sapiens
gcctctgtgtcactggctgcct

SEQ ID NO: 1813398 - DNA, 14 bp, Homo sapiens
gcctcttccaccca

SEQ ID NO: 1813399 - DNA, 16 bp, Homo sapiens
gcctcttgtgctcacg

SEQ ID NO: 1813400 - DNA, 16 bp, Homo sapiens
gcctgagctggggcca

SEQ ID NO: 1813401 - DNA, 17 bp, Homo sapiens
gcctgaggtctcgctga

SEQ ID NO: 1813402 - DNA, 14 bp, Homo sapiens
gcctgatgctgccc

SEQ ID NO: 1813403 - DNA, 17 bp, Homo sapiens
gcctgatgctgccccgt

SEQ ID NO: 1813404 - DNA, 13 bp, Homo sapiens
gcctgatggccaa

SEQ ID NO: 1813405 - DNA, 15 bp, Homo sapiens
gcctgatggccaagg

SEQ ID NO: 1813406 - DNA, 17 bp, Homo sapiens
gcctgatggccaagggg

SEQ ID NO: 1813407 - DNA, 12 bp, Homo sapiens
gcctgcaccagg

SEQ ID NO: 1813408 - DNA, 13 bp, Homo sapiens
gcctgcaccagga

SEQ ID NO: 1813409 - DNA, 14 bp, Homo sapiens
gcctgctccttggc

SEQ ID NO: 1813410 - DNA, 20 bp, Homo sapiens
gcctgctccttggcaccccc

SEQ ID NO: 1813411 - DNA, 21 bp, Homo sapiens
gcctgctccttggcaccccca

SEQ ID NO: 1813412 - DNA, 12 bp, Homo sapiens
gcctggaaccag

SEQ ID NO: 1813413 - DNA, 17 bp, Homo sapiens
gcctggaaccagggagg

SEQ ID NO: 1813414 - DNA, 19 bp, Homo sapiens
gcctggaaccagggaggag

SEQ ID NO: 1813415 - DNA, 20 bp, Homo sapiens
gcctggaaccagggaggaga

SEQ ID NO: 1813416 - DNA, 16 bp, Homo sapiens
gcctggcacagtgtct

SEQ ID NO: 1813417 - DNA, 13 bp, Homo sapiens
gcctggcctgagc

SEQ ID NO: 1813418 - DNA, 20 bp, Homo sapiens
gcctggcctgagctggggcc

SEQ ID NO: 1813419 - DNA, 22 bp, Homo sapiens
gcctggcctgagctggggccac

SEQ ID NO: 1813420 - DNA, 12 bp, Homo sapiens
gcctggctcccc

SEQ ID NO: 1813421 - DNA, 22 bp, Homo sapiens
gcctggctccccacgagtcacc

SEQ ID NO: 1813422 - DNA, 16 bp, Homo sapiens
gcctggctgtggaggc

SEQ ID NO: 1813423 - DNA, 17 bp, Homo sapiens
gcctggctgtggaggcc

SEQ ID NO: 1813424 - DNA, 19 bp, Homo sapiens
gcctggctgtggaggcctg

SEQ ID NO: 1813425 - DNA, 18 bp, Homo sapiens
gcctgggactcccagtga

SEQ ID NO: 1813426 - DNA, 15 bp, Homo sapiens
gcctgggcctgtgca

SEQ ID NO: 1813427 - DNA, 18 bp, Homo sapiens
gcctgggggcagtgactg

SEQ ID NO: 1813428 - DNA, 19 bp, Homo sapiens
gcctgggggcagtgactgg

SEQ ID NO: 1813429 - DNA, 20 bp, Homo sapiens
gcctgggggcagtgactggc

SEQ ID NO: 1813430 - DNA, 21 bp, Homo sapiens
gcctgggggcagtgactggca

SEQ ID NO: 1813431 - DNA, 23 bp, Homo sapiens
gcctgggggcagtgactggcagg

SEQ ID NO: 1813432 - DNA, 21 bp, Homo sapiens
gcctgtgcagcagcccagctt

SEQ ID NO: 1813433 - DNA, 12 bp, Homo sapiens
gcctgtggcaga

SEQ ID NO: 1813434 - DNA, 19 bp, Homo sapiens
gcctgtggcagaaaagagg

SEQ ID NO: 1813435 - DNA, 12 bp, Homo sapiens
gcctgtgtccag

SEQ ID NO: 1813436 - DNA, 14 bp, Homo sapiens
gcctgtgtccagca

SEQ ID NO: 1813437 - DNA, 16 bp, Homo sapiens
gcctgtgtccagcagc

SEQ ID NO: 1813438 - DNA, 17 bp, Homo sapiens
gcctgtgtccagcagct

SEQ ID NO: 1813439 - DNA, 18 bp, Homo sapiens
gcctgtgtccagcagctg

SEQ ID NO: 1813440 - DNA, 22 bp, Homo sapiens
gcctgtgtccagcagctgcggg

SEQ ID NO: 1813441 - DNA, 18 bp, Homo sapiens
gcctgttgggcagagctg

SEQ ID NO: 1813442 - DNA, 23 bp, Homo sapiens
gccttccccttttgcctggctgt

SEQ ID NO: 1813443 - DNA, 14 bp, Homo sapiens
gccttcctcctcca

SEQ ID NO: 1813444 - DNA, 17 bp, Homo sapiens
gccttcctcctccacag

SEQ ID NO: 1813445 - DNA, 21 bp, Homo sapiens
gccttgagagaaaaagtgccc

SEQ ID NO: 1813446 - DNA, 23 bp, Homo sapiens
gccttgagagaaaaagtgcccct

SEQ ID NO: 1813447 - DNA, 13 bp, Homo sapiens
gccttgtgccctg

SEQ ID NO: 1813448 - DNA, 14 bp, Homo sapiens
gccttgtgccctgc

SEQ ID NO: 1813449 - DNA, 17 bp, Homo sapiens
gccttgtgccctgcccc

SEQ ID NO: 1813450 - DNA, 19 bp, Homo sapiens
gcctttgggaggcagcatc

SEQ ID NO: 1813451 - DNA, 16 bp, Homo sapiens
gcgagaggaggggccc

SEQ ID NO: 1813452 - DNA, 17 bp, Homo sapiens
gcgcaccctcccctccc

SEQ ID NO: 1813453 - DNA, 18 bp, Homo sapiens
gcgcaccctcccctcccg

SEQ ID NO: 1813454 - DNA, 14 bp, Homo sapiens
gcgccctctgtcct

SEQ ID NO: 1813455 - DNA, 16 bp, Homo sapiens
gcgccctctgtcctga

SEQ ID NO: 1813456 - DNA, 17 bp, Homo sapiens
gcgcgggaggcaccagc

SEQ ID NO: 1813457 - DNA, 10 bp, Homo sapiens
gcgctcagga

SEQ ID NO: 1813458 - DNA, 16 bp, Homo sapiens
gcgctcttggtccctg

SEQ ID NO: 1813459 - DNA, 20 bp, Homo sapiens
gcggcctttgttgctcagca

SEQ ID NO: 1813460 - DNA, 19 bp, Homo sapiens
gcggcttcctgtccactct

SEQ ID NO: 1813461 - DNA, 12 bp, Homo sapiens
gcgggaggcacc

SEQ ID NO: 1813462 - DNA, 15 bp, Homo sapiens
gcgggaggcaccagc

SEQ ID NO: 1813463 - DNA, 14 bp, Homo sapiens
gcgggcagcacagc

SEQ ID NO: 1813464 - DNA, 15 bp, Homo sapiens
gcgggcagcacagca

SEQ ID NO: 1813465 - DNA, 12 bp, Homo sapiens
gcggtgctctgg

SEQ ID NO: 1813466 - DNA, 21 bp, Homo sapiens
gcggtgctctggcggcttcct

SEQ ID NO: 1813467 - DNA, 17 bp, Homo sapiens
gcgtcctgacgccctgc

SEQ ID NO: 1813468 - DNA, 20 bp, Homo sapiens
gcgtcctgcagaggaccaca

SEQ ID NO: 1813469 - DNA, 18 bp, Homo sapiens
gcgtggctgtggcacaga

SEQ ID NO: 1813470 - DNA, 14 bp, Homo sapiens
gcgttggagccact

SEQ ID NO: 1813471 - DNA, 22 bp, Homo sapiens
ggcagagccatgggcctgggcc

SEQ ID NO: 1813472 - DNA, 22 bp, Homo sapiens
ggcagagggaatgttccctgca

SEQ ID NO: 1813473 - DNA, 23 bp, Homo sapiens
ggcagagggaatgttccctgcac

SEQ ID NO: 1813474 - DNA, 16 bp, Homo sapiens
ggcagcctccagagcc

SEQ ID NO: 1813475 - DNA, 17 bp, Homo sapiens
ggcagcctccagagcca

SEQ ID NO: 1813476 - DNA, 15 bp, Homo sapiens
ggcagctagactgga

SEQ ID NO: 1813477 - DNA, 16 bp, Homo sapiens
ggcagctcctctcctt

SEQ ID NO: 1813478 - DNA, 19 bp, Homo sapiens
ggcagctcctctccttggg

SEQ ID NO: 1813479 - DNA, 13 bp, Homo sapiens
ggcagctgctctt

SEQ ID NO: 1813480 - DNA, 11 bp, Homo sapiens
ggcagctgggc

SEQ ID NO: 1813481 - DNA, 13 bp, Homo sapiens
ggcagctgggccc

SEQ ID NO: 1813482 - DNA, 18 bp, Homo sapiens
ggcagctgggccccacct

SEQ ID NO: 1813483 - DNA, 12 bp, Homo sapiens
ggcaggacacat

SEQ ID NO: 1813484 - DNA, 21 bp, Homo sapiens
ggcaggacacatcccggcctc

SEQ ID NO: 1813485 - DNA, 13 bp, Homo sapiens
ggcaggcacagca

SEQ ID NO: 1813486 - DNA, 14 bp, Homo sapiens
ggcaggcctgggac

SEQ ID NO: 1813487 - DNA, 19 bp, Homo sapiens
ggcaggcctgggacccagc

SEQ ID NO: 1813488 - DNA, 15 bp, Homo sapiens
ggcagggctgaggcc

SEQ ID NO: 1813489 - DNA, 20 bp, Homo sapiens
ggcaggtagatcgcttgagc

SEQ ID NO: 1813490 - DNA, 12 bp, Homo sapiens
ggcaggtgcaga

SEQ ID NO: 1813491 - DNA, 13 bp, Homo sapiens
ggcaggtgcagat

SEQ ID NO: 1813492 - DNA, 14 bp, Homo sapiens
ggcagtacctggga

SEQ ID NO: 1813493 - DNA, 21 bp, Homo sapiens
ggcagtctgaacccttgtgct

SEQ ID NO: 1813494 - DNA, 13 bp, Homo sapiens
ggcagtgactggc

SEQ ID NO: 1813495 - DNA, 20 bp, Homo sapiens
ggcagtgactggcaggtgca

SEQ ID NO: 1813496 - DNA, 20 bp, Homo sapiens
ggcagtgggtcccacttccc

SEQ ID NO: 1813497 - DNA, 12 bp, Homo sapiens
ggcatcaggcac

SEQ ID NO: 1813498 - DNA, 20 bp, Homo sapiens
ggcatcaggcactggtggca

SEQ ID NO: 1813499 - DNA, 18 bp, Homo sapiens
ggcatccacccagtgctg

SEQ ID NO: 1813500 - DNA, 20 bp, Homo sapiens
ggcatccacccagtgctgcc

SEQ ID NO: 1813501 - DNA, 12 bp, Homo sapiens
ggcatgaaagtg

SEQ ID NO: 1813502 - DNA, 20 bp, Homo sapiens
ggcatggttccttccctggg

SEQ ID NO: 1813503 - DNA, 21 bp, Homo sapiens
ggcatggttccttccctggga

SEQ ID NO: 1813504 - DNA, 19 bp, Homo sapiens
ggcatgtgtgcctgtggca

SEQ ID NO: 1813505 - DNA, 13 bp, Homo sapiens
ggcattgggctga

SEQ ID NO: 1813506 - DNA, 15 bp, Homo sapiens
ggcattgggctgaca

SEQ ID NO: 1813507 - DNA, 13 bp, Homo sapiens
ggccaaggcaggt

SEQ ID NO: 1813508 - DNA, 15 bp, Homo sapiens
ggccaaggcaggtag

SEQ ID NO: 1813509 - DNA, 16 bp, Homo sapiens
ggccacacccaggaag

SEQ ID NO: 1813510 - DNA, 17 bp, Homo sapiens
ggccacacccaggaagg

SEQ ID NO: 1813511 - DNA, 21 bp, Homo sapiens
ggccaccccaaaccccagccc

SEQ ID NO: 1813512 - DNA, 13 bp, Homo sapiens
ggccactgtggcc

SEQ ID NO: 1813513 - DNA, 15 bp, Homo sapiens
ggccactgtggccag

SEQ ID NO: 1813514 - DNA, 19 bp, Homo sapiens
ggccagaaggagggcagag

SEQ ID NO: 1813515 - DNA, 24 bp, Homo sapiens
ggccagaaggagggcagagccatg

SEQ ID NO: 1813516 - DNA, 20 bp, Homo sapiens
ggccagagagggcccagctg

SEQ ID NO: 1813517 - DNA, 21 bp, Homo sapiens
ggccagagagggcccagctgt

SEQ ID NO: 1813518 - DNA, 23 bp, Homo sapiens
ggccagagagggcccagctgtag

SEQ ID NO: 1813519 - DNA, 15 bp, Homo sapiens
ggccagagctggaag

SEQ ID NO: 1813520 - DNA, 18 bp, Homo sapiens
ggccagagctggaaggca

SEQ ID NO: 1813521 - DNA, 20 bp, Homo sapiens
ggccagagctggaaggcagg

SEQ ID NO: 1813522 - DNA, 22 bp, Homo sapiens
ggccagagctggaaggcagggc

SEQ ID NO: 1813523 - DNA, 18 bp, Homo sapiens
ggccagcaccatctcttt

SEQ ID NO: 1813524 - DNA, 19 bp, Homo sapiens
ggccagccccacagcccac

SEQ ID NO: 1813525 - DNA, 19 bp, Homo sapiens
ggccagtggctggatctgt

SEQ ID NO: 1813526 - DNA, 16 bp, Homo sapiens
ggccatactggcctcg

SEQ ID NO: 1813527 - DNA, 22 bp, Homo sapiens
ggccatactggcctcgcctggc

SEQ ID NO: 1813528 - DNA, 23 bp, Homo sapiens
ggccatattttaaaaaatcaaaa

SEQ ID NO: 1813529 - DNA, 17 bp, Homo sapiens
ggccatcttccaggtgg

SEQ ID NO: 1813530 - DNA, 18 bp, Homo sapiens
ggccatcttccaggtggg

SEQ ID NO: 1813531 - DNA, 19 bp, Homo sapiens
ggccatcttccaggtgggg

SEQ ID NO: 1813532 - DNA, 22 bp, Homo sapiens
ggccatcttccaggtggggtga

SEQ ID NO: 1813533 - DNA, 11 bp, Homo sapiens
ggccatgctca

SEQ ID NO: 1813534 - DNA, 16 bp, Homo sapiens
ggccatgctcaacccc

SEQ ID NO: 1813535 - DNA, 22 bp, Homo sapiens
ggccatgctcaacccccctccc

SEQ ID NO: 1813536 - DNA, 16 bp, Homo sapiens
ggcccagctcccccgg

SEQ ID NO: 1813537 - DNA, 18 bp, Homo sapiens
ggcccagctgtagccatg

SEQ ID NO: 1813538 - DNA, 21 bp, Homo sapiens
ggcccagctgtagccatggct

SEQ ID NO: 1813539 - DNA, 13 bp, Homo sapiens
ggcccaggccatc

SEQ ID NO: 1813540 - DNA, 13 bp, Homo sapiens
ggcccatcccccc

SEQ ID NO: 1813541 - DNA, 16 bp, Homo sapiens
ggcccatcccccctca

SEQ ID NO: 1813542 - DNA, 21 bp, Homo sapiens
ggcccatctcaggtgccactc

SEQ ID NO: 1813543 - DNA, 20 bp, Homo sapiens
ggccccagatctgcctgggc

SEQ ID NO: 1813544 - DNA, 11 bp, Homo sapiens
ggccccagcct

SEQ ID NO: 1813545 - DNA, 12 bp, Homo sapiens
ggccccagcctg

SEQ ID NO: 1813546 - DNA, 16 bp, Homo sapiens
ggccccagcctggccc

SEQ ID NO: 1813547 - DNA, 23 bp, Homo sapiens
ggccccagcctggcccagctccc

SEQ ID NO: 1813548 - DNA, 12 bp, Homo sapiens
ggccccatgctc

SEQ ID NO: 1813549 - DNA, 16 bp, Homo sapiens
ggccccatgctctgcc

SEQ ID NO: 1813550 - DNA, 19 bp, Homo sapiens
ggccccatgctctgcccca

SEQ ID NO: 1813551 - DNA, 12 bp, Homo sapiens
ggcccccctcca

SEQ ID NO: 1813552 - DNA, 15 bp, Homo sapiens
ggcccccctccaggc

SEQ ID NO: 1813553 - DNA, 15 bp, Homo sapiens
ggcccctgaggactg

SEQ ID NO: 1813554 - DNA, 19 bp, Homo sapiens
ggcccctgaggactggaga

SEQ ID NO: 1813555 - DNA, 14 bp, Homo sapiens
ggcccgcttgcctc

SEQ ID NO: 1813556 - DNA, 21 bp, Homo sapiens
ggcccgcttgcctcggctcct

SEQ ID NO: 1813557 - DNA, 21 bp, Homo sapiens
ggcccgttgtctccctggccc

SEQ ID NO: 1813558 - DNA, 22 bp, Homo sapiens
ggcccgttgtctccctggccct

SEQ ID NO: 1813559 - DNA, 24 bp, Homo sapiens
ggcccgttgtctccctggccctca

SEQ ID NO: 1813560 - DNA, 16 bp, Homo sapiens
ggccctcaaggcctcc

SEQ ID NO: 1813561 - DNA, 19 bp, Homo sapiens
ggccctcaaggcctcccac

SEQ ID NO: 1813562 - DNA, 16 bp, Homo sapiens
ggccctccatgggcta

SEQ ID NO: 1813563 - DNA, 17 bp, Homo sapiens
ggccctccatgggctag

SEQ ID NO: 1813564 - DNA, 22 bp, Homo sapiens
ggccctccctgtctccagggcc

SEQ ID NO: 1813565 - DNA, 23 bp, Homo sapiens
ggccctccctgtctccagggccc

SEQ ID NO: 1813566 - DNA, 17 bp, Homo sapiens
ggccctgcactgtcctg

SEQ ID NO: 1813567 - DNA, 19 bp, Homo sapiens
ggccctgcactgtcctgct

SEQ ID NO: 1813568 - DNA, 23 bp, Homo sapiens
ggccctgcactgtcctgctccac

SEQ ID NO: 1813569 - DNA, 17 bp, Homo sapiens
ggcccttggggcctggc

SEQ ID NO: 1813570 - DNA, 20 bp, Homo sapiens
ggcccttgtcctgccagctg

SEQ ID NO: 1813571 - DNA, 17 bp, Homo sapiens
ggccggccaggtgggcg

SEQ ID NO: 1813572 - DNA, 22 bp, Homo sapiens
ggccgttccccttggcttcctc

SEQ ID NO: 1813573 - DNA, 15 bp, Homo sapiens
ggcctatcagtgtgc

SEQ ID NO: 1813574 - DNA, 23 bp, Homo sapiens
ggcctatcagtgtgccccccatc

SEQ ID NO: 1813575 - DNA, 19 bp, Homo sapiens
ggcctcagtttctccatca

SEQ ID NO: 1813576 - DNA, 20 bp, Homo sapiens
ggcctcagtttctccatcag

SEQ ID NO: 1813577 - DNA, 16 bp, Homo sapiens
ggcctccactccccca

SEQ ID NO: 1813578 - DNA, 14 bp, Homo sapiens
ggcctcccacagtg

SEQ ID NO: 1813579 - DNA, 16 bp, Homo sapiens
ggcctcgcctggcctg

SEQ ID NO: 1813580 - DNA, 17 bp, Homo sapiens
ggcctcgcctggcctga

SEQ ID NO: 1813581 - DNA, 18 bp, Homo sapiens
ggcctcgcctggcctgag

SEQ ID NO: 1813582 - DNA, 22 bp, Homo sapiens
ggcctgagctggggccacaaat

SEQ ID NO: 1813583 - DNA, 18 bp, Homo sapiens
ggcctgaggtctcgctga

SEQ ID NO: 1813584 - DNA, 13 bp, Homo sapiens
ggcctgatgctgc

SEQ ID NO: 1813585 - DNA, 16 bp, Homo sapiens
ggcctgcttttccagg

SEQ ID NO: 1813586 - DNA, 17 bp, Homo sapiens
ggcctgcttttccagga

SEQ ID NO: 1813587 - DNA, 19 bp, Homo sapiens
gtaggcccttgtcctgcca

SEQ ID NO: 1813588 - DNA, 21 bp, Homo sapiens
gtaggcccttgtcctgccagc

SEQ ID NO: 1813589 - DNA, 14 bp, Homo sapiens
gtaggttgggagaa

SEQ ID NO: 1813590 - DNA, 22 bp, Homo sapiens
gtagtaataaaaagtaacacac

SEQ ID NO: 1813591 - DNA, 13 bp, Homo sapiens
gtagtggaagagc

SEQ ID NO: 1813592 - DNA, 17 bp, Homo sapiens
gtagtggaagagcagcc

SEQ ID NO: 1813593 - DNA, 18 bp, Homo sapiens
gtagtggaagagcagcct

SEQ ID NO: 1813594 - DNA, 19 bp, Homo sapiens
gtagtggaagagcagcctg

SEQ ID NO: 1813595 - DNA, 21 bp, Homo sapiens
gtagtggaagagcagcctgat

SEQ ID NO: 1813596 - DNA, 21 bp, Homo sapiens
gtagtgtcttcctagtatatt

SEQ ID NO: 1813597 - DNA, 15 bp, Homo sapiens
gtataggataaatta

SEQ ID NO: 1813598 - DNA, 14 bp, Homo sapiens
gtatagtaatcatt

SEQ ID NO: 1813599 - DNA, 12 bp, Homo sapiens
gtatatatcagg

SEQ ID NO: 1813600 - DNA, 21 bp, Homo sapiens
gtatatattctacacatatat

SEQ ID NO: 1813601 - DNA, 17 bp, Homo sapiens
gtatatgtatatctata

SEQ ID NO: 1813602 - DNA, 15 bp, Homo sapiens
gtatattccctgtgg

SEQ ID NO: 1813603 - DNA, 23 bp, Homo sapiens
gtatctgatatctgtttgcttct

SEQ ID NO: 1813604 - DNA, 16 bp, Homo sapiens
gtatcttcaaaaatac

SEQ ID NO: 1813605 - DNA, 20 bp, Homo sapiens
gtatgaacttgaggacacat

SEQ ID NO: 1813606 - DNA, 22 bp, Homo sapiens
gtatgaacttgaggacacatgt

SEQ ID NO: 1813607 - DNA, 23 bp, Homo sapiens
gtatgaacttgaggacacatgtc

SEQ ID NO: 1813608 - DNA, 21 bp, Homo sapiens
gtatggctctcaagtgaaaga

SEQ ID NO: 1813609 - DNA, 17 bp, Homo sapiens
gtatgtggaagtgtggg

SEQ ID NO: 1813610 - DNA, 15 bp, Homo sapiens
gtattacaagagaaa

SEQ ID NO: 1813611 - DNA, 14 bp, Homo sapiens
gtattaccattact

SEQ ID NO: 1813612 - DNA, 21 bp, Homo sapiens
gtattatttctggctttttga

SEQ ID NO: 1813613 - DNA, 21 bp, Homo sapiens
gtattctcattggggttgcaa

SEQ ID NO: 1813614 - DNA, 21 bp, Homo sapiens
gtatttttcaggtaggccctt

SEQ ID NO: 1813615 - DNA, 13 bp, Homo sapiens
gtcaactggctgg

SEQ ID NO: 1813616 - DNA, 14 bp, Homo sapiens
gtcaactggctggc

SEQ ID NO: 1813617 - DNA, 22 bp, Homo sapiens
gtcaagaaaaatataaaaacaa

SEQ ID NO: 1813618 - DNA, 14 bp, Homo sapiens
gtcacagctgcagc

SEQ ID NO: 1813619 - DNA, 21 bp, Homo sapiens
gtcacagctgcagctgggccc

SEQ ID NO: 1813620 - DNA, 12 bp, Homo sapiens
gtcacctgcaag

SEQ ID NO: 1813621 - DNA, 14 bp, Homo sapiens
gtcactggctgcct

SEQ ID NO: 1813622 - DNA, 16 bp, Homo sapiens
gtcactggctgcctcc

SEQ ID NO: 1813623 - DNA, 13 bp, Homo sapiens
gtcacttccttca

SEQ ID NO: 1813624 - DNA, 17 bp, Homo sapiens
gtcagttcccggagcac

SEQ ID NO: 1813625 - DNA, 19 bp, Homo sapiens
gtcagttcccggagcacag

SEQ ID NO: 1813626 - DNA, 18 bp, Homo sapiens
gtcatcactccctggatg

SEQ ID NO: 1813627 - DNA, 19 bp, Homo sapiens
gtcatcactccctggatgt

SEQ ID NO: 1813628 - DNA, 15 bp, Homo sapiens
gtccacaggggcagg

SEQ ID NO: 1813629 - DNA, 18 bp, Homo sapiens
gtccacaggggcaggcct

SEQ ID NO: 1813630 - DNA, 21 bp, Homo sapiens
gtccacaggggcaggcctggg

SEQ ID NO: 1813631 - DNA, 12 bp, Homo sapiens
gtccacccaggc

SEQ ID NO: 1813632 - DNA, 13 bp, Homo sapiens
gtccacccaggct

SEQ ID NO: 1813633 - DNA, 17 bp, Homo sapiens
gtccactctcggggccc

SEQ ID NO: 1813634 - DNA, 21 bp, Homo sapiens
gtccactctcggggcccttgg

SEQ ID NO: 1813635 - DNA, 17 bp, Homo sapiens
gtccaggaaggcagctg

SEQ ID NO: 1813636 - DNA, 15 bp, Homo sapiens
gtccaggccactgtg

SEQ ID NO: 1813637 - DNA, 22 bp, Homo sapiens
gtccaggccactgtggccagag

SEQ ID NO: 1813638 - DNA, 23 bp, Homo sapiens
gtccaggccactgtggccagagc

SEQ ID NO: 1813639 - DNA, 11 bp, Homo sapiens
gtccataaagt

SEQ ID NO: 1813640 - DNA, 23 bp, Homo sapiens
gtccatctcattgcggcctgttg

SEQ ID NO: 1813641 - DNA, 14 bp, Homo sapiens
gtccatggcaccag

SEQ ID NO: 1813642 - DNA, 19 bp, Homo sapiens
gtccatggcaccagccccc

SEQ ID NO: 1813643 - DNA, 13 bp, Homo sapiens
gtcccaaggagct

SEQ ID NO: 1813644 - DNA, 16 bp, Homo sapiens
gtcccaaggagctgat

SEQ ID NO: 1813645 - DNA, 21 bp, Homo sapiens
gtcccagaggttatctgcctg

SEQ ID NO: 1813646 - DNA, 12 bp, Homo sapiens
gtccccagccct

SEQ ID NO: 1813647 - DNA, 13 bp, Homo sapiens
gtccccagccctt

SEQ ID NO: 1813648 - DNA, 14 bp, Homo sapiens
gtccccagcccttc

SEQ ID NO: 1813649 - DNA, 19 bp, Homo sapiens
gtccccagcccttctgcct

SEQ ID NO: 1813650 - DNA, 20 bp, Homo sapiens
gtccccagcccttctgcctt

SEQ ID NO: 1813651 - DNA, 21 bp, Homo sapiens
gtcccctctgtcatcactccc

SEQ ID NO: 1813652 - DNA, 23 bp, Homo sapiens
gtcccctcttgccccaaccccca

SEQ ID NO: 1813653 - DNA, 21 bp, Homo sapiens
gtcccgccttcctcctccaca

SEQ ID NO: 1813654 - DNA, 16 bp, Homo sapiens
gtccctggtccctcgt

SEQ ID NO: 1813655 - DNA, 22 bp, Homo sapiens
gtccctggtccctcgtccacag

SEQ ID NO: 1813656 - DNA, 24 bp, Homo sapiens
gtccctggtccctcgtccacaggg

SEQ ID NO: 1813657 - DNA, 23 bp, Homo sapiens
gtccgcaccagctgctctgcccc

SEQ ID NO: 1813658 - DNA, 13 bp, Homo sapiens
gtcctagcccagt

SEQ ID NO: 1813659 - DNA, 20 bp, Homo sapiens
gtcctagcccagtgcttctc

SEQ ID NO: 1813660 - DNA, 13 bp, Homo sapiens
gtcctcacagcct

SEQ ID NO: 1813661 - DNA, 18 bp, Homo sapiens
gtcctctccacctagtgg

SEQ ID NO: 1813662 - DNA, 16 bp, Homo sapiens
gtcctgacgccctgcg

SEQ ID NO: 1813663 - DNA, 21 bp, Homo sapiens
gtcctgacttcaggggctgcc

SEQ ID NO: 1813664 - DNA, 16 bp, Homo sapiens
gtcctgcagaggacca

SEQ ID NO: 1813665 - DNA, 14 bp, Homo sapiens
gtcctgccagctgc

SEQ ID NO: 1813666 - DNA, 17 bp, Homo sapiens
gtcctgccagctgcctt

SEQ ID NO: 1813667 - DNA, 22 bp, Homo sapiens
gtcctgccagctgccttcctca

SEQ ID NO: 1813668 - DNA, 13 bp, Homo sapiens
gtcctgtcagtgc

SEQ ID NO: 1813669 - DNA, 16 bp, Homo sapiens
gtcctgtcagtgccgc

SEQ ID NO: 1813670 - DNA, 11 bp, Homo sapiens
gtcctgtccca

SEQ ID NO: 1813671 - DNA, 14 bp, Homo sapiens
gtcctgtcccagag

SEQ ID NO: 1813672 - DNA, 22 bp, Homo sapiens
gtccttcagtgagcccctcccc

SEQ ID NO: 1813673 - DNA, 16 bp, Homo sapiens
gtcgaatttttattat

SEQ ID NO: 1813674 - DNA, 19 bp, Homo sapiens
gtcgcaggatccgctgcca

SEQ ID NO: 1813675 - DNA, 20 bp, Homo sapiens
gtcgcaggatccgctgccac

SEQ ID NO: 1813676 - DNA, 21 bp, Homo sapiens
gtcgcaggatccgctgccacc

SEQ ID NO: 1813677 - DNA, 22 bp, Homo sapiens
gtcgcaggatccgctgccacca

SEQ ID NO: 1813678 - DNA, 12 bp, Homo sapiens
gtcgcgctgcct

SEQ ID NO: 1813679 - DNA, 15 bp, Homo sapiens
gtcggctaagtggga

SEQ ID NO: 1813680 - DNA, 14 bp, Homo sapiens
gtctaaacaatgaa

SEQ ID NO: 1813681 - DNA, 20 bp, Homo sapiens
gtctactcattccccggggc

SEQ ID NO: 1813682 - DNA, 24 bp, Homo sapiens
gtctcagactctttttgtacctgg

SEQ ID NO: 1813683 - DNA, 20 bp, Homo sapiens
gtctcagtacacttcctgtg

SEQ ID NO: 1813684 - DNA, 19 bp, Homo sapiens
gtctccagggcccccaccg

SEQ ID NO: 1813685 - DNA, 15 bp, Homo sapiens
gtctccatgataact

SEQ ID NO: 1813686 - DNA, 18 bp, Homo sapiens
gtctccccatgtgcctgc

SEQ ID NO: 1813687 - DNA, 12 bp, Homo sapiens
gtctcctccacc

SEQ ID NO: 1813688 - DNA, 17 bp, Homo sapiens
gtctccttactctgagc

SEQ ID NO: 1813689 - DNA, 13 bp, Homo sapiens
gtctctcccaccc

SEQ ID NO: 1813690 - DNA, 14 bp, Homo sapiens
gtctctcccacccc

SEQ ID NO: 1813691 - DNA, 22 bp, Homo sapiens
gtctctcccaccccggcctcca

SEQ ID NO: 1813692 - DNA, 19 bp, Homo sapiens
gtctgaacccttgtgcttg

SEQ ID NO: 1813693 - DNA, 19 bp, Homo sapiens
gtctgaaggaatagccaga

SEQ ID NO: 1813694 - DNA, 21 bp, Homo sapiens
gtctgaaggaatagccagaga

SEQ ID NO: 1813695 - DNA, 23 bp, Homo sapiens
gtctgaaggaatagccagagagg

SEQ ID NO: 1813696 - DNA, 13 bp, Homo sapiens
gtctgactccaga

SEQ ID NO: 1813697 - DNA, 18 bp, Homo sapiens
gtctgactccagagtctg

SEQ ID NO: 1813698 - DNA, 23 bp, Homo sapiens
gtctgactccagagtctgagccc

SEQ ID NO: 1813699 - DNA, 22 bp, Homo sapiens
gtctgaggcctcatccctcgga

SEQ ID NO: 1813700 - DNA, 12 bp, Homo sapiens
gtctgccaggcc

SEQ ID NO: 1813701 - DNA, 13 bp, Homo sapiens
gtctgccaggccc

SEQ ID NO: 1813702 - DNA, 14 bp, Homo sapiens
gtctgccaggccca

SEQ ID NO: 1813703 - DNA, 15 bp, Homo sapiens
gtgggcagctgggcc

SEQ ID NO: 1813704 - DNA, 16 bp, Homo sapiens
gtgggcagctgggccc

SEQ ID NO: 1813705 - DNA, 23 bp, Homo sapiens
gtgggcccataatagttagccct

SEQ ID NO: 1813706 - DNA, 16 bp, Homo sapiens
gtgggcctggcctgag

SEQ ID NO: 1813707 - DNA, 21 bp, Homo sapiens
gtgggctttctccggggtctg

SEQ ID NO: 1813708 - DNA, 19 bp, Homo sapiens
gtgggggaagagcacagcc

SEQ ID NO: 1813709 - DNA, 22 bp, Homo sapiens
gtgggggaagagcacagccctc

SEQ ID NO: 1813710 - DNA, 18 bp, Homo sapiens
gtgggtccaggaaggcag

SEQ ID NO: 1813711 - DNA, 23 bp, Homo sapiens
gtgggtccaggaaggcagctgct

SEQ ID NO: 1813712 - DNA, 17 bp, Homo sapiens
gtgggtggcacctcctg

SEQ ID NO: 1813713 - DNA, 19 bp, Homo sapiens
gtggtctgctcgggcccag

SEQ ID NO: 1813714 - DNA, 17 bp, Homo sapiens
gtggtgcagccttcccc

SEQ ID NO: 1813715 - DNA, 19 bp, Homo sapiens
gtggtgcagccttcccctc

SEQ ID NO: 1813716 - DNA, 17 bp, Homo sapiens
gtgtaaacctaattgtg

SEQ ID NO: 1813717 - DNA, 16 bp, Homo sapiens
gtgtaaagaataaatg

SEQ ID NO: 1813718 - DNA, 19 bp, Homo sapiens
gtgtaagacttcagatttc

SEQ ID NO: 1813719 - DNA, 17 bp, Homo sapiens
gtgtacccccgcccagg

SEQ ID NO: 1813720 - DNA, 20 bp, Homo sapiens
gtgtagtggaagagcagcct

SEQ ID NO: 1813721 - DNA, 22 bp, Homo sapiens
gtgtagtggaagagcagcctga

SEQ ID NO: 1813722 - DNA, 13 bp, Homo sapiens
gtgtatgtggggg

SEQ ID NO: 1813723 - DNA, 15 bp, Homo sapiens
gtgtcactggctgcc

SEQ ID NO: 1813724 - DNA, 17 bp, Homo sapiens
gtgtcactggctgcctc

SEQ ID NO: 1813725 - DNA, 23 bp, Homo sapiens
gtgtcactggctgcctccactcc

SEQ ID NO: 1813726 - DNA, 15 bp, Homo sapiens
gtgtccagcagctgc

SEQ ID NO: 1813727 - DNA, 20 bp, Homo sapiens
gtgtctctcccaccccggcc

SEQ ID NO: 1813728 - DNA, 13 bp, Homo sapiens
gtgtctgggctga

SEQ ID NO: 1813729 - DNA, 12 bp, Homo sapiens
gtgtcttcctgt

SEQ ID NO: 1813730 - DNA, 13 bp, Homo sapiens
gtgtcttcctgtg

SEQ ID NO: 1813731 - DNA, 14 bp, Homo sapiens
gtgtgagtggcagc

SEQ ID NO: 1813732 - DNA, 17 bp, Homo sapiens
gtgtgccccccatcctg

SEQ ID NO: 1813733 - DNA, 18 bp, Homo sapiens
gtgtgccccccatcctgg

SEQ ID NO: 1813734 - DNA, 17 bp, Homo sapiens
gtgtgggagtgtgtaat

SEQ ID NO: 1813735 - DNA, 20 bp, Homo sapiens
gtgtgtcacccttaggccag

SEQ ID NO: 1813736 - DNA, 17 bp, Homo sapiens
gtgtgtgttgtgtgtgg

SEQ ID NO: 1813737 - DNA, 12 bp, Homo sapiens
gtgtgttgtgtg

SEQ ID NO: 1813738 - DNA, 21 bp, Homo sapiens
gtgttaggcctggcacagtgt

SEQ ID NO: 1813739 - DNA, 18 bp, Homo sapiens
gtgttgatttgagaaatt

SEQ ID NO: 1813740 - DNA, 15 bp, Homo sapiens
gttaaactgattagt

SEQ ID NO: 1813741 - DNA, 20 bp, Homo sapiens
gttaaaggaagtttgttcac

SEQ ID NO: 1813742 - DNA, 19 bp, Homo sapiens
gttaaatcattttcattaa

SEQ ID NO: 1813743 - DNA, 23 bp, Homo sapiens
gttacttgtctgaggcctcatcc

SEQ ID NO: 1813744 - DNA, 15 bp, Homo sapiens
gttagccctcagtca

SEQ ID NO: 1813745 - DNA, 17 bp, Homo sapiens
gttatacatcttcatta

SEQ ID NO: 1813746 - DNA, 19 bp, Homo sapiens
gttatacatcttcattaat

SEQ ID NO: 1813747 - DNA, 16 bp, Homo sapiens
gttatctgcctggcct

SEQ ID NO: 1813748 - DNA, 14 bp, Homo sapiens
gttattcaaatgaa

SEQ ID NO: 1813749 - DNA, 16 bp, Homo sapiens
gttattggaattttct

SEQ ID NO: 1813750 - DNA, 19 bp, Homo sapiens
gttccccacagtgacagtc

SEQ ID NO: 1813751 - DNA, 22 bp, Homo sapiens
gttccccacagtgacagtcact

SEQ ID NO: 1813752 - DNA, 13 bp, Homo sapiens
gttccccttggct

SEQ ID NO: 1813753 - DNA, 22 bp, Homo sapiens
gttcccggagcacagccctggg

SEQ ID NO: 1813754 - DNA, 11 bp, Homo sapiens
gttccctgcac

SEQ ID NO: 1813755 - DNA, 12 bp, Homo sapiens
gttccctgcacc

SEQ ID NO: 1813756 - DNA, 15 bp, Homo sapiens
gttcccttgaccatt

SEQ ID NO: 1813757 - DNA, 20 bp, Homo sapiens
gttcccttgaccattggctg

SEQ ID NO: 1813758 - DNA, 10 bp, Homo sapiens
gttcctgtgt

SEQ ID NO: 1813759 - DNA, 14 bp, Homo sapiens
gttccttccctggg

SEQ ID NO: 1813760 - DNA, 17 bp, Homo sapiens
gttccttccctgggaag

SEQ ID NO: 1813761 - DNA, 21 bp, Homo sapiens
gttctatcagtgacttctgaa

SEQ ID NO: 1813762 - DNA, 14 bp, Homo sapiens
gttctttgctgccc

SEQ ID NO: 1813763 - DNA, 22 bp, Homo sapiens
gttctttgctgcccctgtctgg

SEQ ID NO: 1813764 - DNA, 21 bp, Homo sapiens
gttgaaggcagtctgaaccct

SEQ ID NO: 1813765 - DNA, 17 bp, Homo sapiens
gttgaccactccagaga

SEQ ID NO: 1813766 - DNA, 22 bp, Homo sapiens
gttgacccaaaaatgttccctt

SEQ ID NO: 1813767 - DNA, 20 bp, Homo sapiens
gttggagccactcctgtccc

SEQ ID NO: 1813768 - DNA, 21 bp, Homo sapiens
gttggagccactcctgtcccg

SEQ ID NO: 1813769 - DNA, 18 bp, Homo sapiens
gttgggccatactggcct

SEQ ID NO: 1813770 - DNA, 17 bp, Homo sapiens
gttgtctccctggccct

SEQ ID NO: 1813771 - DNA, 22 bp, Homo sapiens
gttgtgtgtgggagtgtgtaat

SEQ ID NO: 1813772 - DNA, 14 bp, Homo sapiens
gtttaaaaaaagta

SEQ ID NO: 1813773 - DNA, 17 bp, Homo sapiens
gtttaaaaaaagtatat

SEQ ID NO: 1813774 - DNA, 22 bp, Homo sapiens
gtttaaaaaaagtatatattct

SEQ ID NO: 1813775 - DNA, 19 bp, Homo sapiens
gtttaaaagtccactttta

SEQ ID NO: 1813776 - DNA, 20 bp, Homo sapiens
gtttcacaacagatttctaa

SEQ ID NO: 1813777 - DNA, 21 bp, Homo sapiens
gtttcagaaattctcaaaata

SEQ ID NO: 1813778 - DNA, 22 bp, Homo sapiens
gtttccagctaagcctgatgat

SEQ ID NO: 1813779 - DNA, 17 bp, Homo sapiens
gtttcccggtgacacat

SEQ ID NO: 1813780 - DNA, 19 bp, Homo sapiens
gtttcctggtccatctcat

SEQ ID NO: 1813781 - DNA, 16 bp, Homo sapiens
gtttctagaggcctca

SEQ ID NO: 1813782 - DNA, 18 bp, Homo sapiens
gtttctagaggcctcagt

SEQ ID NO: 1813783 - DNA, 20 bp, Homo sapiens
gtttctagaggcctcagttt

SEQ ID NO: 1813784 - DNA, 17 bp, Homo sapiens
gtttctttcagatcatt

SEQ ID NO: 1813785 - DNA, 19 bp, Homo sapiens
gtttgcttctaaaggtttc

SEQ ID NO: 1813786 - DNA, 12 bp, Homo sapiens
taaaaaatcaaa

SEQ ID NO: 1813787 - DNA, 21 bp, Homo sapiens
taaaaagaggatgatttcaga

SEQ ID NO: 1813788 - DNA, 22 bp, Homo sapiens
taaaaagaggatgatttcagaa

SEQ ID NO: 1813789 - DNA, 21 bp, Homo sapiens
taaaaatgaaggaattacatt

SEQ ID NO: 1813790 - DNA, 11 bp, Homo sapiens
taaaagctaat

SEQ ID NO: 1813791 - DNA, 12 bp, Homo sapiens
taaaagctaatt

SEQ ID NO: 1813792 - DNA, 15 bp, Homo sapiens
taaaaggaaaaaaga

SEQ ID NO: 1813793 - DNA, 18 bp, Homo sapiens
taaaatagcacatgattt

SEQ ID NO: 1813794 - DNA, 20 bp, Homo sapiens
taaaataggattattttaaa

SEQ ID NO: 1813795 - DNA, 18 bp, Homo sapiens
taaaatcgtattctaatt

SEQ ID NO: 1813796 - DNA, 19 bp, Homo sapiens
taaaatctggcaaagttat

SEQ ID NO: 1813797 - DNA, 21 bp, Homo sapiens
taaaatctggcaaagttatat

SEQ ID NO: 1813798 - DNA, 19 bp, Homo sapiens
taaaatgcatatttctatg

SEQ ID NO: 1813799 - DNA, 17 bp, Homo sapiens
taaaattcttgggagtg

SEQ ID NO: 1813800 - DNA, 15 bp, Homo sapiens
taaaattgtgatgtg

SEQ ID NO: 1813801 - DNA, 20 bp, Homo sapiens
taaacaatgaattcttcaac

SEQ ID NO: 1813802 - DNA, 22 bp, Homo sapiens
taaacaatttctgcattcttaa

SEQ ID NO: 1813803 - DNA, 19 bp, Homo sapiens
taaacatttgtaaaaatac

SEQ ID NO: 1813804 - DNA, 14 bp, Homo sapiens
taaacctaattgtg

SEQ ID NO: 1813805 - DNA, 10 bp, Homo sapiens
taaactagtc

SEQ ID NO: 1813806 - DNA, 21 bp, Homo sapiens
taaagctgtgacagttctgtt

SEQ ID NO: 1813807 - DNA, 22 bp, Homo sapiens
taaaggtatttagaatatatta

SEQ ID NO: 1813808 - DNA, 16 bp, Homo sapiens
taaaggtgtaagactt

SEQ ID NO: 1813809 - DNA, 17 bp, Homo sapiens
taaataacacagatatt

SEQ ID NO: 1813810 - DNA, 20 bp, Homo sapiens
taaataacacagatattgtt

SEQ ID NO: 1813811 - DNA, 16 bp, Homo sapiens
taaatcattttcatta

SEQ ID NO: 1813812 - DNA, 17 bp, Homo sapiens
taaatcattttcattaa

SEQ ID NO: 1813813 - DNA, 17 bp, Homo sapiens
taaatgaatcttactcc

SEQ ID NO: 1813814 - DNA, 12 bp, Homo sapiens
taaattacatta

SEQ ID NO: 1813815 - DNA, 14 bp, Homo sapiens
taaattacattaaa

SEQ ID NO: 1813816 - DNA, 13 bp, Homo sapiens
taaatttacagaa

SEQ ID NO: 1813817 - DNA, 17 bp, Homo sapiens
taaatttacagaatatt

SEQ ID NO: 1813818 - DNA, 19 bp, Homo sapiens
taacaactgtgaatatgag

SEQ ID NO: 1813819 - DNA, 22 bp, Homo sapiens
tcagtgagcccctccccagcca

SEQ ID NO: 1813820 - DNA, 14 bp, Homo sapiens
tcagtgccgccgcc

SEQ ID NO: 1813821 - DNA, 20 bp, Homo sapiens
tcagtgccgccgcctcgccc

SEQ ID NO: 1813822 - DNA, 22 bp, Homo sapiens
tcagtgtacccccgcccaggct

SEQ ID NO: 1813823 - DNA, 23 bp, Homo sapiens
tcagtgtacccccgcccaggctg

SEQ ID NO: 1813824 - DNA, 19 bp, Homo sapiens
tcagtgtgccccccatcct

SEQ ID NO: 1813825 - DNA, 15 bp, Homo sapiens
tcagttctagttgat

SEQ ID NO: 1813826 - DNA, 13 bp, Homo sapiens
tcataaagtatgc

SEQ ID NO: 1813827 - DNA, 22 bp, Homo sapiens
tcataatttcagttctagttga

SEQ ID NO: 1813828 - DNA, 13 bp, Homo sapiens
tcatacattatat

SEQ ID NO: 1813829 - DNA, 14 bp, Homo sapiens
tcatacattatatt

SEQ ID NO: 1813830 - DNA, 22 bp, Homo sapiens
tcatcaatcaaatattttttga

SEQ ID NO: 1813831 - DNA, 20 bp, Homo sapiens
tcatcactccctggatgtgt

SEQ ID NO: 1813832 - DNA, 18 bp, Homo sapiens
tcatcccctcgtcctgtc

SEQ ID NO: 1813833 - DNA, 17 bp, Homo sapiens
tcatctcttcaatcact

SEQ ID NO: 1813834 - DNA, 18 bp, Homo sapiens
tcatctggggacctggtt

SEQ ID NO: 1813835 - DNA, 15 bp, Homo sapiens
tcatgcctggccccc

SEQ ID NO: 1813836 - DNA, 19 bp, Homo sapiens
tcattaaaaggaaaaaaga

SEQ ID NO: 1813837 - DNA, 14 bp, Homo sapiens
tcattaatactgtg

SEQ ID NO: 1813838 - DNA, 17 bp, Homo sapiens
tcattactaacttcttc

SEQ ID NO: 1813839 - DNA, 16 bp, Homo sapiens
tcattcactaagccat

SEQ ID NO: 1813840 - DNA, 16 bp, Homo sapiens
tcattcaggtgttctc

SEQ ID NO: 1813841 - DNA, 19 bp, Homo sapiens
tcattcaggtgttctcttc

SEQ ID NO: 1813842 - DNA, 15 bp, Homo sapiens
tcattcattcactgt

SEQ ID NO: 1813843 - DNA, 17 bp, Homo sapiens
tcattcattcactgtat

SEQ ID NO: 1813844 - DNA, 15 bp, Homo sapiens
tcattcgctttgtct

SEQ ID NO: 1813845 - DNA, 21 bp, Homo sapiens
tcattgaaatttactgtgaga

SEQ ID NO: 1813846 - DNA, 18 bp, Homo sapiens
tcattggggttgcaacaa

SEQ ID NO: 1813847 - DNA, 20 bp, Homo sapiens
tcattggggttgcaacaata

SEQ ID NO: 1813848 - DNA, 15 bp, Homo sapiens
tcattgttaaaaaac

SEQ ID NO: 1813849 - DNA, 22 bp, Homo sapiens
tcattgttaaaaaacaaccaaa

SEQ ID NO: 1813850 - DNA, 23 bp, Homo sapiens
tcattgttaaaaaacaaccaaac

SEQ ID NO: 1813851 - DNA, 16 bp, Homo sapiens
tccaaaggggctgctg

SEQ ID NO: 1813852 - DNA, 15 bp, Homo sapiens
tccaacaagttgcct

SEQ ID NO: 1813853 - DNA, 14 bp, Homo sapiens
tccaataactagtg

SEQ ID NO: 1813854 - DNA, 23 bp, Homo sapiens
tccacagggacacagtctggtgc

SEQ ID NO: 1813855 - DNA, 17 bp, Homo sapiens
tccacaggggcaggcct

SEQ ID NO: 1813856 - DNA, 13 bp, Homo sapiens
tccacagtgctgc

SEQ ID NO: 1813857 - DNA, 14 bp, Homo sapiens
tccacagtgctgct

SEQ ID NO: 1813858 - DNA, 12 bp, Homo sapiens
tccacataaagg

SEQ ID NO: 1813859 - DNA, 12 bp, Homo sapiens
tccacccaggct

SEQ ID NO: 1813860 - DNA, 13 bp, Homo sapiens
tccacccaggctg

SEQ ID NO: 1813861 - DNA, 16 bp, Homo sapiens
tccacccaggctgcac

SEQ ID NO: 1813862 - DNA, 17 bp, Homo sapiens
tccacccaggctgcact

SEQ ID NO: 1813863 - DNA, 21 bp, Homo sapiens
tccacccaggctgcactgcag

SEQ ID NO: 1813864 - DNA, 20 bp, Homo sapiens
tccacccagtgctgccatgc

SEQ ID NO: 1813865 - DNA, 13 bp, Homo sapiens
tccacccattccc

SEQ ID NO: 1813866 - DNA, 21 bp, Homo sapiens
tccacggtgcgtggctgtggc

SEQ ID NO: 1813867 - DNA, 13 bp, Homo sapiens
tccactcccactt

SEQ ID NO: 1813868 - DNA, 17 bp, Homo sapiens
tccactcccccacctga

SEQ ID NO: 1813869 - DNA, 23 bp, Homo sapiens
tccactctccttcgtgtctctcc

SEQ ID NO: 1813870 - DNA, 15 bp, Homo sapiens
tccactttttccaga

SEQ ID NO: 1813871 - DNA, 18 bp, Homo sapiens
tccagaatctgctgttgc

SEQ ID NO: 1813872 - DNA, 18 bp, Homo sapiens
tccagaatttgaatatta

SEQ ID NO: 1813873 - DNA, 13 bp, Homo sapiens
tccagagccagcc

SEQ ID NO: 1813874 - DNA, 14 bp, Homo sapiens
tccagagccagcct

SEQ ID NO: 1813875 - DNA, 15 bp, Homo sapiens
tccagagccagcctg

SEQ ID NO: 1813876 - DNA, 17 bp, Homo sapiens
tccagagccagcctggg

SEQ ID NO: 1813877 - DNA, 19 bp, Homo sapiens
tccagagccagcctgggac

SEQ ID NO: 1813878 - DNA, 15 bp, Homo sapiens
tccagagtctgagcc

SEQ ID NO: 1813879 - DNA, 12 bp, Homo sapiens
tccagcagctgc

SEQ ID NO: 1813880 - DNA, 17 bp, Homo sapiens
tccagcatccagcctgt

SEQ ID NO: 1813881 - DNA, 12 bp, Homo sapiens
tccagcctcccc

SEQ ID NO: 1813882 - DNA, 15 bp, Homo sapiens
tccagcctctcccgg

SEQ ID NO: 1813883 - DNA, 16 bp, Homo sapiens
tccagcctctcccggc

SEQ ID NO: 1813884 - DNA, 14 bp, Homo sapiens
tccagcctgtgtgt

SEQ ID NO: 1813885 - DNA, 22 bp, Homo sapiens
tccagctaagcctgatgatgga

SEQ ID NO: 1813886 - DNA, 17 bp, Homo sapiens
tccaggaaggcagctgc

SEQ ID NO: 1813887 - DNA, 14 bp, Homo sapiens
tccaggatcctgca

SEQ ID NO: 1813888 - DNA, 18 bp, Homo sapiens
tccaggatcctgcaggaa

SEQ ID NO: 1813889 - DNA, 16 bp, Homo sapiens
tccaggcatgctggcc

SEQ ID NO: 1813890 - DNA, 21 bp, Homo sapiens
tccaggccactgtggccagag

SEQ ID NO: 1813891 - DNA, 22 bp, Homo sapiens
tccaggccactgtggccagagc

SEQ ID NO: 1813892 - DNA, 18 bp, Homo sapiens
tccaggcccctgaggact

SEQ ID NO: 1813893 - DNA, 13 bp, Homo sapiens
tccagggccccca

SEQ ID NO: 1813894 - DNA, 15 bp, Homo sapiens
tccagggcccccacc

SEQ ID NO: 1813895 - DNA, 21 bp, Homo sapiens
tccagggtcttgggctactgg

SEQ ID NO: 1813896 - DNA, 15 bp, Homo sapiens
tccagttctgatgag

SEQ ID NO: 1813897 - DNA, 12 bp, Homo sapiens
tccataaagtaa

SEQ ID NO: 1813898 - DNA, 21 bp, Homo sapiens
tccataaagtaattttgtgaa

SEQ ID NO: 1813899 - DNA, 20 bp, Homo sapiens
tccatatggagcatttttca

SEQ ID NO: 1813900 - DNA, 17 bp, Homo sapiens
tccatcccctccctgcc

SEQ ID NO: 1813901 - DNA, 14 bp, Homo sapiens
tccatggcaccagc

SEQ ID NO: 1813902 - DNA, 17 bp, Homo sapiens
tccatggcaccagcccc

SEQ ID NO: 1813903 - DNA, 21 bp, Homo sapiens
tcccaaagaagttctggtatg

SEQ ID NO: 1813904 - DNA, 17 bp, Homo sapiens
tcccaacagagctgggc

SEQ ID NO: 1813905 - DNA, 20 bp, Homo sapiens
tcccaagtagtagtgtcttc

SEQ ID NO: 1813906 - DNA, 13 bp, Homo sapiens
tcccaataaagct

SEQ ID NO: 1813907 - DNA, 14 bp, Homo sapiens
tcccaataaagctg

SEQ ID NO: 1813908 - DNA, 18 bp, Homo sapiens
tcccactaagctttctcc

SEQ ID NO: 1813909 - DNA, 21 bp, Homo sapiens
tcccactgcaccccctcctgc

SEQ ID NO: 1813910 - DNA, 15 bp, Homo sapiens
tcccacttcccctcc

SEQ ID NO: 1813911 - DNA, 15 bp, Homo sapiens
tcccagacaggccct

SEQ ID NO: 1813912 - DNA, 15 bp, Homo sapiens
tcccaggagaccatt

SEQ ID NO: 1813913 - DNA, 15 bp, Homo sapiens
tcccagtgtcttcct

SEQ ID NO: 1813914 - DNA, 15 bp, Homo sapiens
tcccatggccttccc

SEQ ID NO: 1813915 - DNA, 20 bp, Homo sapiens
tcccatggtagactgtgaca

SEQ ID NO: 1813916 - DNA, 20 bp, Homo sapiens
tccccacagtcctcacagcc

SEQ ID NO: 1813917 - DNA, 22 bp, Homo sapiens
tccccagccagcccttccctgg

SEQ ID NO: 1813918 - DNA, 17 bp, Homo sapiens
tccccaggcctccagcc

SEQ ID NO: 1813919 - DNA, 18 bp, Homo sapiens
tccccaggcctccagcct

SEQ ID NO: 1813920 - DNA, 19 bp, Homo sapiens
tccccaggcctccagcctc

SEQ ID NO: 1813921 - DNA, 22 bp, Homo sapiens
tccccaggcctccagcctctcc

SEQ ID NO: 1813922 - DNA, 23 bp, Homo sapiens
tcccccaaacatctggcatggct

SEQ ID NO: 1813923 - DNA, 15 bp, Homo sapiens
tcccccatgtggctg

SEQ ID NO: 1813924 - DNA, 18 bp, Homo sapiens
tcccccccggggctgggt

SEQ ID NO: 1813925 - DNA, 12 bp, Homo sapiens
tcccccctcacc

SEQ ID NO: 1813926 - DNA, 19 bp, Homo sapiens
tcccccgacactgctgcac

SEQ ID NO: 1813927 - DNA, 21 bp, Homo sapiens
tcccccgacactgctgcacca

SEQ ID NO: 1813928 - DNA, 22 bp, Homo sapiens
tcccccgacactgctgcaccag

SEQ ID NO: 1813929 - DNA, 21 bp, Homo sapiens
tcccccgcagtccccagccct

SEQ ID NO: 1813930 - DNA, 22 bp, Homo sapiens
tcccccgggaggggcccgcttg

SEQ ID NO: 1813931 - DNA, 16 bp, Homo sapiens
tcccccggggcaaggt

SEQ ID NO: 1813932 - DNA, 15 bp, Homo sapiens
tcccccttagaatgt

SEQ ID NO: 1813933 - DNA, 19 bp, Homo sapiens
tcccctctcgccccatccc

SEQ ID NO: 1813934 - DNA, 23 bp, Homo sapiens
tcccctctcgccccatccctgct

SEQ ID NO: 1813935 - DNA, 21 bp, Homo sapiens
tgactagtgcctagaaagcaa

SEQ ID NO: 1813936 - DNA, 23 bp, Homo sapiens
tgactcagtgtctgcctttaaat

SEQ ID NO: 1813937 - DNA, 14 bp, Homo sapiens
tgactccagagtct

SEQ ID NO: 1813938 - DNA, 15 bp, Homo sapiens
tgactccagagtctg

SEQ ID NO: 1813939 - DNA, 20 bp, Homo sapiens
tgactccagagtctgagccc

SEQ ID NO: 1813940 - DNA, 16 bp, Homo sapiens
tgactcgggctcctgt

SEQ ID NO: 1813941 - DNA, 14 bp, Homo sapiens
tgactggcaggtgc

SEQ ID NO: 1813942 - DNA, 13 bp, Homo sapiens
tgacttcaggggc

SEQ ID NO: 1813943 - DNA, 17 bp, Homo sapiens
tgacttcaggggctgcc

SEQ ID NO: 1813944 - DNA, 12 bp, Homo sapiens
tgacttcaggtg

SEQ ID NO: 1813945 - DNA, 20 bp, Homo sapiens
tgacttcaggtggagagcac

SEQ ID NO: 1813946 - DNA, 14 bp, Homo sapiens
tgactttagaaaca

SEQ ID NO: 1813947 - DNA, 20 bp, Homo sapiens
tgagaacaagtcacagctgc

SEQ ID NO: 1813948 - DNA, 22 bp, Homo sapiens
tgagaacaagtcacagctgcag

SEQ ID NO: 1813949 - DNA, 18 bp, Homo sapiens
tgagaagtgtatatagtt

SEQ ID NO: 1813950 - DNA, 23 bp, Homo sapiens
tgagaattgcaaaactagacaaa

SEQ ID NO: 1813951 - DNA, 12 bp, Homo sapiens
tgagacaagccc

SEQ ID NO: 1813952 - DNA, 15 bp, Homo sapiens
tgagacaagccctgg

SEQ ID NO: 1813953 - DNA, 20 bp, Homo sapiens
tgagacaagccctggcaaca

SEQ ID NO: 1813954 - DNA, 19 bp, Homo sapiens
tgagagaaaaagtgcccct

SEQ ID NO: 1813955 - DNA, 16 bp, Homo sapiens
tgagagaaaagaaaaa

SEQ ID NO: 1813956 - DNA, 15 bp, Homo sapiens
tgagatttgccagca

SEQ ID NO: 1813957 - DNA, 20 bp, Homo sapiens
tgagcattcaggcagcactg

SEQ ID NO: 1813958 - DNA, 22 bp, Homo sapiens
tgagccactcgcagtcgcagga

SEQ ID NO: 1813959 - DNA, 13 bp, Homo sapiens
tgagcccaggccg

SEQ ID NO: 1813960 - DNA, 14 bp, Homo sapiens
tgagcccctcccca

SEQ ID NO: 1813961 - DNA, 15 bp, Homo sapiens
tgagcccctccccag

SEQ ID NO: 1813962 - DNA, 18 bp, Homo sapiens
tgagcccctccccagcca

SEQ ID NO: 1813963 - DNA, 12 bp, Homo sapiens
tgagctgggaag

SEQ ID NO: 1813964 - DNA, 21 bp, Homo sapiens
tgagcttagccttgtgccctg

SEQ ID NO: 1813965 - DNA, 23 bp, Homo sapiens
tgagcttagccttgtgccctgcc

SEQ ID NO: 1813966 - DNA, 21 bp, Homo sapiens
tgagctttggggacagttggc

SEQ ID NO: 1813967 - DNA, 12 bp, Homo sapiens
tgaggacacatg

SEQ ID NO: 1813968 - DNA, 15 bp, Homo sapiens
tgaggacacatgtcc

SEQ ID NO: 1813969 - DNA, 15 bp, Homo sapiens
tgaggccattatttc

SEQ ID NO: 1813970 - DNA, 16 bp, Homo sapiens
tgaggccattatttca

SEQ ID NO: 1813971 - DNA, 15 bp, Homo sapiens
tgaggccccaggccc

SEQ ID NO: 1813972 - DNA, 18 bp, Homo sapiens
tgaggcctcatccctcgg

SEQ ID NO: 1813973 - DNA, 18 bp, Homo sapiens
tgaggcttccaggctctt

SEQ ID NO: 1813974 - DNA, 22 bp, Homo sapiens
tgaggcttccaggctcttcctg

SEQ ID NO: 1813975 - DNA, 14 bp, Homo sapiens
tgaggtctcgctga

SEQ ID NO: 1813976 - DNA, 17 bp, Homo sapiens
tgaggtgaaatgggaga

SEQ ID NO: 1813977 - DNA, 19 bp, Homo sapiens
tgagtgacctcacttctgg

SEQ ID NO: 1813978 - DNA, 15 bp, Homo sapiens
tgagtggcagccatg

SEQ ID NO: 1813979 - DNA, 17 bp, Homo sapiens
tgagtgtgactttttga

SEQ ID NO: 1813980 - DNA, 19 bp, Homo sapiens
tgagtgtgccagagttatt

SEQ ID NO: 1813981 - DNA, 21 bp, Homo sapiens
tgagttacttgtctgaggcct

SEQ ID NO: 1813982 - DNA, 12 bp, Homo sapiens
tgagtttcagaa

SEQ ID NO: 1813983 - DNA, 21 bp, Homo sapiens
tgagtttcagaaattctcaaa

SEQ ID NO: 1813984 - DNA, 22 bp, Homo sapiens
tgagtttcagaaattctcaaaa

SEQ ID NO: 1813985 - DNA, 13 bp, Homo sapiens
tgagtttctttca

SEQ ID NO: 1813986 - DNA, 17 bp, Homo sapiens
tgataacaagcaaggat

SEQ ID NO: 1813987 - DNA, 14 bp, Homo sapiens
tgatactgatgcca

SEQ ID NO: 1813988 - DNA, 19 bp, Homo sapiens
tgatactgatgccatgtaa

SEQ ID NO: 1813989 - DNA, 18 bp, Homo sapiens
tgataggaaataaatgat

SEQ ID NO: 1813990 - DNA, 15 bp, Homo sapiens
tgatgccacaccaag

SEQ ID NO: 1813991 - DNA, 11 bp, Homo sapiens
tgatgctgccc

SEQ ID NO: 1813992 - DNA, 13 bp, Homo sapiens
tgatgctgccccg

SEQ ID NO: 1813993 - DNA, 22 bp, Homo sapiens
tgatgctgccccgttccctgtc

SEQ ID NO: 1813994 - DNA, 13 bp, Homo sapiens
tgatgctgttaac

SEQ ID NO: 1813995 - DNA, 18 bp, Homo sapiens
tgatggaccgggtgggcc

SEQ ID NO: 1813996 - DNA, 20 bp, Homo sapiens
tgatggaccgggtgggcctg

SEQ ID NO: 1813997 - DNA, 22 bp, Homo sapiens
tgatggaccgggtgggcctggc

SEQ ID NO: 1813998 - DNA, 15 bp, Homo sapiens
tgatggccaagagca

SEQ ID NO: 1813999 - DNA, 14 bp, Homo sapiens
tgatggccaagggg

SEQ ID NO: 1814000 - DNA, 20 bp, Homo sapiens
tgatggtcaggatctcatga

SEQ ID NO: 1814001 - DNA, 17 bp, Homo sapiens
tgattgcgagaattttc

SEQ ID NO: 1814002 - DNA, 18 bp, Homo sapiens
tgattgcgagaattttca

SEQ ID NO: 1814003 - DNA, 14 bp, Homo sapiens
tgattgttttagaa

SEQ ID NO: 1814004 - DNA, 11 bp, Homo sapiens
tgatttcagaa

SEQ ID NO: 1814005 - DNA, 17 bp, Homo sapiens
tgatttcccgtggcccc

SEQ ID NO: 1814006 - DNA, 18 bp, Homo sapiens
tgatttcccgtggcccca

SEQ ID NO: 1814007 - DNA, 20 bp, Homo sapiens
tgatttcccgtggccccagc

SEQ ID NO: 1814008 - DNA, 23 bp, Homo sapiens
tgatttcccgtggccccagcctg

SEQ ID NO: 1814009 - DNA, 18 bp, Homo sapiens
tgcaacaaaaatgtgggt

SEQ ID NO: 1814010 - DNA, 19 bp, Homo sapiens
tgcaacaatgcaaaagcca

SEQ ID NO: 1814011 - DNA, 20 bp, Homo sapiens
tgcaacaatgcaaaagccaa

SEQ ID NO: 1814012 - DNA, 13 bp, Homo sapiens
tgcaactagccaa

SEQ ID NO: 1814013 - DNA, 16 bp, Homo sapiens
tgcaactagccaaggc

SEQ ID NO: 1814014 - DNA, 14 bp, Homo sapiens
tgcaagccccaggg

SEQ ID NO: 1814015 - DNA, 16 bp, Homo sapiens
tgcaatctccagggct

SEQ ID NO: 1814016 - DNA, 16 bp, Homo sapiens
tgcaatgaaaacaaaa

SEQ ID NO: 1814017 - DNA, 20 bp, Homo sapiens
tgcaattcaatgcaatgaaa

SEQ ID NO: 1814018 - DNA, 14 bp, Homo sapiens
tgcacacacagctc

SEQ ID NO: 1814019 - DNA, 16 bp, Homo sapiens
tgcacacacagctcct

SEQ ID NO: 1814020 - DNA, 20 bp, Homo sapiens
tgcacagtttagaacagagg

SEQ ID NO: 1814021 - DNA, 15 bp, Homo sapiens
tgcacatcattcatt

SEQ ID NO: 1814022 - DNA, 16 bp, Homo sapiens
tgcaccaacccagccg

SEQ ID NO: 1814023 - DNA, 23 bp, Homo sapiens
tgcaccaacccagccgctgcccg

SEQ ID NO: 1814024 - DNA, 13 bp, Homo sapiens
tgcaccaggagac

SEQ ID NO: 1814025 - DNA, 16 bp, Homo sapiens
tgcacccactcaccag

SEQ ID NO: 1814026 - DNA, 18 bp, Homo sapiens
tgcacccactcaccaggg

SEQ ID NO: 1814027 - DNA, 16 bp, Homo sapiens
tgcacccatgccatag

SEQ ID NO: 1814028 - DNA, 14 bp, Homo sapiens
tgcaccccctcctg

SEQ ID NO: 1814029 - DNA, 16 bp, Homo sapiens
tgcaccccctcctgct

SEQ ID NO: 1814030 - DNA, 19 bp, Homo sapiens
tgcaccccctcctgctgca

SEQ ID NO: 1814031 - DNA, 12 bp, Homo sapiens
tgcaccctggaa

SEQ ID NO: 1814032 - DNA, 17 bp, Homo sapiens
tgcacctcctaccctcc

SEQ ID NO: 1814033 - DNA, 19 bp, Homo sapiens
tgcacctcctaccctccca

SEQ ID NO: 1814034 - DNA, 16 bp, Homo sapiens
tgcactctgtgcccat

SEQ ID NO: 1814035 - DNA, 15 bp, Homo sapiens
tgcactggccccacc

SEQ ID NO: 1814036 - DNA, 12 bp, Homo sapiens
tgcactgtcctg

SEQ ID NO: 1814037 - DNA, 20 bp, Homo sapiens
tgcagagaaagaaagggaaa

SEQ ID NO: 1814038 - DNA, 19 bp, Homo sapiens
tgcagagccttttacccct

SEQ ID NO: 1814039 - DNA, 18 bp, Homo sapiens
tgcagaggggcaggccct

SEQ ID NO: 1814040 - DNA, 22 bp, Homo sapiens
tgcagaggggcaggccctgcac

SEQ ID NO: 1814041 - DNA, 14 bp, Homo sapiens
tgcagattcctggg

SEQ ID NO: 1814042 - DNA, 15 bp, Homo sapiens
tgcagattcctgggc

SEQ ID NO: 1814043 - DNA, 18 bp, Homo sapiens
tgcagattcctgggcctg

SEQ ID NO: 1814044 - DNA, 21 bp, Homo sapiens
tgcagattcctgggcctgtcc

SEQ ID NO: 1814045 - DNA, 22 bp, Homo sapiens
tgcagattcctgggcctgtccc

SEQ ID NO: 1814046 - DNA, 23 bp, Homo sapiens
tgcagattcctgggcctgtcccc

SEQ ID NO: 1814047 - DNA, 11 bp, Homo sapiens
tgcagcagccc

SEQ ID NO: 1814048 - DNA, 16 bp, Homo sapiens
tgcagcagcccagctt

SEQ ID NO: 1814049 - DNA, 20 bp, Homo sapiens
tgcagcagcccagcttcctg

SEQ ID NO: 1814050 - DNA, 17 bp, Homo sapiens
tgcagccttcccctccc

SEQ ID NO: 1814051 - DNA, 18 bp, Homo sapiens
tgcagctgggccccatgc

SEQ ID NO: 1814052 - DNA, 21 bp, Homo sapiens
tggggcctggcttgctccagg

SEQ ID NO: 1814053 - DNA, 15 bp, Homo sapiens
tggggctaaatgaag

SEQ ID NO: 1814054 - DNA, 20 bp, Homo sapiens
tggggctcgtggccttcccc

SEQ ID NO: 1814055 - DNA, 22 bp, Homo sapiens
tgggggaagagcacagccctcc

SEQ ID NO: 1814056 - DNA, 23 bp, Homo sapiens
tgggggaagagcacagccctccc

SEQ ID NO: 1814057 - DNA, 20 bp, Homo sapiens
tgggtccaggaaggcagctg

SEQ ID NO: 1814058 - DNA, 22 bp, Homo sapiens
tgggtccaggaaggcagctgct

SEQ ID NO: 1814059 - DNA, 23 bp, Homo sapiens
tgggtccaggaaggcagctgctc

SEQ ID NO: 1814060 - DNA, 17 bp, Homo sapiens
tgggtcccacttcccct

SEQ ID NO: 1814061 - DNA, 19 bp, Homo sapiens
tgggtcccacttcccctcc

SEQ ID NO: 1814062 - DNA, 19 bp, Homo sapiens
tgggtcctgcaatctccag

SEQ ID NO: 1814063 - DNA, 21 bp, Homo sapiens
tgggtcctgcaatctccaggg

SEQ ID NO: 1814064 - DNA, 13 bp, Homo sapiens
tgggtctgtgtgt

SEQ ID NO: 1814065 - DNA, 15 bp, Homo sapiens
tgggtctgtgtgtgt

SEQ ID NO: 1814066 - DNA, 19 bp, Homo sapiens
tgggtgcgaccccatctgc

SEQ ID NO: 1814067 - DNA, 21 bp, Homo sapiens
tgggtgcgaccccatctgccc

SEQ ID NO: 1814068 - DNA, 22 bp, Homo sapiens
tgggtgcgaccccatctgccca

SEQ ID NO: 1814069 - DNA, 14 bp, Homo sapiens
tgggtggcccatcc

SEQ ID NO: 1814070 - DNA, 16 bp, Homo sapiens
tgggtgttgaccactc

SEQ ID NO: 1814071 - DNA, 23 bp, Homo sapiens
tggtaaaaagattatatatcata

SEQ ID NO: 1814072 - DNA, 21 bp, Homo sapiens
tggtaaacattcctccagcct

SEQ ID NO: 1814073 - DNA, 13 bp, Homo sapiens
tggtaagcagagg

SEQ ID NO: 1814074 - DNA, 17 bp, Homo sapiens
tggtacactgcatctca

SEQ ID NO: 1814075 - DNA, 13 bp, Homo sapiens
tggtaggaactgc

SEQ ID NO: 1814076 - DNA, 13 bp, Homo sapiens
tggtccctcgtcc

SEQ ID NO: 1814077 - DNA, 14 bp, Homo sapiens
tggtccctcgtcca

SEQ ID NO: 1814078 - DNA, 11 bp, Homo sapiens
tggtccctggt

SEQ ID NO: 1814079 - DNA, 21 bp, Homo sapiens
tggtctgctcgggcccaggcc

SEQ ID NO: 1814080 - DNA, 23 bp, Homo sapiens
tggtgccacttcttaaaggcctg

SEQ ID NO: 1814081 - DNA, 22 bp, Homo sapiens
tggtgcccagactcaaggcctc

SEQ ID NO: 1814082 - DNA, 10 bp, Homo sapiens
tggtgcctga

SEQ ID NO: 1814083 - DNA, 14 bp, Homo sapiens
tggtggctcatggc

SEQ ID NO: 1814084 - DNA, 12 bp, Homo sapiens
tggtggtgcagc

SEQ ID NO: 1814085 - DNA, 21 bp, Homo sapiens
tggtgtatttttcaggtaggc

SEQ ID NO: 1814086 - DNA, 18 bp, Homo sapiens
tggtgtcgcgccttctcc

SEQ ID NO: 1814087 - DNA, 16 bp, Homo sapiens
tggtgtgtcatgctca

SEQ ID NO: 1814088 - DNA, 14 bp, Homo sapiens
tggttccttccctg

SEQ ID NO: 1814089 - DNA, 16 bp, Homo sapiens
tggttccttccctggg

SEQ ID NO: 1814090 - DNA, 23 bp, Homo sapiens
tggttgacccaaaaatgttccct

SEQ ID NO: 1814091 - DNA, 22 bp, Homo sapiens
tggtttcccggtgacacatcca

SEQ ID NO: 1814092 - DNA, 17 bp, Homo sapiens
tgtaactgctgagccac

SEQ ID NO: 1814093 - DNA, 19 bp, Homo sapiens
tgtaactgctgagccactc

SEQ ID NO: 1814094 - DNA, 20 bp, Homo sapiens
tgtaagacttcagatttcaa

SEQ ID NO: 1814095 - DNA, 21 bp, Homo sapiens
tgtaagacttcagatttcaaa

SEQ ID NO: 1814096 - DNA, 16 bp, Homo sapiens
tgtaagcaacttgctt

SEQ ID NO: 1814097 - DNA, 19 bp, Homo sapiens
tgtaagcaacttgcttcta

SEQ ID NO: 1814098 - DNA, 17 bp, Homo sapiens
tgtaatactgtagaaat

SEQ ID NO: 1814099 - DNA, 17 bp, Homo sapiens
tgtaatggaactgaccc

SEQ ID NO: 1814100 - DNA, 12 bp, Homo sapiens
tgtaattattgt

SEQ ID NO: 1814101 - DNA, 17 bp, Homo sapiens
tgtaatttaaaattgtg

SEQ ID NO: 1814102 - DNA, 21 bp, Homo sapiens
tgtaatttaaaattgtgatgt

SEQ ID NO: 1814103 - DNA, 18 bp, Homo sapiens
tgtacaaagatatgctaa

SEQ ID NO: 1814104 - DNA, 12 bp, Homo sapiens
tgtacattatgt

SEQ ID NO: 1814105 - DNA, 14 bp, Homo sapiens
tgtacccagctcct

SEQ ID NO: 1814106 - DNA, 14 bp, Homo sapiens
tgtacccccgccca

SEQ ID NO: 1814107 - DNA, 22 bp, Homo sapiens
tgtacccccgcccaggctggcc

SEQ ID NO: 1814108 - DNA, 18 bp, Homo sapiens
tgtacctggtgacccctt

SEQ ID NO: 1814109 - DNA, 15 bp, Homo sapiens
tgtactaaggagcat

SEQ ID NO: 1814110 - DNA, 18 bp, Homo sapiens
tgtagaaatattgctcta

SEQ ID NO: 1814111 - DNA, 15 bp, Homo sapiens
tgtagaataaatgaa

SEQ ID NO: 1814112 - DNA, 17 bp, Homo sapiens
tgtagaataaatgaaga

SEQ ID NO: 1814113 - DNA, 17 bp, Homo sapiens
tgtagccatggctcagg

SEQ ID NO: 1814114 - DNA, 18 bp, Homo sapiens
tgtagccatggctcaggc

SEQ ID NO: 1814115 - DNA, 13 bp, Homo sapiens
tgtaggttgctta

SEQ ID NO: 1814116 - DNA, 15 bp, Homo sapiens
tgtagtggaagagca

SEQ ID NO: 1814117 - DNA, 14 bp, Homo sapiens
tgtatagtaatcat

SEQ ID NO: 1814118 - DNA, 13 bp, Homo sapiens
tgtatatagtttg

SEQ ID NO: 1814119 - DNA, 22 bp, Homo sapiens
tgtatccatccatggggctgat

SEQ ID NO: 1814120 - DNA, 21 bp, Homo sapiens
tgtatgtgggggtctgtgtgt

SEQ ID NO: 1814121 - DNA, 22 bp, Homo sapiens
tgtatgtgggggtctgtgtgtt

SEQ ID NO: 1814122 - DNA, 13 bp, Homo sapiens
tgtatttcattat

SEQ ID NO: 1814123 - DNA, 14 bp, Homo sapiens
tgtatttcattatc

SEQ ID NO: 1814124 - DNA, 15 bp, Homo sapiens
tgtattttgacaaaa

SEQ ID NO: 1814125 - DNA, 19 bp, Homo sapiens
tgtcactggctgcctccac

SEQ ID NO: 1814126 - DNA, 12 bp, Homo sapiens
tgtcagaggcta

SEQ ID NO: 1814127 - DNA, 18 bp, Homo sapiens
tgtcagtatgtggaagtg

SEQ ID NO: 1814128 - DNA, 13 bp, Homo sapiens
tgtcagtgccgcc

SEQ ID NO: 1814129 - DNA, 23 bp, Homo sapiens
tgtcagtgccgccgcctcgccca

SEQ ID NO: 1814130 - DNA, 15 bp, Homo sapiens
tgtcatcactccctg

SEQ ID NO: 1814131 - DNA, 17 bp, Homo sapiens
tgtcatcactccctgga

SEQ ID NO: 1814132 - DNA, 14 bp, Homo sapiens
tgtcatctgaggag

SEQ ID NO: 1814133 - DNA, 22 bp, Homo sapiens
tgtcatgctcacttttgtgaaa

SEQ ID NO: 1814134 - DNA, 14 bp, Homo sapiens
tgtcatttttaaaa

SEQ ID NO: 1814135 - DNA, 12 bp, Homo sapiens
tgtccagcagct

SEQ ID NO: 1814136 - DNA, 15 bp, Homo sapiens
tgtccagcagctgcg

SEQ ID NO: 1814137 - DNA, 14 bp, Homo sapiens
tgtccaggccactg

SEQ ID NO: 1814138 - DNA, 20 bp, Homo sapiens
tgtccaggccactgtggcca

SEQ ID NO: 1814139 - DNA, 16 bp, Homo sapiens
tgtccagtgcccattc

SEQ ID NO: 1814140 - DNA, 16 bp, Homo sapiens
tgtcccaaggagctga

SEQ ID NO: 1814141 - DNA, 22 bp, Homo sapiens
tgtcccagaggttatctgcctg

SEQ ID NO: 1814142 - DNA, 23 bp, Homo sapiens
tgtcccagaggttatctgcctgg

SEQ ID NO: 1814143 - DNA, 24 bp, Homo sapiens
tgtcccagaggttatctgcctggc

SEQ ID NO: 1814144 - DNA, 15 bp, Homo sapiens
tgtccccagggcccc

SEQ ID NO: 1814145 - DNA, 13 bp, Homo sapiens
tgtcccccaaggt

SEQ ID NO: 1814146 - DNA, 17 bp, Homo sapiens
tgtcccctcttgcccca

SEQ ID NO: 1814147 - DNA, 17 bp, Homo sapiens
tgtcctctttactccct

SEQ ID NO: 1814148 - DNA, 22 bp, Homo sapiens
tgtcctgacttcaggggctgcc

SEQ ID NO: 1814149 - DNA, 15 bp, Homo sapiens
tgtcctgctccacag

SEQ ID NO: 1814150 - DNA, 18 bp, Homo sapiens
tgtcctgctccacagtgt

SEQ ID NO: 1814151 - DNA, 23 bp, Homo sapiens
tgtcctgttattttttatttcca

SEQ ID NO: 1814152 - DNA, 19 bp, Homo sapiens
tgtccttcagagctcttca

SEQ ID NO: 1814153 - DNA, 20 bp, Homo sapiens
tgtcgcgccttctccccccc

SEQ ID NO: 1814154 - DNA, 14 bp, Homo sapiens
tgtctattctgagc

SEQ ID NO: 1814155 - DNA, 15 bp, Homo sapiens
tgtctattctgagcc

SEQ ID NO: 1814156 - DNA, 16 bp, Homo sapiens
tgtctccctggccctc

SEQ ID NO: 1814157 - DNA, 15 bp, Homo sapiens
tgtctctcccacccc

SEQ ID NO: 1814158 - DNA, 13 bp, Homo sapiens
tgtctgaggcctc

SEQ ID NO: 1814159 - DNA, 15 bp, Homo sapiens
tgtctgcctttaaat

SEQ ID NO: 1814160 - DNA, 13 bp, Homo sapiens
tgtctgctaacat

SEQ ID NO: 1814161 - DNA, 20 bp, Homo sapiens
tgtctggaagacgtggctct

SEQ ID NO: 1814162 - DNA, 11 bp, Homo sapiens
tgtctgggctg

SEQ ID NO: 1814163 - DNA, 15 bp, Homo sapiens
tgtctgtctgtctgt

SEQ ID NO: 1814164 - DNA, 16 bp, Homo sapiens
tgtctgtctgtctgtc

SEQ ID NO: 1814165 - DNA, 19 bp, Homo sapiens
tgtcttataggtttccact

SEQ ID NO: 1814166 - DNA, 20 bp, Homo sapiens
tgtcttcctagtatattagt

SEQ ID NO: 1814167 - DNA, 15 bp, Homo sapiens
tgtcttgagagaaaa

SEQ ID NO: 1814168 - DNA, 17 bp, Homo sapiens
tgtcttgagagaaaaga

SEQ ID NO: 1814169 - DNA, 22 bp, Homo sapiens
ttctggtatgaacttgaggaca

SEQ ID NO: 1814170 - DNA, 22 bp, Homo sapiens
ttctggtggcagtaacatgcaa

SEQ ID NO: 1814171 - DNA, 20 bp, Homo sapiens
ttctgtatgtgacaacattt

SEQ ID NO: 1814172 - DNA, 19 bp, Homo sapiens
ttctgttggtctacagaaa

SEQ ID NO: 1814173 - DNA, 23 bp, Homo sapiens
ttcttcgctgctctagctggcag

SEQ ID NO: 1814174 - DNA, 14 bp, Homo sapiens
ttctttgctgcccc

SEQ ID NO: 1814175 - DNA, 15 bp, Homo sapiens
ttgaagaaaacacaa

SEQ ID NO: 1814176 - DNA, 22 bp, Homo sapiens
ttgaagcaccatggtgtgtcat

SEQ ID NO: 1814177 - DNA, 18 bp, Homo sapiens
ttgaaggagaaaatgcat

SEQ ID NO: 1814178 - DNA, 14 bp, Homo sapiens
ttgaaggcagtctg

SEQ ID NO: 1814179 - DNA, 18 bp, Homo sapiens
ttgaattttcccactgca

SEQ ID NO: 1814180 - DNA, 18 bp, Homo sapiens
ttgacagaatggtgccat

SEQ ID NO: 1814181 - DNA, 22 bp, Homo sapiens
ttgacagagttggtgttcataa

SEQ ID NO: 1814182 - DNA, 22 bp, Homo sapiens
ttgactaaagccatttgtctgt

SEQ ID NO: 1814183 - DNA, 16 bp, Homo sapiens
ttgagacaagccctgg

SEQ ID NO: 1814184 - DNA, 20 bp, Homo sapiens
ttgagacaagccctggcaac

SEQ ID NO: 1814185 - DNA, 15 bp, Homo sapiens
ttgagagaaaagaaa

SEQ ID NO: 1814186 - DNA, 15 bp, Homo sapiens
ttgaggacacatgtc

SEQ ID NO: 1814187 - DNA, 18 bp, Homo sapiens
ttgatcaaaatcaaaagg

SEQ ID NO: 1814188 - DNA, 14 bp, Homo sapiens
ttgatgatgcagtt

SEQ ID NO: 1814189 - DNA, 15 bp, Homo sapiens
ttgattgcgagaatt

SEQ ID NO: 1814190 - DNA, 14 bp, Homo sapiens
ttgcaacaatgcaa

SEQ ID NO: 1814191 - DNA, 15 bp, Homo sapiens
ttgcacatcattcat

SEQ ID NO: 1814192 - DNA, 16 bp, Homo sapiens
ttgcactggaatatct

SEQ ID NO: 1814193 - DNA, 13 bp, Homo sapiens
ttgcaggctctgg

SEQ ID NO: 1814194 - DNA, 17 bp, Homo sapiens
ttgcaggctgagtccct

SEQ ID NO: 1814195 - DNA, 22 bp, Homo sapiens
ttgcatcccccttagaatgttt

SEQ ID NO: 1814196 - DNA, 13 bp, Homo sapiens
ttgccagcacagg

SEQ ID NO: 1814197 - DNA, 17 bp, Homo sapiens
ttgccatagccccatat

SEQ ID NO: 1814198 - DNA, 15 bp, Homo sapiens
ttgccccaaccccca

SEQ ID NO: 1814199 - DNA, 13 bp, Homo sapiens
ttgcccccatccc

SEQ ID NO: 1814200 - DNA, 14 bp, Homo sapiens
ttgcccgctcccac

SEQ ID NO: 1814201 - DNA, 22 bp, Homo sapiens
ttgcccgctcccacagcttcct

SEQ ID NO: 1814202 - DNA, 22 bp, Homo sapiens
ttgcctcggctcctgctgcacc

SEQ ID NO: 1814203 - DNA, 11 bp, Homo sapiens
ttgcctggctg

SEQ ID NO: 1814204 - DNA, 12 bp, Homo sapiens
ttgcctggctgt

SEQ ID NO: 1814205 - DNA, 15 bp, Homo sapiens
ttgcctggctgtgga

SEQ ID NO: 1814206 - DNA, 19 bp, Homo sapiens
ttgcctggctgtggaggcc

SEQ ID NO: 1814207 - DNA, 22 bp, Homo sapiens
ttgcctggctgtggaggcctga

SEQ ID NO: 1814208 - DNA, 15 bp, Homo sapiens
ttgcgagaattttca

SEQ ID NO: 1814209 - DNA, 23 bp, Homo sapiens
ttgcggcctgttgggcagagctg

SEQ ID NO: 1814210 - DNA, 15 bp, Homo sapiens
ttgcgtcctgcagag

SEQ ID NO: 1814211 - DNA, 14 bp, Homo sapiens
ttgctctaattctt

SEQ ID NO: 1814212 - DNA, 19 bp, Homo sapiens
ttgcttctaaatgcccagt

SEQ ID NO: 1814213 - DNA, 22 bp, Homo sapiens
ttggaattttctttcatacatt

SEQ ID NO: 1814214 - DNA, 20 bp, Homo sapiens
ttggacttcctggggccccg

SEQ ID NO: 1814215 - DNA, 14 bp, Homo sapiens
ttggagcccgtgca

SEQ ID NO: 1814216 - DNA, 22 bp, Homo sapiens
ttggagctgttccattgggtcc

SEQ ID NO: 1814217 - DNA, 21 bp, Homo sapiens
ttggcacccccatgctgcctt

SEQ ID NO: 1814218 - DNA, 13 bp, Homo sapiens
ttggcagagaagg

SEQ ID NO: 1814219 - DNA, 14 bp, Homo sapiens
ttggcagagaaggc

SEQ ID NO: 1814220 - DNA, 21 bp, Homo sapiens
ttggcagcaggtgctgctacc

SEQ ID NO: 1814221 - DNA, 17 bp, Homo sapiens
ttggcgcaccctcccct

SEQ ID NO: 1814222 - DNA, 12 bp, Homo sapiens
ttggctttgcag

SEQ ID NO: 1814223 - DNA, 17 bp, Homo sapiens
ttgggacacctcagaaa

SEQ ID NO: 1814224 - DNA, 16 bp, Homo sapiens
ttgggccatactggcc

SEQ ID NO: 1814225 - DNA, 16 bp, Homo sapiens
ttgggctcctggctgc

SEQ ID NO: 1814226 - DNA, 19 bp, Homo sapiens
ttgggctcctggctgccag

SEQ ID NO: 1814227 - DNA, 16 bp, Homo sapiens
ttgggctgacacctac

SEQ ID NO: 1814228 - DNA, 18 bp, Homo sapiens
ttgggctttgcaggctct

SEQ ID NO: 1814229 - DNA, 19 bp, Homo sapiens
ttgggctttgcaggctctg

SEQ ID NO: 1814230 - DNA, 16 bp, Homo sapiens
ttggggcctggcttgc

SEQ ID NO: 1814231 - DNA, 15 bp, Homo sapiens
ttggggttgcaacaa

SEQ ID NO: 1814232 - DNA, 22 bp, Homo sapiens
ttgggtcctgcaatctccaggg

SEQ ID NO: 1814233 - DNA, 12 bp, Homo sapiens
ttggtccctggt

SEQ ID NO: 1814234 - DNA, 19 bp, Homo sapiens
ttgtaaaaatactgtttca

SEQ ID NO: 1814235 - DNA, 19 bp, Homo sapiens
ttgtaaatttatgtgatgg

SEQ ID NO: 1814236 - DNA, 13 bp, Homo sapiens
ttgtaatataatg

SEQ ID NO: 1814237 - DNA, 12 bp, Homo sapiens
ttgtaattattg

SEQ ID NO: 1814238 - DNA, 15 bp, Homo sapiens
ttgtacaaagatatg

SEQ ID NO: 1814239 - DNA, 11 bp, Homo sapiens
ttgtacattat

SEQ ID NO: 1814240 - DNA, 19 bp, Homo sapiens
ttgtactcttgctttttca

SEQ ID NO: 1814241 - DNA, 20 bp, Homo sapiens
ttgtattttgacaaaaatgt

SEQ ID NO: 1814242 - DNA, 13 bp, Homo sapiens
ttgtccccagggc

SEQ ID NO: 1814243 - DNA, 14 bp, Homo sapiens
ttgtccccagggcc

SEQ ID NO: 1814244 - DNA, 15 bp, Homo sapiens
ttgtccccagggccc

SEQ ID NO: 1814245 - DNA, 13 bp, Homo sapiens
ttgtcctgccagc

SEQ ID NO: 1814246 - DNA, 14 bp, Homo sapiens
ttgtcctgccagct

SEQ ID NO: 1814247 - DNA, 15 bp, Homo sapiens
ttgtcctgccagctg

SEQ ID NO: 1814248 - DNA, 16 bp, Homo sapiens
ttgtcctgccagctgc

SEQ ID NO: 1814249 - DNA, 19 bp, Homo sapiens
ttgtcctgccagctgcctt

SEQ ID NO: 1814250 - DNA, 21 bp, Homo sapiens
ttgtcctgccagctgccttcc

SEQ ID NO: 1814251 - DNA, 14 bp, Homo sapiens
ttgtctccctggcc

SEQ ID NO: 1814252 - DNA, 16 bp, Homo sapiens
ttgtctccctggccct

SEQ ID NO: 1814253 - DNA, 19 bp, Homo sapiens
ttgtctccctggccctcaa

SEQ ID NO: 1814254 - DNA, 14 bp, Homo sapiens
ttgtctgaggcctc

SEQ ID NO: 1814255 - DNA, 21 bp, Homo sapiens
ttgtctgaggcctcatccctc

SEQ ID NO: 1814256 - DNA, 13 bp, Homo sapiens
ttgtgaaagaagg

SEQ ID NO: 1814257 - DNA, 21 bp, Homo sapiens
ttgtgactattaaatgttgca

SEQ ID NO: 1814258 - DNA, 12 bp, Homo sapiens
ttgtgatgtgtc

SEQ ID NO: 1814259 - DNA, 12 bp, Homo sapiens
ttgttataaata

SEQ ID NO: 1814260 - DNA, 18 bp, Homo sapiens
ttgttcctgtgtattctc

SEQ ID NO: 1814261 - DNA, 15 bp, Homo sapiens
ttgtttagaagaagt

SEQ ID NO: 1814262 - DNA, 18 bp, Homo sapiens
ttgtttagaagaagtgtg

SEQ ID NO: 1814263 - DNA, 14 bp, Homo sapiens
ttgttttccactgt

SEQ ID NO: 1814264 - DNA, 14 bp, Homo sapiens
ttgttttcttcatt

SEQ ID NO: 1814265 - DNA, 22 bp, Homo sapiens
tttaaaaaaagtatatattcta

SEQ ID NO: 1814266 - DNA, 12 bp, Homo sapiens
tttaaaaaatca

SEQ ID NO: 1814267 - DNA, 16 bp, Homo sapiens
tttaaaatagtaattt

SEQ ID NO: 1814268 - DNA, 22 bp, Homo sapiens
tttaaatataagtaatgaaggc

SEQ ID NO: 1814269 - DNA, 19 bp, Homo sapiens
tttaacaaaaaaggaaaat

SEQ ID NO: 1814270 - DNA, 16 bp, Homo sapiens
tttaattgcatttaaa

SEQ ID NO: 1814271 - DNA, 16 bp, Homo sapiens
tttacaactaaataac

SEQ ID NO: 1814272 - DNA, 15 bp, Homo sapiens
tttacagtatcttca

SEQ ID NO: 1814273 - DNA, 16 bp, Homo sapiens
tttacattttcctgtg

SEQ ID NO: 1814274 - DNA, 13 bp, Homo sapiens
tttactaaaagaa

SEQ ID NO: 1814275 - DNA, 14 bp, Homo sapiens
tttactgacagaaa

SEQ ID NO: 1814276 - DNA, 14 bp, Homo sapiens
tttagaactactga

SEQ ID NO: 1814277 - DNA, 19 bp, Homo sapiens
tttagaagaagtgtgtcac

SEQ ID NO: 1814278 - DNA, 19 bp, Homo sapiens
tttagaatcaagtctgtga

SEQ ID NO: 1814279 - DNA, 18 bp, Homo sapiens
tttaggtatgctattatc

SEQ ID NO: 1814280 - DNA, 15 bp, Homo sapiens
tttagtaccttcaaa

SEQ ID NO: 1814281 - DNA, 21 bp, Homo sapiens
tttcaaattaatctttctata

SEQ ID NO: 1814282 - DNA, 24 bp, Homo sapiens
tttcaaattaatctttctatattt

SEQ ID NO: 1814283 - DNA, 19 bp, Homo sapiens
tttcacaacagatttctaa

SEQ ID NO: 1814284 - DNA, 23 bp, Homo sapiens
tttcagaattgaaggagaaaatg

SEQ ID NO: 1814285 - DNA, 21 bp, Homo sapiens
tttcagctattagcaactgtg

SEQ ID NO: 1814286 - DNA, 18 bp, Homo sapiens
aaaatagtaattttttac

SEQ ID NO: 1814287 - DNA, 23 bp, Homo sapiens
aaaatcaaaaggcactgtgaact

SEQ ID NO: 1814288 - DNA, 20 bp, Homo sapiens
aaaatcgtattctaattctt

SEQ ID NO: 1814289 - DNA, 17 bp, Homo sapiens
aaaatgaacaggttctt

SEQ ID NO: 1814290 - DNA, 22 bp, Homo sapiens
aaaatgagactatgcgttttta

SEQ ID NO: 1814291 - DNA, 18 bp, Homo sapiens
aaaatggaaaagagagat

SEQ ID NO: 1814292 - DNA, 14 bp, Homo sapiens
aaaatggtgcctga

SEQ ID NO: 1814293 - DNA, 18 bp, Homo sapiens
aaaatgttcccttgacca

SEQ ID NO: 1814294 - DNA, 15 bp, Homo sapiens
aaaatgtttgtactt

SEQ ID NO: 1814295 - DNA, 19 bp, Homo sapiens
aaaattttgtatgtcaata

SEQ ID NO: 1814296 - DNA, 14 bp, Homo sapiens
aaacacaacttgtg

SEQ ID NO: 1814297 - DNA, 12 bp, Homo sapiens
aaacaccattca

SEQ ID NO: 1814298 - DNA, 21 bp, Homo sapiens
aaacagctagcttgaaaactt

SEQ ID NO: 1814299 - DNA, 19 bp, Homo sapiens
aaacattcctccagcctcc

SEQ ID NO: 1814300 - DNA, 20 bp, Homo sapiens
aaacattcctccagcctccc

SEQ ID NO: 1814301 - DNA, 18 bp, Homo sapiens
aaacatttgtaaaaatac

SEQ ID NO: 1814302 - DNA, 13 bp, Homo sapiens
aaaccagcaggtg

SEQ ID NO: 1814303 - DNA, 11 bp, Homo sapiens
aaaccccagcc

SEQ ID NO: 1814304 - DNA, 17 bp, Homo sapiens
aaacctcacactactgt

SEQ ID NO: 1814305 - DNA, 21 bp, Homo sapiens
aatatttttcaaaatcaaagt

SEQ ID NO: 1814306 - DNA, 13 bp, Homo sapiens
aatattttttgag

SEQ ID NO: 1814307 - DNA, 19 bp, Homo sapiens
aatcaaaaggcactgtgaa

SEQ ID NO: 1814308 - DNA, 13 bp, Homo sapiens
aatcaaagcaagg

SEQ ID NO: 1814309 - DNA, 17 bp, Homo sapiens
aatcaaagttatggttt

SEQ ID NO: 1814310 - DNA, 15 bp, Homo sapiens
aatcaagcaaaattt

SEQ ID NO: 1814311 - DNA, 16 bp, Homo sapiens
aatccccccttcagaa

SEQ ID NO: 1814312 - DNA, 23 bp, Homo sapiens
aatccccccttcagaacagaggc

SEQ ID NO: 1814313 - DNA, 15 bp, Homo sapiens
aatctactagaacct

SEQ ID NO: 1814314 - DNA, 17 bp, Homo sapiens
aatctagaaaatgaaaa

SEQ ID NO: 1814315 - DNA, 21 bp, Homo sapiens
aatctccagggctgcccctgt

SEQ ID NO: 1814316 - DNA, 15 bp, Homo sapiens
aatgaaaacaaaatt

SEQ ID NO: 1814317 - DNA, 20 bp, Homo sapiens
aatgaaaacaaaattccatt

SEQ ID NO: 1814318 - DNA, 23 bp, Homo sapiens
aatgaaaagatggagttgtattt

SEQ ID NO: 1814319 - DNA, 14 bp, Homo sapiens
aatgaactttaaaa

SEQ ID NO: 1814320 - DNA, 13 bp, Homo sapiens
aatgaattcttca

SEQ ID NO: 1814321 - DNA, 17 bp, Homo sapiens
aatgatattcatattca

SEQ ID NO: 1814322 - DNA, 16 bp, Homo sapiens
aatgcaatgaaaacaa

SEQ ID NO: 1814323 - DNA, 17 bp, Homo sapiens
aatgcaatgaaaacaaa

SEQ ID NO: 1814324 - DNA, 17 bp, Homo sapiens
aatgcaattcaatgcaa

SEQ ID NO: 1814325 - DNA, 16 bp, Homo sapiens
aatgcacaagctcaga

SEQ ID NO: 1814326 - DNA, 16 bp, Homo sapiens
aatgcagattcctggg

SEQ ID NO: 1814327 - DNA, 19 bp, Homo sapiens
aatgcagattcctgggcct

SEQ ID NO: 1814328 - DNA, 20 bp, Homo sapiens
aatgcagattcctgggcctg

SEQ ID NO: 1814329 - DNA, 19 bp, Homo sapiens
aatgccacacattgtgctt

SEQ ID NO: 1814330 - DNA, 15 bp, Homo sapiens
aatgcccagcacaat

SEQ ID NO: 1814331 - DNA, 20 bp, Homo sapiens
aatgctttgggaggccaagg

SEQ ID NO: 1814332 - DNA, 21 bp, Homo sapiens
aatggacatatgggtttgaac

SEQ ID NO: 1814333 - DNA, 13 bp, Homo sapiens
aatggcagctaga

SEQ ID NO: 1814334 - DNA, 13 bp, Homo sapiens
aatgggcctgccc

SEQ ID NO: 1814335 - DNA, 13 bp, Homo sapiens
aatgtaaaaatga

SEQ ID NO: 1814336 - DNA, 17 bp, Homo sapiens
aatgtaaaaatgaagga

SEQ ID NO: 1814337 - DNA, 14 bp, Homo sapiens
aatgtaatactgta

SEQ ID NO: 1814338 - DNA, 14 bp, Homo sapiens
aatgtacctatgtg

SEQ ID NO: 1814339 - DNA, 23 bp, Homo sapiens
aatgtagtggagagatcatagct

SEQ ID NO: 1814340 - DNA, 13 bp, Homo sapiens
aatgtcagtatgt

SEQ ID NO: 1814341 - DNA, 19 bp, Homo sapiens
aatgttgcacatcattcat

SEQ ID NO: 1814342 - DNA, 22 bp, Homo sapiens
aatgtttgtactttttaatgtt

SEQ ID NO: 1814343 - DNA, 16 bp, Homo sapiens
aattaatctagaaaat

SEQ ID NO: 1814344 - DNA, 18 bp, Homo sapiens
aattaatctagaaaatga

SEQ ID NO: 1814345 - DNA, 19 bp, Homo sapiens
aattacattttatatgtga

SEQ ID NO: 1814346 - DNA, 18 bp, Homo sapiens
aattcaacctgtgtctta

SEQ ID NO: 1814347 - DNA, 12 bp, Homo sapiens
aattcagcaccc

SEQ ID NO: 1814348 - DNA, 15 bp, Homo sapiens
aattcagcaccctgg

SEQ ID NO: 1814349 - DNA, 18 bp, Homo sapiens
aattcagcaccctgggtg

SEQ ID NO: 1814350 - DNA, 20 bp, Homo sapiens
aattcattgttaaaaaacaa

SEQ ID NO: 1814351 - DNA, 21 bp, Homo sapiens
aattcattgttaaaaaacaac

SEQ ID NO: 1814352 - DNA, 13 bp, Homo sapiens
aattctgagggaa

SEQ ID NO: 1814353 - DNA, 17 bp, Homo sapiens
aattctgagggaattta

SEQ ID NO: 1814354 - DNA, 21 bp, Homo sapiens
aattctgcaactagccaaggc

SEQ ID NO: 1814355 - DNA, 15 bp, Homo sapiens
aattctgggaaggga

SEQ ID NO: 1814356 - DNA, 18 bp, Homo sapiens
aattctttgacctgttgg

SEQ ID NO: 1814357 - DNA, 12 bp, Homo sapiens
aattgcaacaat

SEQ ID NO: 1814358 - DNA, 15 bp, Homo sapiens
aattgcaacaatgca

SEQ ID NO: 1814359 - DNA, 19 bp, Homo sapiens
aattggctttgcagatatt

SEQ ID NO: 1814360 - DNA, 18 bp, Homo sapiens
aattgtggtagaaatttt

SEQ ID NO: 1814361 - DNA, 14 bp, Homo sapiens
aatttatgtgatgg

SEQ ID NO: 1814362 - DNA, 12 bp, Homo sapiens
aatttattttgt

SEQ ID NO: 1814363 - DNA, 17 bp, Homo sapiens
aatttcagttctagttg

SEQ ID NO: 1814364 - DNA, 23 bp, Homo sapiens
aatttgtaagcaacttgcttcta

SEQ ID NO: 1814365 - DNA, 13 bp, Homo sapiens
aattttaagttct

SEQ ID NO: 1814366 - DNA, 21 bp, Homo sapiens
aattttactgacagaaatgca

SEQ ID NO: 1814367 - DNA, 13 bp, Homo sapiens
aattttattgctg

SEQ ID NO: 1814368 - DNA, 10 bp, Homo sapiens
acaaaaatgt

SEQ ID NO: 1814369 - DNA, 22 bp, Homo sapiens
acaaagaaatccccccttcaga

SEQ ID NO: 1814370 - DNA, 14 bp, Homo sapiens
acaaataaactagt

SEQ ID NO: 1814371 - DNA, 15 bp, Homo sapiens
acaaatacttccata

SEQ ID NO: 1814372 - DNA, 22 bp, Homo sapiens
acaaatgtgtgggtttttaaaa

SEQ ID NO: 1814373 - DNA, 21 bp, Homo sapiens
acaacatttttgtacattatg

SEQ ID NO: 1814374 - DNA, 23 bp, Homo sapiens
acaacatttttgtacattatgtt

SEQ ID NO: 1814375 - DNA, 13 bp, Homo sapiens
acaactgtgaata

SEQ ID NO: 1814376 - DNA, 20 bp, Homo sapiens
acaagaattacactaatagt

SEQ ID NO: 1814377 - DNA, 22 bp, Homo sapiens
acaagcaaggatatcagagctg

SEQ ID NO: 1814378 - DNA, 13 bp, Homo sapiens
acaagccctggca

SEQ ID NO: 1814379 - DNA, 20 bp, Homo sapiens
acaataattcatcaagtaat

SEQ ID NO: 1814380 - DNA, 23 bp, Homo sapiens
acaataattcatcaagtaatcat

SEQ ID NO: 1814381 - DNA, 12 bp, Homo sapiens
acaatctatagt

SEQ ID NO: 1814382 - DNA, 17 bp, Homo sapiens
acacaagaattacacta

SEQ ID NO: 1814383 - DNA, 16 bp, Homo sapiens
acacaagtgtattatt

SEQ ID NO: 1814384 - DNA, 21 bp, Homo sapiens
acacaagtgtattatttctgg

SEQ ID NO: 1814385 - DNA, 13 bp, Homo sapiens
acacacagctcct

SEQ ID NO: 1814386 - DNA, 13 bp, Homo sapiens
acacactcagcag

SEQ ID NO: 1814387 - DNA, 14 bp, Homo sapiens
acacagtctggtgc

SEQ ID NO: 1814388 - DNA, 16 bp, Homo sapiens
acacatatatgtatat

SEQ ID NO: 1814389 - DNA, 17 bp, Homo sapiens
acacatcccggcctctt

SEQ ID NO: 1814390 - DNA, 13 bp, Homo sapiens
acaccactgccct

SEQ ID NO: 1814391 - DNA, 16 bp, Homo sapiens
acaccactgccctgcc

SEQ ID NO: 1814392 - DNA, 17 bp, Homo sapiens
acaccactgccctgcct

SEQ ID NO: 1814393 - DNA, 18 bp, Homo sapiens
acaccactgccctgcctg

SEQ ID NO: 1814394 - DNA, 21 bp, Homo sapiens
acaccactgccctgcctgccc

SEQ ID NO: 1814395 - DNA, 21 bp, Homo sapiens
acaccagagtgtagaataata

SEQ ID NO: 1814396 - DNA, 22 bp, Homo sapiens
acacgcaagggcatcaggcact

SEQ ID NO: 1814397 - DNA, 24 bp, Homo sapiens
acacgcaagggcatcaggcactgg

SEQ ID NO: 1814398 - DNA, 18 bp, Homo sapiens
acactactgtatttcatt

SEQ ID NO: 1814399 - DNA, 19 bp, Homo sapiens
acactactgtatttcatta

SEQ ID NO: 1814400 - DNA, 17 bp, Homo sapiens
acactcaccgagaggaa

SEQ ID NO: 1814401 - DNA, 14 bp, Homo sapiens
acactcagcagccc

SEQ ID NO: 1814402 - DNA, 15 bp, Homo sapiens
acactgctgcaccag

SEQ ID NO: 1814403 - DNA, 18 bp, Homo sapiens
acacttcctgtgccatgt

SEQ ID NO: 1814404 - DNA, 13 bp, Homo sapiens
acacttggagccc

SEQ ID NO: 1814405 - DNA, 15 bp, Homo sapiens
acacttggagcccgt

SEQ ID NO: 1814406 - DNA, 19 bp, Homo sapiens
acactttgccaaggctctc

SEQ ID NO: 1814407 - DNA, 14 bp, Homo sapiens
acagaaaagaaagc

SEQ ID NO: 1814408 - DNA, 17 bp, Homo sapiens
acagaatggtgccatgc

SEQ ID NO: 1814409 - DNA, 21 bp, Homo sapiens
acagacagagaaggcagcagg

SEQ ID NO: 1814410 - DNA, 18 bp, Homo sapiens
acagacttctggaaggct

SEQ ID NO: 1814411 - DNA, 19 bp, Homo sapiens
acagacttctggaaggctg

SEQ ID NO: 1814412 - DNA, 20 bp, Homo sapiens
acagacttctggaaggctgg

SEQ ID NO: 1814413 - DNA, 16 bp, Homo sapiens
acagagaaggcagcag

SEQ ID NO: 1814414 - DNA, 19 bp, Homo sapiens
acagatattgttataaata

SEQ ID NO: 1814415 - DNA, 12 bp, Homo sapiens
acagatttctaa

SEQ ID NO: 1814416 - DNA, 23 bp, Homo sapiens
acagcaaggaggctggctggggc

SEQ ID NO: 1814417 - DNA, 16 bp, Homo sapiens
acagcaaggcacctgc

SEQ ID NO: 1814418 - DNA, 18 bp, Homo sapiens
acagcaaggcacctgcag

SEQ ID NO: 1814419 - DNA, 20 bp, Homo sapiens
acagcccacgtcctgtcagt

SEQ ID NO: 1814420 - DNA, 14 bp, Homo sapiens
acagccctcccgcc

SEQ ID NO: 1814421 - DNA, 15 bp, Homo sapiens
acagccctcccgccc

SEQ ID NO: 1814422 - DNA, 12 bp, Homo sapiens
acagctgcagct

SEQ ID NO: 1814423 - DNA, 17 bp, Homo sapiens
acaggccctccctgtct

SEQ ID NO: 1814424 - DNA, 18 bp, Homo sapiens
aagagaagggcagggctg

SEQ ID NO: 1814425 - DNA, 12 bp, Homo sapiens
aagagcacagcc

SEQ ID NO: 1814426 - DNA, 15 bp, Homo sapiens
aagagcacagccctc

SEQ ID NO: 1814427 - DNA, 19 bp, Homo sapiens
aagagcacagccctcccgc

SEQ ID NO: 1814428 - DNA, 14 bp, Homo sapiens
aagagcagcctgat

SEQ ID NO: 1814429 - DNA, 20 bp, Homo sapiens
aagagcagcctgatggccaa

SEQ ID NO: 1814430 - DNA, 23 bp, Homo sapiens
aagagcagcctgatggccaaggg

SEQ ID NO: 1814431 - DNA, 16 bp, Homo sapiens
aagaggagaccctgga

SEQ ID NO: 1814432 - DNA, 21 bp, Homo sapiens
aagaggatgatttcagaagga

SEQ ID NO: 1814433 - DNA, 15 bp, Homo sapiens
aagagtgaaaaatga

SEQ ID NO: 1814434 - DNA, 22 bp, Homo sapiens
aagatatatatttactaaaaga

SEQ ID NO: 1814435 - DNA, 23 bp, Homo sapiens
aagatatatatttactaaaagaa

SEQ ID NO: 1814436 - DNA, 19 bp, Homo sapiens
aagatgagatttgccagca

SEQ ID NO: 1814437 - DNA, 23 bp, Homo sapiens
aagattatatatcataaagtatg

SEQ ID NO: 1814438 - DNA, 15 bp, Homo sapiens
aagcaaaagaagtaa

SEQ ID NO: 1814439 - DNA, 17 bp, Homo sapiens
aagcaaagccacatttt

SEQ ID NO: 1814440 - DNA, 18 bp, Homo sapiens
aagcaacttgcttctaaa

SEQ ID NO: 1814441 - DNA, 16 bp, Homo sapiens
aagcaattgccctgta

SEQ ID NO: 1814442 - DNA, 18 bp, Homo sapiens
aagcagcagctaggactg

SEQ ID NO: 1814443 - DNA, 17 bp, Homo sapiens
aagcagccagccagtct

SEQ ID NO: 1814444 - DNA, 22 bp, Homo sapiens
aagcagccagccagtcttgcct

SEQ ID NO: 1814445 - DNA, 20 bp, Homo sapiens
aagcagggaaagctccacgg

SEQ ID NO: 1814446 - DNA, 17 bp, Homo sapiens
aagcagtgcctcgaggc

SEQ ID NO: 1814447 - DNA, 21 bp, Homo sapiens
aagcagtgcctcgaggcaccg

SEQ ID NO: 1814448 - DNA, 14 bp, Homo sapiens
aagccccagggcct

SEQ ID NO: 1814449 - DNA, 15 bp, Homo sapiens
aagccccagggcctg

SEQ ID NO: 1814450 - DNA, 19 bp, Homo sapiens
aagcccctcagcccttgcc

SEQ ID NO: 1814451 - DNA, 14 bp, Homo sapiens
aagccgtctgactc

SEQ ID NO: 1814452 - DNA, 19 bp, Homo sapiens
aagccgtctgactccagag

SEQ ID NO: 1814453 - DNA, 20 bp, Homo sapiens
aagccgtctgactccagagt

SEQ ID NO: 1814454 - DNA, 17 bp, Homo sapiens
aagctaaaatgaaaaat

SEQ ID NO: 1814455 - DNA, 12 bp, Homo sapiens
aagctagaaaca

SEQ ID NO: 1814456 - DNA, 17 bp, Homo sapiens
aagctggacaagaagct

SEQ ID NO: 1814457 - DNA, 18 bp, Homo sapiens
aagctggacaagaagctg

SEQ ID NO: 1814458 - DNA, 19 bp, Homo sapiens
aagctgtactcagagcaga

SEQ ID NO: 1814459 - DNA, 12 bp, Homo sapiens
aagctgtcccct

SEQ ID NO: 1814460 - DNA, 22 bp, Homo sapiens
aagctgtttttgtgctctttgt

SEQ ID NO: 1814461 - DNA, 14 bp, Homo sapiens
aagctttctccttt

SEQ ID NO: 1814462 - DNA, 16 bp, Homo sapiens
aaggaaaaaagaaaaa

SEQ ID NO: 1814463 - DNA, 17 bp, Homo sapiens
aaggaaaaaagaaaaaa

SEQ ID NO: 1814464 - DNA, 18 bp, Homo sapiens
aaggaatagccagagagg

SEQ ID NO: 1814465 - DNA, 20 bp, Homo sapiens
aaggagaaaatgcattatgt

SEQ ID NO: 1814466 - DNA, 18 bp, Homo sapiens
aaggagaaggaaaaagaa

SEQ ID NO: 1814467 - DNA, 24 bp, Homo sapiens
aaggagctgatttccaggcccctg

SEQ ID NO: 1814468 - DNA, 18 bp, Homo sapiens
aaggaggctggctggggc

SEQ ID NO: 1814469 - DNA, 16 bp, Homo sapiens
aaggatatcagagctg

SEQ ID NO: 1814470 - DNA, 22 bp, Homo sapiens
aaggcagcctccagagccagcc

SEQ ID NO: 1814471 - DNA, 23 bp, Homo sapiens
aaggcagcctccagagccagcct

SEQ ID NO: 1814472 - DNA, 12 bp, Homo sapiens
aaggcagctgct

SEQ ID NO: 1814473 - DNA, 14 bp, Homo sapiens
aaggcagctgctct

SEQ ID NO: 1814474 - DNA, 12 bp, Homo sapiens
aaggcagggcag

SEQ ID NO: 1814475 - DNA, 23 bp, Homo sapiens
aaggccatattttaaaaaatcaa

SEQ ID NO: 1814476 - DNA, 14 bp, Homo sapiens
aaggcctcccacag

SEQ ID NO: 1814477 - DNA, 16 bp, Homo sapiens
aaggcctcccacagtg

SEQ ID NO: 1814478 - DNA, 17 bp, Homo sapiens
aaggcctcccacagtga

SEQ ID NO: 1814479 - DNA, 16 bp, Homo sapiens
aaggcgaggagagtgg

SEQ ID NO: 1814480 - DNA, 19 bp, Homo sapiens
aagggaaagcgggcagccc

SEQ ID NO: 1814481 - DNA, 12 bp, Homo sapiens
aagggctccagc

SEQ ID NO: 1814482 - DNA, 13 bp, Homo sapiens
aagggctccagca

SEQ ID NO: 1814483 - DNA, 15 bp, Homo sapiens
aagggctccagcatc

SEQ ID NO: 1814484 - DNA, 13 bp, Homo sapiens
aaggggagttgag

SEQ ID NO: 1814485 - DNA, 17 bp, Homo sapiens
aaggggcacaccactgc

SEQ ID NO: 1814486 - DNA, 21 bp, Homo sapiens
aaggggcacaccactgccctg

SEQ ID NO: 1814487 - DNA, 16 bp, Homo sapiens
aaggggccccggggct

SEQ ID NO: 1814488 - DNA, 17 bp, Homo sapiens
aaggggccccggggctg

SEQ ID NO: 1814489 - DNA, 20 bp, Homo sapiens
aaggggccccggggctggca

SEQ ID NO: 1814490 - DNA, 13 bp, Homo sapiens
aaggtgctgagct

SEQ ID NO: 1814491 - DNA, 15 bp, Homo sapiens
aaggtgggtccagga

SEQ ID NO: 1814492 - DNA, 24 bp, Homo sapiens
aaggtgggtccaggaaggcagctg

SEQ ID NO: 1814493 - DNA, 22 bp, Homo sapiens
aaggtgtaagacttcagatttc

SEQ ID NO: 1814494 - DNA, 19 bp, Homo sapiens
aaggttactcagcagcaga

SEQ ID NO: 1814495 - DNA, 16 bp, Homo sapiens
aaggtttcactgttca

SEQ ID NO: 1814496 - DNA, 15 bp, Homo sapiens
aaggttttattttgt

SEQ ID NO: 1814497 - DNA, 20 bp, Homo sapiens
aagtataggataaattacat

SEQ ID NO: 1814498 - DNA, 14 bp, Homo sapiens
aagtcaatattgat

SEQ ID NO: 1814499 - DNA, 23 bp, Homo sapiens
aagtcacagctgcagctgggccc

SEQ ID NO: 1814500 - DNA, 14 bp, Homo sapiens
aagtctaaacaatg

SEQ ID NO: 1814501 - DNA, 15 bp, Homo sapiens
aagtctaaacaatga

SEQ ID NO: 1814502 - DNA, 15 bp, Homo sapiens
aagtctcctgtatca

SEQ ID NO: 1814503 - DNA, 19 bp, Homo sapiens
aagtgaaagacttgaattt

SEQ ID NO: 1814504 - DNA, 15 bp, Homo sapiens
aagtgatctttcaat

SEQ ID NO: 1814505 - DNA, 17 bp, Homo sapiens
aagtgatctttcaatat

SEQ ID NO: 1814506 - DNA, 20 bp, Homo sapiens
aagtgatctttcaatatcat

SEQ ID NO: 1814507 - DNA, 13 bp, Homo sapiens
aagtgctgtaccc

SEQ ID NO: 1814508 - DNA, 17 bp, Homo sapiens
aagtggggctaaatgaa

SEQ ID NO: 1814509 - DNA, 18 bp, Homo sapiens
aagtggggctaaatgaag

SEQ ID NO: 1814510 - DNA, 19 bp, Homo sapiens
aagtggggctaaatgaagt

SEQ ID NO: 1814511 - DNA, 19 bp, Homo sapiens
aagtgttgtggagaaaaga

SEQ ID NO: 1814512 - DNA, 19 bp, Homo sapiens
aagttatggtttcctcatt

SEQ ID NO: 1814513 - DNA, 22 bp, Homo sapiens
aagttatggtttcctcatttta

SEQ ID NO: 1814514 - DNA, 24 bp, Homo sapiens
aagttatggtttcctcattttact

SEQ ID NO: 1814515 - DNA, 19 bp, Homo sapiens
aagtttcacaacagatttc

SEQ ID NO: 1814516 - DNA, 17 bp, Homo sapiens
aagtttcgaggggtcct

SEQ ID NO: 1814517 - DNA, 14 bp, Homo sapiens
aagtttttcagaaa

SEQ ID NO: 1814518 - DNA, 12 bp, Homo sapiens
aataaagctgga

SEQ ID NO: 1814519 - DNA, 21 bp, Homo sapiens
aataaagctggacaagaagct

SEQ ID NO: 1814520 - DNA, 23 bp, Homo sapiens
aataaagctggacaagaagctgc

SEQ ID NO: 1814521 - DNA, 13 bp, Homo sapiens
aataaagtgaata

SEQ ID NO: 1814522 - DNA, 18 bp, Homo sapiens
aataacacagatattgtt

SEQ ID NO: 1814523 - DNA, 12 bp, Homo sapiens
aataatgtaata

SEQ ID NO: 1814524 - DNA, 17 bp, Homo sapiens
aataatgtaatactgta

SEQ ID NO: 1814525 - DNA, 13 bp, Homo sapiens
aataattcatcaa

SEQ ID NO: 1814526 - DNA, 17 bp, Homo sapiens
aatacagaagaaaataa

SEQ ID NO: 1814527 - DNA, 14 bp, Homo sapiens
aatacgtgttcaaa

SEQ ID NO: 1814528 - DNA, 19 bp, Homo sapiens
aatagcacatgattttctt

SEQ ID NO: 1814529 - DNA, 19 bp, Homo sapiens
aatataatgagtcacaaaa

SEQ ID NO: 1814530 - DNA, 16 bp, Homo sapiens
aatatatagcttgaaa

SEQ ID NO: 1814531 - DNA, 13 bp, Homo sapiens
aatatcattacta

SEQ ID NO: 1814532 - DNA, 17 bp, Homo sapiens
aatatcattactaactt

SEQ ID NO: 1814533 - DNA, 18 bp, Homo sapiens
aatatctgagaagtgtat

SEQ ID NO: 1814534 - DNA, 21 bp, Homo sapiens
aatatctgagaagtgtatata

SEQ ID NO: 1814535 - DNA, 20 bp, Homo sapiens
aatatgagaaatacagaaga

SEQ ID NO: 1814536 - DNA, 14 bp, Homo sapiens
aatattcaataaag

SEQ ID NO: 1814537 - DNA, 15 bp, Homo sapiens
aatattgctctaatt

SEQ ID NO: 1814538 - DNA, 21 bp, Homo sapiens
aatattgctctaattcttttc

SEQ ID NO: 1814539 - DNA, 22 bp, Homo sapiens
aatattgctctaattcttttca

SEQ ID NO: 1814540 - DNA, 13 bp, Homo sapiens
aatatttttcaaa

SEQ ID NO: 1814541 - DNA, 14 bp, Homo sapiens
aatatttttcaaaa

SEQ ID NO: 1814542 - DNA, 15 bp, Homo sapiens
agacttcagatttca

SEQ ID NO: 1814543 - DNA, 21 bp, Homo sapiens
agacttcagatttcaaattaa

SEQ ID NO: 1814544 - DNA, 22 bp, Homo sapiens
agacttctggaaggctggctga

SEQ ID NO: 1814545 - DNA, 17 bp, Homo sapiens
agagaaaaagtgcccct

SEQ ID NO: 1814546 - DNA, 15 bp, Homo sapiens
agagaaaagaaaaat

SEQ ID NO: 1814547 - DNA, 17 bp, Homo sapiens
agagaaaagaaaaatat

SEQ ID NO: 1814548 - DNA, 14 bp, Homo sapiens
agagaaggcagcag

SEQ ID NO: 1814549 - DNA, 17 bp, Homo sapiens
agagactgaaagcagca

SEQ ID NO: 1814550 - DNA, 23 bp, Homo sapiens
agagactgaaagcagcagctagg

SEQ ID NO: 1814551 - DNA, 24 bp, Homo sapiens
agagactgaaagcagcagctagga

SEQ ID NO: 1814552 - DNA, 13 bp, Homo sapiens
agagaggagcacc

SEQ ID NO: 1814553 - DNA, 15 bp, Homo sapiens
agagagggcccagct

SEQ ID NO: 1814554 - DNA, 19 bp, Homo sapiens
agagatgtggcaaagtgct

SEQ ID NO: 1814555 - DNA, 21 bp, Homo sapiens
agagcaacccctgtacccagc

SEQ ID NO: 1814556 - DNA, 15 bp, Homo sapiens
agagcactagaagtg

SEQ ID NO: 1814557 - DNA, 18 bp, Homo sapiens
agagcagcctgatggcca

SEQ ID NO: 1814558 - DNA, 20 bp, Homo sapiens
agagcagcttctgccacttc

SEQ ID NO: 1814559 - DNA, 16 bp, Homo sapiens
agagcatcgtgaccct

SEQ ID NO: 1814560 - DNA, 20 bp, Homo sapiens
agagcatcgtgacccttcag

SEQ ID NO: 1814561 - DNA, 15 bp, Homo sapiens
agagccagcctggga

SEQ ID NO: 1814562 - DNA, 17 bp, Homo sapiens
agagccagcctgggact

SEQ ID NO: 1814563 - DNA, 16 bp, Homo sapiens
agagccatgggcctgg

SEQ ID NO: 1814564 - DNA, 20 bp, Homo sapiens
agagccatgggcctgggcct

SEQ ID NO: 1814565 - DNA, 22 bp, Homo sapiens
agagccatgggcctgggcctgc

SEQ ID NO: 1814566 - DNA, 23 bp, Homo sapiens
agagccatgggcctgggcctgct

SEQ ID NO: 1814567 - DNA, 19 bp, Homo sapiens
agagctcttcaagctgtcc

SEQ ID NO: 1814568 - DNA, 21 bp, Homo sapiens
agagctggaaggcagggcaga

SEQ ID NO: 1814569 - DNA, 22 bp, Homo sapiens
agagctggaaggcagggcagag

SEQ ID NO: 1814570 - DNA, 20 bp, Homo sapiens
agagctgggaaattcatgtg

SEQ ID NO: 1814571 - DNA, 13 bp, Homo sapiens
agaggagaccctg

SEQ ID NO: 1814572 - DNA, 16 bp, Homo sapiens
agaggagaccctggaa

SEQ ID NO: 1814573 - DNA, 16 bp, Homo sapiens
agaggagcacctgaac

SEQ ID NO: 1814574 - DNA, 16 bp, Homo sapiens
agaggatgatttcaga

SEQ ID NO: 1814575 - DNA, 16 bp, Homo sapiens
agaggcaaagaatcaa

SEQ ID NO: 1814576 - DNA, 17 bp, Homo sapiens
agaggcatttaaaatgg

SEQ ID NO: 1814577 - DNA, 19 bp, Homo sapiens
agagggaatgttccctgca

SEQ ID NO: 1814578 - DNA, 22 bp, Homo sapiens
agagggactgttcttttgtccc

SEQ ID NO: 1814579 - DNA, 23 bp, Homo sapiens
agaggggcagccgctaggagaga

SEQ ID NO: 1814580 - DNA, 15 bp, Homo sapiens
agaggggcaggccct

SEQ ID NO: 1814581 - DNA, 14 bp, Homo sapiens
agagggggctctcc

SEQ ID NO: 1814582 - DNA, 15 bp, Homo sapiens
agagggggctctcca

SEQ ID NO: 1814583 - DNA, 16 bp, Homo sapiens
agaggggtgcacccac

SEQ ID NO: 1814584 - DNA, 18 bp, Homo sapiens
agaggtgggcagctgggc

SEQ ID NO: 1814585 - DNA, 19 bp, Homo sapiens
agaggtgggcagctgggcc

SEQ ID NO: 1814586 - DNA, 23 bp, Homo sapiens
agaggttaaggtgggtccaggaa

SEQ ID NO: 1814587 - DNA, 18 bp, Homo sapiens
agaggttatctgcctggc

SEQ ID NO: 1814588 - DNA, 20 bp, Homo sapiens
agaggttatctgcctggcct

SEQ ID NO: 1814589 - DNA, 13 bp, Homo sapiens
agagtctgagccc

SEQ ID NO: 1814590 - DNA, 14 bp, Homo sapiens
agagtgaaagggct

SEQ ID NO: 1814591 - DNA, 15 bp, Homo sapiens
agagtgaattatatt

SEQ ID NO: 1814592 - DNA, 12 bp, Homo sapiens
agagttattcaa

SEQ ID NO: 1814593 - DNA, 16 bp, Homo sapiens
agagttattcaaatga

SEQ ID NO: 1814594 - DNA, 23 bp, Homo sapiens
agagttctttgctgcccctgtct

SEQ ID NO: 1814595 - DNA, 20 bp, Homo sapiens
agatagttacaaaatacaaa

SEQ ID NO: 1814596 - DNA, 19 bp, Homo sapiens
agatatgctaagcagtagt

SEQ ID NO: 1814597 - DNA, 14 bp, Homo sapiens
agatcgcttgagcc

SEQ ID NO: 1814598 - DNA, 19 bp, Homo sapiens
agatcgcttgagcccagga

SEQ ID NO: 1814599 - DNA, 16 bp, Homo sapiens
agatctgatggtgagc

SEQ ID NO: 1814600 - DNA, 20 bp, Homo sapiens
agatctgatggtgagctggg

SEQ ID NO: 1814601 - DNA, 14 bp, Homo sapiens
agatctgcctgggc

SEQ ID NO: 1814602 - DNA, 17 bp, Homo sapiens
agatctgcctgggcctg

SEQ ID NO: 1814603 - DNA, 18 bp, Homo sapiens
agatctgcctgggcctgt

SEQ ID NO: 1814604 - DNA, 19 bp, Homo sapiens
agatctgcctgggcctgtg

SEQ ID NO: 1814605 - DNA, 20 bp, Homo sapiens
agatctgcctgggcctgtgc

SEQ ID NO: 1814606 - DNA, 21 bp, Homo sapiens
agatctgcctgggcctgtgca

SEQ ID NO: 1814607 - DNA, 24 bp, Homo sapiens
agatctgcctgggcctgtgcagca

SEQ ID NO: 1814608 - DNA, 15 bp, Homo sapiens
agatctttttgtgaa

SEQ ID NO: 1814609 - DNA, 20 bp, Homo sapiens
agatggagttgtattttgac

SEQ ID NO: 1814610 - DNA, 14 bp, Homo sapiens
agattcctgggcct

SEQ ID NO: 1814611 - DNA, 14 bp, Homo sapiens
agattctgattcag

SEQ ID NO: 1814612 - DNA, 23 bp, Homo sapiens
agattgaaaggacctcttctgaa

SEQ ID NO: 1814613 - DNA, 17 bp, Homo sapiens
agattgtgcgttcaaac

SEQ ID NO: 1814614 - DNA, 13 bp, Homo sapiens
agatttattaatt

SEQ ID NO: 1814615 - DNA, 21 bp, Homo sapiens
agatttcaaattaatctttct

SEQ ID NO: 1814616 - DNA, 14 bp, Homo sapiens
agatttctaagtta

SEQ ID NO: 1814617 - DNA, 21 bp, Homo sapiens
agatttctaagttaaatcatt

SEQ ID NO: 1814618 - DNA, 19 bp, Homo sapiens
agcaaatgctttgtgacta

SEQ ID NO: 1814619 - DNA, 21 bp, Homo sapiens
agcaacccctgtacccagctc

SEQ ID NO: 1814620 - DNA, 22 bp, Homo sapiens
agcaaggaggctggctggggcc

SEQ ID NO: 1814621 - DNA, 14 bp, Homo sapiens
agcaagggctccag

SEQ ID NO: 1814622 - DNA, 19 bp, Homo sapiens
agcacagcaaggaggctgg

SEQ ID NO: 1814623 - DNA, 24 bp, Homo sapiens
agcacagcaaggaggctggctggg

SEQ ID NO: 1814624 - DNA, 10 bp, Homo sapiens
agcacagccc

SEQ ID NO: 1814625 - DNA, 15 bp, Homo sapiens
agcacagccctggga

SEQ ID NO: 1814626 - DNA, 16 bp, Homo sapiens
agcacagccctgggag

SEQ ID NO: 1814627 - DNA, 12 bp, Homo sapiens
agcacaggggcc

SEQ ID NO: 1814628 - DNA, 16 bp, Homo sapiens
agcacatgattttctt

SEQ ID NO: 1814629 - DNA, 18 bp, Homo sapiens
agcacatgattttctttt

SEQ ID NO: 1814630 - DNA, 17 bp, Homo sapiens
agcacccgggctcaggg

SEQ ID NO: 1814631 - DNA, 14 bp, Homo sapiens
agcactagaagtgg

SEQ ID NO: 1814632 - DNA, 14 bp, Homo sapiens
agcactggccagag

SEQ ID NO: 1814633 - DNA, 19 bp, Homo sapiens
agcactggccagagagggc

SEQ ID NO: 1814634 - DNA, 20 bp, Homo sapiens
agcactggccagagagggcc

SEQ ID NO: 1814635 - DNA, 23 bp, Homo sapiens
agcactggccagagagggcccag

SEQ ID NO: 1814636 - DNA, 14 bp, Homo sapiens
agcacttgcgtcct

SEQ ID NO: 1814637 - DNA, 15 bp, Homo sapiens
agcacttgcgtcctg

SEQ ID NO: 1814638 - DNA, 18 bp, Homo sapiens
agcacttgcgtcctgcag

SEQ ID NO: 1814639 - DNA, 22 bp, Homo sapiens
agcacttgcgtcctgcagagga

SEQ ID NO: 1814640 - DNA, 21 bp, Homo sapiens
agcactttacgctgtctgtaa

SEQ ID NO: 1814641 - DNA, 22 bp, Homo sapiens
agcactttacgctgtctgtaat

SEQ ID NO: 1814642 - DNA, 15 bp, Homo sapiens
agcactttctgtagt

SEQ ID NO: 1814643 - DNA, 14 bp, Homo sapiens
agcagagagccctg

SEQ ID NO: 1814644 - DNA, 15 bp, Homo sapiens
agcagagagccctgg

SEQ ID NO: 1814645 - DNA, 19 bp, Homo sapiens
agcagagagccctgggtga

SEQ ID NO: 1814646 - DNA, 18 bp, Homo sapiens
agcagagcaaatgaggga

SEQ ID NO: 1814647 - DNA, 17 bp, Homo sapiens
agcagggaaagctccac

SEQ ID NO: 1814648 - DNA, 14 bp, Homo sapiens
agcaggtgtggtgg

SEQ ID NO: 1814649 - DNA, 20 bp, Homo sapiens
agcagtgcctcgaggcaccg

SEQ ID NO: 1814650 - DNA, 14 bp, Homo sapiens
agcatccagcctgt

SEQ ID NO: 1814651 - DNA, 19 bp, Homo sapiens
agcatcgtgacccttcagg

SEQ ID NO: 1814652 - DNA, 13 bp, Homo sapiens
agcatctcccagt

SEQ ID NO: 1814653 - DNA, 20 bp, Homo sapiens
agcattcaggcagcactgac

SEQ ID NO: 1814654 - DNA, 12 bp, Homo sapiens
agccaagaaagt

SEQ ID NO: 1814655 - DNA, 14 bp, Homo sapiens
agccactcctgtcc

SEQ ID NO: 1814656 - DNA, 16 bp, Homo sapiens
agccactcctgtcccg

SEQ ID NO: 1814657 - DNA, 17 bp, Homo sapiens
agccactcctgtcccgc

SEQ ID NO: 1814658 - DNA, 20 bp, Homo sapiens
agccactcgcagtcgcagga

SEQ ID NO: 1814659 - DNA, 20 bp, Homo sapiens
agccagagaggagcacctga

SEQ ID NO: 1814660 - DNA, 19 bp, Homo sapiens
aggaaaagcctctgtgtca

SEQ ID NO: 1814661 - DNA, 23 bp, Homo sapiens
aggaaatgctattgttgtgggct

SEQ ID NO: 1814662 - DNA, 18 bp, Homo sapiens
aggaacgagcactggcca

SEQ ID NO: 1814663 - DNA, 12 bp, Homo sapiens
aggaaggcagct

SEQ ID NO: 1814664 - DNA, 15 bp, Homo sapiens
aggaaggtgctgagc

SEQ ID NO: 1814665 - DNA, 17 bp, Homo sapiens
aggaaggtgctgagctt

SEQ ID NO: 1814666 - DNA, 21 bp, Homo sapiens
aggaaggtgctgagcttagcc

SEQ ID NO: 1814667 - DNA, 15 bp, Homo sapiens
aggaatagccagaga

SEQ ID NO: 1814668 - DNA, 21 bp, Homo sapiens
aggacaacctgcccctcccca

SEQ ID NO: 1814669 - DNA, 18 bp, Homo sapiens
aggacacatcccggcctc

SEQ ID NO: 1814670 - DNA, 20 bp, Homo sapiens
aggacacatcccggcctctt

SEQ ID NO: 1814671 - DNA, 16 bp, Homo sapiens
aggaccacagtgggtg

SEQ ID NO: 1814672 - DNA, 22 bp, Homo sapiens
aggaccacagtgggtggcacct

SEQ ID NO: 1814673 - DNA, 19 bp, Homo sapiens
aggacccaggccctccatg

SEQ ID NO: 1814674 - DNA, 15 bp, Homo sapiens
aggacggggccggcc

SEQ ID NO: 1814675 - DNA, 19 bp, Homo sapiens
aggacggggccggccaggt

SEQ ID NO: 1814676 - DNA, 22 bp, Homo sapiens
aggacggggccggccaggtggg

SEQ ID NO: 1814677 - DNA, 15 bp, Homo sapiens
aggagaaggaaaaag

SEQ ID NO: 1814678 - DNA, 13 bp, Homo sapiens
aggagaccctgga

SEQ ID NO: 1814679 - DNA, 15 bp, Homo sapiens
aggagaccctggaat

SEQ ID NO: 1814680 - DNA, 16 bp, Homo sapiens
aggagagactgaaagc

SEQ ID NO: 1814681 - DNA, 16 bp, Homo sapiens
aggagcacctgaaccc

SEQ ID NO: 1814682 - DNA, 23 bp, Homo sapiens
aggagctgatttccaggcccctg

SEQ ID NO: 1814683 - DNA, 13 bp, Homo sapiens
aggaggctggctg

SEQ ID NO: 1814684 - DNA, 15 bp, Homo sapiens
aggagggcagagcca

SEQ ID NO: 1814685 - DNA, 15 bp, Homo sapiens
aggagggtggaggaa

SEQ ID NO: 1814686 - DNA, 15 bp, Homo sapiens
aggaggtgccaacag

SEQ ID NO: 1814687 - DNA, 17 bp, Homo sapiens
aggagtcaactggctgg

SEQ ID NO: 1814688 - DNA, 21 bp, Homo sapiens
aggagtcaactggctggccag

SEQ ID NO: 1814689 - DNA, 21 bp, Homo sapiens
aggagtccctgccatcatgtt

SEQ ID NO: 1814690 - DNA, 14 bp, Homo sapiens
aggagtctgtgctc

SEQ ID NO: 1814691 - DNA, 23 bp, Homo sapiens
aggagtgggttttattgtccttc

SEQ ID NO: 1814692 - DNA, 20 bp, Homo sapiens
aggagttgagtacagtgagg

SEQ ID NO: 1814693 - DNA, 23 bp, Homo sapiens
aggagtttgagacaagccctggc

SEQ ID NO: 1814694 - DNA, 24 bp, Homo sapiens
aggagtttgagacaagccctggca

SEQ ID NO: 1814695 - DNA, 15 bp, Homo sapiens
aggataaattacatt

SEQ ID NO: 1814696 - DNA, 12 bp, Homo sapiens
aggatccgctgc

SEQ ID NO: 1814697 - DNA, 12 bp, Homo sapiens
aggatcctgcag

SEQ ID NO: 1814698 - DNA, 14 bp, Homo sapiens
aggatcctgcagga

SEQ ID NO: 1814699 - DNA, 19 bp, Homo sapiens
aggcaagcccctcagccct

SEQ ID NO: 1814700 - DNA, 21 bp, Homo sapiens
aggcaagcccctcagcccttg

SEQ ID NO: 1814701 - DNA, 12 bp, Homo sapiens
aggcacagcaca

SEQ ID NO: 1814702 - DNA, 13 bp, Homo sapiens
aggcaccagctct

SEQ ID NO: 1814703 - DNA, 17 bp, Homo sapiens
aggcaccagctctgtgg

SEQ ID NO: 1814704 - DNA, 13 bp, Homo sapiens
aggcaccggcgct

SEQ ID NO: 1814705 - DNA, 16 bp, Homo sapiens
aggcaccggcgctgca

SEQ ID NO: 1814706 - DNA, 18 bp, Homo sapiens
aggcacctgcaggttggg

SEQ ID NO: 1814707 - DNA, 21 bp, Homo sapiens
aggcacctgcaggttgggcca

SEQ ID NO: 1814708 - DNA, 13 bp, Homo sapiens
aggcacctggcct

SEQ ID NO: 1814709 - DNA, 14 bp, Homo sapiens
aggcacctggcctg

SEQ ID NO: 1814710 - DNA, 17 bp, Homo sapiens
aggcacctggcctgctg

SEQ ID NO: 1814711 - DNA, 18 bp, Homo sapiens
aggcacctggcctgctgg

SEQ ID NO: 1814712 - DNA, 21 bp, Homo sapiens
aggcacctggcctgctgggaa

SEQ ID NO: 1814713 - DNA, 13 bp, Homo sapiens
aggcactgtgaac

SEQ ID NO: 1814714 - DNA, 11 bp, Homo sapiens
aggcagcctcc

SEQ ID NO: 1814715 - DNA, 22 bp, Homo sapiens
aggcagcctccagagccagcct

SEQ ID NO: 1814716 - DNA, 23 bp, Homo sapiens
aggcagcctccagagccagcctg

SEQ ID NO: 1814717 - DNA, 15 bp, Homo sapiens
aggcagggcagaggg

SEQ ID NO: 1814718 - DNA, 19 bp, Homo sapiens
aggcagggcagagggaatg

SEQ ID NO: 1814719 - DNA, 16 bp, Homo sapiens
aggcagtctgaaccct

SEQ ID NO: 1814720 - DNA, 16 bp, Homo sapiens
aggcagtgggtcccac

SEQ ID NO: 1814721 - DNA, 14 bp, Homo sapiens
aggcatgctggcct

SEQ ID NO: 1814722 - DNA, 13 bp, Homo sapiens
aggccaaggcagg

SEQ ID NO: 1814723 - DNA, 14 bp, Homo sapiens
aggccaaggcaggt

SEQ ID NO: 1814724 - DNA, 20 bp, Homo sapiens
aggccactgtggccagagct

SEQ ID NO: 1814725 - DNA, 18 bp, Homo sapiens
aggccatcttccaggtgg

SEQ ID NO: 1814726 - DNA, 13 bp, Homo sapiens
aggcccagcagac

SEQ ID NO: 1814727 - DNA, 23 bp, Homo sapiens
aggcccagccgcaggaaggcaga

SEQ ID NO: 1814728 - DNA, 18 bp, Homo sapiens
aggcccatctcaggtgcc

SEQ ID NO: 1814729 - DNA, 20 bp, Homo sapiens
aggcccatctcaggtgccac

SEQ ID NO: 1814730 - DNA, 17 bp, Homo sapiens
aggcccctgaggactgg

SEQ ID NO: 1814731 - DNA, 20 bp, Homo sapiens
aggcccctgaggactggaga

SEQ ID NO: 1814732 - DNA, 17 bp, Homo sapiens
aggccctaggattcctc

SEQ ID NO: 1814733 - DNA, 17 bp, Homo sapiens
aggccctccatgggcta

SEQ ID NO: 1814734 - DNA, 13 bp, Homo sapiens
aggccctccctgt

SEQ ID NO: 1814735 - DNA, 13 bp, Homo sapiens
aggccctgcactg

SEQ ID NO: 1814736 - DNA, 17 bp, Homo sapiens
aggcccttgtcctgcca

SEQ ID NO: 1814737 - DNA, 19 bp, Homo sapiens
aggcccttgtcctgccagc

SEQ ID NO: 1814738 - DNA, 22 bp, Homo sapiens
aggcccttgtcctgccagctgc

SEQ ID NO: 1814739 - DNA, 23 bp, Homo sapiens
aggcccttgtcctgccagctgcc

SEQ ID NO: 1814740 - DNA, 21 bp, Homo sapiens
aggccgttccccttggcttcc

SEQ ID NO: 1814741 - DNA, 23 bp, Homo sapiens
aggccgttccccttggcttcctc

SEQ ID NO: 1814742 - DNA, 21 bp, Homo sapiens
aggcctcagtttctccatcag

SEQ ID NO: 1814743 - DNA, 13 bp, Homo sapiens
aggcctcatccct

SEQ ID NO: 1814744 - DNA, 11 bp, Homo sapiens
aggcctccagc

SEQ ID NO: 1814745 - DNA, 14 bp, Homo sapiens
aggcctcccacagt

SEQ ID NO: 1814746 - DNA, 18 bp, Homo sapiens
aggcctcccacagtgact

SEQ ID NO: 1814747 - DNA, 14 bp, Homo sapiens
aggcctcttgtgct

SEQ ID NO: 1814748 - DNA, 16 bp, Homo sapiens
aggcctgactctcagc

SEQ ID NO: 1814749 - DNA, 14 bp, Homo sapiens
aggcctggaaccag

SEQ ID NO: 1814750 - DNA, 15 bp, Homo sapiens
aggcctggaaccagg

SEQ ID NO: 1814751 - DNA, 22 bp, Homo sapiens
aggcctggaaccagggaggaga

SEQ ID NO: 1814752 - DNA, 13 bp, Homo sapiens
aggcctggcacag

SEQ ID NO: 1814753 - DNA, 14 bp, Homo sapiens
aggcctggcacagt

SEQ ID NO: 1814754 - DNA, 20 bp, Homo sapiens
aggcctgggacccagctact

SEQ ID NO: 1814755 - DNA, 23 bp, Homo sapiens
aggcctgggacccagctactctg

SEQ ID NO: 1814756 - DNA, 22 bp, Homo sapiens
aggctaagatgagatttgccag

SEQ ID NO: 1814757 - DNA, 23 bp, Homo sapiens
aggctaagatgagatttgccagc

SEQ ID NO: 1814758 - DNA, 14 bp, Homo sapiens
aggctagttccttt

SEQ ID NO: 1814759 - DNA, 22 bp, Homo sapiens
aggctatggggatagatgtgtg

SEQ ID NO: 1814760 - DNA, 14 bp, Homo sapiens
aggctctcccctct

SEQ ID NO: 1814761 - DNA, 13 bp, Homo sapiens
aggctctgggctc

SEQ ID NO: 1814762 - DNA, 15 bp, Homo sapiens
aggctctgggctcag

SEQ ID NO: 1814763 - DNA, 16 bp, Homo sapiens
aggctctgggctcagg

SEQ ID NO: 1814764 - DNA, 17 bp, Homo sapiens
aggctctgggctcaggg

SEQ ID NO: 1814765 - DNA, 18 bp, Homo sapiens
aggctctgggctcagggc

SEQ ID NO: 1814766 - DNA, 21 bp, Homo sapiens
aggctctgggctcagggctgg

SEQ ID NO: 1814767 - DNA, 11 bp, Homo sapiens
aggctgcactg

SEQ ID NO: 1814768 - DNA, 13 bp, Homo sapiens
aggctgcactgca

SEQ ID NO: 1814769 - DNA, 16 bp, Homo sapiens
aggctgcactgcagtg

SEQ ID NO: 1814770 - DNA, 19 bp, Homo sapiens
aggctgcactgcagtgatg

SEQ ID NO: 1814771 - DNA, 16 bp, Homo sapiens
aggctggccagcccca

SEQ ID NO: 1814772 - DNA, 17 bp, Homo sapiens
aggctggccagccccac

SEQ ID NO: 1814773 - DNA, 20 bp, Homo sapiens
aggctggccagccccacagc

SEQ ID NO: 1814774 - DNA, 21 bp, Homo sapiens
aggctggccagccccacagcc

SEQ ID NO: 1814775 - DNA, 11 bp, Homo sapiens
aggctggctga

SEQ ID NO: 1814776 - DNA, 12 bp, Homo sapiens
aggctggctggg

SEQ ID NO: 1814777 - DNA, 12 bp, Homo sapiens
aggcttccaggc

SEQ ID NO: 1814778 - DNA, 20 bp, Homo sapiens
aggcttccaggctcttcctg

SEQ ID NO: 1814779 - DNA, 13 bp, Homo sapiens
agccagaggtctg

SEQ ID NO: 1814780 - DNA, 14 bp, Homo sapiens
agccagcccttccc

SEQ ID NO: 1814781 - DNA, 17 bp, Homo sapiens
agccagcccttccctgg

SEQ ID NO: 1814782 - DNA, 13 bp, Homo sapiens
agccagcctggga

SEQ ID NO: 1814783 - DNA, 14 bp, Homo sapiens
agccagcctgggac

SEQ ID NO: 1814784 - DNA, 14 bp, Homo sapiens
agccaggagtctgt

SEQ ID NO: 1814785 - DNA, 16 bp, Homo sapiens
agccaggagtctgtgc

SEQ ID NO: 1814786 - DNA, 18 bp, Homo sapiens
agccaggagtctgtgctc

SEQ ID NO: 1814787 - DNA, 21 bp, Homo sapiens
agccaggagtctgtgctcttt

SEQ ID NO: 1814788 - DNA, 17 bp, Homo sapiens
agccagtcttgcctagg

SEQ ID NO: 1814789 - DNA, 15 bp, Homo sapiens
agccatgcctcatgc

SEQ ID NO: 1814790 - DNA, 18 bp, Homo sapiens
agccatggctcaggcaag

SEQ ID NO: 1814791 - DNA, 15 bp, Homo sapiens
agccatgggcctggg

SEQ ID NO: 1814792 - DNA, 18 bp, Homo sapiens
agccatgggcctgggcct

SEQ ID NO: 1814793 - DNA, 19 bp, Homo sapiens
agccatgggcctgggcctg

SEQ ID NO: 1814794 - DNA, 13 bp, Homo sapiens
agccatgtgtcat

SEQ ID NO: 1814795 - DNA, 16 bp, Homo sapiens
agccatgtgtcatgta

SEQ ID NO: 1814796 - DNA, 12 bp, Homo sapiens
agcccacagagc

SEQ ID NO: 1814797 - DNA, 15 bp, Homo sapiens
agcccacagagcctg

SEQ ID NO: 1814798 - DNA, 14 bp, Homo sapiens
agcccacgtcctgt

SEQ ID NO: 1814799 - DNA, 20 bp, Homo sapiens
agcccaggagtttgagacaa

SEQ ID NO: 1814800 - DNA, 11 bp, Homo sapiens
agcccaggccg

SEQ ID NO: 1814801 - DNA, 14 bp, Homo sapiens
agcccagtgcttct

SEQ ID NO: 1814802 - DNA, 13 bp, Homo sapiens
agccccacagccc

SEQ ID NO: 1814803 - DNA, 14 bp, Homo sapiens
agccccagggcctg

SEQ ID NO: 1814804 - DNA, 15 bp, Homo sapiens
agccccagggcctgg

SEQ ID NO: 1814805 - DNA, 17 bp, Homo sapiens
agccccagggcctgggg

SEQ ID NO: 1814806 - DNA, 20 bp, Homo sapiens
agccccctggatgggcattg

SEQ ID NO: 1814807 - DNA, 16 bp, Homo sapiens
agcccctccccagcca

SEQ ID NO: 1814808 - DNA, 21 bp, Homo sapiens
agcccctccccagccagccct

SEQ ID NO: 1814809 - DNA, 22 bp, Homo sapiens
agcccctccccagccagccctt

SEQ ID NO: 1814810 - DNA, 17 bp, Homo sapiens
agccctcagtcagttcc

SEQ ID NO: 1814811 - DNA, 21 bp, Homo sapiens
agccctcgaaccaaggcagcc

SEQ ID NO: 1814812 - DNA, 17 bp, Homo sapiens
agcccttccctggcccc

SEQ ID NO: 1814813 - DNA, 17 bp, Homo sapiens
agcccttctgcctttct

SEQ ID NO: 1814814 - DNA, 15 bp, Homo sapiens
agcccttgcccccat

SEQ ID NO: 1814815 - DNA, 18 bp, Homo sapiens
agcccttgcccccatccc

SEQ ID NO: 1814816 - DNA, 18 bp, Homo sapiens
agccgctaggagagactg

SEQ ID NO: 1814817 - DNA, 19 bp, Homo sapiens
agccgctaggagagactga

SEQ ID NO: 1814818 - DNA, 18 bp, Homo sapiens
agccgctgcccggcgccc

SEQ ID NO: 1814819 - DNA, 17 bp, Homo sapiens
agccgtccatggcacca

SEQ ID NO: 1814820 - DNA, 17 bp, Homo sapiens
agccgtctgactccaga

SEQ ID NO: 1814821 - DNA, 21 bp, Homo sapiens
agccgtctgactccagagtct

SEQ ID NO: 1814822 - DNA, 22 bp, Homo sapiens
agccgtctgactccagagtctg

SEQ ID NO: 1814823 - DNA, 17 bp, Homo sapiens
agcctccagagccagcc

SEQ ID NO: 1814824 - DNA, 18 bp, Homo sapiens
agcctccagagccagcct

SEQ ID NO: 1814825 - DNA, 21 bp, Homo sapiens
agcctccagagccagcctggg

SEQ ID NO: 1814826 - DNA, 20 bp, Homo sapiens
agcctcccctcccctgggga

SEQ ID NO: 1814827 - DNA, 21 bp, Homo sapiens
agcctcccctcccctggggac

SEQ ID NO: 1814828 - DNA, 20 bp, Homo sapiens
agcctccgtttatgggcctt

SEQ ID NO: 1814829 - DNA, 23 bp, Homo sapiens
agcctccgtttatgggccttgct

SEQ ID NO: 1814830 - DNA, 17 bp, Homo sapiens
agcctcctgccccctgc

SEQ ID NO: 1814831 - DNA, 18 bp, Homo sapiens
agcctcctgccccctgcc

SEQ ID NO: 1814832 - DNA, 15 bp, Homo sapiens
agcctctcccggctg

SEQ ID NO: 1814833 - DNA, 16 bp, Homo sapiens
agcctctcccggctgc

SEQ ID NO: 1814834 - DNA, 17 bp, Homo sapiens
agcctctcccggctgcc

SEQ ID NO: 1814835 - DNA, 19 bp, Homo sapiens
agcctctcccggctgcctg

SEQ ID NO: 1814836 - DNA, 20 bp, Homo sapiens
agcctctcccggctgcctgc

SEQ ID NO: 1814837 - DNA, 22 bp, Homo sapiens
agcctctcccggctgcctgccg

SEQ ID NO: 1814838 - DNA, 11 bp, Homo sapiens
agcctctgtgt

SEQ ID NO: 1814839 - DNA, 13 bp, Homo sapiens
agcctctgtgtca

SEQ ID NO: 1814840 - DNA, 17 bp, Homo sapiens
agcctgatgatggaagg

SEQ ID NO: 1814841 - DNA, 15 bp, Homo sapiens
agcctgatggccaag

SEQ ID NO: 1814842 - DNA, 19 bp, Homo sapiens
agcctgatggccaaggggg

SEQ ID NO: 1814843 - DNA, 12 bp, Homo sapiens
agcctggcccag

SEQ ID NO: 1814844 - DNA, 13 bp, Homo sapiens
agcctggcccagc

SEQ ID NO: 1814845 - DNA, 15 bp, Homo sapiens
agcctggcccagctc

SEQ ID NO: 1814846 - DNA, 17 bp, Homo sapiens
agcctgggactcccagt

SEQ ID NO: 1814847 - DNA, 19 bp, Homo sapiens
agcctgggactcccagtga

SEQ ID NO: 1814848 - DNA, 14 bp, Homo sapiens
agcctgtgtgttct

SEQ ID NO: 1814849 - DNA, 13 bp, Homo sapiens
agccttgtgccct

SEQ ID NO: 1814850 - DNA, 16 bp, Homo sapiens
agccttgtgccctgcc

SEQ ID NO: 1814851 - DNA, 20 bp, Homo sapiens
agccttgtgccctgccccca

SEQ ID NO: 1814852 - DNA, 15 bp, Homo sapiens
agcgagcaagccggc

SEQ ID NO: 1814853 - DNA, 17 bp, Homo sapiens
agcgattattgatcaaa

SEQ ID NO: 1814854 - DNA, 12 bp, Homo sapiens
agcgggcagccc

SEQ ID NO: 1814855 - DNA, 14 bp, Homo sapiens
agctactctgtcca

SEQ ID NO: 1814856 - DNA, 22 bp, Homo sapiens
agctactctgtccaggccactg

SEQ ID NO: 1814857 - DNA, 20 bp, Homo sapiens
agctattagcaactgtgcta

SEQ ID NO: 1814858 - DNA, 18 bp, Homo sapiens
agctcactggtttacaaa

SEQ ID NO: 1814859 - DNA, 19 bp, Homo sapiens
agctccacggtgcgtggct

SEQ ID NO: 1814860 - DNA, 21 bp, Homo sapiens
agctccacggtgcgtggctgt

SEQ ID NO: 1814861 - DNA, 23 bp, Homo sapiens
agctccacggtgcgtggctgtgg

SEQ ID NO: 1814862 - DNA, 23 bp, Homo sapiens
agctcccccgggaggggcccgct

SEQ ID NO: 1814863 - DNA, 14 bp, Homo sapiens
agctcctctccttg

SEQ ID NO: 1814864 - DNA, 23 bp, Homo sapiens
agctcctctccttgggctcctgg

SEQ ID NO: 1814865 - DNA, 21 bp, Homo sapiens
agctccttttgtccccagggc

SEQ ID NO: 1814866 - DNA, 23 bp, Homo sapiens
agctccttttgtccccagggccc

SEQ ID NO: 1814867 - DNA, 17 bp, Homo sapiens
agctctgtggcctgtgt

SEQ ID NO: 1814868 - DNA, 14 bp, Homo sapiens
agctgaaagagtat

SEQ ID NO: 1814869 - DNA, 20 bp, Homo sapiens
agctgagttacttgtctgag

SEQ ID NO: 1814870 - DNA, 14 bp, Homo sapiens
agctgatttccagg

SEQ ID NO: 1814871 - DNA, 16 bp, Homo sapiens
agctgatttccaggcc

SEQ ID NO: 1814872 - DNA, 19 bp, Homo sapiens
agctgatttccaggcccct

SEQ ID NO: 1814873 - DNA, 20 bp, Homo sapiens
agctgatttccaggcccctg

SEQ ID NO: 1814874 - DNA, 23 bp, Homo sapiens
agctgatttccaggcccctgagg

SEQ ID NO: 1814875 - DNA, 19 bp, Homo sapiens
agctgctttcgaataaagt

SEQ ID NO: 1814876 - DNA, 19 bp, Homo sapiens
agctggaaggcagggcaga

SEQ ID NO: 1814877 - DNA, 20 bp, Homo sapiens
agctggaaggcagggcagag

SEQ ID NO: 1814878 - DNA, 14 bp, Homo sapiens
agctggacaagaag

SEQ ID NO: 1814879 - DNA, 18 bp, Homo sapiens
agctggacaagaagctgc

SEQ ID NO: 1814880 - DNA, 15 bp, Homo sapiens
agctggcaggacaca

SEQ ID NO: 1814881 - DNA, 23 bp, Homo sapiens
agctggcaggacacatcccggcc

SEQ ID NO: 1814882 - DNA, 14 bp, Homo sapiens
agctgggaaattca

SEQ ID NO: 1814883 - DNA, 21 bp, Homo sapiens
agctgggccccatgctctgcc

SEQ ID NO: 1814884 - DNA, 15 bp, Homo sapiens
agctggtggtgcagc

SEQ ID NO: 1814885 - DNA, 22 bp, Homo sapiens
agctggtggtgcagccttcccc

SEQ ID NO: 1814886 - DNA, 22 bp, Homo sapiens
agctgtagccatggctcaggca

SEQ ID NO: 1814887 - DNA, 16 bp, Homo sapiens
agctgtcccctctgtc

SEQ ID NO: 1814888 - DNA, 12 bp, Homo sapiens
agctgtgccacc

SEQ ID NO: 1814889 - DNA, 13 bp, Homo sapiens
agctgtgccaccc

SEQ ID NO: 1814890 - DNA, 18 bp, Homo sapiens
agctgtgccaccctgggc

SEQ ID NO: 1814891 - DNA, 20 bp, Homo sapiens
agctgtgccaccctgggctc

SEQ ID NO: 1814892 - DNA, 21 bp, Homo sapiens
agctgtgccaccctgggctct

SEQ ID NO: 1814893 - DNA, 15 bp, Homo sapiens
agcttcctgagggct

SEQ ID NO: 1814894 - DNA, 14 bp, Homo sapiens
agcttctgctgggc

SEQ ID NO: 1814895 - DNA, 16 bp, Homo sapiens
agcttctgctgggctg

SEQ ID NO: 1814896 - DNA, 14 bp, Homo sapiens
agctttctcctttg

SEQ ID NO: 1814897 - DNA, 15 bp, Homo sapiens
aggaaaagcctctgt

SEQ ID NO: 1814898 - DNA, 14 bp, Homo sapiens
actgccaggcacct

SEQ ID NO: 1814899 - DNA, 16 bp, Homo sapiens
actgccccactatttt

SEQ ID NO: 1814900 - DNA, 13 bp, Homo sapiens
actgcccccagaa

SEQ ID NO: 1814901 - DNA, 16 bp, Homo sapiens
actgcccccagaaagc

SEQ ID NO: 1814902 - DNA, 12 bp, Homo sapiens
actgccctgcct

SEQ ID NO: 1814903 - DNA, 13 bp, Homo sapiens
actgccctgcctg

SEQ ID NO: 1814904 - DNA, 15 bp, Homo sapiens
actgccctgcctgcc

SEQ ID NO: 1814905 - DNA, 23 bp, Homo sapiens
actgccctgcctgcccacttagc

SEQ ID NO: 1814906 - DNA, 16 bp, Homo sapiens
actgcggggcttggct

SEQ ID NO: 1814907 - DNA, 12 bp, Homo sapiens
actgctgagcca

SEQ ID NO: 1814908 - DNA, 15 bp, Homo sapiens
actgctgagccactc

SEQ ID NO: 1814909 - DNA, 15 bp, Homo sapiens
actgctgcaccagag

SEQ ID NO: 1814910 - DNA, 16 bp, Homo sapiens
actgctgggtggccca

SEQ ID NO: 1814911 - DNA, 19 bp, Homo sapiens
actgctgggtggcccatcc

SEQ ID NO: 1814912 - DNA, 20 bp, Homo sapiens
actggagtgaggcttccagg

SEQ ID NO: 1814913 - DNA, 22 bp, Homo sapiens
actggcaggtgcagatgggctg

SEQ ID NO: 1814914 - DNA, 12 bp, Homo sapiens
actggccagaga

SEQ ID NO: 1814915 - DNA, 13 bp, Homo sapiens
actggccagagag

SEQ ID NO: 1814916 - DNA, 19 bp, Homo sapiens
actggccagagagggccca

SEQ ID NO: 1814917 - DNA, 20 bp, Homo sapiens
actggccagagagggcccag

SEQ ID NO: 1814918 - DNA, 13 bp, Homo sapiens
actggccccaccc

SEQ ID NO: 1814919 - DNA, 19 bp, Homo sapiens
actggcctcgcctggcctg

SEQ ID NO: 1814920 - DNA, 22 bp, Homo sapiens
actgggttccccacagtgacag

SEQ ID NO: 1814921 - DNA, 16 bp, Homo sapiens
actggttgtgaataat

SEQ ID NO: 1814922 - DNA, 16 bp, Homo sapiens
actgtactgatactat

SEQ ID NO: 1814923 - DNA, 15 bp, Homo sapiens
actgtatttcattat

SEQ ID NO: 1814924 - DNA, 12 bp, Homo sapiens
actgtcctgctc

SEQ ID NO: 1814925 - DNA, 16 bp, Homo sapiens
actgtcctgctccaca

SEQ ID NO: 1814926 - DNA, 17 bp, Homo sapiens
actgtcctgctccacag

SEQ ID NO: 1814927 - DNA, 18 bp, Homo sapiens
actgtcctgctccacagt

SEQ ID NO: 1814928 - DNA, 12 bp, Homo sapiens
actgtgaactat

SEQ ID NO: 1814929 - DNA, 15 bp, Homo sapiens
actgtgagactgtat

SEQ ID NO: 1814930 - DNA, 16 bp, Homo sapiens
actgtgagactgtatg

SEQ ID NO: 1814931 - DNA, 20 bp, Homo sapiens
actgttcatgaatacgtaaa

SEQ ID NO: 1814932 - DNA, 21 bp, Homo sapiens
actgtttcactaatacttact

SEQ ID NO: 1814933 - DNA, 15 bp, Homo sapiens
acttacacttggagc

SEQ ID NO: 1814934 - DNA, 12 bp, Homo sapiens
acttagaaggat

SEQ ID NO: 1814935 - DNA, 21 bp, Homo sapiens
acttattaacaactgtgaata

SEQ ID NO: 1814936 - DNA, 13 bp, Homo sapiens
acttatttccatg

SEQ ID NO: 1814937 - DNA, 16 bp, Homo sapiens
acttcactaccaaatg

SEQ ID NO: 1814938 - DNA, 14 bp, Homo sapiens
acttcagatttcaa

SEQ ID NO: 1814939 - DNA, 19 bp, Homo sapiens
acttcagatttcaaattaa

SEQ ID NO: 1814940 - DNA, 17 bp, Homo sapiens
acttcaggggctgcccg

SEQ ID NO: 1814941 - DNA, 22 bp, Homo sapiens
acttcaggggctgcccgctccc

SEQ ID NO: 1814942 - DNA, 17 bp, Homo sapiens
acttcccctcctacccc

SEQ ID NO: 1814943 - DNA, 18 bp, Homo sapiens
acttcctggggccccgct

SEQ ID NO: 1814944 - DNA, 17 bp, Homo sapiens
acttctggaaggctggc

SEQ ID NO: 1814945 - DNA, 19 bp, Homo sapiens
acttctggaaggctggctg

SEQ ID NO: 1814946 - DNA, 21 bp, Homo sapiens
acttctggaaggctggctgag

SEQ ID NO: 1814947 - DNA, 17 bp, Homo sapiens
acttcttaaaggcctgg

SEQ ID NO: 1814948 - DNA, 18 bp, Homo sapiens
acttcttaaaggcctgga

SEQ ID NO: 1814949 - DNA, 17 bp, Homo sapiens
acttctttgcagagcct

SEQ ID NO: 1814950 - DNA, 16 bp, Homo sapiens
acttgaatttagtttt

SEQ ID NO: 1814951 - DNA, 16 bp, Homo sapiens
acttgaggacacatgt

SEQ ID NO: 1814952 - DNA, 18 bp, Homo sapiens
acttgcgtcctgcagagg

SEQ ID NO: 1814953 - DNA, 13 bp, Homo sapiens
acttgctgaaaaa

SEQ ID NO: 1814954 - DNA, 18 bp, Homo sapiens
acttgcttctaaatgccc

SEQ ID NO: 1814955 - DNA, 14 bp, Homo sapiens
acttggagcccgtg

SEQ ID NO: 1814956 - DNA, 16 bp, Homo sapiens
acttgtctgaggcctc

SEQ ID NO: 1814957 - DNA, 12 bp, Homo sapiens
actttatatgaa

SEQ ID NO: 1814958 - DNA, 16 bp, Homo sapiens
actttatatgaagtat

SEQ ID NO: 1814959 - DNA, 14 bp, Homo sapiens
actttcctttgcac

SEQ ID NO: 1814960 - DNA, 22 bp, Homo sapiens
actttcctttgcaccatgtgaa

SEQ ID NO: 1814961 - DNA, 22 bp, Homo sapiens
actttgccaaggctctcccctc

SEQ ID NO: 1814962 - DNA, 15 bp, Homo sapiens
acttttctaaagctc

SEQ ID NO: 1814963 - DNA, 18 bp, Homo sapiens
acttttggcatgaaagtg

SEQ ID NO: 1814964 - DNA, 19 bp, Homo sapiens
acttttggcatgaaagtgc

SEQ ID NO: 1814965 - DNA, 12 bp, Homo sapiens
acttttgtgaaa

SEQ ID NO: 1814966 - DNA, 16 bp, Homo sapiens
actttttccagaattt

SEQ ID NO: 1814967 - DNA, 21 bp, Homo sapiens
agaaaaaaatgattgttttag

SEQ ID NO: 1814968 - DNA, 13 bp, Homo sapiens
agaaaagaccctg

SEQ ID NO: 1814969 - DNA, 14 bp, Homo sapiens
agaaaagaccctga

SEQ ID NO: 1814970 - DNA, 13 bp, Homo sapiens
agaaaataataag

SEQ ID NO: 1814971 - DNA, 15 bp, Homo sapiens
agaaaatgaaaagat

SEQ ID NO: 1814972 - DNA, 17 bp, Homo sapiens
agaaacaaataaactag

SEQ ID NO: 1814973 - DNA, 19 bp, Homo sapiens
agaaactcgatgaatgtgt

SEQ ID NO: 1814974 - DNA, 23 bp, Homo sapiens
agaaagcctcctgccccctgcca

SEQ ID NO: 1814975 - DNA, 23 bp, Homo sapiens
agaaagggaggcccagccgcagg

SEQ ID NO: 1814976 - DNA, 15 bp, Homo sapiens
agaaagtttgaagca

SEQ ID NO: 1814977 - DNA, 19 bp, Homo sapiens
agaaatcacaggggcgggg

SEQ ID NO: 1814978 - DNA, 17 bp, Homo sapiens
agaaatcggttgctgtt

SEQ ID NO: 1814979 - DNA, 20 bp, Homo sapiens
agaaattctcaaaatacgtg

SEQ ID NO: 1814980 - DNA, 20 bp, Homo sapiens
agaaatttttaccaactcta

SEQ ID NO: 1814981 - DNA, 22 bp, Homo sapiens
agaacaagtcacagctgcagct

SEQ ID NO: 1814982 - DNA, 23 bp, Homo sapiens
agaacaagtcacagctgcagctg

SEQ ID NO: 1814983 - DNA, 18 bp, Homo sapiens
agaacagaggcatttaaa

SEQ ID NO: 1814984 - DNA, 13 bp, Homo sapiens
agaacagggatgc

SEQ ID NO: 1814985 - DNA, 14 bp, Homo sapiens
agaactactgataa

SEQ ID NO: 1814986 - DNA, 19 bp, Homo sapiens
agaactgccccatctcctc

SEQ ID NO: 1814987 - DNA, 14 bp, Homo sapiens
agaagaagtgtgtc

SEQ ID NO: 1814988 - DNA, 18 bp, Homo sapiens
agaaggagggcagagcca

SEQ ID NO: 1814989 - DNA, 21 bp, Homo sapiens
agaagtaaactggatactgta

SEQ ID NO: 1814990 - DNA, 12 bp, Homo sapiens
agaagtgtatat

SEQ ID NO: 1814991 - DNA, 13 bp, Homo sapiens
agaagtgtatata

SEQ ID NO: 1814992 - DNA, 22 bp, Homo sapiens
agaataaatccttgggagtcat

SEQ ID NO: 1814993 - DNA, 23 bp, Homo sapiens
agaataatttctcctcatttaat

SEQ ID NO: 1814994 - DNA, 20 bp, Homo sapiens
agaatagatctgatggtgag

SEQ ID NO: 1814995 - DNA, 23 bp, Homo sapiens
agaatagatctgatggtgagctg

SEQ ID NO: 1814996 - DNA, 19 bp, Homo sapiens
agaatgcagattcctgggc

SEQ ID NO: 1814997 - DNA, 22 bp, Homo sapiens
agaatgcagattcctgggcctg

SEQ ID NO: 1814998 - DNA, 18 bp, Homo sapiens
agaatggcctctttgtag

SEQ ID NO: 1814999 - DNA, 15 bp, Homo sapiens
agaatgtcagtatgt

SEQ ID NO: 1815000 - DNA, 20 bp, Homo sapiens
agaatttatagaataatttc

SEQ ID NO: 1815001 - DNA, 19 bp, Homo sapiens
agaattttcaaataaggaa

SEQ ID NO: 1815002 - DNA, 12 bp, Homo sapiens
agacaaagcaaa

SEQ ID NO: 1815003 - DNA, 14 bp, Homo sapiens
agacaagccctggc

SEQ ID NO: 1815004 - DNA, 17 bp, Homo sapiens
agacaagccctggcaac

SEQ ID NO: 1815005 - DNA, 17 bp, Homo sapiens
agacattaatttgtacc

SEQ ID NO: 1815006 - DNA, 21 bp, Homo sapiens
agacatttgctatgagctggg

SEQ ID NO: 1815007 - DNA, 11 bp, Homo sapiens
agaccctgaga

SEQ ID NO: 1815008 - DNA, 18 bp, Homo sapiens
agaccgcttcacccctgc

SEQ ID NO: 1815009 - DNA, 20 bp, Homo sapiens
agaccgcttcacccctgcac

SEQ ID NO: 1815010 - DNA, 21 bp, Homo sapiens
agaccgcttcacccctgcact

SEQ ID NO: 1815011 - DNA, 21 bp, Homo sapiens
agacgtgagtgtgactttttg

SEQ ID NO: 1815012 - DNA, 24 bp, Homo sapiens
agactccagaatctgctgttgcca

SEQ ID NO: 1815013 - DNA, 21 bp, Homo sapiens
agactctttttgtacctggtg

SEQ ID NO: 1815014 - DNA, 17 bp, Homo sapiens
agactgaaagcagcagc

SEQ ID NO: 1815015 - DNA, 19 bp, Homo sapiens
agactggagtgaggcttcc

SEQ ID NO: 1815016 - DNA, 23 bp, Homo sapiens
agactggagtgaggcttccaggc

SEQ ID NO: 1815017 - DNA, 22 bp, Homo sapiens
atgaagtattaaaatgcatatt

SEQ ID NO: 1815018 - DNA, 14 bp, Homo sapiens
atgaattcttcaac

SEQ ID NO: 1815019 - DNA, 21 bp, Homo sapiens
atgactagtgcctagaaagca

SEQ ID NO: 1815020 - DNA, 13 bp, Homo sapiens
atgagaaatacag

SEQ ID NO: 1815021 - DNA, 15 bp, Homo sapiens
atgagaaatacagaa

SEQ ID NO: 1815022 - DNA, 20 bp, Homo sapiens
atgagaaatacagaagaaaa

SEQ ID NO: 1815023 - DNA, 22 bp, Homo sapiens
atgagaaatacagaagaaaata

SEQ ID NO: 1815024 - DNA, 17 bp, Homo sapiens
atgagaacaagtcacag

SEQ ID NO: 1815025 - DNA, 20 bp, Homo sapiens
atgagatttgccagcacagg

SEQ ID NO: 1815026 - DNA, 17 bp, Homo sapiens
atgagtctacctgagca

SEQ ID NO: 1815027 - DNA, 19 bp, Homo sapiens
atgataactgcatttggta

SEQ ID NO: 1815028 - DNA, 14 bp, Homo sapiens
atgattgttttaga

SEQ ID NO: 1815029 - DNA, 13 bp, Homo sapiens
atgatttcagaag

SEQ ID NO: 1815030 - DNA, 15 bp, Homo sapiens
atgattttcttttgt

SEQ ID NO: 1815031 - DNA, 16 bp, Homo sapiens
atgcaatgaaaacaaa

SEQ ID NO: 1815032 - DNA, 18 bp, Homo sapiens
atgcaatgaaaacaaaat

SEQ ID NO: 1815033 - DNA, 22 bp, Homo sapiens
atgcacatcctcattcactaag

SEQ ID NO: 1815034 - DNA, 18 bp, Homo sapiens
atgcagattcctgggcct

SEQ ID NO: 1815035 - DNA, 19 bp, Homo sapiens
atgcagattcctgggcctg

SEQ ID NO: 1815036 - DNA, 18 bp, Homo sapiens
atgccaaagcaaaagaag

SEQ ID NO: 1815037 - DNA, 15 bp, Homo sapiens
atgccacaccaagct

SEQ ID NO: 1815038 - DNA, 17 bp, Homo sapiens
atgccacaccaagctgt

SEQ ID NO: 1815039 - DNA, 21 bp, Homo sapiens
atgccacaccaagctgtgcca

SEQ ID NO: 1815040 - DNA, 14 bp, Homo sapiens
atgccactgccagg

SEQ ID NO: 1815041 - DNA, 15 bp, Homo sapiens
atgccactgccaggc

SEQ ID NO: 1815042 - DNA, 18 bp, Homo sapiens
atgccactgccaggcacc

SEQ ID NO: 1815043 - DNA, 21 bp, Homo sapiens
atgccactgccaggcacctgg

SEQ ID NO: 1815044 - DNA, 12 bp, Homo sapiens
atgcccagttca

SEQ ID NO: 1815045 - DNA, 15 bp, Homo sapiens
atgccccctcgtgcc

SEQ ID NO: 1815046 - DNA, 21 bp, Homo sapiens
atgctattatcccttcttata

SEQ ID NO: 1815047 - DNA, 19 bp, Homo sapiens
atgctattgttgtgggctt

SEQ ID NO: 1815048 - DNA, 18 bp, Homo sapiens
atgctcacttttgtgaaa

SEQ ID NO: 1815049 - DNA, 13 bp, Homo sapiens
atgctctgcccca

SEQ ID NO: 1815050 - DNA, 21 bp, Homo sapiens
atgctctgccccaagccccca

SEQ ID NO: 1815051 - DNA, 22 bp, Homo sapiens
atgctgccccgttccctgtcag

SEQ ID NO: 1815052 - DNA, 24 bp, Homo sapiens
atgctgccccgttccctgtcagag

SEQ ID NO: 1815053 - DNA, 12 bp, Homo sapiens
atgctgccttca

SEQ ID NO: 1815054 - DNA, 22 bp, Homo sapiens
atgctggcctcccaataaagct

SEQ ID NO: 1815055 - DNA, 12 bp, Homo sapiens
atgctgggctgg

SEQ ID NO: 1815056 - DNA, 16 bp, Homo sapiens
atgctgtagctgaaag

SEQ ID NO: 1815057 - DNA, 16 bp, Homo sapiens
atgctttctccttttt

SEQ ID NO: 1815058 - DNA, 18 bp, Homo sapiens
atgctttgtgactattaa

SEQ ID NO: 1815059 - DNA, 13 bp, Homo sapiens
atggaaaagagag

SEQ ID NO: 1815060 - DNA, 23 bp, Homo sapiens
atggaccgggtgggcctggcctg

SEQ ID NO: 1815061 - DNA, 16 bp, Homo sapiens
atggcatcgttgcatt

SEQ ID NO: 1815062 - DNA, 22 bp, Homo sapiens
atggcatttagtaccttcaaat

SEQ ID NO: 1815063 - DNA, 21 bp, Homo sapiens
atggccaagggggtggacgca

SEQ ID NO: 1815064 - DNA, 16 bp, Homo sapiens
atggcctgggggatgt

SEQ ID NO: 1815065 - DNA, 17 bp, Homo sapiens
atggcgtaatgggcctg

SEQ ID NO: 1815066 - DNA, 19 bp, Homo sapiens
atggcgtaatgggcctgcc

SEQ ID NO: 1815067 - DNA, 20 bp, Homo sapiens
atggctcaggcaagcccctc

SEQ ID NO: 1815068 - DNA, 18 bp, Homo sapiens
atgggactgtgcctttgg

SEQ ID NO: 1815069 - DNA, 15 bp, Homo sapiens
atgggagatggtcag

SEQ ID NO: 1815070 - DNA, 19 bp, Homo sapiens
atgggatctatttttgcac

SEQ ID NO: 1815071 - DNA, 22 bp, Homo sapiens
atgggcactgctgggtggccca

SEQ ID NO: 1815072 - DNA, 15 bp, Homo sapiens
atgggcattgggctg

SEQ ID NO: 1815073 - DNA, 21 bp, Homo sapiens
atgggcattgggctgacacct

SEQ ID NO: 1815074 - DNA, 15 bp, Homo sapiens
atgggcctgggcctg

SEQ ID NO: 1815075 - DNA, 13 bp, Homo sapiens
atgggcttggact

SEQ ID NO: 1815076 - DNA, 20 bp, Homo sapiens
atgggcttggacttcctggg

SEQ ID NO: 1815077 - DNA, 19 bp, Homo sapiens
atgggtttgaactcacact

SEQ ID NO: 1815078 - DNA, 16 bp, Homo sapiens
atggtacactgcatct

SEQ ID NO: 1815079 - DNA, 15 bp, Homo sapiens
atggtagactgtgac

SEQ ID NO: 1815080 - DNA, 13 bp, Homo sapiens
atggtgagctggg

SEQ ID NO: 1815081 - DNA, 15 bp, Homo sapiens
atgtaaaataagtat

SEQ ID NO: 1815082 - DNA, 18 bp, Homo sapiens
atgtaatactgaaccact

SEQ ID NO: 1815083 - DNA, 16 bp, Homo sapiens
atgtaatactgtagaa

SEQ ID NO: 1815084 - DNA, 17 bp, Homo sapiens
atgtaatactgtagaaa

SEQ ID NO: 1815085 - DNA, 17 bp, Homo sapiens
atgtatataaacatgct

SEQ ID NO: 1815086 - DNA, 13 bp, Homo sapiens
atgtatatgtata

SEQ ID NO: 1815087 - DNA, 18 bp, Homo sapiens
atgtatatgtatatctat

SEQ ID NO: 1815088 - DNA, 19 bp, Homo sapiens
atgtatatgtatatctata

SEQ ID NO: 1815089 - DNA, 14 bp, Homo sapiens
atgtcagtatgtgg

SEQ ID NO: 1815090 - DNA, 19 bp, Homo sapiens
atgtgagtttcagaaattc

SEQ ID NO: 1815091 - DNA, 22 bp, Homo sapiens
atgtgcctgcaccaggagacag

SEQ ID NO: 1815092 - DNA, 16 bp, Homo sapiens
atgtgctgctgtggca

SEQ ID NO: 1815093 - DNA, 14 bp, Homo sapiens
atgtggatctgggg

SEQ ID NO: 1815094 - DNA, 11 bp, Homo sapiens
atgtggctgaa

SEQ ID NO: 1815095 - DNA, 17 bp, Homo sapiens
atgtgggggtctgtgtg

SEQ ID NO: 1815096 - DNA, 14 bp, Homo sapiens
atgtgtcatgtaat

SEQ ID NO: 1815097 - DNA, 17 bp, Homo sapiens
atgtgtcatgtaatact

SEQ ID NO: 1815098 - DNA, 17 bp, Homo sapiens
atgtgtgcctgtggcag

SEQ ID NO: 1815099 - DNA, 15 bp, Homo sapiens
atgttattggaattt

SEQ ID NO: 1815100 - DNA, 12 bp, Homo sapiens
atgttccctgca

SEQ ID NO: 1815101 - DNA, 14 bp, Homo sapiens
atgttccctgcacc

SEQ ID NO: 1815102 - DNA, 15 bp, Homo sapiens
atgttcccttgacca

SEQ ID NO: 1815103 - DNA, 23 bp, Homo sapiens
atgttcccttgaccattggctgc

SEQ ID NO: 1815104 - DNA, 17 bp, Homo sapiens
atgtttacagaggacag

SEQ ID NO: 1815105 - DNA, 14 bp, Homo sapiens
atgtttatctgaca

SEQ ID NO: 1815106 - DNA, 15 bp, Homo sapiens
atgtttctatttcca

SEQ ID NO: 1815107 - DNA, 22 bp, Homo sapiens
attaaaatgtaggaagaaaaat

SEQ ID NO: 1815108 - DNA, 21 bp, Homo sapiens
attaaataacagtgtgtgacc

SEQ ID NO: 1815109 - DNA, 13 bp, Homo sapiens
attaaatgttgca

SEQ ID NO: 1815110 - DNA, 16 bp, Homo sapiens
attaaatgttgcacat

SEQ ID NO: 1815111 - DNA, 19 bp, Homo sapiens
agtcaactggctggccagt

SEQ ID NO: 1815112 - DNA, 16 bp, Homo sapiens
agtcaagaaaaatata

SEQ ID NO: 1815113 - DNA, 17 bp, Homo sapiens
agtcaagaaaaatataa

SEQ ID NO: 1815114 - DNA, 20 bp, Homo sapiens
agtcaagaaaaatataaaaa

SEQ ID NO: 1815115 - DNA, 23 bp, Homo sapiens
agtcaagaaaaatataaaaacaa

SEQ ID NO: 1815116 - DNA, 17 bp, Homo sapiens
agtcacaaaataaagct

SEQ ID NO: 1815117 - DNA, 20 bp, Homo sapiens
agtcacaaaataaagctgtg

SEQ ID NO: 1815118 - DNA, 23 bp, Homo sapiens
agtcacaaaataaagctgtgaca

SEQ ID NO: 1815119 - DNA, 13 bp, Homo sapiens
agtcacagctgca

SEQ ID NO: 1815120 - DNA, 15 bp, Homo sapiens
agtcacagctgcagc

SEQ ID NO: 1815121 - DNA, 18 bp, Homo sapiens
agtcacagctgcagctgg

SEQ ID NO: 1815122 - DNA, 20 bp, Homo sapiens
agtcacagctgcagctgggc

SEQ ID NO: 1815123 - DNA, 21 bp, Homo sapiens
agtcacagctgcagctgggcc

SEQ ID NO: 1815124 - DNA, 15 bp, Homo sapiens
agtcacctgcaagcc

SEQ ID NO: 1815125 - DNA, 23 bp, Homo sapiens
agtcacttccttcagcatctcac

SEQ ID NO: 1815126 - DNA, 21 bp, Homo sapiens
agtcagtaggtccaagggcca

SEQ ID NO: 1815127 - DNA, 21 bp, Homo sapiens
agtcagttcccggagcacagc

SEQ ID NO: 1815128 - DNA, 15 bp, Homo sapiens
agtcatgactagtgc

SEQ ID NO: 1815129 - DNA, 15 bp, Homo sapiens
agtccccagcccttc

SEQ ID NO: 1815130 - DNA, 19 bp, Homo sapiens
agtcctctccacctagtgg

SEQ ID NO: 1815131 - DNA, 22 bp, Homo sapiens
agtccttcagtgagcccctccc

SEQ ID NO: 1815132 - DNA, 17 bp, Homo sapiens
agtcgcaggatccgctg

SEQ ID NO: 1815133 - DNA, 23 bp, Homo sapiens
agtcgcaggatccgctgccacca

SEQ ID NO: 1815134 - DNA, 14 bp, Homo sapiens
agtcgcgctgcctg

SEQ ID NO: 1815135 - DNA, 17 bp, Homo sapiens
agtcgcgctgcctgtgt

SEQ ID NO: 1815136 - DNA, 20 bp, Homo sapiens
agtctaaacaatgaattctt

SEQ ID NO: 1815137 - DNA, 18 bp, Homo sapiens
agtctacctgagcattca

SEQ ID NO: 1815138 - DNA, 21 bp, Homo sapiens
agtctatcaacattgaatatc

SEQ ID NO: 1815139 - DNA, 17 bp, Homo sapiens
agtctcaaatttttcat

SEQ ID NO: 1815140 - DNA, 21 bp, Homo sapiens
agtctcagtacacttcctgtg

SEQ ID NO: 1815141 - DNA, 20 bp, Homo sapiens
atatatcaggtaaaatattt

SEQ ID NO: 1815142 - DNA, 13 bp, Homo sapiens
atatatcataaag

SEQ ID NO: 1815143 - DNA, 16 bp, Homo sapiens
atatatcataaagtat

SEQ ID NO: 1815144 - DNA, 12 bp, Homo sapiens
atatatgtatat

SEQ ID NO: 1815145 - DNA, 16 bp, Homo sapiens
atatatgtatatgtat

SEQ ID NO: 1815146 - DNA, 23 bp, Homo sapiens
atatattctacacatatatgtat

SEQ ID NO: 1815147 - DNA, 15 bp, Homo sapiens
atatcagagctggga

SEQ ID NO: 1815148 - DNA, 16 bp, Homo sapiens
atatcagttgacagaa

SEQ ID NO: 1815149 - DNA, 13 bp, Homo sapiens
atatcataaagta

SEQ ID NO: 1815150 - DNA, 22 bp, Homo sapiens
atatcattactaacttcttcca

SEQ ID NO: 1815151 - DNA, 21 bp, Homo sapiens
atatctattattataaaaata

SEQ ID NO: 1815152 - DNA, 17 bp, Homo sapiens
atatctctaaactgctg

SEQ ID NO: 1815153 - DNA, 18 bp, Homo sapiens
atatctgagaattgcaaa

SEQ ID NO: 1815154 - DNA, 17 bp, Homo sapiens
atatgagaaatacagaa

SEQ ID NO: 1815155 - DNA, 18 bp, Homo sapiens
atatgagaaatacagaag

SEQ ID NO: 1815156 - DNA, 18 bp, Homo sapiens
atatgagagaactattgt

SEQ ID NO: 1815157 - DNA, 15 bp, Homo sapiens
atatgatactgatgc

SEQ ID NO: 1815158 - DNA, 17 bp, Homo sapiens
atatggagcatttttca

SEQ ID NO: 1815159 - DNA, 19 bp, Homo sapiens
atatggagcatttttcaga

SEQ ID NO: 1815160 - DNA, 20 bp, Homo sapiens
atatggagcatttttcagag

SEQ ID NO: 1815161 - DNA, 22 bp, Homo sapiens
atatgtatatctatatctctaa

SEQ ID NO: 1815162 - DNA, 12 bp, Homo sapiens
atatgtatatgt

SEQ ID NO: 1815163 - DNA, 21 bp, Homo sapiens
atattaaagactaactaaaat

SEQ ID NO: 1815164 - DNA, 14 bp, Homo sapiens
atattagcaaagaa

SEQ ID NO: 1815165 - DNA, 24 bp, Homo sapiens
atattatataacccactgctgaaa

SEQ ID NO: 1815166 - DNA, 13 bp, Homo sapiens
atattcaataaag

SEQ ID NO: 1815167 - DNA, 15 bp, Homo sapiens
atattcaataaagct

SEQ ID NO: 1815168 - DNA, 21 bp, Homo sapiens
atattccgggtgccattccca

SEQ ID NO: 1815169 - DNA, 21 bp, Homo sapiens
atattcctctaaaactctcaa

SEQ ID NO: 1815170 - DNA, 14 bp, Homo sapiens
atattgattttaaa

SEQ ID NO: 1815171 - DNA, 15 bp, Homo sapiens
atattgttataaata

SEQ ID NO: 1815172 - DNA, 18 bp, Homo sapiens
atattttaaaaaatcaaa

SEQ ID NO: 1815173 - DNA, 17 bp, Homo sapiens
atatttttcaaaatcaa

SEQ ID NO: 1815174 - DNA, 18 bp, Homo sapiens
atcaaaaggcactgtgaa

SEQ ID NO: 1815175 - DNA, 13 bp, Homo sapiens
atcaatcaaatat

SEQ ID NO: 1815176 - DNA, 15 bp, Homo sapiens
atcaatcaaatattt

SEQ ID NO: 1815177 - DNA, 12 bp, Homo sapiens
atcacaggggcg

SEQ ID NO: 1815178 - DNA, 21 bp, Homo sapiens
atcactagtcaagaaaaatat

SEQ ID NO: 1815179 - DNA, 12 bp, Homo sapiens
atcactccctgg

SEQ ID NO: 1815180 - DNA, 13 bp, Homo sapiens
atcactccctgga

SEQ ID NO: 1815181 - DNA, 14 bp, Homo sapiens
atcactccctggat

SEQ ID NO: 1815182 - DNA, 16 bp, Homo sapiens
atcactccctggatgt

SEQ ID NO: 1815183 - DNA, 13 bp, Homo sapiens
atcaggcactggt

SEQ ID NO: 1815184 - DNA, 17 bp, Homo sapiens
atcagtgacttctgaat

SEQ ID NO: 1815185 - DNA, 13 bp, Homo sapiens
atcagtgtgcccc

SEQ ID NO: 1815186 - DNA, 12 bp, Homo sapiens
atcataaagtat

SEQ ID NO: 1815187 - DNA, 18 bp, Homo sapiens
atcatgtttacagaggac

SEQ ID NO: 1815188 - DNA, 20 bp, Homo sapiens
atcattatcagcctgtgcca

SEQ ID NO: 1815189 - DNA, 15 bp, Homo sapiens
atcatttctttagag

SEQ ID NO: 1815190 - DNA, 15 bp, Homo sapiens
atccacccagtgctg

SEQ ID NO: 1815191 - DNA, 22 bp, Homo sapiens
atccacccagtgctgccatgcc

SEQ ID NO: 1815192 - DNA, 13 bp, Homo sapiens
atccagcctgtgt

SEQ ID NO: 1815193 - DNA, 11 bp, Homo sapiens
atccatcctgc

SEQ ID NO: 1815194 - DNA, 17 bp, Homo sapiens
atccatgtgctgctgtg

SEQ ID NO: 1815195 - DNA, 19 bp, Homo sapiens
atccatgtgctgctgtggc

SEQ ID NO: 1815196 - DNA, 15 bp, Homo sapiens
atcccctccctgcct

SEQ ID NO: 1815197 - DNA, 20 bp, Homo sapiens
atcccctccctgcctgctcc

SEQ ID NO: 1815198 - DNA, 20 bp, Homo sapiens
atcccctcgtcctgtcccag

SEQ ID NO: 1815199 - DNA, 14 bp, Homo sapiens
atcccggcctcttc

SEQ ID NO: 1815200 - DNA, 12 bp, Homo sapiens
atccgctgccac

SEQ ID NO: 1815201 - DNA, 20 bp, Homo sapiens
atcctgcaggaacgagcact

SEQ ID NO: 1815202 - DNA, 13 bp, Homo sapiens
atcctgctttgat

SEQ ID NO: 1815203 - DNA, 12 bp, Homo sapiens
atcctggcccat

SEQ ID NO: 1815204 - DNA, 22 bp, Homo sapiens
atccttagaatggcctctttgt

SEQ ID NO: 1815205 - DNA, 23 bp, Homo sapiens
atccttagaatggcctctttgta

SEQ ID NO: 1815206 - DNA, 12 bp, Homo sapiens
atccttatgaga

SEQ ID NO: 1815207 - DNA, 14 bp, Homo sapiens
atcgcttgagccca

SEQ ID NO: 1815208 - DNA, 15 bp, Homo sapiens
atcgcttgagcccag

SEQ ID NO: 1815209 - DNA, 19 bp, Homo sapiens
atcgcttgagcccaggagt

SEQ ID NO: 1815210 - DNA, 21 bp, Homo sapiens
atcgtattctaattcttcatt

SEQ ID NO: 1815211 - DNA, 19 bp, Homo sapiens
atcgtgacccttcagggcc

SEQ ID NO: 1815212 - DNA, 22 bp, Homo sapiens
atcgtgacccttcagggccaga

SEQ ID NO: 1815213 - DNA, 19 bp, Homo sapiens
atctactagaaccttctaa

SEQ ID NO: 1815214 - DNA, 19 bp, Homo sapiens
atctagaaaatgaaaagat

SEQ ID NO: 1815215 - DNA, 22 bp, Homo sapiens
atctatagttatacatcttcat

SEQ ID NO: 1815216 - DNA, 20 bp, Homo sapiens
atctcaagatgtttatctga

SEQ ID NO: 1815217 - DNA, 14 bp, Homo sapiens
atctcacttcttct

SEQ ID NO: 1815218 - DNA, 16 bp, Homo sapiens
atctcaggtgccactc

SEQ ID NO: 1815219 - DNA, 15 bp, Homo sapiens
atctcatgacattat

SEQ ID NO: 1815220 - DNA, 17 bp, Homo sapiens
atctccccaggcctcca

SEQ ID NO: 1815221 - DNA, 19 bp, Homo sapiens
atctccccaggcctccagc

SEQ ID NO: 1815222 - DNA, 21 bp, Homo sapiens
atctccccaggcctccagcct

SEQ ID NO: 1815223 - DNA, 13 bp, Homo sapiens
atctcgctagcca

SEQ ID NO: 1815224 - DNA, 13 bp, Homo sapiens
atctcttcaatca

SEQ ID NO: 1815225 - DNA, 20 bp, Homo sapiens
atctgacagtctcaaatttt

SEQ ID NO: 1815226 - DNA, 23 bp, Homo sapiens
atctgacagtctcaaatttttca

SEQ ID NO: 1815227 - DNA, 17 bp, Homo sapiens
atctgagaagtgtatat

SEQ ID NO: 1815228 - DNA, 18 bp, Homo sapiens
atctgagaagtgtatata

SEQ ID NO: 1815229 - DNA, 16 bp, Homo sapiens
atctgatggtgagctg

SEQ ID NO: 1815230 - DNA, 11 bp, Homo sapiens
atctgcctggc

SEQ ID NO: 1815231 - DNA, 12 bp, Homo sapiens
atctgcctggcc

SEQ ID NO: 1815232 - DNA, 13 bp, Homo sapiens
caataattcatca

SEQ ID NO: 1815233 - DNA, 15 bp, Homo sapiens
caataattcatcaag

SEQ ID NO: 1815234 - DNA, 23 bp, Homo sapiens
caataccccaagtccacctgcct

SEQ ID NO: 1815235 - DNA, 15 bp, Homo sapiens
caatatcattactaa

SEQ ID NO: 1815236 - DNA, 16 bp, Homo sapiens
caatattcaataaagc

SEQ ID NO: 1815237 - DNA, 14 bp, Homo sapiens
caatcaagcaaaat

SEQ ID NO: 1815238 - DNA, 18 bp, Homo sapiens
caatcactagtcaagaaa

SEQ ID NO: 1815239 - DNA, 24 bp, Homo sapiens
caatctatagttatacatcttcat

SEQ ID NO: 1815240 - DNA, 12 bp, Homo sapiens
caatctccaggg

SEQ ID NO: 1815241 - DNA, 19 bp, Homo sapiens
caatctccagggctgcccc

SEQ ID NO: 1815242 - DNA, 15 bp, Homo sapiens
caatgaaaacaaaat

SEQ ID NO: 1815243 - DNA, 22 bp, Homo sapiens
caatgcaaaagccaagaaagta

SEQ ID NO: 1815244 - DNA, 16 bp, Homo sapiens
caatgcctataaaatg

SEQ ID NO: 1815245 - DNA, 14 bp, Homo sapiens
caatggcagctaga

SEQ ID NO: 1815246 - DNA, 19 bp, Homo sapiens
caatggcagctagactgga

SEQ ID NO: 1815247 - DNA, 20 bp, Homo sapiens
caatggcagctagactggag

SEQ ID NO: 1815248 - DNA, 23 bp, Homo sapiens
caatgttgcatttatgatgcagt

SEQ ID NO: 1815249 - DNA, 12 bp, Homo sapiens
caattcaatgca

SEQ ID NO: 1815250 - DNA, 15 bp, Homo sapiens
caattcaatgcaatg

SEQ ID NO: 1815251 - DNA, 19 bp, Homo sapiens
caattcaatgcaatgaaaa

SEQ ID NO: 1815252 - DNA, 22 bp, Homo sapiens
caattcaatgcaatgaaaacaa

SEQ ID NO: 1815253 - DNA, 21 bp, Homo sapiens
caattcattgttaaaaaacaa

SEQ ID NO: 1815254 - DNA, 19 bp, Homo sapiens
caattgtgggatgtcctct

SEQ ID NO: 1815255 - DNA, 18 bp, Homo sapiens
cacaaatcaaagcaaggg

SEQ ID NO: 1815256 - DNA, 17 bp, Homo sapiens
cacaacagatttctaag

SEQ ID NO: 1815257 - DNA, 18 bp, Homo sapiens
cacaacagatttctaagt

SEQ ID NO: 1815258 - DNA, 16 bp, Homo sapiens
cacaagtctaaacaat

SEQ ID NO: 1815259 - DNA, 18 bp, Homo sapiens
cacaagtctaaacaatga

SEQ ID NO: 1815260 - DNA, 14 bp, Homo sapiens
cacaagtgtattat

SEQ ID NO: 1815261 - DNA, 18 bp, Homo sapiens
cacaccaagctgtgccac

SEQ ID NO: 1815262 - DNA, 12 bp, Homo sapiens
cacactcagcag

SEQ ID NO: 1815263 - DNA, 18 bp, Homo sapiens
cacagacttctggaaggc

SEQ ID NO: 1815264 - DNA, 21 bp, Homo sapiens
cacagacttctggaaggctgg

SEQ ID NO: 1815265 - DNA, 23 bp, Homo sapiens
cacagacttctggaaggctggct

SEQ ID NO: 1815266 - DNA, 16 bp, Homo sapiens
cacagcccacgtcctg

SEQ ID NO: 1815267 - DNA, 13 bp, Homo sapiens
cacagctgcagct

SEQ ID NO: 1815268 - DNA, 15 bp, Homo sapiens
cacagctgcagctgg

SEQ ID NO: 1815269 - DNA, 21 bp, Homo sapiens
cacagctgcagctgggcccca

SEQ ID NO: 1815270 - DNA, 14 bp, Homo sapiens
cacaggggcaggcc

SEQ ID NO: 1815271 - DNA, 15 bp, Homo sapiens
cacaggggccccaga

SEQ ID NO: 1815272 - DNA, 18 bp, Homo sapiens
cacaggggccccagatct

SEQ ID NO: 1815273 - DNA, 15 bp, Homo sapiens
cacaggggcggggca

SEQ ID NO: 1815274 - DNA, 17 bp, Homo sapiens
cacagtcctcacagcct

SEQ ID NO: 1815275 - DNA, 13 bp, Homo sapiens
cacagtgctgctt

SEQ ID NO: 1815276 - DNA, 22 bp, Homo sapiens
cacagtgggtggcacctcctga

SEQ ID NO: 1815277 - DNA, 17 bp, Homo sapiens
cacagtgtctgggctga

SEQ ID NO: 1815278 - DNA, 20 bp, Homo sapiens
cacagtgtctgggctgactg

SEQ ID NO: 1815279 - DNA, 21 bp, Homo sapiens
cacagtgtctgggctgactgg

SEQ ID NO: 1815280 - DNA, 21 bp, Homo sapiens
cacagttgtctattctgagcc

SEQ ID NO: 1815281 - DNA, 23 bp, Homo sapiens
cacagttgtctattctgagcctt

SEQ ID NO: 1815282 - DNA, 24 bp, Homo sapiens
cacagttgtctattctgagccttg

SEQ ID NO: 1815283 - DNA, 19 bp, Homo sapiens
cacatcccggcctcttcca

SEQ ID NO: 1815284 - DNA, 16 bp, Homo sapiens
cacatcctcattcact

SEQ ID NO: 1815285 - DNA, 13 bp, Homo sapiens
cacatgattttct

SEQ ID NO: 1815286 - DNA, 18 bp, Homo sapiens
cacatgattttcttttgt

SEQ ID NO: 1815287 - DNA, 13 bp, Homo sapiens
caccaacccagcc

SEQ ID NO: 1815288 - DNA, 14 bp, Homo sapiens
caccaagctgtgcc

SEQ ID NO: 1815289 - DNA, 15 bp, Homo sapiens
caccacgtctgccag

SEQ ID NO: 1815290 - DNA, 16 bp, Homo sapiens
caccacgtctgccagg

SEQ ID NO: 1815291 - DNA, 17 bp, Homo sapiens
caccacgtctgccaggc

SEQ ID NO: 1815292 - DNA, 19 bp, Homo sapiens
caccacgtctgccaggccc

SEQ ID NO: 1815293 - DNA, 20 bp, Homo sapiens
caccacgtctgccaggccca

SEQ ID NO: 1815294 - DNA, 16 bp, Homo sapiens
caccactgccctgcct

SEQ ID NO: 1815295 - DNA, 17 bp, Homo sapiens
caccactgccctgcctg

SEQ ID NO: 1815296 - DNA, 18 bp, Homo sapiens
caccactgccctgcctgc

SEQ ID NO: 1815297 - DNA, 21 bp, Homo sapiens
caccagaacgcaccccactgg

SEQ ID NO: 1815298 - DNA, 23 bp, Homo sapiens
caccagagtgaaagggctatggc

SEQ ID NO: 1815299 - DNA, 17 bp, Homo sapiens
caccagctctgtggcct

SEQ ID NO: 1815300 - DNA, 12 bp, Homo sapiens
caccagctgctc

SEQ ID NO: 1815301 - DNA, 13 bp, Homo sapiens
caccaggggcagg

SEQ ID NO: 1815302 - DNA, 19 bp, Homo sapiens
caccaggggcaggcacagc

SEQ ID NO: 1815303 - DNA, 20 bp, Homo sapiens
caccagggtccgcaccagct

SEQ ID NO: 1815304 - DNA, 22 bp, Homo sapiens
caccagggtccgcaccagctgc

SEQ ID NO: 1815305 - DNA, 13 bp, Homo sapiens
caccatgtgaagt

SEQ ID NO: 1815306 - DNA, 16 bp, Homo sapiens
cacccagtgctgccat

SEQ ID NO: 1815307 - DNA, 17 bp, Homo sapiens
cacccagtgctgccatg

SEQ ID NO: 1815308 - DNA, 19 bp, Homo sapiens
cacccagtgctgccatgcc

SEQ ID NO: 1815309 - DNA, 15 bp, Homo sapiens
cacccatcttcctgc

SEQ ID NO: 1815310 - DNA, 18 bp, Homo sapiens
cacccatcttcctgctgc

SEQ ID NO: 1815311 - DNA, 19 bp, Homo sapiens
cacccatcttcctgctgct

SEQ ID NO: 1815312 - DNA, 20 bp, Homo sapiens
cacccatcttcctgctgctg

SEQ ID NO: 1815313 - DNA, 21 bp, Homo sapiens
cacccatcttcctgctgctgt

SEQ ID NO: 1815314 - DNA, 14 bp, Homo sapiens
cacccatgccatag

SEQ ID NO: 1815315 - DNA, 22 bp, Homo sapiens
cacccattcccccatgtggctg

SEQ ID NO: 1815316 - DNA, 13 bp, Homo sapiens
caccccaaacccc

SEQ ID NO: 1815317 - DNA, 22 bp, Homo sapiens
cacccccatgctgccttcaggg

SEQ ID NO: 1815318 - DNA, 16 bp, Homo sapiens
caccccggcctccact

SEQ ID NO: 1815319 - DNA, 18 bp, Homo sapiens
caccccggcctccactcc

SEQ ID NO: 1815320 - DNA, 19 bp, Homo sapiens
caccccggcctccactccc

SEQ ID NO: 1815321 - DNA, 11 bp, Homo sapiens
cacccctgcac

SEQ ID NO: 1815322 - DNA, 13 bp, Homo sapiens
cacccgggctcag

SEQ ID NO: 1815323 - DNA, 23 bp, Homo sapiens
cacccgggctcagggaccacagc

SEQ ID NO: 1815324 - DNA, 13 bp, Homo sapiens
caccctcccctcc

SEQ ID NO: 1815325 - DNA, 19 bp, Homo sapiens
caccctcgtggacacctgc

SEQ ID NO: 1815326 - DNA, 19 bp, Homo sapiens
caccctgggctctgtgggc

SEQ ID NO: 1815327 - DNA, 14 bp, Homo sapiens
caccctgggtgcca

SEQ ID NO: 1815328 - DNA, 15 bp, Homo sapiens
caccgaggttcccag

SEQ ID NO: 1815329 - DNA, 18 bp, Homo sapiens
caccgcatgccccctcgt

SEQ ID NO: 1815330 - DNA, 13 bp, Homo sapiens
caccggcgctgca

SEQ ID NO: 1815331 - DNA, 19 bp, Homo sapiens
cacctacttgtgactgaag

SEQ ID NO: 1815332 - DNA, 18 bp, Homo sapiens
cacctagtggctgtccag

SEQ ID NO: 1815333 - DNA, 21 bp, Homo sapiens
cacctagtggctgtccagtgc

SEQ ID NO: 1815334 - DNA, 22 bp, Homo sapiens
cacctagtggctgtccagtgcc

SEQ ID NO: 1815335 - DNA, 20 bp, Homo sapiens
cacctatgagatggccatgc

SEQ ID NO: 1815336 - DNA, 14 bp, Homo sapiens
cacctcctgagaag

SEQ ID NO: 1815337 - DNA, 13 bp, Homo sapiens
cacctctcaatat

SEQ ID NO: 1815338 - DNA, 19 bp, Homo sapiens
cacctgacaatggcagcta

SEQ ID NO: 1815339 - DNA, 21 bp, Homo sapiens
cacctgacaatggcagctaga

SEQ ID NO: 1815340 - DNA, 15 bp, Homo sapiens
cacctgcaagcccca

SEQ ID NO: 1815341 - DNA, 16 bp, Homo sapiens
cacctgcaagccccag

SEQ ID NO: 1815342 - DNA, 19 bp, Homo sapiens
cacctgcaagccccagggc

SEQ ID NO: 1815343 - DNA, 23 bp, Homo sapiens
cacctgcaggttgggccatactg

SEQ ID NO: 1815344 - DNA, 13 bp, Homo sapiens
cacctgccctgcc

SEQ ID NO: 1815345 - DNA, 13 bp, Homo sapiens
cacctggcctgct

SEQ ID NO: 1815346 - DNA, 15 bp, Homo sapiens
cacctggcctgctgg

SEQ ID NO: 1815347 - DNA, 20 bp, Homo sapiens
cacctggtactgcacatttt

SEQ ID NO: 1815348 - DNA, 15 bp, Homo sapiens
cacgagtcacctgca

SEQ ID NO: 1815349 - DNA, 17 bp, Homo sapiens
cacgagtcacctgcaag

SEQ ID NO: 1815350 - DNA, 20 bp, Homo sapiens
attttcttatgtaagtttgc

SEQ ID NO: 1815351 - DNA, 20 bp, Homo sapiens
attttctttcatacattata

SEQ ID NO: 1815352 - DNA, 20 bp, Homo sapiens
attttcttttgttttcttca

SEQ ID NO: 1815353 - DNA, 14 bp, Homo sapiens
attttgaagaaaac

SEQ ID NO: 1815354 - DNA, 14 bp, Homo sapiens
attttgacaaaaat

SEQ ID NO: 1815355 - DNA, 18 bp, Homo sapiens
attttgacaaaaatgttt

SEQ ID NO: 1815356 - DNA, 19 bp, Homo sapiens
attttgacaaaaatgtttg

SEQ ID NO: 1815357 - DNA, 21 bp, Homo sapiens
attttgacaaaaatgtttgta

SEQ ID NO: 1815358 - DNA, 16 bp, Homo sapiens
attttggacgtgtgag

SEQ ID NO: 1815359 - DNA, 15 bp, Homo sapiens
attttgtatgtcaat

SEQ ID NO: 1815360 - DNA, 17 bp, Homo sapiens
attttgtatgtcaataa

SEQ ID NO: 1815361 - DNA, 19 bp, Homo sapiens
atttttaccaactctatac

SEQ ID NO: 1815362 - DNA, 11 bp, Homo sapiens
atttttcaaaa

SEQ ID NO: 1815363 - DNA, 16 bp, Homo sapiens
atttttcaaaatcaaa

SEQ ID NO: 1815364 - DNA, 20 bp, Homo sapiens
atttttcagagttttctaac

SEQ ID NO: 1815365 - DNA, 18 bp, Homo sapiens
atttttgcactggaatat

SEQ ID NO: 1815366 - DNA, 21 bp, Homo sapiens
atttttgcactggaatatctg

SEQ ID NO: 1815367 - DNA, 16 bp, Homo sapiens
atttttgtacattatg

SEQ ID NO: 1815368 - DNA, 19 bp, Homo sapiens
atttttgtacattatgtta

SEQ ID NO: 1815369 - DNA, 14 bp, Homo sapiens
cagagttttctaac

SEQ ID NO: 1815370 - DNA, 20 bp, Homo sapiens
cagatattgttataaataaa

SEQ ID NO: 1815371 - DNA, 15 bp, Homo sapiens
cagatcatctgggga

SEQ ID NO: 1815372 - DNA, 20 bp, Homo sapiens
cagatcatctggggacctgg

SEQ ID NO: 1815373 - DNA, 22 bp, Homo sapiens
cagatctgcctgggcctgtgca

SEQ ID NO: 1815374 - DNA, 14 bp, Homo sapiens
cagattcctgggcc

SEQ ID NO: 1815375 - DNA, 16 bp, Homo sapiens
cagattcctgggcctg

SEQ ID NO: 1815376 - DNA, 23 bp, Homo sapiens
cacgagtcacctgcaagccccag

SEQ ID NO: 1815377 - DNA, 17 bp, Homo sapiens
cacgcaagggcatcagg

SEQ ID NO: 1815378 - DNA, 21 bp, Homo sapiens
cacgcaagggcatcaggcact

SEQ ID NO: 1815379 - DNA, 15 bp, Homo sapiens
cacggtgcgtggctg

SEQ ID NO: 1815380 - DNA, 15 bp, Homo sapiens
cacgtctgccaggcc

SEQ ID NO: 1815381 - DNA, 16 bp, Homo sapiens
cacgtctgccaggccc

SEQ ID NO: 1815382 - DNA, 19 bp, Homo sapiens
cacgtgtggcctgttcttc

SEQ ID NO: 1815383 - DNA, 22 bp, Homo sapiens
cactaagccatgccatgcccag

SEQ ID NO: 1815384 - DNA, 18 bp, Homo sapiens
cactaagctttctccttt

SEQ ID NO: 1815385 - DNA, 19 bp, Homo sapiens
cactaagctttctcctttg

SEQ ID NO: 1815386 - DNA, 16 bp, Homo sapiens
caggcacctggcctgc

SEQ ID NO: 1815387 - DNA, 13 bp, Homo sapiens
caggccactgtgg

SEQ ID NO: 1815388 - DNA, 17 bp, Homo sapiens
caggccactgtggccag

SEQ ID NO: 1815389 - DNA, 20 bp, Homo sapiens
caggccactgtggccagagc

SEQ ID NO: 1815390 - DNA, 21 bp, Homo sapiens
caggccactgtggccagagct

SEQ ID NO: 1815391 - DNA, 22 bp, Homo sapiens
caggccactgtggccagagctg

SEQ ID NO: 1815392 - DNA, 23 bp, Homo sapiens
caggccactgtggccagagctgg

SEQ ID NO: 1815393 - DNA, 20 bp, Homo sapiens
caggcccatctcaggtgcca

SEQ ID NO: 1815394 - DNA, 24 bp, Homo sapiens
caggcccatctcaggtgccactcc

SEQ ID NO: 1815395 - DNA, 13 bp, Homo sapiens
caggcccctgagg

SEQ ID NO: 1815396 - DNA, 14 bp, Homo sapiens
caggcccctgagga

SEQ ID NO: 1815397 - DNA, 14 bp, Homo sapiens
caggccctccatgg

SEQ ID NO: 1815398 - DNA, 14 bp, Homo sapiens
caggccctccctgt

SEQ ID NO: 1815399 - DNA, 17 bp, Homo sapiens
caggccctccctgtctc

SEQ ID NO: 1815400 - DNA, 22 bp, Homo sapiens
caggccctccctgtctccaggg

SEQ ID NO: 1815401 - DNA, 23 bp, Homo sapiens
caggccctccctgtctccagggc

SEQ ID NO: 1815402 - DNA, 14 bp, Homo sapiens
caggccctgcactg

SEQ ID NO: 1815403 - DNA, 15 bp, Homo sapiens
caggccctgcactgt

SEQ ID NO: 1815404 - DNA, 17 bp, Homo sapiens
caggccctgcactgtcc

SEQ ID NO: 1815405 - DNA, 19 bp, Homo sapiens
caggccctgcactgtcctg

SEQ ID NO: 1815406 - DNA, 22 bp, Homo sapiens
caggccctgcactgtcctgctc

SEQ ID NO: 1815407 - DNA, 20 bp, Homo sapiens
caggccgttccccttggctt

SEQ ID NO: 1815408 - DNA, 14 bp, Homo sapiens
caggcctccagcct

SEQ ID NO: 1815409 - DNA, 15 bp, Homo sapiens
caggcctccagcctc

SEQ ID NO: 1815410 - DNA, 16 bp, Homo sapiens
caggcctccagcctct

SEQ ID NO: 1815411 - DNA, 19 bp, Homo sapiens
caggcctccagcctctccc

SEQ ID NO: 1815412 - DNA, 15 bp, Homo sapiens
caggcctgactctca

SEQ ID NO: 1815413 - DNA, 13 bp, Homo sapiens
caggcctgggacc

SEQ ID NO: 1815414 - DNA, 21 bp, Homo sapiens
caggcctgggacccagctact

SEQ ID NO: 1815415 - DNA, 16 bp, Homo sapiens
caggccttgagcacaa

SEQ ID NO: 1815416 - DNA, 15 bp, Homo sapiens
caggcgttggtgcca

SEQ ID NO: 1815417 - DNA, 19 bp, Homo sapiens
caggcgttggtgccacttc

SEQ ID NO: 1815418 - DNA, 20 bp, Homo sapiens
caggcgttggtgccacttct

SEQ ID NO: 1815419 - DNA, 12 bp, Homo sapiens
caggctctgggc

SEQ ID NO: 1815420 - DNA, 14 bp, Homo sapiens
caggctctgggctc

SEQ ID NO: 1815421 - DNA, 18 bp, Homo sapiens
caggctctgggctcaggg

SEQ ID NO: 1815422 - DNA, 21 bp, Homo sapiens
caggctctgggctcagggctg

SEQ ID NO: 1815423 - DNA, 22 bp, Homo sapiens
caggctctgggctcagggctgg

SEQ ID NO: 1815424 - DNA, 13 bp, Homo sapiens
caggctcttcctg

SEQ ID NO: 1815425 - DNA, 20 bp, Homo sapiens
caggctcttcctggacctga

SEQ ID NO: 1815426 - DNA, 22 bp, Homo sapiens
caggctcttcctggacctgagt

SEQ ID NO: 1815427 - DNA, 21 bp, Homo sapiens
caggctgagtccctccatgca

SEQ ID NO: 1815428 - DNA, 14 bp, Homo sapiens
caggctgcactgca

SEQ ID NO: 1815429 - DNA, 14 bp, Homo sapiens
caggctggccagcc

SEQ ID NO: 1815430 - DNA, 16 bp, Homo sapiens
caggctggccagcccc

SEQ ID NO: 1815431 - DNA, 23 bp, Homo sapiens
caggctggccagccccacagccc

SEQ ID NO: 1815432 - DNA, 14 bp, Homo sapiens
cagggaagagggca

SEQ ID NO: 1815433 - DNA, 20 bp, Homo sapiens
cagggaagagggcagtacct

SEQ ID NO: 1815434 - DNA, 14 bp, Homo sapiens
cagggaccacagca

SEQ ID NO: 1815435 - DNA, 15 bp, Homo sapiens
cagggaggagaggaa

SEQ ID NO: 1815436 - DNA, 12 bp, Homo sapiens
cagggagggctt

SEQ ID NO: 1815437 - DNA, 20 bp, Homo sapiens
cagggagggcttggggctgc

SEQ ID NO: 1815438 - DNA, 20 bp, Homo sapiens
cagggcatgggattaaagag

SEQ ID NO: 1815439 - DNA, 11 bp, Homo sapiens
cagggcccctc

SEQ ID NO: 1815440 - DNA, 20 bp, Homo sapiens
cagggctggagtgcgctctt

SEQ ID NO: 1815441 - DNA, 13 bp, Homo sapiens
caggggcaggcac

SEQ ID NO: 1815442 - DNA, 14 bp, Homo sapiens
caggggcaggcaca

SEQ ID NO: 1815443 - DNA, 17 bp, Homo sapiens
caggggcaggcacagca

SEQ ID NO: 1815444 - DNA, 22 bp, Homo sapiens
caggggcaggcacagcacaggg

SEQ ID NO: 1815445 - DNA, 20 bp, Homo sapiens
caggggctgcccgctcccag

SEQ ID NO: 1815446 - DNA, 13 bp, Homo sapiens
cagggtcttgggc

SEQ ID NO: 1815447 - DNA, 14 bp, Homo sapiens
cagggtcttgggct

SEQ ID NO: 1815448 - DNA, 14 bp, Homo sapiens
caggtaaaatattt

SEQ ID NO: 1815449 - DNA, 16 bp, Homo sapiens
caggtacttcctcctg

SEQ ID NO: 1815450 - DNA, 20 bp, Homo sapiens
caggtagatcgcttgagccc

SEQ ID NO: 1815451 - DNA, 21 bp, Homo sapiens
caggtagatcgcttgagccca

SEQ ID NO: 1815452 - DNA, 22 bp, Homo sapiens
caggtagatcgcttgagcccag

SEQ ID NO: 1815453 - DNA, 19 bp, Homo sapiens
caggtgccactccctgagc

SEQ ID NO: 1815454 - DNA, 22 bp, Homo sapiens
caggtgctgacaatactgctgc

SEQ ID NO: 1815455 - DNA, 20 bp, Homo sapiens
caggtgctgctaccctccct

SEQ ID NO: 1815456 - DNA, 21 bp, Homo sapiens
caggtgctgctaccctccctg

SEQ ID NO: 1815457 - DNA, 22 bp, Homo sapiens
caggtggctagcaaattagaaa

SEQ ID NO: 1815458 - DNA, 22 bp, Homo sapiens
caggtggggtgaggcagtgggt

SEQ ID NO: 1815459 - DNA, 13 bp, Homo sapiens
caggtgtggtggc

SEQ ID NO: 1815460 - DNA, 16 bp, Homo sapiens
caggtgtggtggctca

SEQ ID NO: 1815461 - DNA, 12 bp, Homo sapiens
caggtgttcttc

SEQ ID NO: 1815462 - DNA, 16 bp, Homo sapiens
caggttaggaaggcag

SEQ ID NO: 1815463 - DNA, 18 bp, Homo sapiens
caggttaggaaggcagca

SEQ ID NO: 1815464 - DNA, 21 bp, Homo sapiens
cagtaaacatttgtaaaaata

SEQ ID NO: 1815465 - DNA, 18 bp, Homo sapiens
cagtacctgggaaaggac

SEQ ID NO: 1815466 - DNA, 16 bp, Homo sapiens
cagtaggtccaagggc

SEQ ID NO: 1815467 - DNA, 17 bp, Homo sapiens
cagtaggtccaagggcc

SEQ ID NO: 1815468 - DNA, 18 bp, Homo sapiens
cagtaggtccaagggcca

SEQ ID NO: 1815469 - DNA, 19 bp, Homo sapiens
cagtaggtccaagggccat

SEQ ID NO: 1815470 - DNA, 12 bp, Homo sapiens
cagtatcttcaa

SEQ ID NO: 1815471 - DNA, 14 bp, Homo sapiens
cagtatcttcaaaa

SEQ ID NO: 1815472 - DNA, 16 bp, Homo sapiens
cagtcacttccttcag

SEQ ID NO: 1815473 - DNA, 20 bp, Homo sapiens
cagtcctcacagcctctccc

SEQ ID NO: 1815474 - DNA, 13 bp, Homo sapiens
cagtcctctccac

SEQ ID NO: 1815475 - DNA, 22 bp, Homo sapiens
cagtcctctccacctagtggct

SEQ ID NO: 1815476 - DNA, 14 bp, Homo sapiens
cagtcgcaggatcc

SEQ ID NO: 1815477 - DNA, 18 bp, Homo sapiens
cagtcgcgctgcctgtgt

SEQ ID NO: 1815478 - DNA, 20 bp, Homo sapiens
cagtcgcgctgcctgtgtgg

SEQ ID NO: 1815479 - DNA, 22 bp, Homo sapiens
cagtctgaacccttgtgcttgg

SEQ ID NO: 1815480 - DNA, 23 bp, Homo sapiens
cagtctgggtctgggtttggatc

SEQ ID NO: 1815481 - DNA, 13 bp, Homo sapiens
cagtcttgcctag

SEQ ID NO: 1815482 - DNA, 15 bp, Homo sapiens
cagtcttgcctaggc

SEQ ID NO: 1815483 - DNA, 22 bp, Homo sapiens
cagtctttaatctgagaggcca

SEQ ID NO: 1815484 - DNA, 16 bp, Homo sapiens
cagtgactcgggctcc

SEQ ID NO: 1815485 - DNA, 18 bp, Homo sapiens
cagtgactcgggctcctg

SEQ ID NO: 1815486 - DNA, 23 bp, Homo sapiens
cagtgactcgggctcctgtgccc

SEQ ID NO: 1815487 - DNA, 13 bp, Homo sapiens
cagtgactggcag

SEQ ID NO: 1815488 - DNA, 17 bp, Homo sapiens
cagtgactggcaggtgc

SEQ ID NO: 1815489 - DNA, 13 bp, Homo sapiens
cagtgacttctga

SEQ ID NO: 1815490 - DNA, 14 bp, Homo sapiens
cagtgagcccctcc

SEQ ID NO: 1815491 - DNA, 15 bp, Homo sapiens
cagtgagcccctccc

SEQ ID NO: 1815492 - DNA, 12 bp, Homo sapiens
cagtgaggaggg

SEQ ID NO: 1815493 - DNA, 13 bp, Homo sapiens
cagtgaggagggt

SEQ ID NO: 1815494 - DNA, 15 bp, Homo sapiens
cagtgaggagggtgg

SEQ ID NO: 1815495 - DNA, 14 bp, Homo sapiens
cagtgctgccatgc

SEQ ID NO: 1815496 - DNA, 22 bp, Homo sapiens
cagtgctgccatgccactgcca

SEQ ID NO: 1815497 - DNA, 14 bp, Homo sapiens
cagtgctgcttctc

SEQ ID NO: 1815498 - DNA, 18 bp, Homo sapiens
cagtgctgcttctcttgg

SEQ ID NO: 1815499 - DNA, 18 bp, Homo sapiens
cagtggctggatctgtga

SEQ ID NO: 1815500 - DNA, 20 bp, Homo sapiens
cagtggctggatctgtgagg

SEQ ID NO: 1815501 - DNA, 14 bp, Homo sapiens
cagtgggtcccact

SEQ ID NO: 1815502 - DNA, 17 bp, Homo sapiens
cagtgggtcccacttcc

SEQ ID NO: 1815503 - DNA, 18 bp, Homo sapiens
cagtgggtcccacttccc

SEQ ID NO: 1815504 - DNA, 22 bp, Homo sapiens
cagtgggtcccacttcccctcc

SEQ ID NO: 1815505 - DNA, 15 bp, Homo sapiens
ccctccctgctgtcc

SEQ ID NO: 1815506 - DNA, 17 bp, Homo sapiens
ccctccctgctgtcccc

SEQ ID NO: 1815507 - DNA, 18 bp, Homo sapiens
ccctccctgtctccaggg

SEQ ID NO: 1815508 - DNA, 18 bp, Homo sapiens
ccctcctacccctcccag

SEQ ID NO: 1815509 - DNA, 21 bp, Homo sapiens
ccctcctgctgcctaataaag

SEQ ID NO: 1815510 - DNA, 20 bp, Homo sapiens
ccctcgaaccaaggcagcct

SEQ ID NO: 1815511 - DNA, 21 bp, Homo sapiens
ccctcggaagccgtctgactc

SEQ ID NO: 1815512 - DNA, 23 bp, Homo sapiens
ccctcggaagccgtctgactcca

SEQ ID NO: 1815513 - DNA, 14 bp, Homo sapiens
ccctcggacccacc

SEQ ID NO: 1815514 - DNA, 13 bp, Homo sapiens
ccctcgtccacag

SEQ ID NO: 1815515 - DNA, 15 bp, Homo sapiens
ccctcgtccacaggg

SEQ ID NO: 1815516 - DNA, 23 bp, Homo sapiens
ccctcgtccacaggggcaggcct

SEQ ID NO: 1815517 - DNA, 14 bp, Homo sapiens
ccctcgtgccagtc

SEQ ID NO: 1815518 - DNA, 12 bp, Homo sapiens
ccctctgcccca

SEQ ID NO: 1815519 - DNA, 23 bp, Homo sapiens
ccctctgccccaagcagccagcc

SEQ ID NO: 1815520 - DNA, 20 bp, Homo sapiens
ccctctgtcatcactccctg

SEQ ID NO: 1815521 - DNA, 13 bp, Homo sapiens
ccctctgtcctga

SEQ ID NO: 1815522 - DNA, 13 bp, Homo sapiens
ccctcttgcccca

SEQ ID NO: 1815523 - DNA, 18 bp, Homo sapiens
ccctcttgccccaacccc

SEQ ID NO: 1815524 - DNA, 10 bp, Homo sapiens
ccctgagact

SEQ ID NO: 1815525 - DNA, 14 bp, Homo sapiens
ccctgagactccag

SEQ ID NO: 1815526 - DNA, 14 bp, Homo sapiens
ccctgaggactgga

SEQ ID NO: 1815527 - DNA, 10 bp, Homo sapiens
ccctgcactg

SEQ ID NO: 1815528 - DNA, 13 bp, Homo sapiens
ccctgcactgtcc

SEQ ID NO: 1815529 - DNA, 21 bp, Homo sapiens
ccctgcactgtcctgctccac

SEQ ID NO: 1815530 - DNA, 23 bp, Homo sapiens
ccctgcactgtcctgctccacag

SEQ ID NO: 1815531 - DNA, 17 bp, Homo sapiens
ccctgcacttcagacac

SEQ ID NO: 1815532 - DNA, 13 bp, Homo sapiens
ccctgccacctgt

SEQ ID NO: 1815533 - DNA, 14 bp, Homo sapiens
ccctgccacctgtc

SEQ ID NO: 1815534 - DNA, 21 bp, Homo sapiens
ccctgcccccatctccccagg

SEQ ID NO: 1815535 - DNA, 18 bp, Homo sapiens
ccctgccctgccacctgt

SEQ ID NO: 1815536 - DNA, 13 bp, Homo sapiens
ccctgcctgccca

SEQ ID NO: 1815537 - DNA, 15 bp, Homo sapiens
ccctgcctgcccact

SEQ ID NO: 1815538 - DNA, 16 bp, Homo sapiens
ccctgcgttggagcca

SEQ ID NO: 1815539 - DNA, 18 bp, Homo sapiens
ccctgcgttggagccact

SEQ ID NO: 1815540 - DNA, 20 bp, Homo sapiens
ccctgcgttggagccactcc

SEQ ID NO: 1815541 - DNA, 10 bp, Homo sapiens
ccctgctgtc

SEQ ID NO: 1815542 - DNA, 19 bp, Homo sapiens
ccctggaattcagcaccct

SEQ ID NO: 1815543 - DNA, 22 bp, Homo sapiens
ccctggaattcagcaccctggg

SEQ ID NO: 1815544 - DNA, 15 bp, Homo sapiens
ccctggatgggcatt

SEQ ID NO: 1815545 - DNA, 13 bp, Homo sapiens
ccctggatgtgtg

SEQ ID NO: 1815546 - DNA, 19 bp, Homo sapiens
ccctggatgtgtggggcat

SEQ ID NO: 1815547 - DNA, 14 bp, Homo sapiens
ccctggccccgccg

SEQ ID NO: 1815548 - DNA, 14 bp, Homo sapiens
ccctgggtgccatt

SEQ ID NO: 1815549 - DNA, 17 bp, Homo sapiens
cctcgtccacaggggca

SEQ ID NO: 1815550 - DNA, 22 bp, Homo sapiens
cctcgtccacaggggcaggcct

SEQ ID NO: 1815551 - DNA, 23 bp, Homo sapiens
cctcgtccacaggggcaggcctg

SEQ ID NO: 1815552 - DNA, 14 bp, Homo sapiens
cctcgtgccagtcg

SEQ ID NO: 1815553 - DNA, 21 bp, Homo sapiens
cctcgtggacacctgccctgc

SEQ ID NO: 1815554 - DNA, 18 bp, Homo sapiens
cctctcattccagaggaa

SEQ ID NO: 1815555 - DNA, 23 bp, Homo sapiens
cctctccacctagtggctgtcca

SEQ ID NO: 1815556 - DNA, 16 bp, Homo sapiens
cctctcccggctgcct

SEQ ID NO: 1815557 - DNA, 22 bp, Homo sapiens
cctctcccggctgcctgccgcc

SEQ ID NO: 1815558 - DNA, 16 bp, Homo sapiens
cctctccttgggctcc

SEQ ID NO: 1815559 - DNA, 18 bp, Homo sapiens
cctctccttgggctcctg

SEQ ID NO: 1815560 - DNA, 15 bp, Homo sapiens
cctctcgccccatcc

SEQ ID NO: 1815561 - DNA, 22 bp, Homo sapiens
cctctcgccccatccctgcttg

SEQ ID NO: 1815562 - DNA, 16 bp, Homo sapiens
cctctgccccaagcag

SEQ ID NO: 1815563 - DNA, 17 bp, Homo sapiens
cctctgccccaagcagc

SEQ ID NO: 1815564 - DNA, 19 bp, Homo sapiens
cctctgccccaagcagcca

SEQ ID NO: 1815565 - DNA, 23 bp, Homo sapiens
cctctgccccaagcagccagcca

SEQ ID NO: 1815566 - DNA, 22 bp, Homo sapiens
cctctggtaaacattcctccag

SEQ ID NO: 1815567 - DNA, 11 bp, Homo sapiens
cctctgtcctg

SEQ ID NO: 1815568 - DNA, 14 bp, Homo sapiens
cctctgtcctgact

SEQ ID NO: 1815569 - DNA, 17 bp, Homo sapiens
cctctgtgtcactggct

SEQ ID NO: 1815570 - DNA, 18 bp, Homo sapiens
cctctgtgtcactggctg

SEQ ID NO: 1815571 - DNA, 12 bp, Homo sapiens
cctcttgcccca

SEQ ID NO: 1815572 - DNA, 21 bp, Homo sapiens
cctcttgccccaacccccagc

SEQ ID NO: 1815573 - DNA, 23 bp, Homo sapiens
cctcttgccccaacccccagcac

SEQ ID NO: 1815574 - DNA, 15 bp, Homo sapiens
cctctttactccctt

SEQ ID NO: 1815575 - DNA, 22 bp, Homo sapiens
cctctttactcccttcctggcc

SEQ ID NO: 1815576 - DNA, 21 bp, Homo sapiens
cctgaaaacgaaggggccccg

SEQ ID NO: 1815577 - DNA, 19 bp, Homo sapiens
cctgaagagaagggcaggg

SEQ ID NO: 1815578 - DNA, 16 bp, Homo sapiens
cctgaatttgtaagca

SEQ ID NO: 1815579 - DNA, 13 bp, Homo sapiens
cctgacaatggca

SEQ ID NO: 1815580 - DNA, 16 bp, Homo sapiens
cctgacaatggcagct

SEQ ID NO: 1815581 - DNA, 13 bp, Homo sapiens
cctgacgccctgc

SEQ ID NO: 1815582 - DNA, 14 bp, Homo sapiens
cctgacgccctgcg

SEQ ID NO: 1815583 - DNA, 18 bp, Homo sapiens
cctgacgccctgcgttgg

SEQ ID NO: 1815584 - DNA, 19 bp, Homo sapiens
cctgacttcaggggctgcc

SEQ ID NO: 1815585 - DNA, 20 bp, Homo sapiens
cctgacttcaggggctgccc

SEQ ID NO: 1815586 - DNA, 22 bp, Homo sapiens
cctgacttcaggggctgcccgc

SEQ ID NO: 1815587 - DNA, 14 bp, Homo sapiens
cctgagactccaga

SEQ ID NO: 1815588 - DNA, 12 bp, Homo sapiens
cctgagcattca

SEQ ID NO: 1815589 - DNA, 17 bp, Homo sapiens
cctgagcattcaggcag

SEQ ID NO: 1815590 - DNA, 23 bp, Homo sapiens
cctgagcattcaggcagcactga

SEQ ID NO: 1815591 - DNA, 15 bp, Homo sapiens
cctgagctggggcca

SEQ ID NO: 1815592 - DNA, 17 bp, Homo sapiens
cctgagctggggccaca

SEQ ID NO: 1815593 - DNA, 16 bp, Homo sapiens
cctgagctttggggac

SEQ ID NO: 1815594 - DNA, 18 bp, Homo sapiens
cctgagctttggggacag

SEQ ID NO: 1815595 - DNA, 16 bp, Homo sapiens
cctgaggactggagac

SEQ ID NO: 1815596 - DNA, 15 bp, Homo sapiens
cctgagtcggcccca

SEQ ID NO: 1815597 - DNA, 22 bp, Homo sapiens
cctgagtcggccccacatggga

SEQ ID NO: 1815598 - DNA, 13 bp, Homo sapiens
cctgatgctgccc

SEQ ID NO: 1815599 - DNA, 16 bp, Homo sapiens
cctgatgctgccccgt

SEQ ID NO: 1815600 - DNA, 23 bp, Homo sapiens
cctgatgctgccccgttccctgt

SEQ ID NO: 1815601 - DNA, 16 bp, Homo sapiens
cctgatggccaagagc

SEQ ID NO: 1815602 - DNA, 19 bp, Homo sapiens
cctgattcggctgtctcag

SEQ ID NO: 1815603 - DNA, 16 bp, Homo sapiens
cctgcaagccccaggg

SEQ ID NO: 1815604 - DNA, 19 bp, Homo sapiens
cctgcaagccccagggcct

SEQ ID NO: 1815605 - DNA, 23 bp, Homo sapiens
cctgcaagccccagggcctgggg

SEQ ID NO: 1815606 - DNA, 18 bp, Homo sapiens
cctgcaatctccagggct

SEQ ID NO: 1815607 - DNA, 21 bp, Homo sapiens
cctgcaatctccagggctgcc

SEQ ID NO: 1815608 - DNA, 12 bp, Homo sapiens
cctgcacagttt

SEQ ID NO: 1815609 - DNA, 13 bp, Homo sapiens
cctgcaccctgga

SEQ ID NO: 1815610 - DNA, 20 bp, Homo sapiens
cctgcaccctggaaagggga

SEQ ID NO: 1815611 - DNA, 17 bp, Homo sapiens
cctgcaccgccccttct

SEQ ID NO: 1815612 - DNA, 13 bp, Homo sapiens
cctgcactgtcct

SEQ ID NO: 1815613 - DNA, 14 bp, Homo sapiens
cctgcactgtcctg

SEQ ID NO: 1815614 - DNA, 16 bp, Homo sapiens
cctgcactgtcctgct

SEQ ID NO: 1815615 - DNA, 19 bp, Homo sapiens
cctgcactgtcctgctcca

SEQ ID NO: 1815616 - DNA, 20 bp, Homo sapiens
cctgcactgtcctgctccac

SEQ ID NO: 1815617 - DNA, 21 bp, Homo sapiens
cctgcactgtcctgctccaca

SEQ ID NO: 1815618 - DNA, 21 bp, Homo sapiens
cctgcagaggaccacagtggg

SEQ ID NO: 1815619 - DNA, 16 bp, Homo sapiens
cctgcaggaacgagca

SEQ ID NO: 1815620 - DNA, 19 bp, Homo sapiens
cctgcaggaacgagcactg

SEQ ID NO: 1815621 - DNA, 21 bp, Homo sapiens
cctgcaggaacgagcactggc

SEQ ID NO: 1815622 - DNA, 14 bp, Homo sapiens
cctgccagctgcct

SEQ ID NO: 1815623 - DNA, 20 bp, Homo sapiens
cctgccatcatgtttacaga

SEQ ID NO: 1815624 - DNA, 17 bp, Homo sapiens
cctgcccaatgctttgg

SEQ ID NO: 1815625 - DNA, 19 bp, Homo sapiens
cctgcccccatctccccag

SEQ ID NO: 1815626 - DNA, 20 bp, Homo sapiens
cctgcccccatctccccagg

SEQ ID NO: 1815627 - DNA, 18 bp, Homo sapiens
cctgccccctgccagtga

SEQ ID NO: 1815628 - DNA, 22 bp, Homo sapiens
cctgccccgtcggactgccccc

SEQ ID NO: 1815629 - DNA, 11 bp, Homo sapiens
cctgccctgcc

SEQ ID NO: 1815630 - DNA, 14 bp, Homo sapiens
cctgccctgccacc

SEQ ID NO: 1815631 - DNA, 18 bp, Homo sapiens
cctgccctgccacctgtc

SEQ ID NO: 1815632 - DNA, 17 bp, Homo sapiens
cctgcctatccatcctg

SEQ ID NO: 1815633 - DNA, 21 bp, Homo sapiens
cctgcgtcctgacgccctgcg

SEQ ID NO: 1815634 - DNA, 17 bp, Homo sapiens
cctgcgttggagccact

SEQ ID NO: 1815635 - DNA, 15 bp, Homo sapiens
cctgctagagcaacc

SEQ ID NO: 1815636 - DNA, 20 bp, Homo sapiens
cctgctagagcaacccctgt

SEQ ID NO: 1815637 - DNA, 14 bp, Homo sapiens
cctgctccacagtg

SEQ ID NO: 1815638 - DNA, 16 bp, Homo sapiens
cctgctgcaccaaccc

SEQ ID NO: 1815639 - DNA, 22 bp, Homo sapiens
cctgctgcagaggggcaggccc

SEQ ID NO: 1815640 - DNA, 15 bp, Homo sapiens
cctgctgcctaataa

SEQ ID NO: 1815641 - DNA, 23 bp, Homo sapiens
cctgctgctgtaactgctgagcc

SEQ ID NO: 1815642 - DNA, 20 bp, Homo sapiens
cctgctgggaaccccgcagc

SEQ ID NO: 1815643 - DNA, 15 bp, Homo sapiens
cctgctgtcccctct

SEQ ID NO: 1815644 - DNA, 15 bp, Homo sapiens
cctgcttgcccgctc

SEQ ID NO: 1815645 - DNA, 14 bp, Homo sapiens
cctgcttttccagg

SEQ ID NO: 1815646 - DNA, 15 bp, Homo sapiens
cctgcttttccagga

SEQ ID NO: 1815647 - DNA, 16 bp, Homo sapiens
cctgcttttccaggat

SEQ ID NO: 1815648 - DNA, 22 bp, Homo sapiens
cctgcttttccaggatcctgca

SEQ ID NO: 1815649 - DNA, 15 bp, Homo sapiens
cctggaaccagggag

SEQ ID NO: 1815650 - DNA, 20 bp, Homo sapiens
cctggcacagtgtctgggct

SEQ ID NO: 1815651 - DNA, 13 bp, Homo sapiens
cctggcccagctc

SEQ ID NO: 1815652 - DNA, 20 bp, Homo sapiens
cctggcccagctcccccggg

SEQ ID NO: 1815653 - DNA, 17 bp, Homo sapiens
cctggcccatcagtgta

SEQ ID NO: 1815654 - DNA, 20 bp, Homo sapiens
cctggcccccctccaggcat

SEQ ID NO: 1815655 - DNA, 13 bp, Homo sapiens
cctggccctcaag

SEQ ID NO: 1815656 - DNA, 16 bp, Homo sapiens
cctggcctcactggct

SEQ ID NO: 1815657 - DNA, 18 bp, Homo sapiens
cctggcctcactggctgg

SEQ ID NO: 1815658 - DNA, 21 bp, Homo sapiens
cctggcctcactggctggggc

SEQ ID NO: 1815659 - DNA, 22 bp, Homo sapiens
cctggcctcactggctggggca

SEQ ID NO: 1815660 - DNA, 12 bp, Homo sapiens
cctggcctgagc

SEQ ID NO: 1815661 - DNA, 16 bp, Homo sapiens
cctggcctgagctggg

SEQ ID NO: 1815662 - DNA, 22 bp, Homo sapiens
cctggcctgagctggggccaca

SEQ ID NO: 1815663 - DNA, 15 bp, Homo sapiens
ctactctgtccaggc

SEQ ID NO: 1815664 - DNA, 16 bp, Homo sapiens
ctactctgtccaggcc

SEQ ID NO: 1815665 - DNA, 17 bp, Homo sapiens
ctactctgtccaggcca

SEQ ID NO: 1815666 - DNA, 19 bp, Homo sapiens
ctactctgtccaggccact

SEQ ID NO: 1815667 - DNA, 16 bp, Homo sapiens
ctactggcagctcctc

SEQ ID NO: 1815668 - DNA, 14 bp, Homo sapiens
ctactgtatttcat

SEQ ID NO: 1815669 - DNA, 14 bp, Homo sapiens
ctagaaaatgaaaa

SEQ ID NO: 1815670 - DNA, 23 bp, Homo sapiens
ctagaaagaaaagaccctgagac

SEQ ID NO: 1815671 - DNA, 14 bp, Homo sapiens
ctagactttccttt

SEQ ID NO: 1815672 - DNA, 23 bp, Homo sapiens
ctagaggtgggcagctgggcccc

SEQ ID NO: 1815673 - DNA, 23 bp, Homo sapiens
ctagccaaggctagttcctttca

SEQ ID NO: 1815674 - DNA, 13 bp, Homo sapiens
ctagccaggagtc

SEQ ID NO: 1815675 - DNA, 13 bp, Homo sapiens
ctagcccagtgct

SEQ ID NO: 1815676 - DNA, 15 bp, Homo sapiens
ctagctggcaggaca

SEQ ID NO: 1815677 - DNA, 13 bp, Homo sapiens
ctaggactgagga

SEQ ID NO: 1815678 - DNA, 20 bp, Homo sapiens
ctaggagagactgaaagcag

SEQ ID NO: 1815679 - DNA, 21 bp, Homo sapiens
ctaggagagactgaaagcagc

SEQ ID NO: 1815680 - DNA, 20 bp, Homo sapiens
ctaggccaaatgcacaagct

SEQ ID NO: 1815681 - DNA, 15 bp, Homo sapiens
ctagtaataatgtaa

SEQ ID NO: 1815682 - DNA, 16 bp, Homo sapiens
ctagtaataatgtaat

SEQ ID NO: 1815683 - DNA, 22 bp, Homo sapiens
ctagtaataatgtaatactgta

SEQ ID NO: 1815684 - DNA, 22 bp, Homo sapiens
ctagtactctctgctctagcca

SEQ ID NO: 1815685 - DNA, 15 bp, Homo sapiens
ctagtcaagaaaaat

SEQ ID NO: 1815686 - DNA, 15 bp, Homo sapiens
ctagtgcctagaaag

SEQ ID NO: 1815687 - DNA, 14 bp, Homo sapiens
ctagtggctgtcca

SEQ ID NO: 1815688 - DNA, 20 bp, Homo sapiens
ctagtggctgtccagtgccc

SEQ ID NO: 1815689 - DNA, 20 bp, Homo sapiens
ctagtgtgagtggcagccat

SEQ ID NO: 1815690 - DNA, 21 bp, Homo sapiens
ctagttgattgcgagaatttt

SEQ ID NO: 1815691 - DNA, 23 bp, Homo sapiens
ctagttgattgcgagaattttca

SEQ ID NO: 1815692 - DNA, 16 bp, Homo sapiens
ctataaaatgcccatt

SEQ ID NO: 1815693 - DNA, 16 bp, Homo sapiens
ctatacctatgtgaaa

SEQ ID NO: 1815694 - DNA, 20 bp, Homo sapiens
ctatattccgggtgccattc

SEQ ID NO: 1815695 - DNA, 12 bp, Homo sapiens
ctatcagtgtgc

SEQ ID NO: 1815696 - DNA, 17 bp, Homo sapiens
ctatcagtgtgcccccc

SEQ ID NO: 1815697 - DNA, 18 bp, Homo sapiens
ctatcagtgtgcccccca

SEQ ID NO: 1815698 - DNA, 21 bp, Homo sapiens
ctatcagtgtgccccccatcc

SEQ ID NO: 1815699 - DNA, 14 bp, Homo sapiens
ctatccatcctgcg

SEQ ID NO: 1815700 - DNA, 21 bp, Homo sapiens
ctatgagaacaagtcacagct

SEQ ID NO: 1815701 - DNA, 19 bp, Homo sapiens
ctatggggatagatgtgtg

SEQ ID NO: 1815702 - DNA, 18 bp, Homo sapiens
ctatgtgaaactctatta

SEQ ID NO: 1815703 - DNA, 23 bp, Homo sapiens
ctattcaatgcaatgcaattcaa

SEQ ID NO: 1815704 - DNA, 17 bp, Homo sapiens
ctattttgaagaaaaca

SEQ ID NO: 1815705 - DNA, 22 bp, Homo sapiens
ctatttttattttcttatgtaa

SEQ ID NO: 1815706 - DNA, 14 bp, Homo sapiens
ctcaaaatacgtgt

SEQ ID NO: 1815707 - DNA, 20 bp, Homo sapiens
ctcaaactcctggactcatg

SEQ ID NO: 1815708 - DNA, 17 bp, Homo sapiens
ctcaaatttttcatctc

SEQ ID NO: 1815709 - DNA, 16 bp, Homo sapiens
ctcaacccccctccca

SEQ ID NO: 1815710 - DNA, 21 bp, Homo sapiens
ctcaacccccctcccagacag

SEQ ID NO: 1815711 - DNA, 22 bp, Homo sapiens
ctcaacccccctcccagacagg

SEQ ID NO: 1815712 - DNA, 14 bp, Homo sapiens
ctcaaggcctccag

SEQ ID NO: 1815713 - DNA, 17 bp, Homo sapiens
ctcaaggcctcccacag

SEQ ID NO: 1815714 - DNA, 19 bp, Homo sapiens
ctcaaggcctcccacagtg

SEQ ID NO: 1815715 - DNA, 20 bp, Homo sapiens
ctcaatcaagcaaaatttct

SEQ ID NO: 1815716 - DNA, 15 bp, Homo sapiens
ctcacactactgtat

SEQ ID NO: 1815717 - DNA, 19 bp, Homo sapiens
ctcacactactgtatttca

SEQ ID NO: 1815718 - DNA, 14 bp, Homo sapiens
ctcacagcctctcc

SEQ ID NO: 1815719 - DNA, 15 bp, Homo sapiens
ctcacagcctctccc

SEQ ID NO: 1815720 - DNA, 13 bp, Homo sapiens
ctcaccaggggca

SEQ ID NO: 1815721 - DNA, 15 bp, Homo sapiens
ctcaccaggggcagg

SEQ ID NO: 1815722 - DNA, 21 bp, Homo sapiens
ctcaccagggtccgcaccagc

SEQ ID NO: 1815723 - DNA, 12 bp, Homo sapiens
ctcacctgacct

SEQ ID NO: 1815724 - DNA, 17 bp, Homo sapiens
ctcacctggttgaccca

SEQ ID NO: 1815725 - DNA, 15 bp, Homo sapiens
ctcacttatctgata

SEQ ID NO: 1815726 - DNA, 13 bp, Homo sapiens
ctcagaaaactta

SEQ ID NO: 1815727 - DNA, 18 bp, Homo sapiens
ctcagcaaggggctctgc

SEQ ID NO: 1815728 - DNA, 16 bp, Homo sapiens
ctcaggacccaggccc

SEQ ID NO: 1815729 - DNA, 17 bp, Homo sapiens
ctcaggacccaggccct

SEQ ID NO: 1815730 - DNA, 15 bp, Homo sapiens
ctcaggcaagcccct

SEQ ID NO: 1815731 - DNA, 16 bp, Homo sapiens
ctcaggcaagcccctc

SEQ ID NO: 1815732 - DNA, 23 bp, Homo sapiens
ctccagcctctcccggctgcctg

SEQ ID NO: 1815733 - DNA, 15 bp, Homo sapiens
ctccaggcatgctgg

SEQ ID NO: 1815734 - DNA, 23 bp, Homo sapiens
ctccaggcatgctggcctcccaa

SEQ ID NO: 1815735 - DNA, 15 bp, Homo sapiens
ctccagggcccccac

SEQ ID NO: 1815736 - DNA, 13 bp, Homo sapiens
ctccagggctgcc

SEQ ID NO: 1815737 - DNA, 14 bp, Homo sapiens
ctccagggctgccc

SEQ ID NO: 1815738 - DNA, 16 bp, Homo sapiens
ctccagggctgcccct

SEQ ID NO: 1815739 - DNA, 14 bp, Homo sapiens
ctccaggggcacct

SEQ ID NO: 1815740 - DNA, 11 bp, Homo sapiens
ctccatcccct

SEQ ID NO: 1815741 - DNA, 12 bp, Homo sapiens
ctccatcccctc

SEQ ID NO: 1815742 - DNA, 19 bp, Homo sapiens
ctccatcccctccctgcct

SEQ ID NO: 1815743 - DNA, 20 bp, Homo sapiens
ctccatcccctccctgcctg

SEQ ID NO: 1815744 - DNA, 21 bp, Homo sapiens
ctccatcccctccctgcctgc

SEQ ID NO: 1815745 - DNA, 23 bp, Homo sapiens
ctccatcccctccctgcctgctc

SEQ ID NO: 1815746 - DNA, 14 bp, Homo sapiens
ctcccaacagagct

SEQ ID NO: 1815747 - DNA, 15 bp, Homo sapiens
ctcccaataaagctg

SEQ ID NO: 1815748 - DNA, 20 bp, Homo sapiens
ctcccacagtgactcgggct

SEQ ID NO: 1815749 - DNA, 17 bp, Homo sapiens
ctcccaccccggcctcc

SEQ ID NO: 1815750 - DNA, 18 bp, Homo sapiens
ctcccacttccctgacac

SEQ ID NO: 1815751 - DNA, 18 bp, Homo sapiens
ctcccagacaggccctcc

SEQ ID NO: 1815752 - DNA, 12 bp, Homo sapiens
ctcccagtgtct

SEQ ID NO: 1815753 - DNA, 21 bp, Homo sapiens
ctccccacgagtcacctgcaa

SEQ ID NO: 1815754 - DNA, 22 bp, Homo sapiens
ctccccacgagtcacctgcaag

SEQ ID NO: 1815755 - DNA, 12 bp, Homo sapiens
ctccccactgaa

SEQ ID NO: 1815756 - DNA, 20 bp, Homo sapiens
ctccccactgaaaacatttc

SEQ ID NO: 1815757 - DNA, 11 bp, Homo sapiens
ctccccagcca

SEQ ID NO: 1815758 - DNA, 14 bp, Homo sapiens
ctccccagccagcc

SEQ ID NO: 1815759 - DNA, 16 bp, Homo sapiens
ctccccagccagccct

SEQ ID NO: 1815760 - DNA, 12 bp, Homo sapiens
ctccccagccct

SEQ ID NO: 1815761 - DNA, 20 bp, Homo sapiens
ctccccaggcctccagcctc

SEQ ID NO: 1815762 - DNA, 16 bp, Homo sapiens
ctcccccacctgacaa

SEQ ID NO: 1815763 - DNA, 19 bp, Homo sapiens
ctcccccccggggctgggt

SEQ ID NO: 1815764 - DNA, 19 bp, Homo sapiens
ctcccccgacactgctgca

SEQ ID NO: 1815765 - DNA, 21 bp, Homo sapiens
ctcccccgacactgctgcacc

SEQ ID NO: 1815766 - DNA, 17 bp, Homo sapiens
ctcccccgggaggggcc

SEQ ID NO: 1815767 - DNA, 13 bp, Homo sapiens
ctcccctccaagt

SEQ ID NO: 1815768 - DNA, 13 bp, Homo sapiens
ctcccctcccctg

SEQ ID NO: 1815769 - DNA, 16 bp, Homo sapiens
ctcccctcccctgggg

SEQ ID NO: 1815770 - DNA, 13 bp, Homo sapiens
ctcccggctgcct

SEQ ID NO: 1815771 - DNA, 15 bp, Homo sapiens
ctcccggctgcctgc

SEQ ID NO: 1815772 - DNA, 21 bp, Homo sapiens
ctccctcaaatgacagaccta

SEQ ID NO: 1815773 - DNA, 14 bp, Homo sapiens
ctccctgctgtccc

SEQ ID NO: 1815774 - DNA, 16 bp, Homo sapiens
ctccctgctgtcccct

SEQ ID NO: 1815775 - DNA, 12 bp, Homo sapiens
ctccctggccct

SEQ ID NO: 1815776 - DNA, 14 bp, Homo sapiens
ctccctggccctca

SEQ ID NO: 1815777 - DNA, 15 bp, Homo sapiens
ctccctgtctccagg

SEQ ID NO: 1815778 - DNA, 16 bp, Homo sapiens
ctcccttcctggcctc

SEQ ID NO: 1815779 - DNA, 18 bp, Homo sapiens
ctcccttcctggcctcac

SEQ ID NO: 1815780 - DNA, 13 bp, Homo sapiens
ctccggggtctgt

SEQ ID NO: 1815781 - DNA, 15 bp, Homo sapiens
ctccggggtctgtgc

SEQ ID NO: 1815782 - DNA, 16 bp, Homo sapiens
ctccggggtctgtgct

SEQ ID NO: 1815783 - DNA, 17 bp, Homo sapiens
ctccggggtctgtgctg

SEQ ID NO: 1815784 - DNA, 16 bp, Homo sapiens
ctccgtccacccaggc

SEQ ID NO: 1815785 - DNA, 20 bp, Homo sapiens
ctccgtccacccaggctgca

SEQ ID NO: 1815786 - DNA, 22 bp, Homo sapiens
ctccgtccacccaggctgcact

SEQ ID NO: 1815787 - DNA, 17 bp, Homo sapiens
ctccgtttatgggcctt

SEQ ID NO: 1815788 - DNA, 19 bp, Homo sapiens
ctccgtttatgggccttgc

SEQ ID NO: 1815789 - DNA, 17 bp, Homo sapiens
ctcctaccctcccacca

SEQ ID NO: 1815790 - DNA, 18 bp, Homo sapiens
ctcctaccctcccaccag

SEQ ID NO: 1815791 - DNA, 20 bp, Homo sapiens
ctcctagaggtgggcagctg

SEQ ID NO: 1815792 - DNA, 13 bp, Homo sapiens
ctcctccacagtg

SEQ ID NO: 1815793 - DNA, 16 bp, Homo sapiens
ctcctccaccgccatg

SEQ ID NO: 1815794 - DNA, 15 bp, Homo sapiens
ctcctcccatggcct

SEQ ID NO: 1815795 - DNA, 18 bp, Homo sapiens
ctcctgagaaggcgagga

SEQ ID NO: 1815796 - DNA, 13 bp, Homo sapiens
ctcctgatggcca

SEQ ID NO: 1815797 - DNA, 14 bp, Homo sapiens
ctcctgatggccaa

SEQ ID NO: 1815798 - DNA, 17 bp, Homo sapiens
ctcctgatggccaagag

SEQ ID NO: 1815799 - DNA, 18 bp, Homo sapiens
ctcctgccccctgccagt

SEQ ID NO: 1815800 - DNA, 13 bp, Homo sapiens
ctcctgctgcacc

SEQ ID NO: 1815801 - DNA, 14 bp, Homo sapiens
ctcctgctgcacca

SEQ ID NO: 1815802 - DNA, 19 bp, Homo sapiens
ctcctgctgcaccaaccca

SEQ ID NO: 1815803 - DNA, 21 bp, Homo sapiens
ctcctgctgcaccaacccagc

SEQ ID NO: 1815804 - DNA, 17 bp, Homo sapiens
ctcctgctgcctaataa

SEQ ID NO: 1815805 - DNA, 12 bp, Homo sapiens
ctcctggctgcc

SEQ ID NO: 1815806 - DNA, 13 bp, Homo sapiens
ctcctggctgcca

SEQ ID NO: 1815807 - DNA, 13 bp, Homo sapiens
ctcctgtgccctt

SEQ ID NO: 1815808 - DNA, 16 bp, Homo sapiens
ctccttactctgagcc

SEQ ID NO: 1815809 - DNA, 22 bp, Homo sapiens
ctccttactctgagcccaggcc

SEQ ID NO: 1815810 - DNA, 13 bp, Homo sapiens
ctccttggcaccc

SEQ ID NO: 1815811 - DNA, 15 bp, Homo sapiens
ctccttggcaccccc

SEQ ID NO: 1815812 - DNA, 16 bp, Homo sapiens
ctccttggcaccccca

SEQ ID NO: 1815813 - DNA, 21 bp, Homo sapiens
ctccttggcacccccatgctg

SEQ ID NO: 1815814 - DNA, 13 bp, Homo sapiens
ctccttgggctcc

SEQ ID NO: 1815815 - DNA, 14 bp, Homo sapiens
ctccttgggctcct

SEQ ID NO: 1815816 - DNA, 18 bp, Homo sapiens
ctccttgggctcctggct

SEQ ID NO: 1815817 - DNA, 19 bp, Homo sapiens
ctccttgggctcctggctg

SEQ ID NO: 1815818 - DNA, 20 bp, Homo sapiens
ctccttgggctcctggctgc

SEQ ID NO: 1815819 - DNA, 14 bp, Homo sapiens
ctcgaaccaaggca

SEQ ID NO: 1815820 - DNA, 20 bp, Homo sapiens
ctcgaaccaaggcagcctcc

SEQ ID NO: 1815821 - DNA, 15 bp, Homo sapiens
ctcgcagtcgcagga

SEQ ID NO: 1815822 - DNA, 16 bp, Homo sapiens
ctcgcctggcctgagg

SEQ ID NO: 1815823 - DNA, 20 bp, Homo sapiens
ctcgcctggcctgaggtctc

SEQ ID NO: 1815824 - DNA, 19 bp, Homo sapiens
ctcggaagccgtctgactc

SEQ ID NO: 1815825 - DNA, 16 bp, Homo sapiens
ctcggctcctgctgca

SEQ ID NO: 1815826 - DNA, 19 bp, Homo sapiens
ctcggctcctgctgcacca

SEQ ID NO: 1815827 - DNA, 14 bp, Homo sapiens
ctcgggctcctgtg

SEQ ID NO: 1815828 - DNA, 17 bp, Homo sapiens
ctcgtccacaggggcag

SEQ ID NO: 1815829 - DNA, 21 bp, Homo sapiens
ctcgtgccagtcgcgctgcct

SEQ ID NO: 1815830 - DNA, 19 bp, Homo sapiens
ctcgtggacacctgccctg

SEQ ID NO: 1815831 - DNA, 23 bp, Homo sapiens
ctcgtggccttccccttttgcct

SEQ ID NO: 1815832 - DNA, 15 bp, Homo sapiens
ctctaaaactctcaa

SEQ ID NO: 1815833 - DNA, 13 bp, Homo sapiens
ctctagccaggag

SEQ ID NO: 1815834 - DNA, 17 bp, Homo sapiens
ctctagccaggagtctg

SEQ ID NO: 1815835 - DNA, 20 bp, Homo sapiens
ctctagccaggagtctgtgc

SEQ ID NO: 1815836 - DNA, 15 bp, Homo sapiens
ctctagctggcagga

SEQ ID NO: 1815837 - DNA, 10 bp, Homo sapiens
ctctcaatat

SEQ ID NO: 1815838 - DNA, 20 bp, Homo sapiens
ctctccaaaggggctgctgg

SEQ ID NO: 1815839 - DNA, 21 bp, Homo sapiens
ctctccaaaggggctgctggg

SEQ ID NO: 1815840 - DNA, 17 bp, Homo sapiens
ctctccacctagtggct

SEQ ID NO: 1815841 - DNA, 23 bp, Homo sapiens
ctctccacctagtggctgtccag

SEQ ID NO: 1815842 - DNA, 14 bp, Homo sapiens
ctctcccggctgcc

SEQ ID NO: 1815843 - DNA, 16 bp, Homo sapiens
ctctcccggctgcctg

SEQ ID NO: 1815844 - DNA, 18 bp, Homo sapiens
ctctcccggctgcctgcc

SEQ ID NO: 1815845 - DNA, 20 bp, Homo sapiens
ctctcctaccccacctcatg

SEQ ID NO: 1815846 - DNA, 18 bp, Homo sapiens
ctctccttgggctcctgg

SEQ ID NO: 1815847 - DNA, 20 bp, Homo sapiens
ctctccttgggctcctggct

SEQ ID NO: 1815848 - DNA, 15 bp, Homo sapiens
ctctcggggcccttg

SEQ ID NO: 1815849 - DNA, 23 bp, Homo sapiens
ctctcggggcccttggggcctgg

SEQ ID NO: 1815850 - DNA, 11 bp, Homo sapiens
ctctgagccca

SEQ ID NO: 1815851 - DNA, 16 bp, Homo sapiens
ctctgagcccaggccg

SEQ ID NO: 1815852 - DNA, 18 bp, Homo sapiens
ctctgccccaagccccca

SEQ ID NO: 1815853 - DNA, 21 bp, Homo sapiens
ctctgccccttgggcatccac

SEQ ID NO: 1815854 - DNA, 20 bp, Homo sapiens
ctctgccctccctccttcct

SEQ ID NO: 1815855 - DNA, 20 bp, Homo sapiens
ctctgctcagagtctatcaa

SEQ ID NO: 1815856 - DNA, 13 bp, Homo sapiens
ctctgctctagcc

SEQ ID NO: 1815857 - DNA, 20 bp, Homo sapiens
ctctggcggcttcctgtcca

SEQ ID NO: 1815858 - DNA, 16 bp, Homo sapiens
ctctgggctcagggct

SEQ ID NO: 1815859 - DNA, 18 bp, Homo sapiens
ctctgtcatcactccctg

SEQ ID NO: 1815860 - DNA, 22 bp, Homo sapiens
ctctgtcatcactccctggatg

SEQ ID NO: 1815861 - DNA, 16 bp, Homo sapiens
ctctgtccaggccact

SEQ ID NO: 1815862 - DNA, 24 bp, Homo sapiens
ctctgtccaggccactgtggccag

SEQ ID NO: 1815863 - DNA, 11 bp, Homo sapiens
ctctgtcctga

SEQ ID NO: 1815864 - DNA, 20 bp, Homo sapiens
ctctgtgcccatgggcactg

SEQ ID NO: 1815865 - DNA, 13 bp, Homo sapiens
ctctgtggcctgt

SEQ ID NO: 1815866 - DNA, 18 bp, Homo sapiens
ctctgtggcctgtgtcca

SEQ ID NO: 1815867 - DNA, 16 bp, Homo sapiens
ctctgtgggctgcact

SEQ ID NO: 1815868 - DNA, 18 bp, Homo sapiens
ctctgtgtcactggctgc

SEQ ID NO: 1815869 - DNA, 18 bp, Homo sapiens
ctcttaccgtagcctccg

SEQ ID NO: 1815870 - DNA, 15 bp, Homo sapiens
ctcttcctggacctg

SEQ ID NO: 1815871 - DNA, 14 bp, Homo sapiens
ctcttgcaggctga

SEQ ID NO: 1815872 - DNA, 18 bp, Homo sapiens
ctcttgcaggctgagtcc

SEQ ID NO: 1815873 - DNA, 12 bp, Homo sapiens
ctcttgccccaa

SEQ ID NO: 1815874 - DNA, 20 bp, Homo sapiens
ctcttgccccaacccccagc

SEQ ID NO: 1815875 - DNA, 20 bp, Homo sapiens
ctctttactcccttcctggc

SEQ ID NO: 1815876 - DNA, 16 bp, Homo sapiens
ctctttgttcatcatt

SEQ ID NO: 1815877 - DNA, 22 bp, Homo sapiens
ctgaaagcagcagctaggactg

SEQ ID NO: 1815878 - DNA, 17 bp, Homo sapiens
ctgaaatagagtgaatt

SEQ ID NO: 1815879 - DNA, 14 bp, Homo sapiens
ctgaaccactttga

SEQ ID NO: 1815880 - DNA, 14 bp, Homo sapiens
ctgaaccccatggg

SEQ ID NO: 1815881 - DNA, 20 bp, Homo sapiens
ctgaaccccatgggcttgga

SEQ ID NO: 1815882 - DNA, 14 bp, Homo sapiens
ctgaagctagaaac

SEQ ID NO: 1815883 - DNA, 17 bp, Homo sapiens
ctgaagctagaaacaat

SEQ ID NO: 1815884 - DNA, 20 bp, Homo sapiens
ctgaaggaatagccagagag

SEQ ID NO: 1815885 - DNA, 21 bp, Homo sapiens
ctgaaggaatagccagagagg

SEQ ID NO: 1815886 - DNA, 14 bp, Homo sapiens
ctgaatccttagaa

SEQ ID NO: 1815887 - DNA, 20 bp, Homo sapiens
ctgaattcctttacaactaa

SEQ ID NO: 1815888 - DNA, 17 bp, Homo sapiens
ctgacaatggcagctag

SEQ ID NO: 1815889 - DNA, 18 bp, Homo sapiens
ctgacacctaccatgctg

SEQ ID NO: 1815890 - DNA, 22 bp, Homo sapiens
ctgacgccctgcgttggagcca

SEQ ID NO: 1815891 - DNA, 12 bp, Homo sapiens
ctgactccagag

SEQ ID NO: 1815892 - DNA, 14 bp, Homo sapiens
ctgacttcaggggc

SEQ ID NO: 1815893 - DNA, 12 bp, Homo sapiens
ctgagactccag

SEQ ID NO: 1815894 - DNA, 13 bp, Homo sapiens
ctgagactccaga

SEQ ID NO: 1815895 - DNA, 17 bp, Homo sapiens
ctgagactccagaatct

SEQ ID NO: 1815896 - DNA, 24 bp, Homo sapiens
ctgagagagtggcattggcagcag

SEQ ID NO: 1815897 - DNA, 12 bp, Homo sapiens
ctgagcaggtgt

SEQ ID NO: 1815898 - DNA, 14 bp, Homo sapiens
ctgagcccaggccg

SEQ ID NO: 1815899 - DNA, 16 bp, Homo sapiens
ctgagcccaggccgtt

SEQ ID NO: 1815900 - DNA, 14 bp, Homo sapiens
ctgagcccccggct

SEQ ID NO: 1815901 - DNA, 22 bp, Homo sapiens
ctgagcccccggctagtaccct

SEQ ID NO: 1815902 - DNA, 12 bp, Homo sapiens
ctgagctggggc

SEQ ID NO: 1815903 - DNA, 15 bp, Homo sapiens
ctgagcttagccttg

SEQ ID NO: 1815904 - DNA, 19 bp, Homo sapiens
ctgagcttagccttgtgcc

SEQ ID NO: 1815905 - DNA, 23 bp, Homo sapiens
ctgagcttagccttgtgccctgc

SEQ ID NO: 1815906 - DNA, 22 bp, Homo sapiens
ctgagctttggggacagttggc

SEQ ID NO: 1815907 - DNA, 18 bp, Homo sapiens
ctgaggccccaggcccta

SEQ ID NO: 1815908 - DNA, 11 bp, Homo sapiens
ctgaggcctca

SEQ ID NO: 1815909 - DNA, 14 bp, Homo sapiens
ctgaggcctcatcc

SEQ ID NO: 1815910 - DNA, 17 bp, Homo sapiens
ctgaggcctcatccctc

SEQ ID NO: 1815911 - DNA, 21 bp, Homo sapiens
ctgagggctaattctgggaag

SEQ ID NO: 1815912 - DNA, 20 bp, Homo sapiens
ctgagtcggccccacatggg

SEQ ID NO: 1815913 - DNA, 21 bp, Homo sapiens
ctgagtcggccccacatggga

SEQ ID NO: 1815914 - DNA, 17 bp, Homo sapiens
ctgagtggaatgcaggg

SEQ ID NO: 1815915 - DNA, 15 bp, Homo sapiens
ctgagttacttgtct

SEQ ID NO: 1815916 - DNA, 16 bp, Homo sapiens
ctgagttacttgtctg

SEQ ID NO: 1815917 - DNA, 20 bp, Homo sapiens
ctgagttacttgtctgaggc

SEQ ID NO: 1815918 - DNA, 22 bp, Homo sapiens
ctgagttacttgtctgaggcct

SEQ ID NO: 1815919 - DNA, 16 bp, Homo sapiens
ctgatactattcaatg

SEQ ID NO: 1815920 - DNA, 19 bp, Homo sapiens
ctgatatctgtttgcttct

SEQ ID NO: 1815921 - DNA, 22 bp, Homo sapiens
ctgatatctgtttgcttctaaa

SEQ ID NO: 1815922 - DNA, 19 bp, Homo sapiens
ctgatgctgccccgttccc

SEQ ID NO: 1815923 - DNA, 11 bp, Homo sapiens
ctgatggccaa

SEQ ID NO: 1815924 - DNA, 17 bp, Homo sapiens
ctgatggtgagctggga

SEQ ID NO: 1815925 - DNA, 19 bp, Homo sapiens
ctgatggtgagctgggaag

SEQ ID NO: 1815926 - DNA, 17 bp, Homo sapiens
ctgattcggctgtctca

SEQ ID NO: 1815927 - DNA, 23 bp, Homo sapiens
ctgattcggctgtctcagactct

SEQ ID NO: 1815928 - DNA, 20 bp, Homo sapiens
ctggcaggtgcagatgggct

SEQ ID NO: 1815929 - DNA, 11 bp, Homo sapiens
ctggccagaga

SEQ ID NO: 1815930 - DNA, 14 bp, Homo sapiens
ctggccagccccac

SEQ ID NO: 1815931 - DNA, 21 bp, Homo sapiens
ctggccagccccacagcccac

SEQ ID NO: 1815932 - DNA, 22 bp, Homo sapiens
ctggccctcaaggcctcccaca

SEQ ID NO: 1815933 - DNA, 16 bp, Homo sapiens
ctggcctcactggctg

SEQ ID NO: 1815934 - DNA, 19 bp, Homo sapiens
ctggcctcactggctgggg

SEQ ID NO: 1815935 - DNA, 20 bp, Homo sapiens
ctggcctcactggctggggc

SEQ ID NO: 1815936 - DNA, 22 bp, Homo sapiens
ctggcctcccaataaagctgga

SEQ ID NO: 1815937 - DNA, 23 bp, Homo sapiens
ctggcctcccaataaagctggac

SEQ ID NO: 1815938 - DNA, 19 bp, Homo sapiens
ctggcctcgcctggcctga

SEQ ID NO: 1815939 - DNA, 12 bp, Homo sapiens
ctggcctgagct

SEQ ID NO: 1815940 - DNA, 21 bp, Homo sapiens
ctggcctgagctggggccaca

SEQ ID NO: 1815941 - DNA, 20 bp, Homo sapiens
ctggcctgaggtctcgctga

SEQ ID NO: 1815942 - DNA, 17 bp, Homo sapiens
ctggcctgctgggaacc

SEQ ID NO: 1815943 - DNA, 12 bp, Homo sapiens
ctggcctggctc

SEQ ID NO: 1815944 - DNA, 14 bp, Homo sapiens
ctggcggcttcctg

SEQ ID NO: 1815945 - DNA, 15 bp, Homo sapiens
ctggcggcttcctgt

SEQ ID NO: 1815946 - DNA, 17 bp, Homo sapiens
ctggcggcttcctgtcc

SEQ ID NO: 1815947 - DNA, 16 bp, Homo sapiens
ctggctccccacgagt

SEQ ID NO: 1815948 - DNA, 22 bp, Homo sapiens
ctggctgagtggaatgcaggga

SEQ ID NO: 1815949 - DNA, 14 bp, Homo sapiens
ctggctgccaggcg

SEQ ID NO: 1815950 - DNA, 18 bp, Homo sapiens
ctggctgccaggcgttgg

SEQ ID NO: 1815951 - DNA, 22 bp, Homo sapiens
ctggctgccaggcgttggtgcc

SEQ ID NO: 1815952 - DNA, 18 bp, Homo sapiens
ctggctgcctccactccc

SEQ ID NO: 1815953 - DNA, 16 bp, Homo sapiens
ctggctggccagtctg

SEQ ID NO: 1815954 - DNA, 15 bp, Homo sapiens
ctggctggggcagag

SEQ ID NO: 1815955 - DNA, 16 bp, Homo sapiens
ctggctggggcagagg

SEQ ID NO: 1815956 - DNA, 21 bp, Homo sapiens
ctggctggggcctatcagtgt

SEQ ID NO: 1815957 - DNA, 19 bp, Homo sapiens
ctggctgtggaggcctgat

SEQ ID NO: 1815958 - DNA, 15 bp, Homo sapiens
ctggcttgctccagg

SEQ ID NO: 1815959 - DNA, 16 bp, Homo sapiens
ctggcttgctccaggg

SEQ ID NO: 1815960 - DNA, 22 bp, Homo sapiens
ctggcttgctccagggtcttgg

SEQ ID NO: 1815961 - DNA, 19 bp, Homo sapiens
ctgggaagctgtactcaga

SEQ ID NO: 1815962 - DNA, 21 bp, Homo sapiens
ctgggaagctgtactcagagc

SEQ ID NO: 1815963 - DNA, 18 bp, Homo sapiens
ctgggaataagtgccagg

SEQ ID NO: 1815964 - DNA, 12 bp, Homo sapiens
ctgggacccagc

SEQ ID NO: 1815965 - DNA, 19 bp, Homo sapiens
ctgggacccagctactctg

SEQ ID NO: 1815966 - DNA, 21 bp, Homo sapiens
ctgggacccagctactctgtc

SEQ ID NO: 1815967 - DNA, 13 bp, Homo sapiens
ctgggactcccag

SEQ ID NO: 1815968 - DNA, 14 bp, Homo sapiens
ctgggccccaccta

SEQ ID NO: 1815969 - DNA, 15 bp, Homo sapiens
ctgggccccacctac

SEQ ID NO: 1815970 - DNA, 16 bp, Homo sapiens
ctgggccccacctact

SEQ ID NO: 1815971 - DNA, 12 bp, Homo sapiens
ctgggcctgctt

SEQ ID NO: 1815972 - DNA, 16 bp, Homo sapiens
ctgggcctgtgcagca

SEQ ID NO: 1815973 - DNA, 14 bp, Homo sapiens
ctgggctcagggct

SEQ ID NO: 1815974 - DNA, 20 bp, Homo sapiens
ctgggctcagggctggagtg

SEQ ID NO: 1815975 - DNA, 15 bp, Homo sapiens
ctgggctctgtgggc

SEQ ID NO: 1815976 - DNA, 16 bp, Homo sapiens
ctgggctctgtgggct

SEQ ID NO: 1815977 - DNA, 20 bp, Homo sapiens
ctgggctctgtgggctgcac

SEQ ID NO: 1815978 - DNA, 21 bp, Homo sapiens
ctgggctctgtgggctgcact

SEQ ID NO: 1815979 - DNA, 12 bp, Homo sapiens
ctgggctgactg

SEQ ID NO: 1815980 - DNA, 15 bp, Homo sapiens
ctgggctggggcctg

SEQ ID NO: 1815981 - DNA, 22 bp, Homo sapiens
ctgggctgggtgcgaccccatc

SEQ ID NO: 1815982 - DNA, 16 bp, Homo sapiens
ctggggatgtctctca

SEQ ID NO: 1815983 - DNA, 24 bp, Homo sapiens
ctggggcagaggggcagccgctag

SEQ ID NO: 1815984 - DNA, 19 bp, Homo sapiens
ctggggcatgtgtgcctgt

SEQ ID NO: 1815985 - DNA, 20 bp, Homo sapiens
ctggggcatgtgtgcctgtg

SEQ ID NO: 1815986 - DNA, 21 bp, Homo sapiens
ctggggccacaaatcaaagca

SEQ ID NO: 1815987 - DNA, 19 bp, Homo sapiens
ctgggtgcgaccccatctg

SEQ ID NO: 1815988 - DNA, 20 bp, Homo sapiens
ctgggtggcccatcccccct

SEQ ID NO: 1815989 - DNA, 22 bp, Homo sapiens
ctgggttggcgcaccctcccct

SEQ ID NO: 1815990 - DNA, 23 bp, Homo sapiens
ctgggttggcgcaccctcccctc

SEQ ID NO: 1815991 - DNA, 14 bp, Homo sapiens
ctggtaagcagagg

SEQ ID NO: 1815992 - DNA, 15 bp, Homo sapiens
ctggtaagcagaggc

SEQ ID NO: 1815993 - DNA, 16 bp, Homo sapiens
ctggtaagcagaggct

SEQ ID NO: 1815994 - DNA, 20 bp, Homo sapiens
ctggtatgaacttgaggaca

SEQ ID NO: 1815995 - DNA, 23 bp, Homo sapiens
ctggtatgaacttgaggacacat

SEQ ID NO: 1815996 - DNA, 15 bp, Homo sapiens
ctggtggcccctgcc

SEQ ID NO: 1815997 - DNA, 17 bp, Homo sapiens
ctggtggtgcagccttc

SEQ ID NO: 1815998 - DNA, 21 bp, Homo sapiens
ctggtggtgcagccttcccct

SEQ ID NO: 1815999 - DNA, 20 bp, Homo sapiens
ctgtaactgctgagccactc

SEQ ID NO: 1816000 - DNA, 22 bp, Homo sapiens
ctgtaatggaactgaccccctc

SEQ ID NO: 1816001 - DNA, 14 bp, Homo sapiens
ctgtacctctgcct

SEQ ID NO: 1816002 - DNA, 13 bp, Homo sapiens
ctgtactcagagc

SEQ ID NO: 1816003 - DNA, 14 bp, Homo sapiens
ctgtactcagagca

SEQ ID NO: 1816004 - DNA, 15 bp, Homo sapiens
ctgtactcagagcag

SEQ ID NO: 1816005 - DNA, 18 bp, Homo sapiens
ctgtactcagagcagagc

SEQ ID NO: 1816006 - DNA, 21 bp, Homo sapiens
ctgtactgatactattcaatg

SEQ ID NO: 1816007 - DNA, 23 bp, Homo sapiens
ctgtactgatactattcaatgca

SEQ ID NO: 1816008 - DNA, 14 bp, Homo sapiens
ctgtagaaatattg

SEQ ID NO: 1816009 - DNA, 18 bp, Homo sapiens
ctgtagccatggctcagg

SEQ ID NO: 1816010 - DNA, 22 bp, Homo sapiens
ctgtaggttgcttaaaagggac

SEQ ID NO: 1816011 - DNA, 17 bp, Homo sapiens
ctgtatttcattatctg

SEQ ID NO: 1816012 - DNA, 13 bp, Homo sapiens
ctgtcagaggcta

SEQ ID NO: 1816013 - DNA, 17 bp, Homo sapiens
ctgtcagtgccgccgcc

SEQ ID NO: 1816014 - DNA, 22 bp, Homo sapiens
ctgtcagtgccgccgcctcgcc

SEQ ID NO: 1816015 - DNA, 18 bp, Homo sapiens
ctgtcatcactccctgga

SEQ ID NO: 1816016 - DNA, 20 bp, Homo sapiens
ctgtcatcactccctggatg

SEQ ID NO: 1816017 - DNA, 22 bp, Homo sapiens
ctgtccactctcggggcccttg

SEQ ID NO: 1816018 - DNA, 14 bp, Homo sapiens
ctgtccaggccact

SEQ ID NO: 1816019 - DNA, 18 bp, Homo sapiens
ctgcaactagccaaggct

SEQ ID NO: 1816020 - DNA, 14 bp, Homo sapiens
ctgcaagccccagg

SEQ ID NO: 1816021 - DNA, 15 bp, Homo sapiens
ctgcaatctccaggg

SEQ ID NO: 1816022 - DNA, 22 bp, Homo sapiens
ctgcaatctccagggctgcccc

SEQ ID NO: 1816023 - DNA, 15 bp, Homo sapiens
ctgcacacacagctc

SEQ ID NO: 1816024 - DNA, 16 bp, Homo sapiens
ctgcacacacagctcc

SEQ ID NO: 1816025 - DNA, 16 bp, Homo sapiens
ctgcacactatttccc

SEQ ID NO: 1816026 - DNA, 15 bp, Homo sapiens
ctgcacagtttagaa

SEQ ID NO: 1816027 - DNA, 20 bp, Homo sapiens
ctgcacagtttagaacagag

SEQ ID NO: 1816028 - DNA, 21 bp, Homo sapiens
ctgcaccaacccagccgctgc

SEQ ID NO: 1816029 - DNA, 14 bp, Homo sapiens
ctgcaccccctcct

SEQ ID NO: 1816030 - DNA, 18 bp, Homo sapiens
ctgcaccccctcctgctg

SEQ ID NO: 1816031 - DNA, 12 bp, Homo sapiens
ctgcaccctgga

SEQ ID NO: 1816032 - DNA, 16 bp, Homo sapiens
ctgcacctcctaccct

SEQ ID NO: 1816033 - DNA, 22 bp, Homo sapiens
ctgcactctgtgcccatgggca

SEQ ID NO: 1816034 - DNA, 13 bp, Homo sapiens
ctgcactgtcctg

SEQ ID NO: 1816035 - DNA, 16 bp, Homo sapiens
ctgcactgtcctgctc

SEQ ID NO: 1816036 - DNA, 17 bp, Homo sapiens
ctgcactgtcctgctcc

SEQ ID NO: 1816037 - DNA, 20 bp, Homo sapiens
ctgcactgtcctgctccaca

SEQ ID NO: 1816038 - DNA, 14 bp, Homo sapiens
ctgcagaggaccac

SEQ ID NO: 1816039 - DNA, 15 bp, Homo sapiens
ctgcagaggggcagg

SEQ ID NO: 1816040 - DNA, 17 bp, Homo sapiens
ctgcagaggggcaggcc

SEQ ID NO: 1816041 - DNA, 19 bp, Homo sapiens
ctgcagaggggcaggccct

SEQ ID NO: 1816042 - DNA, 21 bp, Homo sapiens
ctgcagctgggccccatgctc

SEQ ID NO: 1816043 - DNA, 22 bp, Homo sapiens
ctgcagctgggccccatgctct

SEQ ID NO: 1816044 - DNA, 23 bp, Homo sapiens
ctgcagctgggccccatgctctg

SEQ ID NO: 1816045 - DNA, 20 bp, Homo sapiens
ctgcaggaacgagcactggc

SEQ ID NO: 1816046 - DNA, 22 bp, Homo sapiens
ctgcaggaacgagcactggcca

SEQ ID NO: 1816047 - DNA, 20 bp, Homo sapiens
ctgcaggttgggccatactg

SEQ ID NO: 1816048 - DNA, 18 bp, Homo sapiens
ctgcagtgatggcgcggg

SEQ ID NO: 1816049 - DNA, 16 bp, Homo sapiens
ctgcatctcaagatgt

SEQ ID NO: 1816050 - DNA, 20 bp, Homo sapiens
ctgcatctcaagatgtttat

SEQ ID NO: 1816051 - DNA, 20 bp, Homo sapiens
ctgccaccacgtctgccagg

SEQ ID NO: 1816052 - DNA, 22 bp, Homo sapiens
ctgccaccacgtctgccaggcc

SEQ ID NO: 1816053 - DNA, 16 bp, Homo sapiens
ctgccacctgtctgtc

SEQ ID NO: 1816054 - DNA, 18 bp, Homo sapiens
ctgccacctgtctgtctg

SEQ ID NO: 1816055 - DNA, 12 bp, Homo sapiens
cttcctggcctc

SEQ ID NO: 1816056 - DNA, 13 bp, Homo sapiens
cttcctggcctca

SEQ ID NO: 1816057 - DNA, 18 bp, Homo sapiens
cttcctggcctcactggc

SEQ ID NO: 1816058 - DNA, 22 bp, Homo sapiens
cttcctggggccccgctgggat

SEQ ID NO: 1816059 - DNA, 16 bp, Homo sapiens
cttcctgtgccctgca

SEQ ID NO: 1816060 - DNA, 17 bp, Homo sapiens
cttcgctgctctagctg

SEQ ID NO: 1816061 - DNA, 19 bp, Homo sapiens
cttcgctgctctagctggc

SEQ ID NO: 1816062 - DNA, 16 bp, Homo sapiens
cttcgtgtctctccca

SEQ ID NO: 1816063 - DNA, 22 bp, Homo sapiens
cttcgtgtctctcccaccccgg

SEQ ID NO: 1816064 - DNA, 12 bp, Homo sapiens
cttctaaatgcc

SEQ ID NO: 1816065 - DNA, 21 bp, Homo sapiens
cttctaatccatgtgctgctg

SEQ ID NO: 1816066 - DNA, 19 bp, Homo sapiens
cttctaggagtcaactggc

SEQ ID NO: 1816067 - DNA, 20 bp, Homo sapiens
cttctaggagtcaactggct

SEQ ID NO: 1816068 - DNA, 23 bp, Homo sapiens
cttctaggagtcaactggctggc

SEQ ID NO: 1816069 - DNA, 18 bp, Homo sapiens
cttctccaacactgaagt

SEQ ID NO: 1816070 - DNA, 22 bp, Homo sapiens
cttctcccccccggggctgggt

SEQ ID NO: 1816071 - DNA, 20 bp, Homo sapiens
cttctcttgggaactccact

SEQ ID NO: 1816072 - DNA, 16 bp, Homo sapiens
cttctgccacttccca

SEQ ID NO: 1816073 - DNA, 17 bp, Homo sapiens
cttctgccacttcccag

SEQ ID NO: 1816074 - DNA, 23 bp, Homo sapiens
gacagttggcagagaaggcctct

SEQ ID NO: 1816075 - DNA, 17 bp, Homo sapiens
gacatatatattaaaat

SEQ ID NO: 1816076 - DNA, 16 bp, Homo sapiens
gaccaaattgcttcta

SEQ ID NO: 1816077 - DNA, 17 bp, Homo sapiens
gaccagaaacagggaca

SEQ ID NO: 1816078 - DNA, 22 bp, Homo sapiens
gaccagaaacagggacaaagaa

SEQ ID NO: 1816079 - DNA, 16 bp, Homo sapiens
gaccattggctgcgct

SEQ ID NO: 1816080 - DNA, 20 bp, Homo sapiens
gacccacccatcttcctgct

SEQ ID NO: 1816081 - DNA, 23 bp, Homo sapiens
gacccagctactctgtccaggcc

SEQ ID NO: 1816082 - DNA, 15 bp, Homo sapiens
gacccaggccctcca

SEQ ID NO: 1816083 - DNA, 14 bp, Homo sapiens
gaccccctcccctg

SEQ ID NO: 1816084 - DNA, 18 bp, Homo sapiens
gaccccttttcagcttct

SEQ ID NO: 1816085 - DNA, 11 bp, Homo sapiens
gaccctgagac

SEQ ID NO: 1816086 - DNA, 19 bp, Homo sapiens
gaccctggaattcagcacc

SEQ ID NO: 1816087 - DNA, 20 bp, Homo sapiens
gaccctggaattcagcaccc

SEQ ID NO: 1816088 - DNA, 17 bp, Homo sapiens
gaccgcttcacccctgc

SEQ ID NO: 1816089 - DNA, 19 bp, Homo sapiens
gaccgggtgggcctggcct

SEQ ID NO: 1816090 - DNA, 20 bp, Homo sapiens
gaccgggtgggcctggcctg

SEQ ID NO: 1816091 - DNA, 16 bp, Homo sapiens
gaccgtgtcccaagga

SEQ ID NO: 1816092 - DNA, 20 bp, Homo sapiens
gaccgtgtcccaaggagctg

SEQ ID NO: 1816093 - DNA, 14 bp, Homo sapiens
gacctcttctgaag

SEQ ID NO: 1816094 - DNA, 19 bp, Homo sapiens
gacctggtttgaatggaga

SEQ ID NO: 1816095 - DNA, 17 bp, Homo sapiens
gacctttcctgaggaag

SEQ ID NO: 1816096 - DNA, 12 bp, Homo sapiens
gactaactaaaa

SEQ ID NO: 1816097 - DNA, 15 bp, Homo sapiens
gactatggagctgag

SEQ ID NO: 1816098 - DNA, 14 bp, Homo sapiens
gactattaaatgtt

SEQ ID NO: 1816099 - DNA, 22 bp, Homo sapiens
gactcagtgtctgcctttaaat

SEQ ID NO: 1816100 - DNA, 19 bp, Homo sapiens
gactccagaatctgctgtt

SEQ ID NO: 1816101 - DNA, 14 bp, Homo sapiens
gactccagagtctg

SEQ ID NO: 1816102 - DNA, 17 bp, Homo sapiens
gactccagagtctgagc

SEQ ID NO: 1816103 - DNA, 18 bp, Homo sapiens
gactccagagtctgagcc

SEQ ID NO: 1816104 - DNA, 20 bp, Homo sapiens
gactccagagtctgagcccc

SEQ ID NO: 1816105 - DNA, 12 bp, Homo sapiens
gactgaaagcag

SEQ ID NO: 1816106 - DNA, 17 bp, Homo sapiens
gactgaaagcagcagct

SEQ ID NO: 1816107 - DNA, 18 bp, Homo sapiens
gactgaaagcagcagcta

SEQ ID NO: 1816108 - DNA, 16 bp, Homo sapiens
gactgaaccagagctg

SEQ ID NO: 1816109 - DNA, 23 bp, Homo sapiens
gactgaaccagagctggaacaca

SEQ ID NO: 1816110 - DNA, 16 bp, Homo sapiens
gactgaaggggcacac

SEQ ID NO: 1816111 - DNA, 13 bp, Homo sapiens
gactgaggagtgg

SEQ ID NO: 1816112 - DNA, 23 bp, Homo sapiens
gactggagaccgcttcacccctg

SEQ ID NO: 1816113 - DNA, 15 bp, Homo sapiens
gactggagtgaggct

SEQ ID NO: 1816114 - DNA, 14 bp, Homo sapiens
gactggcaggtgca

SEQ ID NO: 1816115 - DNA, 12 bp, Homo sapiens
gacttcagattt

SEQ ID NO: 1816116 - DNA, 21 bp, Homo sapiens
gacttcaggggctgcccgctc

SEQ ID NO: 1816117 - DNA, 24 bp, Homo sapiens
gacttcaggtggagagcactagaa

SEQ ID NO: 1816118 - DNA, 13 bp, Homo sapiens
gacttctggaagg

SEQ ID NO: 1816119 - DNA, 16 bp, Homo sapiens
gacttctggaaggctg

SEQ ID NO: 1816120 - DNA, 21 bp, Homo sapiens
gacttctggaaggctggctga

SEQ ID NO: 1816121 - DNA, 19 bp, Homo sapiens
gacttgaattttcccactg

SEQ ID NO: 1816122 - DNA, 21 bp, Homo sapiens
gacttgaattttcccactgca

SEQ ID NO: 1816123 - DNA, 20 bp, Homo sapiens
gagaaaagagccagaagttg

SEQ ID NO: 1816124 - DNA, 17 bp, Homo sapiens
gagaacaagtcacagct

SEQ ID NO: 1816125 - DNA, 23 bp, Homo sapiens
gagaacaagtcacagctgcagct

SEQ ID NO: 1816126 - DNA, 16 bp, Homo sapiens
gagaaggaaaaagaaa

SEQ ID NO: 1816127 - DNA, 19 bp, Homo sapiens
gagacaagccctggcaaca

SEQ ID NO: 1816128 - DNA, 20 bp, Homo sapiens
gagactccagaatctgctgt

SEQ ID NO: 1816129 - DNA, 17 bp, Homo sapiens
gagactgaaagcagcag

SEQ ID NO: 1816130 - DNA, 18 bp, Homo sapiens
gagactgaaagcagcagc

SEQ ID NO: 1816131 - DNA, 14 bp, Homo sapiens
gagacttcctctgg

SEQ ID NO: 1816132 - DNA, 18 bp, Homo sapiens
gagagaaaagaaaaatat

SEQ ID NO: 1816133 - DNA, 20 bp, Homo sapiens
gagagaaaagaaaaatatga

SEQ ID NO: 1816134 - DNA, 15 bp, Homo sapiens
gagagaacagggatg

SEQ ID NO: 1816135 - DNA, 22 bp, Homo sapiens
gagagcactagaagtggtttcc

SEQ ID NO: 1816136 - DNA, 16 bp, Homo sapiens
gagagcagcttctgcc

SEQ ID NO: 1816137 - DNA, 18 bp, Homo sapiens
gagagcagcttctgccac

SEQ ID NO: 1816138 - DNA, 19 bp, Homo sapiens
gagagcagcttctgccact

SEQ ID NO: 1816139 - DNA, 22 bp, Homo sapiens
gagagcagcttctgccacttcc

SEQ ID NO: 1816140 - DNA, 12 bp, Homo sapiens
gagaggagcacc

SEQ ID NO: 1816141 - DNA, 19 bp, Homo sapiens
gagaggagcacctgaaccc

SEQ ID NO: 1816142 - DNA, 19 bp, Homo sapiens
gagagggcccagctgtagc

SEQ ID NO: 1816143 - DNA, 16 bp, Homo sapiens
gagatggccatgctca

SEQ ID NO: 1816144 - DNA, 17 bp, Homo sapiens
gagcaaatgagggaggg

SEQ ID NO: 1816145 - DNA, 13 bp, Homo sapiens
gagcaacccctgt

SEQ ID NO: 1816146 - DNA, 16 bp, Homo sapiens
gagcaacccctgtacc

SEQ ID NO: 1816147 - DNA, 20 bp, Homo sapiens
gagcaacccctgtacccagc

SEQ ID NO: 1816148 - DNA, 22 bp, Homo sapiens
gagcaacccctgtacccagctc

SEQ ID NO: 1816149 - DNA, 18 bp, Homo sapiens
gagcacagccctcccgcc

SEQ ID NO: 1816150 - DNA, 20 bp, Homo sapiens
gagcacagccctcccgcccc

SEQ ID NO: 1816151 - DNA, 13 bp, Homo sapiens
gagcacagccctg

SEQ ID NO: 1816152 - DNA, 13 bp, Homo sapiens
gagcacctgaacc

SEQ ID NO: 1816153 - DNA, 18 bp, Homo sapiens
gagcacttgcgtcctgca

SEQ ID NO: 1816154 - DNA, 19 bp, Homo sapiens
gagcacttgcgtcctgcag

SEQ ID NO: 1816155 - DNA, 19 bp, Homo sapiens
gagcagcctgatggccaag

SEQ ID NO: 1816156 - DNA, 12 bp, Homo sapiens
gagcagggtcct

SEQ ID NO: 1816157 - DNA, 21 bp, Homo sapiens
gagcatcgtgacccttcaggg

SEQ ID NO: 1816158 - DNA, 15 bp, Homo sapiens
gagcatttttcagag

SEQ ID NO: 1816159 - DNA, 21 bp, Homo sapiens
gagcatttttcagagttttct

SEQ ID NO: 1816160 - DNA, 17 bp, Homo sapiens
gagccactacctttgtc

SEQ ID NO: 1816161 - DNA, 13 bp, Homo sapiens
gagccatgggcct

SEQ ID NO: 1816162 - DNA, 19 bp, Homo sapiens
gagccatgggcctgggcct

SEQ ID NO: 1816163 - DNA, 21 bp, Homo sapiens
gagccatgggcctgggcctgc

SEQ ID NO: 1816164 - DNA, 22 bp, Homo sapiens
gagccatgggcctgggcctgct

SEQ ID NO: 1816165 - DNA, 16 bp, Homo sapiens
gagcccctccccagcc

SEQ ID NO: 1816166 - DNA, 20 bp, Homo sapiens
gagcccgtgcagtacaggca

SEQ ID NO: 1816167 - DNA, 21 bp, Homo sapiens
gagcccgtgcagtacaggcaa

SEQ ID NO: 1816168 - DNA, 20 bp, Homo sapiens
gagctcttcaagctgtcccc

SEQ ID NO: 1816169 - DNA, 18 bp, Homo sapiens
gagctgatttccaggccc

SEQ ID NO: 1816170 - DNA, 15 bp, Homo sapiens
gagctggaacacaat

SEQ ID NO: 1816171 - DNA, 14 bp, Homo sapiens
gagctggaaggcag

SEQ ID NO: 1816172 - DNA, 16 bp, Homo sapiens
gagctggaaggcaggg

SEQ ID NO: 1816173 - DNA, 18 bp, Homo sapiens
gagctggaaggcagggca

SEQ ID NO: 1816174 - DNA, 19 bp, Homo sapiens
gagctgggaagctgtactc

SEQ ID NO: 1816175 - DNA, 23 bp, Homo sapiens
gagctgggaagctgtactcagag

SEQ ID NO: 1816176 - DNA, 23 bp, Homo sapiens
gaggaccacagtgggtggcacct

SEQ ID NO: 1816177 - DNA, 12 bp, Homo sapiens
gaggagaccctg

SEQ ID NO: 1816178 - DNA, 13 bp, Homo sapiens
gaggagaccctgg

SEQ ID NO: 1816179 - DNA, 14 bp, Homo sapiens
gcacaccactgccc

SEQ ID NO: 1816180 - DNA, 16 bp, Homo sapiens
gcacaccactgccctg

SEQ ID NO: 1816181 - DNA, 21 bp, Homo sapiens
gcacaccactgccctgcctgc

SEQ ID NO: 1816182 - DNA, 17 bp, Homo sapiens
gcacactatttccctct

SEQ ID NO: 1816183 - DNA, 15 bp, Homo sapiens
gcacagacttctgga

SEQ ID NO: 1816184 - DNA, 21 bp, Homo sapiens
gcacagacttctggaaggctg

SEQ ID NO: 1816185 - DNA, 22 bp, Homo sapiens
gcacagacttctggaaggctgg

SEQ ID NO: 1816186 - DNA, 23 bp, Homo sapiens
gcacagcaaggaggctggctggg

SEQ ID NO: 1816187 - DNA, 16 bp, Homo sapiens
gcacagccctcccgcc

SEQ ID NO: 1816188 - DNA, 23 bp, Homo sapiens
gcacagtattatttctccatccc

SEQ ID NO: 1816189 - DNA, 15 bp, Homo sapiens
gcacagtgtctgggc

SEQ ID NO: 1816190 - DNA, 18 bp, Homo sapiens
gcacagtgtctgggctga

SEQ ID NO: 1816191 - DNA, 23 bp, Homo sapiens
gcacagtgtctgggctgactggg

SEQ ID NO: 1816192 - DNA, 22 bp, Homo sapiens
gcacagtttagaacagagggac

SEQ ID NO: 1816193 - DNA, 18 bp, Homo sapiens
gcacatgattttcttttg

SEQ ID NO: 1816194 - DNA, 19 bp, Homo sapiens
gcacatgattttcttttgt

SEQ ID NO: 1816195 - DNA, 22 bp, Homo sapiens
gcaccaacccagccgctgcccg

SEQ ID NO: 1816196 - DNA, 23 bp, Homo sapiens
gcaccagagtgaaagggctatgg

SEQ ID NO: 1816197 - DNA, 15 bp, Homo sapiens
gcaccagccccctgg

SEQ ID NO: 1816198 - DNA, 17 bp, Homo sapiens
gcaccagccccctggat

SEQ ID NO: 1816199 - DNA, 13 bp, Homo sapiens
gcaccagctctgt

SEQ ID NO: 1816200 - DNA, 18 bp, Homo sapiens
gcaccagctctgtggcct

SEQ ID NO: 1816201 - DNA, 22 bp, Homo sapiens
gcaccagctctgtggcctgtgt

SEQ ID NO: 1816202 - DNA, 11 bp, Homo sapiens
gcaccagctgc

SEQ ID NO: 1816203 - DNA, 17 bp, Homo sapiens
gcaccagctgctctgcc

SEQ ID NO: 1816204 - DNA, 19 bp, Homo sapiens
gcaccagctgctctgcccc

SEQ ID NO: 1816205 - DNA, 15 bp, Homo sapiens
gcacccactcaccag

SEQ ID NO: 1816206 - DNA, 19 bp, Homo sapiens
gcaccccctcctgctgcag

SEQ ID NO: 1816207 - DNA, 13 bp, Homo sapiens
gcaccctcccctc

SEQ ID NO: 1816208 - DNA, 17 bp, Homo sapiens
gcaccctcccctcccgt

SEQ ID NO: 1816209 - DNA, 22 bp, Homo sapiens
gcaccctggaaaggggagttga

SEQ ID NO: 1816210 - DNA, 12 bp, Homo sapiens
gcaccctgggtg

SEQ ID NO: 1816211 - DNA, 15 bp, Homo sapiens
gcaccctgggtgcca

SEQ ID NO: 1816212 - DNA, 12 bp, Homo sapiens
gcaccggcgctg

SEQ ID NO: 1816213 - DNA, 16 bp, Homo sapiens
gcaccggcgctgcagg

SEQ ID NO: 1816214 - DNA, 14 bp, Homo sapiens
gcacctcctaccct

SEQ ID NO: 1816215 - DNA, 20 bp, Homo sapiens
gcacctcctaccctcccacc

SEQ ID NO: 1816216 - DNA, 16 bp, Homo sapiens
gcacctcctgagaagg

SEQ ID NO: 1816217 - DNA, 18 bp, Homo sapiens
gcacctgaaccccatggg

SEQ ID NO: 1816218 - DNA, 20 bp, Homo sapiens
gcacctgaaccccatgggct

SEQ ID NO: 1816219 - DNA, 12 bp, Homo sapiens
gcacctggcctg

SEQ ID NO: 1816220 - DNA, 20 bp, Homo sapiens
gcactagaagtggtttcctg

SEQ ID NO: 1816221 - DNA, 20 bp, Homo sapiens
gcactctgtgcccatgggca

SEQ ID NO: 1816222 - DNA, 21 bp, Homo sapiens
gcactctgtgcccatgggcac

SEQ ID NO: 1816223 - DNA, 14 bp, Homo sapiens
gcactgctgggtgg

SEQ ID NO: 1816224 - DNA, 18 bp, Homo sapiens
gcactgctgggtggccca

SEQ ID NO: 1816225 - DNA, 21 bp, Homo sapiens
gcactggccagagagggccca

SEQ ID NO: 1816226 - DNA, 14 bp, Homo sapiens
gcactggccccacc

SEQ ID NO: 1816227 - DNA, 19 bp, Homo sapiens
gcactgtcctgctccacag

SEQ ID NO: 1816228 - DNA, 20 bp, Homo sapiens
gcactgtcctgctccacagt

SEQ ID NO: 1816229 - DNA, 15 bp, Homo sapiens
gcacttgcgtcctgc

SEQ ID NO: 1816230 - DNA, 16 bp, Homo sapiens
gcacttgcgtcctgca

SEQ ID NO: 1816231 - DNA, 20 bp, Homo sapiens
gcacttgcgtcctgcagagg

SEQ ID NO: 1816232 - DNA, 19 bp, Homo sapiens
gcactttacgctgtctgta

SEQ ID NO: 1816233 - DNA, 14 bp, Homo sapiens
gcagaaaagaggag

SEQ ID NO: 1816234 - DNA, 21 bp, Homo sapiens
gcagaaaagaggagaccctgg

SEQ ID NO: 1816235 - DNA, 22 bp, Homo sapiens
gcagacttgagtctgaggcccc

SEQ ID NO: 1816236 - DNA, 23 bp, Homo sapiens
gcagagaaagaaagggaaactgg

SEQ ID NO: 1816237 - DNA, 14 bp, Homo sapiens
gcagagaaggcctc

SEQ ID NO: 1816238 - DNA, 17 bp, Homo sapiens
gcagagcaaatgaggga

SEQ ID NO: 1816239 - DNA, 16 bp, Homo sapiens
gcagagccatgggcct

SEQ ID NO: 1816240 - DNA, 18 bp, Homo sapiens
gcagagccatgggcctgg

SEQ ID NO: 1816241 - DNA, 19 bp, Homo sapiens
gcagagccatgggcctggg

SEQ ID NO: 1816242 - DNA, 20 bp, Homo sapiens
gcagagccatgggcctgggc

SEQ ID NO: 1816243 - DNA, 22 bp, Homo sapiens
gcagagccatgggcctgggcct

SEQ ID NO: 1816244 - DNA, 21 bp, Homo sapiens
gcagagccttttacccctgca

SEQ ID NO: 1816245 - DNA, 14 bp, Homo sapiens
gcagaggaccacag

SEQ ID NO: 1816246 - DNA, 21 bp, Homo sapiens
gcagaggaccacagtgggtgg

SEQ ID NO: 1816247 - DNA, 17 bp, Homo sapiens
gcagagggaatgttccc

SEQ ID NO: 1816248 - DNA, 15 bp, Homo sapiens
gcagaggggcagccg

SEQ ID NO: 1816249 - DNA, 13 bp, Homo sapiens
gcagaggggcagg

SEQ ID NO: 1816250 - DNA, 17 bp, Homo sapiens
gcagaggggcaggccct

SEQ ID NO: 1816251 - DNA, 19 bp, Homo sapiens
gcagaggggcaggccctgc

SEQ ID NO: 1816252 - DNA, 20 bp, Homo sapiens
gcagaggggcaggccctgca

SEQ ID NO: 1816253 - DNA, 23 bp, Homo sapiens
gcagatctttttgtgaaattcaa

SEQ ID NO: 1816254 - DNA, 13 bp, Homo sapiens
gcagattcctggg

SEQ ID NO: 1816255 - DNA, 22 bp, Homo sapiens
gcagcacagcaaggaggctggc

SEQ ID NO: 1816256 - DNA, 12 bp, Homo sapiens
gcagcagcccag

SEQ ID NO: 1816257 - DNA, 16 bp, Homo sapiens
gcagcagctaggactg

SEQ ID NO: 1816258 - DNA, 18 bp, Homo sapiens
gcagcaggtgctgctacc

SEQ ID NO: 1816259 - DNA, 20 bp, Homo sapiens
gcagcaggtgctgctaccct

SEQ ID NO: 1816260 - DNA, 17 bp, Homo sapiens
gcagccagccagtcttg

SEQ ID NO: 1816261 - DNA, 20 bp, Homo sapiens
gcagccagccagtcttgcct

SEQ ID NO: 1816262 - DNA, 19 bp, Homo sapiens
gcagcccagcttcctggtg

SEQ ID NO: 1816263 - DNA, 20 bp, Homo sapiens
gcagcccagcttcctggtgt

SEQ ID NO: 1816264 - DNA, 21 bp, Homo sapiens
gcagccccgttttggggacgt

SEQ ID NO: 1816265 - DNA, 20 bp, Homo sapiens
gcagcccgtgaagcagtgcc

SEQ ID NO: 1816266 - DNA, 21 bp, Homo sapiens
gcagccgctaggagagactga

SEQ ID NO: 1816267 - DNA, 21 bp, Homo sapiens
gcagcctccagagccagcctg

SEQ ID NO: 1816268 - DNA, 14 bp, Homo sapiens
gcagcctgatggcc

SEQ ID NO: 1816269 - DNA, 17 bp, Homo sapiens
gcagcctgatggccaag

SEQ ID NO: 1816270 - DNA, 18 bp, Homo sapiens
gcagcctgatggccaagg

SEQ ID NO: 1816271 - DNA, 21 bp, Homo sapiens
gcagcctgatggccaaggggg

SEQ ID NO: 1816272 - DNA, 14 bp, Homo sapiens
gcagctagactgga

SEQ ID NO: 1816273 - DNA, 22 bp, Homo sapiens
gcagctagactggagtgaggct

SEQ ID NO: 1816274 - DNA, 16 bp, Homo sapiens
gcagctaggactgagg

SEQ ID NO: 1816275 - DNA, 18 bp, Homo sapiens
gcagctaggactgaggag

SEQ ID NO: 1816276 - DNA, 14 bp, Homo sapiens
gcagctgcgggtct

SEQ ID NO: 1816277 - DNA, 17 bp, Homo sapiens
gcagctgcgggtctgaa

SEQ ID NO: 1816278 - DNA, 19 bp, Homo sapiens
gcagctgcgggtctgaagg

SEQ ID NO: 1816279 - DNA, 20 bp, Homo sapiens
gcagctgcgggtctgaagga

SEQ ID NO: 1816280 - DNA, 11 bp, Homo sapiens
gcagctgctct

SEQ ID NO: 1816281 - DNA, 12 bp, Homo sapiens
gcagctgggccc

SEQ ID NO: 1816282 - DNA, 13 bp, Homo sapiens
gcagctgggcccc

SEQ ID NO: 1816283 - DNA, 18 bp, Homo sapiens
gcagctgggccccatgct

SEQ ID NO: 1816284 - DNA, 14 bp, Homo sapiens
gcagcttctgccac

SEQ ID NO: 1816285 - DNA, 20 bp, Homo sapiens
gcagcttctgccacttccca

SEQ ID NO: 1816286 - DNA, 19 bp, Homo sapiens
gcaggaacgagcactggcc

SEQ ID NO: 1816287 - DNA, 20 bp, Homo sapiens
gcaggaacgagcactggcca

SEQ ID NO: 1816288 - DNA, 23 bp, Homo sapiens
gcaggaacgagcactggccagag

SEQ ID NO: 1816289 - DNA, 15 bp, Homo sapiens
gcaggaggaggtgcc

SEQ ID NO: 1816290 - DNA, 13 bp, Homo sapiens
gcaggcacagcac

SEQ ID NO: 1816291 - DNA, 15 bp, Homo sapiens
gcaggcacagcacag

SEQ ID NO: 1816292 - DNA, 17 bp, Homo sapiens
ggccagagctggaaggc

SEQ ID NO: 1816293 - DNA, 14 bp, Homo sapiens
ggccagccccacag

SEQ ID NO: 1816294 - DNA, 23 bp, Homo sapiens
ggccaggtgggcgggcagcacag

SEQ ID NO: 1816295 - DNA, 23 bp, Homo sapiens
ggccatactggcctcgcctggcc

SEQ ID NO: 1816296 - DNA, 19 bp, Homo sapiens
ggcccagctgtagccatgg

SEQ ID NO: 1816297 - DNA, 20 bp, Homo sapiens
ggcccagctgtagccatggc

SEQ ID NO: 1816298 - DNA, 16 bp, Homo sapiens
ggcccatcagtgtacc

SEQ ID NO: 1816299 - DNA, 13 bp, Homo sapiens
ggccccacatggg

SEQ ID NO: 1816300 - DNA, 15 bp, Homo sapiens
ggccccagatctgcc

SEQ ID NO: 1816301 - DNA, 22 bp, Homo sapiens
ggccccagatctgcctgggcct

SEQ ID NO: 1816302 - DNA, 18 bp, Homo sapiens
ggccccagcctggcccag

SEQ ID NO: 1816303 - DNA, 21 bp, Homo sapiens
ggccccagcctggcccagctc

SEQ ID NO: 1816304 - DNA, 22 bp, Homo sapiens
ggccccagcctggcccagctcc

SEQ ID NO: 1816305 - DNA, 13 bp, Homo sapiens
ggccccaggccct

SEQ ID NO: 1816306 - DNA, 13 bp, Homo sapiens
ggccccatgctct

SEQ ID NO: 1816307 - DNA, 14 bp, Homo sapiens
ggccccatgctctg

SEQ ID NO: 1816308 - DNA, 16 bp, Homo sapiens
ggcccccctccaggca

SEQ ID NO: 1816309 - DNA, 23 bp, Homo sapiens
ggcccccctccaggcatgctggc

SEQ ID NO: 1816310 - DNA, 15 bp, Homo sapiens
ggccccggggctggc

SEQ ID NO: 1816311 - DNA, 19 bp, Homo sapiens
ggccccggggctggcaagc

SEQ ID NO: 1816312 - DNA, 16 bp, Homo sapiens
ggcccctccctctgcc

SEQ ID NO: 1816313 - DNA, 17 bp, Homo sapiens
ggcccctccctctgccc

SEQ ID NO: 1816314 - DNA, 13 bp, Homo sapiens
ggcccctgaggac

SEQ ID NO: 1816315 - DNA, 21 bp, Homo sapiens
ggccctaggattcctccccca

SEQ ID NO: 1816316 - DNA, 18 bp, Homo sapiens
ggccctcaaggcctccca

SEQ ID NO: 1816317 - DNA, 23 bp, Homo sapiens
ggccctcaaggcctcccacagtg

SEQ ID NO: 1816318 - DNA, 14 bp, Homo sapiens
ggccctccatgggc

SEQ ID NO: 1816319 - DNA, 19 bp, Homo sapiens
ggccctcttcttattcatg

SEQ ID NO: 1816320 - DNA, 14 bp, Homo sapiens
ggccctgcactgtc

SEQ ID NO: 1816321 - DNA, 15 bp, Homo sapiens
ggccctgcactgtcc

SEQ ID NO: 1816322 - DNA, 16 bp, Homo sapiens
ggccctgcactgtcct

SEQ ID NO: 1816323 - DNA, 20 bp, Homo sapiens
ggccctgcactgtcctgctc

SEQ ID NO: 1816324 - DNA, 22 bp, Homo sapiens
ggccctgcactgtcctgctcca

SEQ ID NO: 1816325 - DNA, 12 bp, Homo sapiens
ggccctgtgcct

SEQ ID NO: 1816326 - DNA, 15 bp, Homo sapiens
ggcccttggggcctg

SEQ ID NO: 1816327 - DNA, 16 bp, Homo sapiens
ggcccttggggcctgg

SEQ ID NO: 1816328 - DNA, 19 bp, Homo sapiens
ggcccttggggcctggctt

SEQ ID NO: 1816329 - DNA, 14 bp, Homo sapiens
ggcccttgtcctgc

SEQ ID NO: 1816330 - DNA, 23 bp, Homo sapiens
ggcccttgtcctgccagctgcct

SEQ ID NO: 1816331 - DNA, 15 bp, Homo sapiens
ggccggccaggtggg

SEQ ID NO: 1816332 - DNA, 16 bp, Homo sapiens
ggccggccaggtgggc

SEQ ID NO: 1816333 - DNA, 16 bp, Homo sapiens
ggccgttccccttggc

SEQ ID NO: 1816334 - DNA, 17 bp, Homo sapiens
ggccgttccccttggct

SEQ ID NO: 1816335 - DNA, 18 bp, Homo sapiens
ggccgttccccttggctt

SEQ ID NO: 1816336 - DNA, 16 bp, Homo sapiens
ggcctatcagtgtgcc

SEQ ID NO: 1816337 - DNA, 17 bp, Homo sapiens
ggcctatcagtgtgccc

SEQ ID NO: 1816338 - DNA, 13 bp, Homo sapiens
ggcctcactggct

SEQ ID NO: 1816339 - DNA, 21 bp, Homo sapiens
ggcctccactcccccacctga

SEQ ID NO: 1816340 - DNA, 13 bp, Homo sapiens
ggcctccagcctc

SEQ ID NO: 1816341 - DNA, 14 bp, Homo sapiens
ggcctccagcctct

SEQ ID NO: 1816342 - DNA, 21 bp, Homo sapiens
ggcctccagcctctcccggct

SEQ ID NO: 1816343 - DNA, 23 bp, Homo sapiens
ggcctccagcctctcccggctgc

SEQ ID NO: 1816344 - DNA, 18 bp, Homo sapiens
ggcctcccaataaagctg

SEQ ID NO: 1816345 - DNA, 15 bp, Homo sapiens
ggcctcccacagtga

SEQ ID NO: 1816346 - DNA, 14 bp, Homo sapiens
ggcctcgcctggcc

SEQ ID NO: 1816347 - DNA, 15 bp, Homo sapiens
ggcctcttccaccca

SEQ ID NO: 1816348 - DNA, 13 bp, Homo sapiens
ggcctgagctggg

SEQ ID NO: 1816349 - DNA, 19 bp, Homo sapiens
ggcctgagctggggccaca

SEQ ID NO: 1816350 - DNA, 21 bp, Homo sapiens
ggcctgaggtctcgctgatgc

SEQ ID NO: 1816351 - DNA, 22 bp, Homo sapiens
ggcctgaggtctcgctgatgct

SEQ ID NO: 1816352 - DNA, 24 bp, Homo sapiens
ggcctgcttttccaggatcctgca

SEQ ID NO: 1816353 - DNA, 14 bp, Homo sapiens
ggcctggcctgagc

SEQ ID NO: 1816354 - DNA, 14 bp, Homo sapiens
ggcctggctcccca

SEQ ID NO: 1816355 - DNA, 19 bp, Homo sapiens
ggcctggcttgctccaggg

SEQ ID NO: 1816356 - DNA, 21 bp, Homo sapiens
ggcctggcttgctccagggtc

SEQ ID NO: 1816357 - DNA, 20 bp, Homo sapiens
ggcctgggacccagctactc

SEQ ID NO: 1816358 - DNA, 14 bp, Homo sapiens
ggcctgggcctgct

SEQ ID NO: 1816359 - DNA, 19 bp, Homo sapiens
ggcctgggggcagtgactg

SEQ ID NO: 1816360 - DNA, 18 bp, Homo sapiens
ggcctgtgcagcagccca

SEQ ID NO: 1816361 - DNA, 21 bp, Homo sapiens
ggcctgtgcagcagcccagct

SEQ ID NO: 1816362 - DNA, 22 bp, Homo sapiens
ggccttccccttttgcctggct

SEQ ID NO: 1816363 - DNA, 23 bp, Homo sapiens
ggccttccccttttgcctggctg

SEQ ID NO: 1816364 - DNA, 15 bp, Homo sapiens
ggccttccctcccca

SEQ ID NO: 1816365 - DNA, 16 bp, Homo sapiens
ggcgcaccctcccctc

SEQ ID NO: 1816366 - DNA, 11 bp, Homo sapiens
ggcgccctctg

SEQ ID NO: 1816367 - DNA, 14 bp, Homo sapiens
ggcgccctctgtcc

SEQ ID NO: 1816368 - DNA, 19 bp, Homo sapiens
ggcgcgggaggcaccagct

SEQ ID NO: 1816369 - DNA, 11 bp, Homo sapiens
ggcgctcagga

SEQ ID NO: 1816370 - DNA, 13 bp, Homo sapiens
gcaggcctgggac

SEQ ID NO: 1816371 - DNA, 18 bp, Homo sapiens
gcaggctctgggctcagg

SEQ ID NO: 1816372 - DNA, 23 bp, Homo sapiens
gcaggctctgggctcagggctgg

SEQ ID NO: 1816373 - DNA, 15 bp, Homo sapiens
gcagggaaagctcca

SEQ ID NO: 1816374 - DNA, 16 bp, Homo sapiens
gcagggaagagggcag

SEQ ID NO: 1816375 - DNA, 22 bp, Homo sapiens
gcaggtacttcctcctgatggc

SEQ ID NO: 1816376 - DNA, 20 bp, Homo sapiens
gcaggtagatcgcttgagcc

SEQ ID NO: 1816377 - DNA, 23 bp, Homo sapiens
gcaggtagatcgcttgagcccag

SEQ ID NO: 1816378 - DNA, 14 bp, Homo sapiens
gcaggtgctgctac

SEQ ID NO: 1816379 - DNA, 20 bp, Homo sapiens
gcaggtgtggtggctcatgg

SEQ ID NO: 1816380 - DNA, 21 bp, Homo sapiens
gcaggtgtggtggctcatggc

SEQ ID NO: 1816381 - DNA, 23 bp, Homo sapiens
gcaggttgggccatactggcctc

SEQ ID NO: 1816382 - DNA, 14 bp, Homo sapiens
gcagtacctgggaa

SEQ ID NO: 1816383 - DNA, 18 bp, Homo sapiens
gcagtacctgggaaagga

SEQ ID NO: 1816384 - DNA, 22 bp, Homo sapiens
gcagtacctgggaaaggaccca

SEQ ID NO: 1816385 - DNA, 22 bp, Homo sapiens
gcagtccccagcccttctgcct

SEQ ID NO: 1816386 - DNA, 23 bp, Homo sapiens
gcagtccccagcccttctgcctt

SEQ ID NO: 1816387 - DNA, 23 bp, Homo sapiens
gcagtcgcaggatccgctgccac

SEQ ID NO: 1816388 - DNA, 13 bp, Homo sapiens
gcagtctgaaccc

SEQ ID NO: 1816389 - DNA, 19 bp, Homo sapiens
gcagtctgaacccttgtgc

SEQ ID NO: 1816390 - DNA, 23 bp, Homo sapiens
gcagtgaacacactcagcagccc

SEQ ID NO: 1816391 - DNA, 16 bp, Homo sapiens
gcagtgactggcaggt

SEQ ID NO: 1816392 - DNA, 18 bp, Homo sapiens
gcagtgactggcaggtgc

SEQ ID NO: 1816393 - DNA, 22 bp, Homo sapiens
gcagtgggtcccacttcccctc

SEQ ID NO: 1816394 - DNA, 23 bp, Homo sapiens
gcagtgggtcccacttcccctcc

SEQ ID NO: 1816395 - DNA, 13 bp, Homo sapiens
gcatatttccaat

SEQ ID NO: 1816396 - DNA, 14 bp, Homo sapiens
gcatatttccaata

SEQ ID NO: 1816397 - DNA, 18 bp, Homo sapiens
gcatatttccaataacta

SEQ ID NO: 1816398 - DNA, 15 bp, Homo sapiens
gcatccacccagtgc

SEQ ID NO: 1816399 - DNA, 23 bp, Homo sapiens
gcatccacccagtgctgccatgc

SEQ ID NO: 1816400 - DNA, 19 bp, Homo sapiens
gcatcgtagaagagatgtg

SEQ ID NO: 1816401 - DNA, 22 bp, Homo sapiens
gcatcgtagaagagatgtggca

SEQ ID NO: 1816402 - DNA, 21 bp, Homo sapiens
gcatcgtgacccttcagggcc

SEQ ID NO: 1816403 - DNA, 22 bp, Homo sapiens
gcatcgtgacccttcagggcca

SEQ ID NO: 1816404 - DNA, 18 bp, Homo sapiens
gcatgccccctcgtgcca

SEQ ID NO: 1816405 - DNA, 19 bp, Homo sapiens
gcatggttccttccctggg

SEQ ID NO: 1816406 - DNA, 21 bp, Homo sapiens
gcatggttccttccctgggaa

SEQ ID NO: 1816407 - DNA, 19 bp, Homo sapiens
gcatgtgtgcctgtggcag

SEQ ID NO: 1816408 - DNA, 22 bp, Homo sapiens
gcatgttcgtattacaagagaa

SEQ ID NO: 1816409 - DNA, 15 bp, Homo sapiens
gcattggcagcaggt

SEQ ID NO: 1816410 - DNA, 12 bp, Homo sapiens
gcatttttcaga

SEQ ID NO: 1816411 - DNA, 21 bp, Homo sapiens
gccaaaacaatgcccgtaaga

SEQ ID NO: 1816412 - DNA, 21 bp, Homo sapiens
gccaacagtgttaggcctggc

SEQ ID NO: 1816413 - DNA, 15 bp, Homo sapiens
gccaactaagccctc

SEQ ID NO: 1816414 - DNA, 16 bp, Homo sapiens
gccaactaagccctcg

SEQ ID NO: 1816415 - DNA, 13 bp, Homo sapiens
gccacaccaagct

SEQ ID NO: 1816416 - DNA, 20 bp, Homo sapiens
gccacaccaagctgtgccac

SEQ ID NO: 1816417 - DNA, 11 bp, Homo sapiens
gccacattttg

SEQ ID NO: 1816418 - DNA, 15 bp, Homo sapiens
gccaccacgtctgcc

SEQ ID NO: 1816419 - DNA, 16 bp, Homo sapiens
gccaccacgtctgcca

SEQ ID NO: 1816420 - DNA, 20 bp, Homo sapiens
gccaccacgtctgccaggcc

SEQ ID NO: 1816421 - DNA, 18 bp, Homo sapiens
gccaccccaaaccccagc

SEQ ID NO: 1816422 - DNA, 19 bp, Homo sapiens
gccaccccaaaccccagcc

SEQ ID NO: 1816423 - DNA, 23 bp, Homo sapiens
gccaccccaaaccccagccccaa

SEQ ID NO: 1816424 - DNA, 13 bp, Homo sapiens
gccaccctgggct

SEQ ID NO: 1816425 - DNA, 18 bp, Homo sapiens
gccaccctgggctctgtg

SEQ ID NO: 1816426 - DNA, 21 bp, Homo sapiens
gccaccctgggctctgtgggc

SEQ ID NO: 1816427 - DNA, 13 bp, Homo sapiens
gccacctgtctgt

SEQ ID NO: 1816428 - DNA, 14 bp, Homo sapiens
gccacctgtctgtc

SEQ ID NO: 1816429 - DNA, 14 bp, Homo sapiens
gccactccctgagc

SEQ ID NO: 1816430 - DNA, 18 bp, Homo sapiens
gccactcgcagtcgcagg

SEQ ID NO: 1816431 - DNA, 13 bp, Homo sapiens
gccactgccaggc

SEQ ID NO: 1816432 - DNA, 15 bp, Homo sapiens
gccactgccaggcac

SEQ ID NO: 1816433 - DNA, 20 bp, Homo sapiens
gccactgccaggcacctggc

SEQ ID NO: 1816434 - DNA, 12 bp, Homo sapiens
gccactgtggcc

SEQ ID NO: 1816435 - DNA, 13 bp, Homo sapiens
gccactgtggcca

SEQ ID NO: 1816436 - DNA, 14 bp, Homo sapiens
gccactgtggccag

SEQ ID NO: 1816437 - DNA, 19 bp, Homo sapiens
gccactgtggccagagctg

SEQ ID NO: 1816438 - DNA, 20 bp, Homo sapiens
gccactgtggccagagctgg

SEQ ID NO: 1816439 - DNA, 21 bp, Homo sapiens
gccactgtggccagagctgga

SEQ ID NO: 1816440 - DNA, 15 bp, Homo sapiens
gccacttcccaggta

SEQ ID NO: 1816441 - DNA, 21 bp, Homo sapiens
gccacttcttaaaggcctgga

SEQ ID NO: 1816442 - DNA, 22 bp, Homo sapiens
gccacttcttaaaggcctggaa

SEQ ID NO: 1816443 - DNA, 15 bp, Homo sapiens
gccagaaggagggca

SEQ ID NO: 1816444 - DNA, 17 bp, Homo sapiens
gccagaaggagggcaga

SEQ ID NO: 1816445 - DNA, 13 bp, Homo sapiens
gccagagaggagc

SEQ ID NO: 1816446 - DNA, 17 bp, Homo sapiens
gccagagaggagcacct

SEQ ID NO: 1816447 - DNA, 19 bp, Homo sapiens
gccagagaggagcacctga

SEQ ID NO: 1816448 - DNA, 17 bp, Homo sapiens
gccagagagggcccagc

SEQ ID NO: 1816449 - DNA, 14 bp, Homo sapiens
gccagagctggaag

SEQ ID NO: 1816450 - DNA, 16 bp, Homo sapiens
gccagagctggaaggc

SEQ ID NO: 1816451 - DNA, 18 bp, Homo sapiens
gccagagctggaaggcag

SEQ ID NO: 1816452 - DNA, 21 bp, Homo sapiens
gccagagctggaaggcagggc

SEQ ID NO: 1816453 - DNA, 17 bp, Homo sapiens
gccagccccacagccca

SEQ ID NO: 1816454 - DNA, 20 bp, Homo sapiens
gccagcccttccctggcccc

SEQ ID NO: 1816455 - DNA, 12 bp, Homo sapiens
gccagctgcctt

SEQ ID NO: 1816456 - DNA, 17 bp, Homo sapiens
gccaggagtctgtgctc

SEQ ID NO: 1816457 - DNA, 17 bp, Homo sapiens
gccaggcacctggcctg

SEQ ID NO: 1816458 - DNA, 20 bp, Homo sapiens
gccaggcacctggcctgctg

SEQ ID NO: 1816459 - DNA, 19 bp, Homo sapiens
gccaggcccatctcaggtg

SEQ ID NO: 1816460 - DNA, 18 bp, Homo sapiens
gccaggcgttggtgccac

SEQ ID NO: 1816461 - DNA, 21 bp, Homo sapiens
gccaggcgttggtgccacttc

SEQ ID NO: 1816462 - DNA, 17 bp, Homo sapiens
gccagtcgcgctgcctg

SEQ ID NO: 1816463 - DNA, 23 bp, Homo sapiens
gccagtcttgcctaggccaaatg

SEQ ID NO: 1816464 - DNA, 16 bp, Homo sapiens
gccagtgaagtccttc

SEQ ID NO: 1816465 - DNA, 13 bp, Homo sapiens
gccatactggcct

SEQ ID NO: 1816466 - DNA, 14 bp, Homo sapiens
gccatactggcctc

SEQ ID NO: 1816467 - DNA, 15 bp, Homo sapiens
gccatactggcctcg

SEQ ID NO: 1816468 - DNA, 17 bp, Homo sapiens
gccatactggcctcgcc

SEQ ID NO: 1816469 - DNA, 23 bp, Homo sapiens
gccatactggcctcgcctggcct

SEQ ID NO: 1816470 - DNA, 13 bp, Homo sapiens
gccatattttaaa

SEQ ID NO: 1816471 - DNA, 15 bp, Homo sapiens
gccatattttaaaaa

SEQ ID NO: 1816472 - DNA, 17 bp, Homo sapiens
gccatcatgtttacaga

SEQ ID NO: 1816473 - DNA, 17 bp, Homo sapiens
gccatgccactgccagg

SEQ ID NO: 1816474 - DNA, 18 bp, Homo sapiens
gccatgccactgccaggc

SEQ ID NO: 1816475 - DNA, 13 bp, Homo sapiens
gccatgcctcatg

SEQ ID NO: 1816476 - DNA, 15 bp, Homo sapiens
gccatggctcaggca

SEQ ID NO: 1816477 - DNA, 18 bp, Homo sapiens
gccatggctcaggcaagc

SEQ ID NO: 1816478 - DNA, 24 bp, Homo sapiens
gccatggcttccaaggtggtctgc

SEQ ID NO: 1816479 - DNA, 12 bp, Homo sapiens
gccatgggcctg

SEQ ID NO: 1816480 - DNA, 14 bp, Homo sapiens
gccatgggcctggg

SEQ ID NO: 1816481 - DNA, 21 bp, Homo sapiens
gccatgggcctgggcctgctt

SEQ ID NO: 1816482 - DNA, 13 bp, Homo sapiens
gccattcccagcg

SEQ ID NO: 1816483 - DNA, 21 bp, Homo sapiens
gcccaatgctttgggaggcca

SEQ ID NO: 1816484 - DNA, 11 bp, Homo sapiens
gcccacagagc

SEQ ID NO: 1816485 - DNA, 13 bp, Homo sapiens
gcccacagagcct

SEQ ID NO: 1816486 - DNA, 14 bp, Homo sapiens
gctgcagctgggcc

SEQ ID NO: 1816487 - DNA, 16 bp, Homo sapiens
gctgcagctgggcccc

SEQ ID NO: 1816488 - DNA, 19 bp, Homo sapiens
gctgcagctgggccccatg

SEQ ID NO: 1816489 - DNA, 15 bp, Homo sapiens
gctgccaccacgtct

SEQ ID NO: 1816490 - DNA, 16 bp, Homo sapiens
gctgccaccacgtctg

SEQ ID NO: 1816491 - DNA, 20 bp, Homo sapiens
gctgccaccacgtctgccag

SEQ ID NO: 1816492 - DNA, 21 bp, Homo sapiens
gctgccatgccactgccaggc

SEQ ID NO: 1816493 - DNA, 23 bp, Homo sapiens
gctgccatgccactgccaggcac

SEQ ID NO: 1816494 - DNA, 20 bp, Homo sapiens
gctgcccctggtgcactggc

SEQ ID NO: 1816495 - DNA, 18 bp, Homo sapiens
gctgcccctgtctggaag

SEQ ID NO: 1816496 - DNA, 19 bp, Homo sapiens
gctgcccctgtctggaaga

SEQ ID NO: 1816497 - DNA, 12 bp, Homo sapiens
gctgcccgctcc

SEQ ID NO: 1816498 - DNA, 14 bp, Homo sapiens
gctgcccgctccca

SEQ ID NO: 1816499 - DNA, 19 bp, Homo sapiens
gctgcccgctcccagtgtc

SEQ ID NO: 1816500 - DNA, 19 bp, Homo sapiens
gctgcctaataaagagact

SEQ ID NO: 1816501 - DNA, 16 bp, Homo sapiens
gctgcctccactccca

SEQ ID NO: 1816502 - DNA, 12 bp, Homo sapiens
gctgccttcagg

SEQ ID NO: 1816503 - DNA, 16 bp, Homo sapiens
gctgccttcagggaga

SEQ ID NO: 1816504 - DNA, 16 bp, Homo sapiens
gctgccttcctcatcc

SEQ ID NO: 1816505 - DNA, 16 bp, Homo sapiens
gctgcgctaaccccca

SEQ ID NO: 1816506 - DNA, 16 bp, Homo sapiens
gctgcgggtctgaagg

SEQ ID NO: 1816507 - DNA, 17 bp, Homo sapiens
gctgcgggtctgaagga

SEQ ID NO: 1816508 - DNA, 14 bp, Homo sapiens
gctgctaccctccc

SEQ ID NO: 1816509 - DNA, 16 bp, Homo sapiens
gctgctaccctccctg

SEQ ID NO: 1816510 - DNA, 17 bp, Homo sapiens
gctgctaccctccctgc

SEQ ID NO: 1816511 - DNA, 19 bp, Homo sapiens
gctgctaccctccctgctg

SEQ ID NO: 1816512 - DNA, 22 bp, Homo sapiens
gctgctaccctccctgctgtcc

SEQ ID NO: 1816513 - DNA, 18 bp, Homo sapiens
gctgctctagctggcagg

SEQ ID NO: 1816514 - DNA, 12 bp, Homo sapiens
gctgctctgccc

SEQ ID NO: 1816515 - DNA, 20 bp, Homo sapiens
gctgctctgccccttgggca

SEQ ID NO: 1816516 - DNA, 12 bp, Homo sapiens
gctgctggggca

SEQ ID NO: 1816517 - DNA, 15 bp, Homo sapiens
agagcctgaatttgt

SEQ ID NO: 1816518 - DNA, 16 bp, Homo sapiens
agagcctgaatttgta

SEQ ID NO: 1816519 - DNA, 14 bp, Homo sapiens
agagctggaacaca

SEQ ID NO: 1816520 - DNA, 16 bp, Homo sapiens
agagctggaacacaat

SEQ ID NO: 1816521 - DNA, 19 bp, Homo sapiens
agagctggaaggcagggca

SEQ ID NO: 1816522 - DNA, 20 bp, Homo sapiens
agagctggaaggcagggcag

SEQ ID NO: 1816523 - DNA, 23 bp, Homo sapiens
agagctggaaggcagggcagagg

SEQ ID NO: 1816524 - DNA, 19 bp, Homo sapiens
agaggaccacagtgggtgg

SEQ ID NO: 1816525 - DNA, 20 bp, Homo sapiens
agaggaccacagtgggtggc

SEQ ID NO: 1816526 - DNA, 15 bp, Homo sapiens
agaggagaccctgga

SEQ ID NO: 1816527 - DNA, 16 bp, Homo sapiens
agaggctttggcccaa

SEQ ID NO: 1816528 - DNA, 20 bp, Homo sapiens
agagggaccaaattgcttct

SEQ ID NO: 1816529 - DNA, 22 bp, Homo sapiens
agagggaccaaattgcttctag

SEQ ID NO: 1816530 - DNA, 16 bp, Homo sapiens
agagggcagtacctgg

SEQ ID NO: 1816531 - DNA, 18 bp, Homo sapiens
agagggcagtacctggga

SEQ ID NO: 1816532 - DNA, 15 bp, Homo sapiens
agagggcccagctgt

SEQ ID NO: 1816533 - DNA, 23 bp, Homo sapiens
agagggcccagctgtagccatgg

SEQ ID NO: 1816534 - DNA, 13 bp, Homo sapiens
agaggggcagccg

SEQ ID NO: 1816535 - DNA, 14 bp, Homo sapiens
agaggggcagccgc

SEQ ID NO: 1816536 - DNA, 20 bp, Homo sapiens
agaggggcagccgctaggag

SEQ ID NO: 1816537 - DNA, 13 bp, Homo sapiens
agagggggctctc

SEQ ID NO: 1816538 - DNA, 15 bp, Homo sapiens
agaggggtgcaccca

SEQ ID NO: 1816539 - DNA, 23 bp, Homo sapiens
agaggggtgcacccactcaccag

SEQ ID NO: 1816540 - DNA, 22 bp, Homo sapiens
agaggttaaggtgggtccagga

SEQ ID NO: 1816541 - DNA, 17 bp, Homo sapiens
agaggttatctgcctgg

SEQ ID NO: 1816542 - DNA, 16 bp, Homo sapiens
agagtggttgttgcca

SEQ ID NO: 1816543 - DNA, 18 bp, Homo sapiens
agagttattcaaatgaag

SEQ ID NO: 1816544 - DNA, 19 bp, Homo sapiens
agagttattcaaatgaagg

SEQ ID NO: 1816545 - DNA, 19 bp, Homo sapiens
agagttggtgttcataatt

SEQ ID NO: 1816546 - DNA, 19 bp, Homo sapiens
agagtttctgcagttccat

SEQ ID NO: 1816547 - DNA, 13 bp, Homo sapiens
agagttttctaac

SEQ ID NO: 1816548 - DNA, 22 bp, Homo sapiens
agatatatatttactaaaagaa

SEQ ID NO: 1816549 - DNA, 16 bp, Homo sapiens
agatcgcttgagccca

SEQ ID NO: 1816550 - DNA, 18 bp, Homo sapiens
agatcgcttgagcccagg

SEQ ID NO: 1816551 - DNA, 20 bp, Homo sapiens
agatcgcttgagcccaggag

SEQ ID NO: 1816552 - DNA, 18 bp, Homo sapiens
agatctgatggtgagctg

SEQ ID NO: 1816553 - DNA, 19 bp, Homo sapiens
agatctgatggtgagctgg

SEQ ID NO: 1816554 - DNA, 23 bp, Homo sapiens
agatctgcctgggcctgtgcagc

SEQ ID NO: 1816555 - DNA, 18 bp, Homo sapiens
agatgagatttgccagca

SEQ ID NO: 1816556 - DNA, 15 bp, Homo sapiens
agatggccatgctca

SEQ ID NO: 1816557 - DNA, 20 bp, Homo sapiens
agatggcttatttgtataat

SEQ ID NO: 1816558 - DNA, 23 bp, Homo sapiens
agatgtggcaaagtgctgtaccc

SEQ ID NO: 1816559 - DNA, 18 bp, Homo sapiens
agatgtttatctgacaca

SEQ ID NO: 1816560 - DNA, 16 bp, Homo sapiens
agattatatatcataa

SEQ ID NO: 1816561 - DNA, 13 bp, Homo sapiens
agattcctgggcc

SEQ ID NO: 1816562 - DNA, 17 bp, Homo sapiens
agattcctgggcctgtc

SEQ ID NO: 1816563 - DNA, 22 bp, Homo sapiens
agatttctaagttaaatcattt

SEQ ID NO: 1816564 - DNA, 16 bp, Homo sapiens
agcaacagcactttct

SEQ ID NO: 1816565 - DNA, 13 bp, Homo sapiens
agcaacttgcttc

SEQ ID NO: 1816566 - DNA, 14 bp, Homo sapiens
agcaacttgcttct

SEQ ID NO: 1816567 - DNA, 16 bp, Homo sapiens
agcaaggaggctggct

SEQ ID NO: 1816568 - DNA, 20 bp, Homo sapiens
agcaagggctccagcatcca

SEQ ID NO: 1816569 - DNA, 16 bp, Homo sapiens
agcaaggggctctgcc

SEQ ID NO: 1816570 - DNA, 14 bp, Homo sapiens
agcaattgccctgt

SEQ ID NO: 1816571 - DNA, 15 bp, Homo sapiens
agcaattgccctgta

SEQ ID NO: 1816572 - DNA, 13 bp, Homo sapiens
agcacaattcatt

SEQ ID NO: 1816573 - DNA, 23 bp, Homo sapiens
agcacagcaaggaggctggctgg

SEQ ID NO: 1816574 - DNA, 12 bp, Homo sapiens
agcacagccctc

SEQ ID NO: 1816575 - DNA, 21 bp, Homo sapiens
agcacagccctcccgcccctt

SEQ ID NO: 1816576 - DNA, 22 bp, Homo sapiens
agcacagccctgggagggggct

SEQ ID NO: 1816577 - DNA, 20 bp, Homo sapiens
agcacaggggccccagatct

SEQ ID NO: 1816578 - DNA, 21 bp, Homo sapiens
agcacaggggccccagatctg

SEQ ID NO: 1816579 - DNA, 15 bp, Homo sapiens
agcacccgggctcag

SEQ ID NO: 1816580 - DNA, 17 bp, Homo sapiens
agcaccctgggtgccat

SEQ ID NO: 1816581 - DNA, 21 bp, Homo sapiens
agcacctgaaccccatgggct

SEQ ID NO: 1816582 - DNA, 23 bp, Homo sapiens
agcacctgaaccccatgggcttg

SEQ ID NO: 1816583 - DNA, 12 bp, Homo sapiens
agcactggccag

SEQ ID NO: 1816584 - DNA, 13 bp, Homo sapiens
agcactggccaga

SEQ ID NO: 1816585 - DNA, 15 bp, Homo sapiens
agcactggccagaga

SEQ ID NO: 1816586 - DNA, 16 bp, Homo sapiens
agcactggccagagag

SEQ ID NO: 1816587 - DNA, 18 bp, Homo sapiens
agcactttacgctgtctg

SEQ ID NO: 1816588 - DNA, 15 bp, Homo sapiens
agcagcagagagccc

SEQ ID NO: 1816589 - DNA, 22 bp, Homo sapiens
agcagcagctaggactgaggag

SEQ ID NO: 1816590 - DNA, 10 bp, Homo sapiens
agcagccagc

SEQ ID NO: 1816591 - DNA, 14 bp, Homo sapiens
agcagccagccagt

SEQ ID NO: 1816592 - DNA, 16 bp, Homo sapiens
agcagccagccagtct

SEQ ID NO: 1816593 - DNA, 13 bp, Homo sapiens
agcagcccagctt

SEQ ID NO: 1816594 - DNA, 16 bp, Homo sapiens
agcagccccctgcccg

SEQ ID NO: 1816595 - DNA, 20 bp, Homo sapiens
agcagcctgatggccaaggg

SEQ ID NO: 1816596 - DNA, 12 bp, Homo sapiens
agcagctgcggg

SEQ ID NO: 1816597 - DNA, 17 bp, Homo sapiens
agcagctgcgggtctga

SEQ ID NO: 1816598 - DNA, 16 bp, Homo sapiens
agcaggaggaggtgcc

SEQ ID NO: 1816599 - DNA, 21 bp, Homo sapiens
agcagggaaagctccacggtg

SEQ ID NO: 1816600 - DNA, 17 bp, Homo sapiens
agcaggtgctgctaccc

SEQ ID NO: 1816601 - DNA, 18 bp, Homo sapiens
agcaggtgctgctaccct

SEQ ID NO: 1816602 - DNA, 22 bp, Homo sapiens
agcaggtgtggtggctcatggc

SEQ ID NO: 1816603 - DNA, 21 bp, Homo sapiens
agcagtgcctcgaggcaccgg

SEQ ID NO: 1816604 - DNA, 22 bp, Homo sapiens
agcagtgcctcgaggcaccggc

SEQ ID NO: 1816605 - DNA, 18 bp, Homo sapiens
agcatgattttaagaggc

SEQ ID NO: 1816606 - DNA, 19 bp, Homo sapiens
agcatgattttaagaggct

SEQ ID NO: 1816607 - DNA, 22 bp, Homo sapiens
agcattagctacttttcagaat

SEQ ID NO: 1816608 - DNA, 15 bp, Homo sapiens
agcattcaggcagca

SEQ ID NO: 1816609 - DNA, 19 bp, Homo sapiens
agcattcaggcagcactga

SEQ ID NO: 1816610 - DNA, 12 bp, Homo sapiens
agcatttttcag

SEQ ID NO: 1816611 - DNA, 14 bp, Homo sapiens
agcatttttcagag

SEQ ID NO: 1816612 - DNA, 12 bp, Homo sapiens
agccagagagga

SEQ ID NO: 1816613 - DNA, 21 bp, Homo sapiens
agccagcccttccctggcccc

SEQ ID NO: 1816614 - DNA, 15 bp, Homo sapiens
agccagcctgggact

SEQ ID NO: 1816615 - DNA, 19 bp, Homo sapiens
agccagtcttgcctaggcc

SEQ ID NO: 1816616 - DNA, 16 bp, Homo sapiens
agccatgcctcatgcc

SEQ ID NO: 1816617 - DNA, 17 bp, Homo sapiens
agccatgcctcatgcca

SEQ ID NO: 1816618 - DNA, 13 bp, Homo sapiens
aggacacatgtcc

SEQ ID NO: 1816619 - DNA, 16 bp, Homo sapiens
aggacccacccatctt

SEQ ID NO: 1816620 - DNA, 12 bp, Homo sapiens
aggacccaggcc

SEQ ID NO: 1816621 - DNA, 14 bp, Homo sapiens
aggacccaggccct

SEQ ID NO: 1816622 - DNA, 20 bp, Homo sapiens
aggacggggccggccaggtg

SEQ ID NO: 1816623 - DNA, 16 bp, Homo sapiens
aggactatgggtacat

SEQ ID NO: 1816624 - DNA, 14 bp, Homo sapiens
aggagaaaatgcat

SEQ ID NO: 1816625 - DNA, 23 bp, Homo sapiens
aggagagactgaaagcagcagct

SEQ ID NO: 1816626 - DNA, 17 bp, Homo sapiens
aggagagagcagcttct

SEQ ID NO: 1816627 - DNA, 20 bp, Homo sapiens
aggagagagcagcttctgcc

SEQ ID NO: 1816628 - DNA, 18 bp, Homo sapiens
aggagctgatttccaggc

SEQ ID NO: 1816629 - DNA, 18 bp, Homo sapiens
aggaggaggtgccaacag

SEQ ID NO: 1816630 - DNA, 23 bp, Homo sapiens
aggagggcagagccatgggcctg

SEQ ID NO: 1816631 - DNA, 20 bp, Homo sapiens
aggaggggcccgttgtctcc

SEQ ID NO: 1816632 - DNA, 14 bp, Homo sapiens
aggagggtggagga

SEQ ID NO: 1816633 - DNA, 16 bp, Homo sapiens
aggagggtggaggaag

SEQ ID NO: 1816634 - DNA, 22 bp, Homo sapiens
aggagggtggaggaaggtgctg

SEQ ID NO: 1816635 - DNA, 22 bp, Homo sapiens
aggagggttgggcgtgctacct

SEQ ID NO: 1816636 - DNA, 16 bp, Homo sapiens
aggaggtgccaacagt

SEQ ID NO: 1816637 - DNA, 15 bp, Homo sapiens
aggagtcaactggct

SEQ ID NO: 1816638 - DNA, 14 bp, Homo sapiens
aggatactcttaat

SEQ ID NO: 1816639 - DNA, 14 bp, Homo sapiens
aggatccgctgcca

SEQ ID NO: 1816640 - DNA, 13 bp, Homo sapiens
aggatcctgcagg

SEQ ID NO: 1816641 - DNA, 18 bp, Homo sapiens
aggatctcatgacattat

SEQ ID NO: 1816642 - DNA, 21 bp, Homo sapiens
aggatgatttcagaaggagaa

SEQ ID NO: 1816643 - DNA, 21 bp, Homo sapiens
atagttatacatcttcattaa

SEQ ID NO: 1816644 - DNA, 22 bp, Homo sapiens
atataacccactgctgaaaaag

SEQ ID NO: 1816645 - DNA, 14 bp, Homo sapiens
atatatcataaagt

SEQ ID NO: 1816646 - DNA, 18 bp, Homo sapiens
atatatgctcaaccagaa

SEQ ID NO: 1816647 - DNA, 15 bp, Homo sapiens
atatatgtatatgta

SEQ ID NO: 1816648 - DNA, 21 bp, Homo sapiens
atatatgtatatgtatatcta

SEQ ID NO: 1816649 - DNA, 22 bp, Homo sapiens
atatattaaaatgtaggaagaa

SEQ ID NO: 1816650 - DNA, 18 bp, Homo sapiens
atatatttactaaaagaa

SEQ ID NO: 1816651 - DNA, 15 bp, Homo sapiens
atatcagtcatgact

SEQ ID NO: 1816652 - DNA, 15 bp, Homo sapiens
atatcataaagtatg

SEQ ID NO: 1816653 - DNA, 13 bp, Homo sapiens
atatctatatctc

SEQ ID NO: 1816654 - DNA, 19 bp, Homo sapiens
atatctgagaagtgtatat

SEQ ID NO: 1816655 - DNA, 23 bp, Homo sapiens
atatctgagaattgcaaaactag

SEQ ID NO: 1816656 - DNA, 21 bp, Homo sapiens
atatgaagtattaaaatgcat

SEQ ID NO: 1816657 - DNA, 14 bp, Homo sapiens
atatgagaaataca

SEQ ID NO: 1816658 - DNA, 15 bp, Homo sapiens
atatgagaaatacag

SEQ ID NO: 1816659 - DNA, 17 bp, Homo sapiens
atatgagagaactattg

SEQ ID NO: 1816660 - DNA, 15 bp, Homo sapiens
atatgggtttgaact

SEQ ID NO: 1816661 - DNA, 14 bp, Homo sapiens
atatgtatatctat

SEQ ID NO: 1816662 - DNA, 16 bp, Homo sapiens
atattagcaaagaagc

SEQ ID NO: 1816663 - DNA, 18 bp, Homo sapiens
atattaggggatggagag

SEQ ID NO: 1816664 - DNA, 21 bp, Homo sapiens
atattctacacatatatgtat

SEQ ID NO: 1816665 - DNA, 22 bp, Homo sapiens
atattctacacatatatgtata

SEQ ID NO: 1816666 - DNA, 17 bp, Homo sapiens
atattctctaagatata

SEQ ID NO: 1816667 - DNA, 21 bp, Homo sapiens
atattgctctaattcttttca

SEQ ID NO: 1816668 - DNA, 16 bp, Homo sapiens
atattgttataaataa

SEQ ID NO: 1816669 - DNA, 14 bp, Homo sapiens
atatttatttatgt

SEQ ID NO: 1816670 - DNA, 15 bp, Homo sapiens
atatttatttatgta

SEQ ID NO: 1816671 - DNA, 16 bp, Homo sapiens
atatttctatgttgta

SEQ ID NO: 1816672 - DNA, 19 bp, Homo sapiens
atatttctatgttgtaata

SEQ ID NO: 1816673 - DNA, 18 bp, Homo sapiens
atatttgagtttctttca

SEQ ID NO: 1816674 - DNA, 16 bp, Homo sapiens
atattttaaaaaatca

SEQ ID NO: 1816675 - DNA, 19 bp, Homo sapiens
atattttaaaaaatcaaaa

SEQ ID NO: 1816676 - DNA, 16 bp, Homo sapiens
atattttattaaaaca

SEQ ID NO: 1816677 - DNA, 16 bp, Homo sapiens
atatttttcaaaatca

SEQ ID NO: 1816678 - DNA, 18 bp, Homo sapiens
atatttttcaaaatcaaa

SEQ ID NO: 1816679 - DNA, 19 bp, Homo sapiens
atatttttcaaaatcaaag

SEQ ID NO: 1816680 - DNA, 19 bp, Homo sapiens
atcaaaaggcactgtgaac

SEQ ID NO: 1816681 - DNA, 12 bp, Homo sapiens
atcaaaatcaaa

SEQ ID NO: 1816682 - DNA, 13 bp, Homo sapiens
atcaaaatcaaaa

SEQ ID NO: 1816683 - DNA, 15 bp, Homo sapiens
atcaaagcaagggct

SEQ ID NO: 1816684 - DNA, 19 bp, Homo sapiens
atcaacagccaaactgctg

SEQ ID NO: 1816685 - DNA, 14 bp, Homo sapiens
atcaacattgaata

SEQ ID NO: 1816686 - DNA, 19 bp, Homo sapiens
atcaagcaaaatttctgta

SEQ ID NO: 1816687 - DNA, 13 bp, Homo sapiens
atcaagtctgtga

SEQ ID NO: 1816688 - DNA, 14 bp, Homo sapiens
atcaagtctgtgaa

SEQ ID NO: 1816689 - DNA, 20 bp, Homo sapiens
atcacaggggcggggcagga

SEQ ID NO: 1816690 - DNA, 17 bp, Homo sapiens
atcactagtcaagaaaa

SEQ ID NO: 1816691 - DNA, 18 bp, Homo sapiens
atcagaatcgctaataga

SEQ ID NO: 1816692 - DNA, 17 bp, Homo sapiens
atcagttgacagaatgg

SEQ ID NO: 1816693 - DNA, 17 bp, Homo sapiens
atcattcattcactgta

SEQ ID NO: 1816694 - DNA, 18 bp, Homo sapiens
atcattcattcactgtat

SEQ ID NO: 1816695 - DNA, 20 bp, Homo sapiens
atcattggccctcattccaa

SEQ ID NO: 1816696 - DNA, 19 bp, Homo sapiens
atcattggtatctgatatc

SEQ ID NO: 1816697 - DNA, 21 bp, Homo sapiens
atcatttaggatactcttaat

SEQ ID NO: 1816698 - DNA, 18 bp, Homo sapiens
atccacccagtgctgcca

SEQ ID NO: 1816699 - DNA, 20 bp, Homo sapiens
atccacccagtgctgccatg

SEQ ID NO: 1816700 - DNA, 19 bp, Homo sapiens
atccatagcacctccacat

SEQ ID NO: 1816701 - DNA, 13 bp, Homo sapiens
atccatcctgcga

SEQ ID NO: 1816702 - DNA, 20 bp, Homo sapiens
atccatggggctgattgtat

SEQ ID NO: 1816703 - DNA, 19 bp, Homo sapiens
atcccctcgtcctgtccca

SEQ ID NO: 1816704 - DNA, 23 bp, Homo sapiens
atcccctcgtcctgtcccagagg

SEQ ID NO: 1816705 - DNA, 18 bp, Homo sapiens
atcccggcctcttccacc

SEQ ID NO: 1816706 - DNA, 18 bp, Homo sapiens
atccctcggaagccgtct

SEQ ID NO: 1816707 - DNA, 19 bp, Homo sapiens
atccctcggaagccgtctg

SEQ ID NO: 1816708 - DNA, 13 bp, Homo sapiens
atcctcattcact

SEQ ID NO: 1816709 - DNA, 22 bp, Homo sapiens
aggatgatttcagaaggagaag

SEQ ID NO: 1816710 - DNA, 13 bp, Homo sapiens
aggatgtctgggc

SEQ ID NO: 1816711 - DNA, 14 bp, Homo sapiens
aggcaaagaatcaa

SEQ ID NO: 1816712 - DNA, 14 bp, Homo sapiens
aggcaagcccctca

SEQ ID NO: 1816713 - DNA, 16 bp, Homo sapiens
aggcaagcccctcagc

SEQ ID NO: 1816714 - DNA, 20 bp, Homo sapiens
aggcaagcccctcagccctt

SEQ ID NO: 1816715 - DNA, 23 bp, Homo sapiens
aggcaagcccctcagcccttgcc

SEQ ID NO: 1816716 - DNA, 15 bp, Homo sapiens
aggcaccagctctgt

SEQ ID NO: 1816717 - DNA, 16 bp, Homo sapiens
aggcaccagctctgtg

SEQ ID NO: 1816718 - DNA, 17 bp, Homo sapiens
aggcaccggcgctgcag

SEQ ID NO: 1816719 - DNA, 18 bp, Homo sapiens
aggcaccggcgctgcagg

SEQ ID NO: 1816720 - DNA, 19 bp, Homo sapiens
aggcaccggcgctgcaggt

SEQ ID NO: 1816721 - DNA, 20 bp, Homo sapiens
aggcaccggcgctgcaggta

SEQ ID NO: 1816722 - DNA, 14 bp, Homo sapiens
aggcacctgcaggt

SEQ ID NO: 1816723 - DNA, 22 bp, Homo sapiens
aggcacctggcctgctgggaac

SEQ ID NO: 1816724 - DNA, 15 bp, Homo sapiens
aggcactggtggcat

SEQ ID NO: 1816725 - DNA, 16 bp, Homo sapiens
aggcactggtggcatc

SEQ ID NO: 1816726 - DNA, 17 bp, Homo sapiens
aggcagcctccagagcc

SEQ ID NO: 1816727 - DNA, 18 bp, Homo sapiens
aggcagcctccagagcca

SEQ ID NO: 1816728 - DNA, 21 bp, Homo sapiens
aggcagcctccagagccagcc

SEQ ID NO: 1816729 - DNA, 14 bp, Homo sapiens
aggcagctgctctt

SEQ ID NO: 1816730 - DNA, 13 bp, Homo sapiens
aggcagggcagag

SEQ ID NO: 1816731 - DNA, 14 bp, Homo sapiens
aggcagtctgaacc

SEQ ID NO: 1816732 - DNA, 18 bp, Homo sapiens
aggcagtgggtcccactt

SEQ ID NO: 1816733 - DNA, 19 bp, Homo sapiens
aggcagtgggtcccacttc

SEQ ID NO: 1816734 - DNA, 17 bp, Homo sapiens
aggcatatttccaataa

SEQ ID NO: 1816735 - DNA, 23 bp, Homo sapiens
aggcattttatatgaattataaa

SEQ ID NO: 1816736 - DNA, 22 bp, Homo sapiens
aggccaaatgcacaagctcaga

SEQ ID NO: 1816737 - DNA, 14 bp, Homo sapiens
aggccaccccaaac

SEQ ID NO: 1816738 - DNA, 20 bp, Homo sapiens
aggccaccccaaaccccagc

SEQ ID NO: 1816739 - DNA, 21 bp, Homo sapiens
aggccactgtggccagagctg

SEQ ID NO: 1816740 - DNA, 22 bp, Homo sapiens
aggccactgtggccagagctgg

SEQ ID NO: 1816741 - DNA, 15 bp, Homo sapiens
aggccatattttaaa

SEQ ID NO: 1816742 - DNA, 23 bp, Homo sapiens
aggccatattttaaaaaatcaaa

SEQ ID NO: 1816743 - DNA, 15 bp, Homo sapiens
aggccatcttccagg

SEQ ID NO: 1816744 - DNA, 21 bp, Homo sapiens
aggcccatctcaggtgccact

SEQ ID NO: 1816745 - DNA, 22 bp, Homo sapiens
aggcccatctcaggtgccactc

SEQ ID NO: 1816746 - DNA, 15 bp, Homo sapiens
aggcccctgaggact

SEQ ID NO: 1816747 - DNA, 21 bp, Homo sapiens
aggcccctgaggactggagac

SEQ ID NO: 1816748 - DNA, 22 bp, Homo sapiens
aggccctccctgtctccagggc

SEQ ID NO: 1816749 - DNA, 15 bp, Homo sapiens
aggccctgcactgtc

SEQ ID NO: 1816750 - DNA, 18 bp, Homo sapiens
aggccctgcactgtcctg

SEQ ID NO: 1816751 - DNA, 21 bp, Homo sapiens
aggccctgcactgtcctgctc

SEQ ID NO: 1816752 - DNA, 22 bp, Homo sapiens
aggccctgcactgtcctgctcc

SEQ ID NO: 1816753 - DNA, 23 bp, Homo sapiens
aggccctgcactgtcctgctcca

SEQ ID NO: 1816754 - DNA, 22 bp, Homo sapiens
aggcctcagtttctccatcagc

SEQ ID NO: 1816755 - DNA, 13 bp, Homo sapiens
aggcctccagcct

SEQ ID NO: 1816756 - DNA, 17 bp, Homo sapiens
aggcctccagcctctcc

SEQ ID NO: 1816757 - DNA, 22 bp, Homo sapiens
aggcctccagcctctcccggct

SEQ ID NO: 1816758 - DNA, 21 bp, Homo sapiens
aggcctctcattccagaggaa

SEQ ID NO: 1816759 - DNA, 15 bp, Homo sapiens
aggcctcttgtgctc

SEQ ID NO: 1816760 - DNA, 20 bp, Homo sapiens
aggcctcttgtgctcacgct

SEQ ID NO: 1816761 - DNA, 21 bp, Homo sapiens
aggcctcttgtgctcacgctc

SEQ ID NO: 1816762 - DNA, 17 bp, Homo sapiens
aggcctgatgctgcccc

SEQ ID NO: 1816763 - DNA, 19 bp, Homo sapiens
aggcctggaaccagggagg

SEQ ID NO: 1816764 - DNA, 20 bp, Homo sapiens
aggcctggaaccagggagga

SEQ ID NO: 1816765 - DNA, 15 bp, Homo sapiens
aggcctgggacccag

SEQ ID NO: 1816766 - DNA, 15 bp, Homo sapiens
aggcgttggtgccac

SEQ ID NO: 1816767 - DNA, 16 bp, Homo sapiens
aggcgttggtgccact

SEQ ID NO: 1816768 - DNA, 18 bp, Homo sapiens
aggctaagttcagttctg

SEQ ID NO: 1816769 - DNA, 21 bp, Homo sapiens
aggctatggggatagatgtgt

SEQ ID NO: 1816770 - DNA, 22 bp, Homo sapiens
aggctctcccctctcgccccat

SEQ ID NO: 1816771 - DNA, 12 bp, Homo sapiens
aggctctgggct

SEQ ID NO: 1816772 - DNA, 19 bp, Homo sapiens
aggctctgggctcagggct

SEQ ID NO: 1816773 - DNA, 15 bp, Homo sapiens
aggctgcactgcagt

SEQ ID NO: 1816774 - DNA, 17 bp, Homo sapiens
aggctgcactgcagtga

SEQ ID NO: 1816775 - DNA, 21 bp, Homo sapiens
aggctgcactgcagtgatggc

SEQ ID NO: 1816776 - DNA, 18 bp, Homo sapiens
aggctggccagccccaca

SEQ ID NO: 1816777 - DNA, 19 bp, Homo sapiens
aggctggccagccccacag

SEQ ID NO: 1816778 - DNA, 15 bp, Homo sapiens
aggctggctgagtgg

SEQ ID NO: 1816779 - DNA, 15 bp, Homo sapiens
aggctggctggggcc

SEQ ID NO: 1816780 - DNA, 17 bp, Homo sapiens
aggctggctggggccta

SEQ ID NO: 1816781 - DNA, 14 bp, Homo sapiens
aggcttccaggctc

SEQ ID NO: 1816782 - DNA, 15 bp, Homo sapiens
aggcttccaggctct

SEQ ID NO: 1816783 - DNA, 18 bp, Homo sapiens
aggcttccaggctcttcc

SEQ ID NO: 1816784 - DNA, 13 bp, Homo sapiens
aggctttggccca

SEQ ID NO: 1816785 - DNA, 21 bp, Homo sapiens
agggaaagcgggcagccccgt

SEQ ID NO: 1816786 - DNA, 12 bp, Homo sapiens
agggaagagggc

SEQ ID NO: 1816787 - DNA, 18 bp, Homo sapiens
atgggcactgctgggtgg

SEQ ID NO: 1816788 - DNA, 16 bp, Homo sapiens
atgggcattgggctga

SEQ ID NO: 1816789 - DNA, 19 bp, Homo sapiens
atgggcattgggctgacac

SEQ ID NO: 1816790 - DNA, 11 bp, Homo sapiens
atgggcctggg

SEQ ID NO: 1816791 - DNA, 18 bp, Homo sapiens
atgggcctgggcctgctt

SEQ ID NO: 1816792 - DNA, 19 bp, Homo sapiens
atgggccttgctttgggct

SEQ ID NO: 1816793 - DNA, 21 bp, Homo sapiens
atgggccttgctttgggcttt

SEQ ID NO: 1816794 - DNA, 23 bp, Homo sapiens
atgggctagtgtgagtggcagcc

SEQ ID NO: 1816795 - DNA, 22 bp, Homo sapiens
atgggcttggacttcctggggc

SEQ ID NO: 1816796 - DNA, 23 bp, Homo sapiens
atgggcttggacttcctggggcc

SEQ ID NO: 1816797 - DNA, 9 bp, Homo sapiens
atggtgcct

SEQ ID NO: 1816798 - DNA, 18 bp, Homo sapiens
atggttccttccctggga

SEQ ID NO: 1816799 - DNA, 16 bp, Homo sapiens
atggttctcaggcctg

SEQ ID NO: 1816800 - DNA, 14 bp, Homo sapiens
atgtaaaaatgaag

SEQ ID NO: 1816801 - DNA, 16 bp, Homo sapiens
atgtaagtttgcatat

SEQ ID NO: 1816802 - DNA, 20 bp, Homo sapiens
atgtaagtttgcatatcagt

SEQ ID NO: 1816803 - DNA, 13 bp, Homo sapiens
atgtaatactgta

SEQ ID NO: 1816804 - DNA, 19 bp, Homo sapiens
atgtaatactgtagaaata

SEQ ID NO: 1816805 - DNA, 22 bp, Homo sapiens
atgtaatactgtagaaatattg

SEQ ID NO: 1816806 - DNA, 14 bp, Homo sapiens
atgtacctatgtga

SEQ ID NO: 1816807 - DNA, 16 bp, Homo sapiens
atgtagaataaatgaa

SEQ ID NO: 1816808 - DNA, 23 bp, Homo sapiens
atgtataaatgtaaaaatgaagg

SEQ ID NO: 1816809 - DNA, 15 bp, Homo sapiens
atgtatatctatatc

SEQ ID NO: 1816810 - DNA, 18 bp, Homo sapiens
atgtcaataactttatat

SEQ ID NO: 1816811 - DNA, 21 bp, Homo sapiens
atgtcagaaactcgatgaatg

SEQ ID NO: 1816812 - DNA, 16 bp, Homo sapiens
atgtgagtttcagaaa

SEQ ID NO: 1816813 - DNA, 19 bp, Homo sapiens
atgtgcctgcaccaggaga

SEQ ID NO: 1816814 - DNA, 23 bp, Homo sapiens
atgtggaagtgtgggtctgtgtg

SEQ ID NO: 1816815 - DNA, 18 bp, Homo sapiens
atgtggatggaggtgatg

SEQ ID NO: 1816816 - DNA, 10 bp, Homo sapiens
atgtggctga

SEQ ID NO: 1816817 - DNA, 14 bp, Homo sapiens
atgtggctgaagac

SEQ ID NO: 1816818 - DNA, 12 bp, Homo sapiens
atgtgtgcctgt

SEQ ID NO: 1816819 - DNA, 18 bp, Homo sapiens
atgtgtgcctgtggcaga

SEQ ID NO: 1816820 - DNA, 15 bp, Homo sapiens
atgtgtggggcatgg

SEQ ID NO: 1816821 - DNA, 19 bp, Homo sapiens
atgttattggaattttctt

SEQ ID NO: 1816822 - DNA, 14 bp, Homo sapiens
atgttatttggaat

SEQ ID NO: 1816823 - DNA, 13 bp, Homo sapiens
atgttccctgcac

SEQ ID NO: 1816824 - DNA, 16 bp, Homo sapiens
atgttcccttgaccat

SEQ ID NO: 1816825 - DNA, 15 bp, Homo sapiens
atgtttacagaggac

SEQ ID NO: 1816826 - DNA, 18 bp, Homo sapiens
attaaaatgcatatttct

SEQ ID NO: 1816827 - DNA, 22 bp, Homo sapiens
attaaaatgcatatttctatgt

SEQ ID NO: 1816828 - DNA, 13 bp, Homo sapiens
attaaatctgaca

SEQ ID NO: 1816829 - DNA, 21 bp, Homo sapiens
attaaatgttgcacatcattc

SEQ ID NO: 1816830 - DNA, 22 bp, Homo sapiens
attaagtctcagtacacttcct

SEQ ID NO: 1816831 - DNA, 15 bp, Homo sapiens
attaatctttctata

SEQ ID NO: 1816832 - DNA, 22 bp, Homo sapiens
attatataacccactgctgaaa

SEQ ID NO: 1816833 - DNA, 13 bp, Homo sapiens
attatatatcata

SEQ ID NO: 1816834 - DNA, 17 bp, Homo sapiens
attatatatcataaagt

SEQ ID NO: 1816835 - DNA, 18 bp, Homo sapiens
attatatatcataaagta

SEQ ID NO: 1816836 - DNA, 23 bp, Homo sapiens
attatattcctctaaaactctca

SEQ ID NO: 1816837 - DNA, 17 bp, Homo sapiens
attatcccttcttatac

SEQ ID NO: 1816838 - DNA, 14 bp, Homo sapiens
attatctgtactga

SEQ ID NO: 1816839 - DNA, 15 bp, Homo sapiens
attatctgtactgaa

SEQ ID NO: 1816840 - DNA, 13 bp, Homo sapiens
attatgttattgg

SEQ ID NO: 1816841 - DNA, 22 bp, Homo sapiens
attatgttattggaattttctt

SEQ ID NO: 1816842 - DNA, 19 bp, Homo sapiens
attattgtgatttcccgtg

SEQ ID NO: 1816843 - DNA, 21 bp, Homo sapiens
attatttcaaccgcttgccat

SEQ ID NO: 1816844 - DNA, 22 bp, Homo sapiens
attatttcaaccgcttgccata

SEQ ID NO: 1816845 - DNA, 16 bp, Homo sapiens
attatttctccatccc

SEQ ID NO: 1816846 - DNA, 11 bp, Homo sapiens
attcaatgcaa

SEQ ID NO: 1816847 - DNA, 17 bp, Homo sapiens
attcaatgcaatgaaaa

SEQ ID NO: 1816848 - DNA, 21 bp, Homo sapiens
attcaatgcaatgaaaacaaa

SEQ ID NO: 1816849 - DNA, 17 bp, Homo sapiens
attcagcaccctgggtg

SEQ ID NO: 1816850 - DNA, 17 bp, Homo sapiens
ctggaaggcagggcaga

SEQ ID NO: 1816851 - DNA, 19 bp, Homo sapiens
ctggaaggcagggcagagg

SEQ ID NO: 1816852 - DNA, 17 bp, Homo sapiens
ctggaaggctggctgag

SEQ ID NO: 1816853 - DNA, 18 bp, Homo sapiens
ctggaaggctggctgagt

SEQ ID NO: 1816854 - DNA, 16 bp, Homo sapiens
ctggaattcagcaccc

SEQ ID NO: 1816855 - DNA, 18 bp, Homo sapiens
ctggaattcagcaccctg

SEQ ID NO: 1816856 - DNA, 22 bp, Homo sapiens
ctggaattcagcaccctgggtg

SEQ ID NO: 1816857 - DNA, 15 bp, Homo sapiens
ctggacaagaagctg

SEQ ID NO: 1816858 - DNA, 16 bp, Homo sapiens
ctggacaagaagctgc

SEQ ID NO: 1816859 - DNA, 14 bp, Homo sapiens
ctggacatattccc

SEQ ID NO: 1816860 - DNA, 15 bp, Homo sapiens
ctggacctgagtcgg

SEQ ID NO: 1816861 - DNA, 14 bp, Homo sapiens
ctggagacttcctc

SEQ ID NO: 1816862 - DNA, 17 bp, Homo sapiens
ctggagacttcctctgg

SEQ ID NO: 1816863 - DNA, 16 bp, Homo sapiens
ctggagtgaggcttcc

SEQ ID NO: 1816864 - DNA, 22 bp, Homo sapiens
ctggagtgaggcttccaggctc

SEQ ID NO: 1816865 - DNA, 23 bp, Homo sapiens
ctggagtgaggcttccaggctct

SEQ ID NO: 1816866 - DNA, 14 bp, Homo sapiens
ctggagtgcagtgg

SEQ ID NO: 1816867 - DNA, 24 bp, Homo sapiens
ctggagtgcgctcttggtccctgg

SEQ ID NO: 1816868 - DNA, 13 bp, Homo sapiens
ctggatactgtac

SEQ ID NO: 1816869 - DNA, 15 bp, Homo sapiens
ctggatactgtactg

SEQ ID NO: 1816870 - DNA, 20 bp, Homo sapiens
ctggatgggcattgggctga

SEQ ID NO: 1816871 - DNA, 17 bp, Homo sapiens
ctggatgtgtggggcat

SEQ ID NO: 1816872 - DNA, 17 bp, Homo sapiens
ctggcaagcagggaaag

SEQ ID NO: 1816873 - DNA, 14 bp, Homo sapiens
ctggcacagtgtct

SEQ ID NO: 1816874 - DNA, 23 bp, Homo sapiens
ctggcagctcctctccttgggct

SEQ ID NO: 1816875 - DNA, 23 bp, Homo sapiens
ctggcaggacacatcccggcctc

SEQ ID NO: 1816876 - DNA, 22 bp, Homo sapiens
ctggcaggtgcagatgggctgt

SEQ ID NO: 1816877 - DNA, 17 bp, Homo sapiens
ctggccagagagggccc

SEQ ID NO: 1816878 - DNA, 18 bp, Homo sapiens
ctggccagagagggccca

SEQ ID NO: 1816879 - DNA, 20 bp, Homo sapiens
ctggccagagagggcccagc

SEQ ID NO: 1816880 - DNA, 23 bp, Homo sapiens
ctggccagagagggcccagctgt

SEQ ID NO: 1816881 - DNA, 13 bp, Homo sapiens
ctggccagcccca

SEQ ID NO: 1816882 - DNA, 15 bp, Homo sapiens
ctggccagccccaca

SEQ ID NO: 1816883 - DNA, 15 bp, Homo sapiens
ctggcccagctcccc

SEQ ID NO: 1816884 - DNA, 22 bp, Homo sapiens
ctggcccagctcccccgggagg

SEQ ID NO: 1816885 - DNA, 23 bp, Homo sapiens
ctggccccaccctcgtggacacc

SEQ ID NO: 1816886 - DNA, 23 bp, Homo sapiens
ctggccctatgcttccggcctcc

SEQ ID NO: 1816887 - DNA, 16 bp, Homo sapiens
ctggccctcaaggcct

SEQ ID NO: 1816888 - DNA, 21 bp, Homo sapiens
ctggccctcaaggcctcccac

SEQ ID NO: 1816889 - DNA, 21 bp, Homo sapiens
ctggcctcactggctggggca

SEQ ID NO: 1816890 - DNA, 12 bp, Homo sapiens
ctggcctcgcct

SEQ ID NO: 1816891 - DNA, 18 bp, Homo sapiens
ctggcctcgcctggcctg

SEQ ID NO: 1816892 - DNA, 13 bp, Homo sapiens
ctggcctgagctg

SEQ ID NO: 1816893 - DNA, 18 bp, Homo sapiens
ctggcctgagctggggcc

SEQ ID NO: 1816894 - DNA, 12 bp, Homo sapiens
ctggcctgctgg

SEQ ID NO: 1816895 - DNA, 19 bp, Homo sapiens
ctggcctggctccccacga

SEQ ID NO: 1816896 - DNA, 13 bp, Homo sapiens
ctggcggcttcct

SEQ ID NO: 1816897 - DNA, 19 bp, Homo sapiens
ctggcggcttcctgtccac

SEQ ID NO: 1816898 - DNA, 13 bp, Homo sapiens
ctggctgagggga

SEQ ID NO: 1816899 - DNA, 21 bp, Homo sapiens
ctggctgagtggaatgcaggg

SEQ ID NO: 1816900 - DNA, 24 bp, Homo sapiens
ctggctgagtggaatgcagggaag

SEQ ID NO: 1816901 - DNA, 16 bp, Homo sapiens
ctggctgccaggcgtt

SEQ ID NO: 1816902 - DNA, 23 bp, Homo sapiens
ctggctgccaggcgttggtgcca

SEQ ID NO: 1816903 - DNA, 16 bp, Homo sapiens
ctggctgcctccactc

SEQ ID NO: 1816904 - DNA, 22 bp, Homo sapiens
ctggctgcctccactcccactt

SEQ ID NO: 1816905 - DNA, 17 bp, Homo sapiens
ctggctggggcagaggg

SEQ ID NO: 1816906 - DNA, 22 bp, Homo sapiens
ctggctggggcagaggggcagc

SEQ ID NO: 1816907 - DNA, 23 bp, Homo sapiens
ctggctggggcctatcagtgtgc

SEQ ID NO: 1816908 - DNA, 24 bp, Homo sapiens
ctggctggggcctatcagtgtgcc

SEQ ID NO: 1816909 - DNA, 15 bp, Homo sapiens
ctggctgtggaggcc

SEQ ID NO: 1816910 - DNA, 21 bp, Homo sapiens
ctggctgtggaggcctgatgc

SEQ ID NO: 1816911 - DNA, 14 bp, Homo sapiens
ctggcttgctccag

SEQ ID NO: 1816912 - DNA, 17 bp, Homo sapiens
ctggcttgctccagggt

SEQ ID NO: 1816913 - DNA, 17 bp, Homo sapiens
ctgggaaaggacccacc

SEQ ID NO: 1816914 - DNA, 13 bp, Homo sapiens
ctgggaaccccgc

SEQ ID NO: 1816915 - DNA, 17 bp, Homo sapiens
ctgggaaccccgcagcc

SEQ ID NO: 1816916 - DNA, 22 bp, Homo sapiens
ctgggaagctgtactcagagca

SEQ ID NO: 1816917 - DNA, 14 bp, Homo sapiens
ctgggaaggctaag

SEQ ID NO: 1816918 - DNA, 14 bp, Homo sapiens
ctgggaagggagag

SEQ ID NO: 1816919 - DNA, 20 bp, Homo sapiens
ctgggaagggagagttcttt

SEQ ID NO: 1816920 - DNA, 17 bp, Homo sapiens
ctgggacccagctactc

SEQ ID NO: 1816921 - DNA, 22 bp, Homo sapiens
ctgggacccagctactctgtcc

SEQ ID NO: 1816922 - DNA, 14 bp, Homo sapiens
ctgggactcccagt

SEQ ID NO: 1816923 - DNA, 23 bp, Homo sapiens
ctgggagagctggtggtgcagcc

SEQ ID NO: 1816924 - DNA, 16 bp, Homo sapiens
ccctctcgccccatcc

SEQ ID NO: 1816925 - DNA, 21 bp, Homo sapiens
ccctctcgccccatccctgct

SEQ ID NO: 1816926 - DNA, 16 bp, Homo sapiens
ccctctgccccaagca

SEQ ID NO: 1816927 - DNA, 17 bp, Homo sapiens
ccctctgccccaagcag

SEQ ID NO: 1816928 - DNA, 21 bp, Homo sapiens
ccctctgtcatcactccctgg

SEQ ID NO: 1816929 - DNA, 23 bp, Homo sapiens
ccctctgtcatcactccctggat

SEQ ID NO: 1816930 - DNA, 14 bp, Homo sapiens
ccctctgtcctgac

SEQ ID NO: 1816931 - DNA, 12 bp, Homo sapiens
ccctcttgcccc

SEQ ID NO: 1816932 - DNA, 19 bp, Homo sapiens
ccctcttgccccaaccccc

SEQ ID NO: 1816933 - DNA, 23 bp, Homo sapiens
ccctcttgccccaacccccagca

SEQ ID NO: 1816934 - DNA, 20 bp, Homo sapiens
ccctgacactgcggggcttg

SEQ ID NO: 1816935 - DNA, 19 bp, Homo sapiens
ccctgagactccagaatct

SEQ ID NO: 1816936 - DNA, 13 bp, Homo sapiens
ccctgagctttgg

SEQ ID NO: 1816937 - DNA, 13 bp, Homo sapiens
ccctgaggactgg

SEQ ID NO: 1816938 - DNA, 12 bp, Homo sapiens
ccctgcaccctg

SEQ ID NO: 1816939 - DNA, 14 bp, Homo sapiens
ccctgcaccctgga

SEQ ID NO: 1816940 - DNA, 14 bp, Homo sapiens
ccctgcactgtcct

SEQ ID NO: 1816941 - DNA, 17 bp, Homo sapiens
ccctgccacctgtctgt

SEQ ID NO: 1816942 - DNA, 18 bp, Homo sapiens
ccctgccacctgtctgtc

SEQ ID NO: 1816943 - DNA, 22 bp, Homo sapiens
ccctgccagtgaagtccttcag

SEQ ID NO: 1816944 - DNA, 15 bp, Homo sapiens
ccctgcccccatctc

SEQ ID NO: 1816945 - DNA, 23 bp, Homo sapiens
ccctgcccccatctccccaggcc

SEQ ID NO: 1816946 - DNA, 15 bp, Homo sapiens
ccctgccctgccacc

SEQ ID NO: 1816947 - DNA, 17 bp, Homo sapiens
ccctgccctgccacctg

SEQ ID NO: 1816948 - DNA, 14 bp, Homo sapiens
ccctgcctgcccac

SEQ ID NO: 1816949 - DNA, 22 bp, Homo sapiens
ccctgcgtcctgacgccctgcg

SEQ ID NO: 1816950 - DNA, 19 bp, Homo sapiens
ccctggaaaggggagttga

SEQ ID NO: 1816951 - DNA, 18 bp, Homo sapiens
ccctggaattcagcaccc

SEQ ID NO: 1816952 - DNA, 20 bp, Homo sapiens
ccctggaattcagcaccctg

SEQ ID NO: 1816953 - DNA, 21 bp, Homo sapiens
ccctggaattcagcaccctgg

SEQ ID NO: 1816954 - DNA, 21 bp, Homo sapiens
ccctggatgggcattgggctg

SEQ ID NO: 1816955 - DNA, 22 bp, Homo sapiens
ccctggatgggcattgggctga

SEQ ID NO: 1816956 - DNA, 20 bp, Homo sapiens
ccctggccctcaaggcctcc

SEQ ID NO: 1816957 - DNA, 22 bp, Homo sapiens
ccctggccctcaaggcctccca

SEQ ID NO: 1816958 - DNA, 16 bp, Homo sapiens
ccctgtacccagctcc

SEQ ID NO: 1816959 - DNA, 13 bp, Homo sapiens
ccctgtctccagg

SEQ ID NO: 1816960 - DNA, 15 bp, Homo sapiens
ccctgtctccagggc

SEQ ID NO: 1816961 - DNA, 24 bp, Homo sapiens
ccctgtgccttggtgtgctgtatc

SEQ ID NO: 1816962 - DNA, 20 bp, Homo sapiens
cccttaagggttgaaggcag

SEQ ID NO: 1816963 - DNA, 19 bp, Homo sapiens
cccttcagaacagaggcat

SEQ ID NO: 1816964 - DNA, 15 bp, Homo sapiens
cccttgcccccatcc

SEQ ID NO: 1816965 - DNA, 17 bp, Homo sapiens
cccttggggcctggctt

SEQ ID NO: 1816966 - DNA, 18 bp, Homo sapiens
cccttggggcctggcttg

SEQ ID NO: 1816967 - DNA, 19 bp, Homo sapiens
cccttggggcctggcttgc

SEQ ID NO: 1816968 - DNA, 16 bp, Homo sapiens
cccttgtcctgccagc

SEQ ID NO: 1816969 - DNA, 20 bp, Homo sapiens
ccctttgcaggcccagcaga

SEQ ID NO: 1816970 - DNA, 16 bp, Homo sapiens
cccttttgcctggctg

SEQ ID NO: 1816971 - DNA, 14 bp, Homo sapiens
ccgacactgctgca

SEQ ID NO: 1816972 - DNA, 17 bp, Homo sapiens
ccgacactgctgcacca

SEQ ID NO: 1816973 - DNA, 18 bp, Homo sapiens
ccgacactgctgcaccag

SEQ ID NO: 1816974 - DNA, 21 bp, Homo sapiens
ccgacttgaattttcccactg

SEQ ID NO: 1816975 - DNA, 13 bp, Homo sapiens
ccgacttttctaa

SEQ ID NO: 1816976 - DNA, 16 bp, Homo sapiens
ccgagggatgatgcca

SEQ ID NO: 1816977 - DNA, 13 bp, Homo sapiens
ccgcaccagctgc

SEQ ID NO: 1816978 - DNA, 20 bp, Homo sapiens
ccgcagcccgtgaagcagtg

SEQ ID NO: 1816979 - DNA, 23 bp, Homo sapiens
ccgcccaaagagaaatcacaggg

SEQ ID NO: 1816980 - DNA, 16 bp, Homo sapiens
ccgcccaggctggcca

SEQ ID NO: 1816981 - DNA, 17 bp, Homo sapiens
ccgcccaggctggccag

SEQ ID NO: 1816982 - DNA, 16 bp, Homo sapiens
ccgccgcctcgcccac

SEQ ID NO: 1816983 - DNA, 15 bp, Homo sapiens
ccgcctcgcccaccg

SEQ ID NO: 1816984 - DNA, 17 bp, Homo sapiens
ccgcctcgcccaccgca

SEQ ID NO: 1816985 - DNA, 16 bp, Homo sapiens
ccgccttcctcctcca

SEQ ID NO: 1816986 - DNA, 15 bp, Homo sapiens
ccgcggtgctctggc

SEQ ID NO: 1816987 - DNA, 14 bp, Homo sapiens
ccgctcccacagct

SEQ ID NO: 1816988 - DNA, 12 bp, Homo sapiens
ccgctcccagtg

SEQ ID NO: 1816989 - DNA, 12 bp, Homo sapiens
ccgctgccacca

SEQ ID NO: 1816990 - DNA, 20 bp, Homo sapiens
ccgctgccaccacgtctgcc

SEQ ID NO: 1816991 - DNA, 22 bp, Homo sapiens
ccgctgccaccacgtctgccag

SEQ ID NO: 1816992 - DNA, 23 bp, Homo sapiens
ccgctgccaccacgtctgccagg

SEQ ID NO: 1816993 - DNA, 17 bp, Homo sapiens
ccgcttcacccctgcac

SEQ ID NO: 1816994 - DNA, 13 bp, Homo sapiens
ccgcttgcctcgg

SEQ ID NO: 1816995 - DNA, 13 bp, Homo sapiens
ccggagcacagcc

SEQ ID NO: 1816996 - DNA, 17 bp, Homo sapiens
ccggagcacagccctgg

SEQ ID NO: 1816997 - DNA, 13 bp, Homo sapiens
ccggcctcttcca

SEQ ID NO: 1816998 - DNA, 18 bp, Homo sapiens
ccggcctcttccacccat

SEQ ID NO: 1816999 - DNA, 17 bp, Homo sapiens
ccggcgccctctgtcct

SEQ ID NO: 1817000 - DNA, 18 bp, Homo sapiens
ccggcgccctctgtcctg

SEQ ID NO: 1817001 - DNA, 15 bp, Homo sapiens
ccggcgctgcaggta

SEQ ID NO: 1817002 - DNA, 12 bp, Homo sapiens
ccggctgcctgc

SEQ ID NO: 1817003 - DNA, 22 bp, Homo sapiens
ccgggaggggcccgcttgcctc

SEQ ID NO: 1817004 - DNA, 21 bp, Homo sapiens
ccgggctcagggaccacagca

SEQ ID NO: 1817005 - DNA, 23 bp, Homo sapiens
ccggggcaaggtctccttactct

SEQ ID NO: 1817006 - DNA, 12 bp, Homo sapiens
ccggggctggca

SEQ ID NO: 1817007 - DNA, 22 bp, Homo sapiens
ccggggtctgtgctgtgcctgc

SEQ ID NO: 1817008 - DNA, 23 bp, Homo sapiens
ccggggtctgtgctgtgcctgct

SEQ ID NO: 1817009 - DNA, 16 bp, Homo sapiens
ccgggtgccattccca

SEQ ID NO: 1817010 - DNA, 18 bp, Homo sapiens
ccgggtgggcctggcctg

SEQ ID NO: 1817011 - DNA, 19 bp, Homo sapiens
ccgggtgggcctggcctga

SEQ ID NO: 1817012 - DNA, 20 bp, Homo sapiens
ccgggtgggcctggcctgag

SEQ ID NO: 1817013 - DNA, 21 bp, Homo sapiens
ccgggtgggcctggcctgagc

SEQ ID NO: 1817014 - DNA, 15 bp, Homo sapiens
ccggtgacacatcca

SEQ ID NO: 1817015 - DNA, 12 bp, Homo sapiens
ccgtccacccag

SEQ ID NO: 1817016 - DNA, 13 bp, Homo sapiens
ccgtccacccagg

SEQ ID NO: 1817017 - DNA, 15 bp, Homo sapiens
ccgtccacccaggct

SEQ ID NO: 1817018 - DNA, 15 bp, Homo sapiens
ccgtccatggcacca

SEQ ID NO: 1817019 - DNA, 23 bp, Homo sapiens
ccgtccatggcaccagccccctg

SEQ ID NO: 1817020 - DNA, 17 bp, Homo sapiens
ccgtctgactccagagt

SEQ ID NO: 1817021 - DNA, 13 bp, Homo sapiens
ccgtggccccagc

SEQ ID NO: 1817022 - DNA, 14 bp, Homo sapiens
ccgtggccccagcc

SEQ ID NO: 1817023 - DNA, 15 bp, Homo sapiens
ccgtggccccagcct

SEQ ID NO: 1817024 - DNA, 17 bp, Homo sapiens
ccgtggccccagcctgg

SEQ ID NO: 1817025 - DNA, 20 bp, Homo sapiens
ccgtggccccagcctggccc

SEQ ID NO: 1817026 - DNA, 23 bp, Homo sapiens
ccgtggccccagcctggcccagc

SEQ ID NO: 1817027 - DNA, 11 bp, Homo sapiens
ccgtgtcccaa

SEQ ID NO: 1817028 - DNA, 14 bp, Homo sapiens
ccgtgtcccaagga

SEQ ID NO: 1817029 - DNA, 16 bp, Homo sapiens
ccgtgtcccaaggagc

SEQ ID NO: 1817030 - DNA, 16 bp, Homo sapiens
ccgtttatgggccttg

SEQ ID NO: 1817031 - DNA, 19 bp, Homo sapiens
ccgtttatgggccttgctt

SEQ ID NO: 1817032 - DNA, 15 bp, Homo sapiens
cctaccatgctgctt

SEQ ID NO: 1817033 - DNA, 16 bp, Homo sapiens
cctacccctcccagct

SEQ ID NO: 1817034 - DNA, 17 bp, Homo sapiens
cctacccctcccagctg

SEQ ID NO: 1817035 - DNA, 21 bp, Homo sapiens
cctacccctcccagctgacag

SEQ ID NO: 1817036 - DNA, 16 bp, Homo sapiens
cctagaggtgggcagc

SEQ ID NO: 1817037 - DNA, 20 bp, Homo sapiens
cctagaggtgggcagctggg

SEQ ID NO: 1817038 - DNA, 20 bp, Homo sapiens
cctagcccagtgcttctcca

SEQ ID NO: 1817039 - DNA, 23 bp, Homo sapiens
cctaggccaaatgcacaagctca

SEQ ID NO: 1817040 - DNA, 12 bp, Homo sapiens
catggctcaggc

SEQ ID NO: 1817041 - DNA, 17 bp, Homo sapiens
catgggactgtgccttt

SEQ ID NO: 1817042 - DNA, 17 bp, Homo sapiens
catgggcactgctgggt

SEQ ID NO: 1817043 - DNA, 17 bp, Homo sapiens
catgggcctgggcctgc

SEQ ID NO: 1817044 - DNA, 22 bp, Homo sapiens
catgggctagtgtgagtggcag

SEQ ID NO: 1817045 - DNA, 23 bp, Homo sapiens
catgggctagtgtgagtggcagc

SEQ ID NO: 1817046 - DNA, 12 bp, Homo sapiens
catgggcttgga

SEQ ID NO: 1817047 - DNA, 15 bp, Homo sapiens
catggtagactgtga

SEQ ID NO: 1817048 - DNA, 16 bp, Homo sapiens
catggttccttccctg

SEQ ID NO: 1817049 - DNA, 19 bp, Homo sapiens
catgtagaataaatgaaga

SEQ ID NO: 1817050 - DNA, 21 bp, Homo sapiens
catgtgaagtgttgtggagaa

SEQ ID NO: 1817051 - DNA, 15 bp, Homo sapiens
catgtgcctgcacca

SEQ ID NO: 1817052 - DNA, 23 bp, Homo sapiens
catgtgcctgcaccaggagacag

SEQ ID NO: 1817053 - DNA, 15 bp, Homo sapiens
catgtgctgctgtgg

SEQ ID NO: 1817054 - DNA, 17 bp, Homo sapiens
catgtgctgctgtggca

SEQ ID NO: 1817055 - DNA, 13 bp, Homo sapiens
catgtgtgcctgt

SEQ ID NO: 1817056 - DNA, 17 bp, Homo sapiens
cattaaaaggaaaaaag

SEQ ID NO: 1817057 - DNA, 19 bp, Homo sapiens
cattacaggggcagtgcct

SEQ ID NO: 1817058 - DNA, 22 bp, Homo sapiens
cattacaggggcagtgcctttg

SEQ ID NO: 1817059 - DNA, 19 bp, Homo sapiens
cattagctacttttcagaa

SEQ ID NO: 1817060 - DNA, 21 bp, Homo sapiens
cattatagtaaatctatgagc

SEQ ID NO: 1817061 - DNA, 18 bp, Homo sapiens
cattatatttgagtttct

SEQ ID NO: 1817062 - DNA, 16 bp, Homo sapiens
cattatctgtactgaa

SEQ ID NO: 1817063 - DNA, 18 bp, Homo sapiens
cattatctgtactgaaag

SEQ ID NO: 1817064 - DNA, 21 bp, Homo sapiens
cattatctgtactgaaagcaa

SEQ ID NO: 1817065 - DNA, 19 bp, Homo sapiens
cattatgttattggaattt

SEQ ID NO: 1817066 - DNA, 20 bp, Homo sapiens
cattcccccatgtggctgaa

SEQ ID NO: 1817067 - DNA, 14 bp, Homo sapiens
cattcctccagcct

SEQ ID NO: 1817068 - DNA, 21 bp, Homo sapiens
cattcctccagcctcccctcc

SEQ ID NO: 1817069 - DNA, 21 bp, Homo sapiens
cattggcagcaggtgctgcta

SEQ ID NO: 1817070 - DNA, 18 bp, Homo sapiens
cattggccctcattccaa

SEQ ID NO: 1817071 - DNA, 21 bp, Homo sapiens
cattggccctcattccaagca

SEQ ID NO: 1817072 - DNA, 16 bp, Homo sapiens
cattggggttgcaaca

SEQ ID NO: 1817073 - DNA, 20 bp, Homo sapiens
cattggggttgcaacaataa

SEQ ID NO: 1817074 - DNA, 19 bp, Homo sapiens
cattgtccctgaagagaag

SEQ ID NO: 1817075 - DNA, 13 bp, Homo sapiens
cattgttaaaaaa

SEQ ID NO: 1817076 - DNA, 16 bp, Homo sapiens
cattgttaaaaaacaa

SEQ ID NO: 1817077 - DNA, 17 bp, Homo sapiens
cattgttaaaaaacaac

SEQ ID NO: 1817078 - DNA, 20 bp, Homo sapiens
catttagtaccttcaaataa

SEQ ID NO: 1817079 - DNA, 13 bp, Homo sapiens
catttcctatgca

SEQ ID NO: 1817080 - DNA, 13 bp, Homo sapiens
catttgagtgtct

SEQ ID NO: 1817081 - DNA, 15 bp, Homo sapiens
cattttaatacagat

SEQ ID NO: 1817082 - DNA, 13 bp, Homo sapiens
cattttacagtat

SEQ ID NO: 1817083 - DNA, 13 bp, Homo sapiens
cattttcctgtgt

SEQ ID NO: 1817084 - DNA, 18 bp, Homo sapiens
catttttcagagttttct

SEQ ID NO: 1817085 - DNA, 15 bp, Homo sapiens
catttttgtacatta

SEQ ID NO: 1817086 - DNA, 17 bp, Homo sapiens
catttttgtacattatg

SEQ ID NO: 1817087 - DNA, 18 bp, Homo sapiens
catttttgtacattatgt

SEQ ID NO: 1817088 - DNA, 20 bp, Homo sapiens
catttttgtacattatgtta

SEQ ID NO: 1817089 - DNA, 12 bp, Homo sapiens
ccaaaccccagc

SEQ ID NO: 1817090 - DNA, 13 bp, Homo sapiens
ccaaaccccagcc

SEQ ID NO: 1817091 - DNA, 14 bp, Homo sapiens
ccaaaccccagccc

SEQ ID NO: 1817092 - DNA, 17 bp, Homo sapiens
ccaaaccccagccccaa

SEQ ID NO: 1817093 - DNA, 14 bp, Homo sapiens
ccaaaggggctgct

SEQ ID NO: 1817094 - DNA, 16 bp, Homo sapiens
ccaaaggggctgctgg

SEQ ID NO: 1817095 - DNA, 17 bp, Homo sapiens
ccaaaggggctgctggg

SEQ ID NO: 1817096 - DNA, 19 bp, Homo sapiens
ccaaaggggctgctggggc

SEQ ID NO: 1817097 - DNA, 20 bp, Homo sapiens
ccaaaggggctgctggggca

SEQ ID NO: 1817098 - DNA, 14 bp, Homo sapiens
ccaaattgcttcta

SEQ ID NO: 1817099 - DNA, 19 bp, Homo sapiens
ccaaattgcttctaggagt

SEQ ID NO: 1817100 - DNA, 20 bp, Homo sapiens
ccaacagcttttcccaggag

SEQ ID NO: 1817101 - DNA, 20 bp, Homo sapiens
ccaacagtgttaggcctggc

SEQ ID NO: 1817102 - DNA, 21 bp, Homo sapiens
ccaacccagccgctgcccggc

SEQ ID NO: 1817103 - DNA, 13 bp, Homo sapiens
ccaacccccagca

SEQ ID NO: 1817104 - DNA, 14 bp, Homo sapiens
ccaacccccagcac

SEQ ID NO: 1817105 - DNA, 22 bp, Homo sapiens
ccaaccccgcggtgctctggcg

SEQ ID NO: 1817106 - DNA, 15 bp, Homo sapiens
ccaactaagccctcg

SEQ ID NO: 1817107 - DNA, 15 bp, Homo sapiens
ccaactccaggggca

SEQ ID NO: 1817108 - DNA, 15 bp, Homo sapiens
ccaagctgtgccacc

SEQ ID NO: 1817109 - DNA, 16 bp, Homo sapiens
ccaagctgtgccaccc

SEQ ID NO: 1817110 - DNA, 18 bp, Homo sapiens
ccaagctgtgccaccctg

SEQ ID NO: 1817111 - DNA, 22 bp, Homo sapiens
ccaaggagctgatttccaggcc

SEQ ID NO: 1817112 - DNA, 21 bp, Homo sapiens
ccaaggcagcctccagagcca

SEQ ID NO: 1817113 - DNA, 23 bp, Homo sapiens
ccaaggcagcctccagagccagc

SEQ ID NO: 1817114 - DNA, 11 bp, Homo sapiens
ccaaggcaggt

SEQ ID NO: 1817115 - DNA, 15 bp, Homo sapiens
ccaaggctctcccct

SEQ ID NO: 1817116 - DNA, 15 bp, Homo sapiens
ccaaggtggtctgct

SEQ ID NO: 1817117 - DNA, 21 bp, Homo sapiens
ccaaggttactcagcagcaga

SEQ ID NO: 1817118 - DNA, 16 bp, Homo sapiens
ccaagtccacctgcct

SEQ ID NO: 1817119 - DNA, 17 bp, Homo sapiens
ccaagtttttcagaaag

SEQ ID NO: 1817120 - DNA, 18 bp, Homo sapiens
ccaatgcctataaaatgc

SEQ ID NO: 1817121 - DNA, 24 bp, Homo sapiens
ccaatgctttgggaggccaaggca

SEQ ID NO: 1817122 - DNA, 20 bp, Homo sapiens
ccacaaatcaaagcaagggc

SEQ ID NO: 1817123 - DNA, 23 bp, Homo sapiens
ccacaaatcaaagcaagggctcc

SEQ ID NO: 1817124 - DNA, 20 bp, Homo sapiens
ccacacagacttgggcaggg

SEQ ID NO: 1817125 - DNA, 12 bp, Homo sapiens
ccacaccaagct

SEQ ID NO: 1817126 - DNA, 14 bp, Homo sapiens
ccacaccaagctgt

SEQ ID NO: 1817127 - DNA, 18 bp, Homo sapiens
ccacaccaagctgtgcca

SEQ ID NO: 1817128 - DNA, 18 bp, Homo sapiens
ccacagcccacgtcctgt

SEQ ID NO: 1817129 - DNA, 19 bp, Homo sapiens
ccacagcccacgtcctgtc

SEQ ID NO: 1817130 - DNA, 20 bp, Homo sapiens
ccacagggaaatactgtatt

SEQ ID NO: 1817131 - DNA, 14 bp, Homo sapiens
ccacaggggcaggc

SEQ ID NO: 1817132 - DNA, 17 bp, Homo sapiens
ccacaggggcaggcctg

SEQ ID NO: 1817133 - DNA, 19 bp, Homo sapiens
ccacaggggcaggcctggg

SEQ ID NO: 1817134 - DNA, 18 bp, Homo sapiens
ccacagtcctcacagcct

SEQ ID NO: 1817135 - DNA, 22 bp, Homo sapiens
ccacagtgactcgggctcctgt

SEQ ID NO: 1817136 - DNA, 22 bp, Homo sapiens
ccacagtgggtggcacctcctg

SEQ ID NO: 1817137 - DNA, 23 bp, Homo sapiens
ccacagtgggtggcacctcctga

SEQ ID NO: 1817138 - DNA, 23 bp, Homo sapiens
ccacagtgttggcgagaggaggg

SEQ ID NO: 1817139 - DNA, 21 bp, Homo sapiens
ccaccaaactgcacacacagc

SEQ ID NO: 1817140 - DNA, 24 bp, Homo sapiens
ccaccaaactgcacacacagctcc

SEQ ID NO: 1817141 - DNA, 16 bp, Homo sapiens
ccaccacgtctgccag

SEQ ID NO: 1817142 - DNA, 22 bp, Homo sapiens
ccattggctgcgctaaccccca

SEQ ID NO: 1817143 - DNA, 16 bp, Homo sapiens
ccatttgtattaccat

SEQ ID NO: 1817144 - DNA, 20 bp, Homo sapiens
ccatttgtattaccattact

SEQ ID NO: 1817145 - DNA, 14 bp, Homo sapiens
cccaaacatctggc

SEQ ID NO: 1817146 - DNA, 13 bp, Homo sapiens
cccaaaccccagc

SEQ ID NO: 1817147 - DNA, 13 bp, Homo sapiens
cccaacccccagc

SEQ ID NO: 1817148 - DNA, 20 bp, Homo sapiens
cccaaccccgcggtgctctg

SEQ ID NO: 1817149 - DNA, 16 bp, Homo sapiens
cccaactccaggggca

SEQ ID NO: 1817150 - DNA, 12 bp, Homo sapiens
cccaagacagtc

SEQ ID NO: 1817151 - DNA, 12 bp, Homo sapiens
cccaagcagcca

SEQ ID NO: 1817152 - DNA, 14 bp, Homo sapiens
cccaagcagccagc

SEQ ID NO: 1817153 - DNA, 15 bp, Homo sapiens
cccaagcagccagcc

SEQ ID NO: 1817154 - DNA, 17 bp, Homo sapiens
cccaagcagccagccag

SEQ ID NO: 1817155 - DNA, 12 bp, Homo sapiens
cccaaggagctg

SEQ ID NO: 1817156 - DNA, 22 bp, Homo sapiens
cccaaggagctgatttccaggc

SEQ ID NO: 1817157 - DNA, 23 bp, Homo sapiens
cccaaggttactcagcagcagag

SEQ ID NO: 1817158 - DNA, 19 bp, Homo sapiens
cccaagtagtagtgtcttc

SEQ ID NO: 1817159 - DNA, 14 bp, Homo sapiens
cccaataaagctgg

SEQ ID NO: 1817160 - DNA, 16 bp, Homo sapiens
cccaataaagctggac

SEQ ID NO: 1817161 - DNA, 22 bp, Homo sapiens
cccaatgctttgggaggccaag

SEQ ID NO: 1817162 - DNA, 13 bp, Homo sapiens
cccacagagcctg

SEQ ID NO: 1817163 - DNA, 18 bp, Homo sapiens
cccacagcccacgtcctg

SEQ ID NO: 1817164 - DNA, 22 bp, Homo sapiens
cccacagcccacgtcctgtcag

SEQ ID NO: 1817165 - DNA, 15 bp, Homo sapiens
cccacagcttcctga

SEQ ID NO: 1817166 - DNA, 20 bp, Homo sapiens
cccaccagaacgcaccccac

SEQ ID NO: 1817167 - DNA, 14 bp, Homo sapiens
cccacccatcttcc

SEQ ID NO: 1817168 - DNA, 15 bp, Homo sapiens
cccacccatcttcct

SEQ ID NO: 1817169 - DNA, 16 bp, Homo sapiens
cccacccatcttcctg

SEQ ID NO: 1817170 - DNA, 17 bp, Homo sapiens
cccacccatcttcctgc

SEQ ID NO: 1817171 - DNA, 21 bp, Homo sapiens
cccacccatcttcctgctgct

SEQ ID NO: 1817172 - DNA, 18 bp, Homo sapiens
cccaccgcatgccccctc

SEQ ID NO: 1817173 - DNA, 18 bp, Homo sapiens
cccacctacttgtgactg

SEQ ID NO: 1817174 - DNA, 20 bp, Homo sapiens
cccacctcatgcctggcccc

SEQ ID NO: 1817175 - DNA, 13 bp, Homo sapiens
cccacgagtcacc

SEQ ID NO: 1817176 - DNA, 16 bp, Homo sapiens
cccacgagtcacctgc

SEQ ID NO: 1817177 - DNA, 20 bp, Homo sapiens
cccacgagtcacctgcaagc

SEQ ID NO: 1817178 - DNA, 15 bp, Homo sapiens
cccacgtcctgtcag

SEQ ID NO: 1817179 - DNA, 16 bp, Homo sapiens
cccactaagctttctc

SEQ ID NO: 1817180 - DNA, 14 bp, Homo sapiens
cccactgcaccccc

SEQ ID NO: 1817181 - DNA, 16 bp, Homo sapiens
cccactgcaccccctc

SEQ ID NO: 1817182 - DNA, 17 bp, Homo sapiens
cccactgcaccccctcc

SEQ ID NO: 1817183 - DNA, 21 bp, Homo sapiens
cccactgcaccccctcctgct

SEQ ID NO: 1817184 - DNA, 20 bp, Homo sapiens
cccacttagccgtccatggc

SEQ ID NO: 1817185 - DNA, 15 bp, Homo sapiens
cccacttcccctcct

SEQ ID NO: 1817186 - DNA, 17 bp, Homo sapiens
cccacttcccctcctac

SEQ ID NO: 1817187 - DNA, 19 bp, Homo sapiens
cccacttcccctcctaccc

SEQ ID NO: 1817188 - DNA, 23 bp, Homo sapiens
cccacttcccctcctacccctcc

SEQ ID NO: 1817189 - DNA, 17 bp, Homo sapiens
cccacttccctgacact

SEQ ID NO: 1817190 - DNA, 22 bp, Homo sapiens
cccagaaagcctcctgccccct

SEQ ID NO: 1817191 - DNA, 18 bp, Homo sapiens
cccagaatgcctcctgca

SEQ ID NO: 1817192 - DNA, 22 bp, Homo sapiens
cccagacaggccctccctgtct

SEQ ID NO: 1817193 - DNA, 21 bp, Homo sapiens
cccagaggttatctgcctggc

SEQ ID NO: 1817194 - DNA, 23 bp, Homo sapiens
cccagaggttatctgcctggcct

SEQ ID NO: 1817195 - DNA, 15 bp, Homo sapiens
cccagatctgcctgg

SEQ ID NO: 1817196 - DNA, 22 bp, Homo sapiens
cccagatctgcctgggcctgtg

SEQ ID NO: 1817197 - DNA, 23 bp, Homo sapiens
cccagatctgcctgggcctgtgc

SEQ ID NO: 1817198 - DNA, 22 bp, Homo sapiens
cccagcacccgggctcagggac

SEQ ID NO: 1817199 - DNA, 19 bp, Homo sapiens
cccagcccacagagcctga

SEQ ID NO: 1817200 - DNA, 14 bp, Homo sapiens
cccagcccttctgc

SEQ ID NO: 1817201 - DNA, 15 bp, Homo sapiens
cccagcccttctgcc

SEQ ID NO: 1817202 - DNA, 18 bp, Homo sapiens
cccagccgcaggaaggca

SEQ ID NO: 1817203 - DNA, 19 bp, Homo sapiens
cccagcctggcccagctcc

SEQ ID NO: 1817204 - DNA, 21 bp, Homo sapiens
cccagctatggttctctcgca

SEQ ID NO: 1817205 - DNA, 19 bp, Homo sapiens
cccagctcccccgggaggg

SEQ ID NO: 1817206 - DNA, 21 bp, Homo sapiens
cccagctccttttgtccccag

SEQ ID NO: 1817207 - DNA, 21 bp, Homo sapiens
cccagctgacagtcctctcca

SEQ ID NO: 1817208 - DNA, 16 bp, Homo sapiens
cccagctgtagccatg

SEQ ID NO: 1817209 - DNA, 17 bp, Homo sapiens
cccagctgtagccatgg

SEQ ID NO: 1817210 - DNA, 16 bp, Homo sapiens
cccagcttcctggtgt

SEQ ID NO: 1817211 - DNA, 19 bp, Homo sapiens
cccaggacggggccggcca

SEQ ID NO: 1817212 - DNA, 22 bp, Homo sapiens
cccaggacggggccggccaggt

SEQ ID NO: 1817213 - DNA, 23 bp, Homo sapiens
cccaggacggggccggccaggtg

SEQ ID NO: 1817214 - DNA, 14 bp, Homo sapiens
cccaggccatcttc

SEQ ID NO: 1817215 - DNA, 15 bp, Homo sapiens
cccaggccctccatg

SEQ ID NO: 1817216 - DNA, 13 bp, Homo sapiens
cccaggccgttcc

SEQ ID NO: 1817217 - DNA, 14 bp, Homo sapiens
cccaggccgttccc

SEQ ID NO: 1817218 - DNA, 22 bp, Homo sapiens
cccaggcctccagcctctcccg

SEQ ID NO: 1817219 - DNA, 15 bp, Homo sapiens
cccaggctggccagc

SEQ ID NO: 1817220 - DNA, 16 bp, Homo sapiens
cccaggctggccagcc

SEQ ID NO: 1817221 - DNA, 11 bp, Homo sapiens
cccagggcccc

SEQ ID NO: 1817222 - DNA, 16 bp, Homo sapiens
cccagggcctgggggc

SEQ ID NO: 1817223 - DNA, 24 bp, Homo sapiens
cccagggcctgggggcagtgactg

SEQ ID NO: 1817224 - DNA, 15 bp, Homo sapiens
cccagtcttattttt

SEQ ID NO: 1817225 - DNA, 15 bp, Homo sapiens
cccagtgctgccatg

SEQ ID NO: 1817226 - DNA, 17 bp, Homo sapiens
cccagtgctgccatgcc

SEQ ID NO: 1817227 - DNA, 18 bp, Homo sapiens
cccagtgctgccatgcca

SEQ ID NO: 1817228 - DNA, 19 bp, Homo sapiens
cccagtgtaaagaataaat

SEQ ID NO: 1817229 - DNA, 16 bp, Homo sapiens
cccagtgtcttcctgt

SEQ ID NO: 1817230 - DNA, 17 bp, Homo sapiens
cccagtgtcttcctgtg

SEQ ID NO: 1817231 - DNA, 20 bp, Homo sapiens
cccataatagttagccctca

SEQ ID NO: 1817232 - DNA, 21 bp, Homo sapiens
cccatcagtgtacccccgccc

SEQ ID NO: 1817233 - DNA, 23 bp, Homo sapiens
cccatcagtgtacccccgcccag

SEQ ID NO: 1817234 - DNA, 16 bp, Homo sapiens
cccatccctgcttgcc

SEQ ID NO: 1817235 - DNA, 15 bp, Homo sapiens
cccatctcaggtgcc

SEQ ID NO: 1817236 - DNA, 16 bp, Homo sapiens
cccatctcaggtgcca

SEQ ID NO: 1817237 - DNA, 23 bp, Homo sapiens
cccatctcaggtgccactccctg

SEQ ID NO: 1817238 - DNA, 15 bp, Homo sapiens
cccatctccccaggc

SEQ ID NO: 1817239 - DNA, 16 bp, Homo sapiens
cccatctccccaggcc

SEQ ID NO: 1817240 - DNA, 17 bp, Homo sapiens
cccatctccccaggcct

SEQ ID NO: 1817241 - DNA, 20 bp, Homo sapiens
cccatctcctcccatggcct

SEQ ID NO: 1817242 - DNA, 14 bp, Homo sapiens
cccatctgcccagg

SEQ ID NO: 1817243 - DNA, 16 bp, Homo sapiens
cccatcttcctgctgc

SEQ ID NO: 1817244 - DNA, 17 bp, Homo sapiens
cccatcttcctgctgct

SEQ ID NO: 1817245 - DNA, 19 bp, Homo sapiens
cccatcttcctgctgctgt

SEQ ID NO: 1817246 - DNA, 20 bp, Homo sapiens
cccatggccttccctcccca

SEQ ID NO: 1817247 - DNA, 16 bp, Homo sapiens
cccatgggcactgctg

SEQ ID NO: 1817248 - DNA, 20 bp, Homo sapiens
cccatgggcactgctgggtg

SEQ ID NO: 1817249 - DNA, 17 bp, Homo sapiens
cccatgtggctgaagac

SEQ ID NO: 1817250 - DNA, 24 bp, Homo sapiens
cccatttgtcctgactgtctgcta

SEQ ID NO: 1817251 - DNA, 20 bp, Homo sapiens
ccccaaaccccagccccaac

SEQ ID NO: 1817252 - DNA, 21 bp, Homo sapiens
ccccaaccccgcggtgctctg

SEQ ID NO: 1817253 - DNA, 12 bp, Homo sapiens
ccccacagccca

SEQ ID NO: 1817254 - DNA, 20 bp, Homo sapiens
ccccaccgaggttcccaggg

SEQ ID NO: 1817255 - DNA, 13 bp, Homo sapiens
ccccacctcctgc

SEQ ID NO: 1817256 - DNA, 22 bp, Homo sapiens
ccccacgagtcacctgcaagcc

SEQ ID NO: 1817257 - DNA, 17 bp, Homo sapiens
ccccagatctgcctggg

SEQ ID NO: 1817258 - DNA, 21 bp, Homo sapiens
cagtgaggagggtggaggaag

SEQ ID NO: 1817259 - DNA, 22 bp, Homo sapiens
cagtgatatacttaagttatgt

SEQ ID NO: 1817260 - DNA, 10 bp, Homo sapiens
cagtgcagtt

SEQ ID NO: 1817261 - DNA, 18 bp, Homo sapiens
cagtgccgccgcctcgcc

SEQ ID NO: 1817262 - DNA, 22 bp, Homo sapiens
cagtgccgccgcctcgcccacc

SEQ ID NO: 1817263 - DNA, 15 bp, Homo sapiens
cagtgcctcgaggca

SEQ ID NO: 1817264 - DNA, 19 bp, Homo sapiens
cagtgcctcgaggcaccgg

SEQ ID NO: 1817265 - DNA, 20 bp, Homo sapiens
cagtgcctcgaggcaccggc

SEQ ID NO: 1817266 - DNA, 15 bp, Homo sapiens
cagtgcctttgtagc

SEQ ID NO: 1817267 - DNA, 22 bp, Homo sapiens
cagtgctctcctaccccacctc

SEQ ID NO: 1817268 - DNA, 16 bp, Homo sapiens
cagtgctgccatgcca

SEQ ID NO: 1817269 - DNA, 17 bp, Homo sapiens
cagtgctgccatgccac

SEQ ID NO: 1817270 - DNA, 18 bp, Homo sapiens
cagtgctgccatgccact

SEQ ID NO: 1817271 - DNA, 19 bp, Homo sapiens
cagtgctgcttctcttggg

SEQ ID NO: 1817272 - DNA, 15 bp, Homo sapiens
cagtgggtcccactt

SEQ ID NO: 1817273 - DNA, 20 bp, Homo sapiens
cagtgggtcccacttcccct

SEQ ID NO: 1817274 - DNA, 13 bp, Homo sapiens
cagtgggtggcac

SEQ ID NO: 1817275 - DNA, 17 bp, Homo sapiens
cagtgtacccccgccca

SEQ ID NO: 1817276 - DNA, 13 bp, Homo sapiens
cagtgtctgggct

SEQ ID NO: 1817277 - DNA, 18 bp, Homo sapiens
cagtgtctgggctgactg

SEQ ID NO: 1817278 - DNA, 14 bp, Homo sapiens
cagtgtgcccccca

SEQ ID NO: 1817279 - DNA, 19 bp, Homo sapiens
cagtgtgccccccatcctg

SEQ ID NO: 1817280 - DNA, 14 bp, Homo sapiens
cagtgtggagaggg

SEQ ID NO: 1817281 - DNA, 17 bp, Homo sapiens
cagtgtggagaggggtg

SEQ ID NO: 1817282 - DNA, 19 bp, Homo sapiens
cagtgttaggcctggcaca

SEQ ID NO: 1817283 - DNA, 23 bp, Homo sapiens
cagtgttaggcctggcacagtgt

SEQ ID NO: 1817284 - DNA, 19 bp, Homo sapiens
cagttcattcgctttgtct

SEQ ID NO: 1817285 - DNA, 13 bp, Homo sapiens
cagttctagttga

SEQ ID NO: 1817286 - DNA, 13 bp, Homo sapiens
cagttctgatgag

SEQ ID NO: 1817287 - DNA, 22 bp, Homo sapiens
cagttctgttggtctacagaaa

SEQ ID NO: 1817288 - DNA, 13 bp, Homo sapiens
cagttgacagaat

SEQ ID NO: 1817289 - DNA, 13 bp, Homo sapiens
cagttggcagaga

SEQ ID NO: 1817290 - DNA, 22 bp, Homo sapiens
cagttggcagagaaggcctctt

SEQ ID NO: 1817291 - DNA, 21 bp, Homo sapiens
cagttgtctattctgagcctt

SEQ ID NO: 1817292 - DNA, 22 bp, Homo sapiens
cagttgtctattctgagccttg

SEQ ID NO: 1817293 - DNA, 23 bp, Homo sapiens
cagttgtctattctgagccttga

SEQ ID NO: 1817294 - DNA, 16 bp, Homo sapiens
cagtttctccatcagc

SEQ ID NO: 1817295 - DNA, 23 bp, Homo sapiens
cataaaggtatttagaatatatt

SEQ ID NO: 1817296 - DNA, 16 bp, Homo sapiens
cataaagtatgccttc

SEQ ID NO: 1817297 - DNA, 14 bp, Homo sapiens
cataaatgcccagc

SEQ ID NO: 1817298 - DNA, 17 bp, Homo sapiens
cataagaccgtgtccca

SEQ ID NO: 1817299 - DNA, 21 bp, Homo sapiens
cataagaccgtgtcccaagga

SEQ ID NO: 1817300 - DNA, 18 bp, Homo sapiens
cataatagttagccctca

SEQ ID NO: 1817301 - DNA, 18 bp, Homo sapiens
cataatcacaacccttca

SEQ ID NO: 1817302 - DNA, 18 bp, Homo sapiens
cataatttcagttctagt

SEQ ID NO: 1817303 - DNA, 15 bp, Homo sapiens
catacctggccctgt

SEQ ID NO: 1817304 - DNA, 13 bp, Homo sapiens
catactggcctcg

SEQ ID NO: 1817305 - DNA, 16 bp, Homo sapiens
catactggcctcgcct

SEQ ID NO: 1817306 - DNA, 17 bp, Homo sapiens
catactggcctcgcctg

SEQ ID NO: 1817307 - DNA, 14 bp, Homo sapiens
catatatgtatatg

SEQ ID NO: 1817308 - DNA, 21 bp, Homo sapiens
catatatgtatatgtatatct

SEQ ID NO: 1817309 - DNA, 16 bp, Homo sapiens
catatcagtcatgact

SEQ ID NO: 1817310 - DNA, 13 bp, Homo sapiens
catatgagtcttt

SEQ ID NO: 1817311 - DNA, 18 bp, Homo sapiens
catatggagcatttttca

SEQ ID NO: 1817312 - DNA, 21 bp, Homo sapiens
catatggagcatttttcagag

SEQ ID NO: 1817313 - DNA, 16 bp, Homo sapiens
catatgggtttgaact

SEQ ID NO: 1817314 - DNA, 17 bp, Homo sapiens
catatttccaataacta

SEQ ID NO: 1817315 - DNA, 19 bp, Homo sapiens
catattttaaaaaatcaaa

SEQ ID NO: 1817316 - DNA, 23 bp, Homo sapiens
catattttcacatgacgtaaaat

SEQ ID NO: 1817317 - DNA, 16 bp, Homo sapiens
catcaatcaaatattt

SEQ ID NO: 1817318 - DNA, 14 bp, Homo sapiens
catcactccctgga

SEQ ID NO: 1817319 - DNA, 15 bp, Homo sapiens
catcagccttctcct

SEQ ID NO: 1817320 - DNA, 17 bp, Homo sapiens
catcaggcactggtggc

SEQ ID NO: 1817321 - DNA, 22 bp, Homo sapiens
catcagtgtacccccgcccagg

SEQ ID NO: 1817322 - DNA, 19 bp, Homo sapiens
catcatgtttacagaggac

SEQ ID NO: 1817323 - DNA, 16 bp, Homo sapiens
catccacccagtgctg

SEQ ID NO: 1817324 - DNA, 17 bp, Homo sapiens
catccacccagtgctgc

SEQ ID NO: 1817325 - DNA, 23 bp, Homo sapiens
catccacccagtgctgccatgcc

SEQ ID NO: 1817326 - DNA, 12 bp, Homo sapiens
catccagcctgt

SEQ ID NO: 1817327 - DNA, 19 bp, Homo sapiens
catccatggggctgattgt

SEQ ID NO: 1817328 - DNA, 12 bp, Homo sapiens
catcccccctca

SEQ ID NO: 1817329 - DNA, 18 bp, Homo sapiens
catcccccctcaccaggg

SEQ ID NO: 1817330 - DNA, 14 bp, Homo sapiens
catcccctccctgc

SEQ ID NO: 1817331 - DNA, 18 bp, Homo sapiens
catcccctcgtcctgtcc

SEQ ID NO: 1817332 - DNA, 19 bp, Homo sapiens
catcccctcgtcctgtccc

SEQ ID NO: 1817333 - DNA, 12 bp, Homo sapiens
catcccggcctc

SEQ ID NO: 1817334 - DNA, 13 bp, Homo sapiens
catcccggcctct

SEQ ID NO: 1817335 - DNA, 18 bp, Homo sapiens
catccctgcttgcccgct

SEQ ID NO: 1817336 - DNA, 15 bp, Homo sapiens
catcctgctttgatt

SEQ ID NO: 1817337 - DNA, 19 bp, Homo sapiens
catcctggcccatcagtgt

SEQ ID NO: 1817338 - DNA, 16 bp, Homo sapiens
catcgtgacccttcag

SEQ ID NO: 1817339 - DNA, 21 bp, Homo sapiens
catcgtgacccttcagggcca

SEQ ID NO: 1817340 - DNA, 17 bp, Homo sapiens
catcgttgcattttaca

SEQ ID NO: 1817341 - DNA, 20 bp, Homo sapiens
catctcaagatgtttatctg

SEQ ID NO: 1817342 - DNA, 16 bp, Homo sapiens
catctcaggtgccact

SEQ ID NO: 1817343 - DNA, 18 bp, Homo sapiens
catctcattgcggcctgt

SEQ ID NO: 1817344 - DNA, 16 bp, Homo sapiens
catctccccaggcctc

SEQ ID NO: 1817345 - DNA, 18 bp, Homo sapiens
catctccccaggcctcca

SEQ ID NO: 1817346 - DNA, 20 bp, Homo sapiens
catctccccaggcctccagc

SEQ ID NO: 1817347 - DNA, 11 bp, Homo sapiens
catctgcccag

SEQ ID NO: 1817348 - DNA, 22 bp, Homo sapiens
catctgcccaggacggggccgg

SEQ ID NO: 1817349 - DNA, 13 bp, Homo sapiens
catcttcctgctg

SEQ ID NO: 1817350 - DNA, 17 bp, Homo sapiens
catcttcctgctgctgt

SEQ ID NO: 1817351 - DNA, 15 bp, Homo sapiens
catgacgtaaaattt

SEQ ID NO: 1817352 - DNA, 22 bp, Homo sapiens
catgagtctacctgagcattca

SEQ ID NO: 1817353 - DNA, 18 bp, Homo sapiens
catgattttaagaggctt

SEQ ID NO: 1817354 - DNA, 19 bp, Homo sapiens
catgattttaagaggcttt

SEQ ID NO: 1817355 - DNA, 18 bp, Homo sapiens
catgccaaagcaaaagaa

SEQ ID NO: 1817356 - DNA, 19 bp, Homo sapiens
catgccaaagcaaaagaag

SEQ ID NO: 1817357 - DNA, 13 bp, Homo sapiens
catgccactgcca

SEQ ID NO: 1817358 - DNA, 15 bp, Homo sapiens
catgccactgccagg

SEQ ID NO: 1817359 - DNA, 16 bp, Homo sapiens
catgccactgccaggc

SEQ ID NO: 1817360 - DNA, 19 bp, Homo sapiens
catgccactgccaggcacc

SEQ ID NO: 1817361 - DNA, 17 bp, Homo sapiens
catgccccctcgtgcca

SEQ ID NO: 1817362 - DNA, 15 bp, Homo sapiens
catgcctcatgccac

SEQ ID NO: 1817363 - DNA, 13 bp, Homo sapiens
catgctcaacccc

SEQ ID NO: 1817364 - DNA, 21 bp, Homo sapiens
catgctcaacccccctcccag

SEQ ID NO: 1817365 - DNA, 17 bp, Homo sapiens
catgctgccttcaggga

SEQ ID NO: 1817366 - DNA, 19 bp, Homo sapiens
catgctgctttttggcaca

SEQ ID NO: 1817367 - DNA, 21 bp, Homo sapiens
catgctgctttttggcacagt

SEQ ID NO: 1817368 - DNA, 20 bp, Homo sapiens
cactcagcagccccctgccc

SEQ ID NO: 1817369 - DNA, 12 bp, Homo sapiens
cactccagagaa

SEQ ID NO: 1817370 - DNA, 13 bp, Homo sapiens
cactcccacttcc

SEQ ID NO: 1817371 - DNA, 14 bp, Homo sapiens
cactccctgagctt

SEQ ID NO: 1817372 - DNA, 13 bp, Homo sapiens
cactcctgtcccg

SEQ ID NO: 1817373 - DNA, 20 bp, Homo sapiens
cactcctgtcccgccttcct

SEQ ID NO: 1817374 - DNA, 15 bp, Homo sapiens
cactcgcagtcgcag

SEQ ID NO: 1817375 - DNA, 23 bp, Homo sapiens
cactctcggggcccttggggcct

SEQ ID NO: 1817376 - DNA, 22 bp, Homo sapiens
cactgaaaacatttcaaagctg

SEQ ID NO: 1817377 - DNA, 21 bp, Homo sapiens
cactgcaccccctcctgctgc

SEQ ID NO: 1817378 - DNA, 13 bp, Homo sapiens
cactgcagtgatg

SEQ ID NO: 1817379 - DNA, 15 bp, Homo sapiens
cactgcagtgatggc

SEQ ID NO: 1817380 - DNA, 20 bp, Homo sapiens
cactgccaggcacctggcct

SEQ ID NO: 1817381 - DNA, 22 bp, Homo sapiens
cactgccaggcacctggcctgc

SEQ ID NO: 1817382 - DNA, 11 bp, Homo sapiens
cactgccctgc

SEQ ID NO: 1817383 - DNA, 14 bp, Homo sapiens
cactgccctgcctg

SEQ ID NO: 1817384 - DNA, 16 bp, Homo sapiens
cactgccctgcctgcc

SEQ ID NO: 1817385 - DNA, 22 bp, Homo sapiens
cactgctgaaaaagaaaaaaat

SEQ ID NO: 1817386 - DNA, 13 bp, Homo sapiens
cactgctgcacca

SEQ ID NO: 1817387 - DNA, 14 bp, Homo sapiens
cactgctgcaccag

SEQ ID NO: 1817388 - DNA, 13 bp, Homo sapiens
cactgctgggtgg

SEQ ID NO: 1817389 - DNA, 17 bp, Homo sapiens
cactgctgggtggccca

SEQ ID NO: 1817390 - DNA, 18 bp, Homo sapiens
cactgctgggtggcccat

SEQ ID NO: 1817391 - DNA, 22 bp, Homo sapiens
cactgctgggtggcccatcccc

SEQ ID NO: 1817392 - DNA, 17 bp, Homo sapiens
cactggccagagagggc

SEQ ID NO: 1817393 - DNA, 21 bp, Homo sapiens
cactggccagagagggcccag

SEQ ID NO: 1817394 - DNA, 14 bp, Homo sapiens
cactggctgcctcc

SEQ ID NO: 1817395 - DNA, 15 bp, Homo sapiens
cactggctgcctcca

SEQ ID NO: 1817396 - DNA, 20 bp, Homo sapiens
cactggctgcctccactccc

SEQ ID NO: 1817397 - DNA, 23 bp, Homo sapiens
cactggctgcctccactcccact

SEQ ID NO: 1817398 - DNA, 23 bp, Homo sapiens
cactggctggggcagaggggcag

SEQ ID NO: 1817399 - DNA, 17 bp, Homo sapiens
cactgtaacctcaaact

SEQ ID NO: 1817400 - DNA, 20 bp, Homo sapiens
cactgtcctgctccacagtg

SEQ ID NO: 1817401 - DNA, 15 bp, Homo sapiens
cactgtgaactattt

SEQ ID NO: 1817402 - DNA, 22 bp, Homo sapiens
cactgtgaactattttgaagaa

SEQ ID NO: 1817403 - DNA, 18 bp, Homo sapiens
cactgtggccagagctgg

SEQ ID NO: 1817404 - DNA, 19 bp, Homo sapiens
cactgtggccagagctgga

SEQ ID NO: 1817405 - DNA, 22 bp, Homo sapiens
cactgtggccagagctggaagg

SEQ ID NO: 1817406 - DNA, 23 bp, Homo sapiens
cactgtggccagagctggaaggc

SEQ ID NO: 1817407 - DNA, 19 bp, Homo sapiens
cacttagccgtccatggca

SEQ ID NO: 1817408 - DNA, 21 bp, Homo sapiens
cacttataagtgggagctaaa

SEQ ID NO: 1817409 - DNA, 16 bp, Homo sapiens
cacttatctgatactt

SEQ ID NO: 1817410 - DNA, 14 bp, Homo sapiens
cacttatttccatg

SEQ ID NO: 1817411 - DNA, 18 bp, Homo sapiens
cacttcatcaatcaaata

SEQ ID NO: 1817412 - DNA, 20 bp, Homo sapiens
cacttccctgacactgcggg

SEQ ID NO: 1817413 - DNA, 17 bp, Homo sapiens
cacttcttaaaggcctg

SEQ ID NO: 1817414 - DNA, 19 bp, Homo sapiens
cacttcttaaaggcctgga

SEQ ID NO: 1817415 - DNA, 18 bp, Homo sapiens
cacttctttgcagagcct

SEQ ID NO: 1817416 - DNA, 17 bp, Homo sapiens
cacttgcgtcctgcaga

SEQ ID NO: 1817417 - DNA, 17 bp, Homo sapiens
cactttctgtagtaata

SEQ ID NO: 1817418 - DNA, 21 bp, Homo sapiens
cactttttccagaatttgaat

SEQ ID NO: 1817419 - DNA, 17 bp, Homo sapiens
cagaaaagaaagctgct

SEQ ID NO: 1817420 - DNA, 20 bp, Homo sapiens
cagaaaagaaagctgctttc

SEQ ID NO: 1817421 - DNA, 19 bp, Homo sapiens
cagaaaagaggagaccctg

SEQ ID NO: 1817422 - DNA, 20 bp, Homo sapiens
cagaaaagaggagaccctgg

SEQ ID NO: 1817423 - DNA, 20 bp, Homo sapiens
cagaaactcgatgaatgtgt

SEQ ID NO: 1817424 - DNA, 19 bp, Homo sapiens
cagaaagcctcctgccccc

SEQ ID NO: 1817425 - DNA, 18 bp, Homo sapiens
cagaaatcggttgctgtt

SEQ ID NO: 1817426 - DNA, 23 bp, Homo sapiens
cagaaatgtatggcatgtgtagt

SEQ ID NO: 1817427 - DNA, 14 bp, Homo sapiens
cagaaattctcaaa

SEQ ID NO: 1817428 - DNA, 12 bp, Homo sapiens
cagaacagctga

SEQ ID NO: 1817429 - DNA, 13 bp, Homo sapiens
cagaacagctgaa

SEQ ID NO: 1817430 - DNA, 14 bp, Homo sapiens
cagaagaaaataat

SEQ ID NO: 1817431 - DNA, 23 bp, Homo sapiens
cagaaggagaaggaaaaagaaag

SEQ ID NO: 1817432 - DNA, 18 bp, Homo sapiens
cagaaggagggcagagcc

SEQ ID NO: 1817433 - DNA, 15 bp, Homo sapiens
cagaagttgatgtgg

SEQ ID NO: 1817434 - DNA, 21 bp, Homo sapiens
cagaatagatctgatggtgag

SEQ ID NO: 1817435 - DNA, 21 bp, Homo sapiens
cagaatctgctgttgccatag

SEQ ID NO: 1817436 - DNA, 16 bp, Homo sapiens
cagaattgaaggagaa

SEQ ID NO: 1817437 - DNA, 17 bp, Homo sapiens
cagaatttatagaataa

SEQ ID NO: 1817438 - DNA, 20 bp, Homo sapiens
cagacaggccctccctgtct

SEQ ID NO: 1817439 - DNA, 19 bp, Homo sapiens
cagactgaaccagagctgg

SEQ ID NO: 1817440 - DNA, 19 bp, Homo sapiens
cagacttctggaaggctgg

SEQ ID NO: 1817441 - DNA, 21 bp, Homo sapiens
cagacttctggaaggctggct

SEQ ID NO: 1817442 - DNA, 15 bp, Homo sapiens
cagagaaggcctctt

SEQ ID NO: 1817443 - DNA, 22 bp, Homo sapiens
cagagaaggcctcttgtgctca

SEQ ID NO: 1817444 - DNA, 13 bp, Homo sapiens
cagagagccctgg

SEQ ID NO: 1817445 - DNA, 19 bp, Homo sapiens
cagagcagagcaaatgagg

SEQ ID NO: 1817446 - DNA, 21 bp, Homo sapiens
cagagcagagcaaatgaggga

SEQ ID NO: 1817447 - DNA, 13 bp, Homo sapiens
cagagccagcctg

SEQ ID NO: 1817448 - DNA, 18 bp, Homo sapiens
cagagccagcctgggact

SEQ ID NO: 1817449 - DNA, 23 bp, Homo sapiens
cagagccagcctgggactcccag

SEQ ID NO: 1817450 - DNA, 13 bp, Homo sapiens
cagagccatgggc

SEQ ID NO: 1817451 - DNA, 17 bp, Homo sapiens
cagagccatgggcctgg

SEQ ID NO: 1817452 - DNA, 19 bp, Homo sapiens
cagagccatgggcctgggc

SEQ ID NO: 1817453 - DNA, 20 bp, Homo sapiens
cagagccttttacccctgca

SEQ ID NO: 1817454 - DNA, 17 bp, Homo sapiens
cagagctcttcaagctg

SEQ ID NO: 1817455 - DNA, 18 bp, Homo sapiens
cagagctcttcaagctgt

SEQ ID NO: 1817456 - DNA, 20 bp, Homo sapiens
cagagctcttcaagctgtcc

SEQ ID NO: 1817457 - DNA, 21 bp, Homo sapiens
cagagctggaaggcagggcag

SEQ ID NO: 1817458 - DNA, 21 bp, Homo sapiens
cagaggaccacagtgggtggc

SEQ ID NO: 1817459 - DNA, 16 bp, Homo sapiens
cagaggctaagatgag

SEQ ID NO: 1817460 - DNA, 17 bp, Homo sapiens
cagaggctaagatgaga

SEQ ID NO: 1817461 - DNA, 18 bp, Homo sapiens
cagagggaccaaattgct

SEQ ID NO: 1817462 - DNA, 18 bp, Homo sapiens
cacagtgactcgggctcc

SEQ ID NO: 1817463 - DNA, 19 bp, Homo sapiens
cacagtgactcgggctcct

SEQ ID NO: 1817464 - DNA, 23 bp, Homo sapiens
cacagtgactcgggctcctgtgc

SEQ ID NO: 1817465 - DNA, 18 bp, Homo sapiens
cacagtgggtggcacctc

SEQ ID NO: 1817466 - DNA, 13 bp, Homo sapiens
cacagtgtctggg

SEQ ID NO: 1817467 - DNA, 14 bp, Homo sapiens
cacagtgtctgggc

SEQ ID NO: 1817468 - DNA, 16 bp, Homo sapiens
cacagtgtctgggctg

SEQ ID NO: 1817469 - DNA, 16 bp, Homo sapiens
cacagtttagaacaga

SEQ ID NO: 1817470 - DNA, 10 bp, Homo sapiens
cacataaagg

SEQ ID NO: 1817471 - DNA, 13 bp, Homo sapiens
cacataaaggtat

SEQ ID NO: 1817472 - DNA, 17 bp, Homo sapiens
cacatcattcattcact

SEQ ID NO: 1817473 - DNA, 14 bp, Homo sapiens
cacatcccggcctc

SEQ ID NO: 1817474 - DNA, 15 bp, Homo sapiens
cacatcccggcctct

SEQ ID NO: 1817475 - DNA, 17 bp, Homo sapiens
cacatgacgtaaaattt

SEQ ID NO: 1817476 - DNA, 12 bp, Homo sapiens
cacatgtccagt

SEQ ID NO: 1817477 - DNA, 16 bp, Homo sapiens
caccaaactgcacaca

SEQ ID NO: 1817478 - DNA, 20 bp, Homo sapiens
caccaacccagccgctgccc

SEQ ID NO: 1817479 - DNA, 15 bp, Homo sapiens
caccaagctgtgcca

SEQ ID NO: 1817480 - DNA, 16 bp, Homo sapiens
caccaagctgtgccac

SEQ ID NO: 1817481 - DNA, 21 bp, Homo sapiens
caccaagctgtgccaccctgg

SEQ ID NO: 1817482 - DNA, 14 bp, Homo sapiens
caccacgtctgcca

SEQ ID NO: 1817483 - DNA, 21 bp, Homo sapiens
caccacgtctgccaggcccat

SEQ ID NO: 1817484 - DNA, 21 bp, Homo sapiens
caccactagggtcctggccct

SEQ ID NO: 1817485 - DNA, 15 bp, Homo sapiens
caccactgccctgcc

SEQ ID NO: 1817486 - DNA, 19 bp, Homo sapiens
caccactgccctgcctgcc

SEQ ID NO: 1817487 - DNA, 20 bp, Homo sapiens
caccactgccctgcctgccc

SEQ ID NO: 1817488 - DNA, 12 bp, Homo sapiens
caccagagtgaa

SEQ ID NO: 1817489 - DNA, 14 bp, Homo sapiens
caccagctctgtgg

SEQ ID NO: 1817490 - DNA, 15 bp, Homo sapiens
caccagctctgtggc

SEQ ID NO: 1817491 - DNA, 16 bp, Homo sapiens
caccagctctgtggcc

SEQ ID NO: 1817492 - DNA, 23 bp, Homo sapiens
caccagctctgtggcctgtgtcc

SEQ ID NO: 1817493 - DNA, 11 bp, Homo sapiens
caccagctgct

SEQ ID NO: 1817494 - DNA, 15 bp, Homo sapiens
caccagctgctctgc

SEQ ID NO: 1817495 - DNA, 18 bp, Homo sapiens
caccagctgctctgcccc

SEQ ID NO: 1817496 - DNA, 19 bp, Homo sapiens
caccagctgctctgcccct

SEQ ID NO: 1817497 - DNA, 14 bp, Homo sapiens
caccaggagacaga

SEQ ID NO: 1817498 - DNA, 12 bp, Homo sapiens
caccaggggcag

SEQ ID NO: 1817499 - DNA, 21 bp, Homo sapiens
caccaggggcaggcacagcac

SEQ ID NO: 1817500 - DNA, 19 bp, Homo sapiens
caccagggtccgcaccagc

SEQ ID NO: 1817501 - DNA, 24 bp, Homo sapiens
caccagggtccgcaccagctgctc

SEQ ID NO: 1817502 - DNA, 13 bp, Homo sapiens
cacccactcacca

SEQ ID NO: 1817503 - DNA, 12 bp, Homo sapiens
cacccaggctgc

SEQ ID NO: 1817504 - DNA, 13 bp, Homo sapiens
cacccaggctgca

SEQ ID NO: 1817505 - DNA, 16 bp, Homo sapiens
cacccaggctgcactg

SEQ ID NO: 1817506 - DNA, 13 bp, Homo sapiens
cacccagtgctgc

SEQ ID NO: 1817507 - DNA, 14 bp, Homo sapiens
cacccagtgctgcc

SEQ ID NO: 1817508 - DNA, 15 bp, Homo sapiens
cacccagtgctgcca

SEQ ID NO: 1817509 - DNA, 23 bp, Homo sapiens
cacccagtgctgccatgccactg

SEQ ID NO: 1817510 - DNA, 22 bp, Homo sapiens
cacccatcttcctgctgctgta

SEQ ID NO: 1817511 - DNA, 16 bp, Homo sapiens
caccccaaaccccagc

SEQ ID NO: 1817512 - DNA, 17 bp, Homo sapiens
caccccaaaccccagcc

SEQ ID NO: 1817513 - DNA, 13 bp, Homo sapiens
cacccccatgctg

SEQ ID NO: 1817514 - DNA, 13 bp, Homo sapiens
cacccctgcactt

SEQ ID NO: 1817515 - DNA, 16 bp, Homo sapiens
cacccgccttttataa

SEQ ID NO: 1817516 - DNA, 21 bp, Homo sapiens
caccctcgtggacacctgccc

SEQ ID NO: 1817517 - DNA, 23 bp, Homo sapiens
caccctcgtggacacctgccctg

SEQ ID NO: 1817518 - DNA, 15 bp, Homo sapiens
caccctgggctctgt

SEQ ID NO: 1817519 - DNA, 21 bp, Homo sapiens
caccctgggctctgtgggctg

SEQ ID NO: 1817520 - DNA, 18 bp, Homo sapiens
caccctgggtgccattcc

SEQ ID NO: 1817521 - DNA, 14 bp, Homo sapiens
caccgcatgccccc

SEQ ID NO: 1817522 - DNA, 16 bp, Homo sapiens
caccgcatgccccctc

SEQ ID NO: 1817523 - DNA, 19 bp, Homo sapiens
caccgcatgccccctcgtg

SEQ ID NO: 1817524 - DNA, 22 bp, Homo sapiens
caccgcatgccccctcgtgcca

SEQ ID NO: 1817525 - DNA, 19 bp, Homo sapiens
caccgccccttctccaaca

SEQ ID NO: 1817526 - DNA, 14 bp, Homo sapiens
caccggcgctgcag

SEQ ID NO: 1817527 - DNA, 21 bp, Homo sapiens
caccgtttgtcccccggggca

SEQ ID NO: 1817528 - DNA, 14 bp, Homo sapiens
cacctaccatgctg

SEQ ID NO: 1817529 - DNA, 16 bp, Homo sapiens
cacctaccatgctgct

SEQ ID NO: 1817530 - DNA, 17 bp, Homo sapiens
cacctaccatgctgctt

SEQ ID NO: 1817531 - DNA, 21 bp, Homo sapiens
cacctacttgtgactgaaggg

SEQ ID NO: 1817532 - DNA, 16 bp, Homo sapiens
cacctagtggctgtcc

SEQ ID NO: 1817533 - DNA, 23 bp, Homo sapiens
cacctagtggctgtccagtgccc

SEQ ID NO: 1817534 - DNA, 13 bp, Homo sapiens
cacctcatgagtc

SEQ ID NO: 1817535 - DNA, 14 bp, Homo sapiens
cacctcatgcctgg

SEQ ID NO: 1817536 - DNA, 21 bp, Homo sapiens
cacctcctagaggtgggcagc

SEQ ID NO: 1817537 - DNA, 23 bp, Homo sapiens
cacctctcaatattcaataaagc

SEQ ID NO: 1817538 - DNA, 13 bp, Homo sapiens
cacctgcaagccc

SEQ ID NO: 1817539 - DNA, 18 bp, Homo sapiens
cacctgcaagccccaggg

SEQ ID NO: 1817540 - DNA, 20 bp, Homo sapiens
cacctgcaagccccagggcc

SEQ ID NO: 1817541 - DNA, 23 bp, Homo sapiens
cacctgcaagccccagggcctgg

SEQ ID NO: 1817542 - DNA, 22 bp, Homo sapiens
cacctgcaggttgggccatact

SEQ ID NO: 1817543 - DNA, 14 bp, Homo sapiens
cacctgccctgccc

SEQ ID NO: 1817544 - DNA, 17 bp, Homo sapiens
cacctgccctgccctgc

SEQ ID NO: 1817545 - DNA, 18 bp, Homo sapiens
cacctgccctgccctgcc

SEQ ID NO: 1817546 - DNA, 19 bp, Homo sapiens
cacctgccctgccctgcca

SEQ ID NO: 1817547 - DNA, 23 bp, Homo sapiens
cacctgccctgccctgccacctg

SEQ ID NO: 1817548 - DNA, 17 bp, Homo sapiens
cacctgcctatccatcc

SEQ ID NO: 1817549 - DNA, 12 bp, Homo sapiens
cacctggcctgc

SEQ ID NO: 1817550 - DNA, 16 bp, Homo sapiens
tgtttagaactactga

SEQ ID NO: 1817551 - DNA, 16 bp, Homo sapiens
tgtttagaagaagtgt

SEQ ID NO: 1817552 - DNA, 16 bp, Homo sapiens
tgtttatgtgtgtgtg

SEQ ID NO: 1817553 - DNA, 18 bp, Homo sapiens
tgtttgaaatgcttagtt

SEQ ID NO: 1817554 - DNA, 19 bp, Homo sapiens
tgtttggggaagttcaagt

SEQ ID NO: 1817555 - DNA, 21 bp, Homo sapiens
tgtttggggaagttcaagtga

SEQ ID NO: 1817556 - DNA, 13 bp, Homo sapiens
tgttttcttcatt

SEQ ID NO: 1817557 - DNA, 18 bp, Homo sapiens
tgttttcttcatttctct

SEQ ID NO: 1817558 - DNA, 18 bp, Homo sapiens
ttaaaaaaagtatatatt

SEQ ID NO: 1817559 - DNA, 22 bp, Homo sapiens
ttaaaaaaagtatatattctac

SEQ ID NO: 1817560 - DNA, 21 bp, Homo sapiens
ttaaaatgcatatttctatgt

SEQ ID NO: 1817561 - DNA, 13 bp, Homo sapiens
ttaaaattgtgat

SEQ ID NO: 1817562 - DNA, 20 bp, Homo sapiens
ttaaactgattagtattcag

SEQ ID NO: 1817563 - DNA, 13 bp, Homo sapiens
ttaaatcgttaga

SEQ ID NO: 1817564 - DNA, 16 bp, Homo sapiens
ttaacaactgtgaata

SEQ ID NO: 1817565 - DNA, 18 bp, Homo sapiens
ttaacctgaattattcca

SEQ ID NO: 1817566 - DNA, 23 bp, Homo sapiens
ttaagaatgcagattcctgggcc

SEQ ID NO: 1817567 - DNA, 17 bp, Homo sapiens
ttaaggtgggtccagga

SEQ ID NO: 1817568 - DNA, 14 bp, Homo sapiens
ttaatatttttcaa

SEQ ID NO: 1817569 - DNA, 17 bp, Homo sapiens
ttacaggggcagtgcct

SEQ ID NO: 1817570 - DNA, 22 bp, Homo sapiens
ttacaggggcagtgcctttgta

SEQ ID NO: 1817571 - DNA, 17 bp, Homo sapiens
ttacagtatcttcaaaa

SEQ ID NO: 1817572 - DNA, 19 bp, Homo sapiens
ttacatctttgtttaccat

SEQ ID NO: 1817573 - DNA, 22 bp, Homo sapiens
ttacattaaaatagcacatgat

SEQ ID NO: 1817574 - DNA, 16 bp, Homo sapiens
ttacattttcctgtgt

SEQ ID NO: 1817575 - DNA, 19 bp, Homo sapiens
ttacattttcctgtgtaaa

SEQ ID NO: 1817576 - DNA, 17 bp, Homo sapiens
ttacccctgcacagttt

SEQ ID NO: 1817577 - DNA, 12 bp, Homo sapiens
ttactaaaagaa

SEQ ID NO: 1817578 - DNA, 18 bp, Homo sapiens
ttactcccttcctggcct

SEQ ID NO: 1817579 - DNA, 19 bp, Homo sapiens
ttactcccttcctggcctc

SEQ ID NO: 1817580 - DNA, 20 bp, Homo sapiens
ttactctgagcccaggccgt

SEQ ID NO: 1817581 - DNA, 18 bp, Homo sapiens
ttactgacagaaatgcaa

SEQ ID NO: 1817582 - DNA, 23 bp, Homo sapiens
ttactgttaactgtcttgagaga

SEQ ID NO: 1817583 - DNA, 23 bp, Homo sapiens
ttagaaacaaatttttttcttgt

SEQ ID NO: 1817584 - DNA, 12 bp, Homo sapiens
ttagaatatatt

SEQ ID NO: 1817585 - DNA, 14 bp, Homo sapiens
ttagaatatattaa

SEQ ID NO: 1817586 - DNA, 13 bp, Homo sapiens
ttagaatgtttct

SEQ ID NO: 1817587 - DNA, 23 bp, Homo sapiens
ttagaatgtttctatttccataa

SEQ ID NO: 1817588 - DNA, 18 bp, Homo sapiens
ttagccttgtgccctgcc

SEQ ID NO: 1817589 - DNA, 18 bp, Homo sapiens
ttaggaaggcagcattcc

SEQ ID NO: 1817590 - DNA, 16 bp, Homo sapiens
ttaggatactcttaat

SEQ ID NO: 1817591 - DNA, 12 bp, Homo sapiens
ttaggcctggca

SEQ ID NO: 1817592 - DNA, 17 bp, Homo sapiens
ttaggcctggcacagtg

SEQ ID NO: 1817593 - DNA, 21 bp, Homo sapiens
ttagtgccaagtttttcagaa

SEQ ID NO: 1817594 - DNA, 18 bp, Homo sapiens
ttatacatcttcattaat

SEQ ID NO: 1817595 - DNA, 13 bp, Homo sapiens
ttatatatcataa

SEQ ID NO: 1817596 - DNA, 16 bp, Homo sapiens
ttatatatcataaagt

SEQ ID NO: 1817597 - DNA, 15 bp, Homo sapiens
ttatcccttcttata

SEQ ID NO: 1817598 - DNA, 23 bp, Homo sapiens
ttatctagaaagaaaagaccctg

SEQ ID NO: 1817599 - DNA, 12 bp, Homo sapiens
ttatctgcctgg

SEQ ID NO: 1817600 - DNA, 18 bp, Homo sapiens
ttatctgcctggcctggc

SEQ ID NO: 1817601 - DNA, 21 bp, Homo sapiens
ttatctgcctggcctggctcc

SEQ ID NO: 1817602 - DNA, 15 bp, Homo sapiens
ttatgtaagtttgca

SEQ ID NO: 1817603 - DNA, 17 bp, Homo sapiens
ttattaacaactgtgaa

SEQ ID NO: 1817604 - DNA, 18 bp, Homo sapiens
ttattaacaactgtgaat

SEQ ID NO: 1817605 - DNA, 14 bp, Homo sapiens
ttattcagctcact

SEQ ID NO: 1817606 - DNA, 19 bp, Homo sapiens
ttattgatcaaaatcaaaa

SEQ ID NO: 1817607 - DNA, 14 bp, Homo sapiens
ttattggaattttc

SEQ ID NO: 1817608 - DNA, 19 bp, Homo sapiens
ttattggaattttctttca

SEQ ID NO: 1817609 - DNA, 19 bp, Homo sapiens
ttatttctggctttttgaa

SEQ ID NO: 1817610 - DNA, 18 bp, Homo sapiens
ttatttggaattttaagt

SEQ ID NO: 1817611 - DNA, 14 bp, Homo sapiens
ttattttgtaatta

SEQ ID NO: 1817612 - DNA, 20 bp, Homo sapiens
ttgcatcccccttagaatgt

SEQ ID NO: 1817613 - DNA, 19 bp, Homo sapiens
ttgcatttatgatgcagtt

SEQ ID NO: 1817614 - DNA, 18 bp, Homo sapiens
ttgccaaggctctcccct

SEQ ID NO: 1817615 - DNA, 12 bp, Homo sapiens
ttgccagcacag

SEQ ID NO: 1817616 - DNA, 14 bp, Homo sapiens
ttgccagcacaggg

SEQ ID NO: 1817617 - DNA, 17 bp, Homo sapiens
ttgccagcacaggggcc

SEQ ID NO: 1817618 - DNA, 20 bp, Homo sapiens
ttgcccaggctggagtgcag

SEQ ID NO: 1817619 - DNA, 17 bp, Homo sapiens
ttgccccaacccccagc

SEQ ID NO: 1817620 - DNA, 13 bp, Homo sapiens
ttgcccgctccca

SEQ ID NO: 1817621 - DNA, 21 bp, Homo sapiens
ttgcccgctcccacagcttcc

SEQ ID NO: 1817622 - DNA, 23 bp, Homo sapiens
ttgcccgctcccacagcttcctg

SEQ ID NO: 1817623 - DNA, 14 bp, Homo sapiens
ttgcctcggctcct

SEQ ID NO: 1817624 - DNA, 20 bp, Homo sapiens
ttgcctcggctcctgctgca

SEQ ID NO: 1817625 - DNA, 14 bp, Homo sapiens
ttgctccagggtct

SEQ ID NO: 1817626 - DNA, 20 bp, Homo sapiens
ttgctctaattcttttcaaa

SEQ ID NO: 1817627 - DNA, 12 bp, Homo sapiens
ttgctcttctgt

SEQ ID NO: 1817628 - DNA, 16 bp, Homo sapiens
ttgctgaaaaacacaa

SEQ ID NO: 1817629 - DNA, 19 bp, Homo sapiens
ttgctgaattcctttacaa

SEQ ID NO: 1817630 - DNA, 13 bp, Homo sapiens
ttgctgcccctgt

SEQ ID NO: 1817631 - DNA, 15 bp, Homo sapiens
ttgctgcccctgtct

SEQ ID NO: 1817632 - DNA, 15 bp, Homo sapiens
ttgctggcaatgagt

SEQ ID NO: 1817633 - DNA, 16 bp, Homo sapiens
ttgcttctaaatgccc

SEQ ID NO: 1817634 - DNA, 23 bp, Homo sapiens
ttgcttctaggagtcaactggct

SEQ ID NO: 1817635 - DNA, 13 bp, Homo sapiens
ttggaattttctt

SEQ ID NO: 1817636 - DNA, 18 bp, Homo sapiens
ttggcacccccatgctgc

SEQ ID NO: 1817637 - DNA, 19 bp, Homo sapiens
ttggcacccccatgctgcc

SEQ ID NO: 1817638 - DNA, 12 bp, Homo sapiens
ttggcagcaggt

SEQ ID NO: 1817639 - DNA, 15 bp, Homo sapiens
ttggcgcaccctccc

SEQ ID NO: 1817640 - DNA, 19 bp, Homo sapiens
ttggctgcgctaaccccca

SEQ ID NO: 1817641 - DNA, 20 bp, Homo sapiens
ttggctgcgctaacccccag

SEQ ID NO: 1817642 - DNA, 16 bp, Homo sapiens
ttggcttcctccgtcc

SEQ ID NO: 1817643 - DNA, 17 bp, Homo sapiens
ttgggcagagctggaca

SEQ ID NO: 1817644 - DNA, 16 bp, Homo sapiens
ttgggcatccacccag

SEQ ID NO: 1817645 - DNA, 20 bp, Homo sapiens
ttgggcatccacccagtgct

SEQ ID NO: 1817646 - DNA, 21 bp, Homo sapiens
ttgggcatccacccagtgctg

SEQ ID NO: 1817647 - DNA, 18 bp, Homo sapiens
ttgggccatactggcctc

SEQ ID NO: 1817648 - DNA, 19 bp, Homo sapiens
ttgggccatactggcctcg

SEQ ID NO: 1817649 - DNA, 23 bp, Homo sapiens
ttgggccatactggcctcgcctg

SEQ ID NO: 1817650 - DNA, 19 bp, Homo sapiens
ttgggctactggcagctcc

SEQ ID NO: 1817651 - DNA, 15 bp, Homo sapiens
ttgggctcctggctg

SEQ ID NO: 1817652 - DNA, 21 bp, Homo sapiens
ttgggctcctggctgccaggc

SEQ ID NO: 1817653 - DNA, 22 bp, Homo sapiens
ttgggctgacacctaccatgct

SEQ ID NO: 1817654 - DNA, 16 bp, Homo sapiens
ttggggaagttcaagt

SEQ ID NO: 1817655 - DNA, 18 bp, Homo sapiens
ttggggaagttcaagtga

SEQ ID NO: 1817656 - DNA, 11 bp, Homo sapiens
ttggggcctgg

SEQ ID NO: 1817657 - DNA, 14 bp, Homo sapiens
ttggggcctggctt

SEQ ID NO: 1817658 - DNA, 21 bp, Homo sapiens
ttggggcctggcttgctccag

SEQ ID NO: 1817659 - DNA, 16 bp, Homo sapiens
ttgggttaagtatgag

SEQ ID NO: 1817660 - DNA, 21 bp, Homo sapiens
ttggtggggctcgtggccttc

SEQ ID NO: 1817661 - DNA, 16 bp, Homo sapiens
ttgtacaaagatatgc

SEQ ID NO: 1817662 - DNA, 15 bp, Homo sapiens
ttgtacattatgtta

SEQ ID NO: 1817663 - DNA, 13 bp, Homo sapiens
ttgtacctggtga

SEQ ID NO: 1817664 - DNA, 21 bp, Homo sapiens
ttgtacttttggcatgaaagt

SEQ ID NO: 1817665 - DNA, 18 bp, Homo sapiens
ttgtattttgacaaaaat

SEQ ID NO: 1817666 - DNA, 20 bp, Homo sapiens
ttgtccccagggcccctccc

SEQ ID NO: 1817667 - DNA, 16 bp, Homo sapiens
ttgtcctgactgtctg

SEQ ID NO: 1817668 - DNA, 12 bp, Homo sapiens
ttgtcctgccag

SEQ ID NO: 1817669 - DNA, 17 bp, Homo sapiens
ttgtcctgccagctgcc

SEQ ID NO: 1817670 - DNA, 18 bp, Homo sapiens
ttgtcctgccagctgcct

SEQ ID NO: 1817671 - DNA, 23 bp, Homo sapiens
tgccacttcttaaaggcctggaa

SEQ ID NO: 1817672 - DNA, 19 bp, Homo sapiens
tgccagcacaggggcccca

SEQ ID NO: 1817673 - DNA, 20 bp, Homo sapiens
tgccagcacaggggccccag

SEQ ID NO: 1817674 - DNA, 15 bp, Homo sapiens
tgccaggcacctggc

SEQ ID NO: 1817675 - DNA, 22 bp, Homo sapiens
tgccaggcgttggtgccacttc

SEQ ID NO: 1817676 - DNA, 22 bp, Homo sapiens
tgccagtgaagtccttcagtga

SEQ ID NO: 1817677 - DNA, 16 bp, Homo sapiens
tgccatcatgtttaca

SEQ ID NO: 1817678 - DNA, 22 bp, Homo sapiens
tgccatcatgtttacagaggac

SEQ ID NO: 1817679 - DNA, 19 bp, Homo sapiens
tgccatgccactgccaggc

SEQ ID NO: 1817680 - DNA, 21 bp, Homo sapiens
tgccatgccactgccaggcac

SEQ ID NO: 1817681 - DNA, 14 bp, Homo sapiens
tgccattcccagcg

SEQ ID NO: 1817682 - DNA, 22 bp, Homo sapiens
tgcccaatgctttgggaggcca

SEQ ID NO: 1817683 - DNA, 20 bp, Homo sapiens
tgcccaggctggagtgcagt

SEQ ID NO: 1817684 - DNA, 15 bp, Homo sapiens
tgcccatgggcactg

SEQ ID NO: 1817685 - DNA, 16 bp, Homo sapiens
tgcccatgggcactgc

SEQ ID NO: 1817686 - DNA, 17 bp, Homo sapiens
tgcccatgggcactgct

SEQ ID NO: 1817687 - DNA, 20 bp, Homo sapiens
tgcccatgggcactgctggg

SEQ ID NO: 1817688 - DNA, 21 bp, Homo sapiens
tggcccccctccaggcatgct

SEQ ID NO: 1817689 - DNA, 20 bp, Homo sapiens
tggccctcaaggcctcccac

SEQ ID NO: 1817690 - DNA, 21 bp, Homo sapiens
tggccctcaaggcctcccaca

SEQ ID NO: 1817691 - DNA, 16 bp, Homo sapiens
tggcctcactggctgg

SEQ ID NO: 1817692 - DNA, 11 bp, Homo sapiens
tggcctgagct

SEQ ID NO: 1817693 - DNA, 18 bp, Homo sapiens
tggcctgagctggggcca

SEQ ID NO: 1817694 - DNA, 11 bp, Homo sapiens
tggcctggctc

SEQ ID NO: 1817695 - DNA, 13 bp, Homo sapiens
tggcctgtgtcca

SEQ ID NO: 1817696 - DNA, 14 bp, Homo sapiens
tggcctgtgtccag

SEQ ID NO: 1817697 - DNA, 17 bp, Homo sapiens
tggcctgtgtccagcag

SEQ ID NO: 1817698 - DNA, 22 bp, Homo sapiens
tggcctgtgtccagcagctgcg

SEQ ID NO: 1817699 - DNA, 21 bp, Homo sapiens
tggcctgttcttctatgggtt

SEQ ID NO: 1817700 - DNA, 17 bp, Homo sapiens
tggcgagaggaggggcc

SEQ ID NO: 1817701 - DNA, 14 bp, Homo sapiens
tggcgcaccctccc

SEQ ID NO: 1817702 - DNA, 15 bp, Homo sapiens
tggcgcaccctcccc

SEQ ID NO: 1817703 - DNA, 18 bp, Homo sapiens
tggcgcaccctcccctcc

SEQ ID NO: 1817704 - DNA, 13 bp, Homo sapiens
tggcgcgggaggc

SEQ ID NO: 1817705 - DNA, 16 bp, Homo sapiens
tggcgcgggaggcacc

SEQ ID NO: 1817706 - DNA, 19 bp, Homo sapiens
tggcggcttcctgtccact

SEQ ID NO: 1817707 - DNA, 18 bp, Homo sapiens
tggcgtaatgggcctgcc

SEQ ID NO: 1817708 - DNA, 23 bp, Homo sapiens
tggctcatggcgtaatgggcctg

SEQ ID NO: 1817709 - DNA, 19 bp, Homo sapiens
tggctccccacgagtcacc

SEQ ID NO: 1817710 - DNA, 20 bp, Homo sapiens
tggctgagagagtggcattg

SEQ ID NO: 1817711 - DNA, 11 bp, Homo sapiens
tggctgccagg

SEQ ID NO: 1817712 - DNA, 14 bp, Homo sapiens
tggctgcctccact

SEQ ID NO: 1817713 - DNA, 17 bp, Homo sapiens
tggctgcctccactccc

SEQ ID NO: 1817714 - DNA, 18 bp, Homo sapiens
tggctgcctccactccca

SEQ ID NO: 1817715 - DNA, 14 bp, Homo sapiens
tggctggggcagag

SEQ ID NO: 1817716 - DNA, 16 bp, Homo sapiens
tggctgtggaggcctg

SEQ ID NO: 1817717 - DNA, 20 bp, Homo sapiens
tggctgtggaggcctgatgc

SEQ ID NO: 1817718 - DNA, 14 bp, Homo sapiens
tggctgtggcacag

SEQ ID NO: 1817719 - DNA, 23 bp, Homo sapiens
tggctgtggcacagacttctgga

SEQ ID NO: 1817720 - DNA, 21 bp, Homo sapiens
tggtatgaacttgaggacaca

SEQ ID NO: 1817721 - DNA, 23 bp, Homo sapiens
tggtcaatacacataagaccgtg

SEQ ID NO: 1817722 - DNA, 19 bp, Homo sapiens
tggtcaggatctcatgaca

SEQ ID NO: 1817723 - DNA, 21 bp, Homo sapiens
tggtcagtgtggagaggggtg

SEQ ID NO: 1817724 - DNA, 14 bp, Homo sapiens
tggtccatctcatt

SEQ ID NO: 1817725 - DNA, 17 bp, Homo sapiens
tggtctgctcgggccca

SEQ ID NO: 1817726 - DNA, 18 bp, Homo sapiens
tggtctgctcgggcccag

SEQ ID NO: 1817727 - DNA, 21 bp, Homo sapiens
tggtgagctgggaagctgtac

SEQ ID NO: 1817728 - DNA, 18 bp, Homo sapiens
tggtgcagccttcccctc

SEQ ID NO: 1817729 - DNA, 19 bp, Homo sapiens
tggtgcagccttcccctcc

SEQ ID NO: 1817730 - DNA, 22 bp, Homo sapiens
tggtgcagccttcccctccctg

SEQ ID NO: 1817731 - DNA, 20 bp, Homo sapiens
tggtgttcataatttcagtt

SEQ ID NO: 1817732 - DNA, 12 bp, Homo sapiens
tggttgttgcca

SEQ ID NO: 1817733 - DNA, 14 bp, Homo sapiens
tggtttcctcattt

SEQ ID NO: 1817734 - DNA, 19 bp, Homo sapiens
tgtaaaaatactgtttcac

SEQ ID NO: 1817735 - DNA, 20 bp, Homo sapiens
tgtaaaaatactgtttcact

SEQ ID NO: 1817736 - DNA, 16 bp, Homo sapiens
tgtaaacctaattgtg

SEQ ID NO: 1817737 - DNA, 15 bp, Homo sapiens
tgtaaatttatgtga

SEQ ID NO: 1817738 - DNA, 16 bp, Homo sapiens
tgtaactgctgagcca

SEQ ID NO: 1817739 - DNA, 15 bp, Homo sapiens
tgtaagacttcagat

SEQ ID NO: 1817740 - DNA, 18 bp, Homo sapiens
tgtaagcaacttgcttct

SEQ ID NO: 1817741 - DNA, 13 bp, Homo sapiens
tgtaagtttgcat

SEQ ID NO: 1817742 - DNA, 16 bp, Homo sapiens
tgtaatactgtagaaa

SEQ ID NO: 1817743 - DNA, 20 bp, Homo sapiens
tgtaatgggatctatttttg

SEQ ID NO: 1817744 - DNA, 12 bp, Homo sapiens
tgtacccagctc

SEQ ID NO: 1817745 - DNA, 13 bp, Homo sapiens
tgtacccagctcc

SEQ ID NO: 1817746 - DNA, 15 bp, Homo sapiens
tgtacccccgcccag

SEQ ID NO: 1817747 - DNA, 16 bp, Homo sapiens
tgtacccccgcccagg

SEQ ID NO: 1817748 - DNA, 16 bp, Homo sapiens
tgtacccttccacctc

SEQ ID NO: 1817749 - DNA, 20 bp, Homo sapiens
tgtacccttccacctcctag

SEQ ID NO: 1817750 - DNA, 21 bp, Homo sapiens
tgtaccgggctggcctgtgcc

SEQ ID NO: 1817751 - DNA, 17 bp, Homo sapiens
tgtacctggtgacccct

SEQ ID NO: 1817752 - DNA, 15 bp, Homo sapiens
tgtactcagagcaga

SEQ ID NO: 1817753 - DNA, 22 bp, Homo sapiens
tgtagaaatattgctctaattc

SEQ ID NO: 1817754 - DNA, 14 bp, Homo sapiens
tgtagaataaatga

SEQ ID NO: 1817755 - DNA, 18 bp, Homo sapiens
tgtagaattcgcagtgat

SEQ ID NO: 1817756 - DNA, 14 bp, Homo sapiens
tgtagccatggctc

SEQ ID NO: 1817757 - DNA, 21 bp, Homo sapiens
tgtagccatggctcaggcaag

SEQ ID NO: 1817758 - DNA, 15 bp, Homo sapiens
tctcaaatttttcat

SEQ ID NO: 1817759 - DNA, 14 bp, Homo sapiens
tctcaagtgaaaga

SEQ ID NO: 1817760 - DNA, 18 bp, Homo sapiens
tctcaatattcaataaag

SEQ ID NO: 1817761 - DNA, 15 bp, Homo sapiens
tctcaatttgaaaca

SEQ ID NO: 1817762 - DNA, 16 bp, Homo sapiens
tctcagaacagctgaa

SEQ ID NO: 1817763 - DNA, 15 bp, Homo sapiens
tctcaggtgccactc

SEQ ID NO: 1817764 - DNA, 17 bp, Homo sapiens
tctcaggtgccactccc

SEQ ID NO: 1817765 - DNA, 20 bp, Homo sapiens
tctcaggtgccactccctga

SEQ ID NO: 1817766 - DNA, 14 bp, Homo sapiens
tctcatgacattat

SEQ ID NO: 1817767 - DNA, 17 bp, Homo sapiens
tctccaaaggggctgct

SEQ ID NO: 1817768 - DNA, 19 bp, Homo sapiens
tctccaaaggggctgctgg

SEQ ID NO: 1817769 - DNA, 15 bp, Homo sapiens
tctccacctagtggc

SEQ ID NO: 1817770 - DNA, 12 bp, Homo sapiens
tctccatcccct

SEQ ID NO: 1817771 - DNA, 20 bp, Homo sapiens
tctccatcccctccctgcct

SEQ ID NO: 1817772 - DNA, 14 bp, Homo sapiens
tctccatgataact

SEQ ID NO: 1817773 - DNA, 23 bp, Homo sapiens
tctccatgtagaataaatgaaga

SEQ ID NO: 1817774 - DNA, 12 bp, Homo sapiens
tctccccaggcc

SEQ ID NO: 1817775 - DNA, 16 bp, Homo sapiens
tctccccaggcctcca

SEQ ID NO: 1817776 - DNA, 18 bp, Homo sapiens
tctccccaggcctccagc

SEQ ID NO: 1817777 - DNA, 22 bp, Homo sapiens
tctccccatgtgcctgcaccag

SEQ ID NO: 1817778 - DNA, 13 bp, Homo sapiens
tctcccccccggg

SEQ ID NO: 1817779 - DNA, 21 bp, Homo sapiens
tctcccccccggggctgggtt

SEQ ID NO: 1817780 - DNA, 14 bp, Homo sapiens
tctcccggctgcct

SEQ ID NO: 1817781 - DNA, 17 bp, Homo sapiens
tctcccggctgcctgcc

SEQ ID NO: 1817782 - DNA, 14 bp, Homo sapiens
tctccctggccctc

SEQ ID NO: 1817783 - DNA, 22 bp, Homo sapiens
tctccggggtctgtgctgtgcc

SEQ ID NO: 1817784 - DNA, 17 bp, Homo sapiens
tctcctaccccacctca

SEQ ID NO: 1817785 - DNA, 23 bp, Homo sapiens
tctcctaccccacctcatgcctg

SEQ ID NO: 1817786 - DNA, 17 bp, Homo sapiens
tctcctcatttaatatt

SEQ ID NO: 1817787 - DNA, 21 bp, Homo sapiens
tctcctcccatggccttccct

SEQ ID NO: 1817788 - DNA, 16 bp, Homo sapiens
tctccttactctgagc

SEQ ID NO: 1817789 - DNA, 17 bp, Homo sapiens
tctccttactctgagcc

SEQ ID NO: 1817790 - DNA, 18 bp, Homo sapiens
tctccttactctgagccc

SEQ ID NO: 1817791 - DNA, 19 bp, Homo sapiens
tctccttactctgagccca

SEQ ID NO: 1817792 - DNA, 23 bp, Homo sapiens
tctccttactctgagcccaggcc

SEQ ID NO: 1817793 - DNA, 19 bp, Homo sapiens
tctccttcgtgtctctccc

SEQ ID NO: 1817794 - DNA, 20 bp, Homo sapiens
tctccttcgtgtctctccca

SEQ ID NO: 1817795 - DNA, 21 bp, Homo sapiens
tctccttgggctcctggctgc

SEQ ID NO: 1817796 - DNA, 22 bp, Homo sapiens
tctcggggcccttggggcctgg

SEQ ID NO: 1817797 - DNA, 13 bp, Homo sapiens
tctctaacatatg

SEQ ID NO: 1817798 - DNA, 16 bp, Homo sapiens
tctctcaatttgaaac

SEQ ID NO: 1817799 - DNA, 17 bp, Homo sapiens
tctctcaatttgaaaca

SEQ ID NO: 1817800 - DNA, 19 bp, Homo sapiens
tctctcaatttgaaacaca

SEQ ID NO: 1817801 - DNA, 22 bp, Homo sapiens
tctctcccaccccggcctccac

SEQ ID NO: 1817802 - DNA, 13 bp, Homo sapiens
tctctgctctagc

SEQ ID NO: 1817803 - DNA, 15 bp, Homo sapiens
tctctgctctagcca

SEQ ID NO: 1817804 - DNA, 17 bp, Homo sapiens
tctctgctctagccagg

SEQ ID NO: 1817805 - DNA, 18 bp, Homo sapiens
tctctgctctagccagga

SEQ ID NO: 1817806 - DNA, 19 bp, Homo sapiens
tctcttcaatcactagtca

SEQ ID NO: 1817807 - DNA, 16 bp, Homo sapiens
tctgaagctagaaaca

SEQ ID NO: 1817808 - DNA, 15 bp, Homo sapiens
tctgacagtctcaaa

SEQ ID NO: 1817809 - DNA, 17 bp, Homo sapiens
tctgacagtctcaaatt

SEQ ID NO: 1817810 - DNA, 15 bp, Homo sapiens
tctgactccagagtc

SEQ ID NO: 1817811 - DNA, 20 bp, Homo sapiens
tctgatggtgagctgggaag

SEQ ID NO: 1817812 - DNA, 18 bp, Homo sapiens
tctgcaactagccaaggc

SEQ ID NO: 1817813 - DNA, 23 bp, Homo sapiens
tctgcccaggacggggccggcca

SEQ ID NO: 1817814 - DNA, 19 bp, Homo sapiens
tctgccccaagcagccagc

SEQ ID NO: 1817815 - DNA, 20 bp, Homo sapiens
tctgccccaagcagccagcc

SEQ ID NO: 1817816 - DNA, 22 bp, Homo sapiens
tctgccccaagcagccagccag

SEQ ID NO: 1817817 - DNA, 22 bp, Homo sapiens
tctgccccttgggcatccaccc

SEQ ID NO: 1817818 - DNA, 17 bp, Homo sapiens
tctgcctggcctggctc

SEQ ID NO: 1817819 - DNA, 19 bp, Homo sapiens
tctgcctggcctggctccc

SEQ ID NO: 1817820 - DNA, 20 bp, Homo sapiens
tctgcctggcctggctcccc

SEQ ID NO: 1817821 - DNA, 13 bp, Homo sapiens
tctgcctgggcct

SEQ ID NO: 1817822 - DNA, 20 bp, Homo sapiens
tctgcctgggcctgtgcagc

SEQ ID NO: 1817823 - DNA, 14 bp, Homo sapiens
tctgctgggctggg

SEQ ID NO: 1817824 - DNA, 17 bp, Homo sapiens
tctgctgggctggggcc

SEQ ID NO: 1817825 - DNA, 24 bp, Homo sapiens
tctgctgggctggggcctgatggg

SEQ ID NO: 1817826 - DNA, 13 bp, Homo sapiens
tctgctgttgcca

SEQ ID NO: 1817827 - DNA, 21 bp, Homo sapiens
tctgctgttgccatagcccca

SEQ ID NO: 1817828 - DNA, 18 bp, Homo sapiens
tctggaaggctggctgag

SEQ ID NO: 1817829 - DNA, 18 bp, Homo sapiens
tctggaatgcttgctgta

SEQ ID NO: 1817830 - DNA, 18 bp, Homo sapiens
tctgggctcagggctgga

SEQ ID NO: 1817831 - DNA, 20 bp, Homo sapiens
tctgggctcagggctggagt

SEQ ID NO: 1817832 - DNA, 13 bp, Homo sapiens
tctgggtttggat

SEQ ID NO: 1817833 - DNA, 20 bp, Homo sapiens
tctgtaatggaactgacccc

SEQ ID NO: 1817834 - DNA, 20 bp, Homo sapiens
tctgtatattccctgtggaa

SEQ ID NO: 1817835 - DNA, 19 bp, Homo sapiens
tctgtatgtgacaacattt

SEQ ID NO: 1817836 - DNA, 18 bp, Homo sapiens
tctgtcatcactccctgg

SEQ ID NO: 1817837 - DNA, 18 bp, Homo sapiens
tctgtccaggccactgtg

SEQ ID NO: 1817838 - DNA, 15 bp, Homo sapiens
tctgtctgtctgtcc

SEQ ID NO: 1817839 - DNA, 22 bp, Homo sapiens
tctgtgaaagtctcctgtatca

SEQ ID NO: 1817840 - DNA, 15 bp, Homo sapiens
tctgtgcccatgggc

SEQ ID NO: 1817841 - DNA, 20 bp, Homo sapiens
tctgtgcccatgggcactgc

SEQ ID NO: 1817842 - DNA, 15 bp, Homo sapiens
tctgtgctgtgcctg

SEQ ID NO: 1817843 - DNA, 14 bp, Homo sapiens
tctgtggcctgtgt

SEQ ID NO: 1817844 - DNA, 12 bp, Homo sapiens
tctgtgggctgc

SEQ ID NO: 1817845 - DNA, 15 bp, Homo sapiens
tctgtgggctgcact

SEQ ID NO: 1817846 - DNA, 19 bp, Homo sapiens
tctgtgggctgcactctgt

SEQ ID NO: 1817847 - DNA, 14 bp, Homo sapiens
tctgtgtcactggc

SEQ ID NO: 1817848 - DNA, 15 bp, Homo sapiens
tctgtgtcactggct

SEQ ID NO: 1817849 - DNA, 13 bp, Homo sapiens
tctgtgtgtgtgt

SEQ ID NO: 1817850 - DNA, 15 bp, Homo sapiens
tctgtgtgtgtgtat

SEQ ID NO: 1817851 - DNA, 15 bp, Homo sapiens
tctgtgtgtttatgt

SEQ ID NO: 1817852 - DNA, 17 bp, Homo sapiens
tcttaaaggcctggaac

SEQ ID NO: 1817853 - DNA, 15 bp, Homo sapiens
tcttagtgcccgcct

SEQ ID NO: 1817854 - DNA, 23 bp, Homo sapiens
tcttattcatgctttctcctttt

SEQ ID NO: 1817855 - DNA, 16 bp, Homo sapiens
tcttatttttctagtc

SEQ ID NO: 1817856 - DNA, 18 bp, Homo sapiens
tcttcaacagggaaaaca

SEQ ID NO: 1817857 - DNA, 22 bp, Homo sapiens
tcttcattacctcagtgagaag

SEQ ID NO: 1817858 - DNA, 21 bp, Homo sapiens
tcttcattatagtaaatctat

SEQ ID NO: 1817859 - DNA, 19 bp, Homo sapiens
tcttcctagtatattagtt

SEQ ID NO: 1817860 - DNA, 13 bp, Homo sapiens
tcttcgctgctct

SEQ ID NO: 1817861 - DNA, 22 bp, Homo sapiens
tcttcgctgctctagctggcag

SEQ ID NO: 1817862 - DNA, 21 bp, Homo sapiens
tcttctgtatgtgacaacatt

SEQ ID NO: 1817863 - DNA, 21 bp, Homo sapiens
tcttcttattcatgctttctc

SEQ ID NO: 1817864 - DNA, 13 bp, Homo sapiens
tcttgagagaaaa

SEQ ID NO: 1817865 - DNA, 22 bp, Homo sapiens
tcttgagagaaaagaaaaatat

SEQ ID NO: 1817866 - DNA, 13 bp, Homo sapiens
tcttgcctaggcc

SEQ ID NO: 1817867 - DNA, 18 bp, Homo sapiens
tcttgggctactggcagc

SEQ ID NO: 1817868 - DNA, 18 bp, Homo sapiens
tcttgggggaggccaccc

SEQ ID NO: 1817869 - DNA, 18 bp, Homo sapiens
tcttgtgctcacgctccc

SEQ ID NO: 1817870 - DNA, 19 bp, Homo sapiens
tcttgtgctcacgctcccc

SEQ ID NO: 1817871 - DNA, 16 bp, Homo sapiens
tcttgtggttgtagga

SEQ ID NO: 1817872 - DNA, 20 bp, Homo sapiens
tcaagcaaaatttctgtata

SEQ ID NO: 1817873 - DNA, 16 bp, Homo sapiens
tcaagcaacagcactt

SEQ ID NO: 1817874 - DNA, 18 bp, Homo sapiens
tcaagctgtcccctctgt

SEQ ID NO: 1817875 - DNA, 19 bp, Homo sapiens
tcaagctgtcccctctgtc

SEQ ID NO: 1817876 - DNA, 15 bp, Homo sapiens
tcaaggcctcccaca

SEQ ID NO: 1817877 - DNA, 18 bp, Homo sapiens
tcaaggcctcccacagtg

SEQ ID NO: 1817878 - DNA, 21 bp, Homo sapiens
tcaataccccaagtccacctg

SEQ ID NO: 1817879 - DNA, 16 bp, Homo sapiens
tcaatatcattactaa

SEQ ID NO: 1817880 - DNA, 13 bp, Homo sapiens
tcacaaaataaag

SEQ ID NO: 1817881 - DNA, 15 bp, Homo sapiens
tcacaacagatttct

SEQ ID NO: 1817882 - DNA, 18 bp, Homo sapiens
tcacaacagatttctaag

SEQ ID NO: 1817883 - DNA, 19 bp, Homo sapiens
tcacaagtctaaacaatga

SEQ ID NO: 1817884 - DNA, 20 bp, Homo sapiens
tcacaagtctaaacaatgaa

SEQ ID NO: 1817885 - DNA, 21 bp, Homo sapiens
tcacaagtctaaacaatgaat

SEQ ID NO: 1817886 - DNA, 14 bp, Homo sapiens
tcacactactgtat

SEQ ID NO: 1817887 - DNA, 11 bp, Homo sapiens
tcacactgatg

SEQ ID NO: 1817888 - DNA, 14 bp, Homo sapiens
tcacagcctctccc

SEQ ID NO: 1817889 - DNA, 12 bp, Homo sapiens
tcacagctgcag

SEQ ID NO: 1817890 - DNA, 18 bp, Homo sapiens
tcacagctgcagctgggc

SEQ ID NO: 1817891 - DNA, 22 bp, Homo sapiens
tcacagctgcagctgggcccca

SEQ ID NO: 1817892 - DNA, 22 bp, Homo sapiens
tcaccaggggcaggcacagcac

SEQ ID NO: 1817893 - DNA, 14 bp, Homo sapiens
tcacctgcaagccc

SEQ ID NO: 1817894 - DNA, 16 bp, Homo sapiens
tcacctgcaagcccca

SEQ ID NO: 1817895 - DNA, 19 bp, Homo sapiens
tcacctgcaagccccaggg

SEQ ID NO: 1817896 - DNA, 20 bp, Homo sapiens
tcacgctcccccgcagtccc

SEQ ID NO: 1817897 - DNA, 20 bp, Homo sapiens
tcactaatacttactgttaa

SEQ ID NO: 1817898 - DNA, 12 bp, Homo sapiens
tcactccctgga

SEQ ID NO: 1817899 - DNA, 16 bp, Homo sapiens
tcactggtttacaaat

SEQ ID NO: 1817900 - DNA, 19 bp, Homo sapiens
tcactgtatagtaatcatt

SEQ ID NO: 1817901 - DNA, 14 bp, Homo sapiens
tcactgttcatgaa

SEQ ID NO: 1817902 - DNA, 17 bp, Homo sapiens
tcacttcatcaatcaaa

SEQ ID NO: 1817903 - DNA, 14 bp, Homo sapiens
tcacttttgtgaaa

SEQ ID NO: 1817904 - DNA, 22 bp, Homo sapiens
tcagaaactcgatgaatgtgtt

SEQ ID NO: 1817905 - DNA, 13 bp, Homo sapiens
tcagaaattctca

SEQ ID NO: 1817906 - DNA, 18 bp, Homo sapiens
tcagaaattctcaaaata

SEQ ID NO: 1817907 - DNA, 22 bp, Homo sapiens
tcagaaattctcaaaatacgtg

SEQ ID NO: 1817908 - DNA, 17 bp, Homo sapiens
tcagagctcttcaagct

SEQ ID NO: 1817909 - DNA, 17 bp, Homo sapiens
tcagatttgccttattg

SEQ ID NO: 1817910 - DNA, 20 bp, Homo sapiens
tcagcaaggggctctgccct

SEQ ID NO: 1817911 - DNA, 17 bp, Homo sapiens
tcagcaccctgggtgcc

SEQ ID NO: 1817912 - DNA, 19 bp, Homo sapiens
tcagcaccctgggtgccat

SEQ ID NO: 1817913 - DNA, 17 bp, Homo sapiens
tcagcagcagagagccc

SEQ ID NO: 1817914 - DNA, 14 bp, Homo sapiens
tcagcagccccctg

SEQ ID NO: 1817915 - DNA, 17 bp, Homo sapiens
tcagcagccccctgccc

SEQ ID NO: 1817916 - DNA, 15 bp, Homo sapiens
tcagcatctcacttc

SEQ ID NO: 1817917 - DNA, 16 bp, Homo sapiens
tcagcttatgggatcc

SEQ ID NO: 1817918 - DNA, 15 bp, Homo sapiens
tcagcttctgctggg

SEQ ID NO: 1817919 - DNA, 17 bp, Homo sapiens
tcagcttctgctgggct

SEQ ID NO: 1817920 - DNA, 18 bp, Homo sapiens
tcagcttctgctgggctg

SEQ ID NO: 1817921 - DNA, 19 bp, Homo sapiens
tcagcttctgctgggctgg

SEQ ID NO: 1817922 - DNA, 13 bp, Homo sapiens
tcaggacccaggc

SEQ ID NO: 1817923 - DNA, 16 bp, Homo sapiens
tcaggacccaggccct

SEQ ID NO: 1817924 - DNA, 23 bp, Homo sapiens
tcaggacccaggccctccatggg

SEQ ID NO: 1817925 - DNA, 13 bp, Homo sapiens
tcaggatctcatg

SEQ ID NO: 1817926 - DNA, 15 bp, Homo sapiens
tcaggcaagcccctc

SEQ ID NO: 1817927 - DNA, 15 bp, Homo sapiens
tcaggcactggtggc

SEQ ID NO: 1817928 - DNA, 15 bp, Homo sapiens
tcaggccgaaggagg

SEQ ID NO: 1817929 - DNA, 16 bp, Homo sapiens
tcagggaccacagcaa

SEQ ID NO: 1817930 - DNA, 21 bp, Homo sapiens
tcagggccagaaggagggcag

SEQ ID NO: 1817931 - DNA, 11 bp, Homo sapiens
tcaggtgccac

SEQ ID NO: 1817932 - DNA, 16 bp, Homo sapiens
tcagtaggtccaaggg

SEQ ID NO: 1817933 - DNA, 12 bp, Homo sapiens
tcagtatgtgga

SEQ ID NO: 1817934 - DNA, 16 bp, Homo sapiens
tcagtgagcccctccc

SEQ ID NO: 1817935 - DNA, 17 bp, Homo sapiens
tcagtgagcccctcccc

SEQ ID NO: 1817936 - DNA, 19 bp, Homo sapiens
tcagtgagcccctccccag

SEQ ID NO: 1817937 - DNA, 16 bp, Homo sapiens
tcagtgccgccgcctc

SEQ ID NO: 1817938 - DNA, 20 bp, Homo sapiens
tcagtgtacccccgcccagg

SEQ ID NO: 1817939 - DNA, 21 bp, Homo sapiens
tcagtgtacccccgcccaggc

SEQ ID NO: 1817940 - DNA, 20 bp, Homo sapiens
tcagtgtgccccccatcctg

SEQ ID NO: 1817941 - DNA, 13 bp, Homo sapiens
tcagtgtggagag

SEQ ID NO: 1817942 - DNA, 23 bp, Homo sapiens
tcagtgtggagaggggtgcaccc

SEQ ID NO: 1817943 - DNA, 18 bp, Homo sapiens
tcagtttctccatcagct

SEQ ID NO: 1817944 - DNA, 21 bp, Homo sapiens
tcatattcaagcaacagcact

SEQ ID NO: 1817945 - DNA, 16 bp, Homo sapiens
tcatcaagtaatcatg

SEQ ID NO: 1817946 - DNA, 15 bp, Homo sapiens
tcatcactccctgga

SEQ ID NO: 1817947 - DNA, 23 bp, Homo sapiens
tcatcattggccctcattccaag

SEQ ID NO: 1817948 - DNA, 12 bp, Homo sapiens
tcatctgaggag

SEQ ID NO: 1817949 - DNA, 18 bp, Homo sapiens
tcatgacattatatttga

SEQ ID NO: 1817950 - DNA, 20 bp, Homo sapiens
tcatgactagtgcctagaaa

SEQ ID NO: 1817951 - DNA, 24 bp, Homo sapiens
tcatgactagtgcctagaaagcaa

SEQ ID NO: 1817952 - DNA, 14 bp, Homo sapiens
tcatgcctggcccc

SEQ ID NO: 1817953 - DNA, 21 bp, Homo sapiens
tcatgcctggcccccctccag

SEQ ID NO: 1817954 - DNA, 15 bp, Homo sapiens
tcatgctcacttttg

SEQ ID NO: 1817955 - DNA, 15 bp, Homo sapiens
tcatgctttctcctt

SEQ ID NO: 1817956 - DNA, 18 bp, Homo sapiens
tcatggcgtaatgggcct

SEQ ID NO: 1817957 - DNA, 19 bp, Homo sapiens
tcatggcgtaatgggcctg

SEQ ID NO: 1817958 - DNA, 15 bp, Homo sapiens
tcatgtaatactgaa

SEQ ID NO: 1817959 - DNA, 21 bp, Homo sapiens
tcatgtaatactgaaccactt

SEQ ID NO: 1817960 - DNA, 18 bp, Homo sapiens
tcattaaaaggaaaaaag

SEQ ID NO: 1817961 - DNA, 13 bp, Homo sapiens
tcattaatactgt

SEQ ID NO: 1817962 - DNA, 15 bp, Homo sapiens
tcattaatactgtgt

SEQ ID NO: 1817963 - DNA, 19 bp, Homo sapiens
tcattatagtaaatctatg

SEQ ID NO: 1817964 - DNA, 18 bp, Homo sapiens
tcattatctgtactgaaa

SEQ ID NO: 1817965 - DNA, 21 bp, Homo sapiens
tcattatctgtactgaaagca

SEQ ID NO: 1817966 - DNA, 14 bp, Homo sapiens
tcattccagaggaa

SEQ ID NO: 1817967 - DNA, 18 bp, Homo sapiens
tcattgttaaaaaacaac

SEQ ID NO: 1817968 - DNA, 13 bp, Homo sapiens
tcatttaggactg

SEQ ID NO: 1817969 - DNA, 18 bp, Homo sapiens
tccaaaggggctgctggg

SEQ ID NO: 1817970 - DNA, 21 bp, Homo sapiens
tccacagggacacagtctggt

SEQ ID NO: 1817971 - DNA, 13 bp, Homo sapiens
tccacaggggcag

SEQ ID NO: 1817972 - DNA, 15 bp, Homo sapiens
tccacaggggcaggc

SEQ ID NO: 1817973 - DNA, 19 bp, Homo sapiens
tccacaggggcaggcctgg

SEQ ID NO: 1817974 - DNA, 20 bp, Homo sapiens
tccacaggggcaggcctggg

SEQ ID NO: 1817975 - DNA, 20 bp, Homo sapiens
tccacagtgcccagctaatt

SEQ ID NO: 1817976 - DNA, 19 bp, Homo sapiens
tccacccaggctgcactgc

SEQ ID NO: 1817977 - DNA, 12 bp, Homo sapiens
tccacccagtgc

SEQ ID NO: 1817978 - DNA, 14 bp, Homo sapiens
tccacccagtgctg

SEQ ID NO: 1817979 - DNA, 18 bp, Homo sapiens
tccacccagtgctgccat

SEQ ID NO: 1817980 - DNA, 24 bp, Homo sapiens
tccacccattcccccatgtggctg

SEQ ID NO: 1817981 - DNA, 21 bp, Homo sapiens
tccacctagtggctgtccagt

SEQ ID NO: 1817982 - DNA, 20 bp, Homo sapiens
tccacctcctagaggtgggc

SEQ ID NO: 1817983 - DNA, 13 bp, Homo sapiens
tccacctgcctat

SEQ ID NO: 1817984 - DNA, 23 bp, Homo sapiens
tccacctgcctatccatcctgcg

SEQ ID NO: 1817985 - DNA, 13 bp, Homo sapiens
tccacggtgcgtg

SEQ ID NO: 1817986 - DNA, 15 bp, Homo sapiens
tccacggtgcgtggc

SEQ ID NO: 1817987 - DNA, 16 bp, Homo sapiens
tccacggtgcgtggct

SEQ ID NO: 1817988 - DNA, 20 bp, Homo sapiens
tccacggtgcgtggctgtgg

SEQ ID NO: 1817989 - DNA, 16 bp, Homo sapiens
tcctacccctcccagc

SEQ ID NO: 1817990 - DNA, 20 bp, Homo sapiens
tcctagaggtgggcagctgg

SEQ ID NO: 1817991 - DNA, 22 bp, Homo sapiens
tcctagaggtgggcagctgggc

SEQ ID NO: 1817992 - DNA, 16 bp, Homo sapiens
tcctagcccagtgctt

SEQ ID NO: 1817993 - DNA, 15 bp, Homo sapiens
tcctcaccttttccc

SEQ ID NO: 1817994 - DNA, 22 bp, Homo sapiens
tcctcaccttttcccggggagg

SEQ ID NO: 1817995 - DNA, 23 bp, Homo sapiens
tcctcatcccctcgtcctgtccc

SEQ ID NO: 1817996 - DNA, 11 bp, Homo sapiens
tcctcattcac

SEQ ID NO: 1817997 - DNA, 20 bp, Homo sapiens
tcctcatttaatatttttca

SEQ ID NO: 1817998 - DNA, 17 bp, Homo sapiens
tcctcattttactaaaa

SEQ ID NO: 1817999 - DNA, 13 bp, Homo sapiens
tcctccacagtgc

SEQ ID NO: 1818000 - DNA, 23 bp, Homo sapiens
tcctccaccgccatggcttccaa

SEQ ID NO: 1818001 - DNA, 13 bp, Homo sapiens
tcctccagcctcc

SEQ ID NO: 1818002 - DNA, 23 bp, Homo sapiens
tcctccagcctcccctcccctgg

SEQ ID NO: 1818003 - DNA, 13 bp, Homo sapiens
tcctcccatggcc

SEQ ID NO: 1818004 - DNA, 14 bp, Homo sapiens
tcctccgtccaccc

SEQ ID NO: 1818005 - DNA, 18 bp, Homo sapiens
tcctccgtccacccaggc

SEQ ID NO: 1818006 - DNA, 21 bp, Homo sapiens
tcctccgtccacccaggctgc

SEQ ID NO: 1818007 - DNA, 15 bp, Homo sapiens
tcctcctccacagtg

SEQ ID NO: 1818008 - DNA, 16 bp, Homo sapiens
tcctcctccacagtgc

SEQ ID NO: 1818009 - DNA, 13 bp, Homo sapiens
tcctcctgatggc

SEQ ID NO: 1818010 - DNA, 15 bp, Homo sapiens
tcctctgatttcaag

SEQ ID NO: 1818011 - DNA, 16 bp, Homo sapiens
tcctctgatttcaagg

SEQ ID NO: 1818012 - DNA, 15 bp, Homo sapiens
tcctctggtaaacat

SEQ ID NO: 1818013 - DNA, 20 bp, Homo sapiens
tcctcttaccgtagcctccg

SEQ ID NO: 1818014 - DNA, 14 bp, Homo sapiens
tcctgacgccctgc

SEQ ID NO: 1818015 - DNA, 21 bp, Homo sapiens
tcctgacttcaggggctgccc

SEQ ID NO: 1818016 - DNA, 17 bp, Homo sapiens
tcctgagaaggcgagga

SEQ ID NO: 1818017 - DNA, 18 bp, Homo sapiens
tcctgagaaggcgaggag

SEQ ID NO: 1818018 - DNA, 12 bp, Homo sapiens
tcctgagggcta

SEQ ID NO: 1818019 - DNA, 16 bp, Homo sapiens
tcctgatggccaagag

SEQ ID NO: 1818020 - DNA, 17 bp, Homo sapiens
tcctgatggccaagagc

SEQ ID NO: 1818021 - DNA, 18 bp, Homo sapiens
tcctgatggccaagagca

SEQ ID NO: 1818022 - DNA, 24 bp, Homo sapiens
tcctgcaggaacgagcactggcca

SEQ ID NO: 1818023 - DNA, 11 bp, Homo sapiens
tcctgccagct

SEQ ID NO: 1818024 - DNA, 13 bp, Homo sapiens
tcctgccagctgc

SEQ ID NO: 1818025 - DNA, 14 bp, Homo sapiens
tcctgccagctgcc

SEQ ID NO: 1818026 - DNA, 20 bp, Homo sapiens
tcctgccagctgccttcctc

SEQ ID NO: 1818027 - DNA, 21 bp, Homo sapiens
tcctgccccctgccagtgaag

SEQ ID NO: 1818028 - DNA, 14 bp, Homo sapiens
tcctgctccacagt

SEQ ID NO: 1818029 - DNA, 16 bp, Homo sapiens
tcctgctccacagtgt

SEQ ID NO: 1818030 - DNA, 12 bp, Homo sapiens
tcctgctgcacc

SEQ ID NO: 1818031 - DNA, 19 bp, Homo sapiens
tcctgctgcaccaacccag

SEQ ID NO: 1818032 - DNA, 21 bp, Homo sapiens
tcctgctgcaccaacccagcc

SEQ ID NO: 1818033 - DNA, 16 bp, Homo sapiens
tcctgctgcagagggg

SEQ ID NO: 1818034 - DNA, 18 bp, Homo sapiens
tcctgctgcagaggggca

SEQ ID NO: 1818035 - DNA, 21 bp, Homo sapiens
tcctgctgctgtaactgctga

SEQ ID NO: 1818036 - DNA, 24 bp, Homo sapiens
tcctgctgctgtaactgctgagcc

SEQ ID NO: 1818037 - DNA, 14 bp, Homo sapiens
tcctggcccatcag

SEQ ID NO: 1818038 - DNA, 18 bp, Homo sapiens
tcctggcctcactggctg

SEQ ID NO: 1818039 - DNA, 15 bp, Homo sapiens
tcctggggccccgct

SEQ ID NO: 1818040 - DNA, 19 bp, Homo sapiens
tcctggggccccgctggga

SEQ ID NO: 1818041 - DNA, 14 bp, Homo sapiens
tcctgtcagtgccg

SEQ ID NO: 1818042 - DNA, 23 bp, Homo sapiens
tcctgtgggggaagagcacagcc

SEQ ID NO: 1818043 - DNA, 24 bp, Homo sapiens
tcctgttattttttatttccacat

SEQ ID NO: 1818044 - DNA, 17 bp, Homo sapiens
tccttactctgagccca

SEQ ID NO: 1818045 - DNA, 19 bp, Homo sapiens
tccttactctgagcccagg

SEQ ID NO: 1818046 - DNA, 21 bp, Homo sapiens
tccttcagtgagcccctcccc

SEQ ID NO: 1818047 - DNA, 18 bp, Homo sapiens
tccttcgtgtctctccca

SEQ ID NO: 1818048 - DNA, 16 bp, Homo sapiens
tccttgggctcctggc

SEQ ID NO: 1818049 - DNA, 22 bp, Homo sapiens
tccttgggctcctggctgccag

SEQ ID NO: 1818050 - DNA, 23 bp, Homo sapiens
tccttgggctcctggctgccagg

SEQ ID NO: 1818051 - DNA, 21 bp, Homo sapiens
tcctttacaactaaataacac

SEQ ID NO: 1818052 - DNA, 19 bp, Homo sapiens
tccttttgcaacaagacaa

SEQ ID NO: 1818053 - DNA, 19 bp, Homo sapiens
tccttttgtccccagggcc

SEQ ID NO: 1818054 - DNA, 20 bp, Homo sapiens
tcgaaacctgtccataaagt

SEQ ID NO: 1818055 - DNA, 16 bp, Homo sapiens
tcgaaccaaggcagcc

SEQ ID NO: 1818056 - DNA, 18 bp, Homo sapiens
tcgaaccaaggcagcctc

SEQ ID NO: 1818057 - DNA, 21 bp, Homo sapiens
tcgaaccaaggcagcctccag

SEQ ID NO: 1818058 - DNA, 23 bp, Homo sapiens
tcgaagaacaatgtcagaaactc

SEQ ID NO: 1818059 - DNA, 20 bp, Homo sapiens
tcgaatttttattatttgtt

SEQ ID NO: 1818060 - DNA, 19 bp, Homo sapiens
tcgaggcaccggcgctgca

SEQ ID NO: 1818061 - DNA, 23 bp, Homo sapiens
tcgaggggtcctcacctggttga

SEQ ID NO: 1818062 - DNA, 23 bp, Homo sapiens
tcgatgaatgtgttgatttgaga

SEQ ID NO: 1818063 - DNA, 14 bp, Homo sapiens
tcgcccaccgcatg

SEQ ID NO: 1818064 - DNA, 21 bp, Homo sapiens
tcgcccaccgcatgccccctc

SEQ ID NO: 1818065 - DNA, 22 bp, Homo sapiens
tcgcccaccgcatgccccctcg

SEQ ID NO: 1818066 - DNA, 12 bp, Homo sapiens
tcgccccatccc

SEQ ID NO: 1818067 - DNA, 13 bp, Homo sapiens
tcgccccatccct

SEQ ID NO: 1818068 - DNA, 15 bp, Homo sapiens
tcgcgctgcctgtgt

SEQ ID NO: 1818069 - DNA, 13 bp, Homo sapiens
tcgcttgagccca

SEQ ID NO: 1818070 - DNA, 18 bp, Homo sapiens
tcgcttgagcccaggagt

SEQ ID NO: 1818071 - DNA, 14 bp, Homo sapiens
tcggccccacatgg

SEQ ID NO: 1818072 - DNA, 16 bp, Homo sapiens
tcggccccacatggga

SEQ ID NO: 1818073 - DNA, 11 bp, Homo sapiens
tcggctcctgc

SEQ ID NO: 1818074 - DNA, 13 bp, Homo sapiens
tcggctcctgctg

SEQ ID NO: 1818075 - DNA, 14 bp, Homo sapiens
tcggctcctgctgc

SEQ ID NO: 1818076 - DNA, 12 bp, Homo sapiens
tcgggctcctgt

SEQ ID NO: 1818077 - DNA, 17 bp, Homo sapiens
tcggggcccttggggcc

SEQ ID NO: 1818078 - DNA, 20 bp, Homo sapiens
tcggggcccttggggcctgg

SEQ ID NO: 1818079 - DNA, 19 bp, Homo sapiens
tcgtccacaggggcaggcc

SEQ ID NO: 1818080 - DNA, 20 bp, Homo sapiens
tcgtccacaggggcaggcct

SEQ ID NO: 1818081 - DNA, 23 bp, Homo sapiens
tcgtccacaggggcaggcctggg

SEQ ID NO: 1818082 - DNA, 13 bp, Homo sapiens
tcgtcctgtccca

SEQ ID NO: 1818083 - DNA, 11 bp, Homo sapiens
tcgtggccttc

SEQ ID NO: 1818084 - DNA, 19 bp, Homo sapiens
tcgtgtagtggaagagcag

SEQ ID NO: 1818085 - DNA, 14 bp, Homo sapiens
tcgtgtctctccca

SEQ ID NO: 1818086 - DNA, 13 bp, Homo sapiens
tctaattcttcat

SEQ ID NO: 1818087 - DNA, 14 bp, Homo sapiens
tctaattcttttca

SEQ ID NO: 1818088 - DNA, 17 bp, Homo sapiens
tctaattcttttcaaaa

SEQ ID NO: 1818089 - DNA, 19 bp, Homo sapiens
tctacacatatatgtatat

SEQ ID NO: 1818090 - DNA, 19 bp, Homo sapiens
tctacattttattacacta

SEQ ID NO: 1818091 - DNA, 20 bp, Homo sapiens
tctacctgagcattcaggca

SEQ ID NO: 1818092 - DNA, 19 bp, Homo sapiens
tctacctttttttctctcc

SEQ ID NO: 1818093 - DNA, 21 bp, Homo sapiens
tctacctttttttctctccta

SEQ ID NO: 1818094 - DNA, 18 bp, Homo sapiens
tctactcattccccgggg

SEQ ID NO: 1818095 - DNA, 19 bp, Homo sapiens
tctactccatgcacatagt

SEQ ID NO: 1818096 - DNA, 17 bp, Homo sapiens
tctagaaaatgaaaaga

SEQ ID NO: 1818097 - DNA, 21 bp, Homo sapiens
tctagaaagaaaagaccctga

SEQ ID NO: 1818098 - DNA, 13 bp, Homo sapiens
tctagaggcctca

SEQ ID NO: 1818099 - DNA, 15 bp, Homo sapiens
tctagaggcctcagt

SEQ ID NO: 1818100 - DNA, 17 bp, Homo sapiens
tctagtcagtaaacatt

SEQ ID NO: 1818101 - DNA, 20 bp, Homo sapiens
tctatagttatacatcttca

SEQ ID NO: 1818102 - DNA, 22 bp, Homo sapiens
tctatgagaacaagtcacagct

SEQ ID NO: 1818103 - DNA, 22 bp, Homo sapiens
tctatgagcaactccttacttc

SEQ ID NO: 1818104 - DNA, 14 bp, Homo sapiens
tctattctgagcct

SEQ ID NO: 1818105 - DNA, 17 bp, Homo sapiens
cagagttattagtgcca

SEQ ID NO: 1818106 - DNA, 15 bp, Homo sapiens
cagagtttctgcagt

SEQ ID NO: 1818107 - DNA, 18 bp, Homo sapiens
cagatattgttataaata

SEQ ID NO: 1818108 - DNA, 14 bp, Homo sapiens
cagatcgctgtgtt

SEQ ID NO: 1818109 - DNA, 12 bp, Homo sapiens
cagatctgcctg

SEQ ID NO: 1818110 - DNA, 15 bp, Homo sapiens
cagatctgcctgggc

SEQ ID NO: 1818111 - DNA, 17 bp, Homo sapiens
cagatctgcctgggcct

SEQ ID NO: 1818112 - DNA, 19 bp, Homo sapiens
cagatctgcctgggcctgt

SEQ ID NO: 1818113 - DNA, 15 bp, Homo sapiens
cagatctttttgtga

SEQ ID NO: 1818114 - DNA, 16 bp, Homo sapiens
cagatctttttgtgaa

SEQ ID NO: 1818115 - DNA, 22 bp, Homo sapiens
cagatttctaagttaaatcatt

SEQ ID NO: 1818116 - DNA, 18 bp, Homo sapiens
cagcaaggaggctggctg

SEQ ID NO: 1818117 - DNA, 21 bp, Homo sapiens
cagcaaggaggctggctgggg

SEQ ID NO: 1818118 - DNA, 22 bp, Homo sapiens
cagcaaggaggctggctggggc

SEQ ID NO: 1818119 - DNA, 16 bp, Homo sapiens
cagcaaggcacctgca

SEQ ID NO: 1818120 - DNA, 16 bp, Homo sapiens
cagcacaattcattgt

SEQ ID NO: 1818121 - DNA, 19 bp, Homo sapiens
cagcacagcaaggaggctg

SEQ ID NO: 1818122 - DNA, 21 bp, Homo sapiens
cagcacagcaaggaggctggc

SEQ ID NO: 1818123 - DNA, 20 bp, Homo sapiens
cagcacaggggccccagatc

SEQ ID NO: 1818124 - DNA, 22 bp, Homo sapiens
cagcacaggggccccagatctg

SEQ ID NO: 1818125 - DNA, 16 bp, Homo sapiens
cagcacccgggctcag

SEQ ID NO: 1818126 - DNA, 13 bp, Homo sapiens
cagcaccctgggt

SEQ ID NO: 1818127 - DNA, 17 bp, Homo sapiens
cagcaccctgggtgcca

SEQ ID NO: 1818128 - DNA, 16 bp, Homo sapiens
cagcagagagccctgg

SEQ ID NO: 1818129 - DNA, 15 bp, Homo sapiens
cagcagcagagagcc

SEQ ID NO: 1818130 - DNA, 16 bp, Homo sapiens
cagcagctaggactga

SEQ ID NO: 1818131 - DNA, 17 bp, Homo sapiens
cagcagctaggactgag

SEQ ID NO: 1818132 - DNA, 19 bp, Homo sapiens
cagcagctaggactgagga

SEQ ID NO: 1818133 - DNA, 22 bp, Homo sapiens
cagcagctaggactgaggagtg

SEQ ID NO: 1818134 - DNA, 15 bp, Homo sapiens
cagcaggtgctgcta

SEQ ID NO: 1818135 - DNA, 17 bp, Homo sapiens
cagcaggtgctgctacc

SEQ ID NO: 1818136 - DNA, 23 bp, Homo sapiens
cagcaggtgtggtggctcatggc

SEQ ID NO: 1818137 - DNA, 17 bp, Homo sapiens
cagcatccagcctgtgt

SEQ ID NO: 1818138 - DNA, 15 bp, Homo sapiens
cagcattccatgacc

SEQ ID NO: 1818139 - DNA, 14 bp, Homo sapiens
cagccagccagtct

SEQ ID NO: 1818140 - DNA, 14 bp, Homo sapiens
cagccagcccttcc

SEQ ID NO: 1818141 - DNA, 18 bp, Homo sapiens
cagccagtcttgcctagg

SEQ ID NO: 1818142 - DNA, 19 bp, Homo sapiens
cagccagtcttgcctaggc

SEQ ID NO: 1818143 - DNA, 20 bp, Homo sapiens
cagccatgcctcatgccaca

SEQ ID NO: 1818144 - DNA, 13 bp, Homo sapiens
cagcccacagagc

SEQ ID NO: 1818145 - DNA, 17 bp, Homo sapiens
cagcccacagagcctga

SEQ ID NO: 1818146 - DNA, 15 bp, Homo sapiens
cagcccacgtcctgt

SEQ ID NO: 1818147 - DNA, 20 bp, Homo sapiens
cagcccacgtcctgtcagtg

SEQ ID NO: 1818148 - DNA, 11 bp, Homo sapiens
cagcccagctt

SEQ ID NO: 1818149 - DNA, 12 bp, Homo sapiens
cagccccacagc

SEQ ID NO: 1818150 - DNA, 15 bp, Homo sapiens
cagccccctggatgg

SEQ ID NO: 1818151 - DNA, 23 bp, Homo sapiens
cagcccgtgaagcagtgcctcga

SEQ ID NO: 1818152 - DNA, 12 bp, Homo sapiens
cagccctgggag

SEQ ID NO: 1818153 - DNA, 16 bp, Homo sapiens
cagcccttccctggcc

SEQ ID NO: 1818154 - DNA, 12 bp, Homo sapiens
cagcccttctgc

SEQ ID NO: 1818155 - DNA, 21 bp, Homo sapiens
cagcccttgcccccatccctc

SEQ ID NO: 1818156 - DNA, 14 bp, Homo sapiens
cagccgctaggaga

SEQ ID NO: 1818157 - DNA, 21 bp, Homo sapiens
cagccgctaggagagactgaa

SEQ ID NO: 1818158 - DNA, 15 bp, Homo sapiens
cagccgctgcccggc

SEQ ID NO: 1818159 - DNA, 16 bp, Homo sapiens
cagcctccagagccag

SEQ ID NO: 1818160 - DNA, 12 bp, Homo sapiens
cagcctctcccg

SEQ ID NO: 1818161 - DNA, 13 bp, Homo sapiens
cagcctctcccgg

SEQ ID NO: 1818162 - DNA, 15 bp, Homo sapiens
cagcctctcccggct

SEQ ID NO: 1818163 - DNA, 22 bp, Homo sapiens
cagcctctcccggctgcctgcc

SEQ ID NO: 1818164 - DNA, 14 bp, Homo sapiens
cagcctggcccagc

SEQ ID NO: 1818165 - DNA, 17 bp, Homo sapiens
cagcctggcccagctcc

SEQ ID NO: 1818166 - DNA, 18 bp, Homo sapiens
cagcctggcccagctccc

SEQ ID NO: 1818167 - DNA, 18 bp, Homo sapiens
cagcctgggactcccagt

SEQ ID NO: 1818168 - DNA, 21 bp, Homo sapiens
cagcctgggactcccagtgaa

SEQ ID NO: 1818169 - DNA, 14 bp, Homo sapiens
cagccttcccctcc

SEQ ID NO: 1818170 - DNA, 18 bp, Homo sapiens
cagccttcccctccctgt

SEQ ID NO: 1818171 - DNA, 14 bp, Homo sapiens
cagccttctcctgt

SEQ ID NO: 1818172 - DNA, 18 bp, Homo sapiens
cagcgattattgatcaaa

SEQ ID NO: 1818173 - DNA, 23 bp, Homo sapiens
cagcgattattgatcaaaatcaa

SEQ ID NO: 1818174 - DNA, 19 bp, Homo sapiens
cagcgtttttacctaggca

SEQ ID NO: 1818175 - DNA, 14 bp, Homo sapiens
cagctactctgtcc

SEQ ID NO: 1818176 - DNA, 16 bp, Homo sapiens
cagctactctgtccag

SEQ ID NO: 1818177 - DNA, 19 bp, Homo sapiens
cagctactctgtccaggcc

SEQ ID NO: 1818178 - DNA, 20 bp, Homo sapiens
cagctactctgtccaggcca

SEQ ID NO: 1818179 - DNA, 18 bp, Homo sapiens
cagctagactggagtgag

SEQ ID NO: 1818180 - DNA, 14 bp, Homo sapiens
cagctaggactgag

SEQ ID NO: 1818181 - DNA, 16 bp, Homo sapiens
cagctaggactgagga

SEQ ID NO: 1818182 - DNA, 14 bp, Homo sapiens
cagctcctctcctt

SEQ ID NO: 1818183 - DNA, 18 bp, Homo sapiens
cagctcctctccttgggc

SEQ ID NO: 1818184 - DNA, 21 bp, Homo sapiens
cagctcctctccttgggctcc

SEQ ID NO: 1818185 - DNA, 23 bp, Homo sapiens
cagctcctctccttgggctcctg

SEQ ID NO: 1818186 - DNA, 12 bp, Homo sapiens
cagctcctctta

SEQ ID NO: 1818187 - DNA, 23 bp, Homo sapiens
cagctccttttgtccccagggcc

SEQ ID NO: 1818188 - DNA, 16 bp, Homo sapiens
cagctctgtggcctgt

SEQ ID NO: 1818189 - DNA, 17 bp, Homo sapiens
cagctctgtggcctgtg

SEQ ID NO: 1818190 - DNA, 14 bp, Homo sapiens
cagctgcagctggg

SEQ ID NO: 1818191 - DNA, 19 bp, Homo sapiens
cagctgcagctgggcccca

SEQ ID NO: 1818192 - DNA, 23 bp, Homo sapiens
cagctgcagctgggccccatgct

SEQ ID NO: 1818193 - DNA, 13 bp, Homo sapiens
cagctgccttcct

SEQ ID NO: 1818194 - DNA, 13 bp, Homo sapiens
cagctgctctgcc

SEQ ID NO: 1818195 - DNA, 14 bp, Homo sapiens
cagctgctctgccc

SEQ ID NO: 1818196 - DNA, 16 bp, Homo sapiens
cagctgctctgcccct

SEQ ID NO: 1818197 - DNA, 20 bp, Homo sapiens
cagctgctctgccccttggg

SEQ ID NO: 1818198 - DNA, 22 bp, Homo sapiens
cagctgctcttagtgcccgcct

SEQ ID NO: 1818199 - DNA, 15 bp, Homo sapiens
cagctgggccccatg

SEQ ID NO: 1818200 - DNA, 23 bp, Homo sapiens
cagctgggccccatgctctgccc

SEQ ID NO: 1818201 - DNA, 23 bp, Homo sapiens
cagctgtagccatggctcaggca

SEQ ID NO: 1818202 - DNA, 22 bp, Homo sapiens
cagcttatgggatccttgtctt

SEQ ID NO: 1818203 - DNA, 12 bp, Homo sapiens
cagcttctgcca

SEQ ID NO: 1818204 - DNA, 13 bp, Homo sapiens
cagcttctgccac

SEQ ID NO: 1818205 - DNA, 17 bp, Homo sapiens
cagcttctgccacttcc

SEQ ID NO: 1818206 - DNA, 17 bp, Homo sapiens
cagcttctgctgggctg

SEQ ID NO: 1818207 - DNA, 14 bp, Homo sapiens
caggaacgagcact

SEQ ID NO: 1818208 - DNA, 17 bp, Homo sapiens
caggaacgagcactggc

SEQ ID NO: 1818209 - DNA, 19 bp, Homo sapiens
caggaacgagcactggcca

SEQ ID NO: 1818210 - DNA, 14 bp, Homo sapiens
caggaaggcagctg

SEQ ID NO: 1818211 - DNA, 17 bp, Homo sapiens
caggacccaggccctcc

SEQ ID NO: 1818212 - DNA, 21 bp, Homo sapiens
caggacccaggccctccatgg

SEQ ID NO: 1818213 - DNA, 23 bp, Homo sapiens
caggacggggccggccaggtggg

SEQ ID NO: 1818214 - DNA, 15 bp, Homo sapiens
caggaggaggtgcca

SEQ ID NO: 1818215 - DNA, 20 bp, Homo sapiens
caggagtttgagacaagccc

SEQ ID NO: 1818216 - DNA, 18 bp, Homo sapiens
gtgaatacattttgcaca

SEQ ID NO: 1818217 - DNA, 22 bp, Homo sapiens
gtgaatatgagaaatacagaag

SEQ ID NO: 1818218 - DNA, 16 bp, Homo sapiens
gtgacccttcagggcc

SEQ ID NO: 1818219 - DNA, 12 bp, Homo sapiens
gtgactattaaa

SEQ ID NO: 1818220 - DNA, 18 bp, Homo sapiens
gtgactcgggctcctgtg

SEQ ID NO: 1818221 - DNA, 21 bp, Homo sapiens
gtgactcgggctcctgtgccc

SEQ ID NO: 1818222 - DNA, 15 bp, Homo sapiens
gtgactggcaggtgc

SEQ ID NO: 1818223 - DNA, 21 bp, Homo sapiens
gtgactggcaggtgcagatgg

SEQ ID NO: 1818224 - DNA, 13 bp, Homo sapiens
gtgagaccacctc

SEQ ID NO: 1818225 - DNA, 19 bp, Homo sapiens
gtgagcccctccccagcca

SEQ ID NO: 1818226 - DNA, 17 bp, Homo sapiens
gtgaggcttccaggctc

SEQ ID NO: 1818227 - DNA, 18 bp, Homo sapiens
gtgaggcttccaggctct

SEQ ID NO: 1818228 - DNA, 15 bp, Homo sapiens
gtgagtggcagccat

SEQ ID NO: 1818229 - DNA, 17 bp, Homo sapiens
gtgagtggcagccatgc

SEQ ID NO: 1818230 - DNA, 20 bp, Homo sapiens
gtgatggcgcgggaggcacc

SEQ ID NO: 1818231 - DNA, 19 bp, Homo sapiens
gtgatggtcaggatctcat

SEQ ID NO: 1818232 - DNA, 10 bp, Homo sapiens
gtgatgtgtc

SEQ ID NO: 1818233 - DNA, 18 bp, Homo sapiens
gtgatttcccgtggcccc

SEQ ID NO: 1818234 - DNA, 22 bp, Homo sapiens
gtgatttcccgtggccccagcc

SEQ ID NO: 1818235 - DNA, 17 bp, Homo sapiens
gtgcacccactcaccag

SEQ ID NO: 1818236 - DNA, 22 bp, Homo sapiens
gtgcacccactcaccagggtcc

SEQ ID NO: 1818237 - DNA, 13 bp, Homo sapiens
gtgcactggcccc

SEQ ID NO: 1818238 - DNA, 18 bp, Homo sapiens
gtgcactggccccaccct

SEQ ID NO: 1818239 - DNA, 15 bp, Homo sapiens
gtgcagcagcccagc

SEQ ID NO: 1818240 - DNA, 13 bp, Homo sapiens
gtgcagccttccc

SEQ ID NO: 1818241 - DNA, 17 bp, Homo sapiens
gtgcagccttcccctcc

SEQ ID NO: 1818242 - DNA, 12 bp, Homo sapiens
gtgccaccctgg

SEQ ID NO: 1818243 - DNA, 17 bp, Homo sapiens
gtgccactccctgagct

SEQ ID NO: 1818244 - DNA, 21 bp, Homo sapiens
gtgccaggatggaatgatggg

SEQ ID NO: 1818245 - DNA, 15 bp, Homo sapiens
gtgccagtcgcgctg

SEQ ID NO: 1818246 - DNA, 16 bp, Homo sapiens
gtgccagtcgcgctgc

SEQ ID NO: 1818247 - DNA, 19 bp, Homo sapiens
gtgccagtcgcgctgcctg

SEQ ID NO: 1818248 - DNA, 21 bp, Homo sapiens
gtgccagtcgcgctgcctgtg

SEQ ID NO: 1818249 - DNA, 14 bp, Homo sapiens
gtgccattcccagc

SEQ ID NO: 1818250 - DNA, 17 bp, Homo sapiens
gtgccccccatcctggc

SEQ ID NO: 1818251 - DNA, 16 bp, Homo sapiens
gcccagctcccccggg

SEQ ID NO: 1818252 - DNA, 17 bp, Homo sapiens
gcccagctcccccggga

SEQ ID NO: 1818253 - DNA, 14 bp, Homo sapiens
gcccagctgtagcc

SEQ ID NO: 1818254 - DNA, 15 bp, Homo sapiens
gcccagctgtagcca

SEQ ID NO: 1818255 - DNA, 21 bp, Homo sapiens
gcccagctgtagccatggctc

SEQ ID NO: 1818256 - DNA, 13 bp, Homo sapiens
gcccagcttcctg

SEQ ID NO: 1818257 - DNA, 14 bp, Homo sapiens
gcccagcttcctgg

SEQ ID NO: 1818258 - DNA, 22 bp, Homo sapiens
gcccaggccatcttccaggtgg

SEQ ID NO: 1818259 - DNA, 14 bp, Homo sapiens
gcccaggctggcca

SEQ ID NO: 1818260 - DNA, 17 bp, Homo sapiens
gcccaggctggccagcc

SEQ ID NO: 1818261 - DNA, 19 bp, Homo sapiens
gcccaggctggccagcccc

SEQ ID NO: 1818262 - DNA, 22 bp, Homo sapiens
gcccaggctggccagccccaca

SEQ ID NO: 1818263 - DNA, 22 bp, Homo sapiens
gcccataatagttagccctcag

SEQ ID NO: 1818264 - DNA, 20 bp, Homo sapiens
gcccatcagtgtacccccgc

SEQ ID NO: 1818265 - DNA, 21 bp, Homo sapiens
gcccatcagtgtacccccgcc

SEQ ID NO: 1818266 - DNA, 12 bp, Homo sapiens
gcccatcccccc

SEQ ID NO: 1818267 - DNA, 16 bp, Homo sapiens
gcccatgggcactgct

SEQ ID NO: 1818268 - DNA, 20 bp, Homo sapiens
gcccatgggcactgctgggt

SEQ ID NO: 1818269 - DNA, 23 bp, Homo sapiens
gcccatgggcactgctgggtggc

SEQ ID NO: 1818270 - DNA, 16 bp, Homo sapiens
gcccattcctcacctt

SEQ ID NO: 1818271 - DNA, 19 bp, Homo sapiens
ctgggatttcttcgctgct

SEQ ID NO: 1818272 - DNA, 21 bp, Homo sapiens
ctgggatttcttcgctgctct

SEQ ID NO: 1818273 - DNA, 22 bp, Homo sapiens
ctgggatttcttcgctgctcta

SEQ ID NO: 1818274 - DNA, 17 bp, Homo sapiens
ctgggccccatgctctg

SEQ ID NO: 1818275 - DNA, 12 bp, Homo sapiens
ctgggcctgtgc

SEQ ID NO: 1818276 - DNA, 18 bp, Homo sapiens
ctgggcctgtgcagcagc

SEQ ID NO: 1818277 - DNA, 19 bp, Homo sapiens
ctgggcctgtgcagcagcc

SEQ ID NO: 1818278 - DNA, 20 bp, Homo sapiens
ctgggcctgtgcagcagccc

SEQ ID NO: 1818279 - DNA, 22 bp, Homo sapiens
ctgggcctgtgcagcagcccag

SEQ ID NO: 1818280 - DNA, 23 bp, Homo sapiens
ctgggcctgtgcagcagcccagc

SEQ ID NO: 1818281 - DNA, 13 bp, Homo sapiens
ctgggctcagggc

SEQ ID NO: 1818282 - DNA, 17 bp, Homo sapiens
ctgggctcagggctgga

SEQ ID NO: 1818283 - DNA, 18 bp, Homo sapiens
ctgggctcagggctggag

SEQ ID NO: 1818284 - DNA, 13 bp, Homo sapiens
ctgggctctgtgg

SEQ ID NO: 1818285 - DNA, 22 bp, Homo sapiens
ctgggctctgtgggctgcactc

SEQ ID NO: 1818286 - DNA, 20 bp, Homo sapiens
ctgggctggggcctgatggg

SEQ ID NO: 1818287 - DNA, 19 bp, Homo sapiens
ctggggacgccaaggaggt

SEQ ID NO: 1818288 - DNA, 22 bp, Homo sapiens
ctggggatgtctctcatgacca

SEQ ID NO: 1818289 - DNA, 22 bp, Homo sapiens
ctggggcagaggggcagccgct

SEQ ID NO: 1818290 - DNA, 21 bp, Homo sapiens
ctggggcatgtgtgcctgtgg

SEQ ID NO: 1818291 - DNA, 22 bp, Homo sapiens
ctggggcatgtgtgcctgtggc

SEQ ID NO: 1818292 - DNA, 17 bp, Homo sapiens
ctggggccccgctggga

SEQ ID NO: 1818293 - DNA, 17 bp, Homo sapiens
ctggggcctatcagtgt

SEQ ID NO: 1818294 - DNA, 22 bp, Homo sapiens
ctggggcctatcagtgtgcccc

SEQ ID NO: 1818295 - DNA, 20 bp, Homo sapiens
ctgggggcagtgactggcag

SEQ ID NO: 1818296 - DNA, 15 bp, Homo sapiens
ctgggtgccattccc

SEQ ID NO: 1818297 - DNA, 14 bp, Homo sapiens
ctgggtggcccatc

SEQ ID NO: 1818298 - DNA, 21 bp, Homo sapiens
ctgggtggcccatcccccctc

SEQ ID NO: 1818299 - DNA, 19 bp, Homo sapiens
ctgggtgttgaccactcca

SEQ ID NO: 1818300 - DNA, 23 bp, Homo sapiens
ctggtaaacattcctccagcctc

SEQ ID NO: 1818301 - DNA, 18 bp, Homo sapiens
ctggtaagcagaggcttt

SEQ ID NO: 1818302 - DNA, 21 bp, Homo sapiens
ctggtatgaacttgaggacac

SEQ ID NO: 1818303 - DNA, 22 bp, Homo sapiens
ctggtatgaacttgaggacaca

SEQ ID NO: 1818304 - DNA, 16 bp, Homo sapiens
ctggtgcactggcccc

SEQ ID NO: 1818305 - DNA, 23 bp, Homo sapiens
ctggtttcccggtgacacatcca

SEQ ID NO: 1818306 - DNA, 14 bp, Homo sapiens
ctgtaactgctgag

SEQ ID NO: 1818307 - DNA, 13 bp, Homo sapiens
gcctcgaggcacc

SEQ ID NO: 1818308 - DNA, 14 bp, Homo sapiens
gcctcgaggcaccg

SEQ ID NO: 1818309 - DNA, 23 bp, Homo sapiens
gcctcgaggcaccggcgctgcag

SEQ ID NO: 1818310 - DNA, 20 bp, Homo sapiens
gcctcgcccaccgcatgccc

SEQ ID NO: 1818311 - DNA, 23 bp, Homo sapiens
gcctcgcccaccgcatgccccct

SEQ ID NO: 1818312 - DNA, 15 bp, Homo sapiens
gcctcggctcctgct

SEQ ID NO: 1818313 - DNA, 17 bp, Homo sapiens
gcctcggctcctgctgc

SEQ ID NO: 1818314 - DNA, 13 bp, Homo sapiens
gcctctcccggct

SEQ ID NO: 1818315 - DNA, 15 bp, Homo sapiens
gcctctcccggctgc

SEQ ID NO: 1818316 - DNA, 17 bp, Homo sapiens
gcctctcccggctgcct

SEQ ID NO: 1818317 - DNA, 19 bp, Homo sapiens
gcctctcccggctgcctgc

SEQ ID NO: 1818318 - DNA, 20 bp, Homo sapiens
gcctctgtgtcactggctgc

SEQ ID NO: 1818319 - DNA, 13 bp, Homo sapiens
gcctcttccaccc

SEQ ID NO: 1818320 - DNA, 22 bp, Homo sapiens
gcctcttgtgctcacgctcccc

SEQ ID NO: 1818321 - DNA, 13 bp, Homo sapiens
gcctgatgctgcc

SEQ ID NO: 1818322 - DNA, 16 bp, Homo sapiens
gcctgatggccaaggg

SEQ ID NO: 1818323 - DNA, 17 bp, Homo sapiens
gcctgatggggagggtc

SEQ ID NO: 1818324 - DNA, 15 bp, Homo sapiens
gcctgcaccaggaga

SEQ ID NO: 1818325 - DNA, 16 bp, Homo sapiens
gcctgcaccaggagac

SEQ ID NO: 1818326 - DNA, 17 bp, Homo sapiens
gcctgccgcccaaagag

SEQ ID NO: 1818327 - DNA, 20 bp, Homo sapiens
gcctgctgggaaccccgcag

SEQ ID NO: 1818328 - DNA, 23 bp, Homo sapiens
gcctgctgggaaccccgcagccc

SEQ ID NO: 1818329 - DNA, 16 bp, Homo sapiens
gcctgcttttccagga

SEQ ID NO: 1818330 - DNA, 18 bp, Homo sapiens
gcctgcttttccaggatc

SEQ ID NO: 1818331 - DNA, 19 bp, Homo sapiens
gcctgcttttccaggatcc

SEQ ID NO: 1818332 - DNA, 15 bp, Homo sapiens
gcctggaaccaggga

SEQ ID NO: 1818333 - DNA, 12 bp, Homo sapiens
gcctggcccagc

SEQ ID NO: 1818334 - DNA, 15 bp, Homo sapiens
gcctggcccagctcc

SEQ ID NO: 1818335 - DNA, 17 bp, Homo sapiens
gcctggcccagctcccc

SEQ ID NO: 1818336 - DNA, 18 bp, Homo sapiens
gcctggcccccctccagg

SEQ ID NO: 1818337 - DNA, 19 bp, Homo sapiens
gcctggcccccctccaggc

SEQ ID NO: 1818338 - DNA, 12 bp, Homo sapiens
gcctggcctgag

SEQ ID NO: 1818339 - DNA, 16 bp, Homo sapiens
gcctggcctgagctgg

SEQ ID NO: 1818340 - DNA, 18 bp, Homo sapiens
gcctggcctgagctgggg

SEQ ID NO: 1818341 - DNA, 13 bp, Homo sapiens
gcctggctcccca

SEQ ID NO: 1818342 - DNA, 10 bp, Homo sapiens
gcctggctgt

SEQ ID NO: 1818343 - DNA, 12 bp, Homo sapiens
gcctggctgtgg

SEQ ID NO: 1818344 - DNA, 13 bp, Homo sapiens
gcctggctgtgga

SEQ ID NO: 1818345 - DNA, 14 bp, Homo sapiens
gcctggcttgctcc

SEQ ID NO: 1818346 - DNA, 13 bp, Homo sapiens
gcctgggcctgct

SEQ ID NO: 1818347 - DNA, 22 bp, Homo sapiens
gcctgggcctgcttttccagga

SEQ ID NO: 1818348 - DNA, 20 bp, Homo sapiens
gcctgggcctgtgcagcagc

SEQ ID NO: 1818349 - DNA, 22 bp, Homo sapiens
gcctgggcctgtgcagcagccc

SEQ ID NO: 1818350 - DNA, 22 bp, Homo sapiens
gcctgggggcagtgactggcag

SEQ ID NO: 1818351 - DNA, 21 bp, Homo sapiens
gcctgtactaaggagcatgat

SEQ ID NO: 1818352 - DNA, 14 bp, Homo sapiens
gcctgtgcagcagc

SEQ ID NO: 1818353 - DNA, 17 bp, Homo sapiens
gcctgtgcagcagccca

SEQ ID NO: 1818354 - DNA, 18 bp, Homo sapiens
gcctgtgcagcagcccag

SEQ ID NO: 1818355 - DNA, 22 bp, Homo sapiens
gcctgtgcagcagcccagcttc

SEQ ID NO: 1818356 - DNA, 21 bp, Homo sapiens
gcctgtggcagaaaagaggag

SEQ ID NO: 1818357 - DNA, 13 bp, Homo sapiens
gcctgtgtccagc

SEQ ID NO: 1818358 - DNA, 20 bp, Homo sapiens
gcctgtgtccagcagctgcg

SEQ ID NO: 1818359 - DNA, 21 bp, Homo sapiens
gcctgtgtccagcagctgcgg

SEQ ID NO: 1818360 - DNA, 12 bp, Homo sapiens
gccttcccctcc

SEQ ID NO: 1818361 - DNA, 13 bp, Homo sapiens
gccttcccctccc

SEQ ID NO: 1818362 - DNA, 16 bp, Homo sapiens
gccttccccttttgcc

SEQ ID NO: 1818363 - DNA, 19 bp, Homo sapiens
gccttccccttttgcctgg

SEQ ID NO: 1818364 - DNA, 20 bp, Homo sapiens
gccttccccttttgcctggc

SEQ ID NO: 1818365 - DNA, 21 bp, Homo sapiens
gccttccccttttgcctggct

SEQ ID NO: 1818366 - DNA, 24 bp, Homo sapiens
gccttccccttttgcctggctgtg

SEQ ID NO: 1818367 - DNA, 16 bp, Homo sapiens
gccttccctccccaca

SEQ ID NO: 1818368 - DNA, 16 bp, Homo sapiens
gccttcctcatcccct

SEQ ID NO: 1818369 - DNA, 17 bp, Homo sapiens
gccttcctcatcccctc

SEQ ID NO: 1818370 - DNA, 16 bp, Homo sapiens
gccttcctcctccaca

SEQ ID NO: 1818371 - DNA, 22 bp, Homo sapiens
gccttcctcctccacagtgctg

SEQ ID NO: 1818372 - DNA, 17 bp, Homo sapiens
gccttgctttgggcttt

SEQ ID NO: 1818373 - DNA, 15 bp, Homo sapiens
gccttgtgccctgcc

SEQ ID NO: 1818374 - DNA, 16 bp, Homo sapiens
gccttgtgccctgccc

SEQ ID NO: 1818375 - DNA, 15 bp, Homo sapiens
gcctttgttgctcag

SEQ ID NO: 1818376 - DNA, 14 bp, Homo sapiens
gccttttaaaagaa

SEQ ID NO: 1818377 - DNA, 20 bp, Homo sapiens
gccttttacccctgcacagt

SEQ ID NO: 1818378 - DNA, 15 bp, Homo sapiens
gcgaccccatctgcc

SEQ ID NO: 1818379 - DNA, 16 bp, Homo sapiens
gcgaccccatctgccc

SEQ ID NO: 1818380 - DNA, 19 bp, Homo sapiens
gcgaccccatctgcccagg

SEQ ID NO: 1818381 - DNA, 18 bp, Homo sapiens
gcgagcacagtattattt

SEQ ID NO: 1818382 - DNA, 13 bp, Homo sapiens
gcgcaccctcccc

SEQ ID NO: 1818383 - DNA, 15 bp, Homo sapiens
gcgcaccctcccctc

SEQ ID NO: 1818384 - DNA, 16 bp, Homo sapiens
gcgcaccctcccctcc

SEQ ID NO: 1818385 - DNA, 13 bp, Homo sapiens
gcgccctctgtcc

SEQ ID NO: 1818386 - DNA, 16 bp, Homo sapiens
gcgcgggaggcaccag

SEQ ID NO: 1818387 - DNA, 12 bp, Homo sapiens
gcgctcaggacc

SEQ ID NO: 1818388 - DNA, 16 bp, Homo sapiens
gcgctcaggacccagg

SEQ ID NO: 1818389 - DNA, 13 bp, Homo sapiens
ggcagcctccaga

SEQ ID NO: 1818390 - DNA, 18 bp, Homo sapiens
ggcagcctccagagccag

SEQ ID NO: 1818391 - DNA, 20 bp, Homo sapiens
ggcagcctccagagccagcc

SEQ ID NO: 1818392 - DNA, 22 bp, Homo sapiens
ggcagcctccagagccagcctg

SEQ ID NO: 1818393 - DNA, 22 bp, Homo sapiens
ggcagctcctctccttgggctc

SEQ ID NO: 1818394 - DNA, 15 bp, Homo sapiens
ggcagctgctcttag

SEQ ID NO: 1818395 - DNA, 22 bp, Homo sapiens
ggcagctgctcttagtgcccgc

SEQ ID NO: 1818396 - DNA, 23 bp, Homo sapiens
ggcagctgctcttagtgcccgcc

SEQ ID NO: 1818397 - DNA, 19 bp, Homo sapiens
ggcagctgggccccaccta

SEQ ID NO: 1818398 - DNA, 16 bp, Homo sapiens
ggcaggcacagcacag

SEQ ID NO: 1818399 - DNA, 14 bp, Homo sapiens
ggcaggccctgcac

SEQ ID NO: 1818400 - DNA, 21 bp, Homo sapiens
ggcaggccctgcactgtcctg

SEQ ID NO: 1818401 - DNA, 22 bp, Homo sapiens
ggcaggccctgcactgtcctgc

SEQ ID NO: 1818402 - DNA, 14 bp, Homo sapiens
ggcagggagggctt

SEQ ID NO: 1818403 - DNA, 14 bp, Homo sapiens
ggcagggcagaggg

SEQ ID NO: 1818404 - DNA, 15 bp, Homo sapiens
ggcagggcagaggga

SEQ ID NO: 1818405 - DNA, 24 bp, Homo sapiens
ggcaggtagatcgcttgagcccag

SEQ ID NO: 1818406 - DNA, 19 bp, Homo sapiens
ggcaggtgcagatgggctg

SEQ ID NO: 1818407 - DNA, 20 bp, Homo sapiens
ggcagtaacatgcaacaaaa

SEQ ID NO: 1818408 - DNA, 15 bp, Homo sapiens
ggcagtctgaaccct

SEQ ID NO: 1818409 - DNA, 23 bp, Homo sapiens
ggcagtgggtcccacttcccctc

SEQ ID NO: 1818410 - DNA, 15 bp, Homo sapiens
ggcatccacccagtg

SEQ ID NO: 1818411 - DNA, 16 bp, Homo sapiens
ggcatccacccagtgc

SEQ ID NO: 1818412 - DNA, 17 bp, Homo sapiens
ggcatccacccagtgct

SEQ ID NO: 1818413 - DNA, 21 bp, Homo sapiens
ggcatccacccagtgctgcca

SEQ ID NO: 1818414 - DNA, 16 bp, Homo sapiens
ggcatcgtagaagaga

SEQ ID NO: 1818415 - DNA, 13 bp, Homo sapiens
ggcatggctccct

SEQ ID NO: 1818416 - DNA, 14 bp, Homo sapiens
ggcatgtgtgcctg

SEQ ID NO: 1818417 - DNA, 17 bp, Homo sapiens
ggcatgtgtgcctgtgg

SEQ ID NO: 1818418 - DNA, 21 bp, Homo sapiens
ggcatgtgtgcctgtggcaga

SEQ ID NO: 1818419 - DNA, 16 bp, Homo sapiens
ggccaccccaaacccc

SEQ ID NO: 1818420 - DNA, 20 bp, Homo sapiens
ggccaccccaaaccccagcc

SEQ ID NO: 1818421 - DNA, 18 bp, Homo sapiens
ggccactgtggccagagc

SEQ ID NO: 1818422 - DNA, 19 bp, Homo sapiens
ggccactgtggccagagct

SEQ ID NO: 1818423 - DNA, 20 bp, Homo sapiens
ggccactgtggccagagctg

SEQ ID NO: 1818424 - DNA, 13 bp, Homo sapiens
ggccagaaggagg

SEQ ID NO: 1818425 - DNA, 20 bp, Homo sapiens
ggccagaaggagggcagagc

SEQ ID NO: 1818426 - DNA, 21 bp, Homo sapiens
ggccagaaggagggcagagcc

SEQ ID NO: 1818427 - DNA, 22 bp, Homo sapiens
ggccagaaggagggcagagcca

SEQ ID NO: 1818428 - DNA, 13 bp, Homo sapiens
ggccagagagggc

SEQ ID NO: 1818429 - DNA, 13 bp, Homo sapiens
ggccagagctgga

SEQ ID NO: 1818430 - DNA, 23 bp, Homo sapiens
ggccagagctggaaggcagggca

SEQ ID NO: 1818431 - DNA, 13 bp, Homo sapiens
ggccagccccaca

SEQ ID NO: 1818432 - DNA, 15 bp, Homo sapiens
ggccagccccacagc

SEQ ID NO: 1818433 - DNA, 23 bp, Homo sapiens
ggccagccccacagcccacgtcc

SEQ ID NO: 1818434 - DNA, 15 bp, Homo sapiens
ggccatactggcctc

SEQ ID NO: 1818435 - DNA, 19 bp, Homo sapiens
ggccatacttttgagaggg

SEQ ID NO: 1818436 - DNA, 18 bp, Homo sapiens
ggccatgctcaacccccc

SEQ ID NO: 1818437 - DNA, 20 bp, Homo sapiens
ggccatgctcaacccccctc

SEQ ID NO: 1818438 - DNA, 12 bp, Homo sapiens
ggcccagctccc

SEQ ID NO: 1818439 - DNA, 15 bp, Homo sapiens
ggcccagctcccccg

SEQ ID NO: 1818440 - DNA, 15 bp, Homo sapiens
ggcccagctgtagcc

SEQ ID NO: 1818441 - DNA, 21 bp, Homo sapiens
ggcccataatagttagccctc

SEQ ID NO: 1818442 - DNA, 23 bp, Homo sapiens
ggcccataatagttagccctcag

SEQ ID NO: 1818443 - DNA, 18 bp, Homo sapiens
ggcccatcccccctcacc

SEQ ID NO: 1818444 - DNA, 19 bp, Homo sapiens
ggcccatcccccctcacca

SEQ ID NO: 1818445 - DNA, 16 bp, Homo sapiens
ggccccacatgggaac

SEQ ID NO: 1818446 - DNA, 23 bp, Homo sapiens
ggccccaccctcgtggacacctg

SEQ ID NO: 1818447 - DNA, 21 bp, Homo sapiens
ggccccacctacttgtgactg

SEQ ID NO: 1818448 - DNA, 23 bp, Homo sapiens
ggcctgctgggaaccccgcagcc

SEQ ID NO: 1818449 - DNA, 19 bp, Homo sapiens
ggcctgcttttccaggatc

SEQ ID NO: 1818450 - DNA, 24 bp, Homo sapiens
ggcctggaaccagggaggagagga

SEQ ID NO: 1818451 - DNA, 12 bp, Homo sapiens
ggcctggcacag

SEQ ID NO: 1818452 - DNA, 15 bp, Homo sapiens
ggcctggcctgagct

SEQ ID NO: 1818453 - DNA, 15 bp, Homo sapiens
ggcctggctccccac

SEQ ID NO: 1818454 - DNA, 20 bp, Homo sapiens
ggcctggcttgctccagggt

SEQ ID NO: 1818455 - DNA, 15 bp, Homo sapiens
ggcctgggacccagc

SEQ ID NO: 1818456 - DNA, 13 bp, Homo sapiens
ggcctgtgcagca

SEQ ID NO: 1818457 - DNA, 17 bp, Homo sapiens
ggcctgtgcagcagccc

SEQ ID NO: 1818458 - DNA, 21 bp, Homo sapiens
ggcctgtgtccagcagctgcg

SEQ ID NO: 1818459 - DNA, 19 bp, Homo sapiens
ggccttccccttttgcctg

SEQ ID NO: 1818460 - DNA, 17 bp, Homo sapiens
ggcgcaccctcccctcc

SEQ ID NO: 1818461 - DNA, 18 bp, Homo sapiens
ggcgcaccctcccctccc

SEQ ID NO: 1818462 - DNA, 16 bp, Homo sapiens
ggcgccctctgtcctg

SEQ ID NO: 1818463 - DNA, 17 bp, Homo sapiens
ggcgccctctgtcctga

SEQ ID NO: 1818464 - DNA, 16 bp, Homo sapiens
ggcgcgggaggcacca

SEQ ID NO: 1818465 - DNA, 15 bp, Homo sapiens
ggcgctcaggaccca

SEQ ID NO: 1818466 - DNA, 18 bp, Homo sapiens
ggcgctcaggacccaggc

SEQ ID NO: 1818467 - DNA, 19 bp, Homo sapiens
ggcgtaatgggcctgccca

SEQ ID NO: 1818468 - DNA, 15 bp, Homo sapiens
ggcgttggtgccact

SEQ ID NO: 1818469 - DNA, 15 bp, Homo sapiens
ggctaagatgagatt

SEQ ID NO: 1818470 - DNA, 15 bp, Homo sapiens
ggctagtgtgagtgg

SEQ ID NO: 1818471 - DNA, 14 bp, Homo sapiens
ggctcaggcaagcc

SEQ ID NO: 1818472 - DNA, 14 bp, Homo sapiens
ggctcagggaccac

SEQ ID NO: 1818473 - DNA, 17 bp, Homo sapiens
ggctcagggctggagtg

SEQ ID NO: 1818474 - DNA, 23 bp, Homo sapiens
ggctcatggcgtaatgggcctgc

SEQ ID NO: 1818475 - DNA, 19 bp, Homo sapiens
ggctccagcatccagcctg

SEQ ID NO: 1818476 - DNA, 21 bp, Homo sapiens
ggctccagcatccagcctgtg

SEQ ID NO: 1818477 - DNA, 12 bp, Homo sapiens
ggctcctgctgc

SEQ ID NO: 1818478 - DNA, 14 bp, Homo sapiens
ggctcctgtgccct

SEQ ID NO: 1818479 - DNA, 18 bp, Homo sapiens
ggctctccaaaggggctg

SEQ ID NO: 1818480 - DNA, 19 bp, Homo sapiens
ggctctccaaaggggctgc

SEQ ID NO: 1818481 - DNA, 23 bp, Homo sapiens
ggctctcccctctcgccccatcc

SEQ ID NO: 1818482 - DNA, 21 bp, Homo sapiens
ggctctgccctccctccttcc

SEQ ID NO: 1818483 - DNA, 17 bp, Homo sapiens
ggctctgggctcagggc

SEQ ID NO: 1818484 - DNA, 20 bp, Homo sapiens
ggctctgggctcagggctgg

SEQ ID NO: 1818485 - DNA, 12 bp, Homo sapiens
ggctctgtgggc

SEQ ID NO: 1818486 - DNA, 18 bp, Homo sapiens
ggctctgtgggctgcact

SEQ ID NO: 1818487 - DNA, 14 bp, Homo sapiens
ggctcttcctggac

SEQ ID NO: 1818488 - DNA, 17 bp, Homo sapiens
ggctcttcctggacctg

SEQ ID NO: 1818489 - DNA, 17 bp, Homo sapiens
ggctgacacctaccatg

SEQ ID NO: 1818490 - DNA, 23 bp, Homo sapiens
ggctgacacctaccatgctgctt

SEQ ID NO: 1818491 - DNA, 13 bp, Homo sapiens
ggctgcacctcct

SEQ ID NO: 1818492 - DNA, 20 bp, Homo sapiens
ggctgcacctcctaccctcc

SEQ ID NO: 1818493 - DNA, 11 bp, Homo sapiens
ggctgccaggc

SEQ ID NO: 1818494 - DNA, 16 bp, Homo sapiens
ggctgcctccactccc

SEQ ID NO: 1818495 - DNA, 20 bp, Homo sapiens
ggctgcctccactcccactt

SEQ ID NO: 1818496 - DNA, 11 bp, Homo sapiens
ggctgcctgcc

SEQ ID NO: 1818497 - DNA, 15 bp, Homo sapiens
ggctgcgctaacccc

SEQ ID NO: 1818498 - DNA, 23 bp, Homo sapiens
ggctgctggggcatgtgtgcctg

SEQ ID NO: 1818499 - DNA, 16 bp, Homo sapiens
ggctggagtgcgctct

SEQ ID NO: 1818500 - DNA, 17 bp, Homo sapiens
ggctggatctgtgaggg

SEQ ID NO: 1818501 - DNA, 13 bp, Homo sapiens
ggctggcaagcag

SEQ ID NO: 1818502 - DNA, 14 bp, Homo sapiens
ggctggcaagcagg

SEQ ID NO: 1818503 - DNA, 11 bp, Homo sapiens
ggctggccagc

SEQ ID NO: 1818504 - DNA, 15 bp, Homo sapiens
ggctggccagcccca

SEQ ID NO: 1818505 - DNA, 14 bp, Homo sapiens
ggctgggtgcgacc

SEQ ID NO: 1818506 - DNA, 16 bp, Homo sapiens
ggctgtccagtgccca

SEQ ID NO: 1818507 - DNA, 19 bp, Homo sapiens
ggctgtccagtgcccattc

SEQ ID NO: 1818508 - DNA, 14 bp, Homo sapiens
ggctgtggaggcct

SEQ ID NO: 1818509 - DNA, 13 bp, Homo sapiens
ggctgtggcacag

SEQ ID NO: 1818510 - DNA, 18 bp, Homo sapiens
ggctgtttcgtgtagtgg

SEQ ID NO: 1818511 - DNA, 13 bp, Homo sapiens
ggcttcctgtcca

SEQ ID NO: 1818512 - DNA, 22 bp, Homo sapiens
ggctttctccggggtctgtgct

SEQ ID NO: 1818513 - DNA, 23 bp, Homo sapiens
ggctttctccggggtctgtgctg

SEQ ID NO: 1818514 - DNA, 16 bp, Homo sapiens
ggctttgcaggctctg

SEQ ID NO: 1818515 - DNA, 20 bp, Homo sapiens
ggctttgcaggctctgggct

SEQ ID NO: 1818516 - DNA, 14 bp, Homo sapiens
gggaaactggctga

SEQ ID NO: 1818517 - DNA, 18 bp, Homo sapiens
gggaaagcgggcagcccc

SEQ ID NO: 1818518 - DNA, 13 bp, Homo sapiens
gggaaagctccac

SEQ ID NO: 1818519 - DNA, 17 bp, Homo sapiens
gggaaaggatggagtgt

SEQ ID NO: 1818520 - DNA, 16 bp, Homo sapiens
gggaaccccgcagccc

SEQ ID NO: 1818521 - DNA, 12 bp, Homo sapiens
gggaagagggca

SEQ ID NO: 1818522 - DNA, 18 bp, Homo sapiens
gggaagctgtactcagag

SEQ ID NO: 1818523 - DNA, 21 bp, Homo sapiens
gggaatgttccctgcaccctg

SEQ ID NO: 1818524 - DNA, 20 bp, Homo sapiens
gggacaccaagccttggctc

SEQ ID NO: 1818525 - DNA, 21 bp, Homo sapiens
gggacagtattctcagtgctc

SEQ ID NO: 1818526 - DNA, 19 bp, Homo sapiens
gggaccaaattgcttctag

SEQ ID NO: 1818527 - DNA, 14 bp, Homo sapiens
gggacccagctact

SEQ ID NO: 1818528 - DNA, 21 bp, Homo sapiens
gggacccagctactctgtcca

SEQ ID NO: 1818529 - DNA, 20 bp, Homo sapiens
gggagcacttgcgtcctgca

SEQ ID NO: 1818530 - DNA, 22 bp, Homo sapiens
gggagcacttgcgtcctgcaga

SEQ ID NO: 1818531 - DNA, 14 bp, Homo sapiens
gggaggccaaggca

SEQ ID NO: 1818532 - DNA, 16 bp, Homo sapiens
gggaggccaccccaaa

SEQ ID NO: 1818533 - DNA, 11 bp, Homo sapiens
gggagtgtgta

SEQ ID NO: 1818534 - DNA, 13 bp, Homo sapiens
gggatagatgtgt

SEQ ID NO: 1818535 - DNA, 22 bp, Homo sapiens
gggatgatgccacaccaagctg

SEQ ID NO: 1818536 - DNA, 20 bp, Homo sapiens
gggcaaagaactgccccatc

SEQ ID NO: 1818537 - DNA, 15 bp, Homo sapiens
gggcacaccactgcc

SEQ ID NO: 1818538 - DNA, 19 bp, Homo sapiens
gggcacaccactgccctgc

SEQ ID NO: 1818539 - DNA, 17 bp, Homo sapiens
gggcactgccagactga

SEQ ID NO: 1818540 - DNA, 13 bp, Homo sapiens
gggcactgctggg

SEQ ID NO: 1818541 - DNA, 14 bp, Homo sapiens
gggcactgctgggt

SEQ ID NO: 1818542 - DNA, 16 bp, Homo sapiens
gggcactgctgggtgg

SEQ ID NO: 1818543 - DNA, 20 bp, Homo sapiens
gggcactgctgggtggccca

SEQ ID NO: 1818544 - DNA, 22 bp, Homo sapiens
gggcactgctgggtggcccatc

SEQ ID NO: 1818545 - DNA, 15 bp, Homo sapiens
gggcagagctggaca

SEQ ID NO: 1818546 - DNA, 23 bp, Homo sapiens
gggcagccgctaggagagactga

SEQ ID NO: 1818547 - DNA, 14 bp, Homo sapiens
gggcagctgggccc

SEQ ID NO: 1818548 - DNA, 12 bp, Homo sapiens
gggcaggcacag

SEQ ID NO: 1818549 - DNA, 13 bp, Homo sapiens
gggcaggcacagc

SEQ ID NO: 1818550 - DNA, 14 bp, Homo sapiens
gggcaggcacagca

SEQ ID NO: 1818551 - DNA, 15 bp, Homo sapiens
gggcaggcacagcac

SEQ ID NO: 1818552 - DNA, 13 bp, Homo sapiens
gggcaggccctgc

SEQ ID NO: 1818553 - DNA, 14 bp, Homo sapiens
gggcaggccctgca

SEQ ID NO: 1818554 - DNA, 17 bp, Homo sapiens
gggcaggccctgcactg

SEQ ID NO: 1818555 - DNA, 19 bp, Homo sapiens
gggcaggccctgcactgtc

SEQ ID NO: 1818556 - DNA, 19 bp, Homo sapiens
gggcaggcctgggacccag

SEQ ID NO: 1818557 - DNA, 22 bp, Homo sapiens
gggcagtacctgggaaaggacc

SEQ ID NO: 1818558 - DNA, 12 bp, Homo sapiens
gggcagtgactg

SEQ ID NO: 1818559 - DNA, 12 bp, Homo sapiens
gggcatcaggca

SEQ ID NO: 1818560 - DNA, 16 bp, Homo sapiens
gggcatcaggcactgg

SEQ ID NO: 1818561 - DNA, 21 bp, Homo sapiens
gggcatcaggcactggtggca

SEQ ID NO: 1818562 - DNA, 22 bp, Homo sapiens
gggcatggttccttccctggga

SEQ ID NO: 1818563 - DNA, 21 bp, Homo sapiens
gggcatgtgtgcctgtggcag

SEQ ID NO: 1818564 - DNA, 18 bp, Homo sapiens
gggccagaaggagggcag

SEQ ID NO: 1818565 - DNA, 16 bp, Homo sapiens
ttgtccttcagagctc

SEQ ID NO: 1818566 - DNA, 17 bp, Homo sapiens
ttgtccttcagagctct

SEQ ID NO: 1818567 - DNA, 16 bp, Homo sapiens
ttgtctattctgagcc

SEQ ID NO: 1818568 - DNA, 15 bp, Homo sapiens
ttgtctccctggccc

SEQ ID NO: 1818569 - DNA, 19 bp, Homo sapiens
ttgtgaaattcaacctgtg

SEQ ID NO: 1818570 - DNA, 14 bp, Homo sapiens
ttgtgactattaaa

SEQ ID NO: 1818571 - DNA, 14 bp, Homo sapiens
ttgtgactgaaggg

SEQ ID NO: 1818572 - DNA, 23 bp, Homo sapiens
ttgtgatttcccgtggccccagc

SEQ ID NO: 1818573 - DNA, 22 bp, Homo sapiens
ttgtgccctgcccccatctccc

SEQ ID NO: 1818574 - DNA, 13 bp, Homo sapiens
ttgtgctctttgt

SEQ ID NO: 1818575 - DNA, 14 bp, Homo sapiens
ttgtggtagaaatt

SEQ ID NO: 1818576 - DNA, 11 bp, Homo sapiens
ttgttcctgtg

SEQ ID NO: 1818577 - DNA, 12 bp, Homo sapiens
ttgttcctgtgt

SEQ ID NO: 1818578 - DNA, 22 bp, Homo sapiens
ttgtttggggaagttcaagtga

SEQ ID NO: 1818579 - DNA, 18 bp, Homo sapiens
ttgttttccactgtgcta

SEQ ID NO: 1818580 - DNA, 18 bp, Homo sapiens
tttaaaaaaagtatatat

SEQ ID NO: 1818581 - DNA, 23 bp, Homo sapiens
tttaaaatgccaagcaagggaca

SEQ ID NO: 1818582 - DNA, 14 bp, Homo sapiens
tttaacaaaaaagg

SEQ ID NO: 1818583 - DNA, 18 bp, Homo sapiens
tttaatacagattgaaag

SEQ ID NO: 1818584 - DNA, 21 bp, Homo sapiens
tttaatatctgagaagtgtat

SEQ ID NO: 1818585 - DNA, 18 bp, Homo sapiens
tttaatatttttcaaaat

SEQ ID NO: 1818586 - DNA, 17 bp, Homo sapiens
tttaattgcaacaatgc

SEQ ID NO: 1818587 - DNA, 23 bp, Homo sapiens
tttacaaatataggttgtcttgt

SEQ ID NO: 1818588 - DNA, 20 bp, Homo sapiens
tttacagaggacagtatttg

SEQ ID NO: 1818589 - DNA, 18 bp, Homo sapiens
tttacccctgcacagttt

SEQ ID NO: 1818590 - DNA, 13 bp, Homo sapiens
tttacctataaaa

SEQ ID NO: 1818591 - DNA, 21 bp, Homo sapiens
tttacctatacctatgtgaaa

SEQ ID NO: 1818592 - DNA, 14 bp, Homo sapiens
tttagaatatatta

SEQ ID NO: 1818593 - DNA, 17 bp, Homo sapiens
tttataaaaaatggtgc

SEQ ID NO: 1818594 - DNA, 13 bp, Homo sapiens
tttatgtgtgtgt

SEQ ID NO: 1818595 - DNA, 13 bp, Homo sapiens
tttattaaaacat

SEQ ID NO: 1818596 - DNA, 13 bp, Homo sapiens
tttcaaaatcaaa

SEQ ID NO: 1818597 - DNA, 17 bp, Homo sapiens
tttcaaaatcaaagtta

SEQ ID NO: 1818598 - DNA, 16 bp, Homo sapiens
tttcaaaattgttgca

SEQ ID NO: 1818599 - DNA, 14 bp, Homo sapiens
tttcaaataaggaa

SEQ ID NO: 1818600 - DNA, 20 bp, Homo sapiens
tttcaaattaatctttctat

SEQ ID NO: 1818601 - DNA, 18 bp, Homo sapiens
tttcaaccgcttgccata

SEQ ID NO: 1818602 - DNA, 15 bp, Homo sapiens
tttcaatatcattac

SEQ ID NO: 1818603 - DNA, 14 bp, Homo sapiens
tttcagcttctgct

SEQ ID NO: 1818604 - DNA, 21 bp, Homo sapiens
tttcatacattatattcctct

SEQ ID NO: 1818605 - DNA, 17 bp, Homo sapiens
tttcatctcttcaatca

SEQ ID NO: 1818606 - DNA, 21 bp, Homo sapiens
tttcattaaaaggaaaaaaga

SEQ ID NO: 1818607 - DNA, 19 bp, Homo sapiens
tttccagaatttgaatatt

SEQ ID NO: 1818608 - DNA, 15 bp, Homo sapiens
tttcccactgcaccc

SEQ ID NO: 1818609 - DNA, 22 bp, Homo sapiens
tttcccactgcaccccctcctg

SEQ ID NO: 1818610 - DNA, 19 bp, Homo sapiens
tttcccggtgacacatcca

SEQ ID NO: 1818611 - DNA, 15 bp, Homo sapiens
tttcccgtggcccca

SEQ ID NO: 1818612 - DNA, 19 bp, Homo sapiens
tttcccgtggccccagcct

SEQ ID NO: 1818613 - DNA, 22 bp, Homo sapiens
tttccctcccaacagagctggg

SEQ ID NO: 1818614 - DNA, 18 bp, Homo sapiens
tttctaagttaaatcatt

SEQ ID NO: 1818615 - DNA, 23 bp, Homo sapiens
tttctaagttaaatcattttcat

SEQ ID NO: 1818616 - DNA, 19 bp, Homo sapiens
tttctagtcagtaaacatt

SEQ ID NO: 1818617 - DNA, 14 bp, Homo sapiens
cctttgtcccagaa

SEQ ID NO: 1818618 - DNA, 17 bp, Homo sapiens
ccttttcagcttctgct

SEQ ID NO: 1818619 - DNA, 20 bp, Homo sapiens
ccttttcagcttctgctggg

SEQ ID NO: 1818620 - DNA, 18 bp, Homo sapiens
ccttttgtccccagggcc

SEQ ID NO: 1818621 - DNA, 19 bp, Homo sapiens
ccttttgtccccagggccc

SEQ ID NO: 1818622 - DNA, 12 bp, Homo sapiens
cgaaccaaggca

SEQ ID NO: 1818623 - DNA, 22 bp, Homo sapiens
cgaagagggaatggatggggag

SEQ ID NO: 1818624 - DNA, 19 bp, Homo sapiens
cgaaggggccccggggctg

SEQ ID NO: 1818625 - DNA, 21 bp, Homo sapiens
cgaaggggccccggggctggc

SEQ ID NO: 1818626 - DNA, 13 bp, Homo sapiens
cgacactgctgca

SEQ ID NO: 1818627 - DNA, 17 bp, Homo sapiens
cgaccccatctgcccag

SEQ ID NO: 1818628 - DNA, 17 bp, Homo sapiens
cgacgccccgaacctca

SEQ ID NO: 1818629 - DNA, 19 bp, Homo sapiens
cgacttgaattttcccact

SEQ ID NO: 1818630 - DNA, 20 bp, Homo sapiens
cgaggcaccggcgctgcagg

SEQ ID NO: 1818631 - DNA, 13 bp, Homo sapiens
cgagtcacctgca

SEQ ID NO: 1818632 - DNA, 23 bp, Homo sapiens
cgatgaatgtgttgatttgagaa

SEQ ID NO: 1818633 - DNA, 15 bp, Homo sapiens
cgattattgatcaaa

SEQ ID NO: 1818634 - DNA, 21 bp, Homo sapiens
cgattattgatcaaaatcaaa

SEQ ID NO: 1818635 - DNA, 23 bp, Homo sapiens
cgattgcaggagtccctgccatc

SEQ ID NO: 1818636 - DNA, 20 bp, Homo sapiens
cgcaccagctgctctgcccc

SEQ ID NO: 1818637 - DNA, 23 bp, Homo sapiens
cgcaccagctgctctgccccttg

SEQ ID NO: 1818638 - DNA, 22 bp, Homo sapiens
cgcagcccgtgaagcagtgcct

SEQ ID NO: 1818639 - DNA, 13 bp, Homo sapiens
cgcaggaaggcag

SEQ ID NO: 1818640 - DNA, 15 bp, Homo sapiens
cgcaggatccgctgc

SEQ ID NO: 1818641 - DNA, 17 bp, Homo sapiens
cgcagtccccagccctt

SEQ ID NO: 1818642 - DNA, 23 bp, Homo sapiens
cgcagtcgcaggatccgctgcca

SEQ ID NO: 1818643 - DNA, 14 bp, Homo sapiens
cgcatgccccctcg

SEQ ID NO: 1818644 - DNA, 16 bp, Homo sapiens
cgcatgccccctcgtg

SEQ ID NO: 1818645 - DNA, 21 bp, Homo sapiens
cgcatgccccctcgtgccagt

SEQ ID NO: 1818646 - DNA, 22 bp, Homo sapiens
cgcatgccccctcgtgccagtc

SEQ ID NO: 1818647 - DNA, 12 bp, Homo sapiens
cgcccaggctgg

SEQ ID NO: 1818648 - DNA, 18 bp, Homo sapiens
cgccccatccctgcttgc

SEQ ID NO: 1818649 - DNA, 16 bp, Homo sapiens
cgccctctgtcctgac

SEQ ID NO: 1818650 - DNA, 18 bp, Homo sapiens
cgccctgcgttggagcca

SEQ ID NO: 1818651 - DNA, 15 bp, Homo sapiens
cgcctcgcccaccgc

SEQ ID NO: 1818652 - DNA, 19 bp, Homo sapiens
cgccttctcccccccgggg

SEQ ID NO: 1818653 - DNA, 21 bp, Homo sapiens
cgccttctcccccccggggct

SEQ ID NO: 1818654 - DNA, 23 bp, Homo sapiens
cgcgccttctcccccccggggct

SEQ ID NO: 1818655 - DNA, 13 bp, Homo sapiens
cgcgctgcctgtg

SEQ ID NO: 1818656 - DNA, 13 bp, Homo sapiens
cgctcaggaccca

SEQ ID NO: 1818657 - DNA, 16 bp, Homo sapiens
cgctcaggacccaggc

SEQ ID NO: 1818658 - DNA, 19 bp, Homo sapiens
cgctcaggacccaggccct

SEQ ID NO: 1818659 - DNA, 13 bp, Homo sapiens
cgctcccacagct

SEQ ID NO: 1818660 - DNA, 22 bp, Homo sapiens
cgctcccagtgtcttcctgtgg

SEQ ID NO: 1818661 - DNA, 18 bp, Homo sapiens
cgctcccccgcagtcccc

SEQ ID NO: 1818662 - DNA, 14 bp, Homo sapiens
cgctcttggtccct

SEQ ID NO: 1818663 - DNA, 16 bp, Homo sapiens
cgctcttggtccctgg

SEQ ID NO: 1818664 - DNA, 17 bp, Homo sapiens
cgctgccaccacgtctg

SEQ ID NO: 1818665 - DNA, 22 bp, Homo sapiens
cgctgccaccacgtctgccagg

SEQ ID NO: 1818666 - DNA, 20 bp, Homo sapiens
cgctgcccggcgccctctgt

SEQ ID NO: 1818667 - DNA, 22 bp, Homo sapiens
cgctgcccggcgccctctgtcc

SEQ ID NO: 1818668 - DNA, 13 bp, Homo sapiens
cgctgcctgtgtg

SEQ ID NO: 1818669 - DNA, 14 bp, Homo sapiens
cgctgctctagctg

SEQ ID NO: 1818670 - DNA, 18 bp, Homo sapiens
cgctgctctagctggcag

SEQ ID NO: 1818671 - DNA, 19 bp, Homo sapiens
cgctgctctagctggcagg

SEQ ID NO: 1818672 - DNA, 21 bp, Homo sapiens
cgctgggatttcttcgctgct

SEQ ID NO: 1818673 - DNA, 15 bp, Homo sapiens
cgcttcacccctgca

SEQ ID NO: 1818674 - DNA, 17 bp, Homo sapiens
cgcttcacccctgcact

SEQ ID NO: 1818675 - DNA, 14 bp, Homo sapiens
cgcttgagcccagg

SEQ ID NO: 1818676 - DNA, 23 bp, Homo sapiens
cgcttgcctcggctcctgctgca

SEQ ID NO: 1818677 - DNA, 21 bp, Homo sapiens
cggaagccgtctgactccaga

SEQ ID NO: 1818678 - DNA, 19 bp, Homo sapiens
cggagcacagccctgggag

SEQ ID NO: 1818679 - DNA, 16 bp, Homo sapiens
ctatatttatttatgt

SEQ ID NO: 1818680 - DNA, 12 bp, Homo sapiens
ctatccatcctg

SEQ ID NO: 1818681 - DNA, 13 bp, Homo sapiens
ctatccatcctgc

SEQ ID NO: 1818682 - DNA, 17 bp, Homo sapiens
ctatgagaacaagtcac

SEQ ID NO: 1818683 - DNA, 22 bp, Homo sapiens
ctatgagaacaagtcacagctg

SEQ ID NO: 1818684 - DNA, 23 bp, Homo sapiens
ctatgagaacaagtcacagctgc

SEQ ID NO: 1818685 - DNA, 18 bp, Homo sapiens
ctatgagatggccatgct

SEQ ID NO: 1818686 - DNA, 13 bp, Homo sapiens
ctatgcgttttta

SEQ ID NO: 1818687 - DNA, 18 bp, Homo sapiens
ctatgtgagtttcagaaa

SEQ ID NO: 1818688 - DNA, 19 bp, Homo sapiens
ctatgtgagtttcagaaat

SEQ ID NO: 1818689 - DNA, 17 bp, Homo sapiens
ctattaaatgttgcaca

SEQ ID NO: 1818690 - DNA, 14 bp, Homo sapiens
ctattcaatgcaat

SEQ ID NO: 1818691 - DNA, 15 bp, Homo sapiens
ctattctgagccttg

SEQ ID NO: 1818692 - DNA, 16 bp, Homo sapiens
ctattctgagccttga

SEQ ID NO: 1818693 - DNA, 16 bp, Homo sapiens
ctattgttgtgggctt

SEQ ID NO: 1818694 - DNA, 21 bp, Homo sapiens
ctatttccctctactgagtaa

SEQ ID NO: 1818695 - DNA, 13 bp, Homo sapiens
ctattttgaagaa

SEQ ID NO: 1818696 - DNA, 23 bp, Homo sapiens
ctatttttgcactggaatatctg

SEQ ID NO: 1818697 - DNA, 12 bp, Homo sapiens
ctcaaatttttc

SEQ ID NO: 1818698 - DNA, 17 bp, Homo sapiens
ctcaacccccctcccag

SEQ ID NO: 1818699 - DNA, 16 bp, Homo sapiens
ctcaaggcctcccaca

SEQ ID NO: 1818700 - DNA, 15 bp, Homo sapiens
ctcaatttgaaacac

SEQ ID NO: 1818701 - DNA, 16 bp, Homo sapiens
ctcacactactgtatt

SEQ ID NO: 1818702 - DNA, 14 bp, Homo sapiens
ctcaccaggggcag

SEQ ID NO: 1818703 - DNA, 21 bp, Homo sapiens
ctcaccaggggcaggcacagc

SEQ ID NO: 1818704 - DNA, 22 bp, Homo sapiens
ctcaccaggggcaggcacagca

SEQ ID NO: 1818705 - DNA, 13 bp, Homo sapiens
ctcaccagggtcc

SEQ ID NO: 1818706 - DNA, 23 bp, Homo sapiens
ctcaccagggtccgcaccagctg

SEQ ID NO: 1818707 - DNA, 21 bp, Homo sapiens
ctcacgctcccccgcagtccc

SEQ ID NO: 1818708 - DNA, 14 bp, Homo sapiens
ctcactggctgggg

SEQ ID NO: 1818709 - DNA, 15 bp, Homo sapiens
ctcactggctggggc

SEQ ID NO: 1818710 - DNA, 17 bp, Homo sapiens
ctcactggctggggcag

SEQ ID NO: 1818711 - DNA, 22 bp, Homo sapiens
ctcactggctggggcagagggg

SEQ ID NO: 1818712 - DNA, 16 bp, Homo sapiens
ctcacttatctgatac

SEQ ID NO: 1818713 - DNA, 14 bp, Homo sapiens
ctcacttttgtgaa

SEQ ID NO: 1818714 - DNA, 22 bp, Homo sapiens
ctcagactctttttgtacctgg

SEQ ID NO: 1818715 - DNA, 20 bp, Homo sapiens
ctcagcaaggggctctgccc

SEQ ID NO: 1818716 - DNA, 14 bp, Homo sapiens
ctcagcagcagaga

SEQ ID NO: 1818717 - DNA, 18 bp, Homo sapiens
ctcagcagcagagagccc

SEQ ID NO: 1818718 - DNA, 20 bp, Homo sapiens
ctcagcagcagagagccctg

SEQ ID NO: 1818719 - DNA, 23 bp, Homo sapiens
ctcagcccttgcccccatccctc

SEQ ID NO: 1818720 - DNA, 15 bp, Homo sapiens
ctcaggacccaggcc

SEQ ID NO: 1818721 - DNA, 23 bp, Homo sapiens
ctcaggacccaggccctccatgg

SEQ ID NO: 1818722 - DNA, 14 bp, Homo sapiens
ctcaggcaagcccc

SEQ ID NO: 1818723 - DNA, 19 bp, Homo sapiens
ctcaggcaagcccctcagc

SEQ ID NO: 1818724 - DNA, 12 bp, Homo sapiens
ctcagggaccac

SEQ ID NO: 1818725 - DNA, 19 bp, Homo sapiens
ctcagggaccacagcaagg

SEQ ID NO: 1818726 - DNA, 12 bp, Homo sapiens
ctcagggctgga

SEQ ID NO: 1818727 - DNA, 14 bp, Homo sapiens
ctcaggtgccactc

SEQ ID NO: 1818728 - DNA, 17 bp, Homo sapiens
ctcaggtgccactccct

SEQ ID NO: 1818729 - DNA, 18 bp, Homo sapiens
ctcaggtgccactccctg

SEQ ID NO: 1818730 - DNA, 22 bp, Homo sapiens
ctcagtacacttcctgtgccat

SEQ ID NO: 1818731 - DNA, 21 bp, Homo sapiens
ctcagtgctctcctaccccac

SEQ ID NO: 1818732 - DNA, 20 bp, Homo sapiens
ctcatagccccggtgtgcgg

SEQ ID NO: 1818733 - DNA, 15 bp, Homo sapiens
ctcatccctcggaag

SEQ ID NO: 1818734 - DNA, 17 bp, Homo sapiens
ctcatccctcggaagcc

SEQ ID NO: 1818735 - DNA, 22 bp, Homo sapiens
ctcatgacattatatttgagtt

SEQ ID NO: 1818736 - DNA, 12 bp, Homo sapiens
ctcatgccacac

SEQ ID NO: 1818737 - DNA, 18 bp, Homo sapiens
ggtgccactccctgagct

SEQ ID NO: 1818738 - DNA, 21 bp, Homo sapiens
ggtgcccagactcaaggcctc

SEQ ID NO: 1818739 - DNA, 16 bp, Homo sapiens
ggtgctgagcttagcc

SEQ ID NO: 1818740 - DNA, 17 bp, Homo sapiens
ggtgctgctaccctccc

SEQ ID NO: 1818741 - DNA, 22 bp, Homo sapiens
ggtgctgctaccctccctgctg

SEQ ID NO: 1818742 - DNA, 22 bp, Homo sapiens
ggtggcccatcccccctcacca

SEQ ID NO: 1818743 - DNA, 14 bp, Homo sapiens
ggtggcccctgcct

SEQ ID NO: 1818744 - DNA, 13 bp, Homo sapiens
ggtgggcagctgg

SEQ ID NO: 1818745 - DNA, 13 bp, Homo sapiens
ggtgggcctggcc

SEQ ID NO: 1818746 - DNA, 18 bp, Homo sapiens
ggtgggcctggcctgagc

SEQ ID NO: 1818747 - DNA, 19 bp, Homo sapiens
ggtgggcctggcctgagct

SEQ ID NO: 1818748 - DNA, 20 bp, Homo sapiens
ggtgggcgggcagcacagca

SEQ ID NO: 1818749 - DNA, 23 bp, Homo sapiens
ggtgggtccaggaaggcagctgc

SEQ ID NO: 1818750 - DNA, 18 bp, Homo sapiens
ggtgtggtggctcatggc

SEQ ID NO: 1818751 - DNA, 16 bp, Homo sapiens
ggtgttcataatttca

SEQ ID NO: 1818752 - DNA, 17 bp, Homo sapiens
ggttactcagcagcaga

SEQ ID NO: 1818753 - DNA, 13 bp, Homo sapiens
ggttatctgcctg

SEQ ID NO: 1818754 - DNA, 23 bp, Homo sapiens
ggttatctgcctggcctggctcc

SEQ ID NO: 1818755 - DNA, 15 bp, Homo sapiens
ggttccttccctggg

SEQ ID NO: 1818756 - DNA, 15 bp, Homo sapiens
ggttgaaggcagtct

SEQ ID NO: 1818757 - DNA, 20 bp, Homo sapiens
ggttggcgcaccctcccctc

SEQ ID NO: 1818758 - DNA, 22 bp, Homo sapiens
ggtttgtttagaagaagtgtgt

SEQ ID NO: 1818759 - DNA, 21 bp, Homo sapiens
gtaaaaagattatatatcata

SEQ ID NO: 1818760 - DNA, 14 bp, Homo sapiens
gtaaaaatactgtt

SEQ ID NO: 1818761 - DNA, 22 bp, Homo sapiens
gtaaacattcctccagcctccc

SEQ ID NO: 1818762 - DNA, 18 bp, Homo sapiens
gtaaacatttgtaaaaat

SEQ ID NO: 1818763 - DNA, 20 bp, Homo sapiens
gtaaacatttgtaaaaatac

SEQ ID NO: 1818764 - DNA, 20 bp, Homo sapiens
gtaaaccctatctgtgattc

SEQ ID NO: 1818765 - DNA, 17 bp, Homo sapiens
gtaaatctatgagcaac

SEQ ID NO: 1818766 - DNA, 17 bp, Homo sapiens
gtaaatttatgtgatgg

SEQ ID NO: 1818767 - DNA, 13 bp, Homo sapiens
gtaacaatactgg

SEQ ID NO: 1818768 - DNA, 22 bp, Homo sapiens
gtaacaatactgggcagccttt

SEQ ID NO: 1818769 - DNA, 15 bp, Homo sapiens
gtaacatgcaacaaa

SEQ ID NO: 1818770 - DNA, 17 bp, Homo sapiens
gtaacatgcaacaaaaa

SEQ ID NO: 1818771 - DNA, 22 bp, Homo sapiens
gtaactgctgagccactcgcag

SEQ ID NO: 1818772 - DNA, 19 bp, Homo sapiens
gtaagtggattcagttcat

SEQ ID NO: 1818773 - DNA, 17 bp, Homo sapiens
gtaataaaaagtaacac

SEQ ID NO: 1818774 - DNA, 18 bp, Homo sapiens
gtaataatgtaatactgt

SEQ ID NO: 1818775 - DNA, 17 bp, Homo sapiens
gtaatactgtagaaata

SEQ ID NO: 1818776 - DNA, 15 bp, Homo sapiens
gtaatgcacatcctc

SEQ ID NO: 1818777 - DNA, 20 bp, Homo sapiens
gtaatgccacacattgtgct

SEQ ID NO: 1818778 - DNA, 16 bp, Homo sapiens
gtaatggaactgaccc

SEQ ID NO: 1818779 - DNA, 20 bp, Homo sapiens
gtaatgggatctatttttgc

SEQ ID NO: 1818780 - DNA, 20 bp, Homo sapiens
gtaatttaaaattgtgatgt

SEQ ID NO: 1818781 - DNA, 16 bp, Homo sapiens
gtacaaagatatgcta

SEQ ID NO: 1818782 - DNA, 20 bp, Homo sapiens
gtacaaagatatgctaagca

SEQ ID NO: 1818783 - DNA, 15 bp, Homo sapiens
gtacagtgaggaggg

SEQ ID NO: 1818784 - DNA, 19 bp, Homo sapiens
gtacccccgcccaggctgg

SEQ ID NO: 1818785 - DNA, 20 bp, Homo sapiens
gtacccccgcccaggctggc

SEQ ID NO: 1818786 - DNA, 20 bp, Homo sapiens
gtacccttccacctcctaga

SEQ ID NO: 1818787 - DNA, 16 bp, Homo sapiens
gtctccctggccctca

SEQ ID NO: 1818788 - DNA, 18 bp, Homo sapiens
gtctccctggccctcaag

SEQ ID NO: 1818789 - DNA, 15 bp, Homo sapiens
gtctcctgtatcatt

SEQ ID NO: 1818790 - DNA, 21 bp, Homo sapiens
gtctccttactctgagcccag

SEQ ID NO: 1818791 - DNA, 17 bp, Homo sapiens
gtctcgctgatgctggg

SEQ ID NO: 1818792 - DNA, 18 bp, Homo sapiens
gtctcgctgatgctgggc

SEQ ID NO: 1818793 - DNA, 22 bp, Homo sapiens
gtctcggtggtaccaggtctcc

SEQ ID NO: 1818794 - DNA, 13 bp, Homo sapiens
gtctgaacccttg

SEQ ID NO: 1818795 - DNA, 15 bp, Homo sapiens
gtctgaacccttgtg

SEQ ID NO: 1818796 - DNA, 20 bp, Homo sapiens
gtctgaaggaatagccagag

SEQ ID NO: 1818797 - DNA, 12 bp, Homo sapiens
gtctgagccccc

SEQ ID NO: 1818798 - DNA, 15 bp, Homo sapiens
gtctgaggccccagg

SEQ ID NO: 1818799 - DNA, 11 bp, Homo sapiens
gtctgccaggc

SEQ ID NO: 1818800 - DNA, 17 bp, Homo sapiens
gtctgccaggcccatct

SEQ ID NO: 1818801 - DNA, 17 bp, Homo sapiens
gtctgctcgggcccagg

SEQ ID NO: 1818802 - DNA, 19 bp, Homo sapiens
gtctgctcgggcccaggcc

SEQ ID NO: 1818803 - DNA, 21 bp, Homo sapiens
gtctgtaatgggatctatttt

SEQ ID NO: 1818804 - DNA, 16 bp, Homo sapiens
gtctgtctgtctgtcc

SEQ ID NO: 1818805 - DNA, 12 bp, Homo sapiens
gtctgtgctctt

SEQ ID NO: 1818806 - DNA, 14 bp, Homo sapiens
gtctgtgctgtgcc

SEQ ID NO: 1818807 - DNA, 17 bp, Homo sapiens
gtctgtgctgtgcctgc

SEQ ID NO: 1818808 - DNA, 18 bp, Homo sapiens
gtctgtgctgtgcctgct

SEQ ID NO: 1818809 - DNA, 12 bp, Homo sapiens
gtctgtgtgtgt

SEQ ID NO: 1818810 - DNA, 21 bp, Homo sapiens
gtctgtgtgtttatgtgtgtg

SEQ ID NO: 1818811 - DNA, 18 bp, Homo sapiens
gtcttataggtttccact

SEQ ID NO: 1818812 - DNA, 12 bp, Homo sapiens
gtcttcctgtgg

SEQ ID NO: 1818813 - DNA, 23 bp, Homo sapiens
gtcttgagagaaaagaaaaatat

SEQ ID NO: 1818814 - DNA, 14 bp, Homo sapiens
gtcttgcctaggcc

SEQ ID NO: 1818815 - DNA, 21 bp, Homo sapiens
gtgaaacccagatcgctgtgt

SEQ ID NO: 1818816 - DNA, 23 bp, Homo sapiens
gtgaactattttgaagaaaacac

SEQ ID NO: 1818817 - DNA, 21 bp, Homo sapiens
gtgaacttacacttggagccc

SEQ ID NO: 1818818 - DNA, 20 bp, Homo sapiens
gtgaagtgttgtggagaaaa

SEQ ID NO: 1818819 - DNA, 22 bp, Homo sapiens
gtgaagtgttgtggagaaaaga

SEQ ID NO: 1818820 - DNA, 17 bp, Homo sapiens
gtgaatatgagaaatac

SEQ ID NO: 1818821 - DNA, 12 bp, Homo sapiens
gtgacacatcca

SEQ ID NO: 1818822 - DNA, 20 bp, Homo sapiens
gtgaccccttttcagcttct

SEQ ID NO: 1818823 - DNA, 23 bp, Homo sapiens
gtgaccccttttcagcttctgct

SEQ ID NO: 1818824 - DNA, 18 bp, Homo sapiens
gtgacccttcagggccag

SEQ ID NO: 1818825 - DNA, 19 bp, Homo sapiens
gtgacccttcagggccaga

SEQ ID NO: 1818826 - DNA, 17 bp, Homo sapiens
gtgactcgggctcctgt

SEQ ID NO: 1818827 - DNA, 12 bp, Homo sapiens
gtgactggcagg

SEQ ID NO: 1818828 - DNA, 24 bp, Homo sapiens
gtgactggcaggtgcagatgggct

SEQ ID NO: 1818829 - DNA, 13 bp, Homo sapiens
gtgacttctgaat

SEQ ID NO: 1818830 - DNA, 18 bp, Homo sapiens
gtgagcccctccccagcc

SEQ ID NO: 1818831 - DNA, 16 bp, Homo sapiens
gtgagctgggaagctg

SEQ ID NO: 1818832 - DNA, 15 bp, Homo sapiens
gtgaggatgtctggg

SEQ ID NO: 1818833 - DNA, 16 bp, Homo sapiens
gtgaggcttccaggct

SEQ ID NO: 1818834 - DNA, 12 bp, Homo sapiens
gtgagtggcagc

SEQ ID NO: 1818835 - DNA, 14 bp, Homo sapiens
gtgagtggcagcca

SEQ ID NO: 1818836 - DNA, 18 bp, Homo sapiens
gtgagtgtgactttttga

SEQ ID NO: 1818837 - DNA, 13 bp, Homo sapiens
gtgagtttcagaa

SEQ ID NO: 1818838 - DNA, 17 bp, Homo sapiens
gtgagtttcagaaattc

SEQ ID NO: 1818839 - DNA, 20 bp, Homo sapiens
gtgcacccactcaccagggt

SEQ ID NO: 1818840 - DNA, 17 bp, Homo sapiens
gtgcactggccccaccc

SEQ ID NO: 1818841 - DNA, 19 bp, Homo sapiens
gtgcagcagcccagcttcc

SEQ ID NO: 1818842 - DNA, 20 bp, Homo sapiens
gtgcagccttcccctccctg

SEQ ID NO: 1818843 - DNA, 15 bp, Homo sapiens
gtgcagtacaggcaa

SEQ ID NO: 1818844 - DNA, 14 bp, Homo sapiens
gtgccaccctgggc

SEQ ID NO: 1818845 - DNA, 22 bp, Homo sapiens
gtgccaccctgggctctgtggg

SEQ ID NO: 1818846 - DNA, 17 bp, Homo sapiens
gtgccagtcgcgctgcc

SEQ ID NO: 1818847 - DNA, 21 bp, Homo sapiens
gtgcccatgggcactgctggg

SEQ ID NO: 1818848 - DNA, 20 bp, Homo sapiens
gtgccccccatcctggccca

SEQ ID NO: 1818849 - DNA, 18 bp, Homo sapiens
gtgccgccgcctcgccca

SEQ ID NO: 1818850 - DNA, 20 bp, Homo sapiens
gtgccgccgcctcgcccacc

SEQ ID NO: 1818851 - DNA, 23 bp, Homo sapiens
gtgccgccgcctcgcccaccgca

SEQ ID NO: 1818852 - DNA, 15 bp, Homo sapiens
gtgcctcgaggcacc

SEQ ID NO: 1818853 - DNA, 22 bp, Homo sapiens
gtgcctgattcggctgtctcag

SEQ ID NO: 1818854 - DNA, 19 bp, Homo sapiens
gtgcctgcaccaggagaca

SEQ ID NO: 1818855 - DNA, 17 bp, Homo sapiens
gtgcctgctagagcaac

SEQ ID NO: 1818856 - DNA, 19 bp, Homo sapiens
gtgcctgctagagcaaccc

SEQ ID NO: 1818857 - DNA, 12 bp, Homo sapiens
gtgcctgtggca

SEQ ID NO: 1818858 - DNA, 23 bp, Homo sapiens
attgtttggggaagttcaagtga

SEQ ID NO: 1818859 - DNA, 17 bp, Homo sapiens
atttaatatttttcaaa

SEQ ID NO: 1818860 - DNA, 12 bp, Homo sapiens
atttacagaata

SEQ ID NO: 1818861 - DNA, 14 bp, Homo sapiens
atttactaaaagaa

SEQ ID NO: 1818862 - DNA, 19 bp, Homo sapiens
atttacttaatgggtacaa

SEQ ID NO: 1818863 - DNA, 18 bp, Homo sapiens
atttatagaataatttct

SEQ ID NO: 1818864 - DNA, 23 bp, Homo sapiens
atttcaaattaatctttctatat

SEQ ID NO: 1818865 - DNA, 15 bp, Homo sapiens
atttccacataaagg

SEQ ID NO: 1818866 - DNA, 17 bp, Homo sapiens
atttccacataaaggta

SEQ ID NO: 1818867 - DNA, 12 bp, Homo sapiens
atttccaggccc

SEQ ID NO: 1818868 - DNA, 13 bp, Homo sapiens
atttccaggcccc

SEQ ID NO: 1818869 - DNA, 15 bp, Homo sapiens
atttccaggcccctg

SEQ ID NO: 1818870 - DNA, 21 bp, Homo sapiens
atttccatggattcccctgga

SEQ ID NO: 1818871 - DNA, 16 bp, Homo sapiens
atttcccgtggcccca

SEQ ID NO: 1818872 - DNA, 24 bp, Homo sapiens
atttctaagttaaatcattttcat

SEQ ID NO: 1818873 - DNA, 23 bp, Homo sapiens
atttctccatcccctccctgcct

SEQ ID NO: 1818874 - DNA, 20 bp, Homo sapiens
atttctctccccactgaaaa

SEQ ID NO: 1818875 - DNA, 18 bp, Homo sapiens
atttctggctttttgaat

SEQ ID NO: 1818876 - DNA, 21 bp, Homo sapiens
atttcttcgctgctctagctg

SEQ ID NO: 1818877 - DNA, 22 bp, Homo sapiens
atttcttcgctgctctagctgg

SEQ ID NO: 1818878 - DNA, 18 bp, Homo sapiens
atttggtaggaagcctga

SEQ ID NO: 1818879 - DNA, 14 bp, Homo sapiens
atttgtaaaaatac

SEQ ID NO: 1818880 - DNA, 17 bp, Homo sapiens
atttgtaaaaatactgt

SEQ ID NO: 1818881 - DNA, 19 bp, Homo sapiens
atttgtaaatttatgtgat

SEQ ID NO: 1818882 - DNA, 21 bp, Homo sapiens
atttgtaagcaacttgcttct

SEQ ID NO: 1818883 - DNA, 19 bp, Homo sapiens
atttgttttcccgccaagc

SEQ ID NO: 1818884 - DNA, 15 bp, Homo sapiens
attttaaaaaatcaa

SEQ ID NO: 1818885 - DNA, 16 bp, Homo sapiens
attttaaaaaatcaaa

SEQ ID NO: 1818886 - DNA, 18 bp, Homo sapiens
attttaaaaaatcaaaag

SEQ ID NO: 1818887 - DNA, 19 bp, Homo sapiens
attttacagtatcttcaaa

SEQ ID NO: 1818888 - DNA, 16 bp, Homo sapiens
attttactaaaatcgt

SEQ ID NO: 1818889 - DNA, 19 bp, Homo sapiens
attttcattaaaaggaaaa

SEQ ID NO: 1818890 - DNA, 21 bp, Homo sapiens
attttcattaaaaggaaaaaa

SEQ ID NO: 1818891 - DNA, 17 bp, Homo sapiens
attttctgagtagcata

SEQ ID NO: 1818892 - DNA, 19 bp, Homo sapiens
attttctttcatacattat

SEQ ID NO: 1818893 - DNA, 15 bp, Homo sapiens
attttgaagaaaaca

SEQ ID NO: 1818894 - DNA, 18 bp, Homo sapiens
attttgaagaaaacacaa

SEQ ID NO: 1818895 - DNA, 18 bp, Homo sapiens
attttgcattagacagat

SEQ ID NO: 1818896 - DNA, 21 bp, Homo sapiens
attttgtaattattgtgattt

SEQ ID NO: 1818897 - DNA, 21 bp, Homo sapiens
attttgtacaaagatatgcta

SEQ ID NO: 1818898 - DNA, 19 bp, Homo sapiens
attttgtgaaagaaggagc

SEQ ID NO: 1818899 - DNA, 17 bp, Homo sapiens
atttttaccaactctat

SEQ ID NO: 1818900 - DNA, 15 bp, Homo sapiens
atttttattatttgt

SEQ ID NO: 1818901 - DNA, 20 bp, Homo sapiens
atttttattttcttatgtaa

SEQ ID NO: 1818902 - DNA, 15 bp, Homo sapiens
atttttcaaaatcaa

SEQ ID NO: 1818903 - DNA, 17 bp, Homo sapiens
atttttcaaaatcaaag

SEQ ID NO: 1818904 - DNA, 18 bp, Homo sapiens
atttttcaaaatcaaagt

SEQ ID NO: 1818905 - DNA, 17 bp, Homo sapiens
atttttgcactggaata

SEQ ID NO: 1818906 - DNA, 13 bp, Homo sapiens
atttttgtacatt

SEQ ID NO: 1818907 - DNA, 14 bp, Homo sapiens
atttttgtacatta

SEQ ID NO: 1818908 - DNA, 15 bp, Homo sapiens
atttttgtacattat

SEQ ID NO: 1818909 - DNA, 20 bp, Homo sapiens
attttttaaatttacagaat

SEQ ID NO: 1818910 - DNA, 21 bp, Homo sapiens
caaaaatacagaatttataga

SEQ ID NO: 1818911 - DNA, 15 bp, Homo sapiens
caaaaatgtttgtac

SEQ ID NO: 1818912 - DNA, 20 bp, Homo sapiens
caaaagtggggctaaatgaa

SEQ ID NO: 1818913 - DNA, 21 bp, Homo sapiens
caaaagtttcacaacagattt

SEQ ID NO: 1818914 - DNA, 11 bp, Homo sapiens
caaaatcaaag

SEQ ID NO: 1818915 - DNA, 14 bp, Homo sapiens
caaaccccagcccc

SEQ ID NO: 1818916 - DNA, 19 bp, Homo sapiens
caaactgatggaccgggtg

SEQ ID NO: 1818917 - DNA, 23 bp, Homo sapiens
caaactgatggaccgggtgggcc

SEQ ID NO: 1818918 - DNA, 18 bp, Homo sapiens
caaactgcacacacagct

SEQ ID NO: 1818919 - DNA, 21 bp, Homo sapiens
caaactgcacacacagctcct

SEQ ID NO: 1818920 - DNA, 14 bp, Homo sapiens
caaagaagcttcat

SEQ ID NO: 1818921 - DNA, 22 bp, Homo sapiens
caaagcaaaagaagtaaaagct

SEQ ID NO: 1818922 - DNA, 14 bp, Homo sapiens
caaagcaagggctc

SEQ ID NO: 1818923 - DNA, 19 bp, Homo sapiens
caaagcaagggctccagca

SEQ ID NO: 1818924 - DNA, 14 bp, Homo sapiens
caaagccacatttt

SEQ ID NO: 1818925 - DNA, 18 bp, Homo sapiens
caaagggcagtaaagttt

SEQ ID NO: 1818926 - DNA, 11 bp, Homo sapiens
caaaggggctg

SEQ ID NO: 1818927 - DNA, 14 bp, Homo sapiens
caaaggggctgctg

SEQ ID NO: 1818928 - DNA, 21 bp, Homo sapiens
caaagtgctgtacccttccac

SEQ ID NO: 1818929 - DNA, 17 bp, Homo sapiens
caaatattagcaaagaa

SEQ ID NO: 1818930 - DNA, 19 bp, Homo sapiens
caaatattagcaaagaagc

SEQ ID NO: 1818931 - DNA, 21 bp, Homo sapiens
caaatattagcaaagaagctt

SEQ ID NO: 1818932 - DNA, 16 bp, Homo sapiens
caaatgagcattagct

SEQ ID NO: 1818933 - DNA, 15 bp, Homo sapiens
caaatgagggagggg

SEQ ID NO: 1818934 - DNA, 17 bp, Homo sapiens
caaattggacagaagat

SEQ ID NO: 1818935 - DNA, 17 bp, Homo sapiens
caaatttttcatctctt

SEQ ID NO: 1818936 - DNA, 21 bp, Homo sapiens
caaatttttcatctcttcaat

SEQ ID NO: 1818937 - DNA, 16 bp, Homo sapiens
caacaaaaatgtgggt

SEQ ID NO: 1818938 - DNA, 16 bp, Homo sapiens
caacaaatacttccat

SEQ ID NO: 1818939 - DNA, 19 bp, Homo sapiens
caacaatggggtgggccca

SEQ ID NO: 1818940 - DNA, 22 bp, Homo sapiens
caacactgaagtgcttgcagat

SEQ ID NO: 1818941 - DNA, 17 bp, Homo sapiens
caacagccaaactgctg

SEQ ID NO: 1818942 - DNA, 19 bp, Homo sapiens
caacagcttttcccaggag

SEQ ID NO: 1818943 - DNA, 18 bp, Homo sapiens
caacatttttgtacatta

SEQ ID NO: 1818944 - DNA, 16 bp, Homo sapiens
caacccccctcccaga

SEQ ID NO: 1818945 - DNA, 22 bp, Homo sapiens
caacccctgtacccagctcctt

SEQ ID NO: 1818946 - DNA, 16 bp, Homo sapiens
caaccgcttgccatat

SEQ ID NO: 1818947 - DNA, 22 bp, Homo sapiens
caacctgcccctccccagccct

SEQ ID NO: 1818948 - DNA, 12 bp, Homo sapiens
caactaaataac

SEQ ID NO: 1818949 - DNA, 17 bp, Homo sapiens
caactaaataacacaga

SEQ ID NO: 1818950 - DNA, 13 bp, Homo sapiens
caactaagccctc

SEQ ID NO: 1818951 - DNA, 14 bp, Homo sapiens
caactccaggggca

SEQ ID NO: 1818952 - DNA, 15 bp, Homo sapiens
caactggctggccag

SEQ ID NO: 1818953 - DNA, 13 bp, Homo sapiens
caagaagctgcta

SEQ ID NO: 1818954 - DNA, 17 bp, Homo sapiens
caagaattctagaaaat

SEQ ID NO: 1818955 - DNA, 14 bp, Homo sapiens
caagacaaagcaaa

SEQ ID NO: 1818956 - DNA, 13 bp, Homo sapiens
caagacagtcttt

SEQ ID NO: 1818957 - DNA, 12 bp, Homo sapiens
caagagaacatt

SEQ ID NO: 1818958 - DNA, 22 bp, Homo sapiens
caagagcatcgtgacccttcag

SEQ ID NO: 1818959 - DNA, 18 bp, Homo sapiens
caagatgtttatctgaca

SEQ ID NO: 1818960 - DNA, 16 bp, Homo sapiens
caagcaacagcacttt

SEQ ID NO: 1818961 - DNA, 17 bp, Homo sapiens
caagcaaggatatcaga

SEQ ID NO: 1818962 - DNA, 18 bp, Homo sapiens
caagcagatctcatctca

SEQ ID NO: 1818963 - DNA, 15 bp, Homo sapiens
caagcagccagccag

SEQ ID NO: 1818964 - DNA, 16 bp, Homo sapiens
caagcagccagccagt

SEQ ID NO: 1818965 - DNA, 17 bp, Homo sapiens
caagcagccagccagtc

SEQ ID NO: 1818966 - DNA, 22 bp, Homo sapiens
caagcagccagccagtcttgcc

SEQ ID NO: 1818967 - DNA, 17 bp, Homo sapiens
caagccccagggcctgg

SEQ ID NO: 1818968 - DNA, 17 bp, Homo sapiens
caagcccctcagccctt

SEQ ID NO: 1818969 - DNA, 10 bp, Homo sapiens
caagccctgg

SEQ ID NO: 1818970 - DNA, 12 bp, Homo sapiens
caagccctggca

SEQ ID NO: 1818971 - DNA, 17 bp, Homo sapiens
caagccttggctctacc

SEQ ID NO: 1818972 - DNA, 14 bp, Homo sapiens
caagcgagcacagt

SEQ ID NO: 1818973 - DNA, 12 bp, Homo sapiens
caagctgtcccc

SEQ ID NO: 1818974 - DNA, 16 bp, Homo sapiens
caagctgtcccctctg

SEQ ID NO: 1818975 - DNA, 18 bp, Homo sapiens
cagaacgcaccccactgg

SEQ ID NO: 1818976 - DNA, 13 bp, Homo sapiens
cagaatctgctgt

SEQ ID NO: 1818977 - DNA, 11 bp, Homo sapiens
cagaatgaatc

SEQ ID NO: 1818978 - DNA, 13 bp, Homo sapiens
cagaatttataga

SEQ ID NO: 1818979 - DNA, 13 bp, Homo sapiens
cagacaggccctc

SEQ ID NO: 1818980 - DNA, 18 bp, Homo sapiens
cagacaggccctccctgt

SEQ ID NO: 1818981 - DNA, 14 bp, Homo sapiens
cagacttctggaag

SEQ ID NO: 1818982 - DNA, 22 bp, Homo sapiens
cagagaaagaaagggaaactgg

SEQ ID NO: 1818983 - DNA, 15 bp, Homo sapiens
cagagaaggcagcag

SEQ ID NO: 1818984 - DNA, 18 bp, Homo sapiens
cagagaaggcctcttgtg

SEQ ID NO: 1818985 - DNA, 19 bp, Homo sapiens
cagagaaggcctcttgtgc

SEQ ID NO: 1818986 - DNA, 21 bp, Homo sapiens
cagagaaggcctcttgtgctc

SEQ ID NO: 1818987 - DNA, 16 bp, Homo sapiens
cagagaggagcacctg

SEQ ID NO: 1818988 - DNA, 13 bp, Homo sapiens
cagagagggccca

SEQ ID NO: 1818989 - DNA, 15 bp, Homo sapiens
cagagagggcccagc

SEQ ID NO: 1818990 - DNA, 18 bp, Homo sapiens
cagagagggcccagctgt

SEQ ID NO: 1818991 - DNA, 22 bp, Homo sapiens
cagagagggcccagctgtagcc

SEQ ID NO: 1818992 - DNA, 23 bp, Homo sapiens
cagagagggcccagctgtagcca

SEQ ID NO: 1818993 - DNA, 19 bp, Homo sapiens
cagagcaaatgagggaggg

SEQ ID NO: 1818994 - DNA, 17 bp, Homo sapiens
cagagccagcctgggac

SEQ ID NO: 1818995 - DNA, 11 bp, Homo sapiens
cagagccatgg

SEQ ID NO: 1818996 - DNA, 14 bp, Homo sapiens
cagagccatgggcc

SEQ ID NO: 1818997 - DNA, 20 bp, Homo sapiens
cagagccatgggcctgggcc

SEQ ID NO: 1818998 - DNA, 14 bp, Homo sapiens
cagagctggaacac

SEQ ID NO: 1818999 - DNA, 16 bp, Homo sapiens
cagagctggaaggcag

SEQ ID NO: 1819000 - DNA, 19 bp, Homo sapiens
cagagctggaaggcagggc

SEQ ID NO: 1819001 - DNA, 11 bp, Homo sapiens
cagagctgggc

SEQ ID NO: 1819002 - DNA, 15 bp, Homo sapiens
cagaggaccacagtg

SEQ ID NO: 1819003 - DNA, 17 bp, Homo sapiens
cagagggaatgttccct

SEQ ID NO: 1819004 - DNA, 23 bp, Homo sapiens
cagagggaatgttccctgcaccc

SEQ ID NO: 1819005 - DNA, 21 bp, Homo sapiens
cagagggaccaaattgcttct

SEQ ID NO: 1819006 - DNA, 22 bp, Homo sapiens
cagagggaccaaattgcttcta

SEQ ID NO: 1819007 - DNA, 23 bp, Homo sapiens
cagagggaccaaattgcttctag

SEQ ID NO: 1819008 - DNA, 18 bp, Homo sapiens
cagaggggcagccgctag

SEQ ID NO: 1819009 - DNA, 19 bp, Homo sapiens
cagaggggcaggccctgca

SEQ ID NO: 1819010 - DNA, 21 bp, Homo sapiens
cagaggttatctgcctggcct

SEQ ID NO: 1819011 - DNA, 12 bp, Homo sapiens
cagagtctgagc

SEQ ID NO: 1819012 - DNA, 17 bp, Homo sapiens
cagagttggtgttcata

SEQ ID NO: 1819013 - DNA, 13 bp, Homo sapiens
cagatcatctggg

SEQ ID NO: 1819014 - DNA, 23 bp, Homo sapiens
cagatcattatcagcctgtgcca

SEQ ID NO: 1819015 - DNA, 13 bp, Homo sapiens
cagatctgcctgg

SEQ ID NO: 1819016 - DNA, 14 bp, Homo sapiens
cagatctgcctggg

SEQ ID NO: 1819017 - DNA, 16 bp, Homo sapiens
cagatctgcctgggcc

SEQ ID NO: 1819018 - DNA, 18 bp, Homo sapiens
cagatctgcctgggcctg

SEQ ID NO: 1819019 - DNA, 12 bp, Homo sapiens
cagatttcaaat

SEQ ID NO: 1819020 - DNA, 19 bp, Homo sapiens
cagcaaggaggctggctgg

SEQ ID NO: 1819021 - DNA, 15 bp, Homo sapiens
cagcaaggcacctgc

SEQ ID NO: 1819022 - DNA, 23 bp, Homo sapiens
cagcaaggcacctgcaggttggg

SEQ ID NO: 1819023 - DNA, 12 bp, Homo sapiens
cagcaaggggct

SEQ ID NO: 1819024 - DNA, 14 bp, Homo sapiens
cagcaaggggctct

SEQ ID NO: 1819025 - DNA, 20 bp, Homo sapiens
cagcaaggggctctgccctc

SEQ ID NO: 1819026 - DNA, 18 bp, Homo sapiens
cagcacaggggccccaga

SEQ ID NO: 1819027 - DNA, 11 bp, Homo sapiens
cagcaccctgg

SEQ ID NO: 1819028 - DNA, 17 bp, Homo sapiens
cagcacgtgtggcctgt

SEQ ID NO: 1819029 - DNA, 17 bp, Homo sapiens
cagcagagagccctggg

SEQ ID NO: 1819030 - DNA, 18 bp, Homo sapiens
cagcagcagagagccctg

SEQ ID NO: 1819031 - DNA, 19 bp, Homo sapiens
cagcagcccagcttcctgg

SEQ ID NO: 1819032 - DNA, 21 bp, Homo sapiens
cagcagcccagcttcctggtg

SEQ ID NO: 1819033 - DNA, 16 bp, Homo sapiens
cagcagccccctgccc

SEQ ID NO: 1819034 - DNA, 15 bp, Homo sapiens
cagcagctaggactg

SEQ ID NO: 1819035 - DNA, 11 bp, Homo sapiens
cagcagctgcg

SEQ ID NO: 1819036 - DNA, 17 bp, Homo sapiens
cagcagctgcgggtctg

SEQ ID NO: 1819037 - DNA, 22 bp, Homo sapiens
cagcagctgcgggtctgaagga

SEQ ID NO: 1819038 - DNA, 23 bp, Homo sapiens
cagcaggcggcctttgttgctca

SEQ ID NO: 1819039 - DNA, 17 bp, Homo sapiens
cagcaggtgtggtggct

SEQ ID NO: 1819040 - DNA, 21 bp, Homo sapiens
cagcaggtgtggtggctcatg

SEQ ID NO: 1819041 - DNA, 15 bp, Homo sapiens
cagcatccagcctgt

SEQ ID NO: 1819042 - DNA, 16 bp, Homo sapiens
cagcatccagcctgtg

SEQ ID NO: 1819043 - DNA, 21 bp, Homo sapiens
cagccagtcttgcctaggcca

SEQ ID NO: 1819044 - DNA, 23 bp, Homo sapiens
cagccagtcttgcctaggccaaa

SEQ ID NO: 1819045 - DNA, 11 bp, Homo sapiens
cagccatgcct

SEQ ID NO: 1819046 - DNA, 12 bp, Homo sapiens
cagccatgcctc

SEQ ID NO: 1819047 - DNA, 16 bp, Homo sapiens
cagcccacgtcctgtc

SEQ ID NO: 1819048 - DNA, 18 bp, Homo sapiens
cagcccacgtcctgtcag

SEQ ID NO: 1819049 - DNA, 19 bp, Homo sapiens
cagcccacgtcctgtcagt

SEQ ID NO: 1819050 - DNA, 16 bp, Homo sapiens
cagcccagcttcctgg

SEQ ID NO: 1819051 - DNA, 21 bp, Homo sapiens
cagccccaactccaggggcac

SEQ ID NO: 1819052 - DNA, 22 bp, Homo sapiens
cagccccctggatgggcattgg

SEQ ID NO: 1819053 - DNA, 18 bp, Homo sapiens
cagcccgtgaagcagtgc

SEQ ID NO: 1819054 - DNA, 20 bp, Homo sapiens
cagcccgtgaagcagtgcct

SEQ ID NO: 1819055 - DNA, 12 bp, Homo sapiens
cagcccttccct

SEQ ID NO: 1819056 - DNA, 15 bp, Homo sapiens
cagcccttctgcctt

SEQ ID NO: 1819057 - DNA, 16 bp, Homo sapiens
cagcccttctgccttt

SEQ ID NO: 1819058 - DNA, 18 bp, Homo sapiens
cagcccttctgcctttct

SEQ ID NO: 1819059 - DNA, 12 bp, Homo sapiens
cagcccttgccc

SEQ ID NO: 1819060 - DNA, 15 bp, Homo sapiens
cagcccttgccccca

SEQ ID NO: 1819061 - DNA, 17 bp, Homo sapiens
cagccctttgcaggccc

SEQ ID NO: 1819062 - DNA, 17 bp, Homo sapiens
cagccgcaggaaggcag

SEQ ID NO: 1819063 - DNA, 16 bp, Homo sapiens
cagccgctgcccggcg

SEQ ID NO: 1819064 - DNA, 22 bp, Homo sapiens
cagccgctgcccggcgccctct

SEQ ID NO: 1819065 - DNA, 21 bp, Homo sapiens
cagcctacactattctagcag

SEQ ID NO: 1819066 - DNA, 17 bp, Homo sapiens
cagcctccagagccagc

SEQ ID NO: 1819067 - DNA, 20 bp, Homo sapiens
cagcctccagagccagcctg

SEQ ID NO: 1819068 - DNA, 11 bp, Homo sapiens
cagcctcccct

SEQ ID NO: 1819069 - DNA, 13 bp, Homo sapiens
cagcctcccctcc

SEQ ID NO: 1819070 - DNA, 19 bp, Homo sapiens
cagcctcccctcccctggg

SEQ ID NO: 1819071 - DNA, 21 bp, Homo sapiens
cagcctcccctcccctgggga

SEQ ID NO: 1819072 - DNA, 22 bp, Homo sapiens
cagcctcccctcccctggggac

SEQ ID NO: 1819073 - DNA, 14 bp, Homo sapiens
cagcctctcccggc

SEQ ID NO: 1819074 - DNA, 21 bp, Homo sapiens
cagcctctcccggctgcctgc

SEQ ID NO: 1819075 - DNA, 11 bp, Homo sapiens
cagcctggccc

SEQ ID NO: 1819076 - DNA, 19 bp, Homo sapiens
cagcctggcccagctcccc

SEQ ID NO: 1819077 - DNA, 20 bp, Homo sapiens
cagcctggcccagctccccc

SEQ ID NO: 1819078 - DNA, 17 bp, Homo sapiens
cagcctgggactcccag

SEQ ID NO: 1819079 - DNA, 20 bp, Homo sapiens
cagcgattattgatcaaaat

SEQ ID NO: 1819080 - DNA, 15 bp, Homo sapiens
cagctaagcctgatg

SEQ ID NO: 1819081 - DNA, 15 bp, Homo sapiens
cagctactctgtcca

SEQ ID NO: 1819082 - DNA, 22 bp, Homo sapiens
cagctactctgtccaggccact

SEQ ID NO: 1819083 - DNA, 16 bp, Homo sapiens
cagctagactggagtg

SEQ ID NO: 1819084 - DNA, 14 bp, Homo sapiens
cagctagcttgaaa

SEQ ID NO: 1819085 - DNA, 19 bp, Homo sapiens
cagctccttttgtccccag

SEQ ID NO: 1819086 - DNA, 21 bp, Homo sapiens
cagctccttttgtccccaggg

SEQ ID NO: 1819087 - DNA, 22 bp, Homo sapiens
cagctccttttgtccccagggc

SEQ ID NO: 1819088 - DNA, 14 bp, Homo sapiens
cagctctgtggcct

SEQ ID NO: 1819089 - DNA, 22 bp, Homo sapiens
cagctctgtggcctgtgtccag

SEQ ID NO: 1819090 - DNA, 22 bp, Homo sapiens
cagctgaaacattccgaagagg

SEQ ID NO: 1819091 - DNA, 15 bp, Homo sapiens
cagctgacagtcctc

SEQ ID NO: 1819092 - DNA, 22 bp, Homo sapiens
aacttaacaattaattttctat

SEQ ID NO: 1819093 - DNA, 19 bp, Homo sapiens
aacttacacttggagcccg

SEQ ID NO: 1819094 - DNA, 14 bp, Homo sapiens
aacttgctgaaaaa

SEQ ID NO: 1819095 - DNA, 13 bp, Homo sapiens
aacttgcttctaa

SEQ ID NO: 1819096 - DNA, 17 bp, Homo sapiens
aacttgtgtttatggca

SEQ ID NO: 1819097 - DNA, 15 bp, Homo sapiens
aagaaaaaaatgatt

SEQ ID NO: 1819098 - DNA, 11 bp, Homo sapiens
aagaaaaatat

SEQ ID NO: 1819099 - DNA, 12 bp, Homo sapiens
aagaaaaatata

SEQ ID NO: 1819100 - DNA, 20 bp, Homo sapiens
aagaaaaatataaaaacaac

SEQ ID NO: 1819101 - DNA, 22 bp, Homo sapiens
aagaaaacacaacattttaata

SEQ ID NO: 1819102 - DNA, 14 bp, Homo sapiens
aagaaaacttccaa

SEQ ID NO: 1819103 - DNA, 17 bp, Homo sapiens
aagacccagtgtaaaga

SEQ ID NO: 1819104 - DNA, 14 bp, Homo sapiens
aagagcacagccct

SEQ ID NO: 1819105 - DNA, 19 bp, Homo sapiens
aagagcagcctgatggcca

SEQ ID NO: 1819106 - DNA, 21 bp, Homo sapiens
aagagccatgtgtcatgtaat

SEQ ID NO: 1819107 - DNA, 17 bp, Homo sapiens
aagaggatgatttcaga

SEQ ID NO: 1819108 - DNA, 21 bp, Homo sapiens
aagatggagttgtattttgac

SEQ ID NO: 1819109 - DNA, 14 bp, Homo sapiens
aagatgtttatctg

SEQ ID NO: 1819110 - DNA, 18 bp, Homo sapiens
aagatgtttatctgacac

SEQ ID NO: 1819111 - DNA, 14 bp, Homo sapiens
aagattatatatca

SEQ ID NO: 1819112 - DNA, 15 bp, Homo sapiens
aagattatatatcat

SEQ ID NO: 1819113 - DNA, 15 bp, Homo sapiens
aagcaaaatttctgt

SEQ ID NO: 1819114 - DNA, 13 bp, Homo sapiens
aagcaaatgcttt

SEQ ID NO: 1819115 - DNA, 12 bp, Homo sapiens
aagcaacagcac

SEQ ID NO: 1819116 - DNA, 16 bp, Homo sapiens
aagcaacttgcttcta

SEQ ID NO: 1819117 - DNA, 17 bp, Homo sapiens
aagcaagggctccagca

SEQ ID NO: 1819118 - DNA, 22 bp, Homo sapiens
aagcactttacgctgtctgtaa

SEQ ID NO: 1819119 - DNA, 22 bp, Homo sapiens
aagcagacgtgagtgtgacttt

SEQ ID NO: 1819120 - DNA, 21 bp, Homo sapiens
aagcagaggctttggggtcct

SEQ ID NO: 1819121 - DNA, 13 bp, Homo sapiens
aagcagccagcca

SEQ ID NO: 1819122 - DNA, 21 bp, Homo sapiens
aagcaggaggaggtgccaaca

SEQ ID NO: 1819123 - DNA, 16 bp, Homo sapiens
aagccccagggcctgg

SEQ ID NO: 1819124 - DNA, 12 bp, Homo sapiens
aagcccctcagc

SEQ ID NO: 1819125 - DNA, 15 bp, Homo sapiens
aagcccctcagccct

SEQ ID NO: 1819126 - DNA, 21 bp, Homo sapiens
aagccctcgaaccaaggcagc

SEQ ID NO: 1819127 - DNA, 14 bp, Homo sapiens
aagccctggcaaca

SEQ ID NO: 1819128 - DNA, 16 bp, Homo sapiens
aagccgtctgactcca

SEQ ID NO: 1819129 - DNA, 14 bp, Homo sapiens
aagcctcctgcccc

SEQ ID NO: 1819130 - DNA, 16 bp, Homo sapiens
aagcctcctgccccct

SEQ ID NO: 1819131 - DNA, 18 bp, Homo sapiens
aagcctctgtgtcactgg

SEQ ID NO: 1819132 - DNA, 15 bp, Homo sapiens
aagcgagcacagtat

SEQ ID NO: 1819133 - DNA, 23 bp, Homo sapiens
aagctccacggtgcgtggctgtg

SEQ ID NO: 1819134 - DNA, 20 bp, Homo sapiens
aagctggacaagaagctgct

SEQ ID NO: 1819135 - DNA, 18 bp, Homo sapiens
aagctgtactcagagcag

SEQ ID NO: 1819136 - DNA, 14 bp, Homo sapiens
aagctgtgccaccc

SEQ ID NO: 1819137 - DNA, 22 bp, Homo sapiens
aaggaaaaaagaaaaaaaattt

SEQ ID NO: 1819138 - DNA, 17 bp, Homo sapiens
aaggacaacctgcccct

SEQ ID NO: 1819139 - DNA, 18 bp, Homo sapiens
aaggacccacccatcttc

SEQ ID NO: 1819140 - DNA, 15 bp, Homo sapiens
aaggcactgtgaact

SEQ ID NO: 1819141 - DNA, 20 bp, Homo sapiens
aaggcagcctccagagccag

SEQ ID NO: 1819142 - DNA, 23 bp, Homo sapiens
aaggcaggtagatcgcttgagcc

SEQ ID NO: 1819143 - DNA, 15 bp, Homo sapiens
aaggccatattttaa

SEQ ID NO: 1819144 - DNA, 23 bp, Homo sapiens
aaggctatggggatagatgtgtg

SEQ ID NO: 1819145 - DNA, 17 bp, Homo sapiens
aaggctctcccctctcg

SEQ ID NO: 1819146 - DNA, 12 bp, Homo sapiens
aaggctggctga

SEQ ID NO: 1819147 - DNA, 13 bp, Homo sapiens
acagccctgggag

SEQ ID NO: 1819148 - DNA, 23 bp, Homo sapiens
acagctcctcttaccgtagcctc

SEQ ID NO: 1819149 - DNA, 16 bp, Homo sapiens
acagctgcagctgggc

SEQ ID NO: 1819150 - DNA, 18 bp, Homo sapiens
acagctgcagctgggccc

SEQ ID NO: 1819151 - DNA, 17 bp, Homo sapiens
acagggacacagtctgg

SEQ ID NO: 1819152 - DNA, 14 bp, Homo sapiens
acaggggcaggcct

SEQ ID NO: 1819153 - DNA, 15 bp, Homo sapiens
acagtatcttcaaaa

SEQ ID NO: 1819154 - DNA, 18 bp, Homo sapiens
acagtatcttcaaaaata

SEQ ID NO: 1819155 - DNA, 22 bp, Homo sapiens
acagtatcttcaaaaatacaga

SEQ ID NO: 1819156 - DNA, 20 bp, Homo sapiens
acagtgactcgggctcctgt

SEQ ID NO: 1819157 - DNA, 17 bp, Homo sapiens
acagtgcccagctaatt

SEQ ID NO: 1819158 - DNA, 17 bp, Homo sapiens
acagtgggtggcacctc

SEQ ID NO: 1819159 - DNA, 16 bp, Homo sapiens
acagtgtctgggctga

SEQ ID NO: 1819160 - DNA, 19 bp, Homo sapiens
acagtgttaggcctggcac

SEQ ID NO: 1819161 - DNA, 23 bp, Homo sapiens
acagttgtctattctgagccttg

SEQ ID NO: 1819162 - DNA, 14 bp, Homo sapiens
acatataaaagtta

SEQ ID NO: 1819163 - DNA, 16 bp, Homo sapiens
acatatgatactgatg

SEQ ID NO: 1819164 - DNA, 20 bp, Homo sapiens
acatcattcattcactgtat

SEQ ID NO: 1819165 - DNA, 24 bp, Homo sapiens
acatcattcattcactgtatagta

SEQ ID NO: 1819166 - DNA, 13 bp, Homo sapiens
acatcctcattca

SEQ ID NO: 1819167 - DNA, 13 bp, Homo sapiens
acatcttcattaa

SEQ ID NO: 1819168 - DNA, 19 bp, Homo sapiens
acatcttcattaatactgt

SEQ ID NO: 1819169 - DNA, 14 bp, Homo sapiens
acatgacgtaaaat

SEQ ID NO: 1819170 - DNA, 21 bp, Homo sapiens
acatgtccagtgggaggtgag

SEQ ID NO: 1819171 - DNA, 15 bp, Homo sapiens
acattatattcctct

SEQ ID NO: 1819172 - DNA, 23 bp, Homo sapiens
acattatgttattggaattttct

SEQ ID NO: 1819173 - DNA, 15 bp, Homo sapiens
acattttatatgtga

SEQ ID NO: 1819174 - DNA, 17 bp, Homo sapiens
acattttattacactaa

SEQ ID NO: 1819175 - DNA, 22 bp, Homo sapiens
accaaactgcacacacagctcc

SEQ ID NO: 1819176 - DNA, 21 bp, Homo sapiens
accaaatgagcattagctact

SEQ ID NO: 1819177 - DNA, 20 bp, Homo sapiens
accaagctgtgccaccctgg

SEQ ID NO: 1819178 - DNA, 18 bp, Homo sapiens
accaaggcagcctccaga

SEQ ID NO: 1819179 - DNA, 14 bp, Homo sapiens
accacgtctgccag

SEQ ID NO: 1819180 - DNA, 15 bp, Homo sapiens
accacgtctgccagg

SEQ ID NO: 1819181 - DNA, 16 bp, Homo sapiens
accacgtctgccaggc

SEQ ID NO: 1819182 - DNA, 19 bp, Homo sapiens
accacgtctgccaggccca

SEQ ID NO: 1819183 - DNA, 22 bp, Homo sapiens
accacgtctgccaggcccatct

SEQ ID NO: 1819184 - DNA, 15 bp, Homo sapiens
accactgccctgcct

SEQ ID NO: 1819185 - DNA, 16 bp, Homo sapiens
accactgccctgcctg

SEQ ID NO: 1819186 - DNA, 22 bp, Homo sapiens
accactgccctgcctgcccact

SEQ ID NO: 1819187 - DNA, 13 bp, Homo sapiens
accactttgatat

SEQ ID NO: 1819188 - DNA, 16 bp, Homo sapiens
accagaaacagggaca

SEQ ID NO: 1819189 - DNA, 18 bp, Homo sapiens
accagagctggaacacaa

SEQ ID NO: 1819190 - DNA, 16 bp, Homo sapiens
accagccccctggatg

SEQ ID NO: 1819191 - DNA, 21 bp, Homo sapiens
accagccccctggatgggcat

SEQ ID NO: 1819192 - DNA, 20 bp, Homo sapiens
accagctctgtggcctgtgt

SEQ ID NO: 1819193 - DNA, 14 bp, Homo sapiens
accagctgctctgc

SEQ ID NO: 1819194 - DNA, 18 bp, Homo sapiens
accagctgctctgcccct

SEQ ID NO: 1819195 - DNA, 19 bp, Homo sapiens
accagctgctctgcccctt

SEQ ID NO: 1819196 - DNA, 16 bp, Homo sapiens
accagggaggagagga

SEQ ID NO: 1819197 - DNA, 18 bp, Homo sapiens
accaggggcaggcacagc

SEQ ID NO: 1819198 - DNA, 20 bp, Homo sapiens
accaggtctcctccaccgcc

SEQ ID NO: 1819199 - DNA, 17 bp, Homo sapiens
accattggctgcgctaa

SEQ ID NO: 1819200 - DNA, 14 bp, Homo sapiens
acccacccatcttc

SEQ ID NO: 1819201 - DNA, 15 bp, Homo sapiens
acccactcaccaggg

SEQ ID NO: 1819202 - DNA, 20 bp, Homo sapiens
acccactgctgaaaaagaaa

SEQ ID NO: 1819203 - DNA, 17 bp, Homo sapiens
acccagatcgctgtgtt

SEQ ID NO: 1819204 - DNA, 21 bp, Homo sapiens
acccagctactctgtccaggc

SEQ ID NO: 1819205 - DNA, 22 bp, Homo sapiens
acccagctatggttctctcgca

SEQ ID NO: 1819206 - DNA, 11 bp, Homo sapiens
acccagctcct

SEQ ID NO: 1819207 - DNA, 21 bp, Homo sapiens
acccagctccttttgtcccca

SEQ ID NO: 1819208 - DNA, 11 bp, Homo sapiens
aaaaaagtata

SEQ ID NO: 1819209 - DNA, 12 bp, Homo sapiens
aaaaaatcaaaa

SEQ ID NO: 1819210 - DNA, 13 bp, Homo sapiens
aaaaagtatatat

SEQ ID NO: 1819211 - DNA, 15 bp, Homo sapiens
aaaaatggtgcctga

SEQ ID NO: 1819212 - DNA, 21 bp, Homo sapiens
aaaaatgttcccttgaccatt

SEQ ID NO: 1819213 - DNA, 14 bp, Homo sapiens
aaaacacaacattt

SEQ ID NO: 1819214 - DNA, 15 bp, Homo sapiens
aaaacacaacttgtg

SEQ ID NO: 1819215 - DNA, 15 bp, Homo sapiens
aaaacatacttcaaa

SEQ ID NO: 1819216 - DNA, 23 bp, Homo sapiens
aaaactatacttgtactccttaa

SEQ ID NO: 1819217 - DNA, 19 bp, Homo sapiens
aaaacttgctgaaaaacac

SEQ ID NO: 1819218 - DNA, 21 bp, Homo sapiens
aaaacttgctgaaaaacacaa

SEQ ID NO: 1819219 - DNA, 19 bp, Homo sapiens
aaaagaccctgagactcca

SEQ ID NO: 1819220 - DNA, 19 bp, Homo sapiens
aaaagaggatgatttcaga

SEQ ID NO: 1819221 - DNA, 20 bp, Homo sapiens
aaaagaggatgatttcagaa

SEQ ID NO: 1819222 - DNA, 15 bp, Homo sapiens
aaaagattatatatc

SEQ ID NO: 1819223 - DNA, 23 bp, Homo sapiens
aaaagattatatatcataaagta

SEQ ID NO: 1819224 - DNA, 16 bp, Homo sapiens
aaaagccaagaaagta

SEQ ID NO: 1819225 - DNA, 14 bp, Homo sapiens
aaaagcctctgtgt

SEQ ID NO: 1819226 - DNA, 14 bp, Homo sapiens
aaaataaagctgtg

SEQ ID NO: 1819227 - DNA, 14 bp, Homo sapiens
aaaataagtatttc

SEQ ID NO: 1819228 - DNA, 11 bp, Homo sapiens
aaaatagtaat

SEQ ID NO: 1819229 - DNA, 19 bp, Homo sapiens
aaaatcaaaaggtaatgca

SEQ ID NO: 1819230 - DNA, 13 bp, Homo sapiens
aaaatcatgttaa

SEQ ID NO: 1819231 - DNA, 18 bp, Homo sapiens
aaaatgaaggaattacat

SEQ ID NO: 1819232 - DNA, 14 bp, Homo sapiens
aaaatgcatatttc

SEQ ID NO: 1819233 - DNA, 19 bp, Homo sapiens
aaaatgcatatttctatgt

SEQ ID NO: 1819234 - DNA, 21 bp, Homo sapiens
aaaatttctgcttttgcatct

SEQ ID NO: 1819235 - DNA, 20 bp, Homo sapiens
aaacacaaatgtaaaataag

SEQ ID NO: 1819236 - DNA, 15 bp, Homo sapiens
aaacacaacttgtgt

SEQ ID NO: 1819237 - DNA, 17 bp, Homo sapiens
aaacagggacaaagaaa

SEQ ID NO: 1819238 - DNA, 15 bp, Homo sapiens
aaacattcctccagc

SEQ ID NO: 1819239 - DNA, 22 bp, Homo sapiens
aaacatttgtaaaaatactgtt

SEQ ID NO: 1819240 - DNA, 15 bp, Homo sapiens
aaaccccagccccaa

SEQ ID NO: 1819241 - DNA, 18 bp, Homo sapiens
aaaccccagccccaactc

SEQ ID NO: 1819242 - DNA, 20 bp, Homo sapiens
aaacctctaatttattttgt

SEQ ID NO: 1819243 - DNA, 18 bp, Homo sapiens
aaactatatttatttatg

SEQ ID NO: 1819244 - DNA, 21 bp, Homo sapiens
aaactgatggaccgggtgggc

SEQ ID NO: 1819245 - DNA, 14 bp, Homo sapiens
aaactgctgttaat

SEQ ID NO: 1819246 - DNA, 15 bp, Homo sapiens
aaactggatactgta

SEQ ID NO: 1819247 - DNA, 17 bp, Homo sapiens
aaactggatactgtact

SEQ ID NO: 1819248 - DNA, 18 bp, Homo sapiens
aaacttattaacaactgt

SEQ ID NO: 1819249 - DNA, 22 bp, Homo sapiens
aaacttattaacaactgtgaat

SEQ ID NO: 1819250 - DNA, 17 bp, Homo sapiens
aaacttggttccattgt

SEQ ID NO: 1819251 - DNA, 17 bp, Homo sapiens
aaagagccagaagttga

SEQ ID NO: 1819252 - DNA, 12 bp, Homo sapiens
aaagagccatgt

SEQ ID NO: 1819253 - DNA, 21 bp, Homo sapiens
aaagagccatgtgtcatgtaa

SEQ ID NO: 1819254 - DNA, 16 bp, Homo sapiens
aaagaggagaccctgg

SEQ ID NO: 1819255 - DNA, 14 bp, Homo sapiens
aaagaggatgattt

SEQ ID NO: 1819256 - DNA, 19 bp, Homo sapiens
aaagaggatgatttcagaa

SEQ ID NO: 1819257 - DNA, 17 bp, Homo sapiens
aaagattatatatcata

SEQ ID NO: 1819258 - DNA, 22 bp, Homo sapiens
aaagattatatatcataaagta

SEQ ID NO: 1819259 - DNA, 19 bp, Homo sapiens
aaagcaaaagaagtaaaag

SEQ ID NO: 1819260 - DNA, 17 bp, Homo sapiens
aaagcaagggctccagc

SEQ ID NO: 1819261 - DNA, 20 bp, Homo sapiens
aaagcaagggctccagcatc

SEQ ID NO: 1819262 - DNA, 17 bp, Homo sapiens
aaagcaattgccctgta

SEQ ID NO: 1819263 - DNA, 15 bp, Homo sapiens
aaagccacattttgc

SEQ ID NO: 1819264 - DNA, 21 bp, Homo sapiens
aaagcctcctgccccctgcca

SEQ ID NO: 1819265 - DNA, 13 bp, Homo sapiens
aaagcctctgtgt

SEQ ID NO: 1819266 - DNA, 24 bp, Homo sapiens
aaagcctctgtgtcactggctgcc

SEQ ID NO: 1819267 - DNA, 15 bp, Homo sapiens
aaagcgggcagcccc

SEQ ID NO: 1819268 - DNA, 18 bp, Homo sapiens
aaagctctgaacaaaagc

SEQ ID NO: 1819269 - DNA, 23 bp, Homo sapiens
aaagctgctgagaatctagcctc

SEQ ID NO: 1819270 - DNA, 18 bp, Homo sapiens
aaagctggacaagaagct

SEQ ID NO: 1819271 - DNA, 21 bp, Homo sapiens
aaagctgtgacagttctgttg

SEQ ID NO: 1819272 - DNA, 15 bp, Homo sapiens
aaaggacccacccat

SEQ ID NO: 1819273 - DNA, 11 bp, Homo sapiens
aaaggcctgga

SEQ ID NO: 1819274 - DNA, 15 bp, Homo sapiens
aaagggaaactggct

SEQ ID NO: 1819275 - DNA, 19 bp, Homo sapiens
aaaggggagttgagtcaca

SEQ ID NO: 1819276 - DNA, 19 bp, Homo sapiens
aaaggggctgctggggcat

SEQ ID NO: 1819277 - DNA, 22 bp, Homo sapiens
aaaggtgtaagacttcagattt

SEQ ID NO: 1819278 - DNA, 14 bp, Homo sapiens
aaagtaaagaggaa

SEQ ID NO: 1819279 - DNA, 13 bp, Homo sapiens
aaagtaacacacc

SEQ ID NO: 1819280 - DNA, 20 bp, Homo sapiens
aaagtaggaactcttaagca

SEQ ID NO: 1819281 - DNA, 14 bp, Homo sapiens
aaagtatatattct

SEQ ID NO: 1819282 - DNA, 20 bp, Homo sapiens
aaagtcacatataaaagtta

SEQ ID NO: 1819283 - DNA, 20 bp, Homo sapiens
aaagttaaactacttgtaaa

SEQ ID NO: 1819284 - DNA, 12 bp, Homo sapiens
aaataaaataat

SEQ ID NO: 1819285 - DNA, 15 bp, Homo sapiens
aaatacagaagaaaa

SEQ ID NO: 1819286 - DNA, 17 bp, Homo sapiens
aaatatatagcttgaaa

SEQ ID NO: 1819287 - DNA, 20 bp, Homo sapiens
aaatatgagagaactattgt

SEQ ID NO: 1819288 - DNA, 13 bp, Homo sapiens
aaatattttccaa

SEQ ID NO: 1819289 - DNA, 14 bp, Homo sapiens
aaatcaaaaggtaa

SEQ ID NO: 1819290 - DNA, 14 bp, Homo sapiens
aaatcagtcttgga

SEQ ID NO: 1819291 - DNA, 16 bp, Homo sapiens
aaatcagttatgtcaa

SEQ ID NO: 1819292 - DNA, 14 bp, Homo sapiens
aaatgaatagagag

SEQ ID NO: 1819293 - DNA, 14 bp, Homo sapiens
aaatgacagaccta

SEQ ID NO: 1819294 - DNA, 15 bp, Homo sapiens
aaatgagcattagct

SEQ ID NO: 1819295 - DNA, 22 bp, Homo sapiens
aaatgagcattagctacttttc

SEQ ID NO: 1819296 - DNA, 14 bp, Homo sapiens
aaatgagtctgttt

SEQ ID NO: 1819297 - DNA, 16 bp, Homo sapiens
aaatgcatatttctat

SEQ ID NO: 1819298 - DNA, 11 bp, Homo sapiens
aaatgcccagt

SEQ ID NO: 1819299 - DNA, 16 bp, Homo sapiens
aaatgttaaaccctta

SEQ ID NO: 1819300 - DNA, 17 bp, Homo sapiens
aaatgttcccttgacca

SEQ ID NO: 1819301 - DNA, 20 bp, Homo sapiens
aaatgttcccttgaccattg

SEQ ID NO: 1819302 - DNA, 21 bp, Homo sapiens
aaatgttgcacatcattcatt

SEQ ID NO: 1819303 - DNA, 14 bp, Homo sapiens
aaatgtttgtactt

SEQ ID NO: 1819304 - DNA, 20 bp, Homo sapiens
aaattagaaacaccattcat

SEQ ID NO: 1819305 - DNA, 19 bp, Homo sapiens
aaattcaacctgtgtctta

SEQ ID NO: 1819306 - DNA, 15 bp, Homo sapiens
aaattctcaaaatac

SEQ ID NO: 1819307 - DNA, 15 bp, Homo sapiens
aaattgtgatgtgtc

SEQ ID NO: 1819308 - DNA, 20 bp, Homo sapiens
aaatttctgcttttgcatct

SEQ ID NO: 1819309 - DNA, 23 bp, Homo sapiens
aaatttctgcttttgcatctttg

SEQ ID NO: 1819310 - DNA, 20 bp, Homo sapiens
aaatttttcatctcttcaat

SEQ ID NO: 1819311 - DNA, 15 bp, Homo sapiens
aacaaataaactagt

SEQ ID NO: 1819312 - DNA, 12 bp, Homo sapiens
aacaataattca

SEQ ID NO: 1819313 - DNA, 14 bp, Homo sapiens
aacaataattcatc

SEQ ID NO: 1819314 - DNA, 14 bp, Homo sapiens
aacacaaatgtaaa

SEQ ID NO: 1819315 - DNA, 14 bp, Homo sapiens
aacacaacatttta

SEQ ID NO: 1819316 - DNA, 14 bp, Homo sapiens
aacacagatattgt

SEQ ID NO: 1819317 - DNA, 19 bp, Homo sapiens
aacagatttctaagttaaa

SEQ ID NO: 1819318 - DNA, 16 bp, Homo sapiens
aacagcactttctgta

SEQ ID NO: 1819319 - DNA, 23 bp, Homo sapiens
aacagtgttaggcctggcacagt

SEQ ID NO: 1819320 - DNA, 17 bp, Homo sapiens
aacatcctgctttgatt

SEQ ID NO: 1819321 - DNA, 14 bp, Homo sapiens
aacatgcaacaaaa

SEQ ID NO: 1819322 - DNA, 22 bp, Homo sapiens
aacattcctccagcctcccctc

SEQ ID NO: 1819323 - DNA, 21 bp, Homo sapiens
accaaggcagcctccagagcc

SEQ ID NO: 1819324 - DNA, 23 bp, Homo sapiens
accaaggcagcctccagagccag

SEQ ID NO: 1819325 - DNA, 24 bp, Homo sapiens
accaaggcagcctccagagccagc

SEQ ID NO: 1819326 - DNA, 18 bp, Homo sapiens
accacagcaaggcacctg

SEQ ID NO: 1819327 - DNA, 15 bp, Homo sapiens
accacagtgggtggc

SEQ ID NO: 1819328 - DNA, 16 bp, Homo sapiens
accacagtgggtggca

SEQ ID NO: 1819329 - DNA, 15 bp, Homo sapiens
accacctctcaatat

SEQ ID NO: 1819330 - DNA, 17 bp, Homo sapiens
accacgtctgccaggcc

SEQ ID NO: 1819331 - DNA, 19 bp, Homo sapiens
accactgccctgcctgccc

SEQ ID NO: 1819332 - DNA, 19 bp, Homo sapiens
accagaacgcaccccactg

SEQ ID NO: 1819333 - DNA, 23 bp, Homo sapiens
accagcaggtgtggtggctcatg

SEQ ID NO: 1819334 - DNA, 13 bp, Homo sapiens
accagccccctgg

SEQ ID NO: 1819335 - DNA, 14 bp, Homo sapiens
accagccccctgga

SEQ ID NO: 1819336 - DNA, 14 bp, Homo sapiens
accagctctgtggc

SEQ ID NO: 1819337 - DNA, 16 bp, Homo sapiens
accagctctgtggcct

SEQ ID NO: 1819338 - DNA, 18 bp, Homo sapiens
accagctctgtggcctgt

SEQ ID NO: 1819339 - DNA, 23 bp, Homo sapiens
accagctctgtggcctgtgtcca

SEQ ID NO: 1819340 - DNA, 15 bp, Homo sapiens
accagctgctctgcc

SEQ ID NO: 1819341 - DNA, 12 bp, Homo sapiens
accaggagacag

SEQ ID NO: 1819342 - DNA, 15 bp, Homo sapiens
accaggggcaggcac

SEQ ID NO: 1819343 - DNA, 20 bp, Homo sapiens
accagggtccgcaccagctg

SEQ ID NO: 1819344 - DNA, 19 bp, Homo sapiens
accaggtctcctccaccgc

SEQ ID NO: 1819345 - DNA, 21 bp, Homo sapiens
accatgctgctttttggcaca

SEQ ID NO: 1819346 - DNA, 23 bp, Homo sapiens
accatgctgctttttggcacagt

SEQ ID NO: 1819347 - DNA, 17 bp, Homo sapiens
acccacccatcttcctg

SEQ ID NO: 1819348 - DNA, 17 bp, Homo sapiens
acccactcaccagggtc

SEQ ID NO: 1819349 - DNA, 18 bp, Homo sapiens
acccactcaccagggtcc

SEQ ID NO: 1819350 - DNA, 18 bp, Homo sapiens
acccagccgctgcccggc

SEQ ID NO: 1819351 - DNA, 17 bp, Homo sapiens
acccagctactctgtcc

SEQ ID NO: 1819352 - DNA, 19 bp, Homo sapiens
acccagctactctgtccag

SEQ ID NO: 1819353 - DNA, 11 bp, Homo sapiens
acccaggaagg

SEQ ID NO: 1819354 - DNA, 21 bp, Homo sapiens
acccaggaagggaaagcgggc

SEQ ID NO: 1819355 - DNA, 12 bp, Homo sapiens
acccaggccctc

SEQ ID NO: 1819356 - DNA, 11 bp, Homo sapiens
acccaggctgc

SEQ ID NO: 1819357 - DNA, 18 bp, Homo sapiens
acccaggctgcactgcag

SEQ ID NO: 1819358 - DNA, 19 bp, Homo sapiens
acccaggctgcactgcagt

SEQ ID NO: 1819359 - DNA, 16 bp, Homo sapiens
acccagtgctgccatg

SEQ ID NO: 1819360 - DNA, 18 bp, Homo sapiens
acccagtgctgccatgcc

SEQ ID NO: 1819361 - DNA, 23 bp, Homo sapiens
acccagtgctgccatgccactgc

SEQ ID NO: 1819362 - DNA, 17 bp, Homo sapiens
acccatcttcctgctgc

SEQ ID NO: 1819363 - DNA, 18 bp, Homo sapiens
acccatcttcctgctgct

SEQ ID NO: 1819364 - DNA, 19 bp, Homo sapiens
acccatcttcctgctgctg

SEQ ID NO: 1819365 - DNA, 13 bp, Homo sapiens
acccatgccatag

SEQ ID NO: 1819366 - DNA, 20 bp, Homo sapiens
acccattcccccatgtggct

SEQ ID NO: 1819367 - DNA, 22 bp, Homo sapiens
acccattcccccatgtggctga

SEQ ID NO: 1819368 - DNA, 20 bp, Homo sapiens
accccaaaccccagccccaa

SEQ ID NO: 1819369 - DNA, 14 bp, Homo sapiens
accccatctgccca

SEQ ID NO: 1819370 - DNA, 15 bp, Homo sapiens
accccatctgcccag

SEQ ID NO: 1819371 - DNA, 17 bp, Homo sapiens
accccatctgcccagga

SEQ ID NO: 1819372 - DNA, 17 bp, Homo sapiens
accccatgggcttggac

SEQ ID NO: 1819373 - DNA, 22 bp, Homo sapiens
acccccagcacccgggctcagg

SEQ ID NO: 1819374 - DNA, 18 bp, Homo sapiens
acccccagcccacagagc

SEQ ID NO: 1819375 - DNA, 20 bp, Homo sapiens
acccccagcccacagagcct

SEQ ID NO: 1819376 - DNA, 21 bp, Homo sapiens
acccccatgctgccttcaggg

SEQ ID NO: 1819377 - DNA, 16 bp, Homo sapiens
acccccgcccaggctg

SEQ ID NO: 1819378 - DNA, 13 bp, Homo sapiens
accccctcctgct

SEQ ID NO: 1819379 - DNA, 12 bp, Homo sapiens
accccgcagccc

SEQ ID NO: 1819380 - DNA, 14 bp, Homo sapiens
accccgcagcccgt

SEQ ID NO: 1819381 - DNA, 17 bp, Homo sapiens
accccgcggtgctctgg

SEQ ID NO: 1819382 - DNA, 21 bp, Homo sapiens
accccgcggtgctctggcggc

SEQ ID NO: 1819383 - DNA, 22 bp, Homo sapiens
accccgcggtgctctggcggct

SEQ ID NO: 1819384 - DNA, 12 bp, Homo sapiens
acccctcccagc

SEQ ID NO: 1819385 - DNA, 13 bp, Homo sapiens
acccctcccagct

SEQ ID NO: 1819386 - DNA, 16 bp, Homo sapiens
acccctcccagctgac

SEQ ID NO: 1819387 - DNA, 12 bp, Homo sapiens
acccctgtaccc

SEQ ID NO: 1819388 - DNA, 16 bp, Homo sapiens
acccctgtacccagct

SEQ ID NO: 1819389 - DNA, 18 bp, Homo sapiens
acccctgtacccagctcc

SEQ ID NO: 1819390 - DNA, 13 bp, Homo sapiens
acccgggctcagg

SEQ ID NO: 1819391 - DNA, 23 bp, Homo sapiens
acccgggctcagggaccacagca

SEQ ID NO: 1819392 - DNA, 11 bp, Homo sapiens
accctccctgc

SEQ ID NO: 1819393 - DNA, 12 bp, Homo sapiens
accctccctgct

SEQ ID NO: 1819394 - DNA, 17 bp, Homo sapiens
accctcgtggacacctg

SEQ ID NO: 1819395 - DNA, 18 bp, Homo sapiens
accctcgtggacacctgc

SEQ ID NO: 1819396 - DNA, 19 bp, Homo sapiens
accctcgtggacacctgcc

SEQ ID NO: 1819397 - DNA, 15 bp, Homo sapiens
accctgagactccag

SEQ ID NO: 1819398 - DNA, 17 bp, Homo sapiens
accctgagactccagaa

SEQ ID NO: 1819399 - DNA, 22 bp, Homo sapiens
accctggaattcagcaccctgg

SEQ ID NO: 1819400 - DNA, 18 bp, Homo sapiens
accctgggctctgtgggc

SEQ ID NO: 1819401 - DNA, 19 bp, Homo sapiens
accctgggctctgtgggct

SEQ ID NO: 1819402 - DNA, 18 bp, Homo sapiens
accctggtgtctcctcca

SEQ ID NO: 1819403 - DNA, 14 bp, Homo sapiens
acccttcagggcca

SEQ ID NO: 1819404 - DNA, 15 bp, Homo sapiens
acccttcagggccag

SEQ ID NO: 1819405 - DNA, 16 bp, Homo sapiens
acccttcagggccaga

SEQ ID NO: 1819406 - DNA, 17 bp, Homo sapiens
acccttcagggccagaa

SEQ ID NO: 1819407 - DNA, 14 bp, Homo sapiens
accgaggttcccag

SEQ ID NO: 1819408 - DNA, 14 bp, Homo sapiens
accgcttcacccct

SEQ ID NO: 1819409 - DNA, 17 bp, Homo sapiens
accgcttcacccctgca

SEQ ID NO: 1819410 - DNA, 15 bp, Homo sapiens
accggcgctgcaggt

SEQ ID NO: 1819411 - DNA, 16 bp, Homo sapiens
accgggtgggcctggc

SEQ ID NO: 1819412 - DNA, 22 bp, Homo sapiens
accgggtgggcctggcctgagc

SEQ ID NO: 1819413 - DNA, 23 bp, Homo sapiens
accgggtgggcctggcctgagct

SEQ ID NO: 1819414 - DNA, 19 bp, Homo sapiens
accgtgtcccaaggagctg

SEQ ID NO: 1819415 - DNA, 23 bp, Homo sapiens
acctagtactctctgctctagcc

SEQ ID NO: 1819416 - DNA, 19 bp, Homo sapiens
acctagtggctgtccagtg

SEQ ID NO: 1819417 - DNA, 21 bp, Homo sapiens
acctagtggctgtccagtgcc

SEQ ID NO: 1819418 - DNA, 20 bp, Homo sapiens
acctatgtgaaactctatta

SEQ ID NO: 1819419 - DNA, 18 bp, Homo sapiens
acctatgtgagtttcaga

SEQ ID NO: 1819420 - DNA, 19 bp, Homo sapiens
acctatgtgagtttcagaa

SEQ ID NO: 1819421 - DNA, 20 bp, Homo sapiens
acctatgtgagtttcagaaa

SEQ ID NO: 1819422 - DNA, 22 bp, Homo sapiens
acctcaactaacccttaaaaat

SEQ ID NO: 1819423 - DNA, 19 bp, Homo sapiens
acctcctgagaaggcgagg

SEQ ID NO: 1819424 - DNA, 16 bp, Homo sapiens
acctcctgcaataaaa

SEQ ID NO: 1819425 - DNA, 12 bp, Homo sapiens
acctctcaatat

SEQ ID NO: 1819426 - DNA, 21 bp, Homo sapiens
acctctcaatattcaataaag

SEQ ID NO: 1819427 - DNA, 21 bp, Homo sapiens
acctgaaccccatgggcttgg

SEQ ID NO: 1819428 - DNA, 16 bp, Homo sapiens
acctgacaatggcagc

SEQ ID NO: 1819429 - DNA, 17 bp, Homo sapiens
acctgacaatggcagct

SEQ ID NO: 1819430 - DNA, 21 bp, Homo sapiens
acctgagtcggccccacatgg

SEQ ID NO: 1819431 - DNA, 18 bp, Homo sapiens
acctgcaagccccagggc

SEQ ID NO: 1819432 - DNA, 20 bp, Homo sapiens
acctgcaagccccagggcct

SEQ ID NO: 1819433 - DNA, 13 bp, Homo sapiens
acctgcaggttgg

SEQ ID NO: 1819434 - DNA, 16 bp, Homo sapiens
acctgccctgccctgc

SEQ ID NO: 1819435 - DNA, 20 bp, Homo sapiens
acctgccctgccctgccacc

SEQ ID NO: 1819436 - DNA, 21 bp, Homo sapiens
acctgcctatccatcctgcga

SEQ ID NO: 1819437 - DNA, 16 bp, Homo sapiens
acctggcctgctggga

SEQ ID NO: 1819438 - DNA, 19 bp, Homo sapiens
acctggtactgcacatttt

SEQ ID NO: 1819439 - DNA, 18 bp, Homo sapiens
acttatctagaaagaaaa

SEQ ID NO: 1819440 - DNA, 23 bp, Homo sapiens
acttattaacaactgtgaatatg

SEQ ID NO: 1819441 - DNA, 12 bp, Homo sapiens
acttcagatttc

SEQ ID NO: 1819442 - DNA, 15 bp, Homo sapiens
acttcaggggctgcc

SEQ ID NO: 1819443 - DNA, 16 bp, Homo sapiens
acttcaggggctgccc

SEQ ID NO: 1819444 - DNA, 20 bp, Homo sapiens
acttcaggtggagagcacta

SEQ ID NO: 1819445 - DNA, 12 bp, Homo sapiens
acttcccctcct

SEQ ID NO: 1819446 - DNA, 21 bp, Homo sapiens
acttcccctcctacccctccc

SEQ ID NO: 1819447 - DNA, 13 bp, Homo sapiens
acttcctggggcc

SEQ ID NO: 1819448 - DNA, 13 bp, Homo sapiens
acttctggaaggc

SEQ ID NO: 1819449 - DNA, 16 bp, Homo sapiens
acttctggaaggctgg

SEQ ID NO: 1819450 - DNA, 16 bp, Homo sapiens
acttcttaaaggcctg

SEQ ID NO: 1819451 - DNA, 21 bp, Homo sapiens
acttcttaaaggcctggaacc

SEQ ID NO: 1819452 - DNA, 23 bp, Homo sapiens
acttcttaaaggcctggaaccag

SEQ ID NO: 1819453 - DNA, 20 bp, Homo sapiens
acttgaattttcccactgca

SEQ ID NO: 1819454 - DNA, 12 bp, Homo sapiens
acttgaggacac

SEQ ID NO: 1819455 - DNA, 13 bp, Homo sapiens
acttgaggacaca

SEQ ID NO: 1819456 - DNA, 15 bp, Homo sapiens
acttgaggacacatg

SEQ ID NO: 1819457 - DNA, 18 bp, Homo sapiens
acttgaggacacatgtcc

SEQ ID NO: 1819458 - DNA, 19 bp, Homo sapiens
acttgaggacacatgtcca

SEQ ID NO: 1819459 - DNA, 18 bp, Homo sapiens
acttgctgaaaaacacaa

SEQ ID NO: 1819460 - DNA, 12 bp, Homo sapiens
acttggagcccg

SEQ ID NO: 1819461 - DNA, 15 bp, Homo sapiens
acttggagcccgtgc

SEQ ID NO: 1819462 - DNA, 14 bp, Homo sapiens
acttggttccattg

SEQ ID NO: 1819463 - DNA, 15 bp, Homo sapiens
acttgtctgaggcct

SEQ ID NO: 1819464 - DNA, 17 bp, Homo sapiens
acttgtctgaggcctca

SEQ ID NO: 1819465 - DNA, 20 bp, Homo sapiens
acttgtctgaggcctcatcc

SEQ ID NO: 1819466 - DNA, 16 bp, Homo sapiens
acttttaaaactatat

SEQ ID NO: 1819467 - DNA, 21 bp, Homo sapiens
acttttcagaattgaaggaga

SEQ ID NO: 1819468 - DNA, 13 bp, Homo sapiens
agaaaaatatgag

SEQ ID NO: 1819469 - DNA, 18 bp, Homo sapiens
agaaaaatatgagagaac

SEQ ID NO: 1819470 - DNA, 13 bp, Homo sapiens
agaaaacttccaa

SEQ ID NO: 1819471 - DNA, 15 bp, Homo sapiens
agaaaagaaaaatat

SEQ ID NO: 1819472 - DNA, 18 bp, Homo sapiens
agaaaagaaagctgcttt

SEQ ID NO: 1819473 - DNA, 16 bp, Homo sapiens
agaaaagaccctgaga

SEQ ID NO: 1819474 - DNA, 13 bp, Homo sapiens
agaaaatgaaaag

SEQ ID NO: 1819475 - DNA, 12 bp, Homo sapiens
agaaacaatcta

SEQ ID NO: 1819476 - DNA, 23 bp, Homo sapiens
agaaacacaaatgtaaaataagt

SEQ ID NO: 1819477 - DNA, 15 bp, Homo sapiens
agaaacaccattcat

SEQ ID NO: 1819478 - DNA, 18 bp, Homo sapiens
agaaacagggacaaagaa

SEQ ID NO: 1819479 - DNA, 21 bp, Homo sapiens
agaaagaaaagaccctgagac

SEQ ID NO: 1819480 - DNA, 16 bp, Homo sapiens
agaaagggaaactggc

SEQ ID NO: 1819481 - DNA, 19 bp, Homo sapiens
agaaagggaaactggctga

SEQ ID NO: 1819482 - DNA, 16 bp, Homo sapiens
agaaagggaggcccag

SEQ ID NO: 1819483 - DNA, 22 bp, Homo sapiens
agaaatacagaagaaaataata

SEQ ID NO: 1819484 - DNA, 20 bp, Homo sapiens
agaaatccccccttcagaac

SEQ ID NO: 1819485 - DNA, 17 bp, Homo sapiens
agaaattctcaaaatac

SEQ ID NO: 1819486 - DNA, 20 bp, Homo sapiens
agaaattttactgacagaaa

SEQ ID NO: 1819487 - DNA, 12 bp, Homo sapiens
agaaatttttac

SEQ ID NO: 1819488 - DNA, 17 bp, Homo sapiens
agaacaatgtcagaaac

SEQ ID NO: 1819489 - DNA, 13 bp, Homo sapiens
agaacgcacccca

SEQ ID NO: 1819490 - DNA, 15 bp, Homo sapiens
agaacgcaccccact

SEQ ID NO: 1819491 - DNA, 21 bp, Homo sapiens
agaacgcaccccactgggaga

SEQ ID NO: 1819492 - DNA, 13 bp, Homo sapiens
agaaggcagcagg

SEQ ID NO: 1819493 - DNA, 22 bp, Homo sapiens
agaaggcctcttgtgctcacgc

SEQ ID NO: 1819494 - DNA, 13 bp, Homo sapiens
agaaggcgaggag

SEQ ID NO: 1819495 - DNA, 13 bp, Homo sapiens
agaagtaaaagct

SEQ ID NO: 1819496 - DNA, 16 bp, Homo sapiens
agaagtaaaagctaat

SEQ ID NO: 1819497 - DNA, 12 bp, Homo sapiens
agaagtggtttc

SEQ ID NO: 1819498 - DNA, 14 bp, Homo sapiens
agaataaatgaaga

SEQ ID NO: 1819499 - DNA, 14 bp, Homo sapiens
agaataaatgaatc

SEQ ID NO: 1819500 - DNA, 16 bp, Homo sapiens
agaatcaagtctgtga

SEQ ID NO: 1819501 - DNA, 17 bp, Homo sapiens
agaatctgctgttgcca

SEQ ID NO: 1819502 - DNA, 20 bp, Homo sapiens
agaatctgctgttgccatag

SEQ ID NO: 1819503 - DNA, 21 bp, Homo sapiens
agaatgcagattcctgggcct

SEQ ID NO: 1819504 - DNA, 19 bp, Homo sapiens
agaatgtcagtatgtggaa

SEQ ID NO: 1819505 - DNA, 12 bp, Homo sapiens
agacaagccctg

SEQ ID NO: 1819506 - DNA, 15 bp, Homo sapiens
agacaagccctggca

SEQ ID NO: 1819507 - DNA, 12 bp, Homo sapiens
agacaggccctc

SEQ ID NO: 1819508 - DNA, 13 bp, Homo sapiens
agacaggccctcc

SEQ ID NO: 1819509 - DNA, 14 bp, Homo sapiens
agacaggccctccc

SEQ ID NO: 1819510 - DNA, 19 bp, Homo sapiens
agacaggccctccctgtct

SEQ ID NO: 1819511 - DNA, 12 bp, Homo sapiens
agaccacctctc

SEQ ID NO: 1819512 - DNA, 17 bp, Homo sapiens
agaccacctctcaatat

SEQ ID NO: 1819513 - DNA, 20 bp, Homo sapiens
agacccagtgtaaagaataa

SEQ ID NO: 1819514 - DNA, 23 bp, Homo sapiens
agacccagtgtaaagaataaatg

SEQ ID NO: 1819515 - DNA, 19 bp, Homo sapiens
agaccgcttcacccctgca

SEQ ID NO: 1819516 - DNA, 16 bp, Homo sapiens
agactggagtgaggct

SEQ ID NO: 1819517 - DNA, 16 bp, Homo sapiens
agacttcagatttcaa

SEQ ID NO: 1819518 - DNA, 13 bp, Homo sapiens
agacttctggaag

SEQ ID NO: 1819519 - DNA, 19 bp, Homo sapiens
agacttctggaaggctggc

SEQ ID NO: 1819520 - DNA, 23 bp, Homo sapiens
agacttctggaaggctggctgag

SEQ ID NO: 1819521 - DNA, 18 bp, Homo sapiens
agactttcctttgcacca

SEQ ID NO: 1819522 - DNA, 12 bp, Homo sapiens
agagaaaagaaa

SEQ ID NO: 1819523 - DNA, 16 bp, Homo sapiens
agagaaaagaaaaata

SEQ ID NO: 1819524 - DNA, 16 bp, Homo sapiens
agagaaagaaagggaa

SEQ ID NO: 1819525 - DNA, 14 bp, Homo sapiens
agagaaatcacagg

SEQ ID NO: 1819526 - DNA, 13 bp, Homo sapiens
agagaaggcctct

SEQ ID NO: 1819527 - DNA, 13 bp, Homo sapiens
agagactgaaagc

SEQ ID NO: 1819528 - DNA, 18 bp, Homo sapiens
agagactgaaagcagcag

SEQ ID NO: 1819529 - DNA, 19 bp, Homo sapiens
agagagcagcttctgccac

SEQ ID NO: 1819530 - DNA, 23 bp, Homo sapiens
agagagcagcttctgccacttcc

SEQ ID NO: 1819531 - DNA, 15 bp, Homo sapiens
agagaggagcacctg

SEQ ID NO: 1819532 - DNA, 12 bp, Homo sapiens
agagagggccca

SEQ ID NO: 1819533 - DNA, 13 bp, Homo sapiens
agagagggcccag

SEQ ID NO: 1819534 - DNA, 14 bp, Homo sapiens
agagagggcccagc

SEQ ID NO: 1819535 - DNA, 22 bp, Homo sapiens
agagattgtgcgttcaaaccta

SEQ ID NO: 1819536 - DNA, 11 bp, Homo sapiens
agagcacagcc

SEQ ID NO: 1819537 - DNA, 16 bp, Homo sapiens
agagcacagccctccc

SEQ ID NO: 1819538 - DNA, 11 bp, Homo sapiens
agagcagcctg

SEQ ID NO: 1819539 - DNA, 19 bp, Homo sapiens
agagcagcctgatggccaa

SEQ ID NO: 1819540 - DNA, 13 bp, Homo sapiens
agagcagcttctg

SEQ ID NO: 1819541 - DNA, 16 bp, Homo sapiens
agagccactacctttg

SEQ ID NO: 1819542 - DNA, 22 bp, Homo sapiens
agagctcttcaagctgtcccct

SEQ ID NO: 1819543 - DNA, 15 bp, Homo sapiens
agagctggaaggcag

SEQ ID NO: 1819544 - DNA, 17 bp, Homo sapiens
agagctggaaggcaggg

SEQ ID NO: 1819545 - DNA, 22 bp, Homo sapiens
agagctgggaaattcatgtgga

SEQ ID NO: 1819546 - DNA, 20 bp, Homo sapiens
agagctggtggtgcagcctt

SEQ ID NO: 1819547 - DNA, 23 bp, Homo sapiens
agagctggtggtgcagccttccc

SEQ ID NO: 1819548 - DNA, 14 bp, Homo sapiens
agaggaccacagtg

SEQ ID NO: 1819549 - DNA, 14 bp, Homo sapiens
agaggagaccctgg

SEQ ID NO: 1819550 - DNA, 13 bp, Homo sapiens
agaggagcacctg

SEQ ID NO: 1819551 - DNA, 13 bp, Homo sapiens
agaggatgatttc

SEQ ID NO: 1819552 - DNA, 18 bp, Homo sapiens
agaggatgatttcagaag

SEQ ID NO: 1819553 - DNA, 16 bp, Homo sapiens
agaggcatttaaaatg

SEQ ID NO: 1819554 - DNA, 12 bp, Homo sapiens
agaggcctcagt

SEQ ID NO: 1819555 - DNA, 17 bp, Homo sapiens
agaggctttggggtcct

SEQ ID NO: 1819556 - DNA, 15 bp, Homo sapiens
agagggcagtacctg

SEQ ID NO: 1819557 - DNA, 18 bp, Homo sapiens
aggtctcctccaccgcca

SEQ ID NO: 1819558 - DNA, 19 bp, Homo sapiens
aggtctccttactctgagc

SEQ ID NO: 1819559 - DNA, 20 bp, Homo sapiens
aggtctccttactctgagcc

SEQ ID NO: 1819560 - DNA, 22 bp, Homo sapiens
aggtctccttactctgagccca

SEQ ID NO: 1819561 - DNA, 22 bp, Homo sapiens
aggtgaaatgggagatggtcag

SEQ ID NO: 1819562 - DNA, 15 bp, Homo sapiens
aggtgcagatgggct

SEQ ID NO: 1819563 - DNA, 17 bp, Homo sapiens
aggtgcagatgggctgt

SEQ ID NO: 1819564 - DNA, 12 bp, Homo sapiens
aggtgccactcc

SEQ ID NO: 1819565 - DNA, 18 bp, Homo sapiens
aggtgccactccctgagc

SEQ ID NO: 1819566 - DNA, 20 bp, Homo sapiens
aggtgccactccctgagctt

SEQ ID NO: 1819567 - DNA, 12 bp, Homo sapiens
aggtgctgagct

SEQ ID NO: 1819568 - DNA, 17 bp, Homo sapiens
aggtgctgagcttagcc

SEQ ID NO: 1819569 - DNA, 17 bp, Homo sapiens
aggtggagagcactaga

SEQ ID NO: 1819570 - DNA, 17 bp, Homo sapiens
aggtgggcagctgggcc

SEQ ID NO: 1819571 - DNA, 22 bp, Homo sapiens
aggtgggccacacccaggaagg

SEQ ID NO: 1819572 - DNA, 16 bp, Homo sapiens
aggtgggcgggcagca

SEQ ID NO: 1819573 - DNA, 19 bp, Homo sapiens
aggtgggcgggcagcacag

SEQ ID NO: 1819574 - DNA, 13 bp, Homo sapiens
aggtgggtccagg

SEQ ID NO: 1819575 - DNA, 20 bp, Homo sapiens
aggtggtctgctcgggccca

SEQ ID NO: 1819576 - DNA, 16 bp, Homo sapiens
aggttaaggtgggtcc

SEQ ID NO: 1819577 - DNA, 17 bp, Homo sapiens
aggttaggaaggcagca

SEQ ID NO: 1819578 - DNA, 15 bp, Homo sapiens
aggttatctgcctgg

SEQ ID NO: 1819579 - DNA, 18 bp, Homo sapiens
aggttatctgcctggcct

SEQ ID NO: 1819580 - DNA, 22 bp, Homo sapiens
aggttgggccatactggcctcg

SEQ ID NO: 1819581 - DNA, 20 bp, Homo sapiens
aggtttagaatcaagtctgt

SEQ ID NO: 1819582 - DNA, 17 bp, Homo sapiens
aggtttcactgttcatg

SEQ ID NO: 1819583 - DNA, 14 bp, Homo sapiens
aggttttattttgt

SEQ ID NO: 1819584 - DNA, 15 bp, Homo sapiens
agtaaaagctaatta

SEQ ID NO: 1819585 - DNA, 22 bp, Homo sapiens
agtaacaaaagtatagttttga

SEQ ID NO: 1819586 - DNA, 22 bp, Homo sapiens
agtaacaggccttgagcacaaa

SEQ ID NO: 1819587 - DNA, 14 bp, Homo sapiens
agtaataatgtaat

SEQ ID NO: 1819588 - DNA, 24 bp, Homo sapiens
agtaataatgtaatactgtagaaa

SEQ ID NO: 1819589 - DNA, 20 bp, Homo sapiens
agtaatgaaggcatatttcc

SEQ ID NO: 1819590 - DNA, 20 bp, Homo sapiens
agtacagtgaggagggtgga

SEQ ID NO: 1819591 - DNA, 13 bp, Homo sapiens
agtaccttcaaat

SEQ ID NO: 1819592 - DNA, 17 bp, Homo sapiens
agtactctctgctctag

SEQ ID NO: 1819593 - DNA, 13 bp, Homo sapiens
agtaggtccaagg

SEQ ID NO: 1819594 - DNA, 18 bp, Homo sapiens
agtatcttcaaaaataca

SEQ ID NO: 1819595 - DNA, 21 bp, Homo sapiens
agtatgccttcctgtttaaaa

SEQ ID NO: 1819596 - DNA, 23 bp, Homo sapiens
agtattaaaatgcatatttctat

SEQ ID NO: 1819597 - DNA, 23 bp, Homo sapiens
agtattatttctccatcccctcc

SEQ ID NO: 1819598 - DNA, 17 bp, Homo sapiens
agtattcaggcactgag

SEQ ID NO: 1819599 - DNA, 14 bp, Homo sapiens
agtatttgtgggga

SEQ ID NO: 1819600 - DNA, 18 bp, Homo sapiens
agtcaactggctggccag

SEQ ID NO: 1819601 - DNA, 20 bp, Homo sapiens
agtcaactggctggccagtc

SEQ ID NO: 1819602 - DNA, 15 bp, Homo sapiens
agtcaagaaaaatat

SEQ ID NO: 1819603 - DNA, 12 bp, Homo sapiens
agtcaatattga

SEQ ID NO: 1819604 - DNA, 12 bp, Homo sapiens
agtcacaaaata

SEQ ID NO: 1819605 - DNA, 11 bp, Homo sapiens
agtcacagctg

SEQ ID NO: 1819606 - DNA, 18 bp, Homo sapiens
agtcacctgcaagcccca

SEQ ID NO: 1819607 - DNA, 23 bp, Homo sapiens
agtcacctgcaagccccagggcc

SEQ ID NO: 1819608 - DNA, 22 bp, Homo sapiens
agtccacctgcctatccatcct

SEQ ID NO: 1819609 - DNA, 16 bp, Homo sapiens
agtcctcacagcctct

SEQ ID NO: 1819610 - DNA, 19 bp, Homo sapiens
agtcctcacagcctctccc

SEQ ID NO: 1819611 - DNA, 14 bp, Homo sapiens
agtcctctccacct

SEQ ID NO: 1819612 - DNA, 20 bp, Homo sapiens
agtcgcaggatccgctgcca

SEQ ID NO: 1819613 - DNA, 19 bp, Homo sapiens
agtctaaacaatgaattct

SEQ ID NO: 1819614 - DNA, 20 bp, Homo sapiens
agtctcaaatttttcatctc

SEQ ID NO: 1819615 - DNA, 21 bp, Homo sapiens
agtctcaaatttttcatctct

SEQ ID NO: 1819616 - DNA, 18 bp, Homo sapiens
agtctgaacccttgtgct

SEQ ID NO: 1819617 - DNA, 19 bp, Homo sapiens
agtctgaacccttgtgctt

SEQ ID NO: 1819618 - DNA, 18 bp, Homo sapiens
agtctgttggcaattgag

SEQ ID NO: 1819619 - DNA, 15 bp, Homo sapiens
agtctgtttgaaatg

SEQ ID NO: 1819620 - DNA, 16 bp, Homo sapiens
agtcttggaatacttg

SEQ ID NO: 1819621 - DNA, 20 bp, Homo sapiens
agtgaacacactcagcagcc

SEQ ID NO: 1819622 - DNA, 20 bp, Homo sapiens
agtgaatgagtttccagcta

SEQ ID NO: 1819623 - DNA, 22 bp, Homo sapiens
agtgactcgggctcctgtgccc

SEQ ID NO: 1819624 - DNA, 19 bp, Homo sapiens
agtgagcccctccccagcc

SEQ ID NO: 1819625 - DNA, 20 bp, Homo sapiens
agtgagcccctccccagcca

SEQ ID NO: 1819626 - DNA, 12 bp, Homo sapiens
agtgaggagggt

SEQ ID NO: 1819627 - DNA, 18 bp, Homo sapiens
agtgaggagggtggagga

SEQ ID NO: 1819628 - DNA, 15 bp, Homo sapiens
agtgaggcttccagg

SEQ ID NO: 1819629 - DNA, 17 bp, Homo sapiens
agtgaggcttccaggct

SEQ ID NO: 1819630 - DNA, 18 bp, Homo sapiens
agtgaggcttccaggctc

SEQ ID NO: 1819631 - DNA, 13 bp, Homo sapiens
agtgatctttcaa

SEQ ID NO: 1819632 - DNA, 12 bp, Homo sapiens
agtgcagagaaa

SEQ ID NO: 1819633 - DNA, 14 bp, Homo sapiens
agtgcctcgaggca

SEQ ID NO: 1819634 - DNA, 21 bp, Homo sapiens
agtgcgctcttggtccctggt

SEQ ID NO: 1819635 - DNA, 11 bp, Homo sapiens
agtgctgccat

SEQ ID NO: 1819636 - DNA, 12 bp, Homo sapiens
agtgctgccatg

SEQ ID NO: 1819637 - DNA, 18 bp, Homo sapiens
agtgctgccatgccactg

SEQ ID NO: 1819638 - DNA, 13 bp, Homo sapiens
agtgctgcttctc

SEQ ID NO: 1819639 - DNA, 21 bp, Homo sapiens
agtgctgtacccttccacctc

SEQ ID NO: 1819640 - DNA, 22 bp, Homo sapiens
agtgctgtacccttccacctcc

SEQ ID NO: 1819641 - DNA, 14 bp, Homo sapiens
agtggaagagcagc

SEQ ID NO: 1819642 - DNA, 21 bp, Homo sapiens
agtggaatgcagggaagaggg

SEQ ID NO: 1819643 - DNA, 15 bp, Homo sapiens
agtggcagccatgcc

SEQ ID NO: 1819644 - DNA, 17 bp, Homo sapiens
agtggcagccatgcctc

SEQ ID NO: 1819645 - DNA, 22 bp, Homo sapiens
agtggcagccatgcctcatgcc

SEQ ID NO: 1819646 - DNA, 23 bp, Homo sapiens
agtggcagccatgcctcatgcca

SEQ ID NO: 1819647 - DNA, 12 bp, Homo sapiens
agtggctgtcca

SEQ ID NO: 1819648 - DNA, 13 bp, Homo sapiens
agtggctgtccag

SEQ ID NO: 1819649 - DNA, 18 bp, Homo sapiens
agtggctgtccagtgccc

SEQ ID NO: 1819650 - DNA, 23 bp, Homo sapiens
agtggctgtccagtgcccattcc

SEQ ID NO: 1819651 - DNA, 15 bp, Homo sapiens
agtgggacattagta

SEQ ID NO: 1819652 - DNA, 16 bp, Homo sapiens
agtggggtaggttggg

SEQ ID NO: 1819653 - DNA, 16 bp, Homo sapiens
agtgggtcccacttcc

SEQ ID NO: 1819654 - DNA, 21 bp, Homo sapiens
agtgggtcccacttcccctcc

SEQ ID NO: 1819655 - DNA, 18 bp, Homo sapiens
agtgtaaagaataaatga

SEQ ID NO: 1819656 - DNA, 19 bp, Homo sapiens
agtgtaaagaataaatgaa

SEQ ID NO: 1819657 - DNA, 22 bp, Homo sapiens
agtgtaaagaataaatgaatct

SEQ ID NO: 1819658 - DNA, 19 bp, Homo sapiens
agtgtacccccgcccaggc

SEQ ID NO: 1819659 - DNA, 16 bp, Homo sapiens
agtgtattatttctgg

SEQ ID NO: 1819660 - DNA, 16 bp, Homo sapiens
agtgtcttcctgtggg

SEQ ID NO: 1819661 - DNA, 17 bp, Homo sapiens
agtgtgccccccatcct

SEQ ID NO: 1819662 - DNA, 21 bp, Homo sapiens
agtgtggagaggggtgcaccc

SEQ ID NO: 1819663 - DNA, 19 bp, Homo sapiens
agtgtgggtctgtgtgtgt

SEQ ID NO: 1819664 - DNA, 16 bp, Homo sapiens
agtgttaggcctggca

SEQ ID NO: 1819665 - DNA, 20 bp, Homo sapiens
agttaaatcattttcattaa

SEQ ID NO: 1819666 - DNA, 20 bp, Homo sapiens
agttatacatcttcattaat

SEQ ID NO: 1819667 - DNA, 16 bp, Homo sapiens
agttattcaaatgaag

SEQ ID NO: 1819668 - DNA, 22 bp, Homo sapiens
agttcacttctttgcagagcct

SEQ ID NO: 1819669 - DNA, 23 bp, Homo sapiens
agttccatcaggtcccccccagg

SEQ ID NO: 1819670 - DNA, 21 bp, Homo sapiens
agttcccggagcacagccctg

SEQ ID NO: 1819671 - DNA, 22 bp, Homo sapiens
agttctatcagtgacttctgaa

SEQ ID NO: 1819672 - DNA, 20 bp, Homo sapiens
agttctgttggtctacagaa

SEQ ID NO: 1819673 - DNA, 16 bp, Homo sapiens
ccagctgtagccatgg

SEQ ID NO: 1819674 - DNA, 23 bp, Homo sapiens
ccagctgtagccatggctcaggc

SEQ ID NO: 1819675 - DNA, 13 bp, Homo sapiens
ccagcttcctggt

SEQ ID NO: 1819676 - DNA, 12 bp, Homo sapiens
ccaggaaggcag

SEQ ID NO: 1819677 - DNA, 14 bp, Homo sapiens
ccaggaaggcagct

SEQ ID NO: 1819678 - DNA, 20 bp, Homo sapiens
ccaggaagggaaagcgggca

SEQ ID NO: 1819679 - DNA, 23 bp, Homo sapiens
ccaggaagggaaagcgggcagcc

SEQ ID NO: 1819680 - DNA, 19 bp, Homo sapiens
ccaggacggggccggccag

SEQ ID NO: 1819681 - DNA, 23 bp, Homo sapiens
ccaggacggggccggccaggtgg

SEQ ID NO: 1819682 - DNA, 16 bp, Homo sapiens
ccaggagtctgtgctc

SEQ ID NO: 1819683 - DNA, 22 bp, Homo sapiens
ccaggagtttgagacaagccct

SEQ ID NO: 1819684 - DNA, 12 bp, Homo sapiens
ccaggcatgctg

SEQ ID NO: 1819685 - DNA, 16 bp, Homo sapiens
ccaggcatgctggcct

SEQ ID NO: 1819686 - DNA, 14 bp, Homo sapiens
ccaggccactgtgg

SEQ ID NO: 1819687 - DNA, 22 bp, Homo sapiens
ccaggccactgtggccagagct

SEQ ID NO: 1819688 - DNA, 23 bp, Homo sapiens
ccaggccactgtggccagagctg

SEQ ID NO: 1819689 - DNA, 16 bp, Homo sapiens
ccaggccatcttccag

SEQ ID NO: 1819690 - DNA, 14 bp, Homo sapiens
ccaggcccatctca

SEQ ID NO: 1819691 - DNA, 19 bp, Homo sapiens
ccaggcccatctcaggtgc

SEQ ID NO: 1819692 - DNA, 14 bp, Homo sapiens
ccaggcccctgagg

SEQ ID NO: 1819693 - DNA, 15 bp, Homo sapiens
ccaggcccctgagga

SEQ ID NO: 1819694 - DNA, 16 bp, Homo sapiens
ccaggcccctgaggac

SEQ ID NO: 1819695 - DNA, 17 bp, Homo sapiens
ccaggcccctgaggact

SEQ ID NO: 1819696 - DNA, 19 bp, Homo sapiens
ccaggcccctgaggactgg

SEQ ID NO: 1819697 - DNA, 22 bp, Homo sapiens
ccaggcccctgaggactggaga

SEQ ID NO: 1819698 - DNA, 18 bp, Homo sapiens
ccaggccctccatgggct

SEQ ID NO: 1819699 - DNA, 20 bp, Homo sapiens
ccaggcctccagcctctccc

SEQ ID NO: 1819700 - DNA, 18 bp, Homo sapiens
ccaggcgttggtgccact

SEQ ID NO: 1819701 - DNA, 19 bp, Homo sapiens
ccaggcgttggtgccactt

SEQ ID NO: 1819702 - DNA, 17 bp, Homo sapiens
ccaggctcttcctggac

SEQ ID NO: 1819703 - DNA, 23 bp, Homo sapiens
ccaggctcttcctggacctgagt

SEQ ID NO: 1819704 - DNA, 19 bp, Homo sapiens
ccaggctgcactgcagtga

SEQ ID NO: 1819705 - DNA, 14 bp, Homo sapiens
ccaggctggccagc

SEQ ID NO: 1819706 - DNA, 17 bp, Homo sapiens
ccaggctggccagcccc

SEQ ID NO: 1819707 - DNA, 21 bp, Homo sapiens
ccaggctggccagccccacag

SEQ ID NO: 1819708 - DNA, 14 bp, Homo sapiens
ccagggcccccacc

SEQ ID NO: 1819709 - DNA, 17 bp, Homo sapiens
ccagggcccctccctct

SEQ ID NO: 1819710 - DNA, 22 bp, Homo sapiens
ccagggcccctccctctgcccc

SEQ ID NO: 1819711 - DNA, 23 bp, Homo sapiens
ccagggcccctccctctgcccca

SEQ ID NO: 1819712 - DNA, 13 bp, Homo sapiens
ccagggcctgggg

SEQ ID NO: 1819713 - DNA, 13 bp, Homo sapiens
ccagggctgcccc

SEQ ID NO: 1819714 - DNA, 16 bp, Homo sapiens
ccagggctgcccctgt

SEQ ID NO: 1819715 - DNA, 16 bp, Homo sapiens
ccaggggcaggcacag

SEQ ID NO: 1819716 - DNA, 18 bp, Homo sapiens
ccaggggcaggcacagca

SEQ ID NO: 1819717 - DNA, 20 bp, Homo sapiens
ccagggtccgcaccagctgc

SEQ ID NO: 1819718 - DNA, 14 bp, Homo sapiens
ccagggtcttgggc

SEQ ID NO: 1819719 - DNA, 20 bp, Homo sapiens
ccagggtcttgggctactgg

SEQ ID NO: 1819720 - DNA, 22 bp, Homo sapiens
ccagggtcttgggctactggca

SEQ ID NO: 1819721 - DNA, 14 bp, Homo sapiens
ccaggtctcctcca

SEQ ID NO: 1819722 - DNA, 16 bp, Homo sapiens
ccaggtctcctccacc

SEQ ID NO: 1819723 - DNA, 17 bp, Homo sapiens
ccaggttaggaaggcag

SEQ ID NO: 1819724 - DNA, 23 bp, Homo sapiens
ccaggttaggaaggcagcattcc

SEQ ID NO: 1819725 - DNA, 15 bp, Homo sapiens
ccagtcgcgctgcct

SEQ ID NO: 1819726 - DNA, 16 bp, Homo sapiens
ccagtcgcgctgcctg

SEQ ID NO: 1819727 - DNA, 18 bp, Homo sapiens
ccagtcgcgctgcctgtg

SEQ ID NO: 1819728 - DNA, 19 bp, Homo sapiens
ccagtcgcgctgcctgtgt

SEQ ID NO: 1819729 - DNA, 21 bp, Homo sapiens
ccagtcgcgctgcctgtgtgg

SEQ ID NO: 1819730 - DNA, 17 bp, Homo sapiens
ccagtcttgcctaggcc

SEQ ID NO: 1819731 - DNA, 13 bp, Homo sapiens
ccagtgaagtcct

SEQ ID NO: 1819732 - DNA, 13 bp, Homo sapiens
ccagtgcccattc

SEQ ID NO: 1819733 - DNA, 13 bp, Homo sapiens
ccagtgctgccat

SEQ ID NO: 1819734 - DNA, 15 bp, Homo sapiens
ccagtgctgccatgc

SEQ ID NO: 1819735 - DNA, 16 bp, Homo sapiens
ccagtgctgccatgcc

SEQ ID NO: 1819736 - DNA, 20 bp, Homo sapiens
ccagtgctgccatgccactg

SEQ ID NO: 1819737 - DNA, 22 bp, Homo sapiens
ccagtgcttctccaacactgaa

SEQ ID NO: 1819738 - DNA, 21 bp, Homo sapiens
ccatactggcctcgcctggcc

SEQ ID NO: 1819739 - DNA, 22 bp, Homo sapiens
ccatactggcctcgcctggcct

SEQ ID NO: 1819740 - DNA, 17 bp, Homo sapiens
ccatacttttgagaggg

SEQ ID NO: 1819741 - DNA, 18 bp, Homo sapiens
ccatatggagcatttttc

SEQ ID NO: 1819742 - DNA, 20 bp, Homo sapiens
ccatattttaaaaaatcaaa

SEQ ID NO: 1819743 - DNA, 18 bp, Homo sapiens
ccatcagtgtacccccgc

SEQ ID NO: 1819744 - DNA, 23 bp, Homo sapiens
ccatcagtgtacccccgcccagg

SEQ ID NO: 1819745 - DNA, 14 bp, Homo sapiens
ccatcccccctcac

SEQ ID NO: 1819746 - DNA, 20 bp, Homo sapiens
ccatcccccctcaccagggg

SEQ ID NO: 1819747 - DNA, 21 bp, Homo sapiens
ccatcccccctcaccaggggc

SEQ ID NO: 1819748 - DNA, 15 bp, Homo sapiens
ccatcccctccctgc

SEQ ID NO: 1819749 - DNA, 21 bp, Homo sapiens
ccatcccctccctgcctgctc

SEQ ID NO: 1819750 - DNA, 22 bp, Homo sapiens
ccatcccctccctgcctgctcc

SEQ ID NO: 1819751 - DNA, 13 bp, Homo sapiens
ccatcctggccca

SEQ ID NO: 1819752 - DNA, 14 bp, Homo sapiens
ccatcctggcccat

SEQ ID NO: 1819753 - DNA, 14 bp, Homo sapiens
ccatctcaggtgcc

SEQ ID NO: 1819754 - DNA, 23 bp, Homo sapiens
ccatctcaggtgccactccctga

SEQ ID NO: 1819755 - DNA, 16 bp, Homo sapiens
ccatctccccaggcct

SEQ ID NO: 1819756 - DNA, 19 bp, Homo sapiens
ccatctccccaggcctcca

SEQ ID NO: 1819757 - DNA, 13 bp, Homo sapiens
ccatctcctccca

SEQ ID NO: 1819758 - DNA, 15 bp, Homo sapiens
ccatctgcccaggac

SEQ ID NO: 1819759 - DNA, 16 bp, Homo sapiens
ccatctgcccaggacg

SEQ ID NO: 1819760 - DNA, 17 bp, Homo sapiens
ccatcttcctgctgctg

SEQ ID NO: 1819761 - DNA, 15 bp, Homo sapiens
ccatgataactgcat

SEQ ID NO: 1819762 - DNA, 19 bp, Homo sapiens
ccatgccactgccaggcac

SEQ ID NO: 1819763 - DNA, 20 bp, Homo sapiens
ccatgccactgccaggcacc

SEQ ID NO: 1819764 - DNA, 14 bp, Homo sapiens
ccatgcctcatgcc

SEQ ID NO: 1819765 - DNA, 18 bp, Homo sapiens
ccatgcctcatgccacac

SEQ ID NO: 1819766 - DNA, 20 bp, Homo sapiens
ccatgcctcatgccacacct

SEQ ID NO: 1819767 - DNA, 15 bp, Homo sapiens
ccatgctgccttcag

SEQ ID NO: 1819768 - DNA, 16 bp, Homo sapiens
ccatggattcccctgg

SEQ ID NO: 1819769 - DNA, 15 bp, Homo sapiens
ccatggccttccctc

SEQ ID NO: 1819770 - DNA, 21 bp, Homo sapiens
ccatggccttccctccccaca

SEQ ID NO: 1819771 - DNA, 14 bp, Homo sapiens
ccatggctcaggca

SEQ ID NO: 1819772 - DNA, 20 bp, Homo sapiens
ccatggcttccaaggtggtc

SEQ ID NO: 1819773 - DNA, 22 bp, Homo sapiens
ccatgggcactgctgggtggcc

SEQ ID NO: 1819774 - DNA, 14 bp, Homo sapiens
ccatgggcctgggc

SEQ ID NO: 1819775 - DNA, 16 bp, Homo sapiens
ccatgggcctgggcct

SEQ ID NO: 1819776 - DNA, 17 bp, Homo sapiens
ccatgggcctgggcctg

SEQ ID NO: 1819777 - DNA, 17 bp, Homo sapiens
ccatgggctagtgtgag

SEQ ID NO: 1819778 - DNA, 15 bp, Homo sapiens
ccatggtagactgtg

SEQ ID NO: 1819779 - DNA, 17 bp, Homo sapiens
ccatggtagactgtgac

SEQ ID NO: 1819780 - DNA, 20 bp, Homo sapiens
ccatgtgcctgcaccaggag

SEQ ID NO: 1819781 - DNA, 13 bp, Homo sapiens
ccatgtggctgaa

SEQ ID NO: 1819782 - DNA, 14 bp, Homo sapiens
ccatgtggctgaag

SEQ ID NO: 1819783 - DNA, 15 bp, Homo sapiens
ccatgtggctgaaga

SEQ ID NO: 1819784 - DNA, 19 bp, Homo sapiens
ccattcccccatgtggctg

SEQ ID NO: 1819785 - DNA, 18 bp, Homo sapiens
ccattgctggcaatgagt

SEQ ID NO: 1819786 - DNA, 13 bp, Homo sapiens
ccatttgtctgtg

SEQ ID NO: 1819787 - DNA, 22 bp, Homo sapiens
cccaaaaatgttcccttgacca

SEQ ID NO: 1819788 - DNA, 21 bp, Homo sapiens
cccaaccccgcggtgctctgg

SEQ ID NO: 1819789 - DNA, 13 bp, Homo sapiens
ccccatgggcttg

SEQ ID NO: 1819790 - DNA, 17 bp, Homo sapiens
ccccatgggcttggact

SEQ ID NO: 1819791 - DNA, 13 bp, Homo sapiens
cccccacctgaca

SEQ ID NO: 1819792 - DNA, 22 bp, Homo sapiens
cccccacctgacaatggcagct

SEQ ID NO: 1819793 - DNA, 17 bp, Homo sapiens
cccccatcctggcccat

SEQ ID NO: 1819794 - DNA, 13 bp, Homo sapiens
cccccatgtggct

SEQ ID NO: 1819795 - DNA, 13 bp, Homo sapiens
cccccctccaggc

SEQ ID NO: 1819796 - DNA, 16 bp, Homo sapiens
cccccgacactgctgc

SEQ ID NO: 1819797 - DNA, 18 bp, Homo sapiens
cccccgcccaggctggcc

SEQ ID NO: 1819798 - DNA, 15 bp, Homo sapiens
cccccggggctgggt

SEQ ID NO: 1819799 - DNA, 12 bp, Homo sapiens
ccccctccaggc

SEQ ID NO: 1819800 - DNA, 15 bp, Homo sapiens
ccccctcctgctgca

SEQ ID NO: 1819801 - DNA, 23 bp, Homo sapiens
ccccctggatgggcattgggctg

SEQ ID NO: 1819802 - DNA, 16 bp, Homo sapiens
ccccgacactgctgca

SEQ ID NO: 1819803 - DNA, 18 bp, Homo sapiens
ccccgagggatgatgcca

SEQ ID NO: 1819804 - DNA, 14 bp, Homo sapiens
ccccgcagcccgtg

SEQ ID NO: 1819805 - DNA, 18 bp, Homo sapiens
ccccgcggtgctctggcg

SEQ ID NO: 1819806 - DNA, 16 bp, Homo sapiens
ccccgggaggggcccg

SEQ ID NO: 1819807 - DNA, 23 bp, Homo sapiens
ccccgggaggggcccgcttgcct

SEQ ID NO: 1819808 - DNA, 12 bp, Homo sapiens
ccccggggctgg

SEQ ID NO: 1819809 - DNA, 13 bp, Homo sapiens
ccccgttttgggg

SEQ ID NO: 1819810 - DNA, 13 bp, Homo sapiens
cccctcagccctt

SEQ ID NO: 1819811 - DNA, 16 bp, Homo sapiens
cccctccaggcatgct

SEQ ID NO: 1819812 - DNA, 22 bp, Homo sapiens
cccctccaggcatgctggcctc

SEQ ID NO: 1819813 - DNA, 14 bp, Homo sapiens
cccctcccagacag

SEQ ID NO: 1819814 - DNA, 16 bp, Homo sapiens
cccctcccagacaggc

SEQ ID NO: 1819815 - DNA, 19 bp, Homo sapiens
cccctcccagacaggccct

SEQ ID NO: 1819816 - DNA, 14 bp, Homo sapiens
cccctcccagctga

SEQ ID NO: 1819817 - DNA, 14 bp, Homo sapiens
cccctccccagcca

SEQ ID NO: 1819818 - DNA, 16 bp, Homo sapiens
cccctccctctgcccc

SEQ ID NO: 1819819 - DNA, 19 bp, Homo sapiens
cccctcctacccctcccag

SEQ ID NO: 1819820 - DNA, 23 bp, Homo sapiens
cccctcctacccctcccagctga

SEQ ID NO: 1819821 - DNA, 12 bp, Homo sapiens
cccctcctgctg

SEQ ID NO: 1819822 - DNA, 21 bp, Homo sapiens
cccctcgtcctgtcccagagg

SEQ ID NO: 1819823 - DNA, 17 bp, Homo sapiens
cccctcgtgccagtcgc

SEQ ID NO: 1819824 - DNA, 18 bp, Homo sapiens
cccctctcgccccatccc

SEQ ID NO: 1819825 - DNA, 13 bp, Homo sapiens
cccctgaggactg

SEQ ID NO: 1819826 - DNA, 15 bp, Homo sapiens
cccctgaggactgga

SEQ ID NO: 1819827 - DNA, 17 bp, Homo sapiens
cccctgtacccagctcc

SEQ ID NO: 1819828 - DNA, 19 bp, Homo sapiens
ccccttagaatgtttctat

SEQ ID NO: 1819829 - DNA, 14 bp, Homo sapiens
ccccttttgcctgg

SEQ ID NO: 1819830 - DNA, 15 bp, Homo sapiens
cccgacactgctgca

SEQ ID NO: 1819831 - DNA, 19 bp, Homo sapiens
cccgacactgctgcaccag

SEQ ID NO: 1819832 - DNA, 23 bp, Homo sapiens
cccgacactgctgcaccagagtg

SEQ ID NO: 1819833 - DNA, 14 bp, Homo sapiens
cccgaccccatctc

SEQ ID NO: 1819834 - DNA, 22 bp, Homo sapiens
cccgcagcccgtgaagcagtgc

SEQ ID NO: 1819835 - DNA, 18 bp, Homo sapiens
cccgcagtccccagccct

SEQ ID NO: 1819836 - DNA, 17 bp, Homo sapiens
cccgcccaggctggcca

SEQ ID NO: 1819837 - DNA, 20 bp, Homo sapiens
cccgcccaggctggccagcc

SEQ ID NO: 1819838 - DNA, 20 bp, Homo sapiens
cccgccttcctcctccacag

SEQ ID NO: 1819839 - DNA, 13 bp, Homo sapiens
cccgctcccacag

SEQ ID NO: 1819840 - DNA, 12 bp, Homo sapiens
cccgctcccagt

SEQ ID NO: 1819841 - DNA, 14 bp, Homo sapiens
cccgctcccagtgt

SEQ ID NO: 1819842 - DNA, 15 bp, Homo sapiens
cccgctcccagtgtc

SEQ ID NO: 1819843 - DNA, 23 bp, Homo sapiens
cccgctcccagtgtcttcctgtg

SEQ ID NO: 1819844 - DNA, 21 bp, Homo sapiens
cccgcttgcctcggctcctgc

SEQ ID NO: 1819845 - DNA, 23 bp, Homo sapiens
cccgcttgcctcggctcctgctg

SEQ ID NO: 1819846 - DNA, 19 bp, Homo sapiens
cccggcctccactccccca

SEQ ID NO: 1819847 - DNA, 19 bp, Homo sapiens
cccggcctcttccacccat

SEQ ID NO: 1819848 - DNA, 15 bp, Homo sapiens
cccggcgccctctgt

SEQ ID NO: 1819849 - DNA, 15 bp, Homo sapiens
cccgggaggggcccg

SEQ ID NO: 1819850 - DNA, 20 bp, Homo sapiens
cccgggctcagggaccacag

SEQ ID NO: 1819851 - DNA, 21 bp, Homo sapiens
cccgggctcagggaccacagc

SEQ ID NO: 1819852 - DNA, 17 bp, Homo sapiens
cccggggcaaggtctcc

SEQ ID NO: 1819853 - DNA, 17 bp, Homo sapiens
cccggggctggcaagca

SEQ ID NO: 1819854 - DNA, 22 bp, Homo sapiens
cccggggctggcaagcagggaa

SEQ ID NO: 1819855 - DNA, 22 bp, Homo sapiens
cccgtcggactgcccccagaaa

SEQ ID NO: 1819856 - DNA, 14 bp, Homo sapiens
cccgtgaagcagtg

SEQ ID NO: 1819857 - DNA, 12 bp, Homo sapiens
cccgtggcccca

SEQ ID NO: 1819858 - DNA, 16 bp, Homo sapiens
cccgttccctgtcaga

SEQ ID NO: 1819859 - DNA, 20 bp, Homo sapiens
cccgttgtctccctggccct

SEQ ID NO: 1819860 - DNA, 22 bp, Homo sapiens
cccgttgtctccctggccctca

SEQ ID NO: 1819861 - DNA, 13 bp, Homo sapiens
ccctatagagagg

SEQ ID NO: 1819862 - DNA, 21 bp, Homo sapiens
ccctatagagagggggctctc

SEQ ID NO: 1819863 - DNA, 18 bp, Homo sapiens
ccctcaaggcctcccaca

SEQ ID NO: 1819864 - DNA, 21 bp, Homo sapiens
ccctcaaggcctcccacagtg

SEQ ID NO: 1819865 - DNA, 14 bp, Homo sapiens
ccctcaccaggggc

SEQ ID NO: 1819866 - DNA, 12 bp, Homo sapiens
ccctcagccctt

SEQ ID NO: 1819867 - DNA, 22 bp, Homo sapiens
ccctcagtcagttcccggagca

SEQ ID NO: 1819868 - DNA, 15 bp, Homo sapiens
ccctccaggcatgct

SEQ ID NO: 1819869 - DNA, 19 bp, Homo sapiens
ccctccaggcatgctggcc

SEQ ID NO: 1819870 - DNA, 16 bp, Homo sapiens
ccctcccaccagaacg

SEQ ID NO: 1819871 - DNA, 13 bp, Homo sapiens
ccctcccagacag

SEQ ID NO: 1819872 - DNA, 14 bp, Homo sapiens
ccctcccagacagg

SEQ ID NO: 1819873 - DNA, 16 bp, Homo sapiens
ccctcccagacaggcc

SEQ ID NO: 1819874 - DNA, 19 bp, Homo sapiens
ccctcccagacaggccctc

SEQ ID NO: 1819875 - DNA, 20 bp, Homo sapiens
ccctcccagacaggccctcc

SEQ ID NO: 1819876 - DNA, 12 bp, Homo sapiens
ccctcccagctg

SEQ ID NO: 1819877 - DNA, 13 bp, Homo sapiens
ccctcccagctga

SEQ ID NO: 1819878 - DNA, 17 bp, Homo sapiens
ccctccccacagtcctc

SEQ ID NO: 1819879 - DNA, 21 bp, Homo sapiens
ccctccccacagtcctcacag

SEQ ID NO: 1819880 - DNA, 13 bp, Homo sapiens
ccctccccagccc

SEQ ID NO: 1819881 - DNA, 12 bp, Homo sapiens
ccctcccctggg

SEQ ID NO: 1819882 - DNA, 14 bp, Homo sapiens
ccctccctctgccc

SEQ ID NO: 1819883 - DNA, 15 bp, Homo sapiens
ccctccctctgcccc

SEQ ID NO: 1819884 - DNA, 12 bp, Homo sapiens
ccctccctgctg

SEQ ID NO: 1819885 - DNA, 13 bp, Homo sapiens
ccctccctgctgt

SEQ ID NO: 1819886 - DNA, 14 bp, Homo sapiens
ccctccctgctgtc

SEQ ID NO: 1819887 - DNA, 23 bp, Homo sapiens
ccctccctgtctccagggccccc

SEQ ID NO: 1819888 - DNA, 15 bp, Homo sapiens
ccctcctacccctcc

SEQ ID NO: 1819889 - DNA, 12 bp, Homo sapiens
ccctcctgctgc

SEQ ID NO: 1819890 - DNA, 16 bp, Homo sapiens
ccctcgaaccaaggca

SEQ ID NO: 1819891 - DNA, 17 bp, Homo sapiens
ccctcgaaccaaggcag

SEQ ID NO: 1819892 - DNA, 18 bp, Homo sapiens
ccctcgaaccaaggcagc

SEQ ID NO: 1819893 - DNA, 14 bp, Homo sapiens
ccctcgtcctgtcc

SEQ ID NO: 1819894 - DNA, 16 bp, Homo sapiens
ccctcgtcctgtccca

SEQ ID NO: 1819895 - DNA, 17 bp, Homo sapiens
ccctcgtcctgtcccag

SEQ ID NO: 1819896 - DNA, 21 bp, Homo sapiens
ccctcgtcctgtcccagaggt

SEQ ID NO: 1819897 - DNA, 22 bp, Homo sapiens
ccctcgtgccagtcgcgctgcc

SEQ ID NO: 1819898 - DNA, 23 bp, Homo sapiens
ccctcgtgccagtcgcgctgcct

SEQ ID NO: 1819899 - DNA, 21 bp, Homo sapiens
ccctctgccccaagcagccag

SEQ ID NO: 1819900 - DNA, 22 bp, Homo sapiens
ccctctgtcatcactccctgga

SEQ ID NO: 1819901 - DNA, 22 bp, Homo sapiens
ccctcttgccccaacccccagc

SEQ ID NO: 1819902 - DNA, 19 bp, Homo sapiens
ccctgaaaacgaaggggcc

SEQ ID NO: 1819903 - DNA, 13 bp, Homo sapiens
ccctgagactcca

SEQ ID NO: 1819904 - DNA, 16 bp, Homo sapiens
ccctgagactccagaa

SEQ ID NO: 1819905 - DNA, 12 bp, Homo sapiens
ccctgaggactg

SEQ ID NO: 1819906 - DNA, 20 bp, Homo sapiens
ccttctccaacaagttgcct

SEQ ID NO: 1819907 - DNA, 12 bp, Homo sapiens
ccttctcccctc

SEQ ID NO: 1819908 - DNA, 13 bp, Homo sapiens
ccttgagcacaaa

SEQ ID NO: 1819909 - DNA, 17 bp, Homo sapiens
ccttgcccccatccctc

SEQ ID NO: 1819910 - DNA, 20 bp, Homo sapiens
ccttgcccccatccctcgga

SEQ ID NO: 1819911 - DNA, 19 bp, Homo sapiens
ccttggcacccccatgctg

SEQ ID NO: 1819912 - DNA, 22 bp, Homo sapiens
ccttggcacccccatgctgcct

SEQ ID NO: 1819913 - DNA, 13 bp, Homo sapiens
ccttggcttcctc

SEQ ID NO: 1819914 - DNA, 16 bp, Homo sapiens
ccttgggcatccaccc

SEQ ID NO: 1819915 - DNA, 17 bp, Homo sapiens
ccttgggcatccaccca

SEQ ID NO: 1819916 - DNA, 18 bp, Homo sapiens
ccttgggcatccacccag

SEQ ID NO: 1819917 - DNA, 12 bp, Homo sapiens
ccttgggctcct

SEQ ID NO: 1819918 - DNA, 15 bp, Homo sapiens
ccttgggctcctggc

SEQ ID NO: 1819919 - DNA, 16 bp, Homo sapiens
ccttgggctcctggct

SEQ ID NO: 1819920 - DNA, 13 bp, Homo sapiens
ccttggggcctgg

SEQ ID NO: 1819921 - DNA, 22 bp, Homo sapiens
ccttggggcctggcttgctcca

SEQ ID NO: 1819922 - DNA, 14 bp, Homo sapiens
ccttgtcctgccag

SEQ ID NO: 1819923 - DNA, 14 bp, Homo sapiens
ccttgtgccctgcc

SEQ ID NO: 1819924 - DNA, 16 bp, Homo sapiens
ccttgtgccctgcccc

SEQ ID NO: 1819925 - DNA, 17 bp, Homo sapiens
ccttgtgccctgccccc

SEQ ID NO: 1819926 - DNA, 15 bp, Homo sapiens
cctttacaactaaat

SEQ ID NO: 1819927 - DNA, 18 bp, Homo sapiens
cctttgcaccatgtgaag

SEQ ID NO: 1819928 - DNA, 18 bp, Homo sapiens
cctttgcaggcccagcag

SEQ ID NO: 1819929 - DNA, 14 bp, Homo sapiens
cctttgttgctcag

SEQ ID NO: 1819930 - DNA, 13 bp, Homo sapiens
ccttttaaaagaa

SEQ ID NO: 1819931 - DNA, 21 bp, Homo sapiens
ccttttataaacctctaattt

SEQ ID NO: 1819932 - DNA, 21 bp, Homo sapiens
ccttttcccggggaggagaga

SEQ ID NO: 1819933 - DNA, 14 bp, Homo sapiens
ccttttgcctggct

SEQ ID NO: 1819934 - DNA, 18 bp, Homo sapiens
ccttttgcctggctgtgg

SEQ ID NO: 1819935 - DNA, 14 bp, Homo sapiens
ccttttgtccccag

SEQ ID NO: 1819936 - DNA, 17 bp, Homo sapiens
ccttttgtccccagggc

SEQ ID NO: 1819937 - DNA, 20 bp, Homo sapiens
ccttttgtccccagggcccc

SEQ ID NO: 1819938 - DNA, 21 bp, Homo sapiens
ccttttgtccccagggcccct

SEQ ID NO: 1819939 - DNA, 16 bp, Homo sapiens
cctttttctacctttt

SEQ ID NO: 1819940 - DNA, 15 bp, Homo sapiens
cgaaccaaggcagcc

SEQ ID NO: 1819941 - DNA, 16 bp, Homo sapiens
cgaaccaaggcagcct

SEQ ID NO: 1819942 - DNA, 22 bp, Homo sapiens
cgaaccaaggcagcctccagag

SEQ ID NO: 1819943 - DNA, 21 bp, Homo sapiens
cgaagaacaatgtcagaaact

SEQ ID NO: 1819944 - DNA, 21 bp, Homo sapiens
cgaagagggaatggatgggga

SEQ ID NO: 1819945 - DNA, 23 bp, Homo sapiens
cgaagagggaatggatggggaga

SEQ ID NO: 1819946 - DNA, 16 bp, Homo sapiens
cgaaggggccccgggg

SEQ ID NO: 1819947 - DNA, 15 bp, Homo sapiens
cgacactgctgcacc

SEQ ID NO: 1819948 - DNA, 13 bp, Homo sapiens
cgaccccatctca

SEQ ID NO: 1819949 - DNA, 18 bp, Homo sapiens
cgaccccatctgcccagg

SEQ ID NO: 1819950 - DNA, 19 bp, Homo sapiens
cgaccccatctgcccagga

SEQ ID NO: 1819951 - DNA, 21 bp, Homo sapiens
cgacttgaattttcccactgc

SEQ ID NO: 1819952 - DNA, 14 bp, Homo sapiens
cgagcactggccag

SEQ ID NO: 1819953 - DNA, 15 bp, Homo sapiens
cgagcactggccaga

SEQ ID NO: 1819954 - DNA, 18 bp, Homo sapiens
cgagcactggccagagag

SEQ ID NO: 1819955 - DNA, 17 bp, Homo sapiens
cgaggcaccggcgctgc

SEQ ID NO: 1819956 - DNA, 22 bp, Homo sapiens
cgaggcaccggcgctgcaggta

SEQ ID NO: 1819957 - DNA, 15 bp, Homo sapiens
cgagtcacctgcaag

SEQ ID NO: 1819958 - DNA, 20 bp, Homo sapiens
cgagtcacctgcaagcccca

SEQ ID NO: 1819959 - DNA, 21 bp, Homo sapiens
cgattgcaggagtccctgcca

SEQ ID NO: 1819960 - DNA, 16 bp, Homo sapiens
cgcaagggcatcaggc

SEQ ID NO: 1819961 - DNA, 16 bp, Homo sapiens
cgcaccagctgctctg

SEQ ID NO: 1819962 - DNA, 17 bp, Homo sapiens
cgcaccagctgctctgc

SEQ ID NO: 1819963 - DNA, 19 bp, Homo sapiens
cgcaccagctgctctgccc

SEQ ID NO: 1819964 - DNA, 16 bp, Homo sapiens
cgcaccctcccctccc

SEQ ID NO: 1819965 - DNA, 12 bp, Homo sapiens
cgcagcccgtga

SEQ ID NO: 1819966 - DNA, 17 bp, Homo sapiens
cgcagcccgtgaagcag

SEQ ID NO: 1819967 - DNA, 19 bp, Homo sapiens
cgcagcccgtgaagcagtg

SEQ ID NO: 1819968 - DNA, 20 bp, Homo sapiens
cgcagcccgtgaagcagtgc

SEQ ID NO: 1819969 - DNA, 21 bp, Homo sapiens
cgcagcccgtgaagcagtgcc

SEQ ID NO: 1819970 - DNA, 23 bp, Homo sapiens
cgcagcccgtgaagcagtgcctc

SEQ ID NO: 1819971 - DNA, 17 bp, Homo sapiens
cgcaggatccgctgcca

SEQ ID NO: 1819972 - DNA, 19 bp, Homo sapiens
cgcaggatccgctgccacc

SEQ ID NO: 1819973 - DNA, 15 bp, Homo sapiens
cgcagtccccagccc

SEQ ID NO: 1819974 - DNA, 16 bp, Homo sapiens
cgcagtcgcaggatcc

SEQ ID NO: 1819975 - DNA, 16 bp, Homo sapiens
cgcccaccgcatgccc

SEQ ID NO: 1819976 - DNA, 17 bp, Homo sapiens
cgcccaccgcatgcccc

SEQ ID NO: 1819977 - DNA, 23 bp, Homo sapiens
cgcccaccgcatgccccctcgtg

SEQ ID NO: 1819978 - DNA, 16 bp, Homo sapiens
cgcccaggctggccag

SEQ ID NO: 1819979 - DNA, 17 bp, Homo sapiens
cgcccaggctggccagc

SEQ ID NO: 1819980 - DNA, 16 bp, Homo sapiens
cgccccatccctgctt

SEQ ID NO: 1819981 - DNA, 21 bp, Homo sapiens
cgccctgcgttggagccactc

SEQ ID NO: 1819982 - DNA, 18 bp, Homo sapiens
cgccgcctcgcccaccgc

SEQ ID NO: 1819983 - DNA, 13 bp, Homo sapiens
cgcctcgcccacc

SEQ ID NO: 1819984 - DNA, 22 bp, Homo sapiens
cgcctcgcccaccgcatgcccc

SEQ ID NO: 1819985 - DNA, 12 bp, Homo sapiens
cgcctggcctga

SEQ ID NO: 1819986 - DNA, 13 bp, Homo sapiens
cgccttcctcctc

SEQ ID NO: 1819987 - DNA, 16 bp, Homo sapiens
cgccttcctcctccac

SEQ ID NO: 1819988 - DNA, 17 bp, Homo sapiens
cgccttcctcctccaca

SEQ ID NO: 1819989 - DNA, 22 bp, Homo sapiens
cgccttcctcctccacagtgct

SEQ ID NO: 1819990 - DNA, 19 bp, Homo sapiens
cgcgccttctcccccccgg

SEQ ID NO: 1819991 - DNA, 15 bp, Homo sapiens
cgcgctgcctgtgtg

SEQ ID NO: 1819992 - DNA, 16 bp, Homo sapiens
cgcgggaggcaccagc

SEQ ID NO: 1819993 - DNA, 18 bp, Homo sapiens
cgcggtgctctggcggct

SEQ ID NO: 1819994 - DNA, 15 bp, Homo sapiens
cgctaacccccagcc

SEQ ID NO: 1819995 - DNA, 22 bp, Homo sapiens
cgctaacccccagcccacagag

SEQ ID NO: 1819996 - DNA, 17 bp, Homo sapiens
cgctcaggacccaggcc

SEQ ID NO: 1819997 - DNA, 18 bp, Homo sapiens
cgctcaggacccaggccc

SEQ ID NO: 1819998 - DNA, 12 bp, Homo sapiens
cgctgatgctgg

SEQ ID NO: 1819999 - DNA, 14 bp, Homo sapiens
cgctgatgctgggc

SEQ ID NO: 1820000 - DNA, 19 bp, Homo sapiens
cgctgatgctgggctgggt

SEQ ID NO: 1820001 - DNA, 22 bp, Homo sapiens
cgctgcaggtacttcctcctga

SEQ ID NO: 1820002 - DNA, 20 bp, Homo sapiens
cgctgccaccacgtctgcca

SEQ ID NO: 1820003 - DNA, 20 bp, Homo sapiens
cgctgctctagctggcagga

SEQ ID NO: 1820004 - DNA, 13 bp, Homo sapiens
cgcttcacccctg

SEQ ID NO: 1820005 - DNA, 12 bp, Homo sapiens
cgcttgagccca

SEQ ID NO: 1820006 - DNA, 15 bp, Homo sapiens
cgcttgagcccagga

SEQ ID NO: 1820007 - DNA, 16 bp, Homo sapiens
cgcttgagcccaggag

SEQ ID NO: 1820008 - DNA, 18 bp, Homo sapiens
cgcttgagcccaggagtt

SEQ ID NO: 1820009 - DNA, 13 bp, Homo sapiens
cgcttgcctcggc

SEQ ID NO: 1820010 - DNA, 18 bp, Homo sapiens
cgcttgcctcggctcctg

SEQ ID NO: 1820011 - DNA, 21 bp, Homo sapiens
cgcttgcctcggctcctgctg

SEQ ID NO: 1820012 - DNA, 15 bp, Homo sapiens
cggactgcccccaga

SEQ ID NO: 1820013 - DNA, 19 bp, Homo sapiens
cggactgcccccagaaagc

SEQ ID NO: 1820014 - DNA, 15 bp, Homo sapiens
cggagcacagccctg

SEQ ID NO: 1820015 - DNA, 17 bp, Homo sapiens
cggagcacagccctggg

SEQ ID NO: 1820016 - DNA, 13 bp, Homo sapiens
cggccaggtgggc

SEQ ID NO: 1820017 - DNA, 12 bp, Homo sapiens
cggcctccactc

SEQ ID NO: 1820018 - DNA, 15 bp, Homo sapiens
cggctcctgctgcac

SEQ ID NO: 1820019 - DNA, 17 bp, Homo sapiens
cggctcctgctgcacca

SEQ ID NO: 1820020 - DNA, 11 bp, Homo sapiens
cggctgcctgc

SEQ ID NO: 1820021 - DNA, 12 bp, Homo sapiens
cggctgcctgcc

SEQ ID NO: 1820022 - DNA, 16 bp, Homo sapiens
cgggaggcaccagctc

SEQ ID NO: 1820023 - DNA, 15 bp, Homo sapiens
ctccccagccagccc

SEQ ID NO: 1820024 - DNA, 18 bp, Homo sapiens
ctccccagccagcccttc

SEQ ID NO: 1820025 - DNA, 14 bp, Homo sapiens
ctccccagcccttt

SEQ ID NO: 1820026 - DNA, 12 bp, Homo sapiens
ctccccaggcct

SEQ ID NO: 1820027 - DNA, 18 bp, Homo sapiens
ctccccaggcctccagcc

SEQ ID NO: 1820028 - DNA, 23 bp, Homo sapiens
ctccccatgtgcctgcaccagga

SEQ ID NO: 1820029 - DNA, 13 bp, Homo sapiens
ctcccccacctga

SEQ ID NO: 1820030 - DNA, 12 bp, Homo sapiens
ctcccccagagc

SEQ ID NO: 1820031 - DNA, 13 bp, Homo sapiens
ctcccccagagcc

SEQ ID NO: 1820032 - DNA, 13 bp, Homo sapiens
ctcccccccgggg

SEQ ID NO: 1820033 - DNA, 18 bp, Homo sapiens
ctcccccccggggctggg

SEQ ID NO: 1820034 - DNA, 15 bp, Homo sapiens
ctcccccgacactgc

SEQ ID NO: 1820035 - DNA, 17 bp, Homo sapiens
ctcccccgacactgctg

SEQ ID NO: 1820036 - DNA, 18 bp, Homo sapiens
ctcccccgcagtccccag

SEQ ID NO: 1820037 - DNA, 21 bp, Homo sapiens
ctcccccgcagtccccagccc

SEQ ID NO: 1820038 - DNA, 22 bp, Homo sapiens
ctcccccgcagtccccagccct

SEQ ID NO: 1820039 - DNA, 13 bp, Homo sapiens
ctcccccgggagg

SEQ ID NO: 1820040 - DNA, 18 bp, Homo sapiens
ctcccccgggaggggccc

SEQ ID NO: 1820041 - DNA, 21 bp, Homo sapiens
ctcccccgggaggggcccgct

SEQ ID NO: 1820042 - DNA, 22 bp, Homo sapiens
ctcccccgggaggggcccgctt

SEQ ID NO: 1820043 - DNA, 15 bp, Homo sapiens
ctcccctcccctggg

SEQ ID NO: 1820044 - DNA, 21 bp, Homo sapiens
ctcccgccccttccccgaggg

SEQ ID NO: 1820045 - DNA, 14 bp, Homo sapiens
ctcccggctgcctg

SEQ ID NO: 1820046 - DNA, 14 bp, Homo sapiens
ctccctctgcccca

SEQ ID NO: 1820047 - DNA, 16 bp, Homo sapiens
ctccctgagctttggg

SEQ ID NO: 1820048 - DNA, 14 bp, Homo sapiens
ctccctgcctgctc

SEQ ID NO: 1820049 - DNA, 16 bp, Homo sapiens
ctccctgcctgctcct

SEQ ID NO: 1820050 - DNA, 19 bp, Homo sapiens
ctccctgcctgctccttgg

SEQ ID NO: 1820051 - DNA, 11 bp, Homo sapiens
ctccctgctgt

SEQ ID NO: 1820052 - DNA, 16 bp, Homo sapiens
ctccctgtctccaggg

SEQ ID NO: 1820053 - DNA, 19 bp, Homo sapiens
ctccctgtctccagggccc

SEQ ID NO: 1820054 - DNA, 17 bp, Homo sapiens
ctcccttcctggcctca

SEQ ID NO: 1820055 - DNA, 22 bp, Homo sapiens
ctccggggtctgtgctgtgcct

SEQ ID NO: 1820056 - DNA, 14 bp, Homo sapiens
ctccgtccacccag

SEQ ID NO: 1820057 - DNA, 15 bp, Homo sapiens
ctccgtccacccagg

SEQ ID NO: 1820058 - DNA, 19 bp, Homo sapiens
ctccgtccacccaggctgc

SEQ ID NO: 1820059 - DNA, 19 bp, Homo sapiens
ctcctacccctcccagctg

SEQ ID NO: 1820060 - DNA, 16 bp, Homo sapiens
ctcctaccctcccacc

SEQ ID NO: 1820061 - DNA, 16 bp, Homo sapiens
ctcctagaggtgggca

SEQ ID NO: 1820062 - DNA, 19 bp, Homo sapiens
ctcctagaggtgggcagct

SEQ ID NO: 1820063 - DNA, 22 bp, Homo sapiens
ctcctagaggtgggcagctggg

SEQ ID NO: 1820064 - DNA, 18 bp, Homo sapiens
ctcctccaccgccatggc

SEQ ID NO: 1820065 - DNA, 20 bp, Homo sapiens
ctcctccagttctgatgagg

SEQ ID NO: 1820066 - DNA, 13 bp, Homo sapiens
ctcctcctccagt

SEQ ID NO: 1820067 - DNA, 16 bp, Homo sapiens
ctcctctccttgggct

SEQ ID NO: 1820068 - DNA, 22 bp, Homo sapiens
ctcctctccttgggctcctggc

SEQ ID NO: 1820069 - DNA, 15 bp, Homo sapiens
ctcctgatggccaag

SEQ ID NO: 1820070 - DNA, 13 bp, Homo sapiens
ctcctgccccctg

SEQ ID NO: 1820071 - DNA, 18 bp, Homo sapiens
ctcctgctgcaccaaccc

SEQ ID NO: 1820072 - DNA, 18 bp, Homo sapiens
ctcctgctgcctaataaa

SEQ ID NO: 1820073 - DNA, 17 bp, Homo sapiens
ctcctggctgccaggcg

SEQ ID NO: 1820074 - DNA, 18 bp, Homo sapiens
ctcctggctgccaggcgt

SEQ ID NO: 1820075 - DNA, 11 bp, Homo sapiens
ctcctgtgccc

SEQ ID NO: 1820076 - DNA, 12 bp, Homo sapiens
ctcctgtgccct

SEQ ID NO: 1820077 - DNA, 14 bp, Homo sapiens
ctccttactctgag

SEQ ID NO: 1820078 - DNA, 20 bp, Homo sapiens
ctccttactctgagcccagg

SEQ ID NO: 1820079 - DNA, 21 bp, Homo sapiens
ctccttactctgagcccaggc

SEQ ID NO: 1820080 - DNA, 21 bp, Homo sapiens
ctccttacttcggttcctctg

SEQ ID NO: 1820081 - DNA, 20 bp, Homo sapiens
ctccttcgtgtctctcccac

SEQ ID NO: 1820082 - DNA, 20 bp, Homo sapiens
ctccttggcacccccatgct

SEQ ID NO: 1820083 - DNA, 15 bp, Homo sapiens
ctccttgggctcctg

SEQ ID NO: 1820084 - DNA, 15 bp, Homo sapiens
ctccttttgtcccca

SEQ ID NO: 1820085 - DNA, 17 bp, Homo sapiens
ctccttttgtccccagg

SEQ ID NO: 1820086 - DNA, 20 bp, Homo sapiens
ctccttttgtccccagggcc

SEQ ID NO: 1820087 - DNA, 16 bp, Homo sapiens
ctcctttttctacctt

SEQ ID NO: 1820088 - DNA, 17 bp, Homo sapiens
ctcgaaccaaggcagcc

SEQ ID NO: 1820089 - DNA, 18 bp, Homo sapiens
ctcgaaccaaggcagcct

SEQ ID NO: 1820090 - DNA, 19 bp, Homo sapiens
ctcgaaccaaggcagcctc

SEQ ID NO: 1820091 - DNA, 15 bp, Homo sapiens
ctcgaagaacaatgt

SEQ ID NO: 1820092 - DNA, 21 bp, Homo sapiens
ctcgaggcaccggcgctgcag

SEQ ID NO: 1820093 - DNA, 22 bp, Homo sapiens
ctcgaggcaccggcgctgcagg

SEQ ID NO: 1820094 - DNA, 23 bp, Homo sapiens
ctcgaggcaccggcgctgcaggt

SEQ ID NO: 1820095 - DNA, 18 bp, Homo sapiens
ctcgcagtcgcaggatcc

SEQ ID NO: 1820096 - DNA, 17 bp, Homo sapiens
ctcgcctggcctgaggt

SEQ ID NO: 1820097 - DNA, 18 bp, Homo sapiens
ctcgctgatgctgggctg

SEQ ID NO: 1820098 - DNA, 19 bp, Homo sapiens
ctcgctgatgctgggctgg

SEQ ID NO: 1820099 - DNA, 21 bp, Homo sapiens
ctcgctgatgctgggctgggt

SEQ ID NO: 1820100 - DNA, 13 bp, Homo sapiens
ctcggctcctgct

SEQ ID NO: 1820101 - DNA, 16 bp, Homo sapiens
ctcgggcccaggccat

SEQ ID NO: 1820102 - DNA, 22 bp, Homo sapiens
ctcggggcccttggggcctggc

SEQ ID NO: 1820103 - DNA, 24 bp, Homo sapiens
ctcggggcccttggggcctggctt

SEQ ID NO: 1820104 - DNA, 19 bp, Homo sapiens
ctcggtggtaccaggtctc

SEQ ID NO: 1820105 - DNA, 18 bp, Homo sapiens
ctcgtccacaggggcagg

SEQ ID NO: 1820106 - DNA, 20 bp, Homo sapiens
ctcgtccacaggggcaggcc

SEQ ID NO: 1820107 - DNA, 23 bp, Homo sapiens
ctcgtccacaggggcaggcctgg

SEQ ID NO: 1820108 - DNA, 17 bp, Homo sapiens
ctcgtcctgtcccagag

SEQ ID NO: 1820109 - DNA, 22 bp, Homo sapiens
ctcgtgccagtcgcgctgcctg

SEQ ID NO: 1820110 - DNA, 24 bp, Homo sapiens
ctcgtgccagtcgcgctgcctgtg

SEQ ID NO: 1820111 - DNA, 14 bp, Homo sapiens
ctcgtggacacctg

SEQ ID NO: 1820112 - DNA, 16 bp, Homo sapiens
ctcgtggacacctgcc

SEQ ID NO: 1820113 - DNA, 18 bp, Homo sapiens
ctctaaactgctgttaat

SEQ ID NO: 1820114 - DNA, 15 bp, Homo sapiens
ctctagccaggagtc

SEQ ID NO: 1820115 - DNA, 22 bp, Homo sapiens
ctctagccaggagtctgtgctc

SEQ ID NO: 1820116 - DNA, 12 bp, Homo sapiens
ctctagctggca

SEQ ID NO: 1820117 - DNA, 16 bp, Homo sapiens
ctctagctggcaggac

SEQ ID NO: 1820118 - DNA, 17 bp, Homo sapiens
ctctagctggcaggaca

SEQ ID NO: 1820119 - DNA, 13 bp, Homo sapiens
ctctatacataaa

SEQ ID NO: 1820120 - DNA, 21 bp, Homo sapiens
ctctcaatattcaataaagct

SEQ ID NO: 1820121 - DNA, 16 bp, Homo sapiens
ctctccaaaggggctg

SEQ ID NO: 1820122 - DNA, 23 bp, Homo sapiens
ctctccaaaggggctgctggggc

SEQ ID NO: 1820123 - DNA, 17 bp, Homo sapiens
ctctcccggctgcctgc

SEQ ID NO: 1820124 - DNA, 16 bp, Homo sapiens
ctctccttcgtgtctc

SEQ ID NO: 1820125 - DNA, 19 bp, Homo sapiens
ctctccttgggctcctggc

SEQ ID NO: 1820126 - DNA, 21 bp, Homo sapiens
ctctccttgggctcctggctg

SEQ ID NO: 1820127 - DNA, 23 bp, Homo sapiens
ctctccttgggctcctggctgcc

SEQ ID NO: 1820128 - DNA, 16 bp, Homo sapiens
ctctcgccccatccct

SEQ ID NO: 1820129 - DNA, 19 bp, Homo sapiens
ctctcgccccatccctgct

SEQ ID NO: 1820130 - DNA, 21 bp, Homo sapiens
ctctcgccccatccctgcttg

SEQ ID NO: 1820131 - DNA, 21 bp, Homo sapiens
ctctgaaaagcaattgccctg

SEQ ID NO: 1820132 - DNA, 22 bp, Homo sapiens
ctctgaaaagcaattgccctgt

SEQ ID NO: 1820133 - DNA, 23 bp, Homo sapiens
ctctgaaaagcaattgccctgta

SEQ ID NO: 1820134 - DNA, 12 bp, Homo sapiens
ctctgagcccag

SEQ ID NO: 1820135 - DNA, 13 bp, Homo sapiens
ctctgagcccagg

SEQ ID NO: 1820136 - DNA, 15 bp, Homo sapiens
ctctgagcccaggcc

SEQ ID NO: 1820137 - DNA, 15 bp, Homo sapiens
ctctgatttcaaggc

SEQ ID NO: 1820138 - DNA, 17 bp, Homo sapiens
ctctgccccaagcagcc

SEQ ID NO: 1820139 - DNA, 21 bp, Homo sapiens
cttccaaaaagatttattaat

SEQ ID NO: 1820140 - DNA, 16 bp, Homo sapiens
cttccaaggtggtctg

SEQ ID NO: 1820141 - DNA, 21 bp, Homo sapiens
cttccactttttccagaattt

SEQ ID NO: 1820142 - DNA, 12 bp, Homo sapiens
cttccaggctct

SEQ ID NO: 1820143 - DNA, 15 bp, Homo sapiens
cttccaggctcttcc

SEQ ID NO: 1820144 - DNA, 17 bp, Homo sapiens
cttccaggctcttcctg

SEQ ID NO: 1820145 - DNA, 22 bp, Homo sapiens
cttcccaaggttactcagcagc

SEQ ID NO: 1820146 - DNA, 23 bp, Homo sapiens
cttccccgagggatgatgccaca

SEQ ID NO: 1820147 - DNA, 23 bp, Homo sapiens
cttcccctcctacccctcccagc

SEQ ID NO: 1820148 - DNA, 19 bp, Homo sapiens
cttccccttttgcctggct

SEQ ID NO: 1820149 - DNA, 15 bp, Homo sapiens
cttccctggccccgc

SEQ ID NO: 1820150 - DNA, 18 bp, Homo sapiens
cttcctccgtccacccag

SEQ ID NO: 1820151 - DNA, 19 bp, Homo sapiens
cttcctccgtccacccagg

SEQ ID NO: 1820152 - DNA, 23 bp, Homo sapiens
cttcctccgtccacccaggctgc

SEQ ID NO: 1820153 - DNA, 24 bp, Homo sapiens
cttcctccgtccacccaggctgca

SEQ ID NO: 1820154 - DNA, 15 bp, Homo sapiens
cttcctcctccacag

SEQ ID NO: 1820155 - DNA, 15 bp, Homo sapiens
cttcctcctgatggc

SEQ ID NO: 1820156 - DNA, 13 bp, Homo sapiens
cttcctgctgctg

SEQ ID NO: 1820157 - DNA, 18 bp, Homo sapiens
cttcctgcttaaacttga

SEQ ID NO: 1820158 - DNA, 16 bp, Homo sapiens
cttcctggacctgagt

SEQ ID NO: 1820159 - DNA, 14 bp, Homo sapiens
cttcctggcctcac

SEQ ID NO: 1820160 - DNA, 20 bp, Homo sapiens
cttcctggcctcactggctg

SEQ ID NO: 1820161 - DNA, 16 bp, Homo sapiens
cttcctgtccactctc

SEQ ID NO: 1820162 - DNA, 22 bp, Homo sapiens
cttcggttcctctgatttcaag

SEQ ID NO: 1820163 - DNA, 21 bp, Homo sapiens
cttctaggagtcaactggctg

SEQ ID NO: 1820164 - DNA, 14 bp, Homo sapiens
cttctgccacttcc

SEQ ID NO: 1820165 - DNA, 16 bp, Homo sapiens
cttctgctgggctggg

SEQ ID NO: 1820166 - DNA, 16 bp, Homo sapiens
cttctggaaggctggc

SEQ ID NO: 1820167 - DNA, 22 bp, Homo sapiens
cttctggaaggctggctgagtg

SEQ ID NO: 1820168 - DNA, 14 bp, Homo sapiens
cttcttaaaggcct

SEQ ID NO: 1820169 - DNA, 19 bp, Homo sapiens
cttcttaaaggcctggaac

SEQ ID NO: 1820170 - DNA, 17 bp, Homo sapiens
cttcttgtggttgtata

SEQ ID NO: 1820171 - DNA, 19 bp, Homo sapiens
cttgaaaacctcatttacc

SEQ ID NO: 1820172 - DNA, 12 bp, Homo sapiens
cttgaaaacttg

SEQ ID NO: 1820173 - DNA, 20 bp, Homo sapiens
cttgaaagcagttaaactga

SEQ ID NO: 1820174 - DNA, 17 bp, Homo sapiens
cttgaccattggctgcg

SEQ ID NO: 1820175 - DNA, 21 bp, Homo sapiens
cttgagagaaaaagtgcccct

SEQ ID NO: 1820176 - DNA, 13 bp, Homo sapiens
cttgagagaaaag

SEQ ID NO: 1820177 - DNA, 16 bp, Homo sapiens
cttgagagaaaagaaa

SEQ ID NO: 1820178 - DNA, 20 bp, Homo sapiens
cttgagcacaaaatttggtc

SEQ ID NO: 1820179 - DNA, 13 bp, Homo sapiens
cttgagcccagga

SEQ ID NO: 1820180 - DNA, 12 bp, Homo sapiens
cttgaggacaca

SEQ ID NO: 1820181 - DNA, 15 bp, Homo sapiens
cttgaggacacatgt

SEQ ID NO: 1820182 - DNA, 16 bp, Homo sapiens
cttgaggacacatgtc

SEQ ID NO: 1820183 - DNA, 17 bp, Homo sapiens
cttgccccaacccccag

SEQ ID NO: 1820184 - DNA, 22 bp, Homo sapiens
cttgcccccatccctcggaccc

SEQ ID NO: 1820185 - DNA, 18 bp, Homo sapiens
cttgcctaggccaaatgc

SEQ ID NO: 1820186 - DNA, 18 bp, Homo sapiens
cttgcctcggctcctgct

SEQ ID NO: 1820187 - DNA, 19 bp, Homo sapiens
cttgcctcggctcctgctg

SEQ ID NO: 1820188 - DNA, 20 bp, Homo sapiens
cttgcctcggctcctgctgc

SEQ ID NO: 1820189 - DNA, 22 bp, Homo sapiens
cttgcctcggctcctgctgcac

SEQ ID NO: 1820190 - DNA, 18 bp, Homo sapiens
cttgccttttaaaagaaa

SEQ ID NO: 1820191 - DNA, 13 bp, Homo sapiens
cttgcgtcctgca

SEQ ID NO: 1820192 - DNA, 19 bp, Homo sapiens
cttgcgtcctgcagaggac

SEQ ID NO: 1820193 - DNA, 24 bp, Homo sapiens
cttgcgtcctgcagaggaccacag

SEQ ID NO: 1820194 - DNA, 22 bp, Homo sapiens
cttgctccagggtcttgggcta

SEQ ID NO: 1820195 - DNA, 16 bp, Homo sapiens
cttgctgaaaaacaca

SEQ ID NO: 1820196 - DNA, 19 bp, Homo sapiens
cttgcttctaaatgcccag

SEQ ID NO: 1820197 - DNA, 23 bp, Homo sapiens
cttgctttgggctttgcaggctc

SEQ ID NO: 1820198 - DNA, 21 bp, Homo sapiens
cttggacttcctggggccccg

SEQ ID NO: 1820199 - DNA, 18 bp, Homo sapiens
cttggagcccgtgcagta

SEQ ID NO: 1820200 - DNA, 21 bp, Homo sapiens
cttggcacccccatgctgcct

SEQ ID NO: 1820201 - DNA, 22 bp, Homo sapiens
cttggcacccccatgctgcctt

SEQ ID NO: 1820202 - DNA, 16 bp, Homo sapiens
cttgggaactccactc

SEQ ID NO: 1820203 - DNA, 20 bp, Homo sapiens
cttgggcatccacccagtgc

SEQ ID NO: 1820204 - DNA, 18 bp, Homo sapiens
cttgggctactggcagct

SEQ ID NO: 1820205 - DNA, 12 bp, Homo sapiens
cttgggctcctg

SEQ ID NO: 1820206 - DNA, 15 bp, Homo sapiens
cttgggctcctggct

SEQ ID NO: 1820207 - DNA, 21 bp, Homo sapiens
cttgggctcctggctgccagg

SEQ ID NO: 1820208 - DNA, 14 bp, Homo sapiens
cttggggcctggct

SEQ ID NO: 1820209 - DNA, 19 bp, Homo sapiens
cttggggcctggcttgctc

SEQ ID NO: 1820210 - DNA, 18 bp, Homo sapiens
cttgggggaggccacccc

SEQ ID NO: 1820211 - DNA, 20 bp, Homo sapiens
cttgggggaggccaccccaa

SEQ ID NO: 1820212 - DNA, 23 bp, Homo sapiens
cttgtatggctctcaagtgaaag

SEQ ID NO: 1820213 - DNA, 14 bp, Homo sapiens
cttgtcctgccagc

SEQ ID NO: 1820214 - DNA, 22 bp, Homo sapiens
cttgtcctgccagctgccttcc

SEQ ID NO: 1820215 - DNA, 13 bp, Homo sapiens
cttgtctgaggcc

SEQ ID NO: 1820216 - DNA, 14 bp, Homo sapiens
cttgtctgaggcct

SEQ ID NO: 1820217 - DNA, 15 bp, Homo sapiens
cttgtgactgaaggg

SEQ ID NO: 1820218 - DNA, 23 bp, Homo sapiens
cttgtgccctgcccccatctccc

SEQ ID NO: 1820219 - DNA, 15 bp, Homo sapiens
cttgttattatctac

SEQ ID NO: 1820220 - DNA, 15 bp, Homo sapiens
ctttaaaataaaata

SEQ ID NO: 1820221 - DNA, 15 bp, Homo sapiens
ctttacgctgtctgt

SEQ ID NO: 1820222 - DNA, 16 bp, Homo sapiens
ctttactcccttcctg

SEQ ID NO: 1820223 - DNA, 23 bp, Homo sapiens
ctttctcccccgacactgctgca

SEQ ID NO: 1820224 - DNA, 16 bp, Homo sapiens
ctttgattccctctga

SEQ ID NO: 1820225 - DNA, 17 bp, Homo sapiens
ctttgcaccatgtgaag

SEQ ID NO: 1820226 - DNA, 13 bp, Homo sapiens
ctttgcagagcct

SEQ ID NO: 1820227 - DNA, 20 bp, Homo sapiens
ctttgcaggcccagcagact

SEQ ID NO: 1820228 - DNA, 15 bp, Homo sapiens
ctttgcaggctctgg

SEQ ID NO: 1820229 - DNA, 11 bp, Homo sapiens
ctttgctgccc

SEQ ID NO: 1820230 - DNA, 19 bp, Homo sapiens
ctttgggctttgcaggctc

SEQ ID NO: 1820231 - DNA, 23 bp, Homo sapiens
ctttgggctttgcaggctctggg

SEQ ID NO: 1820232 - DNA, 24 bp, Homo sapiens
ctttggggacagttggcagagaag

SEQ ID NO: 1820233 - DNA, 15 bp, Homo sapiens
ctttgtgactattaa

SEQ ID NO: 1820234 - DNA, 19 bp, Homo sapiens
ctttgtgactattaaatgt

SEQ ID NO: 1820235 - DNA, 20 bp, Homo sapiens
ctttgttgctcagcaagggg

SEQ ID NO: 1820236 - DNA, 18 bp, Homo sapiens
cttttaaaatagtaattt

SEQ ID NO: 1820237 - DNA, 23 bp, Homo sapiens
cttttaacaaaaaaggaaaatga

SEQ ID NO: 1820238 - DNA, 19 bp, Homo sapiens
cttttcagcttctgctggg

SEQ ID NO: 1820239 - DNA, 20 bp, Homo sapiens
cttttccaggatcctgcagg

SEQ ID NO: 1820240 - DNA, 21 bp, Homo sapiens
cttttccaggatcctgcagga

SEQ ID NO: 1820241 - DNA, 16 bp, Homo sapiens
cttttgtcctgttatt

SEQ ID NO: 1820242 - DNA, 19 bp, Homo sapiens
cttttgtccttcctgtgcc

SEQ ID NO: 1820243 - DNA, 20 bp, Homo sapiens
cttttgtccttcctgtgccc

SEQ ID NO: 1820244 - DNA, 21 bp, Homo sapiens
ctttttaatgttatttggaat

SEQ ID NO: 1820245 - DNA, 14 bp, Homo sapiens
ctttttctaccttt

SEQ ID NO: 1820246 - DNA, 22 bp, Homo sapiens
ctttttgaattaatctagaaaa

SEQ ID NO: 1820247 - DNA, 24 bp, Homo sapiens
ctttttgaattaatctagaaaatg

SEQ ID NO: 1820248 - DNA, 22 bp, Homo sapiens
ctttttgtgaaattcaacctgt

SEQ ID NO: 1820249 - DNA, 14 bp, Homo sapiens
gaaaaaagaaaaaa

SEQ ID NO: 1820250 - DNA, 18 bp, Homo sapiens
gaaaacagctagcttgaa

SEQ ID NO: 1820251 - DNA, 15 bp, Homo sapiens
gaaaacttgctgaaa

SEQ ID NO: 1820252 - DNA, 14 bp, Homo sapiens
gaaaagaccctgag

SEQ ID NO: 1820253 - DNA, 14 bp, Homo sapiens
gaaaagcctctgtg

SEQ ID NO: 1820254 - DNA, 14 bp, Homo sapiens
gaccccatctcatt

SEQ ID NO: 1820255 - DNA, 16 bp, Homo sapiens
gaccccatctgcccag

SEQ ID NO: 1820256 - DNA, 16 bp, Homo sapiens
gaccctgagactccag

SEQ ID NO: 1820257 - DNA, 23 bp, Homo sapiens
gaccctggaattcagcaccctgg

SEQ ID NO: 1820258 - DNA, 17 bp, Homo sapiens
gacccttcagggccaga

SEQ ID NO: 1820259 - DNA, 18 bp, Homo sapiens
gaccgcttcacccctgca

SEQ ID NO: 1820260 - DNA, 16 bp, Homo sapiens
gaccgggtgggcctgg

SEQ ID NO: 1820261 - DNA, 18 bp, Homo sapiens
gaccgggtgggcctggcc

SEQ ID NO: 1820262 - DNA, 23 bp, Homo sapiens
gacctcttctgaagctagaaaca

SEQ ID NO: 1820263 - DNA, 17 bp, Homo sapiens
gacctgagtcggcccca

SEQ ID NO: 1820264 - DNA, 17 bp, Homo sapiens
gacgccaaggaggtggg

SEQ ID NO: 1820265 - DNA, 11 bp, Homo sapiens
gacgccctgcg

SEQ ID NO: 1820266 - DNA, 22 bp, Homo sapiens
gacgtgaacgttttaataattt

SEQ ID NO: 1820267 - DNA, 21 bp, Homo sapiens
gactaaagccatttgtctgtg

SEQ ID NO: 1820268 - DNA, 19 bp, Homo sapiens
gactatgcgtttttataaa

SEQ ID NO: 1820269 - DNA, 12 bp, Homo sapiens
gactccagagtc

SEQ ID NO: 1820270 - DNA, 16 bp, Homo sapiens
gactcccagtgaactt

SEQ ID NO: 1820271 - DNA, 15 bp, Homo sapiens
gactcgggctcctgt

SEQ ID NO: 1820272 - DNA, 20 bp, Homo sapiens
gactcgggctcctgtgccct

SEQ ID NO: 1820273 - DNA, 18 bp, Homo sapiens
gactctttttgtacctgg

SEQ ID NO: 1820274 - DNA, 21 bp, Homo sapiens
gactctttttgtacctggtga

SEQ ID NO: 1820275 - DNA, 15 bp, Homo sapiens
gactgaaggggcaca

SEQ ID NO: 1820276 - DNA, 23 bp, Homo sapiens
gactgaaggggcacaccactgcc

SEQ ID NO: 1820277 - DNA, 19 bp, Homo sapiens
gactgagtgtgggagtgca

SEQ ID NO: 1820278 - DNA, 20 bp, Homo sapiens
gactggagaccgcttcaccc

SEQ ID NO: 1820279 - DNA, 21 bp, Homo sapiens
gactggagaccgcttcacccc

SEQ ID NO: 1820280 - DNA, 22 bp, Homo sapiens
gactggagtgaggcttccaggc

SEQ ID NO: 1820281 - DNA, 16 bp, Homo sapiens
gacttcagatttcaaa

SEQ ID NO: 1820282 - DNA, 18 bp, Homo sapiens
gacttcaggggctgcccg

SEQ ID NO: 1820283 - DNA, 22 bp, Homo sapiens
gacttcctggggccccgctggg

SEQ ID NO: 1820284 - DNA, 17 bp, Homo sapiens
gacttctggaaggctgg

SEQ ID NO: 1820285 - DNA, 16 bp, Homo sapiens
gacttttctaaagctc

SEQ ID NO: 1820286 - DNA, 24 bp, Homo sapiens
gagaaaagaaaaatatgagagaac

SEQ ID NO: 1820287 - DNA, 21 bp, Homo sapiens
gagaaatacagaagaaaataa

SEQ ID NO: 1820288 - DNA, 14 bp, Homo sapiens
gagaaggcgaggag

SEQ ID NO: 1820289 - DNA, 15 bp, Homo sapiens
gagaaggcgaggaga

SEQ ID NO: 1820290 - DNA, 17 bp, Homo sapiens
gagaatgtcagtatgtg

SEQ ID NO: 1820291 - DNA, 15 bp, Homo sapiens
gagacaagccctggc

SEQ ID NO: 1820292 - DNA, 22 bp, Homo sapiens
gagaccatttgtattaccatta

SEQ ID NO: 1820293 - DNA, 17 bp, Homo sapiens
gagaccgcttcacccct

SEQ ID NO: 1820294 - DNA, 21 bp, Homo sapiens
gagactccagaatctgctgtt

SEQ ID NO: 1820295 - DNA, 15 bp, Homo sapiens
gagactgaaagcagc

SEQ ID NO: 1820296 - DNA, 19 bp, Homo sapiens
gagactgaaagcagcagct

SEQ ID NO: 1820297 - DNA, 15 bp, Homo sapiens
gagacttcctctggt

SEQ ID NO: 1820298 - DNA, 12 bp, Homo sapiens
gagagaaaagaa

SEQ ID NO: 1820299 - DNA, 16 bp, Homo sapiens
gagagaaaagaaaaat

SEQ ID NO: 1820300 - DNA, 17 bp, Homo sapiens
gagagactgaaagcagc

SEQ ID NO: 1820301 - DNA, 18 bp, Homo sapiens
gagagactgaaagcagca

SEQ ID NO: 1820302 - DNA, 15 bp, Homo sapiens
gagagagcagcttct

SEQ ID NO: 1820303 - DNA, 17 bp, Homo sapiens
gagagcactagaagtgg

SEQ ID NO: 1820304 - DNA, 15 bp, Homo sapiens
gagaggaaaaaggct

SEQ ID NO: 1820305 - DNA, 18 bp, Homo sapiens
gagagttctttgctgccc

SEQ ID NO: 1820306 - DNA, 20 bp, Homo sapiens
gagagttctttgctgcccct

SEQ ID NO: 1820307 - DNA, 15 bp, Homo sapiens
gagatggtcagtgtg

SEQ ID NO: 1820308 - DNA, 14 bp, Homo sapiens
gagatttgccagca

SEQ ID NO: 1820309 - DNA, 19 bp, Homo sapiens
gagatttgccagcacaggg

SEQ ID NO: 1820310 - DNA, 23 bp, Homo sapiens
gagcaacccctgtacccagctcc

SEQ ID NO: 1820311 - DNA, 20 bp, Homo sapiens
gagcaaggacaacctgcccc

SEQ ID NO: 1820312 - DNA, 13 bp, Homo sapiens
gagcacagccctc

SEQ ID NO: 1820313 - DNA, 20 bp, Homo sapiens
gagcacctgaaccccatggg

SEQ ID NO: 1820314 - DNA, 23 bp, Homo sapiens
gagcacctgaaccccatgggctt

SEQ ID NO: 1820315 - DNA, 12 bp, Homo sapiens
gagcactggcca

SEQ ID NO: 1820316 - DNA, 13 bp, Homo sapiens
gagcactggccag

SEQ ID NO: 1820317 - DNA, 15 bp, Homo sapiens
gagcactggccagag

SEQ ID NO: 1820318 - DNA, 23 bp, Homo sapiens
gagcactggccagagagggccca

SEQ ID NO: 1820319 - DNA, 24 bp, Homo sapiens
gagcactggccagagagggcccag

SEQ ID NO: 1820320 - DNA, 16 bp, Homo sapiens
gagcacttttaacaaa

SEQ ID NO: 1820321 - DNA, 15 bp, Homo sapiens
gagcagcctgatggc

SEQ ID NO: 1820322 - DNA, 16 bp, Homo sapiens
gagcagcttctgccac

SEQ ID NO: 1820323 - DNA, 17 bp, Homo sapiens
gagcagcttctgccact

SEQ ID NO: 1820324 - DNA, 20 bp, Homo sapiens
gagcattcaggcagcactga

SEQ ID NO: 1820325 - DNA, 13 bp, Homo sapiens
gagcatttttcag

SEQ ID NO: 1820326 - DNA, 18 bp, Homo sapiens
gagcatttttcagagttt

SEQ ID NO: 1820327 - DNA, 23 bp, Homo sapiens
gagccactacctttgtccaggcc

SEQ ID NO: 1820328 - DNA, 12 bp, Homo sapiens
gagccactcctg

SEQ ID NO: 1820329 - DNA, 15 bp, Homo sapiens
gagccactcctgtcc

SEQ ID NO: 1820330 - DNA, 17 bp, Homo sapiens
gagccactcctgtcccg

SEQ ID NO: 1820331 - DNA, 21 bp, Homo sapiens
gagccactcgcagtcgcagga

SEQ ID NO: 1820332 - DNA, 12 bp, Homo sapiens
gagccagcctgg

SEQ ID NO: 1820333 - DNA, 13 bp, Homo sapiens
gagccagcctggg

SEQ ID NO: 1820334 - DNA, 15 bp, Homo sapiens
gagccagcctgggac

SEQ ID NO: 1820335 - DNA, 16 bp, Homo sapiens
gagccatgggcctggg

SEQ ID NO: 1820336 - DNA, 18 bp, Homo sapiens
gagccatgggcctgggcc

SEQ ID NO: 1820337 - DNA, 12 bp, Homo sapiens
gagcccaggagt

SEQ ID NO: 1820338 - DNA, 11 bp, Homo sapiens
gagcccaggcc

SEQ ID NO: 1820339 - DNA, 18 bp, Homo sapiens
gagcccctccccagccag

SEQ ID NO: 1820340 - DNA, 21 bp, Homo sapiens
gagctcttcaagctgtcccct

SEQ ID NO: 1820341 - DNA, 19 bp, Homo sapiens
gagctgatttccaggcccc

SEQ ID NO: 1820342 - DNA, 14 bp, Homo sapiens
gagctggaacacaa

SEQ ID NO: 1820343 - DNA, 15 bp, Homo sapiens
gagctggaaggcagg

SEQ ID NO: 1820344 - DNA, 19 bp, Homo sapiens
gagctggaaggcagggcag

SEQ ID NO: 1820345 - DNA, 21 bp, Homo sapiens
gagctggcctattttggacgt

SEQ ID NO: 1820346 - DNA, 20 bp, Homo sapiens
gagcttagccttgtgccctg

SEQ ID NO: 1820347 - DNA, 21 bp, Homo sapiens
gagcttagccttgtgccctgc

SEQ ID NO: 1820348 - DNA, 23 bp, Homo sapiens
gagctttggggacagttggcaga

SEQ ID NO: 1820349 - DNA, 14 bp, Homo sapiens
gaggacacatgtcc

SEQ ID NO: 1820350 - DNA, 20 bp, Homo sapiens
gaggagagagcagcttctgc

SEQ ID NO: 1820351 - DNA, 21 bp, Homo sapiens
gaggagagagcagcttctgcc

SEQ ID NO: 1820352 - DNA, 20 bp, Homo sapiens
gaggagagtggttgttgcca

SEQ ID NO: 1820353 - DNA, 16 bp, Homo sapiens
gaggagggtggaggaa

SEQ ID NO: 1820354 - DNA, 21 bp, Homo sapiens
gaggatgatttcagaaggaga

SEQ ID NO: 1820355 - DNA, 22 bp, Homo sapiens
gaggatgatttcagaaggagaa

SEQ ID NO: 1820356 - DNA, 19 bp, Homo sapiens
gaggcagtgggtcccactt

SEQ ID NO: 1820357 - DNA, 22 bp, Homo sapiens
gaggcagtgggtcccacttccc

SEQ ID NO: 1820358 - DNA, 15 bp, Homo sapiens
gaggccaaggcaggt

SEQ ID NO: 1820359 - DNA, 12 bp, Homo sapiens
gaggccacccca

SEQ ID NO: 1820360 - DNA, 23 bp, Homo sapiens
gaggccaccccaaaccccagccc

SEQ ID NO: 1820361 - DNA, 16 bp, Homo sapiens
gaggcccagccgcagg

SEQ ID NO: 1820362 - DNA, 16 bp, Homo sapiens
gaggccccaggcccta

SEQ ID NO: 1820363 - DNA, 15 bp, Homo sapiens
gaggcctcatccctc

SEQ ID NO: 1820364 - DNA, 18 bp, Homo sapiens
gaggcctgatgctgcccc

SEQ ID NO: 1820365 - DNA, 12 bp, Homo sapiens
gaggctggctgg

SEQ ID NO: 1820366 - DNA, 13 bp, Homo sapiens
gaggctggctggg

SEQ ID NO: 1820367 - DNA, 19 bp, Homo sapiens
gaggcttccaggctcttcc

SEQ ID NO: 1820368 - DNA, 14 bp, Homo sapiens
gaggctttggccca

SEQ ID NO: 1820369 - DNA, 21 bp, Homo sapiens
gagggaatgttccctgcaccc

SEQ ID NO: 1820370 - DNA, 23 bp, Homo sapiens
gccatggctcaggcaagcccctc

SEQ ID NO: 1820371 - DNA, 13 bp, Homo sapiens
gccatgggcctgg

SEQ ID NO: 1820372 - DNA, 16 bp, Homo sapiens
gccatgggcctgggcc

SEQ ID NO: 1820373 - DNA, 17 bp, Homo sapiens
gccatgggcctgggcct

SEQ ID NO: 1820374 - DNA, 18 bp, Homo sapiens
gccatgggcctgggcctg

SEQ ID NO: 1820375 - DNA, 16 bp, Homo sapiens
gccatgtaaaggcctt

SEQ ID NO: 1820376 - DNA, 22 bp, Homo sapiens
gcccaatgctttgggaggccaa

SEQ ID NO: 1820377 - DNA, 14 bp, Homo sapiens
gcccacagagcctg

SEQ ID NO: 1820378 - DNA, 19 bp, Homo sapiens
gcccaccgcatgccccctc

SEQ ID NO: 1820379 - DNA, 15 bp, Homo sapiens
gcccacgtcctgtca

SEQ ID NO: 1820380 - DNA, 16 bp, Homo sapiens
gcccactgtaacaata

SEQ ID NO: 1820381 - DNA, 22 bp, Homo sapiens
gcccagctgtagccatggctca

SEQ ID NO: 1820382 - DNA, 18 bp, Homo sapiens
gcccaggacggggccggc

SEQ ID NO: 1820383 - DNA, 19 bp, Homo sapiens
gcccaggacggggccggcc

SEQ ID NO: 1820384 - DNA, 23 bp, Homo sapiens
gcccaggacggggccggccaggt

SEQ ID NO: 1820385 - DNA, 13 bp, Homo sapiens
gcccaggccatct

SEQ ID NO: 1820386 - DNA, 19 bp, Homo sapiens
gcccaggccatcttccagg

SEQ ID NO: 1820387 - DNA, 23 bp, Homo sapiens
gcccaggccatcttccaggtggg

SEQ ID NO: 1820388 - DNA, 20 bp, Homo sapiens
gcccaggctggagtgcagtg

SEQ ID NO: 1820389 - DNA, 18 bp, Homo sapiens
gcccaggctggccagccc

SEQ ID NO: 1820390 - DNA, 20 bp, Homo sapiens
gcccaggctggccagcccca

SEQ ID NO: 1820391 - DNA, 20 bp, Homo sapiens
gcccataatagttagccctc

SEQ ID NO: 1820392 - DNA, 21 bp, Homo sapiens
gcccataatagttagccctca

SEQ ID NO: 1820393 - DNA, 23 bp, Homo sapiens
gcccataatagttagccctcagt

SEQ ID NO: 1820394 - DNA, 22 bp, Homo sapiens
gcccatcagtgtacccccgccc

SEQ ID NO: 1820395 - DNA, 14 bp, Homo sapiens
gcccatcccccctc

SEQ ID NO: 1820396 - DNA, 16 bp, Homo sapiens
gcccatcccccctcac

SEQ ID NO: 1820397 - DNA, 20 bp, Homo sapiens
gcccatcccccctcaccagg

SEQ ID NO: 1820398 - DNA, 17 bp, Homo sapiens
gcccatctcaggtgcca

SEQ ID NO: 1820399 - DNA, 19 bp, Homo sapiens
gcccatctcaggtgccact

SEQ ID NO: 1820400 - DNA, 18 bp, Homo sapiens
gcccatgggcactgctgg

SEQ ID NO: 1820401 - DNA, 14 bp, Homo sapiens
gccccaacccccag

SEQ ID NO: 1820402 - DNA, 19 bp, Homo sapiens
gccccaacccccagcaccc

SEQ ID NO: 1820403 - DNA, 14 bp, Homo sapiens
gccccaagcagcca

SEQ ID NO: 1820404 - DNA, 18 bp, Homo sapiens
gccccaagcagccagcca

SEQ ID NO: 1820405 - DNA, 21 bp, Homo sapiens
gccccaccctcgtggacacct

SEQ ID NO: 1820406 - DNA, 23 bp, Homo sapiens
gccccacctacttgtgactgaag

SEQ ID NO: 1820407 - DNA, 20 bp, Homo sapiens
gccccagatctgcctgggcc

SEQ ID NO: 1820408 - DNA, 22 bp, Homo sapiens
gccccagatctgcctgggcctg

SEQ ID NO: 1820409 - DNA, 10 bp, Homo sapiens
gccccagcct

SEQ ID NO: 1820410 - DNA, 12 bp, Homo sapiens
gccccagcctgg

SEQ ID NO: 1820411 - DNA, 13 bp, Homo sapiens
gccccagcctggc

SEQ ID NO: 1820412 - DNA, 15 bp, Homo sapiens
gccccatccctgctt

SEQ ID NO: 1820413 - DNA, 13 bp, Homo sapiens
gccccatctcctc

SEQ ID NO: 1820414 - DNA, 13 bp, Homo sapiens
gccccatgctctg

SEQ ID NO: 1820415 - DNA, 16 bp, Homo sapiens
gccccatgctctgccc

SEQ ID NO: 1820416 - DNA, 18 bp, Homo sapiens
gccccatgctctgcccca

SEQ ID NO: 1820417 - DNA, 23 bp, Homo sapiens
gcccccaaccccgcggtgctctg

SEQ ID NO: 1820418 - DNA, 16 bp, Homo sapiens
gcccccagaaagcctc

SEQ ID NO: 1820419 - DNA, 21 bp, Homo sapiens
gcccccagaaagcctcctgcc

SEQ ID NO: 1820420 - DNA, 19 bp, Homo sapiens
gcccccatctccccaggcc

SEQ ID NO: 1820421 - DNA, 20 bp, Homo sapiens
gcccccatctccccaggcct

SEQ ID NO: 1820422 - DNA, 21 bp, Homo sapiens
gcccccatctccccaggcctc

SEQ ID NO: 1820423 - DNA, 18 bp, Homo sapiens
gccccccatcctggccca

SEQ ID NO: 1820424 - DNA, 20 bp, Homo sapiens
gccccccatcctggcccatc

SEQ ID NO: 1820425 - DNA, 12 bp, Homo sapiens
gccccctcgtgc

SEQ ID NO: 1820426 - DNA, 13 bp, Homo sapiens
gccccgctgggat

SEQ ID NO: 1820427 - DNA, 23 bp, Homo sapiens
gccccgctgggatttcttcgctg

SEQ ID NO: 1820428 - DNA, 19 bp, Homo sapiens
gccccggggctggcaagca

SEQ ID NO: 1820429 - DNA, 21 bp, Homo sapiens
gccccgtcggactgcccccag

SEQ ID NO: 1820430 - DNA, 16 bp, Homo sapiens
gccccgttccctgtca

SEQ ID NO: 1820431 - DNA, 18 bp, Homo sapiens
gccccgttccctgtcaga

SEQ ID NO: 1820432 - DNA, 22 bp, Homo sapiens
gcccctccccagccagcccttc

SEQ ID NO: 1820433 - DNA, 17 bp, Homo sapiens
gcccctccctctgcccc

SEQ ID NO: 1820434 - DNA, 18 bp, Homo sapiens
gcccctccctctgcccca

SEQ ID NO: 1820435 - DNA, 20 bp, Homo sapiens
gcccctccctctgccccaag

SEQ ID NO: 1820436 - DNA, 15 bp, Homo sapiens
gcccctgaggactgg

SEQ ID NO: 1820437 - DNA, 18 bp, Homo sapiens
gcccctgtaggttgctta

SEQ ID NO: 1820438 - DNA, 23 bp, Homo sapiens
gccccttaagggttgaaggcagt

SEQ ID NO: 1820439 - DNA, 16 bp, Homo sapiens
gccccttccccgaggg

SEQ ID NO: 1820440 - DNA, 22 bp, Homo sapiens
gccccttgggcatccacccagt

SEQ ID NO: 1820441 - DNA, 14 bp, Homo sapiens
gcccgaccccatct

SEQ ID NO: 1820442 - DNA, 19 bp, Homo sapiens
gcccgaccccatctcattc

SEQ ID NO: 1820443 - DNA, 18 bp, Homo sapiens
gcccgcctaggagttgag

SEQ ID NO: 1820444 - DNA, 12 bp, Homo sapiens
gcccgcttgcct

SEQ ID NO: 1820445 - DNA, 18 bp, Homo sapiens
gcccggcgccctctgtcc

SEQ ID NO: 1820446 - DNA, 19 bp, Homo sapiens
gcccgtgaagcagtgcctc

SEQ ID NO: 1820447 - DNA, 22 bp, Homo sapiens
gcccgtgaagcagtgcctcgag

SEQ ID NO: 1820448 - DNA, 17 bp, Homo sapiens
gcccgtgtgacccgttc

SEQ ID NO: 1820449 - DNA, 18 bp, Homo sapiens
gcccgttgtctccctggc

SEQ ID NO: 1820450 - DNA, 19 bp, Homo sapiens
gcccgttgtctccctggcc

SEQ ID NO: 1820451 - DNA, 23 bp, Homo sapiens
gccctaggattcctcccccagag

SEQ ID NO: 1820452 - DNA, 16 bp, Homo sapiens
gccctcaaggcctccc

SEQ ID NO: 1820453 - DNA, 16 bp, Homo sapiens
gccctcgaaccaaggc

SEQ ID NO: 1820454 - DNA, 19 bp, Homo sapiens
gccctcgaaccaaggcagc

SEQ ID NO: 1820455 - DNA, 22 bp, Homo sapiens
gccctcgaaccaaggcagcctc

SEQ ID NO: 1820456 - DNA, 12 bp, Homo sapiens
gccctctgtcct

SEQ ID NO: 1820457 - DNA, 13 bp, Homo sapiens
gccctctgtcctg

SEQ ID NO: 1820458 - DNA, 16 bp, Homo sapiens
gccctgcactgtcctg

SEQ ID NO: 1820459 - DNA, 20 bp, Homo sapiens
gccctgcactgtcctgctcc

SEQ ID NO: 1820460 - DNA, 22 bp, Homo sapiens
gccctgcactgtcctgctccac

SEQ ID NO: 1820461 - DNA, 15 bp, Homo sapiens
gccctgccacctgtc

SEQ ID NO: 1820462 - DNA, 17 bp, Homo sapiens
gccctgccacctgtctg

SEQ ID NO: 1820463 - DNA, 18 bp, Homo sapiens
gccctgccacctgtctgt

SEQ ID NO: 1820464 - DNA, 20 bp, Homo sapiens
gccctgccacctgtctgtct

SEQ ID NO: 1820465 - DNA, 23 bp, Homo sapiens
gccctgcccccatctccccaggc

SEQ ID NO: 1820466 - DNA, 13 bp, Homo sapiens
gccctgcctgccc

SEQ ID NO: 1820467 - DNA, 14 bp, Homo sapiens
gccctgcctgccca

SEQ ID NO: 1820468 - DNA, 16 bp, Homo sapiens
gccctgcgttggagcc

SEQ ID NO: 1820469 - DNA, 18 bp, Homo sapiens
gccctgcgttggagccac

SEQ ID NO: 1820470 - DNA, 20 bp, Homo sapiens
gccctgcgttggagccactc

SEQ ID NO: 1820471 - DNA, 22 bp, Homo sapiens
gccctgcgttggagccactcct

SEQ ID NO: 1820472 - DNA, 16 bp, Homo sapiens
gccctgggagggggct

SEQ ID NO: 1820473 - DNA, 12 bp, Homo sapiens
gcccttctgcct

SEQ ID NO: 1820474 - DNA, 13 bp, Homo sapiens
gcccttgccccca

SEQ ID NO: 1820475 - DNA, 20 bp, Homo sapiens
gcccttgcccccatccctcg

SEQ ID NO: 1820476 - DNA, 18 bp, Homo sapiens
gcccttgtcctgccagct

SEQ ID NO: 1820477 - DNA, 20 bp, Homo sapiens
gcccttgtcctgccagctgc

SEQ ID NO: 1820478 - DNA, 16 bp, Homo sapiens
gccctttgcaggccca

SEQ ID NO: 1820479 - DNA, 21 bp, Homo sapiens
gccgcaggaaggcagaataaa

SEQ ID NO: 1820480 - DNA, 14 bp, Homo sapiens
gccgccgcctcgcc

SEQ ID NO: 1820481 - DNA, 15 bp, Homo sapiens
gccgccgcctcgccc

SEQ ID NO: 1820482 - DNA, 17 bp, Homo sapiens
gccgcctcgcccaccgc

SEQ ID NO: 1820483 - DNA, 19 bp, Homo sapiens
gccgctgcccggcgccctc

SEQ ID NO: 1820484 - DNA, 15 bp, Homo sapiens
gccggcaagcgagca

SEQ ID NO: 1820485 - DNA, 13 bp, Homo sapiens
gccggccaggtgg

SEQ ID NO: 1820486 - DNA, 19 bp, Homo sapiens
gctgcactctgtgcccatg

SEQ ID NO: 1820487 - DNA, 15 bp, Homo sapiens
gctgcactgcagtga

SEQ ID NO: 1820488 - DNA, 13 bp, Homo sapiens
gctgcagaggggc

SEQ ID NO: 1820489 - DNA, 15 bp, Homo sapiens
gctgcagaggggcag

SEQ ID NO: 1820490 - DNA, 22 bp, Homo sapiens
gctgcagaggggcaggccctgc

SEQ ID NO: 1820491 - DNA, 23 bp, Homo sapiens
gctgcagaggggcaggccctgca

SEQ ID NO: 1820492 - DNA, 15 bp, Homo sapiens
gctgcagctgggccc

SEQ ID NO: 1820493 - DNA, 20 bp, Homo sapiens
gctgcaggtacttcctcctg

SEQ ID NO: 1820494 - DNA, 21 bp, Homo sapiens
gctgcaggtacttcctcctga

SEQ ID NO: 1820495 - DNA, 23 bp, Homo sapiens
gctgccaccacgtctgccaggcc

SEQ ID NO: 1820496 - DNA, 20 bp, Homo sapiens
gctgccaggcgttggtgcca

SEQ ID NO: 1820497 - DNA, 12 bp, Homo sapiens
gctgccatgcca

SEQ ID NO: 1820498 - DNA, 15 bp, Homo sapiens
gctgccatgccactg

SEQ ID NO: 1820499 - DNA, 13 bp, Homo sapiens
gctgcccctgtag

SEQ ID NO: 1820500 - DNA, 13 bp, Homo sapiens
gctgcccctgtct

SEQ ID NO: 1820501 - DNA, 16 bp, Homo sapiens
gctgcccgctcccagt

SEQ ID NO: 1820502 - DNA, 20 bp, Homo sapiens
gctgcccgctcccagtgtct

SEQ ID NO: 1820503 - DNA, 17 bp, Homo sapiens
gctgcccggcgccctct

SEQ ID NO: 1820504 - DNA, 19 bp, Homo sapiens
gctgcccggcgccctctgt

SEQ ID NO: 1820505 - DNA, 23 bp, Homo sapiens
gctgcccggcgccctctgtcctg

SEQ ID NO: 1820506 - DNA, 14 bp, Homo sapiens
gctgcctaataaag

SEQ ID NO: 1820507 - DNA, 15 bp, Homo sapiens
gctgcctaataaaga

SEQ ID NO: 1820508 - DNA, 12 bp, Homo sapiens
gctgcctccact

SEQ ID NO: 1820509 - DNA, 17 bp, Homo sapiens
gctgcctccactcccac

SEQ ID NO: 1820510 - DNA, 14 bp, Homo sapiens
gctgccttcaggga

SEQ ID NO: 1820511 - DNA, 15 bp, Homo sapiens
gctgccttcctcatc

SEQ ID NO: 1820512 - DNA, 14 bp, Homo sapiens
gctgccttgccatg

SEQ ID NO: 1820513 - DNA, 15 bp, Homo sapiens
gctgcgggtctgaag

SEQ ID NO: 1820514 - DNA, 21 bp, Homo sapiens
gctgctaccctccctgctgtc

SEQ ID NO: 1820515 - DNA, 16 bp, Homo sapiens
gctgctctagctggca

SEQ ID NO: 1820516 - DNA, 22 bp, Homo sapiens
gctgctctagctggcaggacac

SEQ ID NO: 1820517 - DNA, 13 bp, Homo sapiens
gctgctctgcccc

SEQ ID NO: 1820518 - DNA, 14 bp, Homo sapiens
gctgctctgcccct

SEQ ID NO: 1820519 - DNA, 22 bp, Homo sapiens
gctgctggggcatgtgtgcctg

SEQ ID NO: 1820520 - DNA, 16 bp, Homo sapiens
gctgctgtaactgctg

SEQ ID NO: 1820521 - DNA, 18 bp, Homo sapiens
gctgctgtaactgctgag

SEQ ID NO: 1820522 - DNA, 23 bp, Homo sapiens
gctgctgtaactgctgagccact

SEQ ID NO: 1820523 - DNA, 13 bp, Homo sapiens
gctggaacacaat

SEQ ID NO: 1820524 - DNA, 16 bp, Homo sapiens
gctggaaggcagggca

SEQ ID NO: 1820525 - DNA, 15 bp, Homo sapiens
gctggagtgcagtgg

SEQ ID NO: 1820526 - DNA, 15 bp, Homo sapiens
gctggcaagcaggga

SEQ ID NO: 1820527 - DNA, 16 bp, Homo sapiens
gctggcaagcagggaa

SEQ ID NO: 1820528 - DNA, 20 bp, Homo sapiens
gctggcctcccaataaagct

SEQ ID NO: 1820529 - DNA, 22 bp, Homo sapiens
gctggcctcccaataaagctgg

SEQ ID NO: 1820530 - DNA, 12 bp, Homo sapiens
gctggctgagtg

SEQ ID NO: 1820531 - DNA, 20 bp, Homo sapiens
gctgggaataagtgccagga

SEQ ID NO: 1820532 - DNA, 22 bp, Homo sapiens
gctgggatttcttcgctgctct

SEQ ID NO: 1820533 - DNA, 24 bp, Homo sapiens
gctgggatttcttcgctgctctag

SEQ ID NO: 1820534 - DNA, 15 bp, Homo sapiens
gctgggccccaccta

SEQ ID NO: 1820535 - DNA, 17 bp, Homo sapiens
gctgggctggggcctga

SEQ ID NO: 1820536 - DNA, 12 bp, Homo sapiens
gctgggctgggt

SEQ ID NO: 1820537 - DNA, 15 bp, Homo sapiens
gctgggctgggtgcg

SEQ ID NO: 1820538 - DNA, 14 bp, Homo sapiens
gctggggatgtctc

SEQ ID NO: 1820539 - DNA, 22 bp, Homo sapiens
gctggggcagaggggcagccgc

SEQ ID NO: 1820540 - DNA, 19 bp, Homo sapiens
gctggggcctgatggggag

SEQ ID NO: 1820541 - DNA, 18 bp, Homo sapiens
gctgggtgcgaccccatc

SEQ ID NO: 1820542 - DNA, 21 bp, Homo sapiens
gctgggtgcgaccccatctgc

SEQ ID NO: 1820543 - DNA, 22 bp, Homo sapiens
gctgggtgcgaccccatctgcc

SEQ ID NO: 1820544 - DNA, 14 bp, Homo sapiens
gctgggtggcccat

SEQ ID NO: 1820545 - DNA, 20 bp, Homo sapiens
gctgggtggcccatcccccc

SEQ ID NO: 1820546 - DNA, 17 bp, Homo sapiens
gctgggttggcgcaccc

SEQ ID NO: 1820547 - DNA, 21 bp, Homo sapiens
gctgggttggcgcaccctccc

SEQ ID NO: 1820548 - DNA, 19 bp, Homo sapiens
gctgtaactgctgagccac

SEQ ID NO: 1820549 - DNA, 18 bp, Homo sapiens
gctgtacccttccacctc

SEQ ID NO: 1820550 - DNA, 14 bp, Homo sapiens
gctgtactcagagc

SEQ ID NO: 1820551 - DNA, 15 bp, Homo sapiens
gctgtactcagagca

SEQ ID NO: 1820552 - DNA, 17 bp, Homo sapiens
gctgtactcagagcaga

SEQ ID NO: 1820553 - DNA, 20 bp, Homo sapiens
gctgtactcagagcagagca

SEQ ID NO: 1820554 - DNA, 13 bp, Homo sapiens
gctgtagccatgg

SEQ ID NO: 1820555 - DNA, 17 bp, Homo sapiens
gctgtagccatggctca

SEQ ID NO: 1820556 - DNA, 20 bp, Homo sapiens
gctgtagccatggctcaggc

SEQ ID NO: 1820557 - DNA, 16 bp, Homo sapiens
gctgtccagtgcccat

SEQ ID NO: 1820558 - DNA, 12 bp, Homo sapiens
gctgtcccctct

SEQ ID NO: 1820559 - DNA, 15 bp, Homo sapiens
gctgtcccctcttgc

SEQ ID NO: 1820560 - DNA, 16 bp, Homo sapiens
gctgtcccctcttgcc

SEQ ID NO: 1820561 - DNA, 18 bp, Homo sapiens
gctgtcccctcttgcccc

SEQ ID NO: 1820562 - DNA, 23 bp, Homo sapiens
gctgtcccctcttgccccaaccc

SEQ ID NO: 1820563 - DNA, 19 bp, Homo sapiens
gctgtgccaccctgggctc

SEQ ID NO: 1820564 - DNA, 22 bp, Homo sapiens
gctgtgcctgctagagcaaccc

SEQ ID NO: 1820565 - DNA, 13 bp, Homo sapiens
gctgtggaggcct

SEQ ID NO: 1820566 - DNA, 15 bp, Homo sapiens
gctgtggaggcctga

SEQ ID NO: 1820567 - DNA, 12 bp, Homo sapiens
gctgtggcacag

SEQ ID NO: 1820568 - DNA, 18 bp, Homo sapiens
gctgtggcatcaggaaag

SEQ ID NO: 1820569 - DNA, 14 bp, Homo sapiens
gctgttgccatagc

SEQ ID NO: 1820570 - DNA, 17 bp, Homo sapiens
gcttaaacttgacccag

SEQ ID NO: 1820571 - DNA, 22 bp, Homo sapiens
gcttaaacttgacccaggtggc

SEQ ID NO: 1820572 - DNA, 13 bp, Homo sapiens
gcttagccttgtg

SEQ ID NO: 1820573 - DNA, 18 bp, Homo sapiens
gcttagccttgtgccctg

SEQ ID NO: 1820574 - DNA, 15 bp, Homo sapiens
gcttcacccctgcac

SEQ ID NO: 1820575 - DNA, 15 bp, Homo sapiens
gcttccaaggtggtc

SEQ ID NO: 1820576 - DNA, 16 bp, Homo sapiens
gcttccaaggtggtct

SEQ ID NO: 1820577 - DNA, 12 bp, Homo sapiens
gcttccaggctc

SEQ ID NO: 1820578 - DNA, 18 bp, Homo sapiens
gcttcctccgtccaccca

SEQ ID NO: 1820579 - DNA, 23 bp, Homo sapiens
gcttcctccgtccacccaggctg

SEQ ID NO: 1820580 - DNA, 13 bp, Homo sapiens
gcttcctgagggc

SEQ ID NO: 1820581 - DNA, 22 bp, Homo sapiens
gcttcctggtgtatttttcagg

SEQ ID NO: 1820582 - DNA, 14 bp, Homo sapiens
gcttcctgtccact

SEQ ID NO: 1820583 - DNA, 23 bp, Homo sapiens
gcttcctgtccactctcggggcc

SEQ ID NO: 1820584 - DNA, 16 bp, Homo sapiens
gcttctaaatgcccag

SEQ ID NO: 1820585 - DNA, 15 bp, Homo sapiens
gcttctaggagtcaa

SEQ ID NO: 1820586 - DNA, 20 bp, Homo sapiens
gcttctaggagtcaactggc

SEQ ID NO: 1820587 - DNA, 18 bp, Homo sapiens
gcttctgccacttcccag

SEQ ID NO: 1820588 - DNA, 15 bp, Homo sapiens
gcttgagcccaggag

SEQ ID NO: 1820589 - DNA, 19 bp, Homo sapiens
gcttgcctcggctcctgct

SEQ ID NO: 1820590 - DNA, 20 bp, Homo sapiens
gcttgcctcggctcctgctg

SEQ ID NO: 1820591 - DNA, 14 bp, Homo sapiens
gcttgctccagggt

SEQ ID NO: 1820592 - DNA, 15 bp, Homo sapiens
gcttgctccagggtc

SEQ ID NO: 1820593 - DNA, 16 bp, Homo sapiens
gcttggacttcctggg

SEQ ID NO: 1820594 - DNA, 18 bp, Homo sapiens
gcttggacttcctggggc

SEQ ID NO: 1820595 - DNA, 23 bp, Homo sapiens
gcttggggctgcacctcctaccc

SEQ ID NO: 1820596 - DNA, 16 bp, Homo sapiens
gcttggtggggctcgt

SEQ ID NO: 1820597 - DNA, 20 bp, Homo sapiens
gctttactcaagcagatctc

SEQ ID NO: 1820598 - DNA, 15 bp, Homo sapiens
gctttctccggggtc

SEQ ID NO: 1820599 - DNA, 12 bp, Homo sapiens
gctttctccttt

SEQ ID NO: 1820600 - DNA, 14 bp, Homo sapiens
gctttgcaggctct

SEQ ID NO: 1820601 - DNA, 16 bp, Homo sapiens
gctttgcaggctctgg

SEQ ID NO: 1820602 - DNA, 22 bp, Homo sapiens
gctttgcaggctctgggctcag

SEQ ID NO: 1820603 - DNA, 23 bp, Homo sapiens
gggaggcaccagctctgtggcct

SEQ ID NO: 1820604 - DNA, 14 bp, Homo sapiens
gggatagatgtgtg

SEQ ID NO: 1820605 - DNA, 21 bp, Homo sapiens
gggatgctatctcgctagcca

SEQ ID NO: 1820606 - DNA, 19 bp, Homo sapiens
gggatttcttcgctgctct

SEQ ID NO: 1820607 - DNA, 23 bp, Homo sapiens
gggcacaccactgccctgcctgc

SEQ ID NO: 1820608 - DNA, 17 bp, Homo sapiens
gggcagagccatgggcc

SEQ ID NO: 1820609 - DNA, 19 bp, Homo sapiens
gggcagagccatgggcctg

SEQ ID NO: 1820610 - DNA, 23 bp, Homo sapiens
gggcagagggaatgttccctgca

SEQ ID NO: 1820611 - DNA, 18 bp, Homo sapiens
gggcagaggggcagccgc

SEQ ID NO: 1820612 - DNA, 14 bp, Homo sapiens
gggcagcacagcaa

SEQ ID NO: 1820613 - DNA, 17 bp, Homo sapiens
gggcagccgctaggaga

SEQ ID NO: 1820614 - DNA, 19 bp, Homo sapiens
gggcagccgctaggagaga

SEQ ID NO: 1820615 - DNA, 17 bp, Homo sapiens
gggcagctgggccccac

SEQ ID NO: 1820616 - DNA, 17 bp, Homo sapiens
gggcaggcacagcacag

SEQ ID NO: 1820617 - DNA, 22 bp, Homo sapiens
gggcaggccctgcactgtcctg

SEQ ID NO: 1820618 - DNA, 14 bp, Homo sapiens
gggcaggcctggga

SEQ ID NO: 1820619 - DNA, 15 bp, Homo sapiens
gggcagtggggagca

SEQ ID NO: 1820620 - DNA, 19 bp, Homo sapiens
gggcatccacccagtgctg

SEQ ID NO: 1820621 - DNA, 23 bp, Homo sapiens
gggcatccacccagtgctgccat

SEQ ID NO: 1820622 - DNA, 16 bp, Homo sapiens
gggcatgtgtgcctgt

SEQ ID NO: 1820623 - DNA, 23 bp, Homo sapiens
gggcatgtgtgcctgtggcagaa

SEQ ID NO: 1820624 - DNA, 14 bp, Homo sapiens
gggcattgggctga

SEQ ID NO: 1820625 - DNA, 18 bp, Homo sapiens
gggccacacccaggaagg

SEQ ID NO: 1820626 - DNA, 20 bp, Homo sapiens
gggccacacccaggaaggga

SEQ ID NO: 1820627 - DNA, 15 bp, Homo sapiens
gggccatactggcct

SEQ ID NO: 1820628 - DNA, 22 bp, Homo sapiens
gggccatactggcctcgcctgg

SEQ ID NO: 1820629 - DNA, 20 bp, Homo sapiens
gggcccagctgtagccatgg

SEQ ID NO: 1820630 - DNA, 20 bp, Homo sapiens
gggcccaggccatcttccag

SEQ ID NO: 1820631 - DNA, 17 bp, Homo sapiens
gggccccagatctgcct

SEQ ID NO: 1820632 - DNA, 18 bp, Homo sapiens
gggccccagatctgcctg

SEQ ID NO: 1820633 - DNA, 20 bp, Homo sapiens
gggccccagatctgcctggg

SEQ ID NO: 1820634 - DNA, 20 bp, Homo sapiens
gggccccatgctctgcccca

SEQ ID NO: 1820635 - DNA, 16 bp, Homo sapiens
gggcccctccctctgc

SEQ ID NO: 1820636 - DNA, 14 bp, Homo sapiens
gggcccgcttgcct

SEQ ID NO: 1820637 - DNA, 23 bp, Homo sapiens
gggcccgcttgcctcggctcctg

SEQ ID NO: 1820638 - DNA, 16 bp, Homo sapiens
gggcccgttgtctccc

SEQ ID NO: 1820639 - DNA, 18 bp, Homo sapiens
gggcccgttgtctccctg

SEQ ID NO: 1820640 - DNA, 18 bp, Homo sapiens
gggcccttggggcctggc

SEQ ID NO: 1820641 - DNA, 19 bp, Homo sapiens
gggcccttggggcctggct

SEQ ID NO: 1820642 - DNA, 20 bp, Homo sapiens
gggcccttggggcctggctt

SEQ ID NO: 1820643 - DNA, 14 bp, Homo sapiens
gggccggccaggtg

SEQ ID NO: 1820644 - DNA, 15 bp, Homo sapiens
gggccggccaggtgg

SEQ ID NO: 1820645 - DNA, 15 bp, Homo sapiens
gggcctatcagtgtg

SEQ ID NO: 1820646 - DNA, 23 bp, Homo sapiens
gggcctatcagtgtgccccccat

SEQ ID NO: 1820647 - DNA, 12 bp, Homo sapiens
gggcctggcctg

SEQ ID NO: 1820648 - DNA, 19 bp, Homo sapiens
gggcctggcctgagctggg

SEQ ID NO: 1820649 - DNA, 16 bp, Homo sapiens
gggcctggcttgctcc

SEQ ID NO: 1820650 - DNA, 19 bp, Homo sapiens
gggcctggcttgctccagg

SEQ ID NO: 1820651 - DNA, 12 bp, Homo sapiens
gggcctgtgcag

SEQ ID NO: 1820652 - DNA, 14 bp, Homo sapiens
gggcctgtgcagca

SEQ ID NO: 1820653 - DNA, 18 bp, Homo sapiens
gggcctgtgcagcagccc

SEQ ID NO: 1820654 - DNA, 20 bp, Homo sapiens
gggcgctcaggacccaggcc

SEQ ID NO: 1820655 - DNA, 22 bp, Homo sapiens
gggctaattctgggaagggaga

SEQ ID NO: 1820656 - DNA, 23 bp, Homo sapiens
gggctaccccccctcctgctgcc

SEQ ID NO: 1820657 - DNA, 13 bp, Homo sapiens
gggctactggcag

SEQ ID NO: 1820658 - DNA, 21 bp, Homo sapiens
gggctagtgtgagtggcagcc

SEQ ID NO: 1820659 - DNA, 22 bp, Homo sapiens
gggctagtgtgagtggcagcca

SEQ ID NO: 1820660 - DNA, 14 bp, Homo sapiens
gggctatggcaagg

SEQ ID NO: 1820661 - DNA, 17 bp, Homo sapiens
gggctatggcaaggggg

SEQ ID NO: 1820662 - DNA, 16 bp, Homo sapiens
gggctatttctctccc

SEQ ID NO: 1820663 - DNA, 18 bp, Homo sapiens
gggctatttctctcccca

SEQ ID NO: 1820664 - DNA, 22 bp, Homo sapiens
gggctatttctctccccactga

SEQ ID NO: 1820665 - DNA, 17 bp, Homo sapiens
gggctcagggaccacag

SEQ ID NO: 1820666 - DNA, 20 bp, Homo sapiens
gggctcagggaccacagcaa

SEQ ID NO: 1820667 - DNA, 15 bp, Homo sapiens
gggctcagggctgga

SEQ ID NO: 1820668 - DNA, 17 bp, Homo sapiens
gggctccagcatccagc

SEQ ID NO: 1820669 - DNA, 22 bp, Homo sapiens
gggctccagcatccagcctgtg

SEQ ID NO: 1820670 - DNA, 13 bp, Homo sapiens
gggctcctggctg

SEQ ID NO: 1820671 - DNA, 15 bp, Homo sapiens
gggctcctggctgcc

SEQ ID NO: 1820672 - DNA, 16 bp, Homo sapiens
gggctcctggctgcca

SEQ ID NO: 1820673 - DNA, 20 bp, Homo sapiens
gggctcctggctgccaggcg

SEQ ID NO: 1820674 - DNA, 13 bp, Homo sapiens
gggctctccaaag

SEQ ID NO: 1820675 - DNA, 19 bp, Homo sapiens
gggctctccaaaggggctg

SEQ ID NO: 1820676 - DNA, 22 bp, Homo sapiens
gggctctccaaaggggctgctg

SEQ ID NO: 1820677 - DNA, 22 bp, Homo sapiens
gggctctgccctccctccttcc

SEQ ID NO: 1820678 - DNA, 21 bp, Homo sapiens
gggctgacacctaccatgctg

SEQ ID NO: 1820679 - DNA, 16 bp, Homo sapiens
gggctgcactctgtgc

SEQ ID NO: 1820680 - DNA, 20 bp, Homo sapiens
gggctgcactctgtgcccat

SEQ ID NO: 1820681 - DNA, 21 bp, Homo sapiens
gggctgcccctgtaggttgct

SEQ ID NO: 1820682 - DNA, 16 bp, Homo sapiens
gggctgctggggcatg

SEQ ID NO: 1820683 - DNA, 21 bp, Homo sapiens
gggctggagtgcgctcttggt

SEQ ID NO: 1820684 - DNA, 18 bp, Homo sapiens
gggcttggacttcctggg

SEQ ID NO: 1820685 - DNA, 17 bp, Homo sapiens
gggctttgcaggctctg

SEQ ID NO: 1820686 - DNA, 18 bp, Homo sapiens
ggggacagttggcagaga

SEQ ID NO: 1820687 - DNA, 20 bp, Homo sapiens
ggggacagttggcagagaag

SEQ ID NO: 1820688 - DNA, 21 bp, Homo sapiens
ggggagttgagtcacaagagg

SEQ ID NO: 1820689 - DNA, 14 bp, Homo sapiens
ggggcaaggtctcc

SEQ ID NO: 1820690 - DNA, 18 bp, Homo sapiens
ggggcaaggtctccttac

SEQ ID NO: 1820691 - DNA, 18 bp, Homo sapiens
ggggcacaccactgccct

SEQ ID NO: 1820692 - DNA, 16 bp, Homo sapiens
ggggcagaggggcagc

SEQ ID NO: 1820693 - DNA, 20 bp, Homo sapiens
ggggcagaggggcagccgct

SEQ ID NO: 1820694 - DNA, 19 bp, Homo sapiens
ggggcagccgctaggagag

SEQ ID NO: 1820695 - DNA, 13 bp, Homo sapiens
ggggcaggcacag

SEQ ID NO: 1820696 - DNA, 14 bp, Homo sapiens
ggggcaggcacagc

SEQ ID NO: 1820697 - DNA, 15 bp, Homo sapiens
ggggcaggccctgca

SEQ ID NO: 1820698 - DNA, 11 bp, Homo sapiens
ggggcaggcct

SEQ ID NO: 1820699 - DNA, 17 bp, Homo sapiens
ggggcatggttccttcc

SEQ ID NO: 1820700 - DNA, 20 bp, Homo sapiens
ggggcccgcttgcctcggct

SEQ ID NO: 1820701 - DNA, 21 bp, Homo sapiens
ggggcccgcttgcctcggctc

SEQ ID NO: 1820702 - DNA, 23 bp, Homo sapiens
ggggcctatcagtgtgcccccca

SEQ ID NO: 1820703 - DNA, 13 bp, Homo sapiens
ggggcctggcttg

SEQ ID NO: 1820704 - DNA, 24 bp, Homo sapiens
ggggcgctcaggacccaggccctc

SEQ ID NO: 1820705 - DNA, 13 bp, Homo sapiens
ggggctgcccgct

SEQ ID NO: 1820706 - DNA, 11 bp, Homo sapiens
ggggctgctgg

SEQ ID NO: 1820707 - DNA, 18 bp, Homo sapiens
ggggctggcaagcaggga

SEQ ID NO: 1820708 - DNA, 10 bp, Homo sapiens
ggggctgggt

SEQ ID NO: 1820709 - DNA, 22 bp, Homo sapiens
gggggcgctcaggacccaggcc

SEQ ID NO: 1820710 - DNA, 21 bp, Homo sapiens
gggtcatctgtacctctgcct

SEQ ID NO: 1820711 - DNA, 18 bp, Homo sapiens
gggtcattcatggcctgg

SEQ ID NO: 1820712 - DNA, 21 bp, Homo sapiens
gggtccaggaaggcagctgct

SEQ ID NO: 1820713 - DNA, 20 bp, Homo sapiens
gggtcctgcaatctccaggg

SEQ ID NO: 1820714 - DNA, 22 bp, Homo sapiens
gggtctgtgctgtgcctgctag

SEQ ID NO: 1820715 - DNA, 21 bp, Homo sapiens
gggtcttgggctactggcagc

SEQ ID NO: 1820716 - DNA, 19 bp, Homo sapiens
gggtgcgaccccatctgcc

SEQ ID NO: 1820717 - DNA, 21 bp, Homo sapiens
gggtgcgaccccatctgccca

SEQ ID NO: 1820718 - DNA, 22 bp, Homo sapiens
taacaagcaaggatatcagagc

SEQ ID NO: 1820719 - DNA, 22 bp, Homo sapiens
taacaatactgggcagcctttt

SEQ ID NO: 1820720 - DNA, 18 bp, Homo sapiens
taacaattaattttctat

SEQ ID NO: 1820721 - DNA, 17 bp, Homo sapiens
taacacaccaagtggag

SEQ ID NO: 1820722 - DNA, 12 bp, Homo sapiens
taacacagatat

SEQ ID NO: 1820723 - DNA, 16 bp, Homo sapiens
taacaggccttgagca

SEQ ID NO: 1820724 - DNA, 18 bp, Homo sapiens
taacatgcaacaaaaatg

SEQ ID NO: 1820725 - DNA, 21 bp, Homo sapiens
taacccactgctgaaaaagaa

SEQ ID NO: 1820726 - DNA, 15 bp, Homo sapiens
taacgctaaaggtgt

SEQ ID NO: 1820727 - DNA, 18 bp, Homo sapiens
taactattcctgtgtaaa

SEQ ID NO: 1820728 - DNA, 16 bp, Homo sapiens
taactgtcttgagaga

SEQ ID NO: 1820729 - DNA, 17 bp, Homo sapiens
taactgtcttgagagaa

SEQ ID NO: 1820730 - DNA, 22 bp, Homo sapiens
taacttatctagaaagaaaaga

SEQ ID NO: 1820731 - DNA, 19 bp, Homo sapiens
taagaccgtgtcccaagga

SEQ ID NO: 1820732 - DNA, 21 bp, Homo sapiens
taagaccgtgtcccaaggagc

SEQ ID NO: 1820733 - DNA, 22 bp, Homo sapiens
taagaccgtgtcccaaggagct

SEQ ID NO: 1820734 - DNA, 23 bp, Homo sapiens
taagaccgtgtcccaaggagctg

SEQ ID NO: 1820735 - DNA, 19 bp, Homo sapiens
taagacttcagatttcaaa

SEQ ID NO: 1820736 - DNA, 18 bp, Homo sapiens
taagaggctttggcccaa

SEQ ID NO: 1820737 - DNA, 17 bp, Homo sapiens
taagatgagatttgcca

SEQ ID NO: 1820738 - DNA, 18 bp, Homo sapiens
taagcaacttgcttctaa

SEQ ID NO: 1820739 - DNA, 20 bp, Homo sapiens
taaggagcatgattttaaga

SEQ ID NO: 1820740 - DNA, 18 bp, Homo sapiens
taagggttgaaggcagtc

SEQ ID NO: 1820741 - DNA, 22 bp, Homo sapiens
taaggtgggtccaggaaggcag

SEQ ID NO: 1820742 - DNA, 22 bp, Homo sapiens
taagtcattgaaatttactgtg

SEQ ID NO: 1820743 - DNA, 23 bp, Homo sapiens
taagtctcagtacacttcctgtg

SEQ ID NO: 1820744 - DNA, 21 bp, Homo sapiens
taataatgtaatactgtagaa

SEQ ID NO: 1820745 - DNA, 22 bp, Homo sapiens
taataatgtaatactgtagaaa

SEQ ID NO: 1820746 - DNA, 15 bp, Homo sapiens
taatactgtagaaat

SEQ ID NO: 1820747 - DNA, 22 bp, Homo sapiens
taatactgtgttaccttttaaa

SEQ ID NO: 1820748 - DNA, 22 bp, Homo sapiens
taatataatgagtcacaaaata

SEQ ID NO: 1820749 - DNA, 17 bp, Homo sapiens
taatatctgagaagtgt

SEQ ID NO: 1820750 - DNA, 14 bp, Homo sapiens
taatatttttcaaa

SEQ ID NO: 1820751 - DNA, 19 bp, Homo sapiens
taatatttttcaaaatcaa

SEQ ID NO: 1820752 - DNA, 20 bp, Homo sapiens
taatatttttcaaaatcaaa

SEQ ID NO: 1820753 - DNA, 21 bp, Homo sapiens
taatatttttcaaaatcaaag

SEQ ID NO: 1820754 - DNA, 16 bp, Homo sapiens
taatccatgtgctgct

SEQ ID NO: 1820755 - DNA, 17 bp, Homo sapiens
taatctagaaaatgaaa

SEQ ID NO: 1820756 - DNA, 19 bp, Homo sapiens
taatctagaaaatgaaaag

SEQ ID NO: 1820757 - DNA, 16 bp, Homo sapiens
taatctcacttcatca

SEQ ID NO: 1820758 - DNA, 19 bp, Homo sapiens
taatctcacttcatcaatc

SEQ ID NO: 1820759 - DNA, 20 bp, Homo sapiens
taatctcacttcatcaatca

SEQ ID NO: 1820760 - DNA, 19 bp, Homo sapiens
taatctttctatatttttt

SEQ ID NO: 1820761 - DNA, 16 bp, Homo sapiens
taatgggatctatttt

SEQ ID NO: 1820762 - DNA, 16 bp, Homo sapiens
taatgggcctgcccaa

SEQ ID NO: 1820763 - DNA, 15 bp, Homo sapiens
taatgtaatactgta

SEQ ID NO: 1820764 - DNA, 20 bp, Homo sapiens
taatgtgacagtgttcagta

SEQ ID NO: 1820765 - DNA, 13 bp, Homo sapiens
taattgcaacaat

SEQ ID NO: 1820766 - DNA, 14 bp, Homo sapiens
taattgcaacaatg

SEQ ID NO: 1820767 - DNA, 20 bp, Homo sapiens
taattgcatttaaaaatata

SEQ ID NO: 1820768 - DNA, 16 bp, Homo sapiens
taatttaaaattgtga

SEQ ID NO: 1820769 - DNA, 19 bp, Homo sapiens
taatttaaaattgtgatgt

SEQ ID NO: 1820770 - DNA, 22 bp, Homo sapiens
taatttcagttctagttgattg

SEQ ID NO: 1820771 - DNA, 16 bp, Homo sapiens
taatttctcctcattt

SEQ ID NO: 1820772 - DNA, 18 bp, Homo sapiens
tacaactaaataacacag

SEQ ID NO: 1820773 - DNA, 23 bp, Homo sapiens
tacaagttttttaggattctttt

SEQ ID NO: 1820774 - DNA, 21 bp, Homo sapiens
tacacataagaccgtgtccca

SEQ ID NO: 1820775 - DNA, 16 bp, Homo sapiens
tacacttcctgcttaa

SEQ ID NO: 1820776 - DNA, 17 bp, Homo sapiens
tacagaatattatataa

SEQ ID NO: 1820777 - DNA, 18 bp, Homo sapiens
tacagaggacagtatttg

SEQ ID NO: 1820778 - DNA, 20 bp, Homo sapiens
tacaggggcagtgcctttgt

SEQ ID NO: 1820779 - DNA, 17 bp, Homo sapiens
tacagtgaggagggtgg

SEQ ID NO: 1820780 - DNA, 18 bp, Homo sapiens
tacatcagccttctcctg

SEQ ID NO: 1820781 - DNA, 19 bp, Homo sapiens
tacatcagccttctcctgt

SEQ ID NO: 1820782 - DNA, 21 bp, Homo sapiens
tacatcttcattaatactgtg

SEQ ID NO: 1820783 - DNA, 21 bp, Homo sapiens
tacattaaaatagcacatgat

SEQ ID NO: 1820784 - DNA, 15 bp, Homo sapiens
tacattaaggagcag

SEQ ID NO: 1820785 - DNA, 12 bp, Homo sapiens
tacattatgtta

SEQ ID NO: 1820786 - DNA, 13 bp, Homo sapiens
tacattatgttat

SEQ ID NO: 1820787 - DNA, 14 bp, Homo sapiens
tacattatgttatt

SEQ ID NO: 1820788 - DNA, 17 bp, Homo sapiens
tacattttcctgtgtaa

SEQ ID NO: 1820789 - DNA, 12 bp, Homo sapiens
taccatgctgct

SEQ ID NO: 1820790 - DNA, 23 bp, Homo sapiens
taccatgctgctttttggcacag

SEQ ID NO: 1820791 - DNA, 22 bp, Homo sapiens
taccattacttgtataaataca

SEQ ID NO: 1820792 - DNA, 16 bp, Homo sapiens
taccccaagtccacct

SEQ ID NO: 1820793 - DNA, 18 bp, Homo sapiens
taccccacctcatgcctg

SEQ ID NO: 1820794 - DNA, 17 bp, Homo sapiens
tacccccgcccaggctg

SEQ ID NO: 1820795 - DNA, 14 bp, Homo sapiens
tacccctcccagct

SEQ ID NO: 1820796 - DNA, 14 bp, Homo sapiens
taccctcccaccag

SEQ ID NO: 1820797 - DNA, 17 bp, Homo sapiens
taccctccctgctgtcc

SEQ ID NO: 1820798 - DNA, 18 bp, Homo sapiens
taccctccctgctgtccc

SEQ ID NO: 1820799 - DNA, 23 bp, Homo sapiens
taccctccctgctgtcccctctt

SEQ ID NO: 1820800 - DNA, 20 bp, Homo sapiens
tacccttccacctcctagag

SEQ ID NO: 1820801 - DNA, 14 bp, Homo sapiens
taccgtagcctccg

SEQ ID NO: 1820802 - DNA, 17 bp, Homo sapiens
tacctatacctatgtga

SEQ ID NO: 1820803 - DNA, 15 bp, Homo sapiens
tacgtgttcaaaaat

SEQ ID NO: 1820804 - DNA, 12 bp, Homo sapiens
tactaaaagaat

SEQ ID NO: 1820805 - DNA, 16 bp, Homo sapiens
tactagtaataatgta

SEQ ID NO: 1820806 - DNA, 16 bp, Homo sapiens
tactcaatcaagcaaa

SEQ ID NO: 1820807 - DNA, 13 bp, Homo sapiens
tactcagagcaga

SEQ ID NO: 1820808 - DNA, 15 bp, Homo sapiens
tactcagagcagagc

SEQ ID NO: 1820809 - DNA, 20 bp, Homo sapiens
tactcagcagcagagagccc

SEQ ID NO: 1820810 - DNA, 18 bp, Homo sapiens
tactcccttcctggcctc

SEQ ID NO: 1820811 - DNA, 14 bp, Homo sapiens
tactctctgctcta

SEQ ID NO: 1820812 - DNA, 17 bp, Homo sapiens
tactctgagcccaggcc

SEQ ID NO: 1820813 - DNA, 17 bp, Homo sapiens
tactctgtccaggccac

SEQ ID NO: 1820814 - DNA, 13 bp, Homo sapiens
tactgaaagcaaa

SEQ ID NO: 1820815 - DNA, 16 bp, Homo sapiens
tactgagtaaacccta

SEQ ID NO: 1820816 - DNA, 18 bp, Homo sapiens
tactgatactattcaatg

SEQ ID NO: 1820817 - DNA, 19 bp, Homo sapiens
tactgatactattcaatgc

SEQ ID NO: 1820818 - DNA, 11 bp, Homo sapiens
tactggcagct

SEQ ID NO: 1820819 - DNA, 14 bp, Homo sapiens
tactggcagctcct

SEQ ID NO: 1820820 - DNA, 19 bp, Homo sapiens
tactggcctcgcctggcct

SEQ ID NO: 1820821 - DNA, 13 bp, Homo sapiens
tactgtatttcat

SEQ ID NO: 1820822 - DNA, 21 bp, Homo sapiens
tactgtatttcattatctgta

SEQ ID NO: 1820823 - DNA, 18 bp, Homo sapiens
tacttacatctttgttta

SEQ ID NO: 1820824 - DNA, 23 bp, Homo sapiens
tacttcggttcctctgatttcaa

SEQ ID NO: 1820825 - DNA, 14 bp, Homo sapiens
tacttgtctgaggc

SEQ ID NO: 1820826 - DNA, 19 bp, Homo sapiens
tagaaaagttgctcttaaa

SEQ ID NO: 1820827 - DNA, 19 bp, Homo sapiens
tagaaagaaaagaccctga

SEQ ID NO: 1820828 - DNA, 22 bp, Homo sapiens
tagaaagaaaagaccctgagac

SEQ ID NO: 1820829 - DNA, 12 bp, Homo sapiens
tagaagttaaag

SEQ ID NO: 1820830 - DNA, 19 bp, Homo sapiens
tagaatgtttctatttcca

SEQ ID NO: 1820831 - DNA, 20 bp, Homo sapiens
tagaatgtttctatttccat

SEQ ID NO: 1820832 - DNA, 23 bp, Homo sapiens
tagactggagtgaggcttccagg

SEQ ID NO: 1820833 - DNA, 18 bp, Homo sapiens
tagagatacagtatacct

SEQ ID NO: 1820834 - DNA, 19 bp, Homo sapiens
tcccctctgtcatcactcc

SEQ ID NO: 1820835 - DNA, 15 bp, Homo sapiens
tcccctcttgcccca

SEQ ID NO: 1820836 - DNA, 22 bp, Homo sapiens
tccccttggcttcctccgtcca

SEQ ID NO: 1820837 - DNA, 19 bp, Homo sapiens
tccccttttgcctggctgt

SEQ ID NO: 1820838 - DNA, 20 bp, Homo sapiens
tccccttttgcctggctgtg

SEQ ID NO: 1820839 - DNA, 18 bp, Homo sapiens
tcccgccttcctcctcca

SEQ ID NO: 1820840 - DNA, 15 bp, Homo sapiens
tcccggagcacagcc

SEQ ID NO: 1820841 - DNA, 20 bp, Homo sapiens
tcccggcctcttccacccat

SEQ ID NO: 1820842 - DNA, 13 bp, Homo sapiens
tcccggctgcctg

SEQ ID NO: 1820843 - DNA, 16 bp, Homo sapiens
tcccggctgcctgccg

SEQ ID NO: 1820844 - DNA, 18 bp, Homo sapiens
tcccggctgcctgccgcc

SEQ ID NO: 1820845 - DNA, 21 bp, Homo sapiens
tcccgtggccccagcctggcc

SEQ ID NO: 1820846 - DNA, 23 bp, Homo sapiens
tcccgtggccccagcctggccca

SEQ ID NO: 1820847 - DNA, 24 bp, Homo sapiens
tcccgtggccccagcctggcccag

SEQ ID NO: 1820848 - DNA, 22 bp, Homo sapiens
tccctccccacagtcctcacag

SEQ ID NO: 1820849 - DNA, 14 bp, Homo sapiens
tccctcggaagccg

SEQ ID NO: 1820850 - DNA, 16 bp, Homo sapiens
tccctcggacccacca

SEQ ID NO: 1820851 - DNA, 20 bp, Homo sapiens
tccctcgtccacaggggcag

SEQ ID NO: 1820852 - DNA, 19 bp, Homo sapiens
tccctctactgagtaaacc

SEQ ID NO: 1820853 - DNA, 11 bp, Homo sapiens
tccctctgccc

SEQ ID NO: 1820854 - DNA, 13 bp, Homo sapiens
tccctctgcccca

SEQ ID NO: 1820855 - DNA, 16 bp, Homo sapiens
tccctctgccccaagc

SEQ ID NO: 1820856 - DNA, 22 bp, Homo sapiens
tccctctgccccaagcagccag

SEQ ID NO: 1820857 - DNA, 23 bp, Homo sapiens
tccctctgccccaagcagccagc

SEQ ID NO: 1820858 - DNA, 13 bp, Homo sapiens
tccctgcaccctg

SEQ ID NO: 1820859 - DNA, 15 bp, Homo sapiens
tccctgcctgctcct

SEQ ID NO: 1820860 - DNA, 21 bp, Homo sapiens
tccctgcctgctccttggcac

SEQ ID NO: 1820861 - DNA, 14 bp, Homo sapiens
tccctgctgtcccc

SEQ ID NO: 1820862 - DNA, 22 bp, Homo sapiens
tccctgctgtcccctcttgccc

SEQ ID NO: 1820863 - DNA, 19 bp, Homo sapiens
tccctgcttgcccgctccc

SEQ ID NO: 1820864 - DNA, 22 bp, Homo sapiens
tccctgcttgcccgctcccaca

SEQ ID NO: 1820865 - DNA, 13 bp, Homo sapiens
tcccttcctggcc

SEQ ID NO: 1820866 - DNA, 14 bp, Homo sapiens
tcccttcctggcct

SEQ ID NO: 1820867 - DNA, 19 bp, Homo sapiens
tcccttgaccattggctgc

SEQ ID NO: 1820868 - DNA, 21 bp, Homo sapiens
tccgacttgaattttcccact

SEQ ID NO: 1820869 - DNA, 16 bp, Homo sapiens
tccgcaccagctgctc

SEQ ID NO: 1820870 - DNA, 13 bp, Homo sapiens
tccgctgccacca

SEQ ID NO: 1820871 - DNA, 14 bp, Homo sapiens
tccggggtctgtgc

SEQ ID NO: 1820872 - DNA, 13 bp, Homo sapiens
tccgtccacccag

SEQ ID NO: 1820873 - DNA, 16 bp, Homo sapiens
tccgtccacccaggct

SEQ ID NO: 1820874 - DNA, 14 bp, Homo sapiens
tcctaccccacctc

SEQ ID NO: 1820875 - DNA, 21 bp, Homo sapiens
tcctaccccacctcatgcctg

SEQ ID NO: 1820876 - DNA, 13 bp, Homo sapiens
tcctacccctccc

SEQ ID NO: 1820877 - DNA, 14 bp, Homo sapiens
tcctacccctccca

SEQ ID NO: 1820878 - DNA, 15 bp, Homo sapiens
tcctaccctcccacc

SEQ ID NO: 1820879 - DNA, 15 bp, Homo sapiens
tcctagaggtgggca

SEQ ID NO: 1820880 - DNA, 23 bp, Homo sapiens
tcctagaggtgggcagctgggcc

SEQ ID NO: 1820881 - DNA, 15 bp, Homo sapiens
tcctcacagcctctc

SEQ ID NO: 1820882 - DNA, 19 bp, Homo sapiens
tcctcacagcctctccctt

SEQ ID NO: 1820883 - DNA, 19 bp, Homo sapiens
tcctcaccttttcccgggg

SEQ ID NO: 1820884 - DNA, 15 bp, Homo sapiens
tcctcatcccctcgt

SEQ ID NO: 1820885 - DNA, 15 bp, Homo sapiens
tcctccacagtgctg

SEQ ID NO: 1820886 - DNA, 22 bp, Homo sapiens
tcctccaccgccatggcttcca

SEQ ID NO: 1820887 - DNA, 19 bp, Homo sapiens
tcctccagcctcccctccc

SEQ ID NO: 1820888 - DNA, 22 bp, Homo sapiens
tcctccagcctcccctcccctg

SEQ ID NO: 1820889 - DNA, 15 bp, Homo sapiens
tcctcccatggcctt

SEQ ID NO: 1820890 - DNA, 14 bp, Homo sapiens
tcctcccccagagc

SEQ ID NO: 1820891 - DNA, 15 bp, Homo sapiens
tcctccgtccaccca

SEQ ID NO: 1820892 - DNA, 23 bp, Homo sapiens
tcctccgtccacccaggctgcac

SEQ ID NO: 1820893 - DNA, 12 bp, Homo sapiens
tcctcctccaca

SEQ ID NO: 1820894 - DNA, 20 bp, Homo sapiens
tcctcctccacagtgctgct

SEQ ID NO: 1820895 - DNA, 12 bp, Homo sapiens
tcctcctgatgg

SEQ ID NO: 1820896 - DNA, 23 bp, Homo sapiens
tcctcctgatggccaagagcatc

SEQ ID NO: 1820897 - DNA, 16 bp, Homo sapiens
tcctctccttgggctc

SEQ ID NO: 1820898 - DNA, 21 bp, Homo sapiens
tcctctccttgggctcctggc

SEQ ID NO: 1820899 - DNA, 15 bp, Homo sapiens
tcctgacgccctgcg

SEQ ID NO: 1820900 - DNA, 16 bp, Homo sapiens
tcctgactgtctgcta

SEQ ID NO: 1820901 - DNA, 19 bp, Homo sapiens
tcctgacttcaggggctgc

SEQ ID NO: 1820902 - DNA, 16 bp, Homo sapiens
tcctgagaaggcgagg

SEQ ID NO: 1820903 - DNA, 24 bp, Homo sapiens
tcctgagggctaattctgggaagg

SEQ ID NO: 1820904 - DNA, 16 bp, Homo sapiens
tcctgcaatctccagg

SEQ ID NO: 1820905 - DNA, 17 bp, Homo sapiens
tcctgcaatctccaggg

SEQ ID NO: 1820906 - DNA, 17 bp, Homo sapiens
tcctgcaggaacgagca

SEQ ID NO: 1820907 - DNA, 20 bp, Homo sapiens
tcctgcaggaacgagcactg

SEQ ID NO: 1820908 - DNA, 12 bp, Homo sapiens
tcctgccccctg

SEQ ID NO: 1820909 - DNA, 13 bp, Homo sapiens
tcctgccccctgc

SEQ ID NO: 1820910 - DNA, 14 bp, Homo sapiens
tcctgccccctgcc

SEQ ID NO: 1820911 - DNA, 13 bp, Homo sapiens
tcctgctccacag

SEQ ID NO: 1820912 - DNA, 20 bp, Homo sapiens
tcctgctgcaccaacccagc

SEQ ID NO: 1820913 - DNA, 20 bp, Homo sapiens
tcctgctgcctaataaagag

SEQ ID NO: 1820914 - DNA, 12 bp, Homo sapiens
tcctgctgctgt

SEQ ID NO: 1820915 - DNA, 23 bp, Homo sapiens
tcctgctgctgtaactgctgagc

SEQ ID NO: 1820916 - DNA, 14 bp, Homo sapiens
tcctggacctgagt

SEQ ID NO: 1820917 - DNA, 19 bp, Homo sapiens
tcctggcctcactggctgg

SEQ ID NO: 1820918 - DNA, 20 bp, Homo sapiens
tcctggcctcactggctggg

SEQ ID NO: 1820919 - DNA, 23 bp, Homo sapiens
tcctggcctcactggctggggca

SEQ ID NO: 1820920 - DNA, 15 bp, Homo sapiens
tcctggctgccaggc

SEQ ID NO: 1820921 - DNA, 10 bp, Homo sapiens
tcctgggcct

SEQ ID NO: 1820922 - DNA, 16 bp, Homo sapiens
tcctgggcctgtcccc

SEQ ID NO: 1820923 - DNA, 18 bp, Homo sapiens
tcctggggccccgctggg

SEQ ID NO: 1820924 - DNA, 20 bp, Homo sapiens
tcctggggccccgctgggat

SEQ ID NO: 1820925 - DNA, 21 bp, Homo sapiens
tcctggtaagaggcaaagaat

SEQ ID NO: 1820926 - DNA, 12 bp, Homo sapiens
tcctgtcagtgc

SEQ ID NO: 1820927 - DNA, 13 bp, Homo sapiens
tcctgtcagtgcc

SEQ ID NO: 1820928 - DNA, 19 bp, Homo sapiens
tcctgtccactctcggggc

SEQ ID NO: 1820929 - DNA, 14 bp, Homo sapiens
tcctgtcccagagg

SEQ ID NO: 1820930 - DNA, 15 bp, Homo sapiens
tcctgtcccagaggt

SEQ ID NO: 1820931 - DNA, 18 bp, Homo sapiens
tcctgtcccgccttcctc

SEQ ID NO: 1820932 - DNA, 19 bp, Homo sapiens
tcctgtgccatgttattca

SEQ ID NO: 1820933 - DNA, 15 bp, Homo sapiens
tcctgtgtattctca

SEQ ID NO: 1820934 - DNA, 22 bp, Homo sapiens
tccttaaaatgtgagtgacctc

SEQ ID NO: 1820935 - DNA, 19 bp, Homo sapiens
tccttatgagactcttaaa

SEQ ID NO: 1820936 - DNA, 12 bp, Homo sapiens
tccttcagagct

SEQ ID NO: 1820937 - DNA, 13 bp, Homo sapiens
tccttcagagctc

SEQ ID NO: 1820938 - DNA, 21 bp, Homo sapiens
tccttcagcatctcacttctt

SEQ ID NO: 1820939 - DNA, 23 bp, Homo sapiens
tccttcagtgagcccctccccag

SEQ ID NO: 1820940 - DNA, 15 bp, Homo sapiens
tccttccctgggaag

SEQ ID NO: 1820941 - DNA, 17 bp, Homo sapiens
tccttggcacccccatg

SEQ ID NO: 1820942 - DNA, 18 bp, Homo sapiens
tccttggcacccccatgc

SEQ ID NO: 1820943 - DNA, 17 bp, Homo sapiens
tccttgggctcctggct

SEQ ID NO: 1820944 - DNA, 18 bp, Homo sapiens
tccttgggctcctggctg

SEQ ID NO: 1820945 - DNA, 19 bp, Homo sapiens
tccttgggctcctggctgc

SEQ ID NO: 1820946 - DNA, 14 bp, Homo sapiens
tccttgggtcctgc

SEQ ID NO: 1820947 - DNA, 20 bp, Homo sapiens
tcctttacaactaaataaca

SEQ ID NO: 1820948 - DNA, 14 bp, Homo sapiens
tcctttgagggcag

SEQ ID NO: 1820949 - DNA, 13 bp, Homo sapiens
tcgaaccaaggca

SEQ ID NO: 1820950 - DNA, 15 bp, Homo sapiens
tcgaagatatacaaa

SEQ ID NO: 1820951 - DNA, 23 bp, Homo sapiens
tgctcgggcccaggccatcttcc

SEQ ID NO: 1820952 - DNA, 14 bp, Homo sapiens
tgctctaattcttt

SEQ ID NO: 1820953 - DNA, 13 bp, Homo sapiens
tgctctagccagg

SEQ ID NO: 1820954 - DNA, 20 bp, Homo sapiens
tgctctgccccttgggcatc

SEQ ID NO: 1820955 - DNA, 16 bp, Homo sapiens
tgctctggcggcttcc

SEQ ID NO: 1820956 - DNA, 21 bp, Homo sapiens
tgctctggcggcttcctgtcc

SEQ ID NO: 1820957 - DNA, 18 bp, Homo sapiens
tgctctttgttcatcatt

SEQ ID NO: 1820958 - DNA, 21 bp, Homo sapiens
tgctgaaaaagaaaaaaatga

SEQ ID NO: 1820959 - DNA, 18 bp, Homo sapiens
tgctgaattcctttacaa

SEQ ID NO: 1820960 - DNA, 18 bp, Homo sapiens
tgctgagcttagccttgt

SEQ ID NO: 1820961 - DNA, 18 bp, Homo sapiens
tgctgcaccaacccagcc

SEQ ID NO: 1820962 - DNA, 16 bp, Homo sapiens
tgctgcaccagagtga

SEQ ID NO: 1820963 - DNA, 12 bp, Homo sapiens
tgctgccatgcc

SEQ ID NO: 1820964 - DNA, 15 bp, Homo sapiens
tgctgccatgccact

SEQ ID NO: 1820965 - DNA, 20 bp, Homo sapiens
tgctgccatgccactgccag

SEQ ID NO: 1820966 - DNA, 14 bp, Homo sapiens
tgctgcccctgtct

SEQ ID NO: 1820967 - DNA, 17 bp, Homo sapiens
tgctgctaccctccctg

SEQ ID NO: 1820968 - DNA, 18 bp, Homo sapiens
tgctgctaccctccctgc

SEQ ID NO: 1820969 - DNA, 20 bp, Homo sapiens
tgctgctaccctccctgctg

SEQ ID NO: 1820970 - DNA, 18 bp, Homo sapiens
tgctgctgtaactgctga

SEQ ID NO: 1820971 - DNA, 22 bp, Homo sapiens
tgctgctgtaactgctgagcca

SEQ ID NO: 1820972 - DNA, 17 bp, Homo sapiens
tgctgctttttggcaca

SEQ ID NO: 1820973 - DNA, 22 bp, Homo sapiens
tgctggcctcccaataaagctg

SEQ ID NO: 1820974 - DNA, 21 bp, Homo sapiens
tgctgggaaccccgcagcccg

SEQ ID NO: 1820975 - DNA, 23 bp, Homo sapiens
tgctgggaaccccgcagcccgtg

SEQ ID NO: 1820976 - DNA, 11 bp, Homo sapiens
tgctgggctgg

SEQ ID NO: 1820977 - DNA, 12 bp, Homo sapiens
tgctggggcatg

SEQ ID NO: 1820978 - DNA, 20 bp, Homo sapiens
tgctggggcatgtgtgcctg

SEQ ID NO: 1820979 - DNA, 15 bp, Homo sapiens
tgctgggtggcccat

SEQ ID NO: 1820980 - DNA, 19 bp, Homo sapiens
tgctgtaactgctgagcca

SEQ ID NO: 1820981 - DNA, 15 bp, Homo sapiens
tgctgtacccttcca

SEQ ID NO: 1820982 - DNA, 19 bp, Homo sapiens
tgctgtacccttccacctc

SEQ ID NO: 1820983 - DNA, 15 bp, Homo sapiens
tgctgtcccctcttg

SEQ ID NO: 1820984 - DNA, 21 bp, Homo sapiens
tgctgtcccctcttgccccaa

SEQ ID NO: 1820985 - DNA, 12 bp, Homo sapiens
tgctgtgcctgc

SEQ ID NO: 1820986 - DNA, 15 bp, Homo sapiens
tgctgtgcctgctag

SEQ ID NO: 1820987 - DNA, 19 bp, Homo sapiens
tgctgtgcctgctagagca

SEQ ID NO: 1820988 - DNA, 23 bp, Homo sapiens
tgcttagttggtgaaacccagat

SEQ ID NO: 1820989 - DNA, 15 bp, Homo sapiens
tgcttgcccgctccc

SEQ ID NO: 1820990 - DNA, 19 bp, Homo sapiens
tgctttgggctttgcaggc

SEQ ID NO: 1820991 - DNA, 21 bp, Homo sapiens
tgctttgggctttgcaggctc

SEQ ID NO: 1820992 - DNA, 21 bp, Homo sapiens
tgcttttccaggatcctgcag

SEQ ID NO: 1820993 - DNA, 23 bp, Homo sapiens
tgcttttccaggatcctgcagga

SEQ ID NO: 1820994 - DNA, 17 bp, Homo sapiens
tggaaaggggagttgag

SEQ ID NO: 1820995 - DNA, 13 bp, Homo sapiens
tggaactgacccc

SEQ ID NO: 1820996 - DNA, 17 bp, Homo sapiens
tggaagagcagcctgat

SEQ ID NO: 1820997 - DNA, 15 bp, Homo sapiens
tggaaggcagggcag

SEQ ID NO: 1820998 - DNA, 16 bp, Homo sapiens
tggaaggcagggcaga

SEQ ID NO: 1820999 - DNA, 17 bp, Homo sapiens
tggaaggcagggcagag

SEQ ID NO: 1821000 - DNA, 15 bp, Homo sapiens
tggaaggctggctga

SEQ ID NO: 1821001 - DNA, 13 bp, Homo sapiens
tggaagtgtgggt

SEQ ID NO: 1821002 - DNA, 14 bp, Homo sapiens
tggaagtgtgggtc

SEQ ID NO: 1821003 - DNA, 21 bp, Homo sapiens
tggaagtgtgggtctgtgtgt

SEQ ID NO: 1821004 - DNA, 16 bp, Homo sapiens
tggaatatctgagaat

SEQ ID NO: 1821005 - DNA, 18 bp, Homo sapiens
tggaatatctgagaattg

SEQ ID NO: 1821006 - DNA, 18 bp, Homo sapiens
tggaattcagcaccctgg

SEQ ID NO: 1821007 - DNA, 20 bp, Homo sapiens
tggaattttaagttctatca

SEQ ID NO: 1821008 - DNA, 11 bp, Homo sapiens
tggaattttct

SEQ ID NO: 1821009 - DNA, 21 bp, Homo sapiens
tggaattttctttcatacatt

SEQ ID NO: 1821010 - DNA, 22 bp, Homo sapiens
tggaattttctttcatacatta

SEQ ID NO: 1821011 - DNA, 14 bp, Homo sapiens
tggacacctgccct

SEQ ID NO: 1821012 - DNA, 15 bp, Homo sapiens
tggacacctgccctg

SEQ ID NO: 1821013 - DNA, 16 bp, Homo sapiens
tggacacctgccctgc

SEQ ID NO: 1821014 - DNA, 18 bp, Homo sapiens
tggacacctgccctgccc

SEQ ID NO: 1821015 - DNA, 16 bp, Homo sapiens
tggaccgggtgggcct

SEQ ID NO: 1821016 - DNA, 14 bp, Homo sapiens
tggacgtgtgagga

SEQ ID NO: 1821017 - DNA, 19 bp, Homo sapiens
tggagaccgcttcacccct

SEQ ID NO: 1821018 - DNA, 21 bp, Homo sapiens
tggagaccgcttcacccctgc

SEQ ID NO: 1821019 - DNA, 22 bp, Homo sapiens
tggagaccgcttcacccctgca

SEQ ID NO: 1821020 - DNA, 18 bp, Homo sapiens
tggagcatttttcagagt

SEQ ID NO: 1821021 - DNA, 11 bp, Homo sapiens
tggagccactc

SEQ ID NO: 1821022 - DNA, 18 bp, Homo sapiens
tggagccactcctgtccc

SEQ ID NO: 1821023 - DNA, 19 bp, Homo sapiens
tggagccactcctgtcccg

SEQ ID NO: 1821024 - DNA, 15 bp, Homo sapiens
tggagcccgtgcagt

SEQ ID NO: 1821025 - DNA, 14 bp, Homo sapiens
tggagctgttccat

SEQ ID NO: 1821026 - DNA, 15 bp, Homo sapiens
tggaggaaggtgctg

SEQ ID NO: 1821027 - DNA, 12 bp, Homo sapiens
tggaggtgatga

SEQ ID NO: 1821028 - DNA, 23 bp, Homo sapiens
tggagtgaggcttccaggctctt

SEQ ID NO: 1821029 - DNA, 22 bp, Homo sapiens
tggagtgcgctcttggtccctg

SEQ ID NO: 1821030 - DNA, 23 bp, Homo sapiens
tggagttgtattttgacaaaaat

SEQ ID NO: 1821031 - DNA, 22 bp, Homo sapiens
tggatgggcattgggctgacac

SEQ ID NO: 1821032 - DNA, 16 bp, Homo sapiens
tggattccactgaaat

SEQ ID NO: 1821033 - DNA, 23 bp, Homo sapiens
tggcaagcagggaaagctccacg

SEQ ID NO: 1821034 - DNA, 20 bp, Homo sapiens
tggcacagtgtctgggctga

SEQ ID NO: 1821035 - DNA, 19 bp, Homo sapiens
tggcaccagccccctggat

SEQ ID NO: 1821036 - DNA, 20 bp, Homo sapiens
tggcacccccatgctgcctt

SEQ ID NO: 1821037 - DNA, 13 bp, Homo sapiens
tggcacctcctga

SEQ ID NO: 1821038 - DNA, 17 bp, Homo sapiens
tggcacctcctgagaag

SEQ ID NO: 1821039 - DNA, 18 bp, Homo sapiens
tggcacctcctgagaagg

SEQ ID NO: 1821040 - DNA, 12 bp, Homo sapiens
tggcagaaaaga

SEQ ID NO: 1821041 - DNA, 19 bp, Homo sapiens
tggcagaaaagaggagacc

SEQ ID NO: 1821042 - DNA, 19 bp, Homo sapiens
tggcagagaaggcctcttg

SEQ ID NO: 1821043 - DNA, 13 bp, Homo sapiens
tggcagccatgcc

SEQ ID NO: 1821044 - DNA, 15 bp, Homo sapiens
tggcagctagactgg

SEQ ID NO: 1821045 - DNA, 22 bp, Homo sapiens
tggcagctagactggagtgagg

SEQ ID NO: 1821046 - DNA, 14 bp, Homo sapiens
tggcagctcctctc

SEQ ID NO: 1821047 - DNA, 17 bp, Homo sapiens
tggcagctcctctcctt

SEQ ID NO: 1821048 - DNA, 18 bp, Homo sapiens
tggcagctcctctccttg

SEQ ID NO: 1821049 - DNA, 23 bp, Homo sapiens
tggcagctcctctccttgggctc

SEQ ID NO: 1821050 - DNA, 18 bp, Homo sapiens
tggcaggtgcagatgggc

SEQ ID NO: 1821051 - DNA, 16 bp, Homo sapiens
tggcatcgtagaagag

SEQ ID NO: 1821052 - DNA, 19 bp, Homo sapiens
tggcattggcagcaggtgc

SEQ ID NO: 1821053 - DNA, 21 bp, Homo sapiens
tggcattggcagcaggtgctg

SEQ ID NO: 1821054 - DNA, 13 bp, Homo sapiens
tggccagagaggg

SEQ ID NO: 1821055 - DNA, 22 bp, Homo sapiens
tggccagagagggcccagctgt

SEQ ID NO: 1821056 - DNA, 12 bp, Homo sapiens
tggccagagctg

SEQ ID NO: 1821057 - DNA, 21 bp, Homo sapiens
tggccagagctggaaggcagg

SEQ ID NO: 1821058 - DNA, 22 bp, Homo sapiens
tggccagagctggaaggcaggg

SEQ ID NO: 1821059 - DNA, 13 bp, Homo sapiens
tggccagccccac

SEQ ID NO: 1821060 - DNA, 18 bp, Homo sapiens
tggccagccccacagccc

SEQ ID NO: 1821061 - DNA, 14 bp, Homo sapiens
tggccagtggctgg

SEQ ID NO: 1821062 - DNA, 23 bp, Homo sapiens
tggccagtggctggatctgtgag

SEQ ID NO: 1821063 - DNA, 12 bp, Homo sapiens
tggccatgctca

SEQ ID NO: 1821064 - DNA, 12 bp, Homo sapiens
tggcccagctcc

SEQ ID NO: 1821065 - DNA, 13 bp, Homo sapiens
tggcccagctccc

SEQ ID NO: 1821066 - DNA, 14 bp, Homo sapiens
tggcccagctcccc

SEQ ID NO: 1821067 - DNA, 20 bp, Homo sapiens
tgtgaactattttgaagaaa

SEQ ID NO: 1821068 - DNA, 13 bp, Homo sapiens
tgtgaatatgaga

SEQ ID NO: 1821069 - DNA, 14 bp, Homo sapiens
tgtgaatatgagaa

SEQ ID NO: 1821070 - DNA, 18 bp, Homo sapiens
tgtgacaacatttttgta

SEQ ID NO: 1821071 - DNA, 23 bp, Homo sapiens
tgtgacaacatttttgtacatta

SEQ ID NO: 1821072 - DNA, 20 bp, Homo sapiens
tgtgactgaaggggcacacc

SEQ ID NO: 1821073 - DNA, 17 bp, Homo sapiens
tgtgagtggcagccatg

SEQ ID NO: 1821074 - DNA, 20 bp, Homo sapiens
tgtgcagcagcccagcttcc

SEQ ID NO: 1821075 - DNA, 21 bp, Homo sapiens
tgtgcagcagcccagcttcct

SEQ ID NO: 1821076 - DNA, 15 bp, Homo sapiens
tgtgccaccctgggc

SEQ ID NO: 1821077 - DNA, 17 bp, Homo sapiens
tgtgccaccctgggctc

SEQ ID NO: 1821078 - DNA, 21 bp, Homo sapiens
tgtgccaccctgggctctgtg

SEQ ID NO: 1821079 - DNA, 22 bp, Homo sapiens
tgtgccagagttattagtgcca

SEQ ID NO: 1821080 - DNA, 13 bp, Homo sapiens
tgtgccccccatc

SEQ ID NO: 1821081 - DNA, 21 bp, Homo sapiens
tgtgccccccatcctggccca

SEQ ID NO: 1821082 - DNA, 23 bp, Homo sapiens
tgtgccccccatcctggcccatc

SEQ ID NO: 1821083 - DNA, 18 bp, Homo sapiens
tgtgcctgcaccaggaga

SEQ ID NO: 1821084 - DNA, 13 bp, Homo sapiens
tgtgcctgctaga

SEQ ID NO: 1821085 - DNA, 19 bp, Homo sapiens
tgtgcctgctagagcaacc

SEQ ID NO: 1821086 - DNA, 14 bp, Homo sapiens
tgtgcctgtggcag

SEQ ID NO: 1821087 - DNA, 15 bp, Homo sapiens
tgtgcctgtggcaga

SEQ ID NO: 1821088 - DNA, 17 bp, Homo sapiens
tgtgccttggtgtgctg

SEQ ID NO: 1821089 - DNA, 23 bp, Homo sapiens
tgtgcctttgggaggcagcatca

SEQ ID NO: 1821090 - DNA, 17 bp, Homo sapiens
tgtgctcacgctccccc

SEQ ID NO: 1821091 - DNA, 13 bp, Homo sapiens
tgtgctgtgcctg

SEQ ID NO: 1821092 - DNA, 18 bp, Homo sapiens
tgtgctgtgcctgctaga

SEQ ID NO: 1821093 - DNA, 21 bp, Homo sapiens
tgtgctgtgcctgctagagca

SEQ ID NO: 1821094 - DNA, 14 bp, Homo sapiens
tgtggagaaaagag

SEQ ID NO: 1821095 - DNA, 19 bp, Homo sapiens
tgtggagaggggtgcaccc

SEQ ID NO: 1821096 - DNA, 12 bp, Homo sapiens
tgtggaggcctg

SEQ ID NO: 1821097 - DNA, 19 bp, Homo sapiens
tgtggcaaagtgctgtacc

SEQ ID NO: 1821098 - DNA, 20 bp, Homo sapiens
tgtggcaaagtgctgtaccc

SEQ ID NO: 1821099 - DNA, 19 bp, Homo sapiens
tgtggccagagctggaagg

SEQ ID NO: 1821100 - DNA, 23 bp, Homo sapiens
tgtggcctgtgtccagcagctgc

SEQ ID NO: 1821101 - DNA, 18 bp, Homo sapiens
tgtgggagtgcagagaaa

SEQ ID NO: 1821102 - DNA, 21 bp, Homo sapiens
tgtgggctgcactctgtgccc

SEQ ID NO: 1821103 - DNA, 14 bp, Homo sapiens
tgtgggtctgtgtg

SEQ ID NO: 1821104 - DNA, 16 bp, Homo sapiens
tgtgggtctgtgtgtg

SEQ ID NO: 1821105 - DNA, 14 bp, Homo sapiens
tgtggtagaaattt

SEQ ID NO: 1821106 - DNA, 15 bp, Homo sapiens
tgtggtagaaatttt

SEQ ID NO: 1821107 - DNA, 17 bp, Homo sapiens
tgtgtaaacctaattgt

SEQ ID NO: 1821108 - DNA, 22 bp, Homo sapiens
tgtgtaatttaaaattgtgatg

SEQ ID NO: 1821109 - DNA, 23 bp, Homo sapiens
tgtgtaatttaaaattgtgatgt

SEQ ID NO: 1821110 - DNA, 13 bp, Homo sapiens
tgtgtatgtgggg

SEQ ID NO: 1821111 - DNA, 23 bp, Homo sapiens
tgtgtatgtgggggtctgtgtgt

SEQ ID NO: 1821112 - DNA, 18 bp, Homo sapiens
tgtgtcactggctgcctc

SEQ ID NO: 1821113 - DNA, 13 bp, Homo sapiens
tgtgtccagcagc

SEQ ID NO: 1821114 - DNA, 14 bp, Homo sapiens
tgtgtgggagtgtg

SEQ ID NO: 1821115 - DNA, 11 bp, Homo sapiens
tgtgtgtatgt

SEQ ID NO: 1821116 - DNA, 13 bp, Homo sapiens
tgttaaaaaacaa

SEQ ID NO: 1821117 - DNA, 14 bp, Homo sapiens
tgttaaaaaacaac

SEQ ID NO: 1821118 - DNA, 14 bp, Homo sapiens
tgttaattgattaa

SEQ ID NO: 1821119 - DNA, 13 bp, Homo sapiens
tgttactaaagtc

SEQ ID NO: 1821120 - DNA, 17 bp, Homo sapiens
tgttactaatgatcact

SEQ ID NO: 1821121 - DNA, 13 bp, Homo sapiens
tgttataaataaa

SEQ ID NO: 1821122 - DNA, 13 bp, Homo sapiens
tgttattatctac

SEQ ID NO: 1821123 - DNA, 17 bp, Homo sapiens
tgttattggaattttct

SEQ ID NO: 1821124 - DNA, 23 bp, Homo sapiens
tgttattggaattttctttcata

SEQ ID NO: 1821125 - DNA, 16 bp, Homo sapiens
tgttatttggaatttt

SEQ ID NO: 1821126 - DNA, 20 bp, Homo sapiens
tgttattttttatttccaca

SEQ ID NO: 1821127 - DNA, 12 bp, Homo sapiens
tgttcaaaaatt

SEQ ID NO: 1821128 - DNA, 13 bp, Homo sapiens
tgttccctgcacc

SEQ ID NO: 1821129 - DNA, 10 bp, Homo sapiens
tgttcctgtg

SEQ ID NO: 1821130 - DNA, 20 bp, Homo sapiens
tgttcgtattacaagagaaa

SEQ ID NO: 1821131 - DNA, 23 bp, Homo sapiens
tgttctgggtgttgaccactcca

SEQ ID NO: 1821132 - DNA, 18 bp, Homo sapiens
tgttctgtaatggaactg

SEQ ID NO: 1821133 - DNA, 18 bp, Homo sapiens
tgttctgtccagtttcca

SEQ ID NO: 1821134 - DNA, 16 bp, Homo sapiens
tgttcttttgtcccag

SEQ ID NO: 1821135 - DNA, 18 bp, Homo sapiens
tgttgaccactccagaga

SEQ ID NO: 1821136 - DNA, 17 bp, Homo sapiens
tgttgatttgagaaatt

SEQ ID NO: 1821137 - DNA, 19 bp, Homo sapiens
tgttgcacatcattcattc

SEQ ID NO: 1821138 - DNA, 14 bp, Homo sapiens
tgttgccatagccc

SEQ ID NO: 1821139 - DNA, 20 bp, Homo sapiens
tgttggcgagaggaggggcc

SEQ ID NO: 1821140 - DNA, 20 bp, Homo sapiens
tgtttaaaaaaagtatatat

SEQ ID NO: 1821141 - DNA, 13 bp, Homo sapiens
tgtttatgtgtgt

SEQ ID NO: 1821142 - DNA, 19 bp, Homo sapiens
tgtttgtactttttaatgt

SEQ ID NO: 1821143 - DNA, 14 bp, Homo sapiens
tgttttagttcttg

SEQ ID NO: 1821144 - DNA, 11 bp, Homo sapiens
ttaaaaaatca

SEQ ID NO: 1821145 - DNA, 15 bp, Homo sapiens
ttaaaactatattta

SEQ ID NO: 1821146 - DNA, 17 bp, Homo sapiens
ttaaaaggaaaaaagaa

SEQ ID NO: 1821147 - DNA, 16 bp, Homo sapiens
ttaaaataaaataatt

SEQ ID NO: 1821148 - DNA, 17 bp, Homo sapiens
ttaaaatgtaggaagaa

SEQ ID NO: 1821149 - DNA, 15 bp, Homo sapiens
ttaaacttgacccag

SEQ ID NO: 1821150 - DNA, 21 bp, Homo sapiens
ttaaagtcaatattgatttta

SEQ ID NO: 1821151 - DNA, 14 bp, Homo sapiens
ttaaatcattttca

SEQ ID NO: 1821152 - DNA, 15 bp, Homo sapiens
ttaaatttacagaat

SEQ ID NO: 1821153 - DNA, 22 bp, Homo sapiens
ttaacaaaaaaggaaaatgaac

SEQ ID NO: 1821154 - DNA, 16 bp, Homo sapiens
ttaacctgaattattc

SEQ ID NO: 1821155 - DNA, 22 bp, Homo sapiens
ttaatacagattgaaaggacct

SEQ ID NO: 1821156 - DNA, 14 bp, Homo sapiens
ttaatctagaaaat

SEQ ID NO: 1821157 - DNA, 23 bp, Homo sapiens
ttaatgttatttggaattttaag

SEQ ID NO: 1821158 - DNA, 18 bp, Homo sapiens
ttaattgcaacaatgcaa

SEQ ID NO: 1821159 - DNA, 14 bp, Homo sapiens
ttacaactaaataa

SEQ ID NO: 1821160 - DNA, 20 bp, Homo sapiens
ttacaactaaataacacaga

SEQ ID NO: 1821161 - DNA, 16 bp, Homo sapiens
ttacaagagaaacaaa

SEQ ID NO: 1821162 - DNA, 18 bp, Homo sapiens
ttacagaatattatataa

SEQ ID NO: 1821163 - DNA, 15 bp, Homo sapiens
ttacagtatcttcaa

SEQ ID NO: 1821164 - DNA, 19 bp, Homo sapiens
ttacagtatcttcaaaaat

SEQ ID NO: 1821165 - DNA, 24 bp, Homo sapiens
ttacattaaaatagcacatgattt

SEQ ID NO: 1821166 - DNA, 18 bp, Homo sapiens
ttacattttcctgtgtaa

SEQ ID NO: 1821167 - DNA, 21 bp, Homo sapiens
ttaccattacttgtataaata

SEQ ID NO: 1821168 - DNA, 18 bp, Homo sapiens
ttacctatacctatgtga

SEQ ID NO: 1821169 - DNA, 14 bp, Homo sapiens
ttacgctgtctgta

SEQ ID NO: 1821170 - DNA, 17 bp, Homo sapiens
ttacgctgtctgtaatg

SEQ ID NO: 1821171 - DNA, 14 bp, Homo sapiens
ttactcccttcctg

SEQ ID NO: 1821172 - DNA, 13 bp, Homo sapiens
ttactctgagccc

SEQ ID NO: 1821173 - DNA, 16 bp, Homo sapiens
ttactctgagcccagg

SEQ ID NO: 1821174 - DNA, 17 bp, Homo sapiens
ttactctgagcccaggc

SEQ ID NO: 1821175 - DNA, 18 bp, Homo sapiens
ttactctgagcccaggcc

SEQ ID NO: 1821176 - DNA, 15 bp, Homo sapiens
ttactgacagaaatg

SEQ ID NO: 1821177 - DNA, 16 bp, Homo sapiens
ttagaaacaccattca

SEQ ID NO: 1821178 - DNA, 18 bp, Homo sapiens
ttagaatcaagtctgtga

SEQ ID NO: 1821179 - DNA, 23 bp, Homo sapiens
ttagaatggcctctttgtagaac

SEQ ID NO: 1821180 - DNA, 14 bp, Homo sapiens
ttagaatgtttcta

SEQ ID NO: 1821181 - DNA, 14 bp, Homo sapiens
ttaggcctggcaca

SEQ ID NO: 1821182 - DNA, 15 bp, Homo sapiens
ttaggcctggcacag

SEQ ID NO: 1821183 - DNA, 14 bp, Homo sapiens
ttagtaccttcaaa

SEQ ID NO: 1821184 - DNA, 15 bp, Homo sapiens
agcttctgctgggct

SEQ ID NO: 1821185 - DNA, 23 bp, Homo sapiens
agcttgaaagcagttaaactgat

SEQ ID NO: 1821186 - DNA, 12 bp, Homo sapiens
agctttctcctt

SEQ ID NO: 1821187 - DNA, 13 bp, Homo sapiens
agctttctccttt

SEQ ID NO: 1821188 - DNA, 18 bp, Homo sapiens
agcttttcccaggagacc

SEQ ID NO: 1821189 - DNA, 16 bp, Homo sapiens
aggaaaaaagaaaaaa

SEQ ID NO: 1821190 - DNA, 14 bp, Homo sapiens
aggaaaagcctctg

SEQ ID NO: 1821191 - DNA, 16 bp, Homo sapiens
aggaactgctgggctt

SEQ ID NO: 1821192 - DNA, 13 bp, Homo sapiens
aggaaggcagctg

SEQ ID NO: 1821193 - DNA, 15 bp, Homo sapiens
aggaaggcagctgct

SEQ ID NO: 1821194 - DNA, 16 bp, Homo sapiens
aggaaggcagctgctc

SEQ ID NO: 1821195 - DNA, 18 bp, Homo sapiens
aggaaggcagctgctctt

SEQ ID NO: 1821196 - DNA, 14 bp, Homo sapiens
aggacaacctgccc

SEQ ID NO: 1821197 - DNA, 21 bp, Homo sapiens
aggacacatcccggcctcttc

SEQ ID NO: 1821198 - DNA, 12 bp, Homo sapiens
aggacacatgtc

SEQ ID NO: 1821199 - DNA, 12 bp, Homo sapiens
aggacagtattt

SEQ ID NO: 1821200 - DNA, 19 bp, Homo sapiens
aggacagtatttgtgggga

SEQ ID NO: 1821201 - DNA, 19 bp, Homo sapiens
aggaccacagtgggtggca

SEQ ID NO: 1821202 - DNA, 20 bp, Homo sapiens
aggacccacccatcttcctg

SEQ ID NO: 1821203 - DNA, 15 bp, Homo sapiens
aggacccaggccctc

SEQ ID NO: 1821204 - DNA, 17 bp, Homo sapiens
aggacccaggccctcca

SEQ ID NO: 1821205 - DNA, 16 bp, Homo sapiens
aggacggggccggcca

SEQ ID NO: 1821206 - DNA, 16 bp, Homo sapiens
aggactggagaccgct

SEQ ID NO: 1821207 - DNA, 22 bp, Homo sapiens
aggactggagaccgcttcaccc

SEQ ID NO: 1821208 - DNA, 12 bp, Homo sapiens
aggagaccctgg

SEQ ID NO: 1821209 - DNA, 17 bp, Homo sapiens
aggagagactgaaagca

SEQ ID NO: 1821210 - DNA, 22 bp, Homo sapiens
aggagagactgaaagcagcagc

SEQ ID NO: 1821211 - DNA, 11 bp, Homo sapiens
aggagcagggt

SEQ ID NO: 1821212 - DNA, 19 bp, Homo sapiens
aggagctgatttccaggcc

SEQ ID NO: 1821213 - DNA, 21 bp, Homo sapiens
aggagctgatttccaggcccc

SEQ ID NO: 1821214 - DNA, 14 bp, Homo sapiens
aggaggctggctgg

SEQ ID NO: 1821215 - DNA, 14 bp, Homo sapiens
aggagggcagagcc

SEQ ID NO: 1821216 - DNA, 17 bp, Homo sapiens
aggagggcagagccatg

SEQ ID NO: 1821217 - DNA, 18 bp, Homo sapiens
aggagggcagagccatgg

SEQ ID NO: 1821218 - DNA, 23 bp, Homo sapiens
aggagggttgggcgtgctacctg

SEQ ID NO: 1821219 - DNA, 13 bp, Homo sapiens
aggaggtgggcca

SEQ ID NO: 1821220 - DNA, 15 bp, Homo sapiens
aggaggtgggccaca

SEQ ID NO: 1821221 - DNA, 16 bp, Homo sapiens
aggagtcaactggctg

SEQ ID NO: 1821222 - DNA, 13 bp, Homo sapiens
aggagtctgtgct

SEQ ID NO: 1821223 - DNA, 16 bp, Homo sapiens
aggagtctgtgctctt

SEQ ID NO: 1821224 - DNA, 17 bp, Homo sapiens
aggagtttgagacaagc

SEQ ID NO: 1821225 - DNA, 21 bp, Homo sapiens
aggagtttgagacaagccctg

SEQ ID NO: 1821226 - DNA, 15 bp, Homo sapiens
aggatatcagagctg

SEQ ID NO: 1821227 - DNA, 17 bp, Homo sapiens
aggatccgctgccacca

SEQ ID NO: 1821228 - DNA, 22 bp, Homo sapiens
aggatgtggatggaggtgatga

SEQ ID NO: 1821229 - DNA, 19 bp, Homo sapiens
aggattaggtttagaatca

SEQ ID NO: 1821230 - DNA, 15 bp, Homo sapiens
aggattcctccccca

SEQ ID NO: 1821231 - DNA, 16 bp, Homo sapiens
aggcaaagaatcaaca

SEQ ID NO: 1821232 - DNA, 13 bp, Homo sapiens
aggcaagcccctc

SEQ ID NO: 1821233 - DNA, 19 bp, Homo sapiens
aggcaccagctctgtggcc

SEQ ID NO: 1821234 - DNA, 21 bp, Homo sapiens
aggcaccagctctgtggcctg

SEQ ID NO: 1821235 - DNA, 22 bp, Homo sapiens
aggcaccagctctgtggcctgt

SEQ ID NO: 1821236 - DNA, 15 bp, Homo sapiens
aggcaccggcgctgc

SEQ ID NO: 1821237 - DNA, 15 bp, Homo sapiens
aggcacctggcctgc

SEQ ID NO: 1821238 - DNA, 16 bp, Homo sapiens
aggcacctggcctgct

SEQ ID NO: 1821239 - DNA, 20 bp, Homo sapiens
aggcacctggcctgctggga

SEQ ID NO: 1821240 - DNA, 16 bp, Homo sapiens
aggcactgagaatgat

SEQ ID NO: 1821241 - DNA, 12 bp, Homo sapiens
aggcagcctcca

SEQ ID NO: 1821242 - DNA, 13 bp, Homo sapiens
aggcagcctccag

SEQ ID NO: 1821243 - DNA, 16 bp, Homo sapiens
aggcagcctccagagc

SEQ ID NO: 1821244 - DNA, 19 bp, Homo sapiens
aggcagcctccagagccag

SEQ ID NO: 1821245 - DNA, 13 bp, Homo sapiens
aggcagctgctct

SEQ ID NO: 1821246 - DNA, 15 bp, Homo sapiens
aggcagggagggctt

SEQ ID NO: 1821247 - DNA, 14 bp, Homo sapiens
aggcagggcagagg

SEQ ID NO: 1821248 - DNA, 11 bp, Homo sapiens
aggcagtctga

SEQ ID NO: 1821249 - DNA, 16 bp, Homo sapiens
aggcatgctggcctcc

SEQ ID NO: 1821250 - DNA, 14 bp, Homo sapiens
aggccaaatgcaca

SEQ ID NO: 1821251 - DNA, 16 bp, Homo sapiens
aggccaaatgcacaag

SEQ ID NO: 1821252 - DNA, 17 bp, Homo sapiens
aggccaaatgcacaagc

SEQ ID NO: 1821253 - DNA, 12 bp, Homo sapiens
aggccaccccaa

SEQ ID NO: 1821254 - DNA, 21 bp, Homo sapiens
aggccaccccaaaccccagcc

SEQ ID NO: 1821255 - DNA, 15 bp, Homo sapiens
aggccactgtggcca

SEQ ID NO: 1821256 - DNA, 17 bp, Homo sapiens
aggccactgtggccaga

SEQ ID NO: 1821257 - DNA, 18 bp, Homo sapiens
aggccactgtggccagag

SEQ ID NO: 1821258 - DNA, 23 bp, Homo sapiens
aggccactgtggccagagctgga

SEQ ID NO: 1821259 - DNA, 19 bp, Homo sapiens
aggccatcttccaggtggg

SEQ ID NO: 1821260 - DNA, 19 bp, Homo sapiens
aggcccatctcaggtgcca

SEQ ID NO: 1821261 - DNA, 14 bp, Homo sapiens
aggccccaggccct

SEQ ID NO: 1821262 - DNA, 16 bp, Homo sapiens
aggcccctgaggactg

SEQ ID NO: 1821263 - DNA, 22 bp, Homo sapiens
aggccctaggattcctccccca

SEQ ID NO: 1821264 - DNA, 18 bp, Homo sapiens
aggccctccatgggctag

SEQ ID NO: 1821265 - DNA, 16 bp, Homo sapiens
aggccctgcactgtcc

SEQ ID NO: 1821266 - DNA, 12 bp, Homo sapiens
agcagcccagct

SEQ ID NO: 1821267 - DNA, 13 bp, Homo sapiens
agcagcctgatgg

SEQ ID NO: 1821268 - DNA, 14 bp, Homo sapiens
agcagcctgatggc

SEQ ID NO: 1821269 - DNA, 14 bp, Homo sapiens
agcagctaggactg

SEQ ID NO: 1821270 - DNA, 18 bp, Homo sapiens
agcagctaggactgagga

SEQ ID NO: 1821271 - DNA, 22 bp, Homo sapiens
agcagctaggactgaggagtgg

SEQ ID NO: 1821272 - DNA, 16 bp, Homo sapiens
agcagctgcgggtctg

SEQ ID NO: 1821273 - DNA, 21 bp, Homo sapiens
agcagctgcgggtctgaagga

SEQ ID NO: 1821274 - DNA, 15 bp, Homo sapiens
agcagcttctgccac

SEQ ID NO: 1821275 - DNA, 16 bp, Homo sapiens
agcagcttctgccact

SEQ ID NO: 1821276 - DNA, 17 bp, Homo sapiens
agcagcttctgccactt

SEQ ID NO: 1821277 - DNA, 16 bp, Homo sapiens
agcagggaaagctcca

SEQ ID NO: 1821278 - DNA, 15 bp, Homo sapiens
agcaggtgctgctac

SEQ ID NO: 1821279 - DNA, 16 bp, Homo sapiens
agcaggtgtggtggct

SEQ ID NO: 1821280 - DNA, 18 bp, Homo sapiens
agcaggtgtggtggctca

SEQ ID NO: 1821281 - DNA, 15 bp, Homo sapiens
agcagtgcctcgagg

SEQ ID NO: 1821282 - DNA, 16 bp, Homo sapiens
agcagtgcctcgaggc

SEQ ID NO: 1821283 - DNA, 19 bp, Homo sapiens
agcagtgcctcgaggcacc

SEQ ID NO: 1821284 - DNA, 13 bp, Homo sapiens
agcatccagcctg

SEQ ID NO: 1821285 - DNA, 16 bp, Homo sapiens
agcatccagcctgtgt

SEQ ID NO: 1821286 - DNA, 20 bp, Homo sapiens
agcatcgtgacccttcaggg

SEQ ID NO: 1821287 - DNA, 12 bp, Homo sapiens
agcatctcactt

SEQ ID NO: 1821288 - DNA, 22 bp, Homo sapiens
agcatgttcgtattacaagaga

SEQ ID NO: 1821289 - DNA, 13 bp, Homo sapiens
agcatttttcaga

SEQ ID NO: 1821290 - DNA, 23 bp, Homo sapiens
agcatttttcagagttttctaac

SEQ ID NO: 1821291 - DNA, 16 bp, Homo sapiens
agccactacctttgtc

SEQ ID NO: 1821292 - DNA, 19 bp, Homo sapiens
agccactcctgtcccgcct

SEQ ID NO: 1821293 - DNA, 22 bp, Homo sapiens
agccactcctgtcccgccttcc

SEQ ID NO: 1821294 - DNA, 23 bp, Homo sapiens
agccactcgcagtcgcaggatcc

SEQ ID NO: 1821295 - DNA, 19 bp, Homo sapiens
agccacttatttccatgga

SEQ ID NO: 1821296 - DNA, 15 bp, Homo sapiens
agccagagaggagca

SEQ ID NO: 1821297 - DNA, 17 bp, Homo sapiens
agccagagaggagcacc

SEQ ID NO: 1821298 - DNA, 18 bp, Homo sapiens
agccagagaggagcacct

SEQ ID NO: 1821299 - DNA, 20 bp, Homo sapiens
agccagcctgggactcccag

SEQ ID NO: 1821300 - DNA, 18 bp, Homo sapiens
agccagtcttgcctaggc

SEQ ID NO: 1821301 - DNA, 20 bp, Homo sapiens
agccatatattttctgagta

SEQ ID NO: 1821302 - DNA, 12 bp, Homo sapiens
agccatggctca

SEQ ID NO: 1821303 - DNA, 16 bp, Homo sapiens
agccatggctcaggca

SEQ ID NO: 1821304 - DNA, 21 bp, Homo sapiens
agccatggctcaggcaagccc

SEQ ID NO: 1821305 - DNA, 22 bp, Homo sapiens
agccatggctcaggcaagcccc

SEQ ID NO: 1821306 - DNA, 13 bp, Homo sapiens
agccatgggcctg

SEQ ID NO: 1821307 - DNA, 20 bp, Homo sapiens
agccatgggcctgggcctgc

SEQ ID NO: 1821308 - DNA, 23 bp, Homo sapiens
aggctttggggtcctagcccagt

SEQ ID NO: 1821309 - DNA, 13 bp, Homo sapiens
agggaaagcgggc

SEQ ID NO: 1821310 - DNA, 19 bp, Homo sapiens
agggaatgttccctgcacc

SEQ ID NO: 1821311 - DNA, 22 bp, Homo sapiens
agggaatgttccctgcaccctg

SEQ ID NO: 1821312 - DNA, 20 bp, Homo sapiens
agggacaaagaaatcccccc

SEQ ID NO: 1821313 - DNA, 18 bp, Homo sapiens
agggacagaaaagaaagc

SEQ ID NO: 1821314 - DNA, 23 bp, Homo sapiens
agggaccacagcaaggcacctgc

SEQ ID NO: 1821315 - DNA, 20 bp, Homo sapiens
agggagggggcgctcaggac

SEQ ID NO: 1821316 - DNA, 18 bp, Homo sapiens
agggatgatgccacacca

SEQ ID NO: 1821317 - DNA, 16 bp, Homo sapiens
agggcagtacctggga

SEQ ID NO: 1821318 - DNA, 17 bp, Homo sapiens
agggcatcaggcactgg

SEQ ID NO: 1821319 - DNA, 22 bp, Homo sapiens
agggcatcaggcactggtggca

SEQ ID NO: 1821320 - DNA, 16 bp, Homo sapiens
agggccagaaggaggg

SEQ ID NO: 1821321 - DNA, 21 bp, Homo sapiens
agggccagaaggagggcagag

SEQ ID NO: 1821322 - DNA, 22 bp, Homo sapiens
agggccatacttttgagagggg

SEQ ID NO: 1821323 - DNA, 23 bp, Homo sapiens
agggccatacttttgagaggggt

SEQ ID NO: 1821324 - DNA, 15 bp, Homo sapiens
agggcccagctgtag

SEQ ID NO: 1821325 - DNA, 17 bp, Homo sapiens
agggcccagctgtagcc

SEQ ID NO: 1821326 - DNA, 23 bp, Homo sapiens
agggcccagctgtagccatggct

SEQ ID NO: 1821327 - DNA, 13 bp, Homo sapiens
agggcccccaccg

SEQ ID NO: 1821328 - DNA, 11 bp, Homo sapiens
agggcccctcc

SEQ ID NO: 1821329 - DNA, 18 bp, Homo sapiens
agggcccctccctctgcc

SEQ ID NO: 1821330 - DNA, 17 bp, Homo sapiens
agggcctgggggcagtg

SEQ ID NO: 1821331 - DNA, 14 bp, Homo sapiens
agggctatggcaag

SEQ ID NO: 1821332 - DNA, 13 bp, Homo sapiens
agggctccagcat

SEQ ID NO: 1821333 - DNA, 21 bp, Homo sapiens
agggctccagcatccagcctg

SEQ ID NO: 1821334 - DNA, 19 bp, Homo sapiens
agggctggagtgcgctctt

SEQ ID NO: 1821335 - DNA, 18 bp, Homo sapiens
aggggcaaagaactgccc

SEQ ID NO: 1821336 - DNA, 11 bp, Homo sapiens
aggggcacacc

SEQ ID NO: 1821337 - DNA, 19 bp, Homo sapiens
aggggcacaccactgccct

SEQ ID NO: 1821338 - DNA, 15 bp, Homo sapiens
aggggcaggccctgc

SEQ ID NO: 1821339 - DNA, 12 bp, Homo sapiens
aggggcaggcct

SEQ ID NO: 1821340 - DNA, 18 bp, Homo sapiens
aggggcaggcctgggacc

SEQ ID NO: 1821341 - DNA, 22 bp, Homo sapiens
aggggcaggcctgggacccagc

SEQ ID NO: 1821342 - DNA, 19 bp, Homo sapiens
aggggccccagatctgcct

SEQ ID NO: 1821343 - DNA, 21 bp, Homo sapiens
aggggccccggggctggcaag

SEQ ID NO: 1821344 - DNA, 15 bp, Homo sapiens
aggggcccgcttgcc

SEQ ID NO: 1821345 - DNA, 20 bp, Homo sapiens
aggggcccgttgtctccctg

SEQ ID NO: 1821346 - DNA, 13 bp, Homo sapiens
aggggcggggcag

SEQ ID NO: 1821347 - DNA, 11 bp, Homo sapiens
aggggctctgc

SEQ ID NO: 1821348 - DNA, 13 bp, Homo sapiens
aggggctgcccgc

SEQ ID NO: 1821349 - DNA, 19 bp, Homo sapiens
aggggctgcccgctcccag

SEQ ID NO: 1821350 - DNA, 11 bp, Homo sapiens
aggggctgctg

SEQ ID NO: 1821351 - DNA, 12 bp, Homo sapiens
aggggctgctgg

SEQ ID NO: 1821352 - DNA, 18 bp, Homo sapiens
aggggctgctggggcatg

SEQ ID NO: 1821353 - DNA, 20 bp, Homo sapiens
aggggctgctggggcatgtg

SEQ ID NO: 1821354 - DNA, 23 bp, Homo sapiens
aggggtgcacccactcaccaggg

SEQ ID NO: 1821355 - DNA, 18 bp, Homo sapiens
agggtccgcaccagctgc

SEQ ID NO: 1821356 - DNA, 14 bp, Homo sapiens
agggtcttgggcta

SEQ ID NO: 1821357 - DNA, 21 bp, Homo sapiens
agggtcttgggctactggcag

SEQ ID NO: 1821358 - DNA, 13 bp, Homo sapiens
aggtaatgcacat

SEQ ID NO: 1821359 - DNA, 16 bp, Homo sapiens
aggtaatgcacatcct

SEQ ID NO: 1821360 - DNA, 12 bp, Homo sapiens
aggtaggccctt

SEQ ID NO: 1821361 - DNA, 17 bp, Homo sapiens
aggtaggcccttgtcct

SEQ ID NO: 1821362 - DNA, 18 bp, Homo sapiens
aggtaggcccttgtcctg

SEQ ID NO: 1821363 - DNA, 19 bp, Homo sapiens
aggtaggcccttgtcctgc

SEQ ID NO: 1821364 - DNA, 20 bp, Homo sapiens
aggtaggcccttgtcctgcc

SEQ ID NO: 1821365 - DNA, 22 bp, Homo sapiens
aggtaggcccttgtcctgccag

SEQ ID NO: 1821366 - DNA, 13 bp, Homo sapiens
aggtccaagggcc

SEQ ID NO: 1821367 - DNA, 14 bp, Homo sapiens
aggtccaagggcca

SEQ ID NO: 1821368 - DNA, 23 bp, Homo sapiens
aggtctcctccaccgccatggct

SEQ ID NO: 1821369 - DNA, 15 bp, Homo sapiens
aggtgagaccacctc

SEQ ID NO: 1821370 - DNA, 16 bp, Homo sapiens
aggtgcagatgggctg

SEQ ID NO: 1821371 - DNA, 22 bp, Homo sapiens
aggtgctgctaccctccctgct

SEQ ID NO: 1821372 - DNA, 13 bp, Homo sapiens
aggtgggcagctg

SEQ ID NO: 1821373 - DNA, 19 bp, Homo sapiens
aggtgggtccaggaaggca

SEQ ID NO: 1821374 - DNA, 23 bp, Homo sapiens
aggtgggtccaggaaggcagctg

SEQ ID NO: 1821375 - DNA, 17 bp, Homo sapiens
aggtgtggtggctcatg

SEQ ID NO: 1821376 - DNA, 14 bp, Homo sapiens
aggttatctgcctg

SEQ ID NO: 1821377 - DNA, 20 bp, Homo sapiens
aggttgggccatactggcct

SEQ ID NO: 1821378 - DNA, 12 bp, Homo sapiens
agtaaaagctaa

SEQ ID NO: 1821379 - DNA, 14 bp, Homo sapiens
agtaaaagctaatt

SEQ ID NO: 1821380 - DNA, 22 bp, Homo sapiens
agtaaactggatactgtactga

SEQ ID NO: 1821381 - DNA, 11 bp, Homo sapiens
agtaaagtttt

SEQ ID NO: 1821382 - DNA, 17 bp, Homo sapiens
agtaacatgcaacaaaa

SEQ ID NO: 1821383 - DNA, 19 bp, Homo sapiens
agtaagtttttttagaaga

SEQ ID NO: 1821384 - DNA, 21 bp, Homo sapiens
agtaatgaaggcatatttcca

SEQ ID NO: 1821385 - DNA, 20 bp, Homo sapiens
agtaattttttacattttcc

SEQ ID NO: 1821386 - DNA, 20 bp, Homo sapiens
agtacctgggaaaggaccca

SEQ ID NO: 1821387 - DNA, 15 bp, Homo sapiens
agtaccttcaaataa

SEQ ID NO: 1821388 - DNA, 19 bp, Homo sapiens
agtactctctgctctagcc

SEQ ID NO: 1821389 - DNA, 23 bp, Homo sapiens
agtactctctgctctagccagga

SEQ ID NO: 1821390 - DNA, 22 bp, Homo sapiens
agtataggataaattacattaa

SEQ ID NO: 1821391 - DNA, 15 bp, Homo sapiens
agtatatattctaca

SEQ ID NO: 1821392 - DNA, 21 bp, Homo sapiens
agtatatattctacacatata

SEQ ID NO: 1821393 - DNA, 22 bp, Homo sapiens
atctcattcaggtgttctcttc

SEQ ID NO: 1821394 - DNA, 18 bp, Homo sapiens
atctccagggctgcccct

SEQ ID NO: 1821395 - DNA, 20 bp, Homo sapiens
atctccagggctgcccctgt

SEQ ID NO: 1821396 - DNA, 14 bp, Homo sapiens
atctccccaggcct

SEQ ID NO: 1821397 - DNA, 11 bp, Homo sapiens
atctcttcaat

SEQ ID NO: 1821398 - DNA, 22 bp, Homo sapiens
atctgacacaagtgtattattt

SEQ ID NO: 1821399 - DNA, 16 bp, Homo sapiens
atctgacagtctcaaa

SEQ ID NO: 1821400 - DNA, 20 bp, Homo sapiens
atctgagaggccacagtgca

SEQ ID NO: 1821401 - DNA, 17 bp, Homo sapiens
atctgatggtgagctgg

SEQ ID NO: 1821402 - DNA, 12 bp, Homo sapiens
atctgcccagga

SEQ ID NO: 1821403 - DNA, 17 bp, Homo sapiens
atctgcctggcctggct

SEQ ID NO: 1821404 - DNA, 20 bp, Homo sapiens
atctgcctgggcctgtgcag

SEQ ID NO: 1821405 - DNA, 23 bp, Homo sapiens
atctgcctgggcctgtgcagcag

SEQ ID NO: 1821406 - DNA, 20 bp, Homo sapiens
atctgctgttgccatagccc

SEQ ID NO: 1821407 - DNA, 22 bp, Homo sapiens
atctgctgttgccatagcccca

SEQ ID NO: 1821408 - DNA, 14 bp, Homo sapiens
atctggcatggctc

SEQ ID NO: 1821409 - DNA, 14 bp, Homo sapiens
atctgtactgaaag

SEQ ID NO: 1821410 - DNA, 17 bp, Homo sapiens
atctgtactgaaagcaa

SEQ ID NO: 1821411 - DNA, 22 bp, Homo sapiens
atctgtgaggggctctctcatg

SEQ ID NO: 1821412 - DNA, 15 bp, Homo sapiens
atctgtttgcttcta

SEQ ID NO: 1821413 - DNA, 16 bp, Homo sapiens
atctgtttgcttctaa

SEQ ID NO: 1821414 - DNA, 15 bp, Homo sapiens
atcttaaaattcttg

SEQ ID NO: 1821415 - DNA, 19 bp, Homo sapiens
atctttcaatatcattact

SEQ ID NO: 1821416 - DNA, 19 bp, Homo sapiens
ataaacctctaatttattt

SEQ ID NO: 1821417 - DNA, 20 bp, Homo sapiens
ataaacctctaatttatttt

SEQ ID NO: 1821418 - DNA, 20 bp, Homo sapiens
ataaagctggacaagaagct

SEQ ID NO: 1821419 - DNA, 22 bp, Homo sapiens
ataaagctggacaagaagctgc

SEQ ID NO: 1821420 - DNA, 14 bp, Homo sapiens
ataaagctgtgaca

SEQ ID NO: 1821421 - DNA, 16 bp, Homo sapiens
ataaagctgtgacagt

SEQ ID NO: 1821422 - DNA, 22 bp, Homo sapiens
ataaagctgtgacagttctgtt

SEQ ID NO: 1821423 - DNA, 21 bp, Homo sapiens
ataaaggtatttagaatatat

SEQ ID NO: 1821424 - DNA, 15 bp, Homo sapiens
ataaatgaatcttac

SEQ ID NO: 1821425 - DNA, 20 bp, Homo sapiens
ataagaccgtgtcccaagga

SEQ ID NO: 1821426 - DNA, 21 bp, Homo sapiens
ataagctgttctggtggcagt

SEQ ID NO: 1821427 - DNA, 20 bp, Homo sapiens
ataagtaatgaaggcatatt

SEQ ID NO: 1821428 - DNA, 21 bp, Homo sapiens
ataatggtgttactaaagtca

SEQ ID NO: 1821429 - DNA, 16 bp, Homo sapiens
ataatgtaatactgta

SEQ ID NO: 1821430 - DNA, 21 bp, Homo sapiens
ataatgtaatactgtagaaat

SEQ ID NO: 1821431 - DNA, 19 bp, Homo sapiens
ataatttctcctcatttaa

SEQ ID NO: 1821432 - DNA, 17 bp, Homo sapiens
ataattttattgctgga

SEQ ID NO: 1821433 - DNA, 17 bp, Homo sapiens
atacataaatgcccagc

SEQ ID NO: 1821434 - DNA, 14 bp, Homo sapiens
atacatcttcatta

SEQ ID NO: 1821435 - DNA, 16 bp, Homo sapiens
atacatcttcattaat

SEQ ID NO: 1821436 - DNA, 17 bp, Homo sapiens
ataccccaagtccacct

SEQ ID NO: 1821437 - DNA, 15 bp, Homo sapiens
ataccccattaaatc

SEQ ID NO: 1821438 - DNA, 13 bp, Homo sapiens
atacctatgtgaa

SEQ ID NO: 1821439 - DNA, 18 bp, Homo sapiens
atactattcaatgcaatg

SEQ ID NO: 1821440 - DNA, 16 bp, Homo sapiens
atactcaatcaagcaa

SEQ ID NO: 1821441 - DNA, 22 bp, Homo sapiens
atactggcctcgcctggcctga

SEQ ID NO: 1821442 - DNA, 22 bp, Homo sapiens
atgttcccttgaccattggctg

SEQ ID NO: 1821443 - DNA, 14 bp, Homo sapiens
atgttgcacatcat

SEQ ID NO: 1821444 - DNA, 23 bp, Homo sapiens
atgttgcacatcattcattcact

SEQ ID NO: 1821445 - DNA, 16 bp, Homo sapiens
atgtttatctgacaca

SEQ ID NO: 1821446 - DNA, 17 bp, Homo sapiens
atgtttctatttccata

SEQ ID NO: 1821447 - DNA, 13 bp, Homo sapiens
atgtttgtacttt

SEQ ID NO: 1821448 - DNA, 21 bp, Homo sapiens
attaaaatctggcaaagttat

SEQ ID NO: 1821449 - DNA, 23 bp, Homo sapiens
attaaaatctggcaaagttatat

SEQ ID NO: 1821450 - DNA, 13 bp, Homo sapiens
attaaaatgcata

SEQ ID NO: 1821451 - DNA, 14 bp, Homo sapiens
attaaaatgcatat

SEQ ID NO: 1821452 - DNA, 18 bp, Homo sapiens
attaaaatgtaggaagaa

SEQ ID NO: 1821453 - DNA, 12 bp, Homo sapiens
attaaatgttgc

SEQ ID NO: 1821454 - DNA, 19 bp, Homo sapiens
attaacaactgtgaatatg

SEQ ID NO: 1821455 - DNA, 22 bp, Homo sapiens
attaacaactgtgaatatgaga

SEQ ID NO: 1821456 - DNA, 14 bp, Homo sapiens
attaagtctcagta

SEQ ID NO: 1821457 - DNA, 13 bp, Homo sapiens
attaatactgtgt

SEQ ID NO: 1821458 - DNA, 16 bp, Homo sapiens
attaatctagaaaatg

SEQ ID NO: 1821459 - DNA, 23 bp, Homo sapiens
attacaggggcagtgcctttgta

SEQ ID NO: 1821460 - DNA, 15 bp, Homo sapiens
attacagtgcagttt

SEQ ID NO: 1821461 - DNA, 19 bp, Homo sapiens
attaccacgccttgacctt

SEQ ID NO: 1821462 - DNA, 17 bp, Homo sapiens
attagcaactgtgctac

SEQ ID NO: 1821463 - DNA, 21 bp, Homo sapiens
attagtttgatttaatatctg

SEQ ID NO: 1821464 - DNA, 14 bp, Homo sapiens
attatagtaaatct

SEQ ID NO: 1821465 - DNA, 12 bp, Homo sapiens
attatatatcat

SEQ ID NO: 1821466 - DNA, 19 bp, Homo sapiens
attatatatcataaagtat

SEQ ID NO: 1821467 - DNA, 17 bp, Homo sapiens
attatatttgagtttct

SEQ ID NO: 1821468 - DNA, 20 bp, Homo sapiens
attatatttgagtttctttc

SEQ ID NO: 1821469 - DNA, 21 bp, Homo sapiens
attatatttgagtttctttca

SEQ ID NO: 1821470 - DNA, 20 bp, Homo sapiens
attatctgtactgaaagcaa

SEQ ID NO: 1821471 - DNA, 23 bp, Homo sapiens
attatctgtactgaaagcaaatg

SEQ ID NO: 1821472 - DNA, 20 bp, Homo sapiens
attatgagtctctatgatct

SEQ ID NO: 1821473 - DNA, 21 bp, Homo sapiens
attatttctccatcccctccc

SEQ ID NO: 1821474 - DNA, 22 bp, Homo sapiens
attatttctccatcccctccct

SEQ ID NO: 1821475 - DNA, 22 bp, Homo sapiens
attatttctggctttttgaatt

SEQ ID NO: 1821476 - DNA, 14 bp, Homo sapiens
attatttgttttcc

SEQ ID NO: 1821477 - DNA, 18 bp, Homo sapiens
attcaaatgaactttaaa

SEQ ID NO: 1821478 - DNA, 12 bp, Homo sapiens
attcaataaagc

SEQ ID NO: 1821479 - DNA, 14 bp, Homo sapiens
attcaatgcaatga

SEQ ID NO: 1821480 - DNA, 14 bp, Homo sapiens
attcactaagccat

SEQ ID NO: 1821481 - DNA, 16 bp, Homo sapiens
attcagcaccctgggt

SEQ ID NO: 1821482 - DNA, 12 bp, Homo sapiens
attcaggcactg

SEQ ID NO: 1821483 - DNA, 15 bp, Homo sapiens
attcaggcagcactg

SEQ ID NO: 1821484 - DNA, 17 bp, Homo sapiens
attcaggtgttctcttc

SEQ ID NO: 1821485 - DNA, 19 bp, Homo sapiens
attcatgctttctcctttt

SEQ ID NO: 1821486 - DNA, 17 bp, Homo sapiens
attcatggcctggggga

SEQ ID NO: 1821487 - DNA, 20 bp, Homo sapiens
attcattgttaaaaaacaac

SEQ ID NO: 1821488 - DNA, 23 bp, Homo sapiens
attccaacaatggggtgggccca

SEQ ID NO: 1821489 - DNA, 15 bp, Homo sapiens
attccctgtggaatg

SEQ ID NO: 1821490 - DNA, 13 bp, Homo sapiens
attcctccagcct

SEQ ID NO: 1821491 - DNA, 18 bp, Homo sapiens
attcctccagcctcccct

SEQ ID NO: 1821492 - DNA, 15 bp, Homo sapiens
attcctctaaaactc

SEQ ID NO: 1821493 - DNA, 23 bp, Homo sapiens
attcctttacaactaaataacac

SEQ ID NO: 1821494 - DNA, 14 bp, Homo sapiens
attctaattcttca

SEQ ID NO: 1821495 - DNA, 16 bp, Homo sapiens
attctaattcttcatt

SEQ ID NO: 1821496 - DNA, 17 bp, Homo sapiens
attctaattcttcatta

SEQ ID NO: 1821497 - DNA, 22 bp, Homo sapiens
attctcattggggttgcaacaa

SEQ ID NO: 1821498 - DNA, 13 bp, Homo sapiens
attctgagggaat

SEQ ID NO: 1821499 - DNA, 19 bp, Homo sapiens
attctttgacctgttggga

SEQ ID NO: 1821500 - DNA, 14 bp, Homo sapiens
attcttttcaaaat

SEQ ID NO: 1821501 - DNA, 20 bp, Homo sapiens
attgaaaggacctcttctga

SEQ ID NO: 1821502 - DNA, 22 bp, Homo sapiens
attgaaaggacctcttctgaag

SEQ ID NO: 1821503 - DNA, 17 bp, Homo sapiens
attgaaatttactgtga

SEQ ID NO: 1821504 - DNA, 17 bp, Homo sapiens
attgaaggagaaaatgc

SEQ ID NO: 1821505 - DNA, 17 bp, Homo sapiens
attgatcaaaatcaaaa

SEQ ID NO: 1821506 - DNA, 14 bp, Homo sapiens
attgattaaaatct

SEQ ID NO: 1821507 - DNA, 21 bp, Homo sapiens
attgcaaaactagacaaaagt

SEQ ID NO: 1821508 - DNA, 22 bp, Homo sapiens
attgcaaaactagacaaaagtt

SEQ ID NO: 1821509 - DNA, 15 bp, Homo sapiens
attgcaacaatgcaa

SEQ ID NO: 1821510 - DNA, 16 bp, Homo sapiens
attgcaacaatgcaaa

SEQ ID NO: 1821511 - DNA, 23 bp, Homo sapiens
attgcaggagtccctgccatcat

SEQ ID NO: 1821512 - DNA, 21 bp, Homo sapiens
attgctaattctgagggaatt

SEQ ID NO: 1821513 - DNA, 20 bp, Homo sapiens
attgctctaattcttttcaa

SEQ ID NO: 1821514 - DNA, 13 bp, Homo sapiens
attggaattttct

SEQ ID NO: 1821515 - DNA, 18 bp, Homo sapiens
attggataccccattaaa

SEQ ID NO: 1821516 - DNA, 19 bp, Homo sapiens
attggccctcattccaagc

SEQ ID NO: 1821517 - DNA, 13 bp, Homo sapiens
attggctttgcag

SEQ ID NO: 1821518 - DNA, 17 bp, Homo sapiens
attggggttgcaacaat

SEQ ID NO: 1821519 - DNA, 17 bp, Homo sapiens
attgtccttcagagctc

SEQ ID NO: 1821520 - DNA, 13 bp, Homo sapiens
attgtgatgtgtc

SEQ ID NO: 1821521 - DNA, 14 bp, Homo sapiens
attgtgatgtgtcc

SEQ ID NO: 1821522 - DNA, 15 bp, Homo sapiens
attgtgatgtgtcct

SEQ ID NO: 1821523 - DNA, 16 bp, Homo sapiens
attgtgatttcccgtg

SEQ ID NO: 1821524 - DNA, 20 bp, Homo sapiens
attgttataaataaaattgt

SEQ ID NO: 1821525 - DNA, 15 bp, Homo sapiens
atttaaaattgtgat

SEQ ID NO: 1821526 - DNA, 18 bp, Homo sapiens
atttaatatttttcaaaa

SEQ ID NO: 1821527 - DNA, 19 bp, Homo sapiens
atttaatatttttcaaaat

SEQ ID NO: 1821528 - DNA, 20 bp, Homo sapiens
atttaatatttttcaaaatc

SEQ ID NO: 1821529 - DNA, 17 bp, Homo sapiens
atttactgtgagactgt

SEQ ID NO: 1821530 - DNA, 13 bp, Homo sapiens
atttagaatatat

SEQ ID NO: 1821531 - DNA, 13 bp, Homo sapiens
atttatttatgta

SEQ ID NO: 1821532 - DNA, 19 bp, Homo sapiens
atttcagaaggagaaggaa

SEQ ID NO: 1821533 - DNA, 19 bp, Homo sapiens
atttccaggcccctgagga

SEQ ID NO: 1821534 - DNA, 22 bp, Homo sapiens
atttcccgtggccccagcctgg

SEQ ID NO: 1821535 - DNA, 23 bp, Homo sapiens
atttcccgtggccccagcctggc

SEQ ID NO: 1821536 - DNA, 18 bp, Homo sapiens
atttctaagttaaatcat

SEQ ID NO: 1821537 - DNA, 17 bp, Homo sapiens
atttctcctcatttaat

SEQ ID NO: 1821538 - DNA, 17 bp, Homo sapiens
atttctgcttttgcatc

SEQ ID NO: 1821539 - DNA, 20 bp, Homo sapiens
atttctgcttttgcatcttt

SEQ ID NO: 1821540 - DNA, 12 bp, Homo sapiens
atttctgtatat

SEQ ID NO: 1821541 - DNA, 14 bp, Homo sapiens
atttgccagcacag

SEQ ID NO: 1821542 - DNA, 16 bp, Homo sapiens
atttgctatgagctgg

SEQ ID NO: 1821543 - DNA, 17 bp, Homo sapiens
atttggaattttaagtt

SEQ ID NO: 1821544 - DNA, 21 bp, Homo sapiens
caaggttactcagcagcagag

SEQ ID NO: 1821545 - DNA, 17 bp, Homo sapiens
caaggttttggagtcag

SEQ ID NO: 1821546 - DNA, 17 bp, Homo sapiens
caagtagtagtgtcttc

SEQ ID NO: 1821547 - DNA, 13 bp, Homo sapiens
caagtcacagctg

SEQ ID NO: 1821548 - DNA, 19 bp, Homo sapiens
caagtcacagctgcagctg

SEQ ID NO: 1821549 - DNA, 22 bp, Homo sapiens
caagtcacagctgcagctgggc

SEQ ID NO: 1821550 - DNA, 22 bp, Homo sapiens
caagtctaaacaatgaattctt

SEQ ID NO: 1821551 - DNA, 11 bp, Homo sapiens
caagtctgtga

SEQ ID NO: 1821552 - DNA, 20 bp, Homo sapiens
caagtgaatgagtttccagc

SEQ ID NO: 1821553 - DNA, 16 bp, Homo sapiens
caagtgatctttcaat

SEQ ID NO: 1821554 - DNA, 15 bp, Homo sapiens
caataaagctgctga

SEQ ID NO: 1821555 - DNA, 19 bp, Homo sapiens
caataaagctggacaagaa

SEQ ID NO: 1821556 - DNA, 14 bp, Homo sapiens
caataactagtgat

SEQ ID NO: 1821557 - DNA, 22 bp, Homo sapiens
caatacacataagaccgtgtcc

SEQ ID NO: 1821558 - DNA, 15 bp, Homo sapiens
caatattgattttaa

SEQ ID NO: 1821559 - DNA, 19 bp, Homo sapiens
caatcactagtcaagaaaa

SEQ ID NO: 1821560 - DNA, 22 bp, Homo sapiens
caatcactagtcaagaaaaata

SEQ ID NO: 1821561 - DNA, 23 bp, Homo sapiens
caatcactagtcaagaaaaatat

SEQ ID NO: 1821562 - DNA, 12 bp, Homo sapiens
caatgaaaacaa

SEQ ID NO: 1821563 - DNA, 16 bp, Homo sapiens
caatgaaaacaaaatt

SEQ ID NO: 1821564 - DNA, 15 bp, Homo sapiens
caatgaattcttcaa

SEQ ID NO: 1821565 - DNA, 15 bp, Homo sapiens
caatgagtgtgccag

SEQ ID NO: 1821566 - DNA, 21 bp, Homo sapiens
caatgcaaaagccaagaaagt

SEQ ID NO: 1821567 - DNA, 20 bp, Homo sapiens
caatgcaatgaaaacaaaat

SEQ ID NO: 1821568 - DNA, 21 bp, Homo sapiens
caatgcccgtaagatggctta

SEQ ID NO: 1821569 - DNA, 13 bp, Homo sapiens
caatgctttggga

SEQ ID NO: 1821570 - DNA, 18 bp, Homo sapiens
caatgctttgggaggcca

SEQ ID NO: 1821571 - DNA, 17 bp, Homo sapiens
caatggcagctagactg

SEQ ID NO: 1821572 - DNA, 15 bp, Homo sapiens
caatgtcagaaactc

SEQ ID NO: 1821573 - DNA, 15 bp, Homo sapiens
caatgtgatggtcag

SEQ ID NO: 1821574 - DNA, 22 bp, Homo sapiens
caattcattgttaaaaaacaac

SEQ ID NO: 1821575 - DNA, 12 bp, Homo sapiens
cacaacagattt

SEQ ID NO: 1821576 - DNA, 13 bp, Homo sapiens
cacaacagatttc

SEQ ID NO: 1821577 - DNA, 14 bp, Homo sapiens
cacaacattttaat

SEQ ID NO: 1821578 - DNA, 17 bp, Homo sapiens
cacaccaagctgtgcca

SEQ ID NO: 1821579 - DNA, 23 bp, Homo sapiens
cacaccaagctgtgccaccctgg

SEQ ID NO: 1821580 - DNA, 14 bp, Homo sapiens
cacacccaggaagg

SEQ ID NO: 1821581 - DNA, 15 bp, Homo sapiens
cacacccaggaaggg

SEQ ID NO: 1821582 - DNA, 13 bp, Homo sapiens
cacactcagcagc

SEQ ID NO: 1821583 - DNA, 20 bp, Homo sapiens
cacagacttctggaaggctg

SEQ ID NO: 1821584 - DNA, 22 bp, Homo sapiens
cacagacttctggaaggctggc

SEQ ID NO: 1821585 - DNA, 21 bp, Homo sapiens
cacagatattgttataaataa

SEQ ID NO: 1821586 - DNA, 21 bp, Homo sapiens
cacagcaaggaggctggctgg

SEQ ID NO: 1821587 - DNA, 17 bp, Homo sapiens
cacagcaaggcacctgc

SEQ ID NO: 1821588 - DNA, 14 bp, Homo sapiens
cacagcccacgtcc

SEQ ID NO: 1821589 - DNA, 18 bp, Homo sapiens
cacagcccacgtcctgtc

SEQ ID NO: 1821590 - DNA, 15 bp, Homo sapiens
cacagccctcccgcc

SEQ ID NO: 1821591 - DNA, 17 bp, Homo sapiens
cacagccctcccgcccc

SEQ ID NO: 1821592 - DNA, 13 bp, Homo sapiens
cacagcctctccc

SEQ ID NO: 1821593 - DNA, 22 bp, Homo sapiens
cacagctcctcttaccgtagcc

SEQ ID NO: 1821594 - DNA, 14 bp, Homo sapiens
cacagctgcagctg

SEQ ID NO: 1821595 - DNA, 16 bp, Homo sapiens
cacagctgcagctggg

SEQ ID NO: 1821596 - DNA, 18 bp, Homo sapiens
cacagctgcagctgggcc

SEQ ID NO: 1821597 - DNA, 17 bp, Homo sapiens
cacagcttcctgagggc

SEQ ID NO: 1821598 - DNA, 23 bp, Homo sapiens
cacaggggcaaagaactgcccca

SEQ ID NO: 1821599 - DNA, 16 bp, Homo sapiens
cacaggggcaggcctg

SEQ ID NO: 1821600 - DNA, 14 bp, Homo sapiens
cacaggggcggggc

SEQ ID NO: 1821601 - DNA, 23 bp, Homo sapiens
cacagtattatttctccatcccc

SEQ ID NO: 1821602 - DNA, 14 bp, Homo sapiens
cacagtcctcacag

SEQ ID NO: 1821603 - DNA, 20 bp, Homo sapiens
cacagtcctcacagcctctc

SEQ ID NO: 1821604 - DNA, 16 bp, Homo sapiens
cacagtgacagtcact

SEQ ID NO: 1821605 - DNA, 17 bp, Homo sapiens
cacagtgacagtcactt

SEQ ID NO: 1821606 - DNA, 20 bp, Homo sapiens
cacagtgactcgggctcctg

SEQ ID NO: 1821607 - DNA, 21 bp, Homo sapiens
cacagtgactcgggctcctgt

SEQ ID NO: 1821608 - DNA, 22 bp, Homo sapiens
cacagtgactcgggctcctgtg

SEQ ID NO: 1821609 - DNA, 18 bp, Homo sapiens
cacagtgcccagctaatt

SEQ ID NO: 1821610 - DNA, 15 bp, Homo sapiens
cacagtgctgcttct

SEQ ID NO: 1821611 - DNA, 13 bp, Homo sapiens
cacagtgggtggc

SEQ ID NO: 1821612 - DNA, 17 bp, Homo sapiens
cacagtgggtggcacct

SEQ ID NO: 1821613 - DNA, 20 bp, Homo sapiens
cacagtgggtggcacctcct

SEQ ID NO: 1821614 - DNA, 23 bp, Homo sapiens
cacagtgggtggcacctcctgag

SEQ ID NO: 1821615 - DNA, 17 bp, Homo sapiens
cacagtgttggcgagag

SEQ ID NO: 1821616 - DNA, 20 bp, Homo sapiens
cacagttgtctattctgagc

SEQ ID NO: 1821617 - DNA, 22 bp, Homo sapiens
cacagttgtctattctgagcct

SEQ ID NO: 1821618 - DNA, 12 bp, Homo sapiens
cacatatatgta

SEQ ID NO: 1821619 - DNA, 15 bp, Homo sapiens
cacatatatgtatat

SEQ ID NO: 1821620 - DNA, 14 bp, Homo sapiens
cacatcattcattc

SEQ ID NO: 1821621 - DNA, 15 bp, Homo sapiens
cacatcattcattca

SEQ ID NO: 1821622 - DNA, 16 bp, Homo sapiens
cacatcccggcctctt

SEQ ID NO: 1821623 - DNA, 17 bp, Homo sapiens
cacatcccggcctcttc

SEQ ID NO: 1821624 - DNA, 20 bp, Homo sapiens
cacatcccggcctcttccac

SEQ ID NO: 1821625 - DNA, 14 bp, Homo sapiens
cacatgattttctt

SEQ ID NO: 1821626 - DNA, 14 bp, Homo sapiens
caccaacccagccg

SEQ ID NO: 1821627 - DNA, 21 bp, Homo sapiens
caccaacccagccgctgcccg

SEQ ID NO: 1821628 - DNA, 18 bp, Homo sapiens
caccaagctgtgccaccc

SEQ ID NO: 1821629 - DNA, 20 bp, Homo sapiens
caccaagctgtgccaccctg

SEQ ID NO: 1821630 - DNA, 22 bp, Homo sapiens
caccaagctgtgccaccctggg

SEQ ID NO: 1821631 - DNA, 23 bp, Homo sapiens
caccaagctgtgccaccctgggc

SEQ ID NO: 1821632 - DNA, 23 bp, Homo sapiens
caccactagggtcctggccctct

SEQ ID NO: 1821633 - DNA, 14 bp, Homo sapiens
caccactgccctgc

SEQ ID NO: 1821634 - DNA, 21 bp, Homo sapiens
caccactgccctgcctgccca

SEQ ID NO: 1821635 - DNA, 22 bp, Homo sapiens
caccactgccctgcctgcccac

SEQ ID NO: 1821636 - DNA, 18 bp, Homo sapiens
caccagaacgcaccccac

SEQ ID NO: 1821637 - DNA, 19 bp, Homo sapiens
caccagaacgcaccccact

SEQ ID NO: 1821638 - DNA, 20 bp, Homo sapiens
caccagaacgcaccccactg

SEQ ID NO: 1821639 - DNA, 16 bp, Homo sapiens
caccagccccctggat

SEQ ID NO: 1821640 - DNA, 20 bp, Homo sapiens
caccagccccctggatgggc

SEQ ID NO: 1821641 - DNA, 22 bp, Homo sapiens
caccagccccctggatgggcat

SEQ ID NO: 1821642 - DNA, 13 bp, Homo sapiens
caccagctctgtg

SEQ ID NO: 1821643 - DNA, 18 bp, Homo sapiens
caccagctctgtggcctg

SEQ ID NO: 1821644 - DNA, 19 bp, Homo sapiens
caccagctctgtggcctgt

SEQ ID NO: 1821645 - DNA, 21 bp, Homo sapiens
caccagctctgtggcctgtgt

SEQ ID NO: 1821646 - DNA, 13 bp, Homo sapiens
caccagctgctct

SEQ ID NO: 1821647 - DNA, 14 bp, Homo sapiens
caccagctgctctg

SEQ ID NO: 1821648 - DNA, 17 bp, Homo sapiens
caccagctgctctgccc

SEQ ID NO: 1821649 - DNA, 17 bp, Homo sapiens
caccaggggcaggcaca

SEQ ID NO: 1821650 - DNA, 20 bp, Homo sapiens
caccaggggcaggcacagca

SEQ ID NO: 1821651 - DNA, 23 bp, Homo sapiens
caccagggtccgcaccagctgct

SEQ ID NO: 1821652 - DNA, 19 bp, Homo sapiens
cacccaggctgcactgcag

SEQ ID NO: 1821653 - DNA, 20 bp, Homo sapiens
cacccaggctgcactgcagt

SEQ ID NO: 1821654 - DNA, 21 bp, Homo sapiens
cacccaggctgcactgcagtg

SEQ ID NO: 1821655 - DNA, 22 bp, Homo sapiens
cacccagtgctgccatgccact

SEQ ID NO: 1821656 - DNA, 17 bp, Homo sapiens
cacccatcttcctgctg

SEQ ID NO: 1821657 - DNA, 17 bp, Homo sapiens
caccccactgggagagc

SEQ ID NO: 1821658 - DNA, 17 bp, Homo sapiens
cacccccatgctgcctt

SEQ ID NO: 1821659 - DNA, 18 bp, Homo sapiens
cacccccatgctgccttc

SEQ ID NO: 1821660 - DNA, 16 bp, Homo sapiens
caccccctcctgctgc

SEQ ID NO: 1821661 - DNA, 17 bp, Homo sapiens
caccccctcctgctgca

SEQ ID NO: 1821662 - DNA, 12 bp, Homo sapiens
caccccggcctc

SEQ ID NO: 1821663 - DNA, 12 bp, Homo sapiens
caccctcccctc

SEQ ID NO: 1821664 - DNA, 14 bp, Homo sapiens
caccctcccctccc

SEQ ID NO: 1821665 - DNA, 18 bp, Homo sapiens
caccctcgtggacacctg

SEQ ID NO: 1821666 - DNA, 20 bp, Homo sapiens
caccctcgtggacacctgcc

SEQ ID NO: 1821667 - DNA, 17 bp, Homo sapiens
caccctggaaaggggag

SEQ ID NO: 1821668 - DNA, 16 bp, Homo sapiens
caccctgggctctgtg

SEQ ID NO: 1821669 - DNA, 17 bp, Homo sapiens
caccctgggctctgtgg

SEQ ID NO: 1821670 - DNA, 16 bp, Homo sapiens
caccgaggttcccagg

SEQ ID NO: 1821671 - DNA, 15 bp, Homo sapiens
caccgcatgccccct

SEQ ID NO: 1821672 - DNA, 13 bp, Homo sapiens
caccgccatggct

SEQ ID NO: 1821673 - DNA, 16 bp, Homo sapiens
caccgccatggcttcc

SEQ ID NO: 1821674 - DNA, 22 bp, Homo sapiens
caccgccatggcttccaaggtg

SEQ ID NO: 1821675 - DNA, 23 bp, Homo sapiens
caccgccatggcttccaaggtgg

SEQ ID NO: 1821676 - DNA, 15 bp, Homo sapiens
cacctaccatgctgc

SEQ ID NO: 1821677 - DNA, 14 bp, Homo sapiens
cacctagtggctgt

SEQ ID NO: 1821678 - DNA, 17 bp, Homo sapiens
cacctagtggctgtcca

SEQ ID NO: 1821679 - DNA, 19 bp, Homo sapiens
cacctagtggctgtccagt

SEQ ID NO: 1821680 - DNA, 17 bp, Homo sapiens
cacctatgagatggcca

SEQ ID NO: 1821681 - DNA, 22 bp, Homo sapiens
cacctatgagatggccatgctc

SEQ ID NO: 1821682 - DNA, 23 bp, Homo sapiens
cacctatgagatggccatgctca

SEQ ID NO: 1821683 - DNA, 16 bp, Homo sapiens
cacctcatgcctggcc

SEQ ID NO: 1821684 - DNA, 13 bp, Homo sapiens
cacctcctaccct

SEQ ID NO: 1821685 - DNA, 19 bp, Homo sapiens
cacctcctgagaaggcgag

SEQ ID NO: 1821686 - DNA, 21 bp, Homo sapiens
cacctctcaatattcaataaa

SEQ ID NO: 1821687 - DNA, 22 bp, Homo sapiens
cacctctcaatattcaataaag

SEQ ID NO: 1821688 - DNA, 22 bp, Homo sapiens
cacctgaaccccatgggcttgg

SEQ ID NO: 1821689 - DNA, 17 bp, Homo sapiens
cacctgacaatggcagc

SEQ ID NO: 1821690 - DNA, 20 bp, Homo sapiens
cacctgacaatggcagctag

SEQ ID NO: 1821691 - DNA, 14 bp, Homo sapiens
cacctgcaagcccc

SEQ ID NO: 1821692 - DNA, 14 bp, Homo sapiens
cacctggcctgctg

SEQ ID NO: 1821693 - DNA, 14 bp, Homo sapiens
cacctgtctgtctg

SEQ ID NO: 1821694 - DNA, 16 bp, Homo sapiens
cacctgtctgtctgtc

SEQ ID NO: 1821695 - DNA, 14 bp, Homo sapiens
cacgagtcacctgc

SEQ ID NO: 1821696 - DNA, 20 bp, Homo sapiens
cacgagtcacctgcaagccc

SEQ ID NO: 1821697 - DNA, 18 bp, Homo sapiens
cacgcaagggcatcaggc

SEQ ID NO: 1821698 - DNA, 17 bp, Homo sapiens
cacgctcccccgcagtc

SEQ ID NO: 1821699 - DNA, 19 bp, Homo sapiens
cacgctcccccgcagtccc

SEQ ID NO: 1821700 - DNA, 16 bp, Homo sapiens
cacggtgcgtggctgt

SEQ ID NO: 1821701 - DNA, 20 bp, Homo sapiens
cacggtgcgtggctgtggca

SEQ ID NO: 1821702 - DNA, 23 bp, Homo sapiens
cacggtgcgtggctgtggcacag

SEQ ID NO: 1821703 - DNA, 14 bp, Homo sapiens
cacgtcctgtcagt

SEQ ID NO: 1821704 - DNA, 19 bp, Homo sapiens
cacgtcctgtcagtgccgc

SEQ ID NO: 1821705 - DNA, 23 bp, Homo sapiens
cacgtcctgtcagtgccgccgcc

SEQ ID NO: 1821706 - DNA, 14 bp, Homo sapiens
cacgtctgccaggc

SEQ ID NO: 1821707 - DNA, 14 bp, Homo sapiens
cactaaatgatatt

SEQ ID NO: 1821708 - DNA, 16 bp, Homo sapiens
cactaagccatgccat

SEQ ID NO: 1821709 - DNA, 23 bp, Homo sapiens
cactactgtatttcattatctgt

SEQ ID NO: 1821710 - DNA, 22 bp, Homo sapiens
cactagtcaagaaaaatataaa

SEQ ID NO: 1821711 - DNA, 13 bp, Homo sapiens
cactcagcagccc

SEQ ID NO: 1821712 - DNA, 14 bp, Homo sapiens
cactcagcagcccc

SEQ ID NO: 1821713 - DNA, 15 bp, Homo sapiens
cactcccacttccct

SEQ ID NO: 1821714 - DNA, 12 bp, Homo sapiens
cactccctgagc

SEQ ID NO: 1821715 - DNA, 12 bp, Homo sapiens
cactcctgtccc

SEQ ID NO: 1821716 - DNA, 16 bp, Homo sapiens
cactcctgtcccgcct

SEQ ID NO: 1821717 - DNA, 18 bp, Homo sapiens
cactcctgtcccgccttc

SEQ ID NO: 1821718 - DNA, 15 bp, Homo sapiens
cactctcggggccct

SEQ ID NO: 1821719 - DNA, 17 bp, Homo sapiens
cactctcggggcccttg

SEQ ID NO: 1821720 - DNA, 16 bp, Homo sapiens
cactctgtgcccatgg

SEQ ID NO: 1821721 - DNA, 12 bp, Homo sapiens
cactgaaaacat

SEQ ID NO: 1821722 - DNA, 19 bp, Homo sapiens
cactgattaaaataggatt

SEQ ID NO: 1821723 - DNA, 12 bp, Homo sapiens
cactgccaggca

SEQ ID NO: 1821724 - DNA, 13 bp, Homo sapiens
cactgccaggcac

SEQ ID NO: 1821725 - DNA, 15 bp, Homo sapiens
cactgccaggcacct

SEQ ID NO: 1821726 - DNA, 16 bp, Homo sapiens
cactgccaggcacctg

SEQ ID NO: 1821727 - DNA, 17 bp, Homo sapiens
cactgccaggcacctgg

SEQ ID NO: 1821728 - DNA, 17 bp, Homo sapiens
cactgccctgcctgccc

SEQ ID NO: 1821729 - DNA, 20 bp, Homo sapiens
cactgccctgcctgcccact

SEQ ID NO: 1821730 - DNA, 13 bp, Homo sapiens
cactgctgaaaaa

SEQ ID NO: 1821731 - DNA, 16 bp, Homo sapiens
cactgctgaaaaagaa

SEQ ID NO: 1821732 - DNA, 19 bp, Homo sapiens
cactgctgaaaaagaaaaa

SEQ ID NO: 1821733 - DNA, 12 bp, Homo sapiens
cactgctgcacc

SEQ ID NO: 1821734 - DNA, 16 bp, Homo sapiens
cactgctgcaccagag

SEQ ID NO: 1821735 - DNA, 19 bp, Homo sapiens
cactgctgggtggcccatc

SEQ ID NO: 1821736 - DNA, 20 bp, Homo sapiens
cactgctgggtggcccatcc

SEQ ID NO: 1821737 - DNA, 13 bp, Homo sapiens
cactggccagaga

SEQ ID NO: 1821738 - DNA, 16 bp, Homo sapiens
cactggccagagaggg

SEQ ID NO: 1821739 - DNA, 18 bp, Homo sapiens
cactggccagagagggcc

SEQ ID NO: 1821740 - DNA, 19 bp, Homo sapiens
cactggccagagagggccc

SEQ ID NO: 1821741 - DNA, 20 bp, Homo sapiens
cactggccagagagggccca

SEQ ID NO: 1821742 - DNA, 17 bp, Homo sapiens
cactggctgcctccact

SEQ ID NO: 1821743 - DNA, 18 bp, Homo sapiens
cactggctgcctccactc

SEQ ID NO: 1821744 - DNA, 19 bp, Homo sapiens
cactggctgcctccactcc

SEQ ID NO: 1821745 - DNA, 14 bp, Homo sapiens
cactggctggggca

SEQ ID NO: 1821746 - DNA, 19 bp, Homo sapiens
cactggctggggcagaggg

SEQ ID NO: 1821747 - DNA, 18 bp, Homo sapiens
cactggtttacaaatata

SEQ ID NO: 1821748 - DNA, 17 bp, Homo sapiens
cactgtatagtaatcat

SEQ ID NO: 1821749 - DNA, 11 bp, Homo sapiens
cactgtcctgc

SEQ ID NO: 1821750 - DNA, 12 bp, Homo sapiens
cactgtcctgct

SEQ ID NO: 1821751 - DNA, 21 bp, Homo sapiens
cactgtcctgctccacagtgt

SEQ ID NO: 1821752 - DNA, 16 bp, Homo sapiens
cactgtgctattacaa

SEQ ID NO: 1821753 - DNA, 12 bp, Homo sapiens
cactgtggccag

SEQ ID NO: 1821754 - DNA, 22 bp, Homo sapiens
cacttagccgtccatggcacca

SEQ ID NO: 1821755 - DNA, 21 bp, Homo sapiens
cacttcccctcctacccctcc

SEQ ID NO: 1821756 - DNA, 15 bp, Homo sapiens
cacttccctgacact

SEQ ID NO: 1821757 - DNA, 19 bp, Homo sapiens
cacttctttgcagagcctt

SEQ ID NO: 1821758 - DNA, 14 bp, Homo sapiens
cacttggagcccgt

SEQ ID NO: 1821759 - DNA, 15 bp, Homo sapiens
cacttggagcccgtg

SEQ ID NO: 1821760 - DNA, 21 bp, Homo sapiens
cactttgccaaggctctcccc

SEQ ID NO: 1821761 - DNA, 13 bp, Homo sapiens
cacttttaaaact

SEQ ID NO: 1821762 - DNA, 14 bp, Homo sapiens
cacttttgtgaaag

SEQ ID NO: 1821763 - DNA, 14 bp, Homo sapiens
cactttttccagaa

SEQ ID NO: 1821764 - DNA, 22 bp, Homo sapiens
cacttttttttttttttttgtt

SEQ ID NO: 1821765 - DNA, 16 bp, Homo sapiens
cagaaaagaaagctgc

SEQ ID NO: 1821766 - DNA, 14 bp, Homo sapiens
cagaaacagggaca

SEQ ID NO: 1821767 - DNA, 19 bp, Homo sapiens
cagaaacagggacaaagaa

SEQ ID NO: 1821768 - DNA, 13 bp, Homo sapiens
cagaaagcctcct

SEQ ID NO: 1821769 - DNA, 16 bp, Homo sapiens
cagaaagtttgaagca

SEQ ID NO: 1821770 - DNA, 17 bp, Homo sapiens
cagaaattctcaaaata

SEQ ID NO: 1821771 - DNA, 11 bp, Homo sapiens
cagaacagagg

SEQ ID NO: 1821772 - DNA, 17 bp, Homo sapiens
cagaacgcaccccactg

SEQ ID NO: 1821773 - DNA, 22 bp, Homo sapiens
cagaacgcaccccactgggaga

SEQ ID NO: 1821774 - DNA, 12 bp, Homo sapiens
cagaagaaaata

SEQ ID NO: 1821775 - DNA, 15 bp, Homo sapiens
cagaagaaaataata

SEQ ID NO: 1821776 - DNA, 15 bp, Homo sapiens
cagaaggagggcaga

SEQ ID NO: 1821777 - DNA, 19 bp, Homo sapiens
cagaaggagggcagagcca

SEQ ID NO: 1821778 - DNA, 22 bp, Homo sapiens
cagaaggagggcagagccatgg

SEQ ID NO: 1821779 - DNA, 17 bp, Homo sapiens
cagaataaatccttggg

SEQ ID NO: 1821780 - DNA, 16 bp, Homo sapiens
cagaatctgctgttgc

SEQ ID NO: 1821781 - DNA, 18 bp, Homo sapiens
cagaatctgctgttgcca

SEQ ID NO: 1821782 - DNA, 20 bp, Homo sapiens
cagaatctgctgttgccata

SEQ ID NO: 1821783 - DNA, 22 bp, Homo sapiens
cagaatctgctgttgccatagc

SEQ ID NO: 1821784 - DNA, 23 bp, Homo sapiens
cagaatctgctgttgccatagcc

SEQ ID NO: 1821785 - DNA, 18 bp, Homo sapiens
cagaatttgaatattaac

SEQ ID NO: 1821786 - DNA, 23 bp, Homo sapiens
cagacaccgtttgtcccccgggg

SEQ ID NO: 1821787 - DNA, 15 bp, Homo sapiens
cagacaggccctccc

SEQ ID NO: 1821788 - DNA, 23 bp, Homo sapiens
cagactctttttgtacctggtga

SEQ ID NO: 1821789 - DNA, 18 bp, Homo sapiens
cagactgaaccagagctg

SEQ ID NO: 1821790 - DNA, 16 bp, Homo sapiens
cagagaaggcagcagg

SEQ ID NO: 1821791 - DNA, 13 bp, Homo sapiens
cagagaaggcctc

SEQ ID NO: 1821792 - DNA, 14 bp, Homo sapiens
cagagaaggcctct

SEQ ID NO: 1821793 - DNA, 12 bp, Homo sapiens
cagagaggagca

SEQ ID NO: 1821794 - DNA, 15 bp, Homo sapiens
cagagaggagcacct

SEQ ID NO: 1821795 - DNA, 17 bp, Homo sapiens
cagagaggagcacctga

SEQ ID NO: 1821796 - DNA, 20 bp, Homo sapiens
cagagaggagcacctgaacc

SEQ ID NO: 1821797 - DNA, 21 bp, Homo sapiens
cagagaggagcacctgaaccc

SEQ ID NO: 1821798 - DNA, 14 bp, Homo sapiens
cagagagggcccag

SEQ ID NO: 1821799 - DNA, 16 bp, Homo sapiens
cagagagggcccagct

SEQ ID NO: 1821800 - DNA, 17 bp, Homo sapiens
cagagagggcccagctg

SEQ ID NO: 1821801 - DNA, 15 bp, Homo sapiens
cagagccagcctggg

SEQ ID NO: 1821802 - DNA, 16 bp, Homo sapiens
cagagccagcctggga

SEQ ID NO: 1821803 - DNA, 15 bp, Homo sapiens
cagagccatgggcct

SEQ ID NO: 1821804 - DNA, 18 bp, Homo sapiens
cagagccatgggcctggg

SEQ ID NO: 1821805 - DNA, 14 bp, Homo sapiens
cagagcctgaattt

SEQ ID NO: 1821806 - DNA, 21 bp, Homo sapiens
cagagctcttcaagctgtccc

SEQ ID NO: 1821807 - DNA, 22 bp, Homo sapiens
cagagctcttcaagctgtcccc

SEQ ID NO: 1821808 - DNA, 15 bp, Homo sapiens
cagagctggaacaca

SEQ ID NO: 1821809 - DNA, 13 bp, Homo sapiens
cagaggaccacag

SEQ ID NO: 1821810 - DNA, 20 bp, Homo sapiens
cagagggaatgttccctgca

SEQ ID NO: 1821811 - DNA, 13 bp, Homo sapiens
cagaggggcagcc

SEQ ID NO: 1821812 - DNA, 16 bp, Homo sapiens
cagaggggcagccgct

SEQ ID NO: 1821813 - DNA, 16 bp, Homo sapiens
cagaggggcaggccct

SEQ ID NO: 1821814 - DNA, 20 bp, Homo sapiens
cagaggggcaggccctgcac

SEQ ID NO: 1821815 - DNA, 19 bp, Homo sapiens
cagaggttatctgcctggc

SEQ ID NO: 1821816 - DNA, 23 bp, Homo sapiens
cagagtgaaagggctatggcaag

SEQ ID NO: 1821817 - DNA, 16 bp, Homo sapiens
cagagtgtagaataat

SEQ ID NO: 1821818 - DNA, 20 bp, Homo sapiens
cagatctgcctgggcctgtg

SEQ ID NO: 1821819 - DNA, 23 bp, Homo sapiens
cagatctgcctgggcctgtgcag

SEQ ID NO: 1821820 - DNA, 13 bp, Homo sapiens
cagatctttttgt

SEQ ID NO: 1821821 - DNA, 15 bp, Homo sapiens
cagattcctgggcct

SEQ ID NO: 1821822 - DNA, 20 bp, Homo sapiens
cagattcctgggcctgtccc

SEQ ID NO: 1821823 - DNA, 21 bp, Homo sapiens
cagattcctgggcctgtcccc

SEQ ID NO: 1821824 - DNA, 14 bp, Homo sapiens
cagatttcaaatta

SEQ ID NO: 1821825 - DNA, 17 bp, Homo sapiens
cagcaaggggctctgcc

SEQ ID NO: 1821826 - DNA, 14 bp, Homo sapiens
cagcacaggggccc

SEQ ID NO: 1821827 - DNA, 21 bp, Homo sapiens
cagcacaggggccccagatct

SEQ ID NO: 1821828 - DNA, 12 bp, Homo sapiens
cagcaccctggg

SEQ ID NO: 1821829 - DNA, 14 bp, Homo sapiens
cagcaccctgggtg

SEQ ID NO: 1821830 - DNA, 13 bp, Homo sapiens
cagcagagagccc

SEQ ID NO: 1821831 - DNA, 14 bp, Homo sapiens
cagcagcagagagc

SEQ ID NO: 1821832 - DNA, 12 bp, Homo sapiens
cagcagcccagc

SEQ ID NO: 1821833 - DNA, 13 bp, Homo sapiens
cagcagcccagct

SEQ ID NO: 1821834 - DNA, 16 bp, Homo sapiens
cagcagcccagcttcc

SEQ ID NO: 1821835 - DNA, 17 bp, Homo sapiens
cagcagccccctgcccg

SEQ ID NO: 1821836 - DNA, 23 bp, Homo sapiens
cagcagctgcgggtctgaaggaa

SEQ ID NO: 1821837 - DNA, 14 bp, Homo sapiens
cagcaggtgctgct

SEQ ID NO: 1821838 - DNA, 16 bp, Homo sapiens
cagcaggtgtggtggc

SEQ ID NO: 1821839 - DNA, 19 bp, Homo sapiens
cagcaggtgtggtggctca

SEQ ID NO: 1821840 - DNA, 22 bp, Homo sapiens
cagcaggtgtggtggctcatgg

SEQ ID NO: 1821841 - DNA, 14 bp, Homo sapiens
cagcatccagcctg

SEQ ID NO: 1821842 - DNA, 18 bp, Homo sapiens
cagcatccagcctgtgtg

SEQ ID NO: 1821843 - DNA, 13 bp, Homo sapiens
cagccagccagtc

SEQ ID NO: 1821844 - DNA, 17 bp, Homo sapiens
cagccagccagtcttgc

SEQ ID NO: 1821845 - DNA, 22 bp, Homo sapiens
cagccagcccttccctggcccc

SEQ ID NO: 1821846 - DNA, 15 bp, Homo sapiens
cagccagtcttgcct

SEQ ID NO: 1821847 - DNA, 20 bp, Homo sapiens
cagccagtcttgcctaggcc

SEQ ID NO: 1821848 - DNA, 14 bp, Homo sapiens
cagccatgcctcat

SEQ ID NO: 1821849 - DNA, 16 bp, Homo sapiens
cagccatgcctcatgc

SEQ ID NO: 1821850 - DNA, 17 bp, Homo sapiens
cagccatgcctcatgcc

SEQ ID NO: 1821851 - DNA, 18 bp, Homo sapiens
cagccatgcctcatgcca

SEQ ID NO: 1821852 - DNA, 19 bp, Homo sapiens
cagccatgcctcatgccac

SEQ ID NO: 1821853 - DNA, 12 bp, Homo sapiens
cagcccacagag

SEQ ID NO: 1821854 - DNA, 16 bp, Homo sapiens
cagcccacagagcctg

SEQ ID NO: 1821855 - DNA, 17 bp, Homo sapiens
cagccccaactccaggg

SEQ ID NO: 1821856 - DNA, 13 bp, Homo sapiens
cagccccacagcc

SEQ ID NO: 1821857 - DNA, 16 bp, Homo sapiens
cagccccacagcccac

SEQ ID NO: 1821858 - DNA, 20 bp, Homo sapiens
cagccccacagcccacgtcc

SEQ ID NO: 1821859 - DNA, 19 bp, Homo sapiens
cagcccgtgaagcagtgcc

SEQ ID NO: 1821860 - DNA, 21 bp, Homo sapiens
cagcccgtgaagcagtgcctc

SEQ ID NO: 1821861 - DNA, 12 bp, Homo sapiens
cagccgctgccc

SEQ ID NO: 1821862 - DNA, 13 bp, Homo sapiens
cagcctccagagc

SEQ ID NO: 1821863 - DNA, 14 bp, Homo sapiens
cagcctccagagcc

SEQ ID NO: 1821864 - DNA, 19 bp, Homo sapiens
cagcctccagagccagcct

SEQ ID NO: 1821865 - DNA, 16 bp, Homo sapiens
cagcctctcccggctg

SEQ ID NO: 1821866 - DNA, 20 bp, Homo sapiens
cagcctctcccggctgcctg

SEQ ID NO: 1821867 - DNA, 23 bp, Homo sapiens
cagcctctcccggctgcctgccg

SEQ ID NO: 1821868 - DNA, 16 bp, Homo sapiens
cagcctgatggccaag

SEQ ID NO: 1821869 - DNA, 12 bp, Homo sapiens
cagcctggccca

SEQ ID NO: 1821870 - DNA, 15 bp, Homo sapiens
cagcctggcccagct

SEQ ID NO: 1821871 - DNA, 16 bp, Homo sapiens
cagcctggcccagctc

SEQ ID NO: 1821872 - DNA, 16 bp, Homo sapiens
cagcctgggactccca

SEQ ID NO: 1821873 - DNA, 20 bp, Homo sapiens
cagcctgggactcccagtga

SEQ ID NO: 1821874 - DNA, 11 bp, Homo sapiens
cagccttcccc

SEQ ID NO: 1821875 - DNA, 19 bp, Homo sapiens
cagccttcccctccctgta

SEQ ID NO: 1821876 - DNA, 22 bp, Homo sapiens
cagcgattattgatcaaaatca

SEQ ID NO: 1821877 - DNA, 21 bp, Homo sapiens
cagcgtttagtttctagaggc

SEQ ID NO: 1821878 - DNA, 22 bp, Homo sapiens
cagcgtttagtttctagaggcc

SEQ ID NO: 1821879 - DNA, 17 bp, Homo sapiens
cagctaagcctgatgat

SEQ ID NO: 1821880 - DNA, 18 bp, Homo sapiens
cagctaagcctgatgatg

SEQ ID NO: 1821881 - DNA, 19 bp, Homo sapiens
cagctaagcctgatgatgg

SEQ ID NO: 1821882 - DNA, 18 bp, Homo sapiens
cagctactctgtccaggc

SEQ ID NO: 1821883 - DNA, 21 bp, Homo sapiens
cagctactctgtccaggccac

SEQ ID NO: 1821884 - DNA, 17 bp, Homo sapiens
ctgtgcctgctagagca

SEQ ID NO: 1821885 - DNA, 11 bp, Homo sapiens
ctgtgcctttg

SEQ ID NO: 1821886 - DNA, 22 bp, Homo sapiens
ctgtgctcttttggtggggagc

SEQ ID NO: 1821887 - DNA, 15 bp, Homo sapiens
ctgtgctgtgcctgc

SEQ ID NO: 1821888 - DNA, 16 bp, Homo sapiens
ctgtgctgtgcctgct

SEQ ID NO: 1821889 - DNA, 12 bp, Homo sapiens
ctgtggaggcct

SEQ ID NO: 1821890 - DNA, 14 bp, Homo sapiens
ctgtggaggcctga

SEQ ID NO: 1821891 - DNA, 15 bp, Homo sapiens
ctgtggcacagactt

SEQ ID NO: 1821892 - DNA, 21 bp, Homo sapiens
ctgtggcagaaaagaggagac

SEQ ID NO: 1821893 - DNA, 12 bp, Homo sapiens
ctgtggccagag

SEQ ID NO: 1821894 - DNA, 14 bp, Homo sapiens
ctgtggccagagct

SEQ ID NO: 1821895 - DNA, 18 bp, Homo sapiens
ctgtggccagagctggaa

SEQ ID NO: 1821896 - DNA, 16 bp, Homo sapiens
ctgtggcctgtgtcca

SEQ ID NO: 1821897 - DNA, 19 bp, Homo sapiens
ctgtggcctgtgtccagca

SEQ ID NO: 1821898 - DNA, 21 bp, Homo sapiens
ctgtggcctgtgtccagcagc

SEQ ID NO: 1821899 - DNA, 15 bp, Homo sapiens
ctgtgggctgcactc

SEQ ID NO: 1821900 - DNA, 13 bp, Homo sapiens
ctgtgtattctca

SEQ ID NO: 1821901 - DNA, 16 bp, Homo sapiens
ctgtgtcactggctgc

SEQ ID NO: 1821902 - DNA, 18 bp, Homo sapiens
ctgtgtcactggctgcct

SEQ ID NO: 1821903 - DNA, 22 bp, Homo sapiens
ctgtgtcactggctgcctccac

SEQ ID NO: 1821904 - DNA, 17 bp, Homo sapiens
ctgtgtccagcagctgc

SEQ ID NO: 1821905 - DNA, 22 bp, Homo sapiens
ctgtgtggtgtcgcgccttctc

SEQ ID NO: 1821906 - DNA, 18 bp, Homo sapiens
ctgtgtgtttatgtgtgt

SEQ ID NO: 1821907 - DNA, 22 bp, Homo sapiens
ctgtgttactaatgatcactct

SEQ ID NO: 1821908 - DNA, 21 bp, Homo sapiens
ctgttattttttatttccaca

SEQ ID NO: 1821909 - DNA, 21 bp, Homo sapiens
ctgttcatacggggtggctga

SEQ ID NO: 1821910 - DNA, 23 bp, Homo sapiens
ctgttgttgaggtggtggtagtg

SEQ ID NO: 1821911 - DNA, 23 bp, Homo sapiens
ctgtttaaaaaaagtatatattc

SEQ ID NO: 1821912 - DNA, 22 bp, Homo sapiens
ctgtttcgtgtagtggaagagc

SEQ ID NO: 1821913 - DNA, 17 bp, Homo sapiens
cttaagggttgaaggca

SEQ ID NO: 1821914 - DNA, 23 bp, Homo sapiens
cttaagggttgaaggcagtctga

SEQ ID NO: 1821915 - DNA, 16 bp, Homo sapiens
cttaccgtagcctccg

SEQ ID NO: 1821916 - DNA, 14 bp, Homo sapiens
cttactctgagccc

SEQ ID NO: 1821917 - DNA, 19 bp, Homo sapiens
cttactctgagcccaggcc

SEQ ID NO: 1821918 - DNA, 21 bp, Homo sapiens
cttactctgagcccaggccgt

SEQ ID NO: 1821919 - DNA, 17 bp, Homo sapiens
cttactctttcactcag

SEQ ID NO: 1821920 - DNA, 19 bp, Homo sapiens
cttacttcggttcctctga

SEQ ID NO: 1821921 - DNA, 18 bp, Homo sapiens
cttagaatgtttctattt

SEQ ID NO: 1821922 - DNA, 22 bp, Homo sapiens
cttagaatgtttctatttccat

SEQ ID NO: 1821923 - DNA, 17 bp, Homo sapiens
cttagccgtccatggca

SEQ ID NO: 1821924 - DNA, 20 bp, Homo sapiens
cttagccgtccatggcacca

SEQ ID NO: 1821925 - DNA, 22 bp, Homo sapiens
cttagccgtccatggcaccagc

SEQ ID NO: 1821926 - DNA, 19 bp, Homo sapiens
cttagtgcccgcctaggag

SEQ ID NO: 1821927 - DNA, 14 bp, Homo sapiens
cttataggtttcca

SEQ ID NO: 1821928 - DNA, 19 bp, Homo sapiens
cttatgagactcttaaata

SEQ ID NO: 1821929 - DNA, 18 bp, Homo sapiens
cttatgggatccttgtct

SEQ ID NO: 1821930 - DNA, 16 bp, Homo sapiens
cttattaacaactgtg

SEQ ID NO: 1821931 - DNA, 20 bp, Homo sapiens
cttattcatgctttctcctt

SEQ ID NO: 1821932 - DNA, 23 bp, Homo sapiens
cttattcatgctttctccttttt

SEQ ID NO: 1821933 - DNA, 19 bp, Homo sapiens
cttcaacagggaaaacagc

SEQ ID NO: 1821934 - DNA, 18 bp, Homo sapiens
ctttgctgcccctgtctg

SEQ ID NO: 1821935 - DNA, 22 bp, Homo sapiens
ctttgctgcccctgtctggaag

SEQ ID NO: 1821936 - DNA, 15 bp, Homo sapiens
ctttggcccaatgcc

SEQ ID NO: 1821937 - DNA, 19 bp, Homo sapiens
ctttgggaggccaaggcag

SEQ ID NO: 1821938 - DNA, 12 bp, Homo sapiens
ctttgggctttg

SEQ ID NO: 1821939 - DNA, 20 bp, Homo sapiens
ctttggggacagttggcaga

SEQ ID NO: 1821940 - DNA, 18 bp, Homo sapiens
ctttgtgactattaaatg

SEQ ID NO: 1821941 - DNA, 13 bp, Homo sapiens
cttttaaaatagt

SEQ ID NO: 1821942 - DNA, 14 bp, Homo sapiens
cttttataaacctc

SEQ ID NO: 1821943 - DNA, 14 bp, Homo sapiens
cttttcagcttctg

SEQ ID NO: 1821944 - DNA, 16 bp, Homo sapiens
cttttcagcttctgct

SEQ ID NO: 1821945 - DNA, 19 bp, Homo sapiens
cttttccaggatcctgcag

SEQ ID NO: 1821946 - DNA, 14 bp, Homo sapiens
cttttgagaggggt

SEQ ID NO: 1821947 - DNA, 16 bp, Homo sapiens
cttttggcatgaaagt

SEQ ID NO: 1821948 - DNA, 19 bp, Homo sapiens
cttttggcatgaaagtgcg

SEQ ID NO: 1821949 - DNA, 17 bp, Homo sapiens
cttttgtccccagggcc

SEQ ID NO: 1821950 - DNA, 18 bp, Homo sapiens
cttttgtccccagggccc

SEQ ID NO: 1821951 - DNA, 14 bp, Homo sapiens
cttttgtgaaagct

SEQ ID NO: 1821952 - DNA, 20 bp, Homo sapiens
cttttgttttcttcatttct

SEQ ID NO: 1821953 - DNA, 13 bp, Homo sapiens
ctttttccagaat

SEQ ID NO: 1821954 - DNA, 16 bp, Homo sapiens
ctttttgtacctggtg

SEQ ID NO: 1821955 - DNA, 21 bp, Homo sapiens
gaaaaaaatgattgttttaga

SEQ ID NO: 1821956 - DNA, 15 bp, Homo sapiens
gaaaaaacaaaatca

SEQ ID NO: 1821957 - DNA, 14 bp, Homo sapiens
gaaaaatatgagag

SEQ ID NO: 1821958 - DNA, 18 bp, Homo sapiens
gaaaacatttcaaagctg

SEQ ID NO: 1821959 - DNA, 19 bp, Homo sapiens
gaaaacttagaaataagaa

SEQ ID NO: 1821960 - DNA, 23 bp, Homo sapiens
gaaaacttattaacaactgtgaa

SEQ ID NO: 1821961 - DNA, 16 bp, Homo sapiens
gaaaagaccctgagac

SEQ ID NO: 1821962 - DNA, 22 bp, Homo sapiens
gaaaagaccctgagactccaga

SEQ ID NO: 1821963 - DNA, 19 bp, Homo sapiens
gaaaagcaattgccctgta

SEQ ID NO: 1821964 - DNA, 15 bp, Homo sapiens
gaaaagcctctgtgt

SEQ ID NO: 1821965 - DNA, 18 bp, Homo sapiens
gaaaagttgctcttaaaa

SEQ ID NO: 1821966 - DNA, 21 bp, Homo sapiens
gaaacccagatcgctgtgtta

SEQ ID NO: 1821967 - DNA, 20 bp, Homo sapiens
gaaacctgtccataaagtaa

SEQ ID NO: 1821968 - DNA, 19 bp, Homo sapiens
gaaagaaaagaccctgaga

SEQ ID NO: 1821969 - DNA, 16 bp, Homo sapiens
gaaagcctcctgcccc

SEQ ID NO: 1821970 - DNA, 23 bp, Homo sapiens
gaaagcctcctgccccctgccag

SEQ ID NO: 1821971 - DNA, 15 bp, Homo sapiens
gaaagcgggcagccc

SEQ ID NO: 1821972 - DNA, 17 bp, Homo sapiens
gaaagcgggcagccccg

SEQ ID NO: 1821973 - DNA, 22 bp, Homo sapiens
gaaagctgctttcgaataaagt

SEQ ID NO: 1821974 - DNA, 15 bp, Homo sapiens
gaaatacagaagaaa

SEQ ID NO: 1821975 - DNA, 17 bp, Homo sapiens
gaaatacagaagaaaat

SEQ ID NO: 1821976 - DNA, 18 bp, Homo sapiens
gaaatacagaagaaaata

SEQ ID NO: 1821977 - DNA, 19 bp, Homo sapiens
gaaatacagaagaaaataa

SEQ ID NO: 1821978 - DNA, 16 bp, Homo sapiens
gaaatagagtgaatta

SEQ ID NO: 1821979 - DNA, 24 bp, Homo sapiens
gaaatattgctctaattcttttca

SEQ ID NO: 1821980 - DNA, 15 bp, Homo sapiens
gaaatcacaggggcg

SEQ ID NO: 1821981 - DNA, 19 bp, Homo sapiens
gaaatcacaggggcggggc

SEQ ID NO: 1821982 - DNA, 22 bp, Homo sapiens
gaaatcacaggggcggggcagg

SEQ ID NO: 1821983 - DNA, 21 bp, Homo sapiens
gaaatgctattgttgtgggct

SEQ ID NO: 1821984 - DNA, 13 bp, Homo sapiens
gaaatgcttagtt

SEQ ID NO: 1821985 - DNA, 18 bp, Homo sapiens
gaaatgggagatggtcag

SEQ ID NO: 1821986 - DNA, 15 bp, Homo sapiens
gaaattctcaaaata

SEQ ID NO: 1821987 - DNA, 16 bp, Homo sapiens
gaaatttactgtgaga

SEQ ID NO: 1821988 - DNA, 19 bp, Homo sapiens
gaaattttactgacagaaa

SEQ ID NO: 1821989 - DNA, 14 bp, Homo sapiens
gaacaagtcacagc

SEQ ID NO: 1821990 - DNA, 16 bp, Homo sapiens
gaacaagtcacagctg

SEQ ID NO: 1821991 - DNA, 15 bp, Homo sapiens
gaacaatgtcagaaa

SEQ ID NO: 1821992 - DNA, 17 bp, Homo sapiens
gaacatggattccactg

SEQ ID NO: 1821993 - DNA, 13 bp, Homo sapiens
gaaccaaggcagc

SEQ ID NO: 1821994 - DNA, 15 bp, Homo sapiens
gaaccaaggcagcct

SEQ ID NO: 1821995 - DNA, 15 bp, Homo sapiens
gaaccccatgggctt

SEQ ID NO: 1821996 - DNA, 16 bp, Homo sapiens
gaaccccgcagcccgt

SEQ ID NO: 1821997 - DNA, 17 bp, Homo sapiens
gaacgagcactggccag

SEQ ID NO: 1821998 - DNA, 15 bp, Homo sapiens
gaacgcaccccactg

SEQ ID NO: 1821999 - DNA, 19 bp, Homo sapiens
gaacgttttaataattttt

SEQ ID NO: 1822000 - DNA, 12 bp, Homo sapiens
gaactccactct

SEQ ID NO: 1822001 - DNA, 17 bp, Homo sapiens
gaactgaccccctcccc

SEQ ID NO: 1822002 - DNA, 18 bp, Homo sapiens
gaacttacacttggagcc

SEQ ID NO: 1822003 - DNA, 13 bp, Homo sapiens
gaacttgaggaca

SEQ ID NO: 1822004 - DNA, 15 bp, Homo sapiens
gaacttgaggacaca

SEQ ID NO: 1822005 - DNA, 23 bp, Homo sapiens
gaattcctttacaactaaataac

SEQ ID NO: 1822006 - DNA, 20 bp, Homo sapiens
gaattgaaggagaaaatgca

SEQ ID NO: 1822007 - DNA, 17 bp, Homo sapiens
gaattttaagttctatc

SEQ ID NO: 1822008 - DNA, 14 bp, Homo sapiens
gaatttttattatt

SEQ ID NO: 1822009 - DNA, 11 bp, Homo sapiens
gacaaaaatgt

SEQ ID NO: 1822010 - DNA, 23 bp, Homo sapiens
gacaaaagtttcacaacagattt

SEQ ID NO: 1822011 - DNA, 12 bp, Homo sapiens
gacaacattttt

SEQ ID NO: 1822012 - DNA, 19 bp, Homo sapiens
gacaacatttttgtacatt

SEQ ID NO: 1822013 - DNA, 13 bp, Homo sapiens
gacaagccctggc

SEQ ID NO: 1822014 - DNA, 21 bp, Homo sapiens
gacaatggcagctagactgga

SEQ ID NO: 1822015 - DNA, 14 bp, Homo sapiens
gacaatgttgcatt

SEQ ID NO: 1822016 - DNA, 19 bp, Homo sapiens
gacacagctgagctggcct

SEQ ID NO: 1822017 - DNA, 13 bp, Homo sapiens
gacacatcccggc

SEQ ID NO: 1822018 - DNA, 21 bp, Homo sapiens
gacacatcccggcctcttcca

SEQ ID NO: 1822019 - DNA, 13 bp, Homo sapiens
gacacctaccatg

SEQ ID NO: 1822020 - DNA, 16 bp, Homo sapiens
gacacctaccatgctg

SEQ ID NO: 1822021 - DNA, 18 bp, Homo sapiens
gacacctaccatgctgct

SEQ ID NO: 1822022 - DNA, 9 bp, Homo sapiens
gacacctgc

SEQ ID NO: 1822023 - DNA, 16 bp, Homo sapiens
gacacctgccctgccc

SEQ ID NO: 1822024 - DNA, 16 bp, Homo sapiens
gacactgcggggcttg

SEQ ID NO: 1822025 - DNA, 22 bp, Homo sapiens
gacactgcggggcttggctgag

SEQ ID NO: 1822026 - DNA, 14 bp, Homo sapiens
gacactgctgcacc

SEQ ID NO: 1822027 - DNA, 16 bp, Homo sapiens
gacactgctgcaccag

SEQ ID NO: 1822028 - DNA, 21 bp, Homo sapiens
gacactgctgcaccagagtga

SEQ ID NO: 1822029 - DNA, 17 bp, Homo sapiens
gacagaaaagaaagctg

SEQ ID NO: 1822030 - DNA, 21 bp, Homo sapiens
gacagaaaagaaagctgcttt

SEQ ID NO: 1822031 - DNA, 23 bp, Homo sapiens
gacaggcagccacgtctcaacat

SEQ ID NO: 1822032 - DNA, 18 bp, Homo sapiens
gacaggcagggagggctt

SEQ ID NO: 1822033 - DNA, 18 bp, Homo sapiens
gacagttggcagagaagg

SEQ ID NO: 1822034 - DNA, 24 bp, Homo sapiens
gacagttggcagagaaggcctctt

SEQ ID NO: 1822035 - DNA, 16 bp, Homo sapiens
gacatatatattaaaa

SEQ ID NO: 1822036 - DNA, 14 bp, Homo sapiens
gaccaaattgcttc

SEQ ID NO: 1822037 - DNA, 18 bp, Homo sapiens
gaccaaattgcttctagg

SEQ ID NO: 1822038 - DNA, 20 bp, Homo sapiens
gaccacagcaaggcacctgc

SEQ ID NO: 1822039 - DNA, 21 bp, Homo sapiens
gaccacagcaaggcacctgca

SEQ ID NO: 1822040 - DNA, 19 bp, Homo sapiens
gaccacagtgggtggcacc

SEQ ID NO: 1822041 - DNA, 21 bp, Homo sapiens
gaccacagtgggtggcacctc

SEQ ID NO: 1822042 - DNA, 16 bp, Homo sapiens
gaccacctctcaatat

SEQ ID NO: 1822043 - DNA, 19 bp, Homo sapiens
gacccaaaaatgttccctt

SEQ ID NO: 1822044 - DNA, 22 bp, Homo sapiens
gacccacccatcttcctgctgc

SEQ ID NO: 1822045 - DNA, 23 bp, Homo sapiens
gacccacccatcttcctgctgct

SEQ ID NO: 1822046 - DNA, 20 bp, Homo sapiens
gacccagctactctgtccag

SEQ ID NO: 1822047 - DNA, 12 bp, Homo sapiens
gacccaggccct

SEQ ID NO: 1822048 - DNA, 15 bp, Homo sapiens
gaccccatctgccca

SEQ ID NO: 1822049 - DNA, 17 bp, Homo sapiens
gaccccatctgcccagg

SEQ ID NO: 1822050 - DNA, 18 bp, Homo sapiens
gaccccatctgcccagga

SEQ ID NO: 1822051 - DNA, 13 bp, Homo sapiens
gaccctgagactc

SEQ ID NO: 1822052 - DNA, 17 bp, Homo sapiens
gaccctgagactccaga

SEQ ID NO: 1822053 - DNA, 21 bp, Homo sapiens
gaccctggaattcagcaccct

SEQ ID NO: 1822054 - DNA, 14 bp, Homo sapiens
gacccttcagggcc

SEQ ID NO: 1822055 - DNA, 16 bp, Homo sapiens
gacccttcagggccag

SEQ ID NO: 1822056 - DNA, 14 bp, Homo sapiens
gaccgggtgggcct

SEQ ID NO: 1822057 - DNA, 15 bp, Homo sapiens
gaccgggtgggcctg

SEQ ID NO: 1822058 - DNA, 21 bp, Homo sapiens
gaccgggtgggcctggcctga

SEQ ID NO: 1822059 - DNA, 15 bp, Homo sapiens
gacctcttctgaagc

SEQ ID NO: 1822060 - DNA, 16 bp, Homo sapiens
gacctgagtcggcccc

SEQ ID NO: 1822061 - DNA, 19 bp, Homo sapiens
gacgtgagtgtgacttttt

SEQ ID NO: 1822062 - DNA, 21 bp, Homo sapiens
gactcagtgtctgcctttaaa

SEQ ID NO: 1822063 - DNA, 18 bp, Homo sapiens
gactccagaatctgctgt

SEQ ID NO: 1822064 - DNA, 22 bp, Homo sapiens
gactccagaatctgctgttgcc

SEQ ID NO: 1822065 - DNA, 23 bp, Homo sapiens
gactccagaatctgctgttgcca

SEQ ID NO: 1822066 - DNA, 19 bp, Homo sapiens
gactccagagtctgagccc

SEQ ID NO: 1822067 - DNA, 16 bp, Homo sapiens
gactcgggctcctgtg

SEQ ID NO: 1822068 - DNA, 17 bp, Homo sapiens
gactcgggctcctgtgc

SEQ ID NO: 1822069 - DNA, 18 bp, Homo sapiens
gactcgggctcctgtgcc

SEQ ID NO: 1822070 - DNA, 15 bp, Homo sapiens
gactgaaagcagcag

SEQ ID NO: 1822071 - DNA, 16 bp, Homo sapiens
gactgaaagcagcagc

SEQ ID NO: 1822072 - DNA, 21 bp, Homo sapiens
gactgaaagcagcagctagga

SEQ ID NO: 1822073 - DNA, 19 bp, Homo sapiens
gactgaaccagagctggaa

SEQ ID NO: 1822074 - DNA, 22 bp, Homo sapiens
gactgcccccagaaagcctcct

SEQ ID NO: 1822075 - DNA, 21 bp, Homo sapiens
gactggagtgaggcttccagg

SEQ ID NO: 1822076 - DNA, 23 bp, Homo sapiens
gactgggttccccacagtgacag

SEQ ID NO: 1822077 - DNA, 15 bp, Homo sapiens
gacttcagatttcaa

SEQ ID NO: 1822078 - DNA, 19 bp, Homo sapiens
gacttcaggggctgcccgc

SEQ ID NO: 1822079 - DNA, 20 bp, Homo sapiens
gagcacttgcgtcctgcaga

SEQ ID NO: 1822080 - DNA, 13 bp, Homo sapiens
gagcagcctgatg

SEQ ID NO: 1822081 - DNA, 16 bp, Homo sapiens
gagcagcctgatggcc

SEQ ID NO: 1822082 - DNA, 21 bp, Homo sapiens
gagcagcttctgccacttccc

SEQ ID NO: 1822083 - DNA, 13 bp, Homo sapiens
gagcagggtcctg

SEQ ID NO: 1822084 - DNA, 15 bp, Homo sapiens
gagccactacctttg

SEQ ID NO: 1822085 - DNA, 16 bp, Homo sapiens
gagccactcctgtccc

SEQ ID NO: 1822086 - DNA, 14 bp, Homo sapiens
gagccatgggcctg

SEQ ID NO: 1822087 - DNA, 16 bp, Homo sapiens
gagccatgggtctaca

SEQ ID NO: 1822088 - DNA, 19 bp, Homo sapiens
gagccatgtgtcatgtaat

SEQ ID NO: 1822089 - DNA, 17 bp, Homo sapiens
gagcccctccccagcca

SEQ ID NO: 1822090 - DNA, 21 bp, Homo sapiens
gagcccctccccagccagccc

SEQ ID NO: 1822091 - DNA, 13 bp, Homo sapiens
gagccctgggtga

SEQ ID NO: 1822092 - DNA, 17 bp, Homo sapiens
gagcgagcaagccggca

SEQ ID NO: 1822093 - DNA, 18 bp, Homo sapiens
gagcgagcaagccggcaa

SEQ ID NO: 1822094 - DNA, 15 bp, Homo sapiens
gagctgatttccagg

SEQ ID NO: 1822095 - DNA, 16 bp, Homo sapiens
gagctgatttccaggc

SEQ ID NO: 1822096 - DNA, 20 bp, Homo sapiens
gagctgatttccaggcccct

SEQ ID NO: 1822097 - DNA, 21 bp, Homo sapiens
gagctgatttccaggcccctg

SEQ ID NO: 1822098 - DNA, 20 bp, Homo sapiens
gagctggaaggcagggcaga

SEQ ID NO: 1822099 - DNA, 21 bp, Homo sapiens
gagctggaaggcagggcagag

SEQ ID NO: 1822100 - DNA, 13 bp, Homo sapiens
gagctggggccac

SEQ ID NO: 1822101 - DNA, 14 bp, Homo sapiens
gagcttagccttgt

SEQ ID NO: 1822102 - DNA, 17 bp, Homo sapiens
gagcttagccttgtgcc

SEQ ID NO: 1822103 - DNA, 18 bp, Homo sapiens
gagcttagccttgtgccc

SEQ ID NO: 1822104 - DNA, 22 bp, Homo sapiens
gagcttagccttgtgccctgcc

SEQ ID NO: 1822105 - DNA, 13 bp, Homo sapiens
gaggaaggtgctg

SEQ ID NO: 1822106 - DNA, 15 bp, Homo sapiens
gaggaaggtgctgag

SEQ ID NO: 1822107 - DNA, 11 bp, Homo sapiens
gaggacacatg

SEQ ID NO: 1822108 - DNA, 12 bp, Homo sapiens
gaggacacatgt

SEQ ID NO: 1822109 - DNA, 18 bp, Homo sapiens
gaggaccacagtgggtgg

SEQ ID NO: 1822110 - DNA, 16 bp, Homo sapiens
gaggagaccctggaat

SEQ ID NO: 1822111 - DNA, 14 bp, Homo sapiens
gaggcaccagctct

SEQ ID NO: 1822112 - DNA, 16 bp, Homo sapiens
gaggcaccagctctgt

SEQ ID NO: 1822113 - DNA, 23 bp, Homo sapiens
gaggcaccagctctgtggcctgt

SEQ ID NO: 1822114 - DNA, 19 bp, Homo sapiens
gaggcaccggcgctgcagg

SEQ ID NO: 1822115 - DNA, 14 bp, Homo sapiens
gaggcagtgggtcc

SEQ ID NO: 1822116 - DNA, 13 bp, Homo sapiens
gaggccaaggcag

SEQ ID NO: 1822117 - DNA, 14 bp, Homo sapiens
gaggccaaggcagg

SEQ ID NO: 1822118 - DNA, 14 bp, Homo sapiens
gaggccaccccaaa

SEQ ID NO: 1822119 - DNA, 21 bp, Homo sapiens
gaggccaccccaaaccccagc

SEQ ID NO: 1822120 - DNA, 23 bp, Homo sapiens
gaggcctcagtttctccatcagc

SEQ ID NO: 1822121 - DNA, 13 bp, Homo sapiens
gaggcctcatccc

SEQ ID NO: 1822122 - DNA, 14 bp, Homo sapiens
gaggcctcatccct

SEQ ID NO: 1822123 - DNA, 19 bp, Homo sapiens
gaggctaagatgagatttg

SEQ ID NO: 1822124 - DNA, 23 bp, Homo sapiens
gaggctaagatgagatttgccag

SEQ ID NO: 1822125 - DNA, 13 bp, Homo sapiens
gaggcttccaggc

SEQ ID NO: 1822126 - DNA, 14 bp, Homo sapiens
gaggcttccaggct

SEQ ID NO: 1822127 - DNA, 15 bp, Homo sapiens
gaggcttccaggctc

SEQ ID NO: 1822128 - DNA, 21 bp, Homo sapiens
gaggcttccaggctcttcctg

SEQ ID NO: 1822129 - DNA, 15 bp, Homo sapiens
gaggctttggcccaa

SEQ ID NO: 1822130 - DNA, 20 bp, Homo sapiens
gagggaccaaattgcttcta

SEQ ID NO: 1822131 - DNA, 23 bp, Homo sapiens
gagggagggggcgctcaggaccc

SEQ ID NO: 1822132 - DNA, 11 bp, Homo sapiens
gagggcagagc

SEQ ID NO: 1822133 - DNA, 20 bp, Homo sapiens
gagggcagagccatgggcct

SEQ ID NO: 1822134 - DNA, 21 bp, Homo sapiens
gagggcagagccatgggcctg

SEQ ID NO: 1822135 - DNA, 22 bp, Homo sapiens
gagggcagagccatgggcctgg

SEQ ID NO: 1822136 - DNA, 23 bp, Homo sapiens
gagggcccagctgtagccatggc

SEQ ID NO: 1822137 - DNA, 19 bp, Homo sapiens
gagggctaattctgggaag

SEQ ID NO: 1822138 - DNA, 17 bp, Homo sapiens
gaggggcaggccctgca

SEQ ID NO: 1822139 - DNA, 17 bp, Homo sapiens
gaggggcccgcttgcct

SEQ ID NO: 1822140 - DNA, 21 bp, Homo sapiens
gaggggcccgttgtctccctg

SEQ ID NO: 1822141 - DNA, 12 bp, Homo sapiens
gagggggctctc

SEQ ID NO: 1822142 - DNA, 14 bp, Homo sapiens
gagggtggaggaag

SEQ ID NO: 1822143 - DNA, 21 bp, Homo sapiens
gaggtaggcgggaaaggatgg

SEQ ID NO: 1822144 - DNA, 17 bp, Homo sapiens
gaggtctcgctgatgct

SEQ ID NO: 1822145 - DNA, 22 bp, Homo sapiens
gaggtctcgctgatgctgggct

SEQ ID NO: 1822146 - DNA, 16 bp, Homo sapiens
gaggtgagaccacctc

SEQ ID NO: 1822147 - DNA, 19 bp, Homo sapiens
gaggtgggcagctgggccc

SEQ ID NO: 1822148 - DNA, 19 bp, Homo sapiens
gaggttatctgcctggcct

SEQ ID NO: 1822149 - DNA, 22 bp, Homo sapiens
gaggttatctgcctggcctggc

SEQ ID NO: 1822150 - DNA, 14 bp, Homo sapiens
gaggttcccagggc

SEQ ID NO: 1822151 - DNA, 21 bp, Homo sapiens
gagtcacaaaataaagctgtg

SEQ ID NO: 1822152 - DNA, 15 bp, Homo sapiens
gagtcacctgcaagc

SEQ ID NO: 1822153 - DNA, 16 bp, Homo sapiens
gagtcacctgcaagcc

SEQ ID NO: 1822154 - DNA, 21 bp, Homo sapiens
gagtcacctgcaagccccagg

SEQ ID NO: 1822155 - DNA, 22 bp, Homo sapiens
gagtccctccatgcaaaagtgg

SEQ ID NO: 1822156 - DNA, 18 bp, Homo sapiens
gagtcggccccacatggg

SEQ ID NO: 1822157 - DNA, 16 bp, Homo sapiens
gccagaaggagggcag

SEQ ID NO: 1822158 - DNA, 19 bp, Homo sapiens
gccagaaggagggcagagc

SEQ ID NO: 1822159 - DNA, 20 bp, Homo sapiens
gccagaaggagggcagagcc

SEQ ID NO: 1822160 - DNA, 22 bp, Homo sapiens
gccagaaggagggcagagccat

SEQ ID NO: 1822161 - DNA, 12 bp, Homo sapiens
gccagagaggag

SEQ ID NO: 1822162 - DNA, 16 bp, Homo sapiens
gccagagagggcccag

SEQ ID NO: 1822163 - DNA, 17 bp, Homo sapiens
gccagagctggaaggca

SEQ ID NO: 1822164 - DNA, 21 bp, Homo sapiens
gccagagttattagtgccaag

SEQ ID NO: 1822165 - DNA, 24 bp, Homo sapiens
gccagcacaggggccccagatctg

SEQ ID NO: 1822166 - DNA, 21 bp, Homo sapiens
gccagccagtcttgcctaggc

SEQ ID NO: 1822167 - DNA, 13 bp, Homo sapiens
gccagcctgggac

SEQ ID NO: 1822168 - DNA, 13 bp, Homo sapiens
gccagctgccttc

SEQ ID NO: 1822169 - DNA, 14 bp, Homo sapiens
gccagctgccttcc

SEQ ID NO: 1822170 - DNA, 14 bp, Homo sapiens
gccaggagtctgtg

SEQ ID NO: 1822171 - DNA, 14 bp, Homo sapiens
gccaggatggaatg

SEQ ID NO: 1822172 - DNA, 13 bp, Homo sapiens
gccaggcacctgg

SEQ ID NO: 1822173 - DNA, 14 bp, Homo sapiens
gccaggcacctggc

SEQ ID NO: 1822174 - DNA, 19 bp, Homo sapiens
gccaggcacctggcctgct

SEQ ID NO: 1822175 - DNA, 22 bp, Homo sapiens
gccaggcacctggcctgctggg

SEQ ID NO: 1822176 - DNA, 21 bp, Homo sapiens
gccaggcccatctcaggtgcc

SEQ ID NO: 1822177 - DNA, 18 bp, Homo sapiens
gccaggtgggcgggcagc

SEQ ID NO: 1822178 - DNA, 18 bp, Homo sapiens
gccagtcgcgctgcctgt

SEQ ID NO: 1822179 - DNA, 19 bp, Homo sapiens
gccagtcgcgctgcctgtg

SEQ ID NO: 1822180 - DNA, 20 bp, Homo sapiens
gccagtcgcgctgcctgtgt

SEQ ID NO: 1822181 - DNA, 23 bp, Homo sapiens
gccagtctgggtctgggtttgga

SEQ ID NO: 1822182 - DNA, 17 bp, Homo sapiens
gccagtcttgcctaggc

SEQ ID NO: 1822183 - DNA, 23 bp, Homo sapiens
gccagtggctggatctgtgaggg

SEQ ID NO: 1822184 - DNA, 20 bp, Homo sapiens
gccatactggcctcgcctgg

SEQ ID NO: 1822185 - DNA, 22 bp, Homo sapiens
gccatactggcctcgcctggcc

SEQ ID NO: 1822186 - DNA, 20 bp, Homo sapiens
gccatattttaaaaaatcaa

SEQ ID NO: 1822187 - DNA, 21 bp, Homo sapiens
gccatcatgtttacagaggac

SEQ ID NO: 1822188 - DNA, 12 bp, Homo sapiens
gccatgccactg

SEQ ID NO: 1822189 - DNA, 13 bp, Homo sapiens
gccatgccactgc

SEQ ID NO: 1822190 - DNA, 20 bp, Homo sapiens
gccatgccactgccaggcac

SEQ ID NO: 1822191 - DNA, 17 bp, Homo sapiens
gccatgccatgcccagg

SEQ ID NO: 1822192 - DNA, 16 bp, Homo sapiens
gccatgcctcatgcca

SEQ ID NO: 1822193 - DNA, 17 bp, Homo sapiens
gccatgcctcatgccac

SEQ ID NO: 1822194 - DNA, 22 bp, Homo sapiens
gccatgctcaacccccctccca

SEQ ID NO: 1822195 - DNA, 17 bp, Homo sapiens
gccatggctcaggcaag

SEQ ID NO: 1822196 - DNA, 15 bp, Homo sapiens
gccatgggcctgggc

SEQ ID NO: 1822197 - DNA, 19 bp, Homo sapiens
gccatgggcctgggcctgc

SEQ ID NO: 1822198 - DNA, 20 bp, Homo sapiens
gccatgggcctgggcctgct

SEQ ID NO: 1822199 - DNA, 16 bp, Homo sapiens
gccatgtgtcatgtaa

SEQ ID NO: 1822200 - DNA, 12 bp, Homo sapiens
gccattcccact

SEQ ID NO: 1822201 - DNA, 21 bp, Homo sapiens
gcccaaagagaaatcacaggg

SEQ ID NO: 1822202 - DNA, 20 bp, Homo sapiens
gcccaatgctttgggaggcc

SEQ ID NO: 1822203 - DNA, 15 bp, Homo sapiens
gcccacagagcctga

SEQ ID NO: 1822204 - DNA, 14 bp, Homo sapiens
gcccaccgcatgcc

SEQ ID NO: 1822205 - DNA, 13 bp, Homo sapiens
gcccacgtcctgt

SEQ ID NO: 1822206 - DNA, 16 bp, Homo sapiens
gcccacgtcctgtcag

SEQ ID NO: 1822207 - DNA, 23 bp, Homo sapiens
gcccacgtcctgtcagtgccgcc

SEQ ID NO: 1822208 - DNA, 21 bp, Homo sapiens
gcccacttagccgtccatggc

SEQ ID NO: 1822209 - DNA, 19 bp, Homo sapiens
gcccagctcccccgggagg

SEQ ID NO: 1822210 - DNA, 17 bp, Homo sapiens
gcccagctgtagccatg

SEQ ID NO: 1822211 - DNA, 20 bp, Homo sapiens
gcccagctgtagccatggct

SEQ ID NO: 1822212 - DNA, 20 bp, Homo sapiens
gcccaggacggggccggcca

SEQ ID NO: 1822213 - DNA, 21 bp, Homo sapiens
gcccaggacggggccggccag

SEQ ID NO: 1822214 - DNA, 21 bp, Homo sapiens
gcccaggccgttccccttggc

SEQ ID NO: 1822215 - DNA, 22 bp, Homo sapiens
gcccaggccgttccccttggct

SEQ ID NO: 1822216 - DNA, 23 bp, Homo sapiens
gcccaggccgttccccttggctt

SEQ ID NO: 1822217 - DNA, 13 bp, Homo sapiens
gcccaggctggcc

SEQ ID NO: 1822218 - DNA, 15 bp, Homo sapiens
gcccaggctggccag

SEQ ID NO: 1822219 - DNA, 16 bp, Homo sapiens
gcccaggctggccagc

SEQ ID NO: 1822220 - DNA, 23 bp, Homo sapiens
gcccaggctggccagccccacag

SEQ ID NO: 1822221 - DNA, 14 bp, Homo sapiens
gcccagtgcttctc

SEQ ID NO: 1822222 - DNA, 23 bp, Homo sapiens
gcccagtgcttctccaacactga

SEQ ID NO: 1822223 - DNA, 19 bp, Homo sapiens
gcccataatagttagccct

SEQ ID NO: 1822224 - DNA, 15 bp, Homo sapiens
gcccatcccccctca

SEQ ID NO: 1822225 - DNA, 17 bp, Homo sapiens
gcccatcccccctcacc

SEQ ID NO: 1822226 - DNA, 16 bp, Homo sapiens
gcccatctcaggtgcc

SEQ ID NO: 1822227 - DNA, 18 bp, Homo sapiens
gcccatctcaggtgccac

SEQ ID NO: 1822228 - DNA, 19 bp, Homo sapiens
gcccatgggcactgctggg

SEQ ID NO: 1822229 - DNA, 19 bp, Homo sapiens
gcccatttcgaagatatac

SEQ ID NO: 1822230 - DNA, 19 bp, Homo sapiens
gccccaactccaggggcac

SEQ ID NO: 1822231 - DNA, 16 bp, Homo sapiens
gccccaagcagccagc

SEQ ID NO: 1822232 - DNA, 19 bp, Homo sapiens
gccccaagcagccagccag

SEQ ID NO: 1822233 - DNA, 22 bp, Homo sapiens
gccccaagcagccagccagtct

SEQ ID NO: 1822234 - DNA, 11 bp, Homo sapiens
gccccacagcc

SEQ ID NO: 1822235 - DNA, 17 bp, Homo sapiens
gccccacagcccacgtc

SEQ ID NO: 1822236 - DNA, 23 bp, Homo sapiens
gccccacagcccacgtcctgtca

SEQ ID NO: 1822237 - DNA, 20 bp, Homo sapiens
gccccacctacttgtgactg

SEQ ID NO: 1822238 - DNA, 23 bp, Homo sapiens
gccccagatctgcctgggcctgt

SEQ ID NO: 1822239 - DNA, 14 bp, Homo sapiens
gccccagcctggcc

SEQ ID NO: 1822240 - DNA, 15 bp, Homo sapiens
gccccagcctggccc

SEQ ID NO: 1822241 - DNA, 17 bp, Homo sapiens
gccccagcctggcccag

SEQ ID NO: 1822242 - DNA, 21 bp, Homo sapiens
gccccagcctggcccagctcc

SEQ ID NO: 1822243 - DNA, 22 bp, Homo sapiens
gccccagcctggcccagctccc

SEQ ID NO: 1822244 - DNA, 19 bp, Homo sapiens
gccccatccctgcttgccc

SEQ ID NO: 1822245 - DNA, 16 bp, Homo sapiens
gatggtgagctgggaa

SEQ ID NO: 1822246 - DNA, 22 bp, Homo sapiens
gatgtcctctttactcccttcc

SEQ ID NO: 1822247 - DNA, 19 bp, Homo sapiens
gatgtggcaaagtgctgta

SEQ ID NO: 1822248 - DNA, 14 bp, Homo sapiens
gatgtgggaagaag

SEQ ID NO: 1822249 - DNA, 15 bp, Homo sapiens
gatgtgtggggcatg

SEQ ID NO: 1822250 - DNA, 17 bp, Homo sapiens
gattagtattcaggcac

SEQ ID NO: 1822251 - DNA, 22 bp, Homo sapiens
gattagtattcaggcactgaga

SEQ ID NO: 1822252 - DNA, 18 bp, Homo sapiens
gattatatatcataaagt

SEQ ID NO: 1822253 - DNA, 21 bp, Homo sapiens
gattatatatcataaagtatg

SEQ ID NO: 1822254 - DNA, 22 bp, Homo sapiens
gattatatatcataaagtatgc

SEQ ID NO: 1822255 - DNA, 17 bp, Homo sapiens
gattattgatcaaaatc

SEQ ID NO: 1822256 - DNA, 12 bp, Homo sapiens
gattcctgggcc

SEQ ID NO: 1822257 - DNA, 14 bp, Homo sapiens
gattcctgggcctg

SEQ ID NO: 1822258 - DNA, 23 bp, Homo sapiens
gattgcaggagtccctgccatca

SEQ ID NO: 1822259 - DNA, 16 bp, Homo sapiens
gattgcgagaattttc

SEQ ID NO: 1822260 - DNA, 21 bp, Homo sapiens
gattgttctgtccagtttcca

SEQ ID NO: 1822261 - DNA, 19 bp, Homo sapiens
gattgttttagaagttaaa

SEQ ID NO: 1822262 - DNA, 13 bp, Homo sapiens
gatttccaggccc

SEQ ID NO: 1822263 - DNA, 16 bp, Homo sapiens
gatttcccgtggcccc

SEQ ID NO: 1822264 - DNA, 22 bp, Homo sapiens
gatttcccgtggccccagcctg

SEQ ID NO: 1822265 - DNA, 19 bp, Homo sapiens
gatttcttcgctgctctag

SEQ ID NO: 1822266 - DNA, 14 bp, Homo sapiens
gatttgagaaattt

SEQ ID NO: 1822267 - DNA, 17 bp, Homo sapiens
gatttgccagcacaggg

SEQ ID NO: 1822268 - DNA, 13 bp, Homo sapiens
gcaaaagtggggc

SEQ ID NO: 1822269 - DNA, 22 bp, Homo sapiens
gcaaaagtggggctaaatgaag

SEQ ID NO: 1822270 - DNA, 15 bp, Homo sapiens
gcaaagaagcttcat

SEQ ID NO: 1822271 - DNA, 23 bp, Homo sapiens
gcaaagtgttttctcagaacagc

SEQ ID NO: 1822272 - DNA, 14 bp, Homo sapiens
gcaaagttatattt

SEQ ID NO: 1822273 - DNA, 17 bp, Homo sapiens
gcaaatattagcaaaga

SEQ ID NO: 1822274 - DNA, 12 bp, Homo sapiens
gcaacaatgcaa

SEQ ID NO: 1822275 - DNA, 13 bp, Homo sapiens
gcaacaatgcaaa

SEQ ID NO: 1822276 - DNA, 14 bp, Homo sapiens
gcaactagccaagg

SEQ ID NO: 1822277 - DNA, 13 bp, Homo sapiens
gcaagccccaggg

SEQ ID NO: 1822278 - DNA, 14 bp, Homo sapiens
gcaagccccagggc

SEQ ID NO: 1822279 - DNA, 18 bp, Homo sapiens
gcaagccccagggcctgg

SEQ ID NO: 1822280 - DNA, 17 bp, Homo sapiens
gcaagcgagcacagtat

SEQ ID NO: 1822281 - DNA, 13 bp, Homo sapiens
gcaaggaggctgg

SEQ ID NO: 1822282 - DNA, 15 bp, Homo sapiens
gcaaggaggctggct

SEQ ID NO: 1822283 - DNA, 19 bp, Homo sapiens
gcaaggaggctggctgggg

SEQ ID NO: 1822284 - DNA, 20 bp, Homo sapiens
gcaaggatatcagagctggg

SEQ ID NO: 1822285 - DNA, 14 bp, Homo sapiens
gcaaggcacctgca

SEQ ID NO: 1822286 - DNA, 14 bp, Homo sapiens
gcaagggcatcagg

SEQ ID NO: 1822287 - DNA, 20 bp, Homo sapiens
gcaagggcatcaggcactgg

SEQ ID NO: 1822288 - DNA, 17 bp, Homo sapiens
gcaagggctccagcatc

SEQ ID NO: 1822289 - DNA, 21 bp, Homo sapiens
gcaagggctccagcatccagc

SEQ ID NO: 1822290 - DNA, 14 bp, Homo sapiens
gcaaggggctctgc

SEQ ID NO: 1822291 - DNA, 21 bp, Homo sapiens
gcaagggggtgtcatctgagg

SEQ ID NO: 1822292 - DNA, 22 bp, Homo sapiens
gcaaggtctccttactctgagc

SEQ ID NO: 1822293 - DNA, 13 bp, Homo sapiens
gcaatctccaggg

SEQ ID NO: 1822294 - DNA, 20 bp, Homo sapiens
gcaatctccagggctgcccc

SEQ ID NO: 1822295 - DNA, 14 bp, Homo sapiens
gcaatgaaaacaaa

SEQ ID NO: 1822296 - DNA, 13 bp, Homo sapiens
gcaattcaatgca

SEQ ID NO: 1822297 - DNA, 14 bp, Homo sapiens
gcaattcaatgcaa

SEQ ID NO: 1822298 - DNA, 21 bp, Homo sapiens
gcaattcaatgcaatgaaaac

SEQ ID NO: 1822299 - DNA, 13 bp, Homo sapiens
gcacaattcattg

SEQ ID NO: 1822300 - DNA, 14 bp, Homo sapiens
gcacaattcattgt

SEQ ID NO: 1822301 - DNA, 14 bp, Homo sapiens
gcacacacagctcc

SEQ ID NO: 1822302 - DNA, 15 bp, Homo sapiens
gcacacacagctcct

SEQ ID NO: 1822303 - DNA, 15 bp, Homo sapiens
gcacaccactgccct

SEQ ID NO: 1822304 - DNA, 18 bp, Homo sapiens
gcacaccactgccctgcc

SEQ ID NO: 1822305 - DNA, 19 bp, Homo sapiens
gcacagacttctggaaggc

SEQ ID NO: 1822306 - DNA, 23 bp, Homo sapiens
gcacagacttctggaaggctggc

SEQ ID NO: 1822307 - DNA, 17 bp, Homo sapiens
gcacagcaaggaggctg

SEQ ID NO: 1822308 - DNA, 19 bp, Homo sapiens
gcacagcaaggaggctggc

SEQ ID NO: 1822309 - DNA, 11 bp, Homo sapiens
gcacagccctc

SEQ ID NO: 1822310 - DNA, 12 bp, Homo sapiens
gcacaggggccc

SEQ ID NO: 1822311 - DNA, 16 bp, Homo sapiens
gcacaggggccccaga

SEQ ID NO: 1822312 - DNA, 21 bp, Homo sapiens
gcacagtgtctgggctgactg

SEQ ID NO: 1822313 - DNA, 19 bp, Homo sapiens
gcacagttgtctattctga

SEQ ID NO: 1822314 - DNA, 21 bp, Homo sapiens
gcacagtttagaacagaggga

SEQ ID NO: 1822315 - DNA, 16 bp, Homo sapiens
gcaccagccccctgga

SEQ ID NO: 1822316 - DNA, 19 bp, Homo sapiens
gcaccagccccctggatgg

SEQ ID NO: 1822317 - DNA, 12 bp, Homo sapiens
gcaccagctctg

SEQ ID NO: 1822318 - DNA, 15 bp, Homo sapiens
gcaccagctctgtgg

SEQ ID NO: 1822319 - DNA, 16 bp, Homo sapiens
gcaccagctctgtggc

SEQ ID NO: 1822320 - DNA, 12 bp, Homo sapiens
gcaccagctgct

SEQ ID NO: 1822321 - DNA, 16 bp, Homo sapiens
gcaccagctgctctgc

SEQ ID NO: 1822322 - DNA, 18 bp, Homo sapiens
gcaccagctgctctgccc

SEQ ID NO: 1822323 - DNA, 14 bp, Homo sapiens
gcacccactcacca

SEQ ID NO: 1822324 - DNA, 17 bp, Homo sapiens
gcacccactcaccaggg

SEQ ID NO: 1822325 - DNA, 19 bp, Homo sapiens
gcacccactcaccagggtc

SEQ ID NO: 1822326 - DNA, 13 bp, Homo sapiens
gcacccccatgct

SEQ ID NO: 1822327 - DNA, 22 bp, Homo sapiens
gccccatctcctcccatggcct

SEQ ID NO: 1822328 - DNA, 17 bp, Homo sapiens
gccccatgctctgcccc

SEQ ID NO: 1822329 - DNA, 17 bp, Homo sapiens
gcccccagaaagcctcc

SEQ ID NO: 1822330 - DNA, 18 bp, Homo sapiens
gcccccagaaagcctcct

SEQ ID NO: 1822331 - DNA, 19 bp, Homo sapiens
gcccccagaaagcctcctg

SEQ ID NO: 1822332 - DNA, 23 bp, Homo sapiens
gcccccatctccccaggcctcca

SEQ ID NO: 1822333 - DNA, 14 bp, Homo sapiens
gcccccctccaggc

SEQ ID NO: 1822334 - DNA, 15 bp, Homo sapiens
gcccccctccaggca

SEQ ID NO: 1822335 - DNA, 17 bp, Homo sapiens
gccccctcgtgccagtc

SEQ ID NO: 1822336 - DNA, 13 bp, Homo sapiens
gccccctgccagt

SEQ ID NO: 1822337 - DNA, 14 bp, Homo sapiens
gccccctgccagtg

SEQ ID NO: 1822338 - DNA, 12 bp, Homo sapiens
gccccctggatg

SEQ ID NO: 1822339 - DNA, 13 bp, Homo sapiens
gccccggggctgg

SEQ ID NO: 1822340 - DNA, 23 bp, Homo sapiens
gccccgtcggactgcccccagaa

SEQ ID NO: 1822341 - DNA, 15 bp, Homo sapiens
gccccgttccctgtc

SEQ ID NO: 1822342 - DNA, 13 bp, Homo sapiens
gcccctcagccct

SEQ ID NO: 1822343 - DNA, 15 bp, Homo sapiens
gcccctcagcccttg

SEQ ID NO: 1822344 - DNA, 16 bp, Homo sapiens
gcccctcagcccttgc

SEQ ID NO: 1822345 - DNA, 17 bp, Homo sapiens
gcccctcagcccttgcc

SEQ ID NO: 1822346 - DNA, 18 bp, Homo sapiens
gcccctcagcccttgccc

SEQ ID NO: 1822347 - DNA, 12 bp, Homo sapiens
gcccctccccag

SEQ ID NO: 1822348 - DNA, 17 bp, Homo sapiens
gcccctccccagccctt

SEQ ID NO: 1822349 - DNA, 14 bp, Homo sapiens
gcccctccctctgc

SEQ ID NO: 1822350 - DNA, 19 bp, Homo sapiens
gcccctccctctgccccaa

SEQ ID NO: 1822351 - DNA, 15 bp, Homo sapiens
gcccctgtctggaag

SEQ ID NO: 1822352 - DNA, 16 bp, Homo sapiens
gcccctgtctggaaga

SEQ ID NO: 1822353 - DNA, 12 bp, Homo sapiens
ggcaagcaggga

SEQ ID NO: 1822354 - DNA, 18 bp, Homo sapiens
ggcaagcccctcagccct

SEQ ID NO: 1822355 - DNA, 21 bp, Homo sapiens
ggcaagcccctcagcccttgc

SEQ ID NO: 1822356 - DNA, 23 bp, Homo sapiens
ggcaaggtctccttactctgagc

SEQ ID NO: 1822357 - DNA, 21 bp, Homo sapiens
ggcacaccactgccctgcctg

SEQ ID NO: 1822358 - DNA, 18 bp, Homo sapiens
ggcacagacttctggaag

SEQ ID NO: 1822359 - DNA, 19 bp, Homo sapiens
ggcacagacttctggaagg

SEQ ID NO: 1822360 - DNA, 18 bp, Homo sapiens
ggcaccagccccctggat

SEQ ID NO: 1822361 - DNA, 14 bp, Homo sapiens
ggcaccagctctgt

SEQ ID NO: 1822362 - DNA, 19 bp, Homo sapiens
ggcaccagctctgtggcct

SEQ ID NO: 1822363 - DNA, 22 bp, Homo sapiens
ggcaccagctctgtggcctgtg

SEQ ID NO: 1822364 - DNA, 13 bp, Homo sapiens
ggcacccccatgc

SEQ ID NO: 1822365 - DNA, 15 bp, Homo sapiens
ggcacccccatgctg

SEQ ID NO: 1822366 - DNA, 13 bp, Homo sapiens
ggcaccggcgctg

SEQ ID NO: 1822367 - DNA, 14 bp, Homo sapiens
ggcaccggcgctgc

SEQ ID NO: 1822368 - DNA, 19 bp, Homo sapiens
ggcaccggcgctgcaggta

SEQ ID NO: 1822369 - DNA, 14 bp, Homo sapiens
ggcacctggcctgc

SEQ ID NO: 1822370 - DNA, 16 bp, Homo sapiens
ggcacctggcctgctg

SEQ ID NO: 1822371 - DNA, 20 bp, Homo sapiens
ggcactgtgaactattttga

SEQ ID NO: 1822372 - DNA, 23 bp, Homo sapiens
ggcagaaaagaggagaccctgga

SEQ ID NO: 1822373 - DNA, 24 bp, Homo sapiens
ggcagagccatgggcctgggcctg

SEQ ID NO: 1822374 - DNA, 14 bp, Homo sapiens
ggcagagctggaca

SEQ ID NO: 1822375 - DNA, 16 bp, Homo sapiens
ggcagaggggcagccg

SEQ ID NO: 1822376 - DNA, 15 bp, Homo sapiens
ggcagcaggtgctgc

SEQ ID NO: 1822377 - DNA, 19 bp, Homo sapiens
ggcagcaggtgctgctacc

SEQ ID NO: 1822378 - DNA, 21 bp, Homo sapiens
ggcagcaggtgctgctaccct

SEQ ID NO: 1822379 - DNA, 14 bp, Homo sapiens
ggcagccatgcctc

SEQ ID NO: 1822380 - DNA, 15 bp, Homo sapiens
ggcagccatgcctca

SEQ ID NO: 1822381 - DNA, 19 bp, Homo sapiens
ggcagccatgcctcatgcc

SEQ ID NO: 1822382 - DNA, 21 bp, Homo sapiens
ggcagccatgcctcatgccac

SEQ ID NO: 1822383 - DNA, 17 bp, Homo sapiens
ggcagccgctaggagag

SEQ ID NO: 1822384 - DNA, 21 bp, Homo sapiens
ggcagccgctaggagagactg

SEQ ID NO: 1822385 - DNA, 23 bp, Homo sapiens
ggcagccgctaggagagactgaa

SEQ ID NO: 1822386 - DNA, 19 bp, Homo sapiens
ggcagcctccagagccagc

SEQ ID NO: 1822387 - DNA, 14 bp, Homo sapiens
ggcagctagactgg

SEQ ID NO: 1822388 - DNA, 14 bp, Homo sapiens
ggcagctcctctcc

SEQ ID NO: 1822389 - DNA, 12 bp, Homo sapiens
ggcagctgggcc

SEQ ID NO: 1822390 - DNA, 21 bp, Homo sapiens
ggcagctgggccccacctact

SEQ ID NO: 1822391 - DNA, 22 bp, Homo sapiens
ggcaggacacatcccggcctct

SEQ ID NO: 1822392 - DNA, 18 bp, Homo sapiens
ggcaggcacagcacaggg

SEQ ID NO: 1822393 - DNA, 13 bp, Homo sapiens
ggcaggcctggga

SEQ ID NO: 1822394 - DNA, 18 bp, Homo sapiens
ggcagggagggcttgggg

SEQ ID NO: 1822395 - DNA, 21 bp, Homo sapiens
ggcaggtagatcgcttgagcc

SEQ ID NO: 1822396 - DNA, 23 bp, Homo sapiens
ggcagtacctgggaaaggaccca

SEQ ID NO: 1822397 - DNA, 24 bp, Homo sapiens
ggcagtgaacacactcagcagccc

SEQ ID NO: 1822398 - DNA, 16 bp, Homo sapiens
ggcagtgactggcagg

SEQ ID NO: 1822399 - DNA, 17 bp, Homo sapiens
ggcagtgactggcaggt

SEQ ID NO: 1822400 - DNA, 18 bp, Homo sapiens
ggcagtgactggcaggtg

SEQ ID NO: 1822401 - DNA, 21 bp, Homo sapiens
ggcagtgactggcaggtgcag

SEQ ID NO: 1822402 - DNA, 15 bp, Homo sapiens
ggcatcaggaaagga

SEQ ID NO: 1822403 - DNA, 14 bp, Homo sapiens
ggcatcaggcactg

SEQ ID NO: 1822404 - DNA, 15 bp, Homo sapiens
ggcatcaggcactgg

SEQ ID NO: 1822405 - DNA, 18 bp, Homo sapiens
ggcatcaggcactggtgg

SEQ ID NO: 1822406 - DNA, 19 bp, Homo sapiens
ggcatccacccagtgctgc

SEQ ID NO: 1822407 - DNA, 22 bp, Homo sapiens
ggcatccacccagtgctgccat

SEQ ID NO: 1822408 - DNA, 11 bp, Homo sapiens
ggcatgaaagt

SEQ ID NO: 1822409 - DNA, 13 bp, Homo sapiens
ggcatgctggcct

SEQ ID NO: 1822410 - DNA, 22 bp, Homo sapiens
ggcatggttccttccctgggaa

SEQ ID NO: 1822411 - DNA, 23 bp, Homo sapiens
ggcatggttccttccctgggaag

SEQ ID NO: 1822412 - DNA, 18 bp, Homo sapiens
ggcattggcagcaggtgc

SEQ ID NO: 1822413 - DNA, 21 bp, Homo sapiens
ggcattggcagcaggtgctgc

SEQ ID NO: 1822414 - DNA, 14 bp, Homo sapiens
ggcattgggctgac

SEQ ID NO: 1822415 - DNA, 17 bp, Homo sapiens
ggcattgggctgacacc

SEQ ID NO: 1822416 - DNA, 22 bp, Homo sapiens
ggccacaaatcaaagcaagggc

SEQ ID NO: 1822417 - DNA, 13 bp, Homo sapiens
ggccacacccagg

SEQ ID NO: 1822418 - DNA, 15 bp, Homo sapiens
ggccacacccaggaa

SEQ ID NO: 1822419 - DNA, 14 bp, Homo sapiens
ggccactgtggcca

SEQ ID NO: 1822420 - DNA, 17 bp, Homo sapiens
ggccactgtggccagag

SEQ ID NO: 1822421 - DNA, 21 bp, Homo sapiens
ggccactgtggccagagctgg

SEQ ID NO: 1822422 - DNA, 15 bp, Homo sapiens
ggccagaaggagggc

SEQ ID NO: 1822423 - DNA, 16 bp, Homo sapiens
ggccagaaggagggca

SEQ ID NO: 1822424 - DNA, 23 bp, Homo sapiens
ggccagaaggagggcagagccat

SEQ ID NO: 1822425 - DNA, 12 bp, Homo sapiens
ggccagagaggg

SEQ ID NO: 1822426 - DNA, 19 bp, Homo sapiens
ggccagagctggaaggcag

SEQ ID NO: 1822427 - DNA, 18 bp, Homo sapiens
ggccagccccacagccca

SEQ ID NO: 1822428 - DNA, 18 bp, Homo sapiens
ggccatattttaaaaaat

SEQ ID NO: 1822429 - DNA, 22 bp, Homo sapiens
ggccatattttaaaaaatcaaa

SEQ ID NO: 1822430 - DNA, 16 bp, Homo sapiens
ggcccaatgcctataa

SEQ ID NO: 1822431 - DNA, 14 bp, Homo sapiens
ggcccagctccccc

SEQ ID NO: 1822432 - DNA, 14 bp, Homo sapiens
ggcccagctgtagc

SEQ ID NO: 1822433 - DNA, 16 bp, Homo sapiens
ggcccagctgtagcca

SEQ ID NO: 1822434 - DNA, 22 bp, Homo sapiens
ggcccagctgtagccatggctc

SEQ ID NO: 1822435 - DNA, 22 bp, Homo sapiens
ggcccatcagtgtacccccgcc

SEQ ID NO: 1822436 - DNA, 13 bp, Homo sapiens
ggcccatctcagg

SEQ ID NO: 1822437 - DNA, 20 bp, Homo sapiens
ggcccatctcaggtgccact

SEQ ID NO: 1822438 - DNA, 22 bp, Homo sapiens
ggcccatctcaggtgccactcc

SEQ ID NO: 1822439 - DNA, 18 bp, Homo sapiens
ggccccagatctgcctgg

SEQ ID NO: 1822440 - DNA, 19 bp, Homo sapiens
ggccccagatctgcctggg

SEQ ID NO: 1822441 - DNA, 23 bp, Homo sapiens
ggccccagatctgcctgggcctg

SEQ ID NO: 1822442 - DNA, 17 bp, Homo sapiens
ggccccagcctggccca

SEQ ID NO: 1822443 - DNA, 20 bp, Homo sapiens
ggccccagcctggcccagct

SEQ ID NO: 1822444 - DNA, 15 bp, Homo sapiens
ggccccatgctctgc

SEQ ID NO: 1822445 - DNA, 14 bp, Homo sapiens
ggccccggggctgg

SEQ ID NO: 1822446 - DNA, 16 bp, Homo sapiens
ggccccggggctggca

SEQ ID NO: 1822447 - DNA, 16 bp, Homo sapiens
ggcccctgaggactgg

SEQ ID NO: 1822448 - DNA, 19 bp, Homo sapiens
ggcccgcttgcctcggctc

SEQ ID NO: 1822449 - DNA, 22 bp, Homo sapiens
ggcccgcttgcctcggctcctg

SEQ ID NO: 1822450 - DNA, 17 bp, Homo sapiens
ggcccgttgtctccctg

SEQ ID NO: 1822451 - DNA, 18 bp, Homo sapiens
ggcccgttgtctccctgg

SEQ ID NO: 1822452 - DNA, 23 bp, Homo sapiens
ggcccgttgtctccctggccctc

SEQ ID NO: 1822453 - DNA, 22 bp, Homo sapiens
ggccctaggattcctcccccag

SEQ ID NO: 1822454 - DNA, 19 bp, Homo sapiens
ggccctccctgtctccagg

SEQ ID NO: 1822455 - DNA, 18 bp, Homo sapiens
ggccctgcactgtcctgc

SEQ ID NO: 1822456 - DNA, 17 bp, Homo sapiens
ggccctgtgccttggtg

SEQ ID NO: 1822457 - DNA, 21 bp, Homo sapiens
ggcccttggggcctggcttgc

SEQ ID NO: 1822458 - DNA, 16 bp, Homo sapiens
ggcccttgtcctgcca

SEQ ID NO: 1822459 - DNA, 17 bp, Homo sapiens
ggcccttgtcctgccag

SEQ ID NO: 1822460 - DNA, 18 bp, Homo sapiens
ggcccttgtcctgccagc

SEQ ID NO: 1822461 - DNA, 18 bp, Homo sapiens
ggcctatcagtgtgcccc

SEQ ID NO: 1822462 - DNA, 20 bp, Homo sapiens
ggcctatcagtgtgcccccc

SEQ ID NO: 1822463 - DNA, 14 bp, Homo sapiens
ggcctcactggctg

SEQ ID NO: 1822464 - DNA, 15 bp, Homo sapiens
ggcctcactggctgg

SEQ ID NO: 1822465 - DNA, 23 bp, Homo sapiens
ggcctcactggctggggcagagg

SEQ ID NO: 1822466 - DNA, 15 bp, Homo sapiens
ggcctcatccctcgg

SEQ ID NO: 1822467 - DNA, 21 bp, Homo sapiens
ggcctcatccctcggaagccg

SEQ ID NO: 1822468 - DNA, 22 bp, Homo sapiens
ggcctccactcccccacctgac

SEQ ID NO: 1822469 - DNA, 23 bp, Homo sapiens
ggcctccactcccccacctgaca

SEQ ID NO: 1822470 - DNA, 17 bp, Homo sapiens
gcctggcctgagctggg

SEQ ID NO: 1822471 - DNA, 13 bp, Homo sapiens
gcctggcctggct

SEQ ID NO: 1822472 - DNA, 23 bp, Homo sapiens
gcctggctccccacgagtcacct

SEQ ID NO: 1822473 - DNA, 14 bp, Homo sapiens
gcctggctgtggag

SEQ ID NO: 1822474 - DNA, 18 bp, Homo sapiens
gcctggctgtggaggcct

SEQ ID NO: 1822475 - DNA, 20 bp, Homo sapiens
gcctggctgtggaggcctga

SEQ ID NO: 1822476 - DNA, 21 bp, Homo sapiens
gcctggctgtggaggcctgat

SEQ ID NO: 1822477 - DNA, 16 bp, Homo sapiens
gcctggcttgctccag

SEQ ID NO: 1822478 - DNA, 18 bp, Homo sapiens
gcctggcttgctccaggg

SEQ ID NO: 1822479 - DNA, 21 bp, Homo sapiens
gcctggcttgctccagggtct

SEQ ID NO: 1822480 - DNA, 17 bp, Homo sapiens
gcctgggacccagctac

SEQ ID NO: 1822481 - DNA, 15 bp, Homo sapiens
gcctgggactcccag

SEQ ID NO: 1822482 - DNA, 14 bp, Homo sapiens
gcctgggcctgctt

SEQ ID NO: 1822483 - DNA, 21 bp, Homo sapiens
gcctgggcctgtgcagcagcc

SEQ ID NO: 1822484 - DNA, 23 bp, Homo sapiens
gcctgggcctgtgcagcagccca

SEQ ID NO: 1822485 - DNA, 14 bp, Homo sapiens
gcctgggggcagtg

SEQ ID NO: 1822486 - DNA, 15 bp, Homo sapiens
gcctgggggcagtga

SEQ ID NO: 1822487 - DNA, 17 bp, Homo sapiens
gcctgggggcagtgact

SEQ ID NO: 1822488 - DNA, 16 bp, Homo sapiens
gcctgtcccccaaggt

SEQ ID NO: 1822489 - DNA, 15 bp, Homo sapiens
gcctgtgcagcagcc

SEQ ID NO: 1822490 - DNA, 20 bp, Homo sapiens
gcctgtgcagcagcccagct

SEQ ID NO: 1822491 - DNA, 22 bp, Homo sapiens
gcctgtggcagaaaagaggaga

SEQ ID NO: 1822492 - DNA, 16 bp, Homo sapiens
ggcctccagcctctcc

SEQ ID NO: 1822493 - DNA, 21 bp, Homo sapiens
ggcctcccaataaagctggac

SEQ ID NO: 1822494 - DNA, 11 bp, Homo sapiens
ggcctcccaca

SEQ ID NO: 1822495 - DNA, 13 bp, Homo sapiens
ggcctcccacagt

SEQ ID NO: 1822496 - DNA, 20 bp, Homo sapiens
ggcctctcattccagaggaa

SEQ ID NO: 1822497 - DNA, 16 bp, Homo sapiens
ggcctcttgtgctcac

SEQ ID NO: 1822498 - DNA, 12 bp, Homo sapiens
ggcctgagctgg

SEQ ID NO: 1822499 - DNA, 15 bp, Homo sapiens
ggcctgagctggggc

SEQ ID NO: 1822500 - DNA, 16 bp, Homo sapiens
ggcctgagctggggcc

SEQ ID NO: 1822501 - DNA, 11 bp, Homo sapiens
gggcacaccac

SEQ ID NO: 1822502 - DNA, 14 bp, Homo sapiens
gggcacaccactgc

SEQ ID NO: 1822503 - DNA, 21 bp, Homo sapiens
gggcacaccactgccctgcct

SEQ ID NO: 1822504 - DNA, 18 bp, Homo sapiens
gggcagagccatgggcct

SEQ ID NO: 1822505 - DNA, 20 bp, Homo sapiens
gggcagagccatgggcctgg

SEQ ID NO: 1822506 - DNA, 20 bp, Homo sapiens
ggtctgtgtgtgtgtatgtg

SEQ ID NO: 1822507 - DNA, 18 bp, Homo sapiens
gtccactctcggggccct

SEQ ID NO: 1822508 - DNA, 19 bp, Homo sapiens
gtccactctcggggccctt

SEQ ID NO: 1822509 - DNA, 12 bp, Homo sapiens
gtccagcagctg

SEQ ID NO: 1822510 - DNA, 15 bp, Homo sapiens
gtccagcagctgcgg

SEQ ID NO: 1822511 - DNA, 11 bp, Homo sapiens
gtccaggccac

SEQ ID NO: 1822512 - DNA, 13 bp, Homo sapiens
gtccaggccactg

SEQ ID NO: 1822513 - DNA, 18 bp, Homo sapiens
gtccaggccactgtggcc

SEQ ID NO: 1822514 - DNA, 20 bp, Homo sapiens
gtccaggccactgtggccag

SEQ ID NO: 1822515 - DNA, 14 bp, Homo sapiens
gtccagtgcccatt

SEQ ID NO: 1822516 - DNA, 21 bp, Homo sapiens
gtccatctcattgcggcctgt

SEQ ID NO: 1822517 - DNA, 13 bp, Homo sapiens
gtccatggcacca

SEQ ID NO: 1822518 - DNA, 15 bp, Homo sapiens
gtccatggcaccagc

SEQ ID NO: 1822519 - DNA, 21 bp, Homo sapiens
gtccatggcaccagccccctg

SEQ ID NO: 1822520 - DNA, 22 bp, Homo sapiens
gtccatggcaccagccccctgg

SEQ ID NO: 1822521 - DNA, 15 bp, Homo sapiens
gtcccaaggagctga

SEQ ID NO: 1822522 - DNA, 16 bp, Homo sapiens
gtcccacttcccctcc

SEQ ID NO: 1822523 - DNA, 17 bp, Homo sapiens
gtcccacttcccctcct

SEQ ID NO: 1822524 - DNA, 20 bp, Homo sapiens
gtcccagaatgcctcctgca

SEQ ID NO: 1822525 - DNA, 16 bp, Homo sapiens
gtccccagggcccctc

SEQ ID NO: 1822526 - DNA, 22 bp, Homo sapiens
gtccccagggcccctccctctg

SEQ ID NO: 1822527 - DNA, 23 bp, Homo sapiens
gtcccctctgtcatcactccctg

SEQ ID NO: 1822528 - DNA, 14 bp, Homo sapiens
gtcccgccttcctc

SEQ ID NO: 1822529 - DNA, 15 bp, Homo sapiens
gtccctcgtccacag

SEQ ID NO: 1822530 - DNA, 12 bp, Homo sapiens
gtccctggtccc

SEQ ID NO: 1822531 - DNA, 13 bp, Homo sapiens
gtccctggtccct

SEQ ID NO: 1822532 - DNA, 19 bp, Homo sapiens
gtccctggtccctcgtcca

SEQ ID NO: 1822533 - DNA, 14 bp, Homo sapiens
gtccgcaccagctg

SEQ ID NO: 1822534 - DNA, 17 bp, Homo sapiens
gtccgcaccagctgctc

SEQ ID NO: 1822535 - DNA, 22 bp, Homo sapiens
gtccgcaccagctgctctgccc

SEQ ID NO: 1822536 - DNA, 15 bp, Homo sapiens
gtcctcacagcctct

SEQ ID NO: 1822537 - DNA, 16 bp, Homo sapiens
gtcctcacagcctctc

SEQ ID NO: 1822538 - DNA, 12 bp, Homo sapiens
gtcctctccacc

SEQ ID NO: 1822539 - DNA, 21 bp, Homo sapiens
gtcctctttactcccttcctg

SEQ ID NO: 1822540 - DNA, 14 bp, Homo sapiens
gtcctgacgccctg

SEQ ID NO: 1822541 - DNA, 17 bp, Homo sapiens
gtcctgacgccctgcgt

SEQ ID NO: 1822542 - DNA, 20 bp, Homo sapiens
gtcctgacttcaggggctgc

SEQ ID NO: 1822543 - DNA, 20 bp, Homo sapiens
gtcctgcaatctccagggct

SEQ ID NO: 1822544 - DNA, 12 bp, Homo sapiens
gtcctgccagct

SEQ ID NO: 1822545 - DNA, 21 bp, Homo sapiens
gtcctgccagctgccttcctc

SEQ ID NO: 1822546 - DNA, 19 bp, Homo sapiens
gtcctgctccacagtgttg

SEQ ID NO: 1822547 - DNA, 15 bp, Homo sapiens
gtcctgtcagtgccg

SEQ ID NO: 1822548 - DNA, 21 bp, Homo sapiens
gtcctgtcagtgccgccgcct

SEQ ID NO: 1822549 - DNA, 22 bp, Homo sapiens
gtcctgtcagtgccgccgcctc

SEQ ID NO: 1822550 - DNA, 12 bp, Homo sapiens
gtcctgtcccag

SEQ ID NO: 1822551 - DNA, 13 bp, Homo sapiens
gtcctgtcccaga

SEQ ID NO: 1822552 - DNA, 13 bp, Homo sapiens
gtccttcagagct

SEQ ID NO: 1822553 - DNA, 14 bp, Homo sapiens
gtccttcagagctc

SEQ ID NO: 1822554 - DNA, 16 bp, Homo sapiens
gtcgcgctgcctgtgt

SEQ ID NO: 1822555 - DNA, 15 bp, Homo sapiens
gtctattctgagcct

SEQ ID NO: 1822556 - DNA, 14 bp, Homo sapiens
gtctccatgataac

SEQ ID NO: 1822557 - DNA, 13 bp, Homo sapiens
gtctccctggccc

SEQ ID NO: 1822558 - DNA, 15 bp, Homo sapiens
gtctccctggccctc

SEQ ID NO: 1822559 - DNA, 21 bp, Homo sapiens
gtctcctccaccgccatggct

SEQ ID NO: 1822560 - DNA, 23 bp, Homo sapiens
gtctccttactctgagcccaggc

SEQ ID NO: 1822561 - DNA, 20 bp, Homo sapiens
gtctcgctgatgctgggctg

SEQ ID NO: 1822562 - DNA, 21 bp, Homo sapiens
gtctcgctgatgctgggctgg

SEQ ID NO: 1822563 - DNA, 16 bp, Homo sapiens
gtctctcccaccccgg

SEQ ID NO: 1822564 - DNA, 20 bp, Homo sapiens
gtctctcccaccccggcctc

SEQ ID NO: 1822565 - DNA, 18 bp, Homo sapiens
gtctgaacccttgtgctt

SEQ ID NO: 1822566 - DNA, 22 bp, Homo sapiens
gtctgaaggaatagccagagag

SEQ ID NO: 1822567 - DNA, 15 bp, Homo sapiens
gtctgactccagagt

SEQ ID NO: 1822568 - DNA, 17 bp, Homo sapiens
gtctgactccagagtct

SEQ ID NO: 1822569 - DNA, 21 bp, Homo sapiens
gtctgactccagagtctgagc

SEQ ID NO: 1822570 - DNA, 22 bp, Homo sapiens
gtctgactccagagtctgagcc

SEQ ID NO: 1822571 - DNA, 16 bp, Homo sapiens
gtctgagcccccggct

SEQ ID NO: 1822572 - DNA, 19 bp, Homo sapiens
gtctgaggccccaggccct

SEQ ID NO: 1822573 - DNA, 13 bp, Homo sapiens
gtctgaggcctca

SEQ ID NO: 1822574 - DNA, 21 bp, Homo sapiens
gtctgccaggcccatctcagg

SEQ ID NO: 1822575 - DNA, 21 bp, Homo sapiens
gtctgctcgggcccaggccat

SEQ ID NO: 1822576 - DNA, 16 bp, Homo sapiens
gtctgtgctgtgcctg

SEQ ID NO: 1822577 - DNA, 16 bp, Homo sapiens
gtcttatttttctagt

SEQ ID NO: 1822578 - DNA, 19 bp, Homo sapiens
gtcttgggctactggcagc

SEQ ID NO: 1822579 - DNA, 20 bp, Homo sapiens
gtcttgggctactggcagct

SEQ ID NO: 1822580 - DNA, 24 bp, Homo sapiens
gtcttgggctactggcagctcctc

SEQ ID NO: 1822581 - DNA, 22 bp, Homo sapiens
gtcttgtctcatttaggactgg

SEQ ID NO: 1822582 - DNA, 23 bp, Homo sapiens
gtctttgaaggaaagctaagtct

SEQ ID NO: 1822583 - DNA, 19 bp, Homo sapiens
gtgaactattttgaagaaa

SEQ ID NO: 1822584 - DNA, 18 bp, Homo sapiens
gtgaataaaaattgatga

SEQ ID NO: 1822585 - DNA, 15 bp, Homo sapiens
gtgaatatgagaaat

SEQ ID NO: 1822586 - DNA, 20 bp, Homo sapiens
gtgaatatgagaaatacaga

SEQ ID NO: 1822587 - DNA, 11 bp, Homo sapiens
gtgaattctgc

SEQ ID NO: 1822588 - DNA, 22 bp, Homo sapiens
gtgaccccttttcagcttctgc

SEQ ID NO: 1822589 - DNA, 19 bp, Homo sapiens
gtgactcgggctcctgtgc

SEQ ID NO: 1822590 - DNA, 20 bp, Homo sapiens
gtgactcgggctcctgtgcc

SEQ ID NO: 1822591 - DNA, 18 bp, Homo sapiens
gtgactgaaggggcacac

SEQ ID NO: 1822592 - DNA, 19 bp, Homo sapiens
gtgactgaaggggcacacc

SEQ ID NO: 1822593 - DNA, 21 bp, Homo sapiens
gtgactgaaggggcacaccac

SEQ ID NO: 1822594 - DNA, 13 bp, Homo sapiens
gtgactggcaggt

SEQ ID NO: 1822595 - DNA, 14 bp, Homo sapiens
gtgagaccacctct

SEQ ID NO: 1822596 - DNA, 20 bp, Homo sapiens
gtgagaccacctctcaatat

SEQ ID NO: 1822597 - DNA, 15 bp, Homo sapiens
gtgagcccctcccca

SEQ ID NO: 1822598 - DNA, 16 bp, Homo sapiens
gtgagcccctccccag

SEQ ID NO: 1822599 - DNA, 17 bp, Homo sapiens
gtgagcccctccccagc

SEQ ID NO: 1822600 - DNA, 14 bp, Homo sapiens
gtgagctgggaagc

SEQ ID NO: 1822601 - DNA, 12 bp, Homo sapiens
gtgaggagggtg

SEQ ID NO: 1822602 - DNA, 13 bp, Homo sapiens
gtgagtggcagcc

SEQ ID NO: 1822603 - DNA, 20 bp, Homo sapiens
gtgagtggcagccatgcctc

SEQ ID NO: 1822604 - DNA, 20 bp, Homo sapiens
gtgatttcccgtggccccag

SEQ ID NO: 1822605 - DNA, 21 bp, Homo sapiens
gtgatttcccgtggccccagc

SEQ ID NO: 1822606 - DNA, 23 bp, Homo sapiens
gtgatttcccgtggccccagcct

SEQ ID NO: 1822607 - DNA, 18 bp, Homo sapiens
gtgcacccactcaccagg

SEQ ID NO: 1822608 - DNA, 14 bp, Homo sapiens
gtgcagcagcccag

SEQ ID NO: 1822609 - DNA, 21 bp, Homo sapiens
gtgccaacagtgttaggcctg

SEQ ID NO: 1822610 - DNA, 18 bp, Homo sapiens
gtgccaagtttttcagaa

SEQ ID NO: 1822611 - DNA, 11 bp, Homo sapiens
gtgccaccctg

SEQ ID NO: 1822612 - DNA, 16 bp, Homo sapiens
gtgccaccctgggctc

SEQ ID NO: 1822613 - DNA, 16 bp, Homo sapiens
gtgccactccctgagc

SEQ ID NO: 1822614 - DNA, 18 bp, Homo sapiens
gtgccactccctgagctt

SEQ ID NO: 1822615 - DNA, 21 bp, Homo sapiens
gtgccacttcttaaaggcctg

SEQ ID NO: 1822616 - DNA, 22 bp, Homo sapiens
gtgccagtcgcgctgcctgtgt

SEQ ID NO: 1822617 - DNA, 13 bp, Homo sapiens
gtgccattcccag

SEQ ID NO: 1822618 - DNA, 14 bp, Homo sapiens
gtgcccatgggcac

SEQ ID NO: 1822619 - DNA, 16 bp, Homo sapiens
gtgcccattcctcacc

SEQ ID NO: 1822620 - DNA, 22 bp, Homo sapiens
gtgccccccatcctggcccatc

SEQ ID NO: 1822621 - DNA, 23 bp, Homo sapiens
gtgccccttaagggttgaaggca

SEQ ID NO: 1822622 - DNA, 17 bp, Homo sapiens
tccatgtgctgctgtgg

SEQ ID NO: 1822623 - DNA, 22 bp, Homo sapiens
tccattacaggggcagtgcctt

SEQ ID NO: 1822624 - DNA, 14 bp, Homo sapiens
tcccaaggagctga

SEQ ID NO: 1822625 - DNA, 15 bp, Homo sapiens
tcccaaggagctgat

SEQ ID NO: 1822626 - DNA, 22 bp, Homo sapiens
tcccaaggagctgatttccagg

SEQ ID NO: 1822627 - DNA, 17 bp, Homo sapiens
tcccaataaagctggac

SEQ ID NO: 1822628 - DNA, 18 bp, Homo sapiens
tcccaccccggcctccac

SEQ ID NO: 1822629 - DNA, 19 bp, Homo sapiens
tcccaccccggcctccact

SEQ ID NO: 1822630 - DNA, 20 bp, Homo sapiens
tcccactaagctttctcctt

SEQ ID NO: 1822631 - DNA, 22 bp, Homo sapiens
tcccactaagctttctcctttg

SEQ ID NO: 1822632 - DNA, 13 bp, Homo sapiens
tcccactgcaccc

SEQ ID NO: 1822633 - DNA, 20 bp, Homo sapiens
tcccactgcaccccctcctg

SEQ ID NO: 1822634 - DNA, 20 bp, Homo sapiens
tcccacttcccctcctaccc

SEQ ID NO: 1822635 - DNA, 18 bp, Homo sapiens
tcccagacaggccctccc

SEQ ID NO: 1822636 - DNA, 23 bp, Homo sapiens
tcccagaggttatctgcctggcc

SEQ ID NO: 1822637 - DNA, 24 bp, Homo sapiens
tcccagaggttatctgcctggcct

SEQ ID NO: 1822638 - DNA, 20 bp, Homo sapiens
tcccagtgtcttcctgtggg

SEQ ID NO: 1822639 - DNA, 17 bp, Homo sapiens
tcccatggtagactgtg

SEQ ID NO: 1822640 - DNA, 18 bp, Homo sapiens
tccccacagtcctcacag

SEQ ID NO: 1822641 - DNA, 23 bp, Homo sapiens
tccccacgagtcacctgcaagcc

SEQ ID NO: 1822642 - DNA, 15 bp, Homo sapiens
tccccagccagccct

SEQ ID NO: 1822643 - DNA, 21 bp, Homo sapiens
tccccagccagcccttccctg

SEQ ID NO: 1822644 - DNA, 14 bp, Homo sapiens
tccccagcccttct

SEQ ID NO: 1822645 - DNA, 15 bp, Homo sapiens
tccccagccctttgc

SEQ ID NO: 1822646 - DNA, 20 bp, Homo sapiens
tccccaggcctccagcctct

SEQ ID NO: 1822647 - DNA, 12 bp, Homo sapiens
tccccagggccc

SEQ ID NO: 1822648 - DNA, 22 bp, Homo sapiens
tccccatgtgcctgcaccagga

SEQ ID NO: 1822649 - DNA, 15 bp, Homo sapiens
tcccccacctgacaa

SEQ ID NO: 1822650 - DNA, 22 bp, Homo sapiens
tcccccacctgacaatggcagc

SEQ ID NO: 1822651 - DNA, 14 bp, Homo sapiens
tcccccatgtggct

SEQ ID NO: 1822652 - DNA, 17 bp, Homo sapiens
tcccccgacactgctgc

SEQ ID NO: 1822653 - DNA, 20 bp, Homo sapiens
tcccccgcagtccccagccc

SEQ ID NO: 1822654 - DNA, 14 bp, Homo sapiens
tcccctccctgcct

SEQ ID NO: 1822655 - DNA, 13 bp, Homo sapiens
tcccctccctgta

SEQ ID NO: 1822656 - DNA, 13 bp, Homo sapiens
tcccctcctaccc

SEQ ID NO: 1822657 - DNA, 17 bp, Homo sapiens
tcccctcctacccctcc

SEQ ID NO: 1822658 - DNA, 19 bp, Homo sapiens
tcccctcctacccctccca

SEQ ID NO: 1822659 - DNA, 20 bp, Homo sapiens
tcccctcctacccctcccag

SEQ ID NO: 1822660 - DNA, 22 bp, Homo sapiens
tcccctcctacccctcccagct

SEQ ID NO: 1822661 - DNA, 19 bp, Homo sapiens
tcccctcgtcctgtcccag

SEQ ID NO: 1822662 - DNA, 14 bp, Homo sapiens
tcccctggggacgc

SEQ ID NO: 1822663 - DNA, 24 bp, Homo sapiens
tccccttttgcctggctgtggagg

SEQ ID NO: 1822664 - DNA, 14 bp, Homo sapiens
tcccggagcacagc

SEQ ID NO: 1822665 - DNA, 22 bp, Homo sapiens
tcccggagcacagccctgggag

SEQ ID NO: 1822666 - DNA, 13 bp, Homo sapiens
tcccggcctcttc

SEQ ID NO: 1822667 - DNA, 14 bp, Homo sapiens
tcccggctgcctgc

SEQ ID NO: 1822668 - DNA, 18 bp, Homo sapiens
tcccggtgacacatccat

SEQ ID NO: 1822669 - DNA, 12 bp, Homo sapiens
tcccgtggcccc

SEQ ID NO: 1822670 - DNA, 13 bp, Homo sapiens
tcccgtggcccca

SEQ ID NO: 1822671 - DNA, 19 bp, Homo sapiens
tcccgtggccccagcctgg

SEQ ID NO: 1822672 - DNA, 24 bp, Homo sapiens
tccctcggaagccgtctgactcca

SEQ ID NO: 1822673 - DNA, 15 bp, Homo sapiens
tccctcgtccacagg

SEQ ID NO: 1822674 - DNA, 21 bp, Homo sapiens
tccctctgccccaagcagcca

SEQ ID NO: 1822675 - DNA, 22 bp, Homo sapiens
tccctgacactgcggggcttgg

SEQ ID NO: 1822676 - DNA, 14 bp, Homo sapiens
tccctgagctttgg

SEQ ID NO: 1822677 - DNA, 17 bp, Homo sapiens
tccctgcaccctggaaa

SEQ ID NO: 1822678 - DNA, 19 bp, Homo sapiens
tccctgcctgctccttggc

SEQ ID NO: 1822679 - DNA, 20 bp, Homo sapiens
tccctgcttgcccgctccca

SEQ ID NO: 1822680 - DNA, 21 bp, Homo sapiens
tccctggatgtgtggggcatg

SEQ ID NO: 1822681 - DNA, 17 bp, Homo sapiens
tccctggtccctcgtcc

SEQ ID NO: 1822682 - DNA, 15 bp, Homo sapiens
tccctgtcagaggct

SEQ ID NO: 1822683 - DNA, 13 bp, Homo sapiens
tccctgtctccag

SEQ ID NO: 1822684 - DNA, 14 bp, Homo sapiens
tccctgtctccagg

SEQ ID NO: 1822685 - DNA, 16 bp, Homo sapiens
tccctgtctccagggc

SEQ ID NO: 1822686 - DNA, 21 bp, Homo sapiens
tccctgtctccagggccccca

SEQ ID NO: 1822687 - DNA, 15 bp, Homo sapiens
tcccttcctggcctc

SEQ ID NO: 1822688 - DNA, 22 bp, Homo sapiens
tccgacttgaattttcccactg

SEQ ID NO: 1822689 - DNA, 14 bp, Homo sapiens
tccgcaccagctgc

SEQ ID NO: 1822690 - DNA, 15 bp, Homo sapiens
tccgcaccagctgct

SEQ ID NO: 1822691 - DNA, 23 bp, Homo sapiens
tccgctgccaccacgtctgccag

SEQ ID NO: 1822692 - DNA, 15 bp, Homo sapiens
tccggggtctgtgct

SEQ ID NO: 1822693 - DNA, 20 bp, Homo sapiens
tccggggtctgtgctgtgcc

SEQ ID NO: 1822694 - DNA, 21 bp, Homo sapiens
tccggggtctgtgctgtgcct

SEQ ID NO: 1822695 - DNA, 16 bp, Homo sapiens
tccgggtgccattccc

SEQ ID NO: 1822696 - DNA, 15 bp, Homo sapiens
tccgtccacccaggc

SEQ ID NO: 1822697 - DNA, 16 bp, Homo sapiens
tccgtttatgggcctt

SEQ ID NO: 1822698 - DNA, 12 bp, Homo sapiens
tcctacccctcc

SEQ ID NO: 1822699 - DNA, 18 bp, Homo sapiens
tcctacccctcccagctg

SEQ ID NO: 1822700 - DNA, 14 bp, Homo sapiens
tcctaccctcccac

SEQ ID NO: 1822701 - DNA, 21 bp, Homo sapiens
tcctaccctcccaccagaacg

SEQ ID NO: 1822702 - DNA, 19 bp, Homo sapiens
tcctagaggtgggcagctg

SEQ ID NO: 1822703 - DNA, 19 bp, Homo sapiens
tcctagcccagtgcttctc

SEQ ID NO: 1822704 - DNA, 16 bp, Homo sapiens
tcctcacagcctctcc

SEQ ID NO: 1822705 - DNA, 12 bp, Homo sapiens
tcctcacctggt

SEQ ID NO: 1822706 - DNA, 21 bp, Homo sapiens
tcctcatttaatatttttcaa

SEQ ID NO: 1822707 - DNA, 22 bp, Homo sapiens
tcctcatttaatatttttcaaa

SEQ ID NO: 1822708 - DNA, 21 bp, Homo sapiens
tcctccaccgccatggcttcc

SEQ ID NO: 1822709 - DNA, 14 bp, Homo sapiens
tcctccagcctccc

SEQ ID NO: 1822710 - DNA, 14 bp, Homo sapiens
tcctcccatggcct

SEQ ID NO: 1822711 - DNA, 18 bp, Homo sapiens
tcctcccatggccttccc

SEQ ID NO: 1822712 - DNA, 20 bp, Homo sapiens
tcctcccatggccttccctc

SEQ ID NO: 1822713 - DNA, 15 bp, Homo sapiens
tcctcccccagagcc

SEQ ID NO: 1822714 - DNA, 17 bp, Homo sapiens
tcctccgtccacccagg

SEQ ID NO: 1822715 - DNA, 19 bp, Homo sapiens
tcctccgtccacccaggct

SEQ ID NO: 1822716 - DNA, 20 bp, Homo sapiens
tctcggggcccttggggcct

SEQ ID NO: 1822717 - DNA, 14 bp, Homo sapiens
tctctcccaccccg

SEQ ID NO: 1822718 - DNA, 21 bp, Homo sapiens
tctgaaaagcaattgccctgt

SEQ ID NO: 1822719 - DNA, 22 bp, Homo sapiens
tctgaaaagcaattgccctgta

SEQ ID NO: 1822720 - DNA, 15 bp, Homo sapiens
tctgaacaaaagctt

SEQ ID NO: 1822721 - DNA, 21 bp, Homo sapiens
tctgaacccttgtgcttggtg

SEQ ID NO: 1822722 - DNA, 18 bp, Homo sapiens
tctgaaggaatagccaga

SEQ ID NO: 1822723 - DNA, 20 bp, Homo sapiens
tctgaaggaatagccagaga

SEQ ID NO: 1822724 - DNA, 15 bp, Homo sapiens
tctgaatccttagaa

SEQ ID NO: 1822725 - DNA, 18 bp, Homo sapiens
tctgaatccttagaatgg

SEQ ID NO: 1822726 - DNA, 21 bp, Homo sapiens
tctgacagtctcaaatttttc

SEQ ID NO: 1822727 - DNA, 12 bp, Homo sapiens
tctgactccaga

SEQ ID NO: 1822728 - DNA, 13 bp, Homo sapiens
tctgactccagag

SEQ ID NO: 1822729 - DNA, 21 bp, Homo sapiens
tctgactccagagtctgagcc

SEQ ID NO: 1822730 - DNA, 15 bp, Homo sapiens
tctgagcccaggccg

SEQ ID NO: 1822731 - DNA, 18 bp, Homo sapiens
tctgagcccccggctagt

SEQ ID NO: 1822732 - DNA, 17 bp, Homo sapiens
tctgaggccccaggccc

SEQ ID NO: 1822733 - DNA, 14 bp, Homo sapiens
tctgaggcctcatc

SEQ ID NO: 1822734 - DNA, 19 bp, Homo sapiens
tctgcaactagccaaggct

SEQ ID NO: 1822735 - DNA, 16 bp, Homo sapiens
tctgccacttcccagg

SEQ ID NO: 1822736 - DNA, 17 bp, Homo sapiens
tctgccacttcccaggt

SEQ ID NO: 1822737 - DNA, 12 bp, Homo sapiens
tctgccaggccc

SEQ ID NO: 1822738 - DNA, 13 bp, Homo sapiens
tctgccaggccca

SEQ ID NO: 1822739 - DNA, 14 bp, Homo sapiens
tctgccaggcccat

SEQ ID NO: 1822740 - DNA, 17 bp, Homo sapiens
tctgccccaagcagcca

SEQ ID NO: 1822741 - DNA, 21 bp, Homo sapiens
tctgccccaagcagccagcca

SEQ ID NO: 1822742 - DNA, 16 bp, Homo sapiens
tctgccccaagccccc

SEQ ID NO: 1822743 - DNA, 22 bp, Homo sapiens
tctgccccaagcccccaacccc

SEQ ID NO: 1822744 - DNA, 18 bp, Homo sapiens
tctgccctccctccttcc

SEQ ID NO: 1822745 - DNA, 12 bp, Homo sapiens
tctgcctggcct

SEQ ID NO: 1822746 - DNA, 17 bp, Homo sapiens
tctgcctgggcctgtgc

SEQ ID NO: 1822747 - DNA, 18 bp, Homo sapiens
tctgcctgggcctgtgca

SEQ ID NO: 1822748 - DNA, 22 bp, Homo sapiens
tctgcctgggcctgtgcagcag

SEQ ID NO: 1822749 - DNA, 18 bp, Homo sapiens
tctgctcgggcccaggcc

SEQ ID NO: 1822750 - DNA, 15 bp, Homo sapiens
tctggaagacgtggc

SEQ ID NO: 1822751 - DNA, 17 bp, Homo sapiens
tctggaagacgtggctc

SEQ ID NO: 1822752 - DNA, 18 bp, Homo sapiens
tctggaagacgtggctct

SEQ ID NO: 1822753 - DNA, 20 bp, Homo sapiens
tctggcaccactagggtcct

SEQ ID NO: 1822754 - DNA, 11 bp, Homo sapiens
tctggccctat

SEQ ID NO: 1822755 - DNA, 15 bp, Homo sapiens
tctggcggcttcctg

SEQ ID NO: 1822756 - DNA, 19 bp, Homo sapiens
tctggcggcttcctgtcca

SEQ ID NO: 1822757 - DNA, 12 bp, Homo sapiens
tctgggaaggga

SEQ ID NO: 1822758 - DNA, 13 bp, Homo sapiens
tctgggctcaggg

SEQ ID NO: 1822759 - DNA, 15 bp, Homo sapiens
tctgggctcagggct

SEQ ID NO: 1822760 - DNA, 20 bp, Homo sapiens
tctggggacctggtttgaat

SEQ ID NO: 1822761 - DNA, 18 bp, Homo sapiens
tctgggtgttgaccactc

SEQ ID NO: 1822762 - DNA, 20 bp, Homo sapiens
tctgggtgttgaccactcca

SEQ ID NO: 1822763 - DNA, 23 bp, Homo sapiens
tctggtatgaacttgaggacaca

SEQ ID NO: 1822764 - DNA, 13 bp, Homo sapiens
tctgtactgaaag

SEQ ID NO: 1822765 - DNA, 20 bp, Homo sapiens
tctgtcatcactccctggat

SEQ ID NO: 1822766 - DNA, 14 bp, Homo sapiens
tctgtccaggccac

SEQ ID NO: 1822767 - DNA, 23 bp, Homo sapiens
tctgtccaggccactgtggccag

SEQ ID NO: 1822768 - DNA, 10 bp, Homo sapiens
tctgtcctga

SEQ ID NO: 1822769 - DNA, 15 bp, Homo sapiens
tctgtctgtcccaaa

SEQ ID NO: 1822770 - DNA, 23 bp, Homo sapiens
tctgtgaaagtctcctgtatcat

SEQ ID NO: 1822771 - DNA, 19 bp, Homo sapiens
tctgtgcccatgggcactg

SEQ ID NO: 1822772 - DNA, 22 bp, Homo sapiens
tctgtgcccatgggcactgctg

SEQ ID NO: 1822773 - DNA, 13 bp, Homo sapiens
tctgtgctgtgcc

SEQ ID NO: 1822774 - DNA, 14 bp, Homo sapiens
tctgtgctgtgcct

SEQ ID NO: 1822775 - DNA, 18 bp, Homo sapiens
tctgtgctgtgcctgcta

SEQ ID NO: 1822776 - DNA, 23 bp, Homo sapiens
tctgtggcctgtgtccagcagct

SEQ ID NO: 1822777 - DNA, 20 bp, Homo sapiens
tctgtgggctgcactctgtg

SEQ ID NO: 1822778 - DNA, 19 bp, Homo sapiens
tctgtgtgtgtgtatgtgg

SEQ ID NO: 1822779 - DNA, 21 bp, Homo sapiens
tctgtgtgtgtgtatgtgggg

SEQ ID NO: 1822780 - DNA, 19 bp, Homo sapiens
tctgtgtgtttatgtgtgt

SEQ ID NO: 1822781 - DNA, 20 bp, Homo sapiens
tctgtgtgtttatgtgtgtg

SEQ ID NO: 1822782 - DNA, 14 bp, Homo sapiens
tcttaaaggcctgg

SEQ ID NO: 1822783 - DNA, 17 bp, Homo sapiens
tcttaatctcacttcat

SEQ ID NO: 1822784 - DNA, 15 bp, Homo sapiens
tcttatgtaagtttg

SEQ ID NO: 1822785 - DNA, 19 bp, Homo sapiens
tcttatgtaagtttgcata

SEQ ID NO: 1822786 - DNA, 13 bp, Homo sapiens
tcttatttttcta

SEQ ID NO: 1822787 - DNA, 18 bp, Homo sapiens
tcttcaaaaatacagaat

SEQ ID NO: 1822788 - DNA, 15 bp, Homo sapiens
tcttcaagctgtccc

SEQ ID NO: 1822789 - DNA, 18 bp, Homo sapiens
tcttcattaatactgtgt

SEQ ID NO: 1822790 - DNA, 16 bp, Homo sapiens
tcttccactttttcca

SEQ ID NO: 1822791 - DNA, 18 bp, Homo sapiens
tcttccactttttccaga

SEQ ID NO: 1822792 - DNA, 13 bp, Homo sapiens
tcttccaggtggg

SEQ ID NO: 1822793 - DNA, 18 bp, Homo sapiens
tcttcctggacctgagtc

SEQ ID NO: 1822794 - DNA, 12 bp, Homo sapiens
tcttcctgtggg

SEQ ID NO: 1822795 - DNA, 16 bp, Homo sapiens
tcttgagagaaaagaa

SEQ ID NO: 1822796 - DNA, 21 bp, Homo sapiens
tcttgccccaacccccagcac

SEQ ID NO: 1822797 - DNA, 21 bp, Homo sapiens
tcttgggctactggcagctcc

SEQ ID NO: 1822798 - DNA, 19 bp, Homo sapiens
tcttgggggaggccacccc

SEQ ID NO: 1822799 - DNA, 15 bp, Homo sapiens
tcttgtgctcacgct

SEQ ID NO: 1822800 - DNA, 19 bp, Homo sapiens
tctttcaatatcattacta

SEQ ID NO: 1822801 - DNA, 10 bp, Homo sapiens
tctttcagat

SEQ ID NO: 1822802 - DNA, 15 bp, Homo sapiens
tctttcagatcattt

SEQ ID NO: 1822803 - DNA, 16 bp, Homo sapiens
tgaagctagaaacaat

SEQ ID NO: 1822804 - DNA, 19 bp, Homo sapiens
tgaaggaatagccagagag

SEQ ID NO: 1822805 - DNA, 21 bp, Homo sapiens
tgaaggaatagccagagagga

SEQ ID NO: 1822806 - DNA, 17 bp, Homo sapiens
tgaagtattaaaatgca

SEQ ID NO: 1822807 - DNA, 23 bp, Homo sapiens
tgaataattttctggcactggtt

SEQ ID NO: 1822808 - DNA, 17 bp, Homo sapiens
tgaatatgagaaataca

SEQ ID NO: 1822809 - DNA, 15 bp, Homo sapiens
tgaattaatctagaa

SEQ ID NO: 1822810 - DNA, 17 bp, Homo sapiens
tgaattaatctagaaaa

SEQ ID NO: 1822811 - DNA, 13 bp, Homo sapiens
tgaattcttcaac

SEQ ID NO: 1822812 - DNA, 18 bp, Homo sapiens
tgaattgctaattctgag

SEQ ID NO: 1822813 - DNA, 17 bp, Homo sapiens
tgaattttcccactgca

SEQ ID NO: 1822814 - DNA, 20 bp, Homo sapiens
tgaattttcccactgcaccc

SEQ ID NO: 1822815 - DNA, 19 bp, Homo sapiens
tgacaaaaatgtttgtact

SEQ ID NO: 1822816 - DNA, 20 bp, Homo sapiens
tgacaacatttttgtacatt

SEQ ID NO: 1822817 - DNA, 17 bp, Homo sapiens
tgacaatactgctgcct

SEQ ID NO: 1822818 - DNA, 19 bp, Homo sapiens
tgacacatccattgctggc

SEQ ID NO: 1822819 - DNA, 18 bp, Homo sapiens
tgacacctaccatgctgc

SEQ ID NO: 1822820 - DNA, 20 bp, Homo sapiens
tgacacctaccatgctgctt

SEQ ID NO: 1822821 - DNA, 14 bp, Homo sapiens
tgacagaaatgcaa

SEQ ID NO: 1822822 - DNA, 15 bp, Homo sapiens
tgacagtcctctcca

SEQ ID NO: 1822823 - DNA, 18 bp, Homo sapiens
tgacagtcctctccacct

SEQ ID NO: 1822824 - DNA, 20 bp, Homo sapiens
tgacagtctcaaatttttca

SEQ ID NO: 1822825 - DNA, 18 bp, Homo sapiens
tgaccattggctgcgcta

SEQ ID NO: 1822826 - DNA, 19 bp, Homo sapiens
tgacccaaaaatgttccct

SEQ ID NO: 1822827 - DNA, 21 bp, Homo sapiens
tgaccccttttcagcttctgc

SEQ ID NO: 1822828 - DNA, 13 bp, Homo sapiens
tgacccttcaggg

SEQ ID NO: 1822829 - DNA, 19 bp, Homo sapiens
tgacggtttatgctgggca

SEQ ID NO: 1822830 - DNA, 23 bp, Homo sapiens
tgactccagagtctgagcccccg

SEQ ID NO: 1822831 - DNA, 23 bp, Homo sapiens
tgactcctgaaggtttcctggtc

SEQ ID NO: 1822832 - DNA, 17 bp, Homo sapiens
tgactcgggctcctgtg

SEQ ID NO: 1822833 - DNA, 18 bp, Homo sapiens
tgactcgggctcctgtgc

SEQ ID NO: 1822834 - DNA, 18 bp, Homo sapiens
tgactgaaggggcacacc

SEQ ID NO: 1822835 - DNA, 21 bp, Homo sapiens
tgactggcaggtgcagatggg

SEQ ID NO: 1822836 - DNA, 18 bp, Homo sapiens
tgacttcaggggctgccc

SEQ ID NO: 1822837 - DNA, 22 bp, Homo sapiens
tgacttcaggggctgcccgctc

SEQ ID NO: 1822838 - DNA, 21 bp, Homo sapiens
tgacttcaggtggagagcact

SEQ ID NO: 1822839 - DNA, 18 bp, Homo sapiens
tgagaaatacagaagaaa

SEQ ID NO: 1822840 - DNA, 17 bp, Homo sapiens
tgagaaggcgaggagag

SEQ ID NO: 1822841 - DNA, 13 bp, Homo sapiens
tgagacaagccct

SEQ ID NO: 1822842 - DNA, 18 bp, Homo sapiens
tgagacaagccctggcaa

SEQ ID NO: 1822843 - DNA, 18 bp, Homo sapiens
tgagacattaatttgtac

SEQ ID NO: 1822844 - DNA, 13 bp, Homo sapiens
tgagactcttaaa

SEQ ID NO: 1822845 - DNA, 16 bp, Homo sapiens
tgagactcttaaatat

SEQ ID NO: 1822846 - DNA, 17 bp, Homo sapiens
tgagagaaaaagtgccc

SEQ ID NO: 1822847 - DNA, 20 bp, Homo sapiens
tgagagaaaaagtgcccctt

SEQ ID NO: 1822848 - DNA, 13 bp, Homo sapiens
tgagagaaaagaa

SEQ ID NO: 1822849 - DNA, 16 bp, Homo sapiens
tgagatggccatgctc

SEQ ID NO: 1822850 - DNA, 18 bp, Homo sapiens
tgagatttgccagcacag

SEQ ID NO: 1822851 - DNA, 20 bp, Homo sapiens
tgagatttgccagcacaggg

SEQ ID NO: 1822852 - DNA, 22 bp, Homo sapiens
tgagatttgccagcacaggggc

SEQ ID NO: 1822853 - DNA, 18 bp, Homo sapiens
tgagcacaaaatttggtc

SEQ ID NO: 1822854 - DNA, 14 bp, Homo sapiens
tgagcattcaggca

SEQ ID NO: 1822855 - DNA, 22 bp, Homo sapiens
tgagcccaggagtttgagacaa

SEQ ID NO: 1822856 - DNA, 14 bp, Homo sapiens
tgagcccaggccgt

SEQ ID NO: 1822857 - DNA, 16 bp, Homo sapiens
tgagcccctccccagc

SEQ ID NO: 1822858 - DNA, 17 bp, Homo sapiens
tgagcccctccccagcc

SEQ ID NO: 1822859 - DNA, 22 bp, Homo sapiens
tgagcccctccccagccagccc

SEQ ID NO: 1822860 - DNA, 12 bp, Homo sapiens
tgagctggggcc

SEQ ID NO: 1822861 - DNA, 20 bp, Homo sapiens
tgagcttagccttgtgccct

SEQ ID NO: 1822862 - DNA, 22 bp, Homo sapiens
tgagcttagccttgtgccctgc

SEQ ID NO: 1822863 - DNA, 17 bp, Homo sapiens
tgaggaagagggactgt

SEQ ID NO: 1822864 - DNA, 16 bp, Homo sapiens
tgaggacacatgtcca

SEQ ID NO: 1822865 - DNA, 13 bp, Homo sapiens
tgaggagggtgga

SEQ ID NO: 1822866 - DNA, 17 bp, Homo sapiens
tgaggagggtggaggaa

SEQ ID NO: 1822867 - DNA, 14 bp, Homo sapiens
tgaggcttccaggc

SEQ ID NO: 1822868 - DNA, 15 bp, Homo sapiens
tgaggcttccaggct

SEQ ID NO: 1822869 - DNA, 16 bp, Homo sapiens
tgaggcttccaggctc

SEQ ID NO: 1822870 - DNA, 20 bp, Homo sapiens
tgaggcttccaggctcttcc

SEQ ID NO: 1822871 - DNA, 19 bp, Homo sapiens
tgagggagggggcgctcag

SEQ ID NO: 1822872 - DNA, 19 bp, Homo sapiens
tgagggcagtggggagcat

SEQ ID NO: 1822873 - DNA, 18 bp, Homo sapiens
tgaggtctcgctgatgct

SEQ ID NO: 1822874 - DNA, 18 bp, Homo sapiens
tgaggtgaaatgggagat

SEQ ID NO: 1822875 - DNA, 22 bp, Homo sapiens
tgagtaaaccctatctgtgatt

SEQ ID NO: 1822876 - DNA, 16 bp, Homo sapiens
tgagtacagtgaggag

SEQ ID NO: 1822877 - DNA, 21 bp, Homo sapiens
tgagtacagtgaggagggtgg

SEQ ID NO: 1822878 - DNA, 12 bp, Homo sapiens
tgagtagcatat

SEQ ID NO: 1822879 - DNA, 13 bp, Homo sapiens
tgagtcacaaaat

SEQ ID NO: 1822880 - DNA, 22 bp, Homo sapiens
tgagtcacaaaataaagctgtg

SEQ ID NO: 1822881 - DNA, 19 bp, Homo sapiens
tgagtcggccccacatggg

SEQ ID NO: 1822882 - DNA, 23 bp, Homo sapiens
tgagtcggccccacatgggaacc

SEQ ID NO: 1822883 - DNA, 18 bp, Homo sapiens
tgagtggaatgcagggaa

SEQ ID NO: 1822884 - DNA, 20 bp, Homo sapiens
tgagtggcagccatgcctca

SEQ ID NO: 1822885 - DNA, 22 bp, Homo sapiens
tgagtgtgggagtgcagagaaa

SEQ ID NO: 1822886 - DNA, 23 bp, Homo sapiens
tgcccatgggcactgctgggtgg

SEQ ID NO: 1822887 - DNA, 21 bp, Homo sapiens
tgcccatttcgaagatataca

SEQ ID NO: 1822888 - DNA, 20 bp, Homo sapiens
tgccccaacccccagcaccc

SEQ ID NO: 1822889 - DNA, 14 bp, Homo sapiens
tgcccccatccctc

SEQ ID NO: 1822890 - DNA, 17 bp, Homo sapiens
tgcccccatctccccag

SEQ ID NO: 1822891 - DNA, 18 bp, Homo sapiens
tgcccccatctccccagg

SEQ ID NO: 1822892 - DNA, 12 bp, Homo sapiens
tgccccccatcc

SEQ ID NO: 1822893 - DNA, 13 bp, Homo sapiens
tgccccccatcct

SEQ ID NO: 1822894 - DNA, 14 bp, Homo sapiens
tgccccccatcctg

SEQ ID NO: 1822895 - DNA, 17 bp, Homo sapiens
tgccccccatcctggcc

SEQ ID NO: 1822896 - DNA, 14 bp, Homo sapiens
tgccccctgccagt

SEQ ID NO: 1822897 - DNA, 18 bp, Homo sapiens
tgccccctgccagtgaag

SEQ ID NO: 1822898 - DNA, 23 bp, Homo sapiens
tgccccgtcggactgcccccaga

SEQ ID NO: 1822899 - DNA, 23 bp, Homo sapiens
tgccccgttccctgtcagaggct

SEQ ID NO: 1822900 - DNA, 23 bp, Homo sapiens
tgcccctgtctggaagacgtggc

SEQ ID NO: 1822901 - DNA, 13 bp, Homo sapiens
tgccccttgggca

SEQ ID NO: 1822902 - DNA, 18 bp, Homo sapiens
tgccccttgggcatccac

SEQ ID NO: 1822903 - DNA, 21 bp, Homo sapiens
tgccccttgggcatccaccca

SEQ ID NO: 1822904 - DNA, 13 bp, Homo sapiens
tgcccgctcccag

SEQ ID NO: 1822905 - DNA, 17 bp, Homo sapiens
tgcccgctcccagtgtc

SEQ ID NO: 1822906 - DNA, 22 bp, Homo sapiens
tgcccggcgccctctgtcctga

SEQ ID NO: 1822907 - DNA, 17 bp, Homo sapiens
tgccctgccacctgtct

SEQ ID NO: 1822908 - DNA, 21 bp, Homo sapiens
tgccctgccacctgtctgtct

SEQ ID NO: 1822909 - DNA, 22 bp, Homo sapiens
tgccctgccacctgtctgtctg

SEQ ID NO: 1822910 - DNA, 18 bp, Homo sapiens
tgccgccgcctcgcccac

SEQ ID NO: 1822911 - DNA, 20 bp, Homo sapiens
tgccgccgcctcgcccaccg

SEQ ID NO: 1822912 - DNA, 21 bp, Homo sapiens
tgccgccgcctcgcccaccgc

SEQ ID NO: 1822913 - DNA, 14 bp, Homo sapiens
tgcctagaaagcaa

SEQ ID NO: 1822914 - DNA, 19 bp, Homo sapiens
tgcctccactcccacttcc

SEQ ID NO: 1822915 - DNA, 20 bp, Homo sapiens
tgcctccactcccacttccc

SEQ ID NO: 1822916 - DNA, 14 bp, Homo sapiens
tgcctcgaggcacc

SEQ ID NO: 1822917 - DNA, 13 bp, Homo sapiens
tgcctcggctcct

SEQ ID NO: 1822918 - DNA, 14 bp, Homo sapiens
tgcctcggctcctg

SEQ ID NO: 1822919 - DNA, 15 bp, Homo sapiens
tgcctcggctcctgc

SEQ ID NO: 1822920 - DNA, 21 bp, Homo sapiens
tgcctcggctcctgctgcacc

SEQ ID NO: 1822921 - DNA, 16 bp, Homo sapiens
tgcctgcaccaggaga

SEQ ID NO: 1822922 - DNA, 18 bp, Homo sapiens
tgcctgcaccaggagaca

SEQ ID NO: 1822923 - DNA, 19 bp, Homo sapiens
tgcctgcaccaggagacag

SEQ ID NO: 1822924 - DNA, 12 bp, Homo sapiens
tgcctgctagag

SEQ ID NO: 1822925 - DNA, 22 bp, Homo sapiens
tggcaagcagggaaagctccac

SEQ ID NO: 1822926 - DNA, 13 bp, Homo sapiens
tggcaatgagtgt

SEQ ID NO: 1822927 - DNA, 19 bp, Homo sapiens
tggcaatgagtgtgccaga

SEQ ID NO: 1822928 - DNA, 21 bp, Homo sapiens
tggcacagacttctggaaggc

SEQ ID NO: 1822929 - DNA, 13 bp, Homo sapiens
tggcaccagcccc

SEQ ID NO: 1822930 - DNA, 15 bp, Homo sapiens
tggcaccagccccct

SEQ ID NO: 1822931 - DNA, 17 bp, Homo sapiens
tggcaccagccccctgg

SEQ ID NO: 1822932 - DNA, 14 bp, Homo sapiens
tggcacccccatgc

SEQ ID NO: 1822933 - DNA, 15 bp, Homo sapiens
tggcacccccatgct

SEQ ID NO: 1822934 - DNA, 16 bp, Homo sapiens
tggcacccccatgctg

SEQ ID NO: 1822935 - DNA, 19 bp, Homo sapiens
tggcacctcctgagaaggc

SEQ ID NO: 1822936 - DNA, 17 bp, Homo sapiens
tggcagaaaagaggaga

SEQ ID NO: 1822937 - DNA, 23 bp, Homo sapiens
tggcagagaaggcctcttgtgct

SEQ ID NO: 1822938 - DNA, 17 bp, Homo sapiens
tggcagcaggtgctgct

SEQ ID NO: 1822939 - DNA, 20 bp, Homo sapiens
tggcagcaggtgctgctacc

SEQ ID NO: 1822940 - DNA, 21 bp, Homo sapiens
tggcagcaggtgctgctaccc

SEQ ID NO: 1822941 - DNA, 20 bp, Homo sapiens
tggcagccatgcctcatgcc

SEQ ID NO: 1822942 - DNA, 17 bp, Homo sapiens
tggcagctagactggag

SEQ ID NO: 1822943 - DNA, 20 bp, Homo sapiens
tggcagctagactggagtga

SEQ ID NO: 1822944 - DNA, 16 bp, Homo sapiens
tggcagctcctctcct

SEQ ID NO: 1822945 - DNA, 19 bp, Homo sapiens
tggcaggacacatcccggc

SEQ ID NO: 1822946 - DNA, 20 bp, Homo sapiens
tggcaggtgcagatgggctg

SEQ ID NO: 1822947 - DNA, 23 bp, Homo sapiens
tggcatcgtagaagagatgtggc

SEQ ID NO: 1822948 - DNA, 20 bp, Homo sapiens
tggcatttagtaccttcaaa

SEQ ID NO: 1822949 - DNA, 21 bp, Homo sapiens
tggcatttagtaccttcaaat

SEQ ID NO: 1822950 - DNA, 22 bp, Homo sapiens
tggcatttagtaccttcaaata

SEQ ID NO: 1822951 - DNA, 21 bp, Homo sapiens
tggccagagagggcccagctg

SEQ ID NO: 1822952 - DNA, 13 bp, Homo sapiens
tggccagagctgg

SEQ ID NO: 1822953 - DNA, 16 bp, Homo sapiens
tggccagccccacagc

SEQ ID NO: 1822954 - DNA, 12 bp, Homo sapiens
tggcccatcagt

SEQ ID NO: 1822955 - DNA, 17 bp, Homo sapiens
tggcccatcccccctca

SEQ ID NO: 1822956 - DNA, 20 bp, Homo sapiens
tggcccatcccccctcacca

SEQ ID NO: 1822957 - DNA, 12 bp, Homo sapiens
tggccccagcct

SEQ ID NO: 1822958 - DNA, 16 bp, Homo sapiens
tggccccagcctggcc

SEQ ID NO: 1822959 - DNA, 18 bp, Homo sapiens
tggccccagcctggccca

SEQ ID NO: 1822960 - DNA, 20 bp, Homo sapiens
tggccccagcctggcccagc

SEQ ID NO: 1822961 - DNA, 12 bp, Homo sapiens
tggcccccctcc

SEQ ID NO: 1822962 - DNA, 17 bp, Homo sapiens
tggcccccctccaggca

SEQ ID NO: 1822963 - DNA, 23 bp, Homo sapiens
tggcccccctccaggcatgctgg

SEQ ID NO: 1822964 - DNA, 15 bp, Homo sapiens
tggcctcactggctg

SEQ ID NO: 1822965 - DNA, 19 bp, Homo sapiens
tggcctcactggctggggc

SEQ ID NO: 1822966 - DNA, 23 bp, Homo sapiens
tggcctcactggctggggcagag

SEQ ID NO: 1822967 - DNA, 18 bp, Homo sapiens
tggcctcccaataaagct

SEQ ID NO: 1822968 - DNA, 20 bp, Homo sapiens
tggcctcccaataaagctgg

SEQ ID NO: 1822969 - DNA, 22 bp, Homo sapiens
tggcctcccaataaagctggac

SEQ ID NO: 1822970 - DNA, 17 bp, Homo sapiens
tggcctcgcctggcctg

SEQ ID NO: 1822971 - DNA, 12 bp, Homo sapiens
tggcctgctggg

SEQ ID NO: 1822972 - DNA, 13 bp, Homo sapiens
tggcctgctggga

SEQ ID NO: 1822973 - DNA, 22 bp, Homo sapiens
tggcctgctgggaaccccgcag

SEQ ID NO: 1822974 - DNA, 23 bp, Homo sapiens
tggccttccccttttgcctggct

SEQ ID NO: 1822975 - DNA, 13 bp, Homo sapiens
tggcgcaccctcc

SEQ ID NO: 1822976 - DNA, 15 bp, Homo sapiens
tggcgtaatgggcct

SEQ ID NO: 1822977 - DNA, 20 bp, Homo sapiens
tggcgtaatgggcctgccca

SEQ ID NO: 1822978 - DNA, 13 bp, Homo sapiens
tggctcaggcaag

SEQ ID NO: 1822979 - DNA, 21 bp, Homo sapiens
tggctcaggcaagcccctcag

SEQ ID NO: 1822980 - DNA, 14 bp, Homo sapiens
tggctctcaagtga

SEQ ID NO: 1822981 - DNA, 18 bp, Homo sapiens
tggctctcaagtgaaaga

SEQ ID NO: 1822982 - DNA, 13 bp, Homo sapiens
tggctgaagacat

SEQ ID NO: 1822983 - DNA, 20 bp, Homo sapiens
tggctgagtggaatgcaggg

SEQ ID NO: 1822984 - DNA, 12 bp, Homo sapiens
tggctgccaggc

SEQ ID NO: 1822985 - DNA, 16 bp, Homo sapiens
tggctgcctccactcc

SEQ ID NO: 1822986 - DNA, 20 bp, Homo sapiens
tggctgcctccactcccact

SEQ ID NO: 1822987 - DNA, 18 bp, Homo sapiens
tggctgcgctaaccccca

SEQ ID NO: 1822988 - DNA, 19 bp, Homo sapiens
tggctgcgctaacccccag

SEQ ID NO: 1822989 - DNA, 15 bp, Homo sapiens
tggctggggcagagg

SEQ ID NO: 1822990 - DNA, 17 bp, Homo sapiens
tggctgtccagtgccca

SEQ ID NO: 1822991 - DNA, 18 bp, Homo sapiens
tggctgtccagtgcccat

SEQ ID NO: 1822992 - DNA, 23 bp, Homo sapiens
tggctgtccagtgcccattcctc

SEQ ID NO: 1822993 - DNA, 13 bp, Homo sapiens
tggcttgctccag

SEQ ID NO: 1822994 - DNA, 15 bp, Homo sapiens
tggcttgctccaggg

SEQ ID NO: 1822995 - DNA, 20 bp, Homo sapiens
tgggaaccccgcagcccgtg

SEQ ID NO: 1822996 - DNA, 21 bp, Homo sapiens
tggggctcgtggccttcccct

SEQ ID NO: 1822997 - DNA, 18 bp, Homo sapiens
tgggggaagagcacagcc

SEQ ID NO: 1822998 - DNA, 18 bp, Homo sapiens
tgggggcagtgactggca

SEQ ID NO: 1822999 - DNA, 19 bp, Homo sapiens
tgggggcagtgactggcag

SEQ ID NO: 1823000 - DNA, 14 bp, Homo sapiens
tgggggtctgtgtg

SEQ ID NO: 1823001 - DNA, 15 bp, Homo sapiens
tgggggtctgtgtgt

SEQ ID NO: 1823002 - DNA, 18 bp, Homo sapiens
tgggggtctgtgtgttta

SEQ ID NO: 1823003 - DNA, 17 bp, Homo sapiens
tgggtaacttagaagga

SEQ ID NO: 1823004 - DNA, 18 bp, Homo sapiens
tgggtccaggaaggcagc

SEQ ID NO: 1823005 - DNA, 20 bp, Homo sapiens
tgggtcccacttcccctcct

SEQ ID NO: 1823006 - DNA, 17 bp, Homo sapiens
tgggtgccattcccagc

SEQ ID NO: 1823007 - DNA, 16 bp, Homo sapiens
tgggtggcacctcctg

SEQ ID NO: 1823008 - DNA, 21 bp, Homo sapiens
tgggtggcccatcccccctca

SEQ ID NO: 1823009 - DNA, 22 bp, Homo sapiens
tgggttggcgcaccctcccctc

SEQ ID NO: 1823010 - DNA, 18 bp, Homo sapiens
tggtaaacattcctccag

SEQ ID NO: 1823011 - DNA, 15 bp, Homo sapiens
tggtaccaggtctcc

SEQ ID NO: 1823012 - DNA, 18 bp, Homo sapiens
tggtactgcacattttgt

SEQ ID NO: 1823013 - DNA, 20 bp, Homo sapiens
tggtaggaactgctgggctt

SEQ ID NO: 1823014 - DNA, 17 bp, Homo sapiens
tggtaggaagcctgagg

SEQ ID NO: 1823015 - DNA, 19 bp, Homo sapiens
tggtatgaacttgaggaca

SEQ ID NO: 1823016 - DNA, 22 bp, Homo sapiens
tggtatgaacttgaggacacat

SEQ ID NO: 1823017 - DNA, 23 bp, Homo sapiens
tggtatgaacttgaggacacatg

SEQ ID NO: 1823018 - DNA, 17 bp, Homo sapiens
tggtcagtgtggagagg

SEQ ID NO: 1823019 - DNA, 23 bp, Homo sapiens
tggtcccaagtagtagtgtcttc

SEQ ID NO: 1823020 - DNA, 23 bp, Homo sapiens
tggtccctcgtccacaggggcag

SEQ ID NO: 1823021 - DNA, 19 bp, Homo sapiens
tggtctgctcgggcccagg

SEQ ID NO: 1823022 - DNA, 15 bp, Homo sapiens
tggtgcagccttccc

SEQ ID NO: 1823023 - DNA, 21 bp, Homo sapiens
tggtgcctgattcggctgtct

SEQ ID NO: 1823024 - DNA, 22 bp, Homo sapiens
tggtggcagtaacatgcaacaa

SEQ ID NO: 1823025 - DNA, 13 bp, Homo sapiens
tggtgtgtcatgc

SEQ ID NO: 1823026 - DNA, 15 bp, Homo sapiens
tgtaaaaatactgtt

SEQ ID NO: 1823027 - DNA, 17 bp, Homo sapiens
tgtaaaaatgaaggaat

SEQ ID NO: 1823028 - DNA, 15 bp, Homo sapiens
tgtaaagaataaatg

SEQ ID NO: 1823029 - DNA, 20 bp, Homo sapiens
tgtaaagaataaatgaatct

SEQ ID NO: 1823030 - DNA, 17 bp, Homo sapiens
tgtaagcaacttgcttc

SEQ ID NO: 1823031 - DNA, 21 bp, Homo sapiens
tgtaagcaacttgcttctaaa

SEQ ID NO: 1823032 - DNA, 14 bp, Homo sapiens
tgtaagtttgcata

SEQ ID NO: 1823033 - DNA, 20 bp, Homo sapiens
tgtaatactgtagaaatatt

SEQ ID NO: 1823034 - DNA, 20 bp, Homo sapiens
tgtaatataatgagtcacaa

SEQ ID NO: 1823035 - DNA, 21 bp, Homo sapiens
tgtaatataatgagtcacaaa

SEQ ID NO: 1823036 - DNA, 18 bp, Homo sapiens
tgtaatgggatctatttt

SEQ ID NO: 1823037 - DNA, 18 bp, Homo sapiens
tgtaatttaaaattgtga

SEQ ID NO: 1823038 - DNA, 17 bp, Homo sapiens
tgtacccccgcccaggc

SEQ ID NO: 1823039 - DNA, 14 bp, Homo sapiens
tgtacctctgcctc

SEQ ID NO: 1823040 - DNA, 14 bp, Homo sapiens
tgtactcagagcag

SEQ ID NO: 1823041 - DNA, 17 bp, Homo sapiens
tgtactgatactattca

SEQ ID NO: 1823042 - DNA, 21 bp, Homo sapiens
tgtactgatactattcaatgc

SEQ ID NO: 1823043 - DNA, 16 bp, Homo sapiens
tgtagccatggctcag

SEQ ID NO: 1823044 - DNA, 16 bp, Homo sapiens
tgtagcctatgtcttg

SEQ ID NO: 1823045 - DNA, 23 bp, Homo sapiens
tgtagccttgccttttaaaagaa

SEQ ID NO: 1823046 - DNA, 18 bp, Homo sapiens
tgtagtggaagagcagcc

SEQ ID NO: 1823047 - DNA, 19 bp, Homo sapiens
tgtagtggaagagcagcct

SEQ ID NO: 1823048 - DNA, 19 bp, Homo sapiens
tgtataagacactttgcca

SEQ ID NO: 1823049 - DNA, 12 bp, Homo sapiens
tgtatgtggggg

SEQ ID NO: 1823050 - DNA, 23 bp, Homo sapiens
tgtattatttctggctttttgaa

SEQ ID NO: 1823051 - DNA, 21 bp, Homo sapiens
tgtattgaatattttattaaa

SEQ ID NO: 1823052 - DNA, 17 bp, Homo sapiens
tgtattttgacaaaaat

SEQ ID NO: 1823053 - DNA, 19 bp, Homo sapiens
tgtcaataactttatatga

SEQ ID NO: 1823054 - DNA, 17 bp, Homo sapiens
tgtcactggctgcctcc

SEQ ID NO: 1823055 - DNA, 12 bp, Homo sapiens
tgtcagaaactc

SEQ ID NO: 1823056 - DNA, 20 bp, Homo sapiens
tgtcagtatgtggaagtgtg

SEQ ID NO: 1823057 - DNA, 22 bp, Homo sapiens
tgtcagtatgtggaagtgtggg

SEQ ID NO: 1823058 - DNA, 16 bp, Homo sapiens
tgtcagtgccgccgcc

SEQ ID NO: 1823059 - DNA, 13 bp, Homo sapiens
tgtcatcactccc

SEQ ID NO: 1823060 - DNA, 18 bp, Homo sapiens
tgtcatcactccctggat

SEQ ID NO: 1823061 - DNA, 20 bp, Homo sapiens
tgtcatcactccctggatgt

SEQ ID NO: 1823062 - DNA, 15 bp, Homo sapiens
tgtgcggtgcataca

SEQ ID NO: 1823063 - DNA, 14 bp, Homo sapiens
tgtgcgttcaaacc

SEQ ID NO: 1823064 - DNA, 14 bp, Homo sapiens
tgtgctcacgctcc

SEQ ID NO: 1823065 - DNA, 21 bp, Homo sapiens
tgtgctcacgctcccccgcag

SEQ ID NO: 1823066 - DNA, 13 bp, Homo sapiens
tgtggccagagct

SEQ ID NO: 1823067 - DNA, 14 bp, Homo sapiens
tgtggccagagctg

SEQ ID NO: 1823068 - DNA, 15 bp, Homo sapiens
tgtgggagtgtgtaa

SEQ ID NO: 1823069 - DNA, 16 bp, Homo sapiens
tgtgggctgcactctg

SEQ ID NO: 1823070 - DNA, 22 bp, Homo sapiens
tgtgggctgcactctgtgccca

SEQ ID NO: 1823071 - DNA, 16 bp, Homo sapiens
tgtgggggtctgtgtg

SEQ ID NO: 1823072 - DNA, 21 bp, Homo sapiens
tgtgtaaacctaattgtggta

SEQ ID NO: 1823073 - DNA, 18 bp, Homo sapiens
tgtgtgaattctgcaact

SEQ ID NO: 1823074 - DNA, 12 bp, Homo sapiens
tgtgtgtgggag

SEQ ID NO: 1823075 - DNA, 20 bp, Homo sapiens
tgtgtgtgggagtgtgtaat

SEQ ID NO: 1823076 - DNA, 14 bp, Homo sapiens
tgtgtgtgtatgtg

SEQ ID NO: 1823077 - DNA, 13 bp, Homo sapiens
tgttaactgtctt

SEQ ID NO: 1823078 - DNA, 22 bp, Homo sapiens
tgttaccttttaaaatagtaat

SEQ ID NO: 1823079 - DNA, 20 bp, Homo sapiens
tgttaggcctggcacagtgt

SEQ ID NO: 1823080 - DNA, 21 bp, Homo sapiens
tgttaggcctggcacagtgtc

SEQ ID NO: 1823081 - DNA, 15 bp, Homo sapiens
tgttataaataaaat

SEQ ID NO: 1823082 - DNA, 12 bp, Homo sapiens
tgttatttggaa

SEQ ID NO: 1823083 - DNA, 15 bp, Homo sapiens
tgttcaaaaatttct

SEQ ID NO: 1823084 - DNA, 14 bp, Homo sapiens
tgttccctgcaccc

SEQ ID NO: 1823085 - DNA, 15 bp, Homo sapiens
tgttcccttgaccat

SEQ ID NO: 1823086 - DNA, 21 bp, Homo sapiens
tgttctgtccagtttccaaag

SEQ ID NO: 1823087 - DNA, 14 bp, Homo sapiens
tgttgcacatcatt

SEQ ID NO: 1823088 - DNA, 15 bp, Homo sapiens
tgttgcacatcattc

SEQ ID NO: 1823089 - DNA, 16 bp, Homo sapiens
tgttgcacatcattca

SEQ ID NO: 1823090 - DNA, 23 bp, Homo sapiens
tgttgctcagcaaggggctctgc

SEQ ID NO: 1823091 - DNA, 14 bp, Homo sapiens
tgttgtgtgtggga

SEQ ID NO: 1823092 - DNA, 14 bp, Homo sapiens
tgtttacagaggac

SEQ ID NO: 1823093 - DNA, 19 bp, Homo sapiens
tgtttagaactactgataa

SEQ ID NO: 1823094 - DNA, 19 bp, Homo sapiens
tgtttagaagaagtgtgtc

SEQ ID NO: 1823095 - DNA, 19 bp, Homo sapiens
tgtttctatttccataagg

SEQ ID NO: 1823096 - DNA, 17 bp, Homo sapiens
tgtttggggaagttcaa

SEQ ID NO: 1823097 - DNA, 16 bp, Homo sapiens
ttaaaaaatcaaaagg

SEQ ID NO: 1823098 - DNA, 18 bp, Homo sapiens
ttaaaatgcatatttcta

SEQ ID NO: 1823099 - DNA, 12 bp, Homo sapiens
ttaaatcatttt

SEQ ID NO: 1823100 - DNA, 15 bp, Homo sapiens
ttaaatcattttcat

SEQ ID NO: 1823101 - DNA, 19 bp, Homo sapiens
ttaaatcattttcattaaa

SEQ ID NO: 1823102 - DNA, 14 bp, Homo sapiens
ttaaatctgacagt

SEQ ID NO: 1823103 - DNA, 20 bp, Homo sapiens
ttaaatctgacagtctcaaa

SEQ ID NO: 1823104 - DNA, 22 bp, Homo sapiens
ttaaatgttgcacatcattcat

SEQ ID NO: 1823105 - DNA, 14 bp, Homo sapiens
ttaaatttacagaa

SEQ ID NO: 1823106 - DNA, 12 bp, Homo sapiens
ttaactcagtct

SEQ ID NO: 1823107 - DNA, 12 bp, Homo sapiens
ttaagaggcttt

SEQ ID NO: 1823108 - DNA, 14 bp, Homo sapiens
ttaaggcagtgact

SEQ ID NO: 1823109 - DNA, 16 bp, Homo sapiens
ttaagtggatctgttt

SEQ ID NO: 1823110 - DNA, 18 bp, Homo sapiens
ttaatacagattgaaagg

SEQ ID NO: 1823111 - DNA, 14 bp, Homo sapiens
ttaatactgtgtta

SEQ ID NO: 1823112 - DNA, 14 bp, Homo sapiens
ttaatatctgagaa

SEQ ID NO: 1823113 - DNA, 22 bp, Homo sapiens
ttaatatctgagaagtgtatat

SEQ ID NO: 1823114 - DNA, 17 bp, Homo sapiens
ttaatatttttcaaaat

SEQ ID NO: 1823115 - DNA, 20 bp, Homo sapiens
ttaatatttttcaaaatcaa

SEQ ID NO: 1823116 - DNA, 18 bp, Homo sapiens
ttaatctcacttcatcaa

SEQ ID NO: 1823117 - DNA, 23 bp, Homo sapiens
ttaatgaagacccagtgtaaaga

SEQ ID NO: 1823118 - DNA, 10 bp, Homo sapiens
ttaattgcaa

SEQ ID NO: 1823119 - DNA, 15 bp, Homo sapiens
ttaattttctatgaa

SEQ ID NO: 1823120 - DNA, 12 bp, Homo sapiens
ttacaactaaat

SEQ ID NO: 1823121 - DNA, 15 bp, Homo sapiens
ttacaactaaataac

SEQ ID NO: 1823122 - DNA, 15 bp, Homo sapiens
ttacacttggagccc

SEQ ID NO: 1823123 - DNA, 18 bp, Homo sapiens
ttacagtatcttcaaaaa

SEQ ID NO: 1823124 - DNA, 21 bp, Homo sapiens
ttacagtatcttcaaaaatac

SEQ ID NO: 1823125 - DNA, 17 bp, Homo sapiens
ttacattttcctgtgta

SEQ ID NO: 1823126 - DNA, 21 bp, Homo sapiens
ttgctctaattcttttcaaaa

SEQ ID NO: 1823127 - DNA, 22 bp, Homo sapiens
ttgctctaattcttttcaaaat

SEQ ID NO: 1823128 - DNA, 19 bp, Homo sapiens
ttgctggaatctactagaa

SEQ ID NO: 1823129 - DNA, 21 bp, Homo sapiens
ttgctggcaatgagtgtgcca

SEQ ID NO: 1823130 - DNA, 21 bp, Homo sapiens
ttgcttctaggagtcaactgg

SEQ ID NO: 1823131 - DNA, 20 bp, Homo sapiens
ttgctttgggctttgcaggc

SEQ ID NO: 1823132 - DNA, 23 bp, Homo sapiens
ttgctttgggctttgcaggctct

SEQ ID NO: 1823133 - DNA, 14 bp, Homo sapiens
ttggaattttcttt

SEQ ID NO: 1823134 - DNA, 23 bp, Homo sapiens
ttggaattttctttcatacatta

SEQ ID NO: 1823135 - DNA, 20 bp, Homo sapiens
ttggagccactcctgtcccg

SEQ ID NO: 1823136 - DNA, 19 bp, Homo sapiens
ttggatctccaattgcctc

SEQ ID NO: 1823137 - DNA, 12 bp, Homo sapiens
ttggcaccccca

SEQ ID NO: 1823138 - DNA, 20 bp, Homo sapiens
ttggcacccccatgctgcct

SEQ ID NO: 1823139 - DNA, 17 bp, Homo sapiens
ttggcagagaaggcctc

SEQ ID NO: 1823140 - DNA, 18 bp, Homo sapiens
ttggcagcaggtgctgct

SEQ ID NO: 1823141 - DNA, 22 bp, Homo sapiens
ttggcagcaggtgctgctaccc

SEQ ID NO: 1823142 - DNA, 16 bp, Homo sapiens
ttggcagctctactct

SEQ ID NO: 1823143 - DNA, 13 bp, Homo sapiens
ttggcccaatgcc

SEQ ID NO: 1823144 - DNA, 19 bp, Homo sapiens
ttggcgcaccctcccctcc

SEQ ID NO: 1823145 - DNA, 16 bp, Homo sapiens
ttgggaggccaaggca

SEQ ID NO: 1823146 - DNA, 23 bp, Homo sapiens
ttgggcatccacccagtgctgcc

SEQ ID NO: 1823147 - DNA, 20 bp, Homo sapiens
ttgggctcctggctgccagg

SEQ ID NO: 1823148 - DNA, 23 bp, Homo sapiens
ttgggctgacacctaccatgctg

SEQ ID NO: 1823149 - DNA, 13 bp, Homo sapiens
ttggggcctggct

SEQ ID NO: 1823150 - DNA, 15 bp, Homo sapiens
ttggggcctggcttg

SEQ ID NO: 1823151 - DNA, 16 bp, Homo sapiens
ttgtaatataatgagt

SEQ ID NO: 1823152 - DNA, 18 bp, Homo sapiens
ttgtaattattgtgattt

SEQ ID NO: 1823153 - DNA, 18 bp, Homo sapiens
ttgtacaaagatatgcta

SEQ ID NO: 1823154 - DNA, 12 bp, Homo sapiens
ttgtacattatg

SEQ ID NO: 1823155 - DNA, 13 bp, Homo sapiens
ttgtactttttaa

SEQ ID NO: 1823156 - DNA, 19 bp, Homo sapiens
ttgtatggctctcaagtga

SEQ ID NO: 1823157 - DNA, 15 bp, Homo sapiens
ttgtattttgacaaa

SEQ ID NO: 1823158 - DNA, 18 bp, Homo sapiens
ttgtccctgaagagaagg

SEQ ID NO: 1823159 - DNA, 15 bp, Homo sapiens
ttgtccttcagagct

SEQ ID NO: 1823160 - DNA, 17 bp, Homo sapiens
ttgtctattctgagcct

SEQ ID NO: 1823161 - DNA, 17 bp, Homo sapiens
ttgtctccctggccctc

SEQ ID NO: 1823162 - DNA, 18 bp, Homo sapiens
ttgtctccctggccctca

SEQ ID NO: 1823163 - DNA, 13 bp, Homo sapiens
ttgtctgaggcct

SEQ ID NO: 1823164 - DNA, 19 bp, Homo sapiens
ttgtctgaggcctcatccc

SEQ ID NO: 1823165 - DNA, 22 bp, Homo sapiens
ttgtctgtgttttcttcttgtg

SEQ ID NO: 1823166 - DNA, 14 bp, Homo sapiens
ttgtggtaaaaaga

SEQ ID NO: 1823167 - DNA, 10 bp, Homo sapiens
ttgtgtgtgg

SEQ ID NO: 1823168 - DNA, 16 bp, Homo sapiens
ttgtgtgtgggagtgt

SEQ ID NO: 1823169 - DNA, 14 bp, Homo sapiens
ttgttataaataaa

SEQ ID NO: 1823170 - DNA, 15 bp, Homo sapiens
ttgttatattgtcct

SEQ ID NO: 1823171 - DNA, 12 bp, Homo sapiens
ttgttgccaact

SEQ ID NO: 1823172 - DNA, 16 bp, Homo sapiens
tttaaaattgtgatgt

SEQ ID NO: 1823173 - DNA, 18 bp, Homo sapiens
tttaaatttacagaatat

SEQ ID NO: 1823174 - DNA, 20 bp, Homo sapiens
tttaagaggctttggcccaa

SEQ ID NO: 1823175 - DNA, 16 bp, Homo sapiens
tttaatatttttcaaa

SEQ ID NO: 1823176 - DNA, 17 bp, Homo sapiens
tttaatatttttcaaaa

SEQ ID NO: 1823177 - DNA, 22 bp, Homo sapiens
tttaatgaagacccagtgtaaa

SEQ ID NO: 1823178 - DNA, 19 bp, Homo sapiens
tttaattgcaacaatgcaa

SEQ ID NO: 1823179 - DNA, 18 bp, Homo sapiens
tttacatagttcttacta

SEQ ID NO: 1823180 - DNA, 16 bp, Homo sapiens
tttaccattaaaaagt

SEQ ID NO: 1823181 - DNA, 15 bp, Homo sapiens
tttacccctgcacag

SEQ ID NO: 1823182 - DNA, 16 bp, Homo sapiens
atctgcctggcctggc

SEQ ID NO: 1823183 - DNA, 19 bp, Homo sapiens
atctgcctggcctggctcc

SEQ ID NO: 1823184 - DNA, 16 bp, Homo sapiens
atctgcctgggcctgt

SEQ ID NO: 1823185 - DNA, 18 bp, Homo sapiens
atctgcctgggcctgtgc

SEQ ID NO: 1823186 - DNA, 15 bp, Homo sapiens
atctgctgttgccat

SEQ ID NO: 1823187 - DNA, 17 bp, Homo sapiens
atctgctgttgccatag

SEQ ID NO: 1823188 - DNA, 16 bp, Homo sapiens
atctgtacctctgcct

SEQ ID NO: 1823189 - DNA, 21 bp, Homo sapiens
atctgtcaaagaaaacttcca

SEQ ID NO: 1823190 - DNA, 15 bp, Homo sapiens
atctgtgattccccc

SEQ ID NO: 1823191 - DNA, 14 bp, Homo sapiens
atcttcaaaaatac

SEQ ID NO: 1823192 - DNA, 12 bp, Homo sapiens
atcttcctgctg

SEQ ID NO: 1823193 - DNA, 13 bp, Homo sapiens
atcttcctgctgc

SEQ ID NO: 1823194 - DNA, 15 bp, Homo sapiens
atcttcctgctgctg

SEQ ID NO: 1823195 - DNA, 12 bp, Homo sapiens
atctttcaatat

SEQ ID NO: 1823196 - DNA, 16 bp, Homo sapiens
atctttgaaagctgaa

SEQ ID NO: 1823197 - DNA, 21 bp, Homo sapiens
atgaaaacaaaattccattac

SEQ ID NO: 1823198 - DNA, 13 bp, Homo sapiens
atgaaaatgaata

SEQ ID NO: 1823199 - DNA, 13 bp, Homo sapiens
atgaacttgagga

SEQ ID NO: 1823200 - DNA, 16 bp, Homo sapiens
atgaacttgaggacac

SEQ ID NO: 1823201 - DNA, 13 bp, Homo sapiens
atgaactttaaaa

SEQ ID NO: 1823202 - DNA, 14 bp, Homo sapiens
atgaagaaagggag

SEQ ID NO: 1823203 - DNA, 20 bp, Homo sapiens
atgaagacccagtgtaaaga

SEQ ID NO: 1823204 - DNA, 23 bp, Homo sapiens
atgaagctgtttttgtgctcttt

SEQ ID NO: 1823205 - DNA, 18 bp, Homo sapiens
atgaaggcatatttccaa

SEQ ID NO: 1823206 - DNA, 20 bp, Homo sapiens
atgaaggcatatttccaata

SEQ ID NO: 1823207 - DNA, 17 bp, Homo sapiens
attaaatgttgcacatc

SEQ ID NO: 1823208 - DNA, 15 bp, Homo sapiens
attaacaactgtgaa

SEQ ID NO: 1823209 - DNA, 16 bp, Homo sapiens
attaacaactgtgaat

SEQ ID NO: 1823210 - DNA, 23 bp, Homo sapiens
attaacaactgtgaatatgagaa

SEQ ID NO: 1823211 - DNA, 17 bp, Homo sapiens
attaatctagaaaatga

SEQ ID NO: 1823212 - DNA, 20 bp, Homo sapiens
attaatctagaaaatgaaaa

SEQ ID NO: 1823213 - DNA, 13 bp, Homo sapiens
attaatctttcta

SEQ ID NO: 1823214 - DNA, 13 bp, Homo sapiens
attacattaaaat

SEQ ID NO: 1823215 - DNA, 22 bp, Homo sapiens
attagctacttttcagaattga

SEQ ID NO: 1823216 - DNA, 16 bp, Homo sapiens
attaggtttagaatca

SEQ ID NO: 1823217 - DNA, 15 bp, Homo sapiens
attagtattcaggca

SEQ ID NO: 1823218 - DNA, 20 bp, Homo sapiens
attagtattcaggcactgag

SEQ ID NO: 1823219 - DNA, 21 bp, Homo sapiens
attagtgccaagtttttcaga

SEQ ID NO: 1823220 - DNA, 23 bp, Homo sapiens
attagtgccaagtttttcagaaa

SEQ ID NO: 1823221 - DNA, 20 bp, Homo sapiens
attagtttgatttaatatct

SEQ ID NO: 1823222 - DNA, 22 bp, Homo sapiens
attagtttgatttaatatctga

SEQ ID NO: 1823223 - DNA, 18 bp, Homo sapiens
attatagtaaatctatga

SEQ ID NO: 1823224 - DNA, 14 bp, Homo sapiens
attatgttattgga

SEQ ID NO: 1823225 - DNA, 15 bp, Homo sapiens
attatgttattggaa

SEQ ID NO: 1823226 - DNA, 21 bp, Homo sapiens
attatgttattggaattttct

SEQ ID NO: 1823227 - DNA, 19 bp, Homo sapiens
attattgatcaaaatcaaa

SEQ ID NO: 1823228 - DNA, 21 bp, Homo sapiens
attattgatcaaaatcaaaag

SEQ ID NO: 1823229 - DNA, 21 bp, Homo sapiens
attatttctggctttttgaat

SEQ ID NO: 1823230 - DNA, 17 bp, Homo sapiens
attcaatgcaatgcaat

SEQ ID NO: 1823231 - DNA, 22 bp, Homo sapiens
attcaatgcaatgcaattcaat

SEQ ID NO: 1823232 - DNA, 17 bp, Homo sapiens
attcactgtatagtaat

SEQ ID NO: 1823233 - DNA, 18 bp, Homo sapiens
attcagcaccctgggtgc

SEQ ID NO: 1823234 - DNA, 20 bp, Homo sapiens
attcagcaccctgggtgcca

SEQ ID NO: 1823235 - DNA, 21 bp, Homo sapiens
attcagctcactggtttacaa

SEQ ID NO: 1823236 - DNA, 17 bp, Homo sapiens
attcaggcactgagaat

SEQ ID NO: 1823237 - DNA, 21 bp, Homo sapiens
attcatgccaaagcaaaagaa

SEQ ID NO: 1823238 - DNA, 16 bp, Homo sapiens
attcatgctttctcct

SEQ ID NO: 1823239 - DNA, 17 bp, Homo sapiens
attcatgctttctcctt

SEQ ID NO: 1823240 - DNA, 16 bp, Homo sapiens
attcattcactgtata

SEQ ID NO: 1823241 - DNA, 20 bp, Homo sapiens
attccactgaaatagagtga

SEQ ID NO: 1823242 - DNA, 23 bp, Homo sapiens
attccatgaccagaaacagggac

SEQ ID NO: 1823243 - DNA, 19 bp, Homo sapiens
attcccactaagctttctc

SEQ ID NO: 1823244 - DNA, 15 bp, Homo sapiens
attccgaagagggaa

SEQ ID NO: 1823245 - DNA, 15 bp, Homo sapiens
attcctccagcctcc

SEQ ID NO: 1823246 - DNA, 11 bp, Homo sapiens
attcctgggcc

SEQ ID NO: 1823247 - DNA, 16 bp, Homo sapiens
attcctttacaactaa

SEQ ID NO: 1823248 - DNA, 22 bp, Homo sapiens
attcctttacaactaaataaca

SEQ ID NO: 1823249 - DNA, 18 bp, Homo sapiens
attctaattcttcattat

SEQ ID NO: 1823250 - DNA, 20 bp, Homo sapiens
attctacacatatatgtata

SEQ ID NO: 1823251 - DNA, 15 bp, Homo sapiens
attctatgagaacaa

SEQ ID NO: 1823252 - DNA, 23 bp, Homo sapiens
attctcattggggttgcaacaat

SEQ ID NO: 1823253 - DNA, 17 bp, Homo sapiens
attctgagggaatttaa

SEQ ID NO: 1823254 - DNA, 20 bp, Homo sapiens
attctgagggaatttaacca

SEQ ID NO: 1823255 - DNA, 12 bp, Homo sapiens
attctgattcag

SEQ ID NO: 1823256 - DNA, 14 bp, Homo sapiens
attctgggaaggga

SEQ ID NO: 1823257 - DNA, 23 bp, Homo sapiens
attgaaaggacctcttctgaagc

SEQ ID NO: 1823258 - DNA, 13 bp, Homo sapiens
attgaatatcagt

SEQ ID NO: 1823259 - DNA, 16 bp, Homo sapiens
attgatcaaaatcaaa

SEQ ID NO: 1823260 - DNA, 18 bp, Homo sapiens
attgatcaaaatcaaaag

SEQ ID NO: 1823261 - DNA, 15 bp, Homo sapiens
attgattttaaatat

SEQ ID NO: 1823262 - DNA, 22 bp, Homo sapiens
attgattttaaatataagtaat

SEQ ID NO: 1823263 - DNA, 12 bp, Homo sapiens
attgcaaaacta

SEQ ID NO: 1823264 - DNA, 20 bp, Homo sapiens
attgcaaaactagacaaaag

SEQ ID NO: 1823265 - DNA, 13 bp, Homo sapiens
attgcaacaatgc

SEQ ID NO: 1823266 - DNA, 15 bp, Homo sapiens
attgcgagaattttc

SEQ ID NO: 1823267 - DNA, 17 bp, Homo sapiens
attgctctaattctttt

SEQ ID NO: 1823268 - DNA, 22 bp, Homo sapiens
attgctctaattcttttcaaaa

SEQ ID NO: 1823269 - DNA, 14 bp, Homo sapiens
attggaattttctt

SEQ ID NO: 1823270 - DNA, 22 bp, Homo sapiens
attgtattttagcagggtacat

SEQ ID NO: 1823271 - DNA, 15 bp, Homo sapiens
attgtccttcagagc

SEQ ID NO: 1823272 - DNA, 16 bp, Homo sapiens
attgtccttcagagct

SEQ ID NO: 1823273 - DNA, 18 bp, Homo sapiens
attgtccttcagagctct

SEQ ID NO: 1823274 - DNA, 19 bp, Homo sapiens
attgttaaaaaacaaccaa

SEQ ID NO: 1823275 - DNA, 15 bp, Homo sapiens
attgttgtgggcttt

SEQ ID NO: 1823276 - DNA, 20 bp, Homo sapiens
atttaaaattgtgatgtgtc

SEQ ID NO: 1823277 - DNA, 13 bp, Homo sapiens
atttaatatctga

SEQ ID NO: 1823278 - DNA, 22 bp, Homo sapiens
atttaatatctgagaagtgtat

SEQ ID NO: 1823279 - DNA, 14 bp, Homo sapiens
atttagaatatatt

SEQ ID NO: 1823280 - DNA, 15 bp, Homo sapiens
atttaggactgggtt

SEQ ID NO: 1823281 - DNA, 16 bp, Homo sapiens
atttaggtatgctatt

SEQ ID NO: 1823282 - DNA, 19 bp, Homo sapiens
atttagtaccttcaaataa

SEQ ID NO: 1823283 - DNA, 20 bp, Homo sapiens
atttagtaccttcaaataat

SEQ ID NO: 1823284 - DNA, 16 bp, Homo sapiens
atttatgatgcagttt

SEQ ID NO: 1823285 - DNA, 14 bp, Homo sapiens
atttatttatgtag

SEQ ID NO: 1823286 - DNA, 22 bp, Homo sapiens
atttcaaattaatctttctata

SEQ ID NO: 1823287 - DNA, 22 bp, Homo sapiens
atttcaaggccatattttaaaa

SEQ ID NO: 1823288 - DNA, 19 bp, Homo sapiens
atttcattatctgtactga

SEQ ID NO: 1823289 - DNA, 20 bp, Homo sapiens
atttcattatctgtactgaa

SEQ ID NO: 1823290 - DNA, 21 bp, Homo sapiens
atttccaataactagtgatat

SEQ ID NO: 1823291 - DNA, 11 bp, Homo sapiens
atttccaggcc

SEQ ID NO: 1823292 - DNA, 18 bp, Homo sapiens
atttccaggcccctgagg

SEQ ID NO: 1823293 - DNA, 22 bp, Homo sapiens
atttccaggcccctgaggactg

SEQ ID NO: 1823294 - DNA, 23 bp, Homo sapiens
atttccaggcccctgaggactgg

SEQ ID NO: 1823295 - DNA, 19 bp, Homo sapiens
atttcccgtggccccagcc

SEQ ID NO: 1823296 - DNA, 20 bp, Homo sapiens
atttcccgtggccccagcct

SEQ ID NO: 1823297 - DNA, 21 bp, Homo sapiens
atttcccgtggccccagcctg

SEQ ID NO: 1823298 - DNA, 14 bp, Homo sapiens
atttcgaagatata

SEQ ID NO: 1823299 - DNA, 19 bp, Homo sapiens
atttctaagttaaatcatt

SEQ ID NO: 1823300 - DNA, 15 bp, Homo sapiens
atttctatgttgtaa

SEQ ID NO: 1823301 - DNA, 18 bp, Homo sapiens
atttctatgttgtaatat

SEQ ID NO: 1823302 - DNA, 16 bp, Homo sapiens
atttctccatcccctc

SEQ ID NO: 1823303 - DNA, 20 bp, Homo sapiens
atttctccatcccctccctg

SEQ ID NO: 1823304 - DNA, 21 bp, Homo sapiens
atttctgcttttgcatctttg

SEQ ID NO: 1823305 - DNA, 17 bp, Homo sapiens
atttctggctttttgaa

SEQ ID NO: 1823306 - DNA, 23 bp, Homo sapiens
atttctgtatattccctgtggaa

SEQ ID NO: 1823307 - DNA, 19 bp, Homo sapiens
atttcttggtatgatcatt

SEQ ID NO: 1823308 - DNA, 15 bp, Homo sapiens
atttgataaactaaa

SEQ ID NO: 1823309 - DNA, 11 bp, Homo sapiens
atttgccagca

SEQ ID NO: 1823310 - DNA, 20 bp, Homo sapiens
atttgctatgagctggggat

SEQ ID NO: 1823311 - DNA, 17 bp, Homo sapiens
atttggtaggaagcctg

SEQ ID NO: 1823312 - DNA, 21 bp, Homo sapiens
atttggtcaagaaatgagtct

SEQ ID NO: 1823313 - DNA, 13 bp, Homo sapiens
atttgttttcccg

SEQ ID NO: 1823314 - DNA, 13 bp, Homo sapiens
attttaaaaaatc

SEQ ID NO: 1823315 - DNA, 18 bp, Homo sapiens
attttaaatataagtaat

SEQ ID NO: 1823316 - DNA, 14 bp, Homo sapiens
attttaatacagat

SEQ ID NO: 1823317 - DNA, 14 bp, Homo sapiens
attttacagtatct

SEQ ID NO: 1823318 - DNA, 17 bp, Homo sapiens
attttacagtatcttca

SEQ ID NO: 1823319 - DNA, 19 bp, Homo sapiens
attttactgacagaaatgc

SEQ ID NO: 1823320 - DNA, 21 bp, Homo sapiens
attttactgacagaaatgcaa

SEQ ID NO: 1823321 - DNA, 14 bp, Homo sapiens
attttattaaaaca

SEQ ID NO: 1823322 - DNA, 12 bp, Homo sapiens
attttcattaaa

SEQ ID NO: 1823323 - DNA, 22 bp, Homo sapiens
attttcattaaaaggaaaaaag

SEQ ID NO: 1823324 - DNA, 14 bp, Homo sapiens
attttcccactgca

SEQ ID NO: 1823325 - DNA, 22 bp, Homo sapiens
atttttgttttccactgtgcta

SEQ ID NO: 1823326 - DNA, 18 bp, Homo sapiens
caaaaacatacttcaaaa

SEQ ID NO: 1823327 - DNA, 14 bp, Homo sapiens
caaaaaccagcagg

SEQ ID NO: 1823328 - DNA, 17 bp, Homo sapiens
caaaactagacaaaagt

SEQ ID NO: 1823329 - DNA, 21 bp, Homo sapiens
caaaagtggggctaaatgaag

SEQ ID NO: 1823330 - DNA, 23 bp, Homo sapiens
caaaagtttcacaacagatttct

SEQ ID NO: 1823331 - DNA, 19 bp, Homo sapiens
caaaatacgtgttcaaaaa

SEQ ID NO: 1823332 - DNA, 16 bp, Homo sapiens
caaaattgttgcatcc

SEQ ID NO: 1823333 - DNA, 14 bp, Homo sapiens
caaaatttctgtat

SEQ ID NO: 1823334 - DNA, 21 bp, Homo sapiens
caaaatttctgtatattccct

SEQ ID NO: 1823335 - DNA, 20 bp, Homo sapiens
caaacctcacactactgtat

SEQ ID NO: 1823336 - DNA, 22 bp, Homo sapiens
caaactgcacacacagctcctc

SEQ ID NO: 1823337 - DNA, 20 bp, Homo sapiens
caaagaactgccccatctcc

SEQ ID NO: 1823338 - DNA, 21 bp, Homo sapiens
caaagaatcaacagccaaact

SEQ ID NO: 1823339 - DNA, 20 bp, Homo sapiens
caaagagaaatcacaggggc

SEQ ID NO: 1823340 - DNA, 21 bp, Homo sapiens
caaagagaaatcacaggggcg

SEQ ID NO: 1823341 - DNA, 14 bp, Homo sapiens
caaagcaaaagaag

SEQ ID NO: 1823342 - DNA, 18 bp, Homo sapiens
caaagcaaaagaagtaaa

SEQ ID NO: 1823343 - DNA, 18 bp, Homo sapiens
caaagcaagggctccagc

SEQ ID NO: 1823344 - DNA, 21 bp, Homo sapiens
caaagctgagttacttgtctg

SEQ ID NO: 1823345 - DNA, 20 bp, Homo sapiens
caaagggcagtaaagttttc

SEQ ID NO: 1823346 - DNA, 19 bp, Homo sapiens
caaaggggctgctggggca

SEQ ID NO: 1823347 - DNA, 14 bp, Homo sapiens
caaagtgctgtacc

SEQ ID NO: 1823348 - DNA, 16 bp, Homo sapiens
caaataaactagtctg

SEQ ID NO: 1823349 - DNA, 12 bp, Homo sapiens
caaatattagca

SEQ ID NO: 1823350 - DNA, 22 bp, Homo sapiens
caaatcaaagcaagggctccag

SEQ ID NO: 1823351 - DNA, 16 bp, Homo sapiens
caaatgaactttaaaa

SEQ ID NO: 1823352 - DNA, 14 bp, Homo sapiens
caaatgctttgtga

SEQ ID NO: 1823353 - DNA, 21 bp, Homo sapiens
caaatgtgtgggtttttaaaa

SEQ ID NO: 1823354 - DNA, 15 bp, Homo sapiens
caaattaatctttct

SEQ ID NO: 1823355 - DNA, 12 bp, Homo sapiens
caaattagaaac

SEQ ID NO: 1823356 - DNA, 21 bp, Homo sapiens
caaattagaaacaccattcat

SEQ ID NO: 1823357 - DNA, 12 bp, Homo sapiens
caaatttttcat

SEQ ID NO: 1823358 - DNA, 16 bp, Homo sapiens
caaatttttcatctct

SEQ ID NO: 1823359 - DNA, 18 bp, Homo sapiens
caacaatggggtgggccc

SEQ ID NO: 1823360 - DNA, 14 bp, Homo sapiens
caacagatttctaa

SEQ ID NO: 1823361 - DNA, 15 bp, Homo sapiens
caacagggaaaacag

SEQ ID NO: 1823362 - DNA, 23 bp, Homo sapiens
caacagtgttaggcctggcacag

SEQ ID NO: 1823363 - DNA, 22 bp, Homo sapiens
caacatagtgagatcccatttc

SEQ ID NO: 1823364 - DNA, 12 bp, Homo sapiens
caacattttaat

SEQ ID NO: 1823365 - DNA, 17 bp, Homo sapiens
caacatttttgtacatt

SEQ ID NO: 1823366 - DNA, 23 bp, Homo sapiens
caacatttttgtacattatgtta

SEQ ID NO: 1823367 - DNA, 14 bp, Homo sapiens
caacccagccgctg

SEQ ID NO: 1823368 - DNA, 13 bp, Homo sapiens
caacccccctccc

SEQ ID NO: 1823369 - DNA, 20 bp, Homo sapiens
caaccccgcggtgctctggc

SEQ ID NO: 1823370 - DNA, 20 bp, Homo sapiens
caacccctgtacccagctcc

SEQ ID NO: 1823371 - DNA, 12 bp, Homo sapiens
caacctgcccct

SEQ ID NO: 1823372 - DNA, 14 bp, Homo sapiens
caacctgcccctcc

SEQ ID NO: 1823373 - DNA, 14 bp, Homo sapiens
caacctgtgtctta

SEQ ID NO: 1823374 - DNA, 14 bp, Homo sapiens
caactaagccctcg

SEQ ID NO: 1823375 - DNA, 17 bp, Homo sapiens
caactccaggggcacct

SEQ ID NO: 1823376 - DNA, 13 bp, Homo sapiens
caactgtgaatat

SEQ ID NO: 1823377 - DNA, 16 bp, Homo sapiens
caactgtgaatatgag

SEQ ID NO: 1823378 - DNA, 17 bp, Homo sapiens
caagaaatgagtctgtt

SEQ ID NO: 1823379 - DNA, 12 bp, Homo sapiens
caagaagctgct

SEQ ID NO: 1823380 - DNA, 17 bp, Homo sapiens
caagacaaagcaaagcc

SEQ ID NO: 1823381 - DNA, 23 bp, Homo sapiens
caagagaaacaaataaactagtc

SEQ ID NO: 1823382 - DNA, 16 bp, Homo sapiens
caagcaaaatttctgt

SEQ ID NO: 1823383 - DNA, 15 bp, Homo sapiens
caagcaacagcactt

SEQ ID NO: 1823384 - DNA, 20 bp, Homo sapiens
caagcactttacgctgtctg

SEQ ID NO: 1823385 - DNA, 17 bp, Homo sapiens
caagcagggaaagctcc

SEQ ID NO: 1823386 - DNA, 21 bp, Homo sapiens
caagcagggaaagctccacgg

SEQ ID NO: 1823387 - DNA, 18 bp, Homo sapiens
caagccccagggcctggg

SEQ ID NO: 1823388 - DNA, 16 bp, Homo sapiens
caagcccctcagccct

SEQ ID NO: 1823389 - DNA, 19 bp, Homo sapiens
caagcccctcagcccttgc

SEQ ID NO: 1823390 - DNA, 15 bp, Homo sapiens
caagccctggcaaca

SEQ ID NO: 1823391 - DNA, 15 bp, Homo sapiens
caagctcagaataga

SEQ ID NO: 1823392 - DNA, 15 bp, Homo sapiens
caagctgtgccaccc

SEQ ID NO: 1823393 - DNA, 17 bp, Homo sapiens
caagctgtgccaccctg

SEQ ID NO: 1823394 - DNA, 19 bp, Homo sapiens
caagctgtgccaccctggg

SEQ ID NO: 1823395 - DNA, 21 bp, Homo sapiens
caagctgtgccaccctgggct

SEQ ID NO: 1823396 - DNA, 17 bp, Homo sapiens
caaggacaacctgcccc

SEQ ID NO: 1823397 - DNA, 20 bp, Homo sapiens
caaggagctgatttccaggc

SEQ ID NO: 1823398 - DNA, 13 bp, Homo sapiens
caaggcacctgca

SEQ ID NO: 1823399 - DNA, 14 bp, Homo sapiens
caaggcagcctcca

SEQ ID NO: 1823400 - DNA, 14 bp, Homo sapiens
caaggcctcccaca

SEQ ID NO: 1823401 - DNA, 14 bp, Homo sapiens
caaggctctcccct

SEQ ID NO: 1823402 - DNA, 15 bp, Homo sapiens
caaggctctcccctc

SEQ ID NO: 1823403 - DNA, 16 bp, Homo sapiens
caaggctctcccctct

SEQ ID NO: 1823404 - DNA, 17 bp, Homo sapiens
caaggctctcccctctc

SEQ ID NO: 1823405 - DNA, 19 bp, Homo sapiens
caagggcatcaggcactgg

SEQ ID NO: 1823406 - DNA, 14 bp, Homo sapiens
caagggctccagca

SEQ ID NO: 1823407 - DNA, 19 bp, Homo sapiens
caagggctccagcatccag

SEQ ID NO: 1823408 - DNA, 20 bp, Homo sapiens
caagggctccagcatccagc

SEQ ID NO: 1823409 - DNA, 21 bp, Homo sapiens
caagggggtgtcatctgagga

SEQ ID NO: 1823410 - DNA, 20 bp, Homo sapiens
caaggtggtctgctcgggcc

SEQ ID NO: 1823411 - DNA, 19 bp, Homo sapiens
caaggttactcagcagcag

SEQ ID NO: 1823412 - DNA, 23 bp, Homo sapiens
caaggttactcagcagcagagag

SEQ ID NO: 1823413 - DNA, 12 bp, Homo sapiens
caagtcacagct

SEQ ID NO: 1823414 - DNA, 15 bp, Homo sapiens
caagtcacagctgca

SEQ ID NO: 1823415 - DNA, 18 bp, Homo sapiens
caagtcacagctgcagct

SEQ ID NO: 1823416 - DNA, 12 bp, Homo sapiens
caagtctgtgaa

SEQ ID NO: 1823417 - DNA, 14 bp, Homo sapiens
caagtgtattattt

SEQ ID NO: 1823418 - DNA, 12 bp, Homo sapiens
caagtttttcag

SEQ ID NO: 1823419 - DNA, 13 bp, Homo sapiens
caagtttttcaga

SEQ ID NO: 1823420 - DNA, 18 bp, Homo sapiens
caagtttttcagaaagtt

SEQ ID NO: 1823421 - DNA, 22 bp, Homo sapiens
caataaagctgctgagaatcta

SEQ ID NO: 1823422 - DNA, 23 bp, Homo sapiens
caataaagctgctgagaatctag

SEQ ID NO: 1823423 - DNA, 13 bp, Homo sapiens
caataaagctgga

SEQ ID NO: 1823424 - DNA, 22 bp, Homo sapiens
caataaagctggacaagaagct

SEQ ID NO: 1823425 - DNA, 17 bp, Homo sapiens
cagattcctgggcctgt

SEQ ID NO: 1823426 - DNA, 18 bp, Homo sapiens
cagattcctgggcctgtc

SEQ ID NO: 1823427 - DNA, 19 bp, Homo sapiens
cagattcctgggcctgtcc

SEQ ID NO: 1823428 - DNA, 23 bp, Homo sapiens
cagattgaaaggacctcttctga

SEQ ID NO: 1823429 - DNA, 19 bp, Homo sapiens
cagatttcaaattaatctt

SEQ ID NO: 1823430 - DNA, 17 bp, Homo sapiens
cagatttctaagttaaa

SEQ ID NO: 1823431 - DNA, 20 bp, Homo sapiens
cagcaaggaggctggctggg

SEQ ID NO: 1823432 - DNA, 17 bp, Homo sapiens
cagcaaggcacctgcag

SEQ ID NO: 1823433 - DNA, 16 bp, Homo sapiens
cagcaaggggctctgc

SEQ ID NO: 1823434 - DNA, 13 bp, Homo sapiens
cagcacagcaagg

SEQ ID NO: 1823435 - DNA, 18 bp, Homo sapiens
cagcacagggatccgact

SEQ ID NO: 1823436 - DNA, 13 bp, Homo sapiens
cagcacaggggcc

SEQ ID NO: 1823437 - DNA, 16 bp, Homo sapiens
cagcacaggggcccca

SEQ ID NO: 1823438 - DNA, 17 bp, Homo sapiens
cagcacaggggccccag

SEQ ID NO: 1823439 - DNA, 20 bp, Homo sapiens
cagcaccctgggtgccattc

SEQ ID NO: 1823440 - DNA, 18 bp, Homo sapiens
cagcagcccagcttcctg

SEQ ID NO: 1823441 - DNA, 23 bp, Homo sapiens
cagcagctaggactgaggagtgg

SEQ ID NO: 1823442 - DNA, 11 bp, Homo sapiens
cagcaggtgct

SEQ ID NO: 1823443 - DNA, 19 bp, Homo sapiens
cagcaggtgctgctaccct

SEQ ID NO: 1823444 - DNA, 23 bp, Homo sapiens
cagcaggtgctgctaccctccct

SEQ ID NO: 1823445 - DNA, 18 bp, Homo sapiens
cagcaggtgtggtggctc

SEQ ID NO: 1823446 - DNA, 20 bp, Homo sapiens
cagcaggtgtggtggctcat

SEQ ID NO: 1823447 - DNA, 13 bp, Homo sapiens
cagcatccagcct

SEQ ID NO: 1823448 - DNA, 22 bp, Homo sapiens
cagccaaactgctggggctgca

SEQ ID NO: 1823449 - DNA, 15 bp, Homo sapiens
cagccagcccttccc

SEQ ID NO: 1823450 - DNA, 16 bp, Homo sapiens
cagccagtcttgccta

SEQ ID NO: 1823451 - DNA, 13 bp, Homo sapiens
cagccatgcctca

SEQ ID NO: 1823452 - DNA, 14 bp, Homo sapiens
cagcccacagagcc

SEQ ID NO: 1823453 - DNA, 15 bp, Homo sapiens
cagcccacagagcct

SEQ ID NO: 1823454 - DNA, 15 bp, Homo sapiens
cagcccagcttcctg

SEQ ID NO: 1823455 - DNA, 23 bp, Homo sapiens
cagccccaactccaggggcacct

SEQ ID NO: 1823456 - DNA, 14 bp, Homo sapiens
cagccccacagccc

SEQ ID NO: 1823457 - DNA, 15 bp, Homo sapiens
cagccccacagccca

SEQ ID NO: 1823458 - DNA, 18 bp, Homo sapiens
cagccccacagcccacgt

SEQ ID NO: 1823459 - DNA, 14 bp, Homo sapiens
cagccccctggatg

SEQ ID NO: 1823460 - DNA, 18 bp, Homo sapiens
cagccccgttttggggac

SEQ ID NO: 1823461 - DNA, 22 bp, Homo sapiens
cagccccgttttggggacgtga

SEQ ID NO: 1823462 - DNA, 22 bp, Homo sapiens
cagcccgtgaagcagtgcctcg

SEQ ID NO: 1823463 - DNA, 20 bp, Homo sapiens
cagccctcccgccccttccc

SEQ ID NO: 1823464 - DNA, 15 bp, Homo sapiens
cagcccttccctggc

SEQ ID NO: 1823465 - DNA, 22 bp, Homo sapiens
cagccctttgcaggcccagcag

SEQ ID NO: 1823466 - DNA, 15 bp, Homo sapiens
cagccgctaggagag

SEQ ID NO: 1823467 - DNA, 16 bp, Homo sapiens
cagccgctaggagaga

SEQ ID NO: 1823468 - DNA, 17 bp, Homo sapiens
cagccgctaggagagac

SEQ ID NO: 1823469 - DNA, 13 bp, Homo sapiens
cagccgctgcccg

SEQ ID NO: 1823470 - DNA, 12 bp, Homo sapiens
cagcctccagag

SEQ ID NO: 1823471 - DNA, 15 bp, Homo sapiens
cagcctccagagcca

SEQ ID NO: 1823472 - DNA, 18 bp, Homo sapiens
cagcctccagagccagcc

SEQ ID NO: 1823473 - DNA, 21 bp, Homo sapiens
cagcctccagagccagcctgg

SEQ ID NO: 1823474 - DNA, 22 bp, Homo sapiens
cagcctccagagccagcctggg

SEQ ID NO: 1823475 - DNA, 23 bp, Homo sapiens
cagcctccagagccagcctggga

SEQ ID NO: 1823476 - DNA, 14 bp, Homo sapiens
cagcctcccctccc

SEQ ID NO: 1823477 - DNA, 18 bp, Homo sapiens
cagcctcccctcccctgg

SEQ ID NO: 1823478 - DNA, 19 bp, Homo sapiens
cagcctctcccggctgcct

SEQ ID NO: 1823479 - DNA, 14 bp, Homo sapiens
cagcctgatggcca

SEQ ID NO: 1823480 - DNA, 13 bp, Homo sapiens
cagcctggcccag

SEQ ID NO: 1823481 - DNA, 15 bp, Homo sapiens
cagccttcccctccc

SEQ ID NO: 1823482 - DNA, 15 bp, Homo sapiens
cagccttctcctgtc

SEQ ID NO: 1823483 - DNA, 24 bp, Homo sapiens
cagcgtttagtttctagaggcctc

SEQ ID NO: 1823484 - DNA, 14 bp, Homo sapiens
cagctagactggag

SEQ ID NO: 1823485 - DNA, 21 bp, Homo sapiens
cagctagactggagtgaggct

SEQ ID NO: 1823486 - DNA, 17 bp, Homo sapiens
cagctaggactgaggag

SEQ ID NO: 1823487 - DNA, 19 bp, Homo sapiens
cagctattagcaactgtgc

SEQ ID NO: 1823488 - DNA, 12 bp, Homo sapiens
cagctcccccgg

SEQ ID NO: 1823489 - DNA, 13 bp, Homo sapiens
cagctcctctcct

SEQ ID NO: 1823490 - DNA, 13 bp, Homo sapiens
cagctctgtggcc

SEQ ID NO: 1823491 - DNA, 15 bp, Homo sapiens
cagctctgtggcctg

SEQ ID NO: 1823492 - DNA, 18 bp, Homo sapiens
cagctctgtggcctgtgt

SEQ ID NO: 1823493 - DNA, 19 bp, Homo sapiens
cagctctgtggcctgtgtc

SEQ ID NO: 1823494 - DNA, 18 bp, Homo sapiens
cagctgacagtcctctcc

SEQ ID NO: 1823495 - DNA, 21 bp, Homo sapiens
cagctgacagtcctctccacc

SEQ ID NO: 1823496 - DNA, 15 bp, Homo sapiens
cagctgagctggcct

SEQ ID NO: 1823497 - DNA, 13 bp, Homo sapiens
cagctgcagctgg

SEQ ID NO: 1823498 - DNA, 16 bp, Homo sapiens
cagctgcagctgggcc

SEQ ID NO: 1823499 - DNA, 18 bp, Homo sapiens
cagctgcagctgggcccc

SEQ ID NO: 1823500 - DNA, 14 bp, Homo sapiens
cagctgcgggtctg

SEQ ID NO: 1823501 - DNA, 19 bp, Homo sapiens
cagctgcgggtctgaagga

SEQ ID NO: 1823502 - DNA, 12 bp, Homo sapiens
cagctgctctgc

SEQ ID NO: 1823503 - DNA, 16 bp, Homo sapiens
cagctgctcttagtgc

SEQ ID NO: 1823504 - DNA, 17 bp, Homo sapiens
cagctgggccccatgct

SEQ ID NO: 1823505 - DNA, 18 bp, Homo sapiens
cagctgggccccatgctc

SEQ ID NO: 1823506 - DNA, 20 bp, Homo sapiens
cagctgggccccatgctctg

SEQ ID NO: 1823507 - DNA, 22 bp, Homo sapiens
cagctgggccccatgctctgcc

SEQ ID NO: 1823508 - DNA, 12 bp, Homo sapiens
cagctgtagcca

SEQ ID NO: 1823509 - DNA, 14 bp, Homo sapiens
cagctgtagccatg

SEQ ID NO: 1823510 - DNA, 19 bp, Homo sapiens
cagctgtagccatggctca

SEQ ID NO: 1823511 - DNA, 20 bp, Homo sapiens
cagctgtagccatggctcag

SEQ ID NO: 1823512 - DNA, 15 bp, Homo sapiens
cagcttcctggtgta

SEQ ID NO: 1823513 - DNA, 11 bp, Homo sapiens
cagcttctgcc

SEQ ID NO: 1823514 - DNA, 14 bp, Homo sapiens
cagcttctgccact

SEQ ID NO: 1823515 - DNA, 15 bp, Homo sapiens
cagcttctgccactt

SEQ ID NO: 1823516 - DNA, 18 bp, Homo sapiens
cagcttctgccacttccc

SEQ ID NO: 1823517 - DNA, 16 bp, Homo sapiens
cagcttctgctgggct

SEQ ID NO: 1823518 - DNA, 15 bp, Homo sapiens
caggaacgagcactg

SEQ ID NO: 1823519 - DNA, 22 bp, Homo sapiens
caggaacgagcactggccagag

SEQ ID NO: 1823520 - DNA, 13 bp, Homo sapiens
caggaaggcagaa

SEQ ID NO: 1823521 - DNA, 13 bp, Homo sapiens
caggaaggcagct

SEQ ID NO: 1823522 - DNA, 16 bp, Homo sapiens
caggaaggcagctgct

SEQ ID NO: 1823523 - DNA, 23 bp, Homo sapiens
caggaagggaaagcgggcagccc

SEQ ID NO: 1823524 - DNA, 14 bp, Homo sapiens
caggacccaggccc

SEQ ID NO: 1823525 - DNA, 15 bp, Homo sapiens
caggacccaggccct

SEQ ID NO: 1823526 - DNA, 16 bp, Homo sapiens
caggacccaggccctc

SEQ ID NO: 1823527 - DNA, 22 bp, Homo sapiens
caggacggggccggccaggtgg

SEQ ID NO: 1823528 - DNA, 14 bp, Homo sapiens
caggagtccctgcc

SEQ ID NO: 1823529 - DNA, 15 bp, Homo sapiens
caggagtccctgcca

SEQ ID NO: 1823530 - DNA, 17 bp, Homo sapiens
caggagtctgtgctctt

SEQ ID NO: 1823531 - DNA, 21 bp, Homo sapiens
caggagtttgagacaagccct

SEQ ID NO: 1823532 - DNA, 15 bp, Homo sapiens
caggatccgctgcca

SEQ ID NO: 1823533 - DNA, 19 bp, Homo sapiens
caggatccgctgccaccac

SEQ ID NO: 1823534 - DNA, 17 bp, Homo sapiens
caggatcctgcaggaac

SEQ ID NO: 1823535 - DNA, 12 bp, Homo sapiens
caggcacctggc

SEQ ID NO: 1823536 - DNA, 13 bp, Homo sapiens
caggcacctggcc

SEQ ID NO: 1823537 - DNA, 20 bp, Homo sapiens
cactaagctttctcctttga

SEQ ID NO: 1823538 - DNA, 14 bp, Homo sapiens
cactacctttgtcc

SEQ ID NO: 1823539 - DNA, 20 bp, Homo sapiens
cactacctttgtccaggcct

SEQ ID NO: 1823540 - DNA, 21 bp, Homo sapiens
cactacctttgtccaggcctg

SEQ ID NO: 1823541 - DNA, 17 bp, Homo sapiens
cactactgtatttcatt

SEQ ID NO: 1823542 - DNA, 22 bp, Homo sapiens
cactatttttattttcttatgt

SEQ ID NO: 1823543 - DNA, 12 bp, Homo sapiens
cactcaccaggg

SEQ ID NO: 1823544 - DNA, 24 bp, Homo sapiens
cactcaccagggtccgcaccagct

SEQ ID NO: 1823545 - DNA, 14 bp, Homo sapiens
cactcccacttccc

SEQ ID NO: 1823546 - DNA, 15 bp, Homo sapiens
cactcccccacctga

SEQ ID NO: 1823547 - DNA, 16 bp, Homo sapiens
cactcccccacctgac

SEQ ID NO: 1823548 - DNA, 13 bp, Homo sapiens
cactccctgagct

SEQ ID NO: 1823549 - DNA, 23 bp, Homo sapiens
cactctccttcgtgtctctccca

SEQ ID NO: 1823550 - DNA, 12 bp, Homo sapiens
cactctgtgccc

SEQ ID NO: 1823551 - DNA, 14 bp, Homo sapiens
cactctgtgcccat

SEQ ID NO: 1823552 - DNA, 18 bp, Homo sapiens
cactctgtgcccatgggc

SEQ ID NO: 1823553 - DNA, 21 bp, Homo sapiens
cactctgtgcccatgggcact

SEQ ID NO: 1823554 - DNA, 14 bp, Homo sapiens
cactgaaatagagt

SEQ ID NO: 1823555 - DNA, 13 bp, Homo sapiens
cactgaagtgctt

SEQ ID NO: 1823556 - DNA, 22 bp, Homo sapiens
cactgaagtgcttgcagatcat

SEQ ID NO: 1823557 - DNA, 20 bp, Homo sapiens
cactgcaacttctacctccg

SEQ ID NO: 1823558 - DNA, 13 bp, Homo sapiens
cactgcaccccct

SEQ ID NO: 1823559 - DNA, 16 bp, Homo sapiens
cactgcaccccctcct

SEQ ID NO: 1823560 - DNA, 18 bp, Homo sapiens
cactgcaccccctcctgc

SEQ ID NO: 1823561 - DNA, 16 bp, Homo sapiens
cactgcatctcaagat

SEQ ID NO: 1823562 - DNA, 11 bp, Homo sapiens
cactgccaggc

SEQ ID NO: 1823563 - DNA, 18 bp, Homo sapiens
cactgccaggcacctggc

SEQ ID NO: 1823564 - DNA, 21 bp, Homo sapiens
cactgccaggcacctggcctg

SEQ ID NO: 1823565 - DNA, 16 bp, Homo sapiens
cactgccccactattt

SEQ ID NO: 1823566 - DNA, 15 bp, Homo sapiens
cactgccctgcctgc

SEQ ID NO: 1823567 - DNA, 20 bp, Homo sapiens
cactgcggggcttggctgag

SEQ ID NO: 1823568 - DNA, 18 bp, Homo sapiens
cactgctgcaccagagtg

SEQ ID NO: 1823569 - DNA, 20 bp, Homo sapiens
cactgctgcaccagagtgaa

SEQ ID NO: 1823570 - DNA, 14 bp, Homo sapiens
cactgctgggtggc

SEQ ID NO: 1823571 - DNA, 14 bp, Homo sapiens
cactggccagagag

SEQ ID NO: 1823572 - DNA, 23 bp, Homo sapiens
cactggccagagagggcccagct

SEQ ID NO: 1823573 - DNA, 16 bp, Homo sapiens
cactggctgcctccac

SEQ ID NO: 1823574 - DNA, 22 bp, Homo sapiens
cactggctgcctccactcccac

SEQ ID NO: 1823575 - DNA, 16 bp, Homo sapiens
cactggctggggcaga

SEQ ID NO: 1823576 - DNA, 22 bp, Homo sapiens
cactggctggggcagaggggca

SEQ ID NO: 1823577 - DNA, 14 bp, Homo sapiens
cactggtggcatcg

SEQ ID NO: 1823578 - DNA, 15 bp, Homo sapiens
cactgtcctgctcca

SEQ ID NO: 1823579 - DNA, 16 bp, Homo sapiens
cactgtcctgctccac

SEQ ID NO: 1823580 - DNA, 13 bp, Homo sapiens
cactgtggccaga

SEQ ID NO: 1823581 - DNA, 15 bp, Homo sapiens
cactgtggccagagc

SEQ ID NO: 1823582 - DNA, 17 bp, Homo sapiens
cactgtggccagagctg

SEQ ID NO: 1823583 - DNA, 20 bp, Homo sapiens
cactgtggccagagctggaa

SEQ ID NO: 1823584 - DNA, 19 bp, Homo sapiens
cactgtttaactgggagtg

SEQ ID NO: 1823585 - DNA, 13 bp, Homo sapiens
cacttatttccat

SEQ ID NO: 1823586 - DNA, 23 bp, Homo sapiens
cacttcccaggtaagcaggagga

SEQ ID NO: 1823587 - DNA, 12 bp, Homo sapiens
cacttcccctcc

SEQ ID NO: 1823588 - DNA, 14 bp, Homo sapiens
cacttcctgtgcca

SEQ ID NO: 1823589 - DNA, 21 bp, Homo sapiens
cacttcttaaaggcctggaac

SEQ ID NO: 1823590 - DNA, 17 bp, Homo sapiens
cacttctttgcagagcc

SEQ ID NO: 1823591 - DNA, 18 bp, Homo sapiens
cacttgcgtcctgcagag

SEQ ID NO: 1823592 - DNA, 20 bp, Homo sapiens
cacttgcgtcctgcagagga

SEQ ID NO: 1823593 - DNA, 23 bp, Homo sapiens
cacttgcgtcctgcagaggacca

SEQ ID NO: 1823594 - DNA, 12 bp, Homo sapiens
cacttggagccc

SEQ ID NO: 1823595 - DNA, 20 bp, Homo sapiens
cactttttccagaatttgaa

SEQ ID NO: 1823596 - DNA, 21 bp, Homo sapiens
cagaaaacttagaaataagaa

SEQ ID NO: 1823597 - DNA, 21 bp, Homo sapiens
cagaaagcctcctgccccctg

SEQ ID NO: 1823598 - DNA, 22 bp, Homo sapiens
cagaaagcctcctgccccctgc

SEQ ID NO: 1823599 - DNA, 23 bp, Homo sapiens
cagaaagcctcctgccccctgcc

SEQ ID NO: 1823600 - DNA, 13 bp, Homo sapiens
cagaacagaggca

SEQ ID NO: 1823601 - DNA, 13 bp, Homo sapiens
cagaagaaaataa

SEQ ID NO: 1823602 - DNA, 16 bp, Homo sapiens
cagaaggagaaggaaa

SEQ ID NO: 1823603 - DNA, 13 bp, Homo sapiens
cagaaggagggca

SEQ ID NO: 1823604 - DNA, 17 bp, Homo sapiens
cagaaggagggcagagc

SEQ ID NO: 1823605 - DNA, 21 bp, Homo sapiens
cagaaggagggcagagccatg

SEQ ID NO: 1823606 - DNA, 14 bp, Homo sapiens
cagaatctgctgtt

SEQ ID NO: 1823607 - DNA, 17 bp, Homo sapiens
cagaatctgctgttgcc

SEQ ID NO: 1823608 - DNA, 15 bp, Homo sapiens
cagaatttgaatatt

SEQ ID NO: 1823609 - DNA, 17 bp, Homo sapiens
cagacgtgagtgtgact

SEQ ID NO: 1823610 - DNA, 20 bp, Homo sapiens
cagacgtgagtgtgactttt

SEQ ID NO: 1823611 - DNA, 17 bp, Homo sapiens
cagactgaaccagagct

SEQ ID NO: 1823612 - DNA, 15 bp, Homo sapiens
cagacttctggaagg

SEQ ID NO: 1823613 - DNA, 20 bp, Homo sapiens
cagacttctggaaggctggc

SEQ ID NO: 1823614 - DNA, 22 bp, Homo sapiens
cagacttctggaaggctggctg

SEQ ID NO: 1823615 - DNA, 23 bp, Homo sapiens
cagacttctggaaggctggctga

SEQ ID NO: 1823616 - DNA, 14 bp, Homo sapiens
cagagaggagcacc

SEQ ID NO: 1823617 - DNA, 20 bp, Homo sapiens
cagagagggcccagctgtag

SEQ ID NO: 1823618 - DNA, 12 bp, Homo sapiens
cagagccagcct

SEQ ID NO: 1823619 - DNA, 14 bp, Homo sapiens
cagagccagcctgg

SEQ ID NO: 1823620 - DNA, 19 bp, Homo sapiens
cagagccagcctgggactc

SEQ ID NO: 1823621 - DNA, 16 bp, Homo sapiens
cagagccatgggcctg

SEQ ID NO: 1823622 - DNA, 21 bp, Homo sapiens
cagagccatgggcctgggcct

SEQ ID NO: 1823623 - DNA, 23 bp, Homo sapiens
cagagccatgggcctgggcctgc

SEQ ID NO: 1823624 - DNA, 16 bp, Homo sapiens
cagagctggaacacaa

SEQ ID NO: 1823625 - DNA, 13 bp, Homo sapiens
cagagctggaagg

SEQ ID NO: 1823626 - DNA, 14 bp, Homo sapiens
cagagctggaaggc

SEQ ID NO: 1823627 - DNA, 18 bp, Homo sapiens
cagagctggaaggcaggg

SEQ ID NO: 1823628 - DNA, 20 bp, Homo sapiens
cagagctggaaggcagggca

SEQ ID NO: 1823629 - DNA, 23 bp, Homo sapiens
cagagctggaaggcagggcagag

SEQ ID NO: 1823630 - DNA, 12 bp, Homo sapiens
cagagctggaca

SEQ ID NO: 1823631 - DNA, 22 bp, Homo sapiens
cagaggacagtatttgtgggga

SEQ ID NO: 1823632 - DNA, 12 bp, Homo sapiens
cagaggaccaca

SEQ ID NO: 1823633 - DNA, 18 bp, Homo sapiens
cagaggaccacagtgggt

SEQ ID NO: 1823634 - DNA, 18 bp, Homo sapiens
cagagggaatgttccctg

SEQ ID NO: 1823635 - DNA, 19 bp, Homo sapiens
cagagggaatgttccctgc

SEQ ID NO: 1823636 - DNA, 21 bp, Homo sapiens
cagagggaatgttccctgcac

SEQ ID NO: 1823637 - DNA, 20 bp, Homo sapiens
cagagggaccaaattgcttc

SEQ ID NO: 1823638 - DNA, 14 bp, Homo sapiens
cagaggggcagccg

SEQ ID NO: 1823639 - DNA, 15 bp, Homo sapiens
cagaggggcagccgc

SEQ ID NO: 1823640 - DNA, 18 bp, Homo sapiens
cagaggggcaggccctgc

SEQ ID NO: 1823641 - DNA, 18 bp, Homo sapiens
cagaggttatctgcctgg

SEQ ID NO: 1823642 - DNA, 20 bp, Homo sapiens
cagaggttatctgcctggcc

SEQ ID NO: 1823643 - DNA, 14 bp, Homo sapiens
cagagtctgagccc

SEQ ID NO: 1823644 - DNA, 20 bp, Homo sapiens
cagagtgaaagggctatggc

SEQ ID NO: 1823645 - DNA, 16 bp, Homo sapiens
agtctcctgtatcatt

SEQ ID NO: 1823646 - DNA, 17 bp, Homo sapiens
agtctgaacccttgtgc

SEQ ID NO: 1823647 - DNA, 17 bp, Homo sapiens
agtctgagcccccggct

SEQ ID NO: 1823648 - DNA, 20 bp, Homo sapiens
agtctgaggccccaggccct

SEQ ID NO: 1823649 - DNA, 14 bp, Homo sapiens
agtcttatttttct

SEQ ID NO: 1823650 - DNA, 13 bp, Homo sapiens
agtcttgcctagg

SEQ ID NO: 1823651 - DNA, 17 bp, Homo sapiens
agtcttgtctcatttag

SEQ ID NO: 1823652 - DNA, 22 bp, Homo sapiens
agtgaagtccttcagtgagccc

SEQ ID NO: 1823653 - DNA, 19 bp, Homo sapiens
agtgactcgggctcctgtg

SEQ ID NO: 1823654 - DNA, 21 bp, Homo sapiens
agtgactcgggctcctgtgcc

SEQ ID NO: 1823655 - DNA, 14 bp, Homo sapiens
agtgactggcaggt

SEQ ID NO: 1823656 - DNA, 22 bp, Homo sapiens
agtgactggcaggtgcagatgg

SEQ ID NO: 1823657 - DNA, 21 bp, Homo sapiens
agtgagcccctccccagccag

SEQ ID NO: 1823658 - DNA, 14 bp, Homo sapiens
agtgaggatgtctg

SEQ ID NO: 1823659 - DNA, 18 bp, Homo sapiens
agtgatctttcaatatca

SEQ ID NO: 1823660 - DNA, 22 bp, Homo sapiens
agtgcagagaaagaaagggaaa

SEQ ID NO: 1823661 - DNA, 19 bp, Homo sapiens
agtgccaagtttttcagaa

SEQ ID NO: 1823662 - DNA, 22 bp, Homo sapiens
agtgccgccgcctcgcccaccg

SEQ ID NO: 1823663 - DNA, 17 bp, Homo sapiens
agtgcctcgaggcaccg

SEQ ID NO: 1823664 - DNA, 19 bp, Homo sapiens
agtgcgctcttggtccctg

SEQ ID NO: 1823665 - DNA, 15 bp, Homo sapiens
agtgctgccatgcca

SEQ ID NO: 1823666 - DNA, 19 bp, Homo sapiens
agtgctgccatgccactgc

SEQ ID NO: 1823667 - DNA, 21 bp, Homo sapiens
agtgctgccatgccactgcca

SEQ ID NO: 1823668 - DNA, 23 bp, Homo sapiens
agtgctgccatgccactgccagg

SEQ ID NO: 1823669 - DNA, 24 bp, Homo sapiens
agtgctgccatgccactgccaggc

SEQ ID NO: 1823670 - DNA, 16 bp, Homo sapiens
agtgctgtacccttcc

SEQ ID NO: 1823671 - DNA, 17 bp, Homo sapiens
agtgctgtacccttcca

SEQ ID NO: 1823672 - DNA, 18 bp, Homo sapiens
agtgcttctccaacactg

SEQ ID NO: 1823673 - DNA, 23 bp, Homo sapiens
agtgcttgcagatcatctgggga

SEQ ID NO: 1823674 - DNA, 17 bp, Homo sapiens
agtggaagagcagcctg

SEQ ID NO: 1823675 - DNA, 20 bp, Homo sapiens
agtggaagagcagcctgatg

SEQ ID NO: 1823676 - DNA, 23 bp, Homo sapiens
agtggaagagcagcctgatggcc

SEQ ID NO: 1823677 - DNA, 17 bp, Homo sapiens
agtggaatgcagggaag

SEQ ID NO: 1823678 - DNA, 16 bp, Homo sapiens
agtggcagccatgcct

SEQ ID NO: 1823679 - DNA, 17 bp, Homo sapiens
agtggctgtccagtgcc

SEQ ID NO: 1823680 - DNA, 19 bp, Homo sapiens
agtggctgtccagtgccca

SEQ ID NO: 1823681 - DNA, 14 bp, Homo sapiens
agtgggtcccactt

SEQ ID NO: 1823682 - DNA, 17 bp, Homo sapiens
agtgggtcccacttccc

SEQ ID NO: 1823683 - DNA, 22 bp, Homo sapiens
agtgggtcccacttcccctcct

SEQ ID NO: 1823684 - DNA, 14 bp, Homo sapiens
agtgggtggcacct

SEQ ID NO: 1823685 - DNA, 14 bp, Homo sapiens
agtggttgttgcca

SEQ ID NO: 1823686 - DNA, 19 bp, Homo sapiens
agtgtctgggctgactggg

SEQ ID NO: 1823687 - DNA, 16 bp, Homo sapiens
agtgtgagtggcagcc

SEQ ID NO: 1823688 - DNA, 20 bp, Homo sapiens
agtgtgagtggcagccatgc

SEQ ID NO: 1823689 - DNA, 13 bp, Homo sapiens
agtgtgcccccca

SEQ ID NO: 1823690 - DNA, 19 bp, Homo sapiens
agtgtgccccccatcctgg

SEQ ID NO: 1823691 - DNA, 20 bp, Homo sapiens
agtgtgccccccatcctggc

SEQ ID NO: 1823692 - DNA, 16 bp, Homo sapiens
agtgtgggtctgtgtg

SEQ ID NO: 1823693 - DNA, 17 bp, Homo sapiens
agtgtgggtctgtgtgt

SEQ ID NO: 1823694 - DNA, 23 bp, Homo sapiens
agtgtgggtctgtgtgtgtgtat

SEQ ID NO: 1823695 - DNA, 9 bp, Homo sapiens
agtgtgtaa

SEQ ID NO: 1823696 - DNA, 20 bp, Homo sapiens
agtgttaggcctggcacagt

SEQ ID NO: 1823697 - DNA, 13 bp, Homo sapiens
agtgttgtggaga

SEQ ID NO: 1823698 - DNA, 17 bp, Homo sapiens
agttacttgtctgaggc

SEQ ID NO: 1823699 - DNA, 12 bp, Homo sapiens
agttagccctca

SEQ ID NO: 1823700 - DNA, 16 bp, Homo sapiens
agttatacatcttcat

SEQ ID NO: 1823701 - DNA, 19 bp, Homo sapiens
agttatacatcttcattaa

SEQ ID NO: 1823702 - DNA, 17 bp, Homo sapiens
agttattagtgccaagt

SEQ ID NO: 1823703 - DNA, 17 bp, Homo sapiens
agttattcaaatgaagg

SEQ ID NO: 1823704 - DNA, 11 bp, Homo sapiens
agttcaagtga

SEQ ID NO: 1823705 - DNA, 19 bp, Homo sapiens
agttccatcaggtcccccc

SEQ ID NO: 1823706 - DNA, 21 bp, Homo sapiens
agttctgttggtctacagaaa

SEQ ID NO: 1823707 - DNA, 21 bp, Homo sapiens
agttctttgctgcccctgtct

SEQ ID NO: 1823708 - DNA, 21 bp, Homo sapiens
agttgagtacagtgaggaggg

SEQ ID NO: 1823709 - DNA, 17 bp, Homo sapiens
agttggtgttcataatt

SEQ ID NO: 1823710 - DNA, 21 bp, Homo sapiens
agttgtctattctgagccttg

SEQ ID NO: 1823711 - DNA, 14 bp, Homo sapiens
agtttcacaacaga

SEQ ID NO: 1823712 - DNA, 18 bp, Homo sapiens
agtttcacaacagatttc

SEQ ID NO: 1823713 - DNA, 14 bp, Homo sapiens
agtttcagaaattc

SEQ ID NO: 1823714 - DNA, 17 bp, Homo sapiens
agtttcagaaattctca

SEQ ID NO: 1823715 - DNA, 15 bp, Homo sapiens
agtttctagaggcct

SEQ ID NO: 1823716 - DNA, 23 bp, Homo sapiens
agtttgagacaagccctggcaac

SEQ ID NO: 1823717 - DNA, 20 bp, Homo sapiens
agttttgacggtttatgctg

SEQ ID NO: 1823718 - DNA, 14 bp, Homo sapiens
agtttttcagaaag

SEQ ID NO: 1823719 - DNA, 12 bp, Homo sapiens
ataaaaaatggt

SEQ ID NO: 1823720 - DNA, 18 bp, Homo sapiens
ataaaaataatatatgct

SEQ ID NO: 1823721 - DNA, 14 bp, Homo sapiens
ataaaaattgatga

SEQ ID NO: 1823722 - DNA, 14 bp, Homo sapiens
ataaaataatttta

SEQ ID NO: 1823723 - DNA, 16 bp, Homo sapiens
ataaaataattttatt

SEQ ID NO: 1823724 - DNA, 18 bp, Homo sapiens
ataaaatgcccatttcga

SEQ ID NO: 1823725 - DNA, 21 bp, Homo sapiens
ataaactagtctgttggcaat

SEQ ID NO: 1823726 - DNA, 15 bp, Homo sapiens
ataaattacattaaa

SEQ ID NO: 1823727 - DNA, 17 bp, Homo sapiens
ataactttatatgaagt

SEQ ID NO: 1823728 - DNA, 16 bp, Homo sapiens
ataagctgttctggtg

SEQ ID NO: 1823729 - DNA, 23 bp, Homo sapiens
ataagggtcacaagtctaaacaa

SEQ ID NO: 1823730 - DNA, 22 bp, Homo sapiens
ataagtaatgaaggcatatttc

SEQ ID NO: 1823731 - DNA, 16 bp, Homo sapiens
ataagtcattgaaatt

SEQ ID NO: 1823732 - DNA, 18 bp, Homo sapiens
ataatcacaacccttcag

SEQ ID NO: 1823733 - DNA, 15 bp, Homo sapiens
ataatgtaatactgt

SEQ ID NO: 1823734 - DNA, 17 bp, Homo sapiens
ataatgtaatactgtag

SEQ ID NO: 1823735 - DNA, 15 bp, Homo sapiens
ataattcatcaagta

SEQ ID NO: 1823736 - DNA, 18 bp, Homo sapiens
ataattggctttgcagat

SEQ ID NO: 1823737 - DNA, 15 bp, Homo sapiens
ataatttctcctcat

SEQ ID NO: 1823738 - DNA, 15 bp, Homo sapiens
atacagaagaaaata

SEQ ID NO: 1823739 - DNA, 14 bp, Homo sapiens
atacagaatgaatc

SEQ ID NO: 1823740 - DNA, 15 bp, Homo sapiens
atacatcttcattaa

SEQ ID NO: 1823741 - DNA, 20 bp, Homo sapiens
atacattatattcctctaaa

SEQ ID NO: 1823742 - DNA, 21 bp, Homo sapiens
atacattgtattaataccaaa

SEQ ID NO: 1823743 - DNA, 20 bp, Homo sapiens
ataccccattaaatctgaca

SEQ ID NO: 1823744 - DNA, 13 bp, Homo sapiens
atactcaatcaag

SEQ ID NO: 1823745 - DNA, 18 bp, Homo sapiens
atactcaatcaagcaaaa

SEQ ID NO: 1823746 - DNA, 23 bp, Homo sapiens
atactcaatcaagcaaaatttct

SEQ ID NO: 1823747 - DNA, 17 bp, Homo sapiens
atactggcctcgcctgg

SEQ ID NO: 1823748 - DNA, 16 bp, Homo sapiens
atactgtactgatact

SEQ ID NO: 1823749 - DNA, 23 bp, Homo sapiens
atactgtagaaatattgctctaa

SEQ ID NO: 1823750 - DNA, 23 bp, Homo sapiens
atactgtgttaccttttaaaata

SEQ ID NO: 1823751 - DNA, 14 bp, Homo sapiens
atactgtttcacta

SEQ ID NO: 1823752 - DNA, 12 bp, Homo sapiens
atagatgtgtgg

SEQ ID NO: 1823753 - DNA, 14 bp, Homo sapiens
atagccagagagga

SEQ ID NO: 1823754 - DNA, 20 bp, Homo sapiens
ataggaggggaaaaaacaaa

SEQ ID NO: 1823755 - DNA, 13 bp, Homo sapiens
atagtaacaggcc

SEQ ID NO: 1823756 - DNA, 12 bp, Homo sapiens
atagtaatcatt

SEQ ID NO: 1823757 - DNA, 13 bp, Homo sapiens
atataaaaacaac

SEQ ID NO: 1823758 - DNA, 15 bp, Homo sapiens
atataaaaacaacaa

SEQ ID NO: 1823759 - DNA, 16 bp, Homo sapiens
atataaaaacaacaaa

SEQ ID NO: 1823760 - DNA, 20 bp, Homo sapiens
atataaaagttaaactactt

SEQ ID NO: 1823761 - DNA, 14 bp, Homo sapiens
aggctttggcccaa

SEQ ID NO: 1823762 - DNA, 13 bp, Homo sapiens
agggaaactggct

SEQ ID NO: 1823763 - DNA, 15 bp, Homo sapiens
agggaaactggctga

SEQ ID NO: 1823764 - DNA, 14 bp, Homo sapiens
agggaaagcgggca

SEQ ID NO: 1823765 - DNA, 14 bp, Homo sapiens
agggaagagggcag

SEQ ID NO: 1823766 - DNA, 16 bp, Homo sapiens
agggaatgttccctgc

SEQ ID NO: 1823767 - DNA, 17 bp, Homo sapiens
agggaatgttccctgca

SEQ ID NO: 1823768 - DNA, 18 bp, Homo sapiens
agggaatgttccctgcac

SEQ ID NO: 1823769 - DNA, 18 bp, Homo sapiens
agggaccaaattgcttct

SEQ ID NO: 1823770 - DNA, 13 bp, Homo sapiens
agggaccacagca

SEQ ID NO: 1823771 - DNA, 14 bp, Homo sapiens
agggaccacagcaa

SEQ ID NO: 1823772 - DNA, 23 bp, Homo sapiens
agggaggagaggaaatgctattg

SEQ ID NO: 1823773 - DNA, 14 bp, Homo sapiens
agggaggcccagcc

SEQ ID NO: 1823774 - DNA, 19 bp, Homo sapiens
agggagggggcgctcagga

SEQ ID NO: 1823775 - DNA, 22 bp, Homo sapiens
agggatttggggctcagagtgg

SEQ ID NO: 1823776 - DNA, 18 bp, Homo sapiens
agggcagagccatgggcc

SEQ ID NO: 1823777 - DNA, 21 bp, Homo sapiens
agggcagagccatgggcctgg

SEQ ID NO: 1823778 - DNA, 22 bp, Homo sapiens
agggcagagggaatgttccctg

SEQ ID NO: 1823779 - DNA, 23 bp, Homo sapiens
agggcagagggaatgttccctgc

SEQ ID NO: 1823780 - DNA, 15 bp, Homo sapiens
agggcagtacctggg

SEQ ID NO: 1823781 - DNA, 17 bp, Homo sapiens
agggcagtacctgggaa

SEQ ID NO: 1823782 - DNA, 19 bp, Homo sapiens
agggccagaaggagggcag

SEQ ID NO: 1823783 - DNA, 20 bp, Homo sapiens
agggccagaaggagggcaga

SEQ ID NO: 1823784 - DNA, 22 bp, Homo sapiens
agggccagaaggagggcagagc

SEQ ID NO: 1823785 - DNA, 19 bp, Homo sapiens
agggcccagctgtagccat

SEQ ID NO: 1823786 - DNA, 13 bp, Homo sapiens
agggcccctccct

SEQ ID NO: 1823787 - DNA, 20 bp, Homo sapiens
agggcccctccctctgcccc

SEQ ID NO: 1823788 - DNA, 20 bp, Homo sapiens
agggctaattctgggaaggg

SEQ ID NO: 1823789 - DNA, 23 bp, Homo sapiens
agggctaattctgggaagggaga

SEQ ID NO: 1823790 - DNA, 15 bp, Homo sapiens
agggctccagcatcc

SEQ ID NO: 1823791 - DNA, 20 bp, Homo sapiens
agggctccagcatccagcct

SEQ ID NO: 1823792 - DNA, 22 bp, Homo sapiens
agggctccagcatccagcctgt

SEQ ID NO: 1823793 - DNA, 16 bp, Homo sapiens
agggcttggggctgca

SEQ ID NO: 1823794 - DNA, 21 bp, Homo sapiens
agggcttttttttgagaatac

SEQ ID NO: 1823795 - DNA, 16 bp, Homo sapiens
aggggcacaccactgc

SEQ ID NO: 1823796 - DNA, 22 bp, Homo sapiens
aggggcacaccactgccctgcc

SEQ ID NO: 1823797 - DNA, 22 bp, Homo sapiens
aggggcacctatgagatggcca

SEQ ID NO: 1823798 - DNA, 23 bp, Homo sapiens
aggggcaggccctgcactgtcct

SEQ ID NO: 1823799 - DNA, 14 bp, Homo sapiens
aggggcaggcctgg

SEQ ID NO: 1823800 - DNA, 21 bp, Homo sapiens
aggggcaggcctgggacccag

SEQ ID NO: 1823801 - DNA, 20 bp, Homo sapiens
aggggccccagatctgcctg

SEQ ID NO: 1823802 - DNA, 22 bp, Homo sapiens
aggggccccagatctgcctggg

SEQ ID NO: 1823803 - DNA, 16 bp, Homo sapiens
aggggccccggggctg

SEQ ID NO: 1823804 - DNA, 20 bp, Homo sapiens
aggggccccggggctggcaa

SEQ ID NO: 1823805 - DNA, 14 bp, Homo sapiens
aggggcggggcagg

SEQ ID NO: 1823806 - DNA, 16 bp, Homo sapiens
aggggcggggcaggaa

SEQ ID NO: 1823807 - DNA, 15 bp, Homo sapiens
aggggctgcccgctc

SEQ ID NO: 1823808 - DNA, 13 bp, Homo sapiens
aggggctgctggg

SEQ ID NO: 1823809 - DNA, 22 bp, Homo sapiens
agggggcgctcaggacccaggc

SEQ ID NO: 1823810 - DNA, 21 bp, Homo sapiens
agggggctctccaaaggggct

SEQ ID NO: 1823811 - DNA, 15 bp, Homo sapiens
agggtccgcaccagc

SEQ ID NO: 1823812 - DNA, 17 bp, Homo sapiens
agggtccgcaccagctg

SEQ ID NO: 1823813 - DNA, 19 bp, Homo sapiens
agggtccgcaccagctgct

SEQ ID NO: 1823814 - DNA, 20 bp, Homo sapiens
agggtccgcaccagctgctc

SEQ ID NO: 1823815 - DNA, 22 bp, Homo sapiens
agggtccgcaccagctgctctg

SEQ ID NO: 1823816 - DNA, 17 bp, Homo sapiens
agggtcttgggctactg

SEQ ID NO: 1823817 - DNA, 22 bp, Homo sapiens
agggtcttgggctactggcagc

SEQ ID NO: 1823818 - DNA, 23 bp, Homo sapiens
agggtcttgggctactggcagct

SEQ ID NO: 1823819 - DNA, 21 bp, Homo sapiens
agggtggaggaaggtgctgag

SEQ ID NO: 1823820 - DNA, 22 bp, Homo sapiens
agggtggaggaaggtgctgagc

SEQ ID NO: 1823821 - DNA, 22 bp, Homo sapiens
aggtaatgcacatcctcattca

SEQ ID NO: 1823822 - DNA, 13 bp, Homo sapiens
aggtaggcccttg

SEQ ID NO: 1823823 - DNA, 21 bp, Homo sapiens
aggtaggcccttgtcctgcca

SEQ ID NO: 1823824 - DNA, 18 bp, Homo sapiens
aggtccaagggccatact

SEQ ID NO: 1823825 - DNA, 21 bp, Homo sapiens
aggtctccccatgtgcctgca

SEQ ID NO: 1823826 - DNA, 13 bp, Homo sapiens
aggtctcctccac

SEQ ID NO: 1823827 - DNA, 15 bp, Homo sapiens
aggtctccttactct

SEQ ID NO: 1823828 - DNA, 21 bp, Homo sapiens
aggtctccttactctgagccc

SEQ ID NO: 1823829 - DNA, 20 bp, Homo sapiens
aggtctcgctgatgctgggc

SEQ ID NO: 1823830 - DNA, 21 bp, Homo sapiens
aggtctcgctgatgctgggct

SEQ ID NO: 1823831 - DNA, 14 bp, Homo sapiens
aggtgagaccacct

SEQ ID NO: 1823832 - DNA, 12 bp, Homo sapiens
aggtgcaggtgc

SEQ ID NO: 1823833 - DNA, 15 bp, Homo sapiens
aggtgccactccctg

SEQ ID NO: 1823834 - DNA, 16 bp, Homo sapiens
aggtgccactccctga

SEQ ID NO: 1823835 - DNA, 17 bp, Homo sapiens
aggtgccactccctgag

SEQ ID NO: 1823836 - DNA, 19 bp, Homo sapiens
aggtgccactccctgagct

SEQ ID NO: 1823837 - DNA, 18 bp, Homo sapiens
aggtgctgagcttagcct

SEQ ID NO: 1823838 - DNA, 23 bp, Homo sapiens
aggtgctgagcttagccttgtgc

SEQ ID NO: 1823839 - DNA, 20 bp, Homo sapiens
aggtgctgctaccctccctg

SEQ ID NO: 1823840 - DNA, 23 bp, Homo sapiens
aggtgctgctaccctccctgctg

SEQ ID NO: 1823841 - DNA, 15 bp, Homo sapiens
aggtgggcagctggg

SEQ ID NO: 1823842 - DNA, 18 bp, Homo sapiens
aggtgggcagctgggccc

SEQ ID NO: 1823843 - DNA, 16 bp, Homo sapiens
aggtgggccacaccca

SEQ ID NO: 1823844 - DNA, 18 bp, Homo sapiens
aggtgggcgggcagcaca

SEQ ID NO: 1823845 - DNA, 20 bp, Homo sapiens
aggtgggcgggcagcacagc

SEQ ID NO: 1823846 - DNA, 22 bp, Homo sapiens
aggtgggcgggcagcacagcaa

SEQ ID NO: 1823847 - DNA, 21 bp, Homo sapiens
aggtgggtccaggaaggcagc

SEQ ID NO: 1823848 - DNA, 22 bp, Homo sapiens
aggtgggtccaggaaggcagct

SEQ ID NO: 1823849 - DNA, 12 bp, Homo sapiens
aggtgtggtggc

SEQ ID NO: 1823850 - DNA, 20 bp, Homo sapiens
aggttaaggtgggtccagga

SEQ ID NO: 1823851 - DNA, 20 bp, Homo sapiens
aggttactcagcagcagaga

SEQ ID NO: 1823852 - DNA, 13 bp, Homo sapiens
aggttatctgcct

SEQ ID NO: 1823853 - DNA, 16 bp, Homo sapiens
aggttatctgcctggc

SEQ ID NO: 1823854 - DNA, 19 bp, Homo sapiens
aggttatctgcctggcctg

SEQ ID NO: 1823855 - DNA, 23 bp, Homo sapiens
aggttatctgcctggcctggctc

SEQ ID NO: 1823856 - DNA, 19 bp, Homo sapiens
aggttcccagggctggaga

SEQ ID NO: 1823857 - DNA, 19 bp, Homo sapiens
aggtttcactgttcatgaa

SEQ ID NO: 1823858 - DNA, 23 bp, Homo sapiens
aggtttgtttagaagaagtgtgt

SEQ ID NO: 1823859 - DNA, 24 bp, Homo sapiens
agtaaacatttgtaaaaatactgt

SEQ ID NO: 1823860 - DNA, 20 bp, Homo sapiens
agtaacaggccttgagcaca

SEQ ID NO: 1823861 - DNA, 18 bp, Homo sapiens
agtaacatgcaacaaaaa

SEQ ID NO: 1823862 - DNA, 15 bp, Homo sapiens
agtaataatgtaata

SEQ ID NO: 1823863 - DNA, 18 bp, Homo sapiens
agtaatgaaggcatattt

SEQ ID NO: 1823864 - DNA, 17 bp, Homo sapiens
agtaattttttacattt

SEQ ID NO: 1823865 - DNA, 20 bp, Homo sapiens
agtactctctgctctagcca

SEQ ID NO: 1823866 - DNA, 15 bp, Homo sapiens
agtagtagtgtcttc

SEQ ID NO: 1823867 - DNA, 22 bp, Homo sapiens
agtagtgtcttcctagtatatt

SEQ ID NO: 1823868 - DNA, 20 bp, Homo sapiens
agtataggataaattacatt

SEQ ID NO: 1823869 - DNA, 13 bp, Homo sapiens
agtatatattcta

SEQ ID NO: 1823870 - DNA, 19 bp, Homo sapiens
agtatattagtttgattta

SEQ ID NO: 1823871 - DNA, 21 bp, Homo sapiens
agtatcttcaaaaatacagaa

SEQ ID NO: 1823872 - DNA, 15 bp, Homo sapiens
agtatgtggaagtgt

SEQ ID NO: 1823873 - DNA, 13 bp, Homo sapiens
agtattaaaatgc

SEQ ID NO: 1823874 - DNA, 19 bp, Homo sapiens
agtattaaaatgcatattt

SEQ ID NO: 1823875 - DNA, 16 bp, Homo sapiens
agtattctcagtgctc

SEQ ID NO: 1823876 - DNA, 14 bp, Homo sapiens
agtcaactggctgg

SEQ ID NO: 1823877 - DNA, 17 bp, Homo sapiens
agtcaactggctggcca

SEQ ID NO: 1823878 - DNA, 23 bp, Homo sapiens
cattatgttattggaattttctt

SEQ ID NO: 1823879 - DNA, 23 bp, Homo sapiens
cattatttcaaccgcttgccata

SEQ ID NO: 1823880 - DNA, 14 bp, Homo sapiens
cattcaggcagcac

SEQ ID NO: 1823881 - DNA, 21 bp, Homo sapiens
cattcatgccaaagcaaaaga

SEQ ID NO: 1823882 - DNA, 16 bp, Homo sapiens
cattcattcactgtat

SEQ ID NO: 1823883 - DNA, 18 bp, Homo sapiens
cattccaacaatggggtg

SEQ ID NO: 1823884 - DNA, 12 bp, Homo sapiens
cattcccagcgt

SEQ ID NO: 1823885 - DNA, 18 bp, Homo sapiens
cattcccccatgtggctg

SEQ ID NO: 1823886 - DNA, 21 bp, Homo sapiens
cattcccccatgtggctgaag

SEQ ID NO: 1823887 - DNA, 13 bp, Homo sapiens
cattcctcacctt

SEQ ID NO: 1823888 - DNA, 21 bp, Homo sapiens
cattgcggcctgttgggcaga

SEQ ID NO: 1823889 - DNA, 23 bp, Homo sapiens
cattggcagcaggtgctgctacc

SEQ ID NO: 1823890 - DNA, 15 bp, Homo sapiens
cattgggctgacacc

SEQ ID NO: 1823891 - DNA, 23 bp, Homo sapiens
catttaatatttttcaaaatcaa

SEQ ID NO: 1823892 - DNA, 18 bp, Homo sapiens
catttgtaaaaatactgt

SEQ ID NO: 1823893 - DNA, 19 bp, Homo sapiens
catttgtaaaaatactgtt

SEQ ID NO: 1823894 - DNA, 23 bp, Homo sapiens
catttgtaaaaatactgtttcac

SEQ ID NO: 1823895 - DNA, 23 bp, Homo sapiens
cattttaatacagattgaaagga

SEQ ID NO: 1823896 - DNA, 20 bp, Homo sapiens
cattttacagtatcttcaaa

SEQ ID NO: 1823897 - DNA, 21 bp, Homo sapiens
cattttacagtatcttcaaaa

SEQ ID NO: 1823898 - DNA, 14 bp, Homo sapiens
cattttactaaaat

SEQ ID NO: 1823899 - DNA, 12 bp, Homo sapiens
cattttcattaa

SEQ ID NO: 1823900 - DNA, 23 bp, Homo sapiens
cattttgtacaaagatatgctaa

SEQ ID NO: 1823901 - DNA, 12 bp, Homo sapiens
catttttcagag

SEQ ID NO: 1823902 - DNA, 20 bp, Homo sapiens
catttttcagagttttctaa

SEQ ID NO: 1823903 - DNA, 21 bp, Homo sapiens
catttttcagagttttctaac

SEQ ID NO: 1823904 - DNA, 13 bp, Homo sapiens
ccaaacatctggc

SEQ ID NO: 1823905 - DNA, 16 bp, Homo sapiens
ccaaaccccagcccca

SEQ ID NO: 1823906 - DNA, 20 bp, Homo sapiens
ccaaactgcacacacagctc

SEQ ID NO: 1823907 - DNA, 15 bp, Homo sapiens
ccaaagcaaaagaag

SEQ ID NO: 1823908 - DNA, 17 bp, Homo sapiens
ccaaatgcacaagctca

SEQ ID NO: 1823909 - DNA, 16 bp, Homo sapiens
ccaaattgcttctagg

SEQ ID NO: 1823910 - DNA, 14 bp, Homo sapiens
ccaacaatggggtg

SEQ ID NO: 1823911 - DNA, 12 bp, Homo sapiens
ccaacccagccg

SEQ ID NO: 1823912 - DNA, 13 bp, Homo sapiens
ccaacccagccgc

SEQ ID NO: 1823913 - DNA, 16 bp, Homo sapiens
ccaacccagccgctgc

SEQ ID NO: 1823914 - DNA, 19 bp, Homo sapiens
ccaacccagccgctgcccg

SEQ ID NO: 1823915 - DNA, 14 bp, Homo sapiens
ccaactccaggggc

SEQ ID NO: 1823916 - DNA, 16 bp, Homo sapiens
ccaactccaggggcac

SEQ ID NO: 1823917 - DNA, 18 bp, Homo sapiens
ccaactccaggggcacct

SEQ ID NO: 1823918 - DNA, 20 bp, Homo sapiens
ccaactctatactcaatcaa

SEQ ID NO: 1823919 - DNA, 14 bp, Homo sapiens
ccaagcagccagcc

SEQ ID NO: 1823920 - DNA, 15 bp, Homo sapiens
ccaagcagccagcca

SEQ ID NO: 1823921 - DNA, 18 bp, Homo sapiens
ccaagcagccagccagtc

SEQ ID NO: 1823922 - DNA, 13 bp, Homo sapiens
ccaagctgtgcca

SEQ ID NO: 1823923 - DNA, 14 bp, Homo sapiens
ccaagctgtgccac

SEQ ID NO: 1823924 - DNA, 17 bp, Homo sapiens
ccaagctgtgccaccct

SEQ ID NO: 1823925 - DNA, 21 bp, Homo sapiens
ccaaggagctgatttccaggc

SEQ ID NO: 1823926 - DNA, 21 bp, Homo sapiens
ccaaggaggtgggccacaccc

SEQ ID NO: 1823927 - DNA, 13 bp, Homo sapiens
ccaaggcagcctc

SEQ ID NO: 1823928 - DNA, 20 bp, Homo sapiens
ccaaggcagcctccagagcc

SEQ ID NO: 1823929 - DNA, 19 bp, Homo sapiens
ccaaggctctcccctctcg

SEQ ID NO: 1823930 - DNA, 23 bp, Homo sapiens
ccaaggtggtctgctcgggccca

SEQ ID NO: 1823931 - DNA, 13 bp, Homo sapiens
ccaagtttttcag

SEQ ID NO: 1823932 - DNA, 15 bp, Homo sapiens
ccaagtttttcagaa

SEQ ID NO: 1823933 - DNA, 14 bp, Homo sapiens
ccaataaagctgga

SEQ ID NO: 1823934 - DNA, 18 bp, Homo sapiens
ccaatacgtagatttttg

SEQ ID NO: 1823935 - DNA, 18 bp, Homo sapiens
ccaattgcctcttgcagg

SEQ ID NO: 1823936 - DNA, 21 bp, Homo sapiens
ccacaaatcaaagcaagggct

SEQ ID NO: 1823937 - DNA, 13 bp, Homo sapiens
ccacaccaagctg

SEQ ID NO: 1823938 - DNA, 20 bp, Homo sapiens
ccacaccaagctgtgccacc

SEQ ID NO: 1823939 - DNA, 23 bp, Homo sapiens
ccacaccaagctgtgccaccctg

SEQ ID NO: 1823940 - DNA, 12 bp, Homo sapiens
ccacacccagga

SEQ ID NO: 1823941 - DNA, 15 bp, Homo sapiens
ccacacccaggaagg

SEQ ID NO: 1823942 - DNA, 14 bp, Homo sapiens
ccacagcccacgtc

SEQ ID NO: 1823943 - DNA, 17 bp, Homo sapiens
ccacagcttcctgaggg

SEQ ID NO: 1823944 - DNA, 18 bp, Homo sapiens
ccacaggggcaggcctgg

SEQ ID NO: 1823945 - DNA, 16 bp, Homo sapiens
ccacagtgacagtcac

SEQ ID NO: 1823946 - DNA, 17 bp, Homo sapiens
ccacagtgacagtcact

SEQ ID NO: 1823947 - DNA, 15 bp, Homo sapiens
ccacagtgctgcttc

SEQ ID NO: 1823948 - DNA, 22 bp, Homo sapiens
ccacagtgttggcgagaggagg

SEQ ID NO: 1823949 - DNA, 13 bp, Homo sapiens
ccacatttttcca

SEQ ID NO: 1823950 - DNA, 15 bp, Homo sapiens
ccaccaaactgcaca

SEQ ID NO: 1823951 - DNA, 14 bp, Homo sapiens
ccaccacgtctgcc

SEQ ID NO: 1823952 - DNA, 23 bp, Homo sapiens
ccaccagaacgcaccccactggg

SEQ ID NO: 1823953 - DNA, 21 bp, Homo sapiens
ccacccatcttcctgctgctg

SEQ ID NO: 1823954 - DNA, 18 bp, Homo sapiens
ccaccccaaaccccagcc

SEQ ID NO: 1823955 - DNA, 21 bp, Homo sapiens
ccaccccaaaccccagcccca

SEQ ID NO: 1823956 - DNA, 18 bp, Homo sapiens
ccaccctcgtggacacct

SEQ ID NO: 1823957 - DNA, 22 bp, Homo sapiens
ccaccctcgtggacacctgccc

SEQ ID NO: 1823958 - DNA, 13 bp, Homo sapiens
ccaccctgggctc

SEQ ID NO: 1823959 - DNA, 17 bp, Homo sapiens
ccaccctgggctctgtg

SEQ ID NO: 1823960 - DNA, 23 bp, Homo sapiens
ccaccctgggctctgtgggctgc

SEQ ID NO: 1823961 - DNA, 13 bp, Homo sapiens
ccaccgcatgccc

SEQ ID NO: 1823962 - DNA, 16 bp, Homo sapiens
ccaccgcatgccccct

SEQ ID NO: 1823963 - DNA, 17 bp, Homo sapiens
ccaccgcatgccccctc

SEQ ID NO: 1823964 - DNA, 17 bp, Homo sapiens
ccaccgccatggcttcc

SEQ ID NO: 1823965 - DNA, 17 bp, Homo sapiens
ccacctacttgtgactg

SEQ ID NO: 1823966 - DNA, 15 bp, Homo sapiens
ccacctagtggctgt

SEQ ID NO: 1823967 - DNA, 20 bp, Homo sapiens
ccacctagtggctgtccagt

SEQ ID NO: 1823968 - DNA, 17 bp, Homo sapiens
ccacctcatgcctggcc

SEQ ID NO: 1823969 - DNA, 23 bp, Homo sapiens
ccacctcctagaggtgggcagct

SEQ ID NO: 1823970 - DNA, 13 bp, Homo sapiens
ccacctctcaata

SEQ ID NO: 1823971 - DNA, 14 bp, Homo sapiens
ccacctgcctatcc

SEQ ID NO: 1823972 - DNA, 19 bp, Homo sapiens
ccacctgcctatccatcct

SEQ ID NO: 1823973 - DNA, 16 bp, Homo sapiens
ccacctgtctgtctgt

SEQ ID NO: 1823974 - DNA, 15 bp, Homo sapiens
ccacgagtcacctgc

SEQ ID NO: 1823975 - DNA, 23 bp, Homo sapiens
ccacgagtcacctgcaagcccca

SEQ ID NO: 1823976 - DNA, 14 bp, Homo sapiens
ccacgccttgacct

SEQ ID NO: 1823977 - DNA, 24 bp, Homo sapiens
ccacggtgcgtggctgtggcacag

SEQ ID NO: 1823978 - DNA, 19 bp, Homo sapiens
ccacgtcctgtcagtgccg

SEQ ID NO: 1823979 - DNA, 13 bp, Homo sapiens
ccacgtctgccag

SEQ ID NO: 1823980 - DNA, 14 bp, Homo sapiens
ccacgtctgccagg

SEQ ID NO: 1823981 - DNA, 18 bp, Homo sapiens
ccacgtctgccaggccca

SEQ ID NO: 1823982 - DNA, 22 bp, Homo sapiens
ccacgtctgccaggcccatctc

SEQ ID NO: 1823983 - DNA, 14 bp, Homo sapiens
ccactacctttgtc

SEQ ID NO: 1823984 - DNA, 13 bp, Homo sapiens
ccactcaccaggg

SEQ ID NO: 1823985 - DNA, 17 bp, Homo sapiens
ccactcccacttccctg

SEQ ID NO: 1823986 - DNA, 22 bp, Homo sapiens
ccactcccacttccctgacact

SEQ ID NO: 1823987 - DNA, 23 bp, Homo sapiens
ccactcccacttccctgacactg

SEQ ID NO: 1823988 - DNA, 14 bp, Homo sapiens
ccactccctgagct

SEQ ID NO: 1823989 - DNA, 15 bp, Homo sapiens
ccactccctgagctt

SEQ ID NO: 1823990 - DNA, 18 bp, Homo sapiens
ccactccctgagctttgg

SEQ ID NO: 1823991 - DNA, 13 bp, Homo sapiens
ccactcctgtccc

SEQ ID NO: 1823992 - DNA, 14 bp, Homo sapiens
ccactcgcagtcgc

SEQ ID NO: 1823993 - DNA, 17 bp, Homo sapiens
ccactcgcagtcgcagg

SEQ ID NO: 1823994 - DNA, 13 bp, Homo sapiens
ccactctcggggc

SEQ ID NO: 1823995 - DNA, 22 bp, Homo sapiens
ccactgaaaacatttcaaagct

SEQ ID NO: 1823996 - DNA, 23 bp, Homo sapiens
ccactgaaaacatttcaaagctg

SEQ ID NO: 1823997 - DNA, 16 bp, Homo sapiens
cagtgggtggcacctc

SEQ ID NO: 1823998 - DNA, 20 bp, Homo sapiens
cagtgggtggcacctcctga

SEQ ID NO: 1823999 - DNA, 21 bp, Homo sapiens
cagtgggtggcacctcctgag

SEQ ID NO: 1824000 - DNA, 23 bp, Homo sapiens
cagtgggtggcacctcctgagaa

SEQ ID NO: 1824001 - DNA, 19 bp, Homo sapiens
cagtgtacccccgcccagg

SEQ ID NO: 1824002 - DNA, 14 bp, Homo sapiens
cagtgtctgggctg

SEQ ID NO: 1824003 - DNA, 15 bp, Homo sapiens
cagtgtctgggctga

SEQ ID NO: 1824004 - DNA, 13 bp, Homo sapiens
cagtgtcttcctg

SEQ ID NO: 1824005 - DNA, 15 bp, Homo sapiens
cagtgtgccccccat

SEQ ID NO: 1824006 - DNA, 13 bp, Homo sapiens
cagtgtggagagg

SEQ ID NO: 1824007 - DNA, 21 bp, Homo sapiens
cagtgttaggcctggcacagt

SEQ ID NO: 1824008 - DNA, 21 bp, Homo sapiens
cagttcacttctttgcagagc

SEQ ID NO: 1824009 - DNA, 17 bp, Homo sapiens
cagttcccggagcacag

SEQ ID NO: 1824010 - DNA, 21 bp, Homo sapiens
cagttcccggagcacagccct

SEQ ID NO: 1824011 - DNA, 16 bp, Homo sapiens
cagttctagttgattg

SEQ ID NO: 1824012 - DNA, 15 bp, Homo sapiens
cagttggcagagaag

SEQ ID NO: 1824013 - DNA, 21 bp, Homo sapiens
cagttggcagagaaggcctct

SEQ ID NO: 1824014 - DNA, 19 bp, Homo sapiens
cagttgtctattctgagcc

SEQ ID NO: 1824015 - DNA, 20 bp, Homo sapiens
cagttgtctattctgagcct

SEQ ID NO: 1824016 - DNA, 18 bp, Homo sapiens
cagtttagaacagaggga

SEQ ID NO: 1824017 - DNA, 21 bp, Homo sapiens
cagtttagaacagagggacca

SEQ ID NO: 1824018 - DNA, 23 bp, Homo sapiens
cataaaaagaggatgatttcaga

SEQ ID NO: 1824019 - DNA, 20 bp, Homo sapiens
cataaagtatgccttcctgt

SEQ ID NO: 1824020 - DNA, 22 bp, Homo sapiens
catacacccccacctcctgcaa

SEQ ID NO: 1824021 - DNA, 11 bp, Homo sapiens
catacattata

SEQ ID NO: 1824022 - DNA, 16 bp, Homo sapiens
catacggggtggctga

SEQ ID NO: 1824023 - DNA, 15 bp, Homo sapiens
catactggcctcgcc

SEQ ID NO: 1824024 - DNA, 18 bp, Homo sapiens
catactggcctcgcctgg

SEQ ID NO: 1824025 - DNA, 19 bp, Homo sapiens
catatggagcatttttcag

SEQ ID NO: 1824026 - DNA, 15 bp, Homo sapiens
catattttaaaaaat

SEQ ID NO: 1824027 - DNA, 17 bp, Homo sapiens
catattttaaaaaatca

SEQ ID NO: 1824028 - DNA, 18 bp, Homo sapiens
catattttaaaaaatcaa

SEQ ID NO: 1824029 - DNA, 21 bp, Homo sapiens
catcaatcaaatattttttga

SEQ ID NO: 1824030 - DNA, 22 bp, Homo sapiens
catcaatcaaatattttttgag

SEQ ID NO: 1824031 - DNA, 13 bp, Homo sapiens
catcaggcactgg

SEQ ID NO: 1824032 - DNA, 19 bp, Homo sapiens
catcaggtcccccccaggt

SEQ ID NO: 1824033 - DNA, 21 bp, Homo sapiens
catcatgtttacagaggacag

SEQ ID NO: 1824034 - DNA, 16 bp, Homo sapiens
catcattcattcactg

SEQ ID NO: 1824035 - DNA, 19 bp, Homo sapiens
catccacccagtgctgcca

SEQ ID NO: 1824036 - DNA, 20 bp, Homo sapiens
catccacccagtgctgccat

SEQ ID NO: 1824037 - DNA, 21 bp, Homo sapiens
catccacccagtgctgccatg

SEQ ID NO: 1824038 - DNA, 22 bp, Homo sapiens
catccacccagtgctgccatgc

SEQ ID NO: 1824039 - DNA, 16 bp, Homo sapiens
catccagcctgtgtgt

SEQ ID NO: 1824040 - DNA, 13 bp, Homo sapiens
catcccccctcac

SEQ ID NO: 1824041 - DNA, 14 bp, Homo sapiens
catcccccctcacc

SEQ ID NO: 1824042 - DNA, 17 bp, Homo sapiens
catcccccctcaccagg

SEQ ID NO: 1824043 - DNA, 21 bp, Homo sapiens
catcccctccctgcctgctcc

SEQ ID NO: 1824044 - DNA, 22 bp, Homo sapiens
catcccctccctgcctgctcct

SEQ ID NO: 1824045 - DNA, 20 bp, Homo sapiens
catcccctcgtcctgtccca

SEQ ID NO: 1824046 - DNA, 21 bp, Homo sapiens
catcccctcgtcctgtcccag

SEQ ID NO: 1824047 - DNA, 16 bp, Homo sapiens
catcccggcctcttcc

SEQ ID NO: 1824048 - DNA, 18 bp, Homo sapiens
catcccggcctcttccac

SEQ ID NO: 1824049 - DNA, 22 bp, Homo sapiens
catccctgcttgcccgctccca

SEQ ID NO: 1824050 - DNA, 23 bp, Homo sapiens
catccctgcttgcccgctcccac

SEQ ID NO: 1824051 - DNA, 16 bp, Homo sapiens
catcctcattcactaa

SEQ ID NO: 1824052 - DNA, 13 bp, Homo sapiens
catcctggcccat

SEQ ID NO: 1824053 - DNA, 14 bp, Homo sapiens
catccttatgagac

SEQ ID NO: 1824054 - DNA, 15 bp, Homo sapiens
catcgtgacccttca

SEQ ID NO: 1824055 - DNA, 18 bp, Homo sapiens
catcgtgacccttcaggg

SEQ ID NO: 1824056 - DNA, 19 bp, Homo sapiens
catcgtgacccttcagggc

SEQ ID NO: 1824057 - DNA, 12 bp, Homo sapiens
catctcaggtgc

SEQ ID NO: 1824058 - DNA, 15 bp, Homo sapiens
catctcaggtgccac

SEQ ID NO: 1824059 - DNA, 19 bp, Homo sapiens
catctcaggtgccactccc

SEQ ID NO: 1824060 - DNA, 21 bp, Homo sapiens
catctccatgtagaataaatg

SEQ ID NO: 1824061 - DNA, 17 bp, Homo sapiens
catctccccaggcctcc

SEQ ID NO: 1824062 - DNA, 20 bp, Homo sapiens
catctcctcccatggccttc

SEQ ID NO: 1824063 - DNA, 12 bp, Homo sapiens
catctcttcaat

SEQ ID NO: 1824064 - DNA, 15 bp, Homo sapiens
catctcttcaatcac

SEQ ID NO: 1824065 - DNA, 12 bp, Homo sapiens
catctgcccagg

SEQ ID NO: 1824066 - DNA, 14 bp, Homo sapiens
catctgcccaggac

SEQ ID NO: 1824067 - DNA, 12 bp, Homo sapiens
catcttcattaa

SEQ ID NO: 1824068 - DNA, 14 bp, Homo sapiens
catcttccaggtgg

SEQ ID NO: 1824069 - DNA, 21 bp, Homo sapiens
catcttccaggtggggtgagg

SEQ ID NO: 1824070 - DNA, 14 bp, Homo sapiens
catcttcctgctgc

SEQ ID NO: 1824071 - DNA, 19 bp, Homo sapiens
catgactagtgcctagaaa

SEQ ID NO: 1824072 - DNA, 12 bp, Homo sapiens
catgattttctt

SEQ ID NO: 1824073 - DNA, 14 bp, Homo sapiens
catgcaacaaaaat

SEQ ID NO: 1824074 - DNA, 14 bp, Homo sapiens
catgccactgccag

SEQ ID NO: 1824075 - DNA, 18 bp, Homo sapiens
catgccactgccaggcac

SEQ ID NO: 1824076 - DNA, 20 bp, Homo sapiens
catgccactgccaggcacct

SEQ ID NO: 1824077 - DNA, 21 bp, Homo sapiens
catgccaggttaggaaggcag

SEQ ID NO: 1824078 - DNA, 15 bp, Homo sapiens
catgccccctcgtgc

SEQ ID NO: 1824079 - DNA, 19 bp, Homo sapiens
catgccccctcgtgccagt

SEQ ID NO: 1824080 - DNA, 19 bp, Homo sapiens
catgcctcatgccacacct

SEQ ID NO: 1824081 - DNA, 21 bp, Homo sapiens
catgcctggcccccctccagg

SEQ ID NO: 1824082 - DNA, 14 bp, Homo sapiens
catgctcaaccccc

SEQ ID NO: 1824083 - DNA, 20 bp, Homo sapiens
catgctcaacccccctccca

SEQ ID NO: 1824084 - DNA, 23 bp, Homo sapiens
catgctcaacccccctcccagac

SEQ ID NO: 1824085 - DNA, 14 bp, Homo sapiens
catgctctgcccca

SEQ ID NO: 1824086 - DNA, 22 bp, Homo sapiens
catgctctgccccaagccccca

SEQ ID NO: 1824087 - DNA, 20 bp, Homo sapiens
catgctgctttttggcacag

SEQ ID NO: 1824088 - DNA, 15 bp, Homo sapiens
catgctttctccttt

SEQ ID NO: 1824089 - DNA, 12 bp, Homo sapiens
catggcaccagc

SEQ ID NO: 1824090 - DNA, 20 bp, Homo sapiens
catggcaccagccccctgga

SEQ ID NO: 1824091 - DNA, 22 bp, Homo sapiens
catggcaccagccccctggatg

SEQ ID NO: 1824092 - DNA, 19 bp, Homo sapiens
catggcgtaatgggcctgc

SEQ ID NO: 1824093 - DNA, 16 bp, Homo sapiens
catggctcaggcaagc

SEQ ID NO: 1824094 - DNA, 13 bp, Homo sapiens
catgggcactgct

SEQ ID NO: 1824095 - DNA, 15 bp, Homo sapiens
catgggcactgctgg

SEQ ID NO: 1824096 - DNA, 18 bp, Homo sapiens
catgggcactgctgggtg

SEQ ID NO: 1824097 - DNA, 19 bp, Homo sapiens
catgggcactgctgggtgg

SEQ ID NO: 1824098 - DNA, 13 bp, Homo sapiens
catgggcctgggc

SEQ ID NO: 1824099 - DNA, 19 bp, Homo sapiens
catgggctagtgtgagtgg

SEQ ID NO: 1824100 - DNA, 23 bp, Homo sapiens
catgggcttggacttcctggggc

SEQ ID NO: 1824101 - DNA, 19 bp, Homo sapiens
catggggctgattgtattt

SEQ ID NO: 1824102 - DNA, 17 bp, Homo sapiens
catggtagactgtgaca

SEQ ID NO: 1824103 - DNA, 13 bp, Homo sapiens
catggtgtgtcat

SEQ ID NO: 1824104 - DNA, 15 bp, Homo sapiens
catgtaaaggccttt

SEQ ID NO: 1824105 - DNA, 17 bp, Homo sapiens
catgtagaataaatgaa

SEQ ID NO: 1824106 - DNA, 18 bp, Homo sapiens
catgtagaataaatgaag

SEQ ID NO: 1824107 - DNA, 14 bp, Homo sapiens
catgtgtgcctgtg

SEQ ID NO: 1824108 - DNA, 16 bp, Homo sapiens
catgtgtgcctgtggc

SEQ ID NO: 1824109 - DNA, 17 bp, Homo sapiens
catgtgtgcctgtggca

SEQ ID NO: 1824110 - DNA, 20 bp, Homo sapiens
cattaaaaggaaaaaagaaa

SEQ ID NO: 1824111 - DNA, 20 bp, Homo sapiens
cattaaaatagcacatgatt

SEQ ID NO: 1824112 - DNA, 13 bp, Homo sapiens
cattaatactgtg

SEQ ID NO: 1824113 - DNA, 17 bp, Homo sapiens
cattatagtaaatctat

SEQ ID NO: 1824114 - DNA, 20 bp, Homo sapiens
cattatctgtactgaaagca

SEQ ID NO: 1824115 - DNA, 14 bp, Homo sapiens
ccactgcaccccct

SEQ ID NO: 1824116 - DNA, 20 bp, Homo sapiens
ccactgcaccccctcctgct

SEQ ID NO: 1824117 - DNA, 22 bp, Homo sapiens
ccactgcaccccctcctgctgc

SEQ ID NO: 1824118 - DNA, 15 bp, Homo sapiens
ccactgccaggcacc

SEQ ID NO: 1824119 - DNA, 16 bp, Homo sapiens
ccactgccaggcacct

SEQ ID NO: 1824120 - DNA, 15 bp, Homo sapiens
ccactgccctgcctg

SEQ ID NO: 1824121 - DNA, 18 bp, Homo sapiens
ccactgctgaaaaagaaa

SEQ ID NO: 1824122 - DNA, 20 bp, Homo sapiens
ccactgctgaaaaagaaaaa

SEQ ID NO: 1824123 - DNA, 12 bp, Homo sapiens
ccactgtggcca

SEQ ID NO: 1824124 - DNA, 17 bp, Homo sapiens
ccactgtggccagagct

SEQ ID NO: 1824125 - DNA, 22 bp, Homo sapiens
ccacttagccgtccatggcacc

SEQ ID NO: 1824126 - DNA, 13 bp, Homo sapiens
ccacttcccctcc

SEQ ID NO: 1824127 - DNA, 15 bp, Homo sapiens
ccacttccctgacac

SEQ ID NO: 1824128 - DNA, 20 bp, Homo sapiens
ccacttcttaaaggcctgga

SEQ ID NO: 1824129 - DNA, 22 bp, Homo sapiens
ccacttcttaaaggcctggaac

SEQ ID NO: 1824130 - DNA, 15 bp, Homo sapiens
ccagaaacagggaca

SEQ ID NO: 1824131 - DNA, 15 bp, Homo sapiens
ccagaaagcctcctg

SEQ ID NO: 1824132 - DNA, 21 bp, Homo sapiens
ccagaaagcctcctgccccct

SEQ ID NO: 1824133 - DNA, 23 bp, Homo sapiens
ccagaaagcctcctgccccctgc

SEQ ID NO: 1824134 - DNA, 16 bp, Homo sapiens
ccagaaggagggcaga

SEQ ID NO: 1824135 - DNA, 21 bp, Homo sapiens
ccagaaggagggcagagccat

SEQ ID NO: 1824136 - DNA, 13 bp, Homo sapiens
ccagaatctgctg

SEQ ID NO: 1824137 - DNA, 17 bp, Homo sapiens
ccagaatctgctgttgc

SEQ ID NO: 1824138 - DNA, 18 bp, Homo sapiens
ccagaatctgctgttgcc

SEQ ID NO: 1824139 - DNA, 12 bp, Homo sapiens
ccagacaggccc

SEQ ID NO: 1824140 - DNA, 17 bp, Homo sapiens
ccagacaggccctccct

SEQ ID NO: 1824141 - DNA, 19 bp, Homo sapiens
ccagactgaaccagagctg

SEQ ID NO: 1824142 - DNA, 15 bp, Homo sapiens
ccagagaggagcacc

SEQ ID NO: 1824143 - DNA, 16 bp, Homo sapiens
ccagagaggagcacct

SEQ ID NO: 1824144 - DNA, 17 bp, Homo sapiens
ccagagaggagcacctg

SEQ ID NO: 1824145 - DNA, 13 bp, Homo sapiens
ccagagagggccc

SEQ ID NO: 1824146 - DNA, 14 bp, Homo sapiens
ccagagagggccca

SEQ ID NO: 1824147 - DNA, 23 bp, Homo sapiens
ccagagagggcccagctgtagcc

SEQ ID NO: 1824148 - DNA, 18 bp, Homo sapiens
ccagagctggaacacaat

SEQ ID NO: 1824149 - DNA, 14 bp, Homo sapiens
ccagagctggaagg

SEQ ID NO: 1824150 - DNA, 17 bp, Homo sapiens
ccagagctggaaggcag

SEQ ID NO: 1824151 - DNA, 21 bp, Homo sapiens
ccagagctggaaggcagggca

SEQ ID NO: 1824152 - DNA, 23 bp, Homo sapiens
ccagagctggaaggcagggcaga

SEQ ID NO: 1824153 - DNA, 20 bp, Homo sapiens
ccagaggttatctgcctggc

SEQ ID NO: 1824154 - DNA, 23 bp, Homo sapiens
ccagaggttatctgcctggcctg

SEQ ID NO: 1824155 - DNA, 13 bp, Homo sapiens
ccagagtctgagc

SEQ ID NO: 1824156 - DNA, 16 bp, Homo sapiens
ccagagtctgagcccc

SEQ ID NO: 1824157 - DNA, 17 bp, Homo sapiens
ccagagtctgagccccc

SEQ ID NO: 1824158 - DNA, 23 bp, Homo sapiens
ccagagtctgagcccccggctag

SEQ ID NO: 1824159 - DNA, 19 bp, Homo sapiens
ccagagtgaaagggctatg

SEQ ID NO: 1824160 - DNA, 13 bp, Homo sapiens
ccagatctgcctg

SEQ ID NO: 1824161 - DNA, 24 bp, Homo sapiens
ccagatctgcctgggcctgtgcag

SEQ ID NO: 1824162 - DNA, 14 bp, Homo sapiens
ccagcacaggggcc

SEQ ID NO: 1824163 - DNA, 20 bp, Homo sapiens
ccagcacaggggccccagat

SEQ ID NO: 1824164 - DNA, 18 bp, Homo sapiens
ccagcacccgggctcagg

SEQ ID NO: 1824165 - DNA, 23 bp, Homo sapiens
ccagcacccgggctcagggacca

SEQ ID NO: 1824166 - DNA, 18 bp, Homo sapiens
ccagcagctgcgggtctg

SEQ ID NO: 1824167 - DNA, 23 bp, Homo sapiens
ccagcagctgcgggtctgaagga

SEQ ID NO: 1824168 - DNA, 23 bp, Homo sapiens
ccagcaggtgtggtggctcatgg

SEQ ID NO: 1824169 - DNA, 17 bp, Homo sapiens
ccagcatccagcctgtg

SEQ ID NO: 1824170 - DNA, 19 bp, Homo sapiens
ccagcatccagcctgtgtg

SEQ ID NO: 1824171 - DNA, 15 bp, Homo sapiens
ccagccagcccttcc

SEQ ID NO: 1824172 - DNA, 14 bp, Homo sapiens
ccagccagtcttgc

SEQ ID NO: 1824173 - DNA, 16 bp, Homo sapiens
ccagccagtcttgcct

SEQ ID NO: 1824174 - DNA, 18 bp, Homo sapiens
ccagcccacagagcctga

SEQ ID NO: 1824175 - DNA, 22 bp, Homo sapiens
ccagccccctggatgggcattg

SEQ ID NO: 1824176 - DNA, 19 bp, Homo sapiens
ccagcccttccctggcccc

SEQ ID NO: 1824177 - DNA, 15 bp, Homo sapiens
ccagcccttctgcct

SEQ ID NO: 1824178 - DNA, 22 bp, Homo sapiens
ccagccctttgcaggcccagca

SEQ ID NO: 1824179 - DNA, 23 bp, Homo sapiens
ccagccctttgcaggcccagcag

SEQ ID NO: 1824180 - DNA, 18 bp, Homo sapiens
ccagccgcaggaaggcag

SEQ ID NO: 1824181 - DNA, 18 bp, Homo sapiens
ccagcctcccctcccctg

SEQ ID NO: 1824182 - DNA, 22 bp, Homo sapiens
ccagcctctcccggctgcctgc

SEQ ID NO: 1824183 - DNA, 17 bp, Homo sapiens
ccagcctggcccagctc

SEQ ID NO: 1824184 - DNA, 18 bp, Homo sapiens
ccagcctggcccagctcc

SEQ ID NO: 1824185 - DNA, 19 bp, Homo sapiens
ccagcctggcccagctccc

SEQ ID NO: 1824186 - DNA, 14 bp, Homo sapiens
ccagcctgggactc

SEQ ID NO: 1824187 - DNA, 18 bp, Homo sapiens
ccagcctgtgtgttctgt

SEQ ID NO: 1824188 - DNA, 20 bp, Homo sapiens
ccagctactctgtccaggcc

SEQ ID NO: 1824189 - DNA, 23 bp, Homo sapiens
ccagctactctgtccaggccact

SEQ ID NO: 1824190 - DNA, 15 bp, Homo sapiens
ccagctctgtggcct

SEQ ID NO: 1824191 - DNA, 17 bp, Homo sapiens
ccagctctgtggcctgt

SEQ ID NO: 1824192 - DNA, 18 bp, Homo sapiens
ccagctctgtggcctgtg

SEQ ID NO: 1824193 - DNA, 15 bp, Homo sapiens
ccagctgacagtcct

SEQ ID NO: 1824194 - DNA, 11 bp, Homo sapiens
ccagctgcctt

SEQ ID NO: 1824195 - DNA, 14 bp, Homo sapiens
ccagctgccttcct

SEQ ID NO: 1824196 - DNA, 14 bp, Homo sapiens
ccagctgctctgcc

SEQ ID NO: 1824197 - DNA, 22 bp, Homo sapiens
ccagctgctctgccccttgggc

SEQ ID NO: 1824198 - DNA, 14 bp, Homo sapiens
ccagctgtagccat

SEQ ID NO: 1824199 - DNA, 15 bp, Homo sapiens
ccagctgtagccatg

SEQ ID NO: 1824200 - DNA, 21 bp, Homo sapiens
ccagctgtagccatggctcag

SEQ ID NO: 1824201 - DNA, 14 bp, Homo sapiens
ccagcttcctggtg

SEQ ID NO: 1824202 - DNA, 15 bp, Homo sapiens
ccaggaaggcagctg

SEQ ID NO: 1824203 - DNA, 16 bp, Homo sapiens
ccaggaaggcagctgc

SEQ ID NO: 1824204 - DNA, 16 bp, Homo sapiens
ccaggacggggccggc

SEQ ID NO: 1824205 - DNA, 18 bp, Homo sapiens
ccaggacggggccggcca

SEQ ID NO: 1824206 - DNA, 13 bp, Homo sapiens
ccaggagtctgtg

SEQ ID NO: 1824207 - DNA, 15 bp, Homo sapiens
ccaggagtctgtgct

SEQ ID NO: 1824208 - DNA, 17 bp, Homo sapiens
ccaggagtctgtgctct

SEQ ID NO: 1824209 - DNA, 14 bp, Homo sapiens
ccaggatcctgcag

SEQ ID NO: 1824210 - DNA, 16 bp, Homo sapiens
ccaggatcctgcagga

SEQ ID NO: 1824211 - DNA, 17 bp, Homo sapiens
ccaggatcctgcaggaa

SEQ ID NO: 1824212 - DNA, 13 bp, Homo sapiens
ccaggcacctggc

SEQ ID NO: 1824213 - DNA, 15 bp, Homo sapiens
ccaggcacctggcct

SEQ ID NO: 1824214 - DNA, 16 bp, Homo sapiens
ccaggcacctggcctg

SEQ ID NO: 1824215 - DNA, 18 bp, Homo sapiens
ccaggcacctggcctgct

SEQ ID NO: 1824216 - DNA, 18 bp, Homo sapiens
ccaggcatgctggcctcc

SEQ ID NO: 1824217 - DNA, 15 bp, Homo sapiens
ccaggccactgtggc

SEQ ID NO: 1824218 - DNA, 19 bp, Homo sapiens
ccaggccactgtggccaga

SEQ ID NO: 1824219 - DNA, 20 bp, Homo sapiens
ccaggccactgtggccagag

SEQ ID NO: 1824220 - DNA, 21 bp, Homo sapiens
ccaggccactgtggccagagc

SEQ ID NO: 1824221 - DNA, 21 bp, Homo sapiens
ccaggcccatctcaggtgcca

SEQ ID NO: 1824222 - DNA, 12 bp, Homo sapiens
ccaggcccctga

SEQ ID NO: 1824223 - DNA, 21 bp, Homo sapiens
ccaggccctaggattcctccc

SEQ ID NO: 1824224 - DNA, 21 bp, Homo sapiens
ccaggccctccatgggctagt

SEQ ID NO: 1824225 - DNA, 20 bp, Homo sapiens
ccaggccgttccccttggct

SEQ ID NO: 1824226 - DNA, 21 bp, Homo sapiens
ccaggccgttccccttggctt

SEQ ID NO: 1824227 - DNA, 22 bp, Homo sapiens
ccaggccgttccccttggcttc

SEQ ID NO: 1824228 - DNA, 13 bp, Homo sapiens
ccaggcctccagc

SEQ ID NO: 1824229 - DNA, 18 bp, Homo sapiens
ccaggcctccagcctctc

SEQ ID NO: 1824230 - DNA, 14 bp, Homo sapiens
ccaggctcttcctg

SEQ ID NO: 1824231 - DNA, 14 bp, Homo sapiens
ccaggctgcactgc

SEQ ID NO: 1824232 - DNA, 15 bp, Homo sapiens
ccaggctgcactgca

SEQ ID NO: 1824233 - DNA, 15 bp, Homo sapiens
ccgtttatgggcctt

SEQ ID NO: 1824234 - DNA, 15 bp, Homo sapiens
ccgttttggggacgt

SEQ ID NO: 1824235 - DNA, 13 bp, Homo sapiens
cctaccccacctc

SEQ ID NO: 1824236 - DNA, 19 bp, Homo sapiens
cctaccccacctcatgcct

SEQ ID NO: 1824237 - DNA, 13 bp, Homo sapiens
cctaccctcccac

SEQ ID NO: 1824238 - DNA, 18 bp, Homo sapiens
cctacttgtgactgaagg

SEQ ID NO: 1824239 - DNA, 13 bp, Homo sapiens
cctagaaagcaat

SEQ ID NO: 1824240 - DNA, 18 bp, Homo sapiens
cctagaaagcaatgtgat

SEQ ID NO: 1824241 - DNA, 17 bp, Homo sapiens
cctagaggtgggcagct

SEQ ID NO: 1824242 - DNA, 19 bp, Homo sapiens
cctagaggtgggcagctgg

SEQ ID NO: 1824243 - DNA, 22 bp, Homo sapiens
cctagaggtgggcagctgggcc

SEQ ID NO: 1824244 - DNA, 23 bp, Homo sapiens
cctagaggtgggcagctgggccc

SEQ ID NO: 1824245 - DNA, 12 bp, Homo sapiens
cctagcccagtg

SEQ ID NO: 1824246 - DNA, 20 bp, Homo sapiens
cctaggagttgagtacagtg

SEQ ID NO: 1824247 - DNA, 20 bp, Homo sapiens
cctaggccaaatgcacaagc

SEQ ID NO: 1824248 - DNA, 16 bp, Homo sapiens
cctagtactctctgct

SEQ ID NO: 1824249 - DNA, 15 bp, Homo sapiens
cctagtggctgtcca

SEQ ID NO: 1824250 - DNA, 19 bp, Homo sapiens
cctagtggctgtccagtgc

SEQ ID NO: 1824251 - DNA, 17 bp, Homo sapiens
cctatcagtgtgccccc

SEQ ID NO: 1824252 - DNA, 18 bp, Homo sapiens
cctatcagtgtgcccccc

SEQ ID NO: 1824253 - DNA, 23 bp, Homo sapiens
cctatcatcagttaggattaggt

SEQ ID NO: 1824254 - DNA, 12 bp, Homo sapiens
cctatccatcct

SEQ ID NO: 1824255 - DNA, 19 bp, Homo sapiens
cctatctgtgattccccca

SEQ ID NO: 1824256 - DNA, 20 bp, Homo sapiens
cctatgagatggccatgctc

SEQ ID NO: 1824257 - DNA, 14 bp, Homo sapiens
cctatgtcttgtat

SEQ ID NO: 1824258 - DNA, 17 bp, Homo sapiens
cctatgtgagtttcaga

SEQ ID NO: 1824259 - DNA, 19 bp, Homo sapiens
cctcaaggcctcccacagt

SEQ ID NO: 1824260 - DNA, 15 bp, Homo sapiens
cctcacagcctctcc

SEQ ID NO: 1824261 - DNA, 17 bp, Homo sapiens
cctcacagcctctccct

SEQ ID NO: 1824262 - DNA, 14 bp, Homo sapiens
cctcaccaggggca

SEQ ID NO: 1824263 - DNA, 22 bp, Homo sapiens
cctcaccaggggcaggcacagc

SEQ ID NO: 1824264 - DNA, 16 bp, Homo sapiens
cctcactggctggggc

SEQ ID NO: 1824265 - DNA, 17 bp, Homo sapiens
cctcactggctggggca

SEQ ID NO: 1824266 - DNA, 23 bp, Homo sapiens
cctcactggctggggcagagggg

SEQ ID NO: 1824267 - DNA, 19 bp, Homo sapiens
cctcagaaaacttattaac

SEQ ID NO: 1824268 - DNA, 11 bp, Homo sapiens
cctcagccctt

SEQ ID NO: 1824269 - DNA, 22 bp, Homo sapiens
cctcagcccttgcccccatccc

SEQ ID NO: 1824270 - DNA, 19 bp, Homo sapiens
cctcagtttctccatcagc

SEQ ID NO: 1824271 - DNA, 11 bp, Homo sapiens
cctcatccctc

SEQ ID NO: 1824272 - DNA, 15 bp, Homo sapiens
cctcatgccacacct

SEQ ID NO: 1824273 - DNA, 15 bp, Homo sapiens
cctcatgcctggccc

SEQ ID NO: 1824274 - DNA, 17 bp, Homo sapiens
cctcatgcctggccccc

SEQ ID NO: 1824275 - DNA, 19 bp, Homo sapiens
cctcatgcctggcccccct

SEQ ID NO: 1824276 - DNA, 23 bp, Homo sapiens
cctcatgcctggcccccctccag

SEQ ID NO: 1824277 - DNA, 14 bp, Homo sapiens
cctccacagtgctg

SEQ ID NO: 1824278 - DNA, 21 bp, Homo sapiens
cctccaccgccatggcttcca

SEQ ID NO: 1824279 - DNA, 15 bp, Homo sapiens
cctccactcccactt

SEQ ID NO: 1824280 - DNA, 20 bp, Homo sapiens
cctccactcccacttccctg

SEQ ID NO: 1824281 - DNA, 12 bp, Homo sapiens
cctccactcccc

SEQ ID NO: 1824282 - DNA, 21 bp, Homo sapiens
cctccactcccccacctgaca

SEQ ID NO: 1824283 - DNA, 17 bp, Homo sapiens
cctccagagccagcctg

SEQ ID NO: 1824284 - DNA, 18 bp, Homo sapiens
cctccagagccagcctgg

SEQ ID NO: 1824285 - DNA, 21 bp, Homo sapiens
cctccagagccagcctgggac

SEQ ID NO: 1824286 - DNA, 22 bp, Homo sapiens
cctccagagccagcctgggact

SEQ ID NO: 1824287 - DNA, 12 bp, Homo sapiens
cctccagcctcc

SEQ ID NO: 1824288 - DNA, 15 bp, Homo sapiens
cctccagcctcccct

SEQ ID NO: 1824289 - DNA, 22 bp, Homo sapiens
cctccagcctcccctcccctgg

SEQ ID NO: 1824290 - DNA, 12 bp, Homo sapiens
cctccagcctct

SEQ ID NO: 1824291 - DNA, 13 bp, Homo sapiens
cctccagcctctc

SEQ ID NO: 1824292 - DNA, 17 bp, Homo sapiens
cctccagcctctcccgg

SEQ ID NO: 1824293 - DNA, 18 bp, Homo sapiens
cctccagcctctcccggc

SEQ ID NO: 1824294 - DNA, 10 bp, Homo sapiens
cctccaggca

SEQ ID NO: 1824295 - DNA, 18 bp, Homo sapiens
cctccaggcatgctggcc

SEQ ID NO: 1824296 - DNA, 22 bp, Homo sapiens
cctccaggcatgctggcctccc

SEQ ID NO: 1824297 - DNA, 18 bp, Homo sapiens
cctcccaataaagctgga

SEQ ID NO: 1824298 - DNA, 12 bp, Homo sapiens
cctcccacagtg

SEQ ID NO: 1824299 - DNA, 13 bp, Homo sapiens
cctcccacagtga

SEQ ID NO: 1824300 - DNA, 13 bp, Homo sapiens
cctcccagacagg

SEQ ID NO: 1824301 - DNA, 17 bp, Homo sapiens
cctcccagacaggccct

SEQ ID NO: 1824302 - DNA, 12 bp, Homo sapiens
cctcccagctga

SEQ ID NO: 1824303 - DNA, 12 bp, Homo sapiens
cctcccatggcc

SEQ ID NO: 1824304 - DNA, 13 bp, Homo sapiens
cctccccacagtc

SEQ ID NO: 1824305 - DNA, 14 bp, Homo sapiens
cctccccagccagc

SEQ ID NO: 1824306 - DNA, 14 bp, Homo sapiens
cctcccccagagcc

SEQ ID NO: 1824307 - DNA, 13 bp, Homo sapiens
cctcccctcccgt

SEQ ID NO: 1824308 - DNA, 14 bp, Homo sapiens
cctccctccttcct

SEQ ID NO: 1824309 - DNA, 18 bp, Homo sapiens
cctccctctgccccaagc

SEQ ID NO: 1824310 - DNA, 11 bp, Homo sapiens
cctccctgcct

SEQ ID NO: 1824311 - DNA, 12 bp, Homo sapiens
cctccctgcctg

SEQ ID NO: 1824312 - DNA, 13 bp, Homo sapiens
cctccctgcctgc

SEQ ID NO: 1824313 - DNA, 20 bp, Homo sapiens
cctccctgcctgctccttgg

SEQ ID NO: 1824314 - DNA, 12 bp, Homo sapiens
cctccctgctgt

SEQ ID NO: 1824315 - DNA, 15 bp, Homo sapiens
cctccctgctgtccc

SEQ ID NO: 1824316 - DNA, 13 bp, Homo sapiens
cctccctgtctcc

SEQ ID NO: 1824317 - DNA, 13 bp, Homo sapiens
cctccgtccaccc

SEQ ID NO: 1824318 - DNA, 15 bp, Homo sapiens
cctccgtccacccag

SEQ ID NO: 1824319 - DNA, 17 bp, Homo sapiens
cctccgtttatgggcct

SEQ ID NO: 1824320 - DNA, 19 bp, Homo sapiens
cctcctacccctcccagct

SEQ ID NO: 1824321 - DNA, 14 bp, Homo sapiens
cctcctaccctccc

SEQ ID NO: 1824322 - DNA, 19 bp, Homo sapiens
cctcctagaggtgggcagc

SEQ ID NO: 1824323 - DNA, 22 bp, Homo sapiens
cctcctagaggtgggcagctgg

SEQ ID NO: 1824324 - DNA, 20 bp, Homo sapiens
cctcctccacagtgctgctt

SEQ ID NO: 1824325 - DNA, 18 bp, Homo sapiens
cctcctgatggccaagag

SEQ ID NO: 1824326 - DNA, 20 bp, Homo sapiens
cctcctgatggccaagagca

SEQ ID NO: 1824327 - DNA, 16 bp, Homo sapiens
cctcctgccccctgcc

SEQ ID NO: 1824328 - DNA, 17 bp, Homo sapiens
cctcctgccccctgcca

SEQ ID NO: 1824329 - DNA, 17 bp, Homo sapiens
cctcctgctgcagaggg

SEQ ID NO: 1824330 - DNA, 17 bp, Homo sapiens
cctcctgctgcctaata

SEQ ID NO: 1824331 - DNA, 16 bp, Homo sapiens
cctcgaaccaaggcag

SEQ ID NO: 1824332 - DNA, 23 bp, Homo sapiens
cctcgaaccaaggcagcctccag

SEQ ID NO: 1824333 - DNA, 20 bp, Homo sapiens
cctcgaggcaccggcgctgc

SEQ ID NO: 1824334 - DNA, 13 bp, Homo sapiens
cctcgcccaccgc

SEQ ID NO: 1824335 - DNA, 19 bp, Homo sapiens
cctcgcccaccgcatgccc

SEQ ID NO: 1824336 - DNA, 12 bp, Homo sapiens
cctcgcctggcc

SEQ ID NO: 1824337 - DNA, 15 bp, Homo sapiens
cctcggctcctgctg

SEQ ID NO: 1824338 - DNA, 16 bp, Homo sapiens
cctcggctcctgctgc

SEQ ID NO: 1824339 - DNA, 18 bp, Homo sapiens
cctcggctcctgctgcac

SEQ ID NO: 1824340 - DNA, 16 bp, Homo sapiens
ctgccacttcccaggt

SEQ ID NO: 1824341 - DNA, 15 bp, Homo sapiens
ctgccagctgccttc

SEQ ID NO: 1824342 - DNA, 16 bp, Homo sapiens
ctgccagctgccttcc

SEQ ID NO: 1824343 - DNA, 16 bp, Homo sapiens
ctgccaggcacctggc

SEQ ID NO: 1824344 - DNA, 20 bp, Homo sapiens
ctgccaggcacctggcctgc

SEQ ID NO: 1824345 - DNA, 18 bp, Homo sapiens
ctgccaggcccatctcag

SEQ ID NO: 1824346 - DNA, 20 bp, Homo sapiens
ctgccaggcccatctcaggt

SEQ ID NO: 1824347 - DNA, 21 bp, Homo sapiens
ctgccaggcgttggtgccact

SEQ ID NO: 1824348 - DNA, 17 bp, Homo sapiens
ctgccagtgaagtcctt

SEQ ID NO: 1824349 - DNA, 21 bp, Homo sapiens
ctgccagtgaagtccttcagt

SEQ ID NO: 1824350 - DNA, 13 bp, Homo sapiens
ctgccatgccact

SEQ ID NO: 1824351 - DNA, 17 bp, Homo sapiens
ctgccatgccactgcca

SEQ ID NO: 1824352 - DNA, 21 bp, Homo sapiens
ctgcccaggacggggccggcc

SEQ ID NO: 1824353 - DNA, 17 bp, Homo sapiens
ctgccccaagcagccag

SEQ ID NO: 1824354 - DNA, 18 bp, Homo sapiens
ctgccccaagcagccagc

SEQ ID NO: 1824355 - DNA, 13 bp, Homo sapiens
ctgccccaagccc

SEQ ID NO: 1824356 - DNA, 13 bp, Homo sapiens
ctgccccatctcc

SEQ ID NO: 1824357 - DNA, 16 bp, Homo sapiens
ctgccccatctcctcc

SEQ ID NO: 1824358 - DNA, 20 bp, Homo sapiens
ctgcccccagaaagcctcct

SEQ ID NO: 1824359 - DNA, 14 bp, Homo sapiens
ctgccccctgccag

SEQ ID NO: 1824360 - DNA, 15 bp, Homo sapiens
ctgccccctgccagt

SEQ ID NO: 1824361 - DNA, 18 bp, Homo sapiens
ctgccccctgccagtgaa

SEQ ID NO: 1824362 - DNA, 16 bp, Homo sapiens
ctgccccgttccctgt

SEQ ID NO: 1824363 - DNA, 14 bp, Homo sapiens
ctgcccctgtctgg

SEQ ID NO: 1824364 - DNA, 17 bp, Homo sapiens
ctgcccctgtctggaag

SEQ ID NO: 1824365 - DNA, 13 bp, Homo sapiens
ctgccccttgggc

SEQ ID NO: 1824366 - DNA, 14 bp, Homo sapiens
ctgccccttgggca

SEQ ID NO: 1824367 - DNA, 15 bp, Homo sapiens
ctgcccggcgccctc

SEQ ID NO: 1824368 - DNA, 22 bp, Homo sapiens
ctgcccggcgccctctgtcctg

SEQ ID NO: 1824369 - DNA, 14 bp, Homo sapiens
ctgccctgccacct

SEQ ID NO: 1824370 - DNA, 15 bp, Homo sapiens
ctgccctgccctgcc

SEQ ID NO: 1824371 - DNA, 14 bp, Homo sapiens
ctgccctgcctgcc

SEQ ID NO: 1824372 - DNA, 15 bp, Homo sapiens
ctgccctgcctgccc

SEQ ID NO: 1824373 - DNA, 17 bp, Homo sapiens
ctgcctatccatcctgc

SEQ ID NO: 1824374 - DNA, 14 bp, Homo sapiens
ctgcctccactccc

SEQ ID NO: 1824375 - DNA, 17 bp, Homo sapiens
ctgcctccactcccact

SEQ ID NO: 1824376 - DNA, 13 bp, Homo sapiens
ctgcctgcccact

SEQ ID NO: 1824377 - DNA, 19 bp, Homo sapiens
ctgcctgcccacttagccg

SEQ ID NO: 1824378 - DNA, 12 bp, Homo sapiens
ctgcctgctcct

SEQ ID NO: 1824379 - DNA, 15 bp, Homo sapiens
ctgcctgctccttgg

SEQ ID NO: 1824380 - DNA, 14 bp, Homo sapiens
ctgcctggcctggc

SEQ ID NO: 1824381 - DNA, 15 bp, Homo sapiens
ctgcctggcctggct

SEQ ID NO: 1824382 - DNA, 16 bp, Homo sapiens
ctgcctggcctggctc

SEQ ID NO: 1824383 - DNA, 18 bp, Homo sapiens
ctgcctggcctggctccc

SEQ ID NO: 1824384 - DNA, 11 bp, Homo sapiens
ctgcctgggcc

SEQ ID NO: 1824385 - DNA, 14 bp, Homo sapiens
ctgcctgggcctgt

SEQ ID NO: 1824386 - DNA, 15 bp, Homo sapiens
ctgcctgggcctgtg

SEQ ID NO: 1824387 - DNA, 20 bp, Homo sapiens
ctgcctgggcctgtgcagca

SEQ ID NO: 1824388 - DNA, 23 bp, Homo sapiens
ctgcctttctcccccgacactgc

SEQ ID NO: 1824389 - DNA, 18 bp, Homo sapiens
ctgcgtcctgacgccctg

SEQ ID NO: 1824390 - DNA, 20 bp, Homo sapiens
ctgcgtcctgacgccctgcg

SEQ ID NO: 1824391 - DNA, 14 bp, Homo sapiens
ctgcgttggagcca

SEQ ID NO: 1824392 - DNA, 23 bp, Homo sapiens
ctgcgttggagccactcctgtcc

SEQ ID NO: 1824393 - DNA, 16 bp, Homo sapiens
ctgctaccctccctgc

SEQ ID NO: 1824394 - DNA, 12 bp, Homo sapiens
ctgctccacagt

SEQ ID NO: 1824395 - DNA, 14 bp, Homo sapiens
ctgctccacagtgt

SEQ ID NO: 1824396 - DNA, 14 bp, Homo sapiens
ctgctcgaagaaca

SEQ ID NO: 1824397 - DNA, 15 bp, Homo sapiens
ctgctctagctggca

SEQ ID NO: 1824398 - DNA, 18 bp, Homo sapiens
ctgctcttagtgcccgcc

SEQ ID NO: 1824399 - DNA, 12 bp, Homo sapiens
ctgctgaaaaag

SEQ ID NO: 1824400 - DNA, 11 bp, Homo sapiens
ctgctgagcca

SEQ ID NO: 1824401 - DNA, 13 bp, Homo sapiens
ctgctgagccact

SEQ ID NO: 1824402 - DNA, 23 bp, Homo sapiens
ctgctgcaccaacccagccgctg

SEQ ID NO: 1824403 - DNA, 15 bp, Homo sapiens
ctgctgcaccagagt

SEQ ID NO: 1824404 - DNA, 23 bp, Homo sapiens
ctgctgcagaggggcaggccctg

SEQ ID NO: 1824405 - DNA, 20 bp, Homo sapiens
ctgctgctgtaactgctgag

SEQ ID NO: 1824406 - DNA, 17 bp, Homo sapiens
ctgctgggaaccccgca

SEQ ID NO: 1824407 - DNA, 21 bp, Homo sapiens
ctgctgggaaccccgcagccc

SEQ ID NO: 1824408 - DNA, 15 bp, Homo sapiens
ctgctgggctggggc

SEQ ID NO: 1824409 - DNA, 17 bp, Homo sapiens
ctgctgggctggggcct

SEQ ID NO: 1824410 - DNA, 17 bp, Homo sapiens
ctgctggggcatgtgtg

SEQ ID NO: 1824411 - DNA, 20 bp, Homo sapiens
ctgctggggcatgtgtgcct

SEQ ID NO: 1824412 - DNA, 21 bp, Homo sapiens
ctgctggggcatgtgtgcctg

SEQ ID NO: 1824413 - DNA, 22 bp, Homo sapiens
ctgctggggcatgtgtgcctgt

SEQ ID NO: 1824414 - DNA, 17 bp, Homo sapiens
ctgctggggctgcaagc

SEQ ID NO: 1824415 - DNA, 21 bp, Homo sapiens
ctgctgggtggcccatccccc

SEQ ID NO: 1824416 - DNA, 15 bp, Homo sapiens
ctgctgtaactgctg

SEQ ID NO: 1824417 - DNA, 18 bp, Homo sapiens
ctgctgtaactgctgagc

SEQ ID NO: 1824418 - DNA, 21 bp, Homo sapiens
ctgctgtaactgctgagccac

SEQ ID NO: 1824419 - DNA, 22 bp, Homo sapiens
ctgctgtcccctcttgccccaa

SEQ ID NO: 1824420 - DNA, 23 bp, Homo sapiens
ctgctgtggcatcaggaaaggaa

SEQ ID NO: 1824421 - DNA, 18 bp, Homo sapiens
ctgctgttgccatagccc

SEQ ID NO: 1824422 - DNA, 18 bp, Homo sapiens
ctgcttaaacttgaccca

SEQ ID NO: 1824423 - DNA, 19 bp, Homo sapiens
ctgcttaaacttgacccag

SEQ ID NO: 1824424 - DNA, 17 bp, Homo sapiens
ctgcttgcccgctccca

SEQ ID NO: 1824425 - DNA, 14 bp, Homo sapiens
ctgcttttccagga

SEQ ID NO: 1824426 - DNA, 21 bp, Homo sapiens
ctgcttttccaggatcctgca

SEQ ID NO: 1824427 - DNA, 14 bp, Homo sapiens
ctgcttttgcatct

SEQ ID NO: 1824428 - DNA, 11 bp, Homo sapiens
ctggaacacaa

SEQ ID NO: 1824429 - DNA, 12 bp, Homo sapiens
ctggaacacaat

SEQ ID NO: 1824430 - DNA, 23 bp, Homo sapiens
ctggaaccagggaggagaggaaa

SEQ ID NO: 1824431 - DNA, 19 bp, Homo sapiens
ctggaagacgtggctctgg

SEQ ID NO: 1824432 - DNA, 14 bp, Homo sapiens
ctggaaggcagggc

SEQ ID NO: 1824433 - DNA, 15 bp, Homo sapiens
ctggaaggcagggca

SEQ ID NO: 1824434 - DNA, 20 bp, Homo sapiens
ctggaaggcagggcagaggg

SEQ ID NO: 1824435 - DNA, 21 bp, Homo sapiens
ctggaaggcagggcagaggga

SEQ ID NO: 1824436 - DNA, 13 bp, Homo sapiens
ctggaaggctggc

SEQ ID NO: 1824437 - DNA, 15 bp, Homo sapiens
ctggaaggctggctg

SEQ ID NO: 1824438 - DNA, 17 bp, Homo sapiens
ctggaatatctgagaat

SEQ ID NO: 1824439 - DNA, 17 bp, Homo sapiens
ctggaattcagcaccct

SEQ ID NO: 1824440 - DNA, 19 bp, Homo sapiens
ctggacaagaagctgctat

SEQ ID NO: 1824441 - DNA, 21 bp, Homo sapiens
ctggactggtggcccctgcct

SEQ ID NO: 1824442 - DNA, 21 bp, Homo sapiens
ctggagaccgcttcacccctg

SEQ ID NO: 1824443 - DNA, 19 bp, Homo sapiens
ctggagtgcgctcttggtc

SEQ ID NO: 1824444 - DNA, 12 bp, Homo sapiens
ctggatactgta

SEQ ID NO: 1824445 - DNA, 19 bp, Homo sapiens
ctggcagctcctctccttg

SEQ ID NO: 1824446 - DNA, 20 bp, Homo sapiens
ctggcagctcctctccttgg

SEQ ID NO: 1824447 - DNA, 12 bp, Homo sapiens
ctggcaggtgca

SEQ ID NO: 1824448 - DNA, 14 bp, Homo sapiens
ctggcaggtgcaga

SEQ ID NO: 1824449 - DNA, 16 bp, Homo sapiens
ctggcaggtgcagatg

SEQ ID NO: 1824450 - DNA, 22 bp, Homo sapiens
ctgtgcagcagcccagcttcct

SEQ ID NO: 1824451 - DNA, 24 bp, Homo sapiens
ctgtgcagcagcccagcttcctgg

SEQ ID NO: 1824452 - DNA, 13 bp, Homo sapiens
ctgtgccaccctg

SEQ ID NO: 1824453 - DNA, 22 bp, Homo sapiens
ctgtgccaccctgggctctgtg

SEQ ID NO: 1824454 - DNA, 23 bp, Homo sapiens
ctgtgccaccctgggctctgtgg

SEQ ID NO: 1824455 - DNA, 20 bp, Homo sapiens
ctgtgccatgttattcagct

SEQ ID NO: 1824456 - DNA, 23 bp, Homo sapiens
ctgtgccatgttattcagctcac

SEQ ID NO: 1824457 - DNA, 15 bp, Homo sapiens
ctgtgcccatgggca

SEQ ID NO: 1824458 - DNA, 21 bp, Homo sapiens
ctgtgcccatgggcactgctg

SEQ ID NO: 1824459 - DNA, 17 bp, Homo sapiens
ctgtgcccttattcagg

SEQ ID NO: 1824460 - DNA, 14 bp, Homo sapiens
ctgtgcctgctaga

SEQ ID NO: 1824461 - DNA, 12 bp, Homo sapiens
ctgtgctgtgcc

SEQ ID NO: 1824462 - DNA, 18 bp, Homo sapiens
ctgtgctgtgcctgctag

SEQ ID NO: 1824463 - DNA, 19 bp, Homo sapiens
ctgtgctgtgcctgctaga

SEQ ID NO: 1824464 - DNA, 16 bp, Homo sapiens
ctgtggaggcctgatg

SEQ ID NO: 1824465 - DNA, 18 bp, Homo sapiens
ctgtggaggcctgatgct

SEQ ID NO: 1824466 - DNA, 16 bp, Homo sapiens
ctgtggcagaaaagag

SEQ ID NO: 1824467 - DNA, 15 bp, Homo sapiens
ctgtggccagagctg

SEQ ID NO: 1824468 - DNA, 14 bp, Homo sapiens
ctgtggcctgtgtc

SEQ ID NO: 1824469 - DNA, 14 bp, Homo sapiens
ctgtgggctgcact

SEQ ID NO: 1824470 - DNA, 22 bp, Homo sapiens
ctgtgggctgcactctgtgccc

SEQ ID NO: 1824471 - DNA, 20 bp, Homo sapiens
ctgtgggggaagagcacagc

SEQ ID NO: 1824472 - DNA, 21 bp, Homo sapiens
ctgtgggggaagagcacagcc

SEQ ID NO: 1824473 - DNA, 21 bp, Homo sapiens
ctgtgtcactggctgcctcca

SEQ ID NO: 1824474 - DNA, 16 bp, Homo sapiens
ctgtgtccagcagctg

SEQ ID NO: 1824475 - DNA, 14 bp, Homo sapiens
ctgtgtgtgtgtat

SEQ ID NO: 1824476 - DNA, 15 bp, Homo sapiens
ctgtgtgtgtgtatg

SEQ ID NO: 1824477 - DNA, 16 bp, Homo sapiens
ctgtgtgtttatgtgt

SEQ ID NO: 1824478 - DNA, 20 bp, Homo sapiens
ctgtgtgtttatgtgtgtgt

SEQ ID NO: 1824479 - DNA, 21 bp, Homo sapiens
ctgttaactgtcttgagagaa

SEQ ID NO: 1824480 - DNA, 16 bp, Homo sapiens
ctgttggtctacagaa

SEQ ID NO: 1824481 - DNA, 19 bp, Homo sapiens
ctgtttaaaaaaagtatat

SEQ ID NO: 1824482 - DNA, 18 bp, Homo sapiens
ctgtttagaactactgat

SEQ ID NO: 1824483 - DNA, 19 bp, Homo sapiens
ctgtttcactaatacttac

SEQ ID NO: 1824484 - DNA, 21 bp, Homo sapiens
cttaagggttgaaggcagtct

SEQ ID NO: 1824485 - DNA, 16 bp, Homo sapiens
cttaatctcacttcat

SEQ ID NO: 1824486 - DNA, 20 bp, Homo sapiens
cttaatctcacttcatcaat

SEQ ID NO: 1824487 - DNA, 16 bp, Homo sapiens
cttacacttggagccc

SEQ ID NO: 1824488 - DNA, 17 bp, Homo sapiens
cttacacttggagcccg

SEQ ID NO: 1824489 - DNA, 23 bp, Homo sapiens
cttacacttggagcccgtgcagt

SEQ ID NO: 1824490 - DNA, 15 bp, Homo sapiens
cttaccgtagcctcc

SEQ ID NO: 1824491 - DNA, 13 bp, Homo sapiens
cttactctgagcc

SEQ ID NO: 1824492 - DNA, 15 bp, Homo sapiens
cttactctgagccca

SEQ ID NO: 1824493 - DNA, 18 bp, Homo sapiens
cttactctgagcccaggc

SEQ ID NO: 1824494 - DNA, 18 bp, Homo sapiens
cttactgttaactgtctt

SEQ ID NO: 1824495 - DNA, 21 bp, Homo sapiens
cttacttcggttcctctgatt

SEQ ID NO: 1824496 - DNA, 22 bp, Homo sapiens
cttagaatggcctctttgtaga

SEQ ID NO: 1824497 - DNA, 19 bp, Homo sapiens
cttagctgaacaatgaatg

SEQ ID NO: 1824498 - DNA, 23 bp, Homo sapiens
cttagtgcccgcctaggagttga

SEQ ID NO: 1824499 - DNA, 18 bp, Homo sapiens
cttatattggtttttcca

SEQ ID NO: 1824500 - DNA, 18 bp, Homo sapiens
cttatgagactcttaaat

SEQ ID NO: 1824501 - DNA, 18 bp, Homo sapiens
cttattaacaactgtgaa

SEQ ID NO: 1824502 - DNA, 19 bp, Homo sapiens
cttattaacaactgtgaat

SEQ ID NO: 1824503 - DNA, 21 bp, Homo sapiens
cttattcatgctttctccttt

SEQ ID NO: 1824504 - DNA, 22 bp, Homo sapiens
cttattcatgctttctcctttt

SEQ ID NO: 1824505 - DNA, 18 bp, Homo sapiens
cttattggcagctctact

SEQ ID NO: 1824506 - DNA, 23 bp, Homo sapiens
cttatttacctataaaatgagat

SEQ ID NO: 1824507 - DNA, 14 bp, Homo sapiens
cttcaagctgtccc

SEQ ID NO: 1824508 - DNA, 16 bp, Homo sapiens
cttcacccctgcactt

SEQ ID NO: 1824509 - DNA, 14 bp, Homo sapiens
cttcagaacagagg

SEQ ID NO: 1824510 - DNA, 15 bp, Homo sapiens
cttcagaacagaggc

SEQ ID NO: 1824511 - DNA, 16 bp, Homo sapiens
cttcagaacagaggca

SEQ ID NO: 1824512 - DNA, 19 bp, Homo sapiens
cttcagaacagaggcattt

SEQ ID NO: 1824513 - DNA, 12 bp, Homo sapiens
cttcagatttca

SEQ ID NO: 1824514 - DNA, 15 bp, Homo sapiens
cttcagatttcaaat

SEQ ID NO: 1824515 - DNA, 16 bp, Homo sapiens
cttcagatttcaaatt

SEQ ID NO: 1824516 - DNA, 11 bp, Homo sapiens
cttcagggcca

SEQ ID NO: 1824517 - DNA, 18 bp, Homo sapiens
cttcagggccagaaggag

SEQ ID NO: 1824518 - DNA, 21 bp, Homo sapiens
cttcagggccagaaggagggc

SEQ ID NO: 1824519 - DNA, 22 bp, Homo sapiens
cttcagggccagaaggagggca

SEQ ID NO: 1824520 - DNA, 23 bp, Homo sapiens
cttcagggccagaaggagggcag

SEQ ID NO: 1824521 - DNA, 22 bp, Homo sapiens
cttcaggggctgcccgctccca

SEQ ID NO: 1824522 - DNA, 23 bp, Homo sapiens
cttcaggggctgcccgctcccag

SEQ ID NO: 1824523 - DNA, 19 bp, Homo sapiens
cttcaggtggagagcacta

SEQ ID NO: 1824524 - DNA, 17 bp, Homo sapiens
cttcagtgagcccctcc

SEQ ID NO: 1824525 - DNA, 18 bp, Homo sapiens
cttcagtgagcccctccc

SEQ ID NO: 1824526 - DNA, 16 bp, Homo sapiens
cttcattaatactgtg

SEQ ID NO: 1824527 - DNA, 18 bp, Homo sapiens
cttccaaggtggtctgct

SEQ ID NO: 1824528 - DNA, 20 bp, Homo sapiens
cttccaaggtggtctgctcg

SEQ ID NO: 1824529 - DNA, 14 bp, Homo sapiens
cttccacccattcc

SEQ ID NO: 1824530 - DNA, 22 bp, Homo sapiens
cttccacccattcccccatgtg

SEQ ID NO: 1824531 - DNA, 22 bp, Homo sapiens
cttccacctcctagaggtgggc

SEQ ID NO: 1824532 - DNA, 18 bp, Homo sapiens
cttccactttttccagaa

SEQ ID NO: 1824533 - DNA, 22 bp, Homo sapiens
cttccccgagggatgatgccac

SEQ ID NO: 1824534 - DNA, 14 bp, Homo sapiens
cttcccctccctgt

SEQ ID NO: 1824535 - DNA, 16 bp, Homo sapiens
cttccccttttgcctg

SEQ ID NO: 1824536 - DNA, 21 bp, Homo sapiens
cttccccttttgcctggctgt

SEQ ID NO: 1824537 - DNA, 19 bp, Homo sapiens
cttccctgggaaggctaag

SEQ ID NO: 1824538 - DNA, 20 bp, Homo sapiens
cttcctccgtccacccaggc

SEQ ID NO: 1824539 - DNA, 21 bp, Homo sapiens
cttcctccgtccacccaggct

SEQ ID NO: 1824540 - DNA, 22 bp, Homo sapiens
cttcctccgtccacccaggctg

SEQ ID NO: 1824541 - DNA, 21 bp, Homo sapiens
cttcctcctccacagtgctgc

SEQ ID NO: 1824542 - DNA, 12 bp, Homo sapiens
cttcctgagggc

SEQ ID NO: 1824543 - DNA, 11 bp, Homo sapiens
cttcctggcct

SEQ ID NO: 1824544 - DNA, 13 bp, Homo sapiens
gaaacaccattca

SEQ ID NO: 1824545 - DNA, 17 bp, Homo sapiens
gaaacagggacaaagaa

SEQ ID NO: 1824546 - DNA, 20 bp, Homo sapiens
gaaacccagatcgctgtgtt

SEQ ID NO: 1824547 - DNA, 11 bp, Homo sapiens
gaaactggctg

SEQ ID NO: 1824548 - DNA, 21 bp, Homo sapiens
gaaagaaaagaccctgagact

SEQ ID NO: 1824549 - DNA, 16 bp, Homo sapiens
gaaagagtatgtacgt

SEQ ID NO: 1824550 - DNA, 21 bp, Homo sapiens
gaaagcctcctgccccctgcc

SEQ ID NO: 1824551 - DNA, 14 bp, Homo sapiens
gaaagcgggcagcc

SEQ ID NO: 1824552 - DNA, 16 bp, Homo sapiens
gaaagcgggcagcccc

SEQ ID NO: 1824553 - DNA, 18 bp, Homo sapiens
gaaagcgggcagccccgt

SEQ ID NO: 1824554 - DNA, 22 bp, Homo sapiens
gaaagctccacggtgcgtggct

SEQ ID NO: 1824555 - DNA, 16 bp, Homo sapiens
gaaagggaaactggct

SEQ ID NO: 1824556 - DNA, 18 bp, Homo sapiens
gaaagggctatggcaagg

SEQ ID NO: 1824557 - DNA, 16 bp, Homo sapiens
gaaatacagaagaaaa

SEQ ID NO: 1824558 - DNA, 13 bp, Homo sapiens
gaaatactgtatt

SEQ ID NO: 1824559 - DNA, 22 bp, Homo sapiens
gaaatccccccttcagaacaga

SEQ ID NO: 1824560 - DNA, 20 bp, Homo sapiens
gaaatgctattgttgtgggc

SEQ ID NO: 1824561 - DNA, 20 bp, Homo sapiens
gaacaagtcacagctgcagc

SEQ ID NO: 1824562 - DNA, 20 bp, Homo sapiens
gaacacactcagcagccccc

SEQ ID NO: 1824563 - DNA, 18 bp, Homo sapiens
gaaccaaggcagcctcca

SEQ ID NO: 1824564 - DNA, 21 bp, Homo sapiens
gaaccaaggcagcctccagag

SEQ ID NO: 1824565 - DNA, 22 bp, Homo sapiens
gaaccaaggcagcctccagagc

SEQ ID NO: 1824566 - DNA, 16 bp, Homo sapiens
gaaccagggaggagag

SEQ ID NO: 1824567 - DNA, 17 bp, Homo sapiens
gaaccccatgggcttgg

SEQ ID NO: 1824568 - DNA, 13 bp, Homo sapiens
gaaccccgcagcc

SEQ ID NO: 1824569 - DNA, 14 bp, Homo sapiens
gaaccccgcagccc

SEQ ID NO: 1824570 - DNA, 15 bp, Homo sapiens
gaacccttgtgcttg

SEQ ID NO: 1824571 - DNA, 18 bp, Homo sapiens
gaacccttgtgcttggtg

SEQ ID NO: 1824572 - DNA, 20 bp, Homo sapiens
gaacctagtactctctgctc

SEQ ID NO: 1824573 - DNA, 14 bp, Homo sapiens
gaacgagcactggc

SEQ ID NO: 1824574 - DNA, 18 bp, Homo sapiens
gaacgagcactggccaga

SEQ ID NO: 1824575 - DNA, 15 bp, Homo sapiens
gaactattttgaaga

SEQ ID NO: 1824576 - DNA, 18 bp, Homo sapiens
gaactccactctccttcg

SEQ ID NO: 1824577 - DNA, 20 bp, Homo sapiens
gaactgctgggcttggcagc

SEQ ID NO: 1824578 - DNA, 23 bp, Homo sapiens
gaacttacacttggagcccgtgc

SEQ ID NO: 1824579 - DNA, 14 bp, Homo sapiens
gaacttgaggacac

SEQ ID NO: 1824580 - DNA, 16 bp, Homo sapiens
gaacttgaggacacat

SEQ ID NO: 1824581 - DNA, 18 bp, Homo sapiens
gaacttgaggacacatgt

SEQ ID NO: 1824582 - DNA, 17 bp, Homo sapiens
gaagagaagggcagggc

SEQ ID NO: 1824583 - DNA, 22 bp, Homo sapiens
gaagagatgtggcaaagtgctg

SEQ ID NO: 1824584 - DNA, 15 bp, Homo sapiens
gaagagcacagccct

SEQ ID NO: 1824585 - DNA, 20 bp, Homo sapiens
gaagagcacagccctcccgc

SEQ ID NO: 1824586 - DNA, 13 bp, Homo sapiens
gaagagcagcctg

SEQ ID NO: 1824587 - DNA, 14 bp, Homo sapiens
gaagagcagcctga

SEQ ID NO: 1824588 - DNA, 18 bp, Homo sapiens
gaagagcagcctgatggc

SEQ ID NO: 1824589 - DNA, 22 bp, Homo sapiens
gaagagggaatggatggggaga

SEQ ID NO: 1824590 - DNA, 19 bp, Homo sapiens
gaagagggcagtacctggg

SEQ ID NO: 1824591 - DNA, 17 bp, Homo sapiens
gaagaggggtcttttat

SEQ ID NO: 1824592 - DNA, 18 bp, Homo sapiens
gaagcagtgcctcgaggc

SEQ ID NO: 1824593 - DNA, 16 bp, Homo sapiens
gaagccgtctgactcc

SEQ ID NO: 1824594 - DNA, 20 bp, Homo sapiens
gaagccgtctgactccagag

SEQ ID NO: 1824595 - DNA, 22 bp, Homo sapiens
gaagccgtctgactccagagtc

SEQ ID NO: 1824596 - DNA, 23 bp, Homo sapiens
gaagccgtctgactccagagtct

SEQ ID NO: 1824597 - DNA, 24 bp, Homo sapiens
gaagccgtctgactccagagtctg

SEQ ID NO: 1824598 - DNA, 20 bp, Homo sapiens
gaagctgtactcagagcaga

SEQ ID NO: 1824599 - DNA, 23 bp, Homo sapiens
gaagctgtactcagagcagagca

SEQ ID NO: 1824600 - DNA, 17 bp, Homo sapiens
gaaggagggcagagcca

SEQ ID NO: 1824601 - DNA, 14 bp, Homo sapiens
gaaggcagggcaga

SEQ ID NO: 1824602 - DNA, 18 bp, Homo sapiens
gaaggcctcttgtgctca

SEQ ID NO: 1824603 - DNA, 13 bp, Homo sapiens
gaaggctggctga

SEQ ID NO: 1824604 - DNA, 16 bp, Homo sapiens
gaagggaaagcgggca

SEQ ID NO: 1824605 - DNA, 20 bp, Homo sapiens
gaagggaaagcgggcagccc

SEQ ID NO: 1824606 - DNA, 13 bp, Homo sapiens
gaaggggcacacc

SEQ ID NO: 1824607 - DNA, 22 bp, Homo sapiens
gaaggggcacaccactgccctg

SEQ ID NO: 1824608 - DNA, 14 bp, Homo sapiens
gaaggggccccggg

SEQ ID NO: 1824609 - DNA, 13 bp, Homo sapiens
gaagtgtatatag

SEQ ID NO: 1824610 - DNA, 17 bp, Homo sapiens
gaagtgtgggtctgtgt

SEQ ID NO: 1824611 - DNA, 21 bp, Homo sapiens
gaagtgtgggtctgtgtgtgt

SEQ ID NO: 1824612 - DNA, 21 bp, Homo sapiens
gaagtgttgtggagaaaagag

SEQ ID NO: 1824613 - DNA, 18 bp, Homo sapiens
gaatacattttgcacaaa

SEQ ID NO: 1824614 - DNA, 15 bp, Homo sapiens
gaatagccagagagg

SEQ ID NO: 1824615 - DNA, 16 bp, Homo sapiens
gaatatctgagaattg

SEQ ID NO: 1824616 - DNA, 13 bp, Homo sapiens
gaatccttagaat

SEQ ID NO: 1824617 - DNA, 16 bp, Homo sapiens
gaatgcagattcctgg

SEQ ID NO: 1824618 - DNA, 22 bp, Homo sapiens
gaatgcagattcctgggcctgt

SEQ ID NO: 1824619 - DNA, 23 bp, Homo sapiens
gaatgcagattcctgggcctgtc

SEQ ID NO: 1824620 - DNA, 17 bp, Homo sapiens
gaatgcagggaagaggg

SEQ ID NO: 1824621 - DNA, 16 bp, Homo sapiens
gaatgtcagtatgtgg

SEQ ID NO: 1824622 - DNA, 18 bp, Homo sapiens
gaatgtcagtatgtggaa

SEQ ID NO: 1824623 - DNA, 14 bp, Homo sapiens
gaatgttccctgca

SEQ ID NO: 1824624 - DNA, 22 bp, Homo sapiens
gaatgttccctgcaccctggaa

SEQ ID NO: 1824625 - DNA, 13 bp, Homo sapiens
gaatgtttctatt

SEQ ID NO: 1824626 - DNA, 15 bp, Homo sapiens
gaatgtttctatttc

SEQ ID NO: 1824627 - DNA, 16 bp, Homo sapiens
gaattaatctagaaaa

SEQ ID NO: 1824628 - DNA, 19 bp, Homo sapiens
gaattcagcaccctgggtg

SEQ ID NO: 1824629 - DNA, 14 bp, Homo sapiens
gaattctagaaaat

SEQ ID NO: 1824630 - DNA, 16 bp, Homo sapiens
gaattctagaaaattt

SEQ ID NO: 1824631 - DNA, 23 bp, Homo sapiens
gaattctgcaactagccaaggct

SEQ ID NO: 1824632 - DNA, 22 bp, Homo sapiens
gaattcttcaacagggaaaaca

SEQ ID NO: 1824633 - DNA, 19 bp, Homo sapiens
gaattgaaggagaaaatgc

SEQ ID NO: 1824634 - DNA, 17 bp, Homo sapiens
gaattgatgatgcagtt

SEQ ID NO: 1824635 - DNA, 13 bp, Homo sapiens
gaatttgtaagca

SEQ ID NO: 1824636 - DNA, 13 bp, Homo sapiens
gaattttctttca

SEQ ID NO: 1824637 - DNA, 21 bp, Homo sapiens
gaattttctttcatacattat

SEQ ID NO: 1824638 - DNA, 22 bp, Homo sapiens
gaattttctttcatacattata

SEQ ID NO: 1824639 - DNA, 16 bp, Homo sapiens
gacaaaaatgtttgta

SEQ ID NO: 1824640 - DNA, 21 bp, Homo sapiens
gacaacatttttgtacattat

SEQ ID NO: 1824641 - DNA, 14 bp, Homo sapiens
gacaacctgcccct

SEQ ID NO: 1824642 - DNA, 12 bp, Homo sapiens
gacaagaagctg

SEQ ID NO: 1824643 - DNA, 13 bp, Homo sapiens
gacaagaagctgc

SEQ ID NO: 1824644 - DNA, 16 bp, Homo sapiens
gacaatactgctgcct

SEQ ID NO: 1824645 - DNA, 13 bp, Homo sapiens
gaggagcacctga

SEQ ID NO: 1824646 - DNA, 16 bp, Homo sapiens
gaggagcacctgaacc

SEQ ID NO: 1824647 - DNA, 15 bp, Homo sapiens
gaggatgtctgggcc

SEQ ID NO: 1824648 - DNA, 15 bp, Homo sapiens
gaggcaccggcgctg

SEQ ID NO: 1824649 - DNA, 16 bp, Homo sapiens
gaggcaccggcgctgc

SEQ ID NO: 1824650 - DNA, 20 bp, Homo sapiens
gaggcaccggcgctgcaggt

SEQ ID NO: 1824651 - DNA, 16 bp, Homo sapiens
gaggccaaggcaggta

SEQ ID NO: 1824652 - DNA, 13 bp, Homo sapiens
gaggccaccccaa

SEQ ID NO: 1824653 - DNA, 15 bp, Homo sapiens
gaggcccagccgcag

SEQ ID NO: 1824654 - DNA, 20 bp, Homo sapiens
gctatctactgagacatgac

SEQ ID NO: 1824655 - DNA, 12 bp, Homo sapiens
gctattgttgtg

SEQ ID NO: 1824656 - DNA, 16 bp, Homo sapiens
gctattgttgtgggct

SEQ ID NO: 1824657 - DNA, 18 bp, Homo sapiens
gctattgttgtgggcttt

SEQ ID NO: 1824658 - DNA, 18 bp, Homo sapiens
gctcaacccccctcccag

SEQ ID NO: 1824659 - DNA, 21 bp, Homo sapiens
gctcaacccccctcccagaca

SEQ ID NO: 1824660 - DNA, 18 bp, Homo sapiens
gctcacgctcccccgcag

SEQ ID NO: 1824661 - DNA, 19 bp, Homo sapiens
gctcacttttgtgaaagct

SEQ ID NO: 1824662 - DNA, 14 bp, Homo sapiens
gctcaggacccagg

SEQ ID NO: 1824663 - DNA, 15 bp, Homo sapiens
gctcaggacccaggc

SEQ ID NO: 1824664 - DNA, 16 bp, Homo sapiens
gctcaggacccaggcc

SEQ ID NO: 1824665 - DNA, 19 bp, Homo sapiens
gctcaggacccaggccctc

SEQ ID NO: 1824666 - DNA, 13 bp, Homo sapiens
gctcaggcaagcc

SEQ ID NO: 1824667 - DNA, 17 bp, Homo sapiens
gctcagggaccacagca

SEQ ID NO: 1824668 - DNA, 18 bp, Homo sapiens
gctcagggaccacagcaa

SEQ ID NO: 1824669 - DNA, 12 bp, Homo sapiens
gctcagggctgg

SEQ ID NO: 1824670 - DNA, 23 bp, Homo sapiens
gctccacggtgcgtggctgtggc

SEQ ID NO: 1824671 - DNA, 22 bp, Homo sapiens
gctccagcatccagcctgtgtg

SEQ ID NO: 1824672 - DNA, 12 bp, Homo sapiens
gctcccacagct

SEQ ID NO: 1824673 - DNA, 20 bp, Homo sapiens
gctcccacagcttcctgagg

SEQ ID NO: 1824674 - DNA, 18 bp, Homo sapiens
gctcccagtgtcttcctg

SEQ ID NO: 1824675 - DNA, 20 bp, Homo sapiens
gctcccagtgtcttcctgtg

SEQ ID NO: 1824676 - DNA, 21 bp, Homo sapiens
gctccccacgagtcacctgca

SEQ ID NO: 1824677 - DNA, 15 bp, Homo sapiens
gctcccccgcagtcc

SEQ ID NO: 1824678 - DNA, 21 bp, Homo sapiens
gctcccccgggaggggcccgc

SEQ ID NO: 1824679 - DNA, 16 bp, Homo sapiens
gctcccttttgtcctt

SEQ ID NO: 1824680 - DNA, 18 bp, Homo sapiens
gctcctctccttgggctc

SEQ ID NO: 1824681 - DNA, 20 bp, Homo sapiens
gctcctctccttgggctcct

SEQ ID NO: 1824682 - DNA, 21 bp, Homo sapiens
gctcctctccttgggctcctg

SEQ ID NO: 1824683 - DNA, 22 bp, Homo sapiens
gctcctctccttgggctcctgg

SEQ ID NO: 1824684 - DNA, 18 bp, Homo sapiens
gctcctcttaccgtagcc

SEQ ID NO: 1824685 - DNA, 22 bp, Homo sapiens
gctcctcttaccgtagcctccg

SEQ ID NO: 1824686 - DNA, 11 bp, Homo sapiens
gctcctggctg

SEQ ID NO: 1824687 - DNA, 16 bp, Homo sapiens
gctcctggctgccagg

SEQ ID NO: 1824688 - DNA, 15 bp, Homo sapiens
gctcctgtgccctta

SEQ ID NO: 1824689 - DNA, 19 bp, Homo sapiens
gctccttggcacccccatg

SEQ ID NO: 1824690 - DNA, 20 bp, Homo sapiens
gctccttggcacccccatgc

SEQ ID NO: 1824691 - DNA, 16 bp, Homo sapiens
gctccttgggtcctgc

SEQ ID NO: 1824692 - DNA, 18 bp, Homo sapiens
gctccttgggtcctgcaa

SEQ ID NO: 1824693 - DNA, 14 bp, Homo sapiens
gctccttttgtccc

SEQ ID NO: 1824694 - DNA, 20 bp, Homo sapiens
gctccttttgtccccagggc

SEQ ID NO: 1824695 - DNA, 14 bp, Homo sapiens
gctcgggcccaggc

SEQ ID NO: 1824696 - DNA, 15 bp, Homo sapiens
gctcgggcccaggcc

SEQ ID NO: 1824697 - DNA, 18 bp, Homo sapiens
gctctaattcttttcaaa

SEQ ID NO: 1824698 - DNA, 13 bp, Homo sapiens
gctctagccagga

SEQ ID NO: 1824699 - DNA, 18 bp, Homo sapiens
gctctagccaggagtctg

SEQ ID NO: 1824700 - DNA, 20 bp, Homo sapiens
gctctagccaggagtctgtg

SEQ ID NO: 1824701 - DNA, 22 bp, Homo sapiens
gctctagccaggagtctgtgct

SEQ ID NO: 1824702 - DNA, 14 bp, Homo sapiens
gctctagctggcag

SEQ ID NO: 1824703 - DNA, 12 bp, Homo sapiens
gctctcaagtga

SEQ ID NO: 1824704 - DNA, 15 bp, Homo sapiens
gctctcaagtgaaag

SEQ ID NO: 1824705 - DNA, 16 bp, Homo sapiens
gctctccaaaggggct

SEQ ID NO: 1824706 - DNA, 15 bp, Homo sapiens
gctctgccccaagcc

SEQ ID NO: 1824707 - DNA, 14 bp, Homo sapiens
gctctgccccttgg

SEQ ID NO: 1824708 - DNA, 19 bp, Homo sapiens
gctctgggctcagggctgg

SEQ ID NO: 1824709 - DNA, 23 bp, Homo sapiens
gctctgggctcagggctggagtg

SEQ ID NO: 1824710 - DNA, 16 bp, Homo sapiens
gctctgtggcctgtgt

SEQ ID NO: 1824711 - DNA, 19 bp, Homo sapiens
gctctgtggcctgtgtcca

SEQ ID NO: 1824712 - DNA, 24 bp, Homo sapiens
gctctgtgggctgcactctgtgcc

SEQ ID NO: 1824713 - DNA, 16 bp, Homo sapiens
gctcttagtgcccgcc

SEQ ID NO: 1824714 - DNA, 16 bp, Homo sapiens
gctcttcaagctgtcc

SEQ ID NO: 1824715 - DNA, 13 bp, Homo sapiens
gctcttcctggac

SEQ ID NO: 1824716 - DNA, 19 bp, Homo sapiens
gctcttggtccctggtccc

SEQ ID NO: 1824717 - DNA, 17 bp, Homo sapiens
gctctttgttcatcatt

SEQ ID NO: 1824718 - DNA, 20 bp, Homo sapiens
gctcttttggtggggagcac

SEQ ID NO: 1824719 - DNA, 20 bp, Homo sapiens
gctgaaacattccgaagagg

SEQ ID NO: 1824720 - DNA, 14 bp, Homo sapiens
gctgacacctacca

SEQ ID NO: 1824721 - DNA, 17 bp, Homo sapiens
gctgacacctaccatgc

SEQ ID NO: 1824722 - DNA, 18 bp, Homo sapiens
gctgacacctaccatgct

SEQ ID NO: 1824723 - DNA, 21 bp, Homo sapiens
gctgacacctaccatgctgct

SEQ ID NO: 1824724 - DNA, 14 bp, Homo sapiens
gctgacagtcctct

SEQ ID NO: 1824725 - DNA, 19 bp, Homo sapiens
gctgacagtcctctccacc

SEQ ID NO: 1824726 - DNA, 12 bp, Homo sapiens
gctgagccactc

SEQ ID NO: 1824727 - DNA, 15 bp, Homo sapiens
gctgagccactcgca

SEQ ID NO: 1824728 - DNA, 14 bp, Homo sapiens
gctgatgctgggct

SEQ ID NO: 1824729 - DNA, 15 bp, Homo sapiens
gctgatgctgggctg

SEQ ID NO: 1824730 - DNA, 20 bp, Homo sapiens
gctgatgctgggctgggtgc

SEQ ID NO: 1824731 - DNA, 14 bp, Homo sapiens
gctgattgtattta

SEQ ID NO: 1824732 - DNA, 16 bp, Homo sapiens
gctgatttccaggccc

SEQ ID NO: 1824733 - DNA, 18 bp, Homo sapiens
gctgcaccaacccagccg

SEQ ID NO: 1824734 - DNA, 12 bp, Homo sapiens
gctgcaccagag

SEQ ID NO: 1824735 - DNA, 15 bp, Homo sapiens
gctgcaccagagtga

SEQ ID NO: 1824736 - DNA, 16 bp, Homo sapiens
gctgcaccagagtgaa

SEQ ID NO: 1824737 - DNA, 22 bp, Homo sapiens
gctgcaccagagtgaaagggct

SEQ ID NO: 1824738 - DNA, 19 bp, Homo sapiens
gctgcacctcctaccctcc

SEQ ID NO: 1824739 - DNA, 20 bp, Homo sapiens
gctgcacctcctaccctccc

SEQ ID NO: 1824740 - DNA, 15 bp, Homo sapiens
gctgcactctgtgcc

SEQ ID NO: 1824741 - DNA, 19 bp, Homo sapiens
gctgcagaggggcaggccc

SEQ ID NO: 1824742 - DNA, 15 bp, Homo sapiens
ggaactgctgggctt

SEQ ID NO: 1824743 - DNA, 19 bp, Homo sapiens
ggaagagcacagccctccc

SEQ ID NO: 1824744 - DNA, 12 bp, Homo sapiens
ggaagagcagcc

SEQ ID NO: 1824745 - DNA, 18 bp, Homo sapiens
ggaagccgtctgactcca

SEQ ID NO: 1824746 - DNA, 22 bp, Homo sapiens
ggaagccgtctgactccagagt

SEQ ID NO: 1824747 - DNA, 14 bp, Homo sapiens
ggaagcctgaggca

SEQ ID NO: 1824748 - DNA, 18 bp, Homo sapiens
ggaagctgtactcagagc

SEQ ID NO: 1824749 - DNA, 13 bp, Homo sapiens
ggaaggcagggca

SEQ ID NO: 1824750 - DNA, 14 bp, Homo sapiens
ggaaggcagggcag

SEQ ID NO: 1824751 - DNA, 21 bp, Homo sapiens
ggaaggctaagttcagttctg

SEQ ID NO: 1824752 - DNA, 23 bp, Homo sapiens
ggaagggacaccaagccttggct

SEQ ID NO: 1824753 - DNA, 21 bp, Homo sapiens
ggaagggagagttctttgctg

SEQ ID NO: 1824754 - DNA, 16 bp, Homo sapiens
ggaaggtgctgagctt

SEQ ID NO: 1824755 - DNA, 22 bp, Homo sapiens
ggaagtgtgggtctgtgtgtgt

SEQ ID NO: 1824756 - DNA, 12 bp, Homo sapiens
ggaatgcaggga

SEQ ID NO: 1824757 - DNA, 20 bp, Homo sapiens
ggaatgttccctgcaccctg

SEQ ID NO: 1824758 - DNA, 21 bp, Homo sapiens
ggaatgttccctgcaccctgg

SEQ ID NO: 1824759 - DNA, 21 bp, Homo sapiens
ggaattcagcaccctgggtgc

SEQ ID NO: 1824760 - DNA, 22 bp, Homo sapiens
ggaattcagcaccctgggtgcc

SEQ ID NO: 1824761 - DNA, 11 bp, Homo sapiens
ggaattttctt

SEQ ID NO: 1824762 - DNA, 14 bp, Homo sapiens
ggacacatcccggc

SEQ ID NO: 1824763 - DNA, 20 bp, Homo sapiens
ggacacatcccggcctcttc

SEQ ID NO: 1824764 - DNA, 23 bp, Homo sapiens
ggacacatcccggcctcttccac

SEQ ID NO: 1824765 - DNA, 19 bp, Homo sapiens
ggacacatgtccagtggga

SEQ ID NO: 1824766 - DNA, 11 bp, Homo sapiens
ggacacctgcc

SEQ ID NO: 1824767 - DNA, 12 bp, Homo sapiens
ggacacctgccc

SEQ ID NO: 1824768 - DNA, 22 bp, Homo sapiens
ggacagaaaagaaagctgcttt

SEQ ID NO: 1824769 - DNA, 18 bp, Homo sapiens
ggacagtatttgtgggga

SEQ ID NO: 1824770 - DNA, 14 bp, Homo sapiens
ggacatcatgaagc

SEQ ID NO: 1824771 - DNA, 19 bp, Homo sapiens
ggaccaaattgcttctagg

SEQ ID NO: 1824772 - DNA, 20 bp, Homo sapiens
ggaccaaattgcttctagga

SEQ ID NO: 1824773 - DNA, 12 bp, Homo sapiens
ggacccaccaaa

SEQ ID NO: 1824774 - DNA, 13 bp, Homo sapiens
ggacccaggccct

SEQ ID NO: 1824775 - DNA, 18 bp, Homo sapiens
ggaccgggtgggcctggc

SEQ ID NO: 1824776 - DNA, 22 bp, Homo sapiens
ggaccgggtgggcctggcctga

SEQ ID NO: 1824777 - DNA, 13 bp, Homo sapiens
ggactccagttca

SEQ ID NO: 1824778 - DNA, 14 bp, Homo sapiens
ggactgaggagtgg

SEQ ID NO: 1824779 - DNA, 14 bp, Homo sapiens
ggactgcccccaga

SEQ ID NO: 1824780 - DNA, 15 bp, Homo sapiens
ggactgcccccagaa

SEQ ID NO: 1824781 - DNA, 16 bp, Homo sapiens
ggacttcctggggccc

SEQ ID NO: 1824782 - DNA, 14 bp, Homo sapiens
ggagaaggaaaaag

SEQ ID NO: 1824783 - DNA, 20 bp, Homo sapiens
ggagaccgcttcacccctgc

SEQ ID NO: 1824784 - DNA, 18 bp, Homo sapiens
ggagagactgaaagcagc

SEQ ID NO: 1824785 - DNA, 20 bp, Homo sapiens
ggagagatcatagctcactg

SEQ ID NO: 1824786 - DNA, 19 bp, Homo sapiens
ggagaggggtgcacccact

SEQ ID NO: 1824787 - DNA, 21 bp, Homo sapiens
ggagaggggtgcacccactca

SEQ ID NO: 1824788 - DNA, 22 bp, Homo sapiens
ggagatggtcagtgtggagagg

SEQ ID NO: 1824789 - DNA, 16 bp, Homo sapiens
ggagcacagccctggg

SEQ ID NO: 1824790 - DNA, 17 bp, Homo sapiens
ggagcacagccctggga

SEQ ID NO: 1824791 - DNA, 19 bp, Homo sapiens
ggagcacctgaaccccatg

SEQ ID NO: 1824792 - DNA, 18 bp, Homo sapiens
ggagcacttgcgtcctgc

SEQ ID NO: 1824793 - DNA, 19 bp, Homo sapiens
ggagcacttgcgtcctgca

SEQ ID NO: 1824794 - DNA, 22 bp, Homo sapiens
ggagcacttgcgtcctgcagag

SEQ ID NO: 1824795 - DNA, 17 bp, Homo sapiens
ggagcatttttcagagt

SEQ ID NO: 1824796 - DNA, 11 bp, Homo sapiens
ggagccactcc

SEQ ID NO: 1824797 - DNA, 18 bp, Homo sapiens
ggagctgatttccaggcc

SEQ ID NO: 1824798 - DNA, 19 bp, Homo sapiens
ggagctgatttccaggccc

SEQ ID NO: 1824799 - DNA, 15 bp, Homo sapiens
ggaggaggtgccaac

SEQ ID NO: 1824800 - DNA, 12 bp, Homo sapiens
ggaggcaccagc

SEQ ID NO: 1824801 - DNA, 14 bp, Homo sapiens
ggaggcaccagctc

SEQ ID NO: 1824802 - DNA, 16 bp, Homo sapiens
ggaggcaccagctctg

SEQ ID NO: 1824803 - DNA, 20 bp, Homo sapiens
ggaggcaccagctctgtggc

SEQ ID NO: 1824804 - DNA, 18 bp, Homo sapiens
ggaggccaaggcaggtag

SEQ ID NO: 1824805 - DNA, 13 bp, Homo sapiens
ggaggccacccca

SEQ ID NO: 1824806 - DNA, 19 bp, Homo sapiens
ggaggcctgatgctgcccc

SEQ ID NO: 1824807 - DNA, 16 bp, Homo sapiens
ggaggctggctggggc

SEQ ID NO: 1824808 - DNA, 22 bp, Homo sapiens
ggagggcagagccatgggcctg

SEQ ID NO: 1824809 - DNA, 21 bp, Homo sapiens
ggagggggctatttctctccc

SEQ ID NO: 1824810 - DNA, 16 bp, Homo sapiens
ggagtctgtgctcttt

SEQ ID NO: 1824811 - DNA, 18 bp, Homo sapiens
ggagtgaggcttccaggc

SEQ ID NO: 1824812 - DNA, 21 bp, Homo sapiens
ggagtgcgctcttggtccctg

SEQ ID NO: 1824813 - DNA, 23 bp, Homo sapiens
ggagtgcgctcttggtccctggt

SEQ ID NO: 1824814 - DNA, 14 bp, Homo sapiens
ggagttgagtacag

SEQ ID NO: 1824815 - DNA, 13 bp, Homo sapiens
ggagttgagtcac

SEQ ID NO: 1824816 - DNA, 19 bp, Homo sapiens
ggagttgagtcacaagagg

SEQ ID NO: 1824817 - DNA, 22 bp, Homo sapiens
ggagttgtattttgacaaaaat

SEQ ID NO: 1824818 - DNA, 13 bp, Homo sapiens
ggatactgtactg

SEQ ID NO: 1824819 - DNA, 13 bp, Homo sapiens
ggatagatgtgtg

SEQ ID NO: 1824820 - DNA, 17 bp, Homo sapiens
ggatccgctgccaccac

SEQ ID NO: 1824821 - DNA, 17 bp, Homo sapiens
ggatctatttttgcact

SEQ ID NO: 1824822 - DNA, 20 bp, Homo sapiens
ggatggcatctccatgtaga

SEQ ID NO: 1824823 - DNA, 16 bp, Homo sapiens
ggattcccctggacat

SEQ ID NO: 1824824 - DNA, 19 bp, Homo sapiens
ggcaaaacacgcaagggca

SEQ ID NO: 1824825 - DNA, 21 bp, Homo sapiens
ggcaaagtgctgtacccttcc

SEQ ID NO: 1824826 - DNA, 13 bp, Homo sapiens
ggcaagcagggaa

SEQ ID NO: 1824827 - DNA, 17 bp, Homo sapiens
ggcaagcccctcagccc

SEQ ID NO: 1824828 - DNA, 20 bp, Homo sapiens
ggcaagcccctcagcccttg

SEQ ID NO: 1824829 - DNA, 16 bp, Homo sapiens
ggcaaggtctccttac

SEQ ID NO: 1824830 - DNA, 13 bp, Homo sapiens
ggcacaccactgc

SEQ ID NO: 1824831 - DNA, 16 bp, Homo sapiens
ggcacaccactgccct

SEQ ID NO: 1824832 - DNA, 17 bp, Homo sapiens
ggcacaccactgccctg

SEQ ID NO: 1824833 - DNA, 19 bp, Homo sapiens
ggcacaccactgccctgcc

SEQ ID NO: 1824834 - DNA, 22 bp, Homo sapiens
ggcacaccactgccctgcctgc

SEQ ID NO: 1824835 - DNA, 15 bp, Homo sapiens
ggcacagtgtctggg

SEQ ID NO: 1824836 - DNA, 19 bp, Homo sapiens
ggcacagtgtctgggctga

SEQ ID NO: 1824837 - DNA, 14 bp, Homo sapiens
ggcaccagccccct

SEQ ID NO: 1824838 - DNA, 17 bp, Homo sapiens
ggcaccagccccctgga

SEQ ID NO: 1824839 - DNA, 13 bp, Homo sapiens
ggcaccagctctg

SEQ ID NO: 1824840 - DNA, 20 bp, Homo sapiens
ggcaccagctctgtggcctg

SEQ ID NO: 1824841 - DNA, 16 bp, Homo sapiens
ggcacccccatgctgc

SEQ ID NO: 1824842 - DNA, 16 bp, Homo sapiens
ggcaccggcgctgcag

SEQ ID NO: 1824843 - DNA, 14 bp, Homo sapiens
ggcacctcctgaga

SEQ ID NO: 1824844 - DNA, 16 bp, Homo sapiens
ggcacctgcaggttgg

SEQ ID NO: 1824845 - DNA, 16 bp, Homo sapiens
ggcactgccagactga

SEQ ID NO: 1824846 - DNA, 15 bp, Homo sapiens
ggcactgctgggtgg

SEQ ID NO: 1824847 - DNA, 21 bp, Homo sapiens
ggcactgctgggtggcccatc

SEQ ID NO: 1824848 - DNA, 13 bp, Homo sapiens
ggcactggtggca

SEQ ID NO: 1824849 - DNA, 21 bp, Homo sapiens
ggcagaaaagaggagaccctg

SEQ ID NO: 1824850 - DNA, 17 bp, Homo sapiens
ggcagagaaggcctctt

SEQ ID NO: 1824851 - DNA, 17 bp, Homo sapiens
ggcagaggggcagccgc

SEQ ID NO: 1824852 - DNA, 16 bp, Homo sapiens
ggcagcaggtgctgct

SEQ ID NO: 1824853 - DNA, 14 bp, Homo sapiens
ggcagcctccagag

SEQ ID NO: 1824854 - DNA, 15 bp, Homo sapiens
ggcagcctccagagc

SEQ ID NO: 1824855 - DNA, 21 bp, Homo sapiens
ggcagcctccagagccagcct

SEQ ID NO: 1824856 - DNA, 23 bp, Homo sapiens
ggcagcctccagagccagcctgg

SEQ ID NO: 1824857 - DNA, 24 bp, Homo sapiens
ggcagcctccagagccagcctggg

SEQ ID NO: 1824858 - DNA, 18 bp, Homo sapiens
ggcagctagactggagtg

SEQ ID NO: 1824859 - DNA, 18 bp, Homo sapiens
ggcagctcctctccttgg

SEQ ID NO: 1824860 - DNA, 12 bp, Homo sapiens
ggcagctgctct

SEQ ID NO: 1824861 - DNA, 14 bp, Homo sapiens
ggcagctgggcccc

SEQ ID NO: 1824862 - DNA, 20 bp, Homo sapiens
ggcagctgggccccacctac

SEQ ID NO: 1824863 - DNA, 16 bp, Homo sapiens
ggcaggacacatcccg

SEQ ID NO: 1824864 - DNA, 13 bp, Homo sapiens
ggcaggccctgca

SEQ ID NO: 1824865 - DNA, 15 bp, Homo sapiens
ggcaggccctgcact

SEQ ID NO: 1824866 - DNA, 16 bp, Homo sapiens
ggcaggccctgcactg

SEQ ID NO: 1824867 - DNA, 19 bp, Homo sapiens
ggcaggccctgcactgtcc

SEQ ID NO: 1824868 - DNA, 12 bp, Homo sapiens
ggcaggcctggg

SEQ ID NO: 1824869 - DNA, 13 bp, Homo sapiens
ggcagggcagagg

SEQ ID NO: 1824870 - DNA, 13 bp, Homo sapiens
ggcagtacctggg

SEQ ID NO: 1824871 - DNA, 23 bp, Homo sapiens
ggcagtgaacacactcagcagcc

SEQ ID NO: 1824872 - DNA, 14 bp, Homo sapiens
ggcagtgactggca

SEQ ID NO: 1824873 - DNA, 15 bp, Homo sapiens
ggcagtgactggcag

SEQ ID NO: 1824874 - DNA, 16 bp, Homo sapiens
ggcatcaggcactggt

SEQ ID NO: 1824875 - DNA, 19 bp, Homo sapiens
ggcatcaggcactggtggc

SEQ ID NO: 1824876 - DNA, 13 bp, Homo sapiens
ggcatccacccag

SEQ ID NO: 1824877 - DNA, 23 bp, Homo sapiens
ggcatccacccagtgctgccatg

SEQ ID NO: 1824878 - DNA, 22 bp, Homo sapiens
ggcatcgtagaagagatgtggc

SEQ ID NO: 1824879 - DNA, 16 bp, Homo sapiens
ggcatctccatgtaga

SEQ ID NO: 1824880 - DNA, 18 bp, Homo sapiens
ggcatgtgtagttaattt

SEQ ID NO: 1824881 - DNA, 15 bp, Homo sapiens
ggcatgtgtgcctgt

SEQ ID NO: 1824882 - DNA, 19 bp, Homo sapiens
ggcattggcagcaggtgct

SEQ ID NO: 1824883 - DNA, 18 bp, Homo sapiens
ggcattgggctgacacct

SEQ ID NO: 1824884 - DNA, 19 bp, Homo sapiens
ggccaaatgcacaagctca

SEQ ID NO: 1824885 - DNA, 22 bp, Homo sapiens
ggccaaatgcacaagctcagaa

SEQ ID NO: 1824886 - DNA, 23 bp, Homo sapiens
ggccacaaatcaaagcaagggct

SEQ ID NO: 1824887 - DNA, 19 bp, Homo sapiens
ggccaccccaaaccccagc

SEQ ID NO: 1824888 - DNA, 23 bp, Homo sapiens
ggccaccccaaaccccagcccca

SEQ ID NO: 1824889 - DNA, 14 bp, Homo sapiens
ggccagaaggaggg

SEQ ID NO: 1824890 - DNA, 15 bp, Homo sapiens
ggccagagagggccc

SEQ ID NO: 1824891 - DNA, 16 bp, Homo sapiens
ggccagagagggccca

SEQ ID NO: 1824892 - DNA, 17 bp, Homo sapiens
ggccagagagggcccag

SEQ ID NO: 1824893 - DNA, 18 bp, Homo sapiens
ggccagagagggcccagc

SEQ ID NO: 1824894 - DNA, 19 bp, Homo sapiens
ggccagagagggcccagct

SEQ ID NO: 1824895 - DNA, 16 bp, Homo sapiens
ggccagagctggaagg

SEQ ID NO: 1824896 - DNA, 23 bp, Homo sapiens
gcaggccctgcactgtcctgctc

SEQ ID NO: 1824897 - DNA, 23 bp, Homo sapiens
gcccacttagccgtccatggcac

SEQ ID NO: 1824898 - DNA, 13 bp, Homo sapiens
gcccagctccccc

SEQ ID NO: 1824899 - DNA, 18 bp, Homo sapiens
gcccagctgtagccatgg

SEQ ID NO: 1824900 - DNA, 19 bp, Homo sapiens
gcccagctgtagccatggc

SEQ ID NO: 1824901 - DNA, 23 bp, Homo sapiens
gcccagctgtagccatggctcag

SEQ ID NO: 1824902 - DNA, 17 bp, Homo sapiens
gcccagcttcctggtgt

SEQ ID NO: 1824903 - DNA, 18 bp, Homo sapiens
gcccaggccatcttccag

SEQ ID NO: 1824904 - DNA, 19 bp, Homo sapiens
gcccaggctggagtgcagt

SEQ ID NO: 1824905 - DNA, 18 bp, Homo sapiens
gcccatcccccctcacca

SEQ ID NO: 1824906 - DNA, 20 bp, Homo sapiens
gcccatctcaggtgccactc

SEQ ID NO: 1824907 - DNA, 23 bp, Homo sapiens
gcccatctcaggtgccactccct

SEQ ID NO: 1824908 - DNA, 24 bp, Homo sapiens
gcccatctcaggtgccactccctg

SEQ ID NO: 1824909 - DNA, 15 bp, Homo sapiens
gcccatgggcactgc

SEQ ID NO: 1824910 - DNA, 17 bp, Homo sapiens
gcccatgggcactgctg

SEQ ID NO: 1824911 - DNA, 21 bp, Homo sapiens
gcccatgggcactgctgggtg

SEQ ID NO: 1824912 - DNA, 22 bp, Homo sapiens
gcccatgggcactgctgggtgg

SEQ ID NO: 1824913 - DNA, 17 bp, Homo sapiens
gccccaacccccagcac

SEQ ID NO: 1824914 - DNA, 18 bp, Homo sapiens
gccccaactccaggggca

SEQ ID NO: 1824915 - DNA, 13 bp, Homo sapiens
gccccaagcagcc

SEQ ID NO: 1824916 - DNA, 21 bp, Homo sapiens
gccccaagcagccagccagtc

SEQ ID NO: 1824917 - DNA, 13 bp, Homo sapiens
gccccacagccca

SEQ ID NO: 1824918 - DNA, 20 bp, Homo sapiens
gccccaccctcgtggacacc

SEQ ID NO: 1824919 - DNA, 22 bp, Homo sapiens
gccccaccctcgtggacacctg

SEQ ID NO: 1824920 - DNA, 23 bp, Homo sapiens
gccccaccctcgtggacacctgc

SEQ ID NO: 1824921 - DNA, 17 bp, Homo sapiens
gccccacctacttgtga

SEQ ID NO: 1824922 - DNA, 15 bp, Homo sapiens
gccccagatctgcct

SEQ ID NO: 1824923 - DNA, 16 bp, Homo sapiens
gccccagatctgcctg

SEQ ID NO: 1824924 - DNA, 17 bp, Homo sapiens
gccccagatctgcctgg

SEQ ID NO: 1824925 - DNA, 18 bp, Homo sapiens
gccccagatctgcctggg

SEQ ID NO: 1824926 - DNA, 19 bp, Homo sapiens
gccccagatctgcctgggc

SEQ ID NO: 1824927 - DNA, 21 bp, Homo sapiens
gccccagatctgcctgggcct

SEQ ID NO: 1824928 - DNA, 16 bp, Homo sapiens
gccccagcctggccca

SEQ ID NO: 1824929 - DNA, 12 bp, Homo sapiens
gccccagggcct

SEQ ID NO: 1824930 - DNA, 14 bp, Homo sapiens
gccccagggcctgg

SEQ ID NO: 1824931 - DNA, 15 bp, Homo sapiens
gccccagggcctggg

SEQ ID NO: 1824932 - DNA, 14 bp, Homo sapiens
gccccatccctgct

SEQ ID NO: 1824933 - DNA, 23 bp, Homo sapiens
gccccatccctgcttgcccgctc

SEQ ID NO: 1824934 - DNA, 16 bp, Homo sapiens
gccccatctcctccca

SEQ ID NO: 1824935 - DNA, 20 bp, Homo sapiens
gccccatgctctgccccaag

SEQ ID NO: 1824936 - DNA, 22 bp, Homo sapiens
gccccatgctctgccccaagcc

SEQ ID NO: 1824937 - DNA, 20 bp, Homo sapiens
gcccccaccgaggttcccag

SEQ ID NO: 1824938 - DNA, 21 bp, Homo sapiens
gcccccaccgaggttcccagg

SEQ ID NO: 1824939 - DNA, 11 bp, Homo sapiens
gcccccagaaa

SEQ ID NO: 1824940 - DNA, 22 bp, Homo sapiens
gcccccagaaagcctcctgccc

SEQ ID NO: 1824941 - DNA, 16 bp, Homo sapiens
gcccccatctccccag

SEQ ID NO: 1824942 - DNA, 15 bp, Homo sapiens
gccccccatcctggc

SEQ ID NO: 1824943 - DNA, 17 bp, Homo sapiens
gccccccatcctggccc

SEQ ID NO: 1824944 - DNA, 14 bp, Homo sapiens
gccccggggctggc

SEQ ID NO: 1824945 - DNA, 16 bp, Homo sapiens
gccccggggctggcaa

SEQ ID NO: 1824946 - DNA, 23 bp, Homo sapiens
gccccggggctggcaagcaggga

SEQ ID NO: 1824947 - DNA, 16 bp, Homo sapiens
gccccggtgtgcggtg

SEQ ID NO: 1824948 - DNA, 13 bp, Homo sapiens
gccccgttccctg

SEQ ID NO: 1824949 - DNA, 17 bp, Homo sapiens
gccccgttccctgtcag

SEQ ID NO: 1824950 - DNA, 15 bp, Homo sapiens
gccccgttttgggga

SEQ ID NO: 1824951 - DNA, 14 bp, Homo sapiens
gcccctcagccctt

SEQ ID NO: 1824952 - DNA, 13 bp, Homo sapiens
gcccctccccagc

SEQ ID NO: 1824953 - DNA, 16 bp, Homo sapiens
gcccctccccagccag

SEQ ID NO: 1824954 - DNA, 16 bp, Homo sapiens
gcccctgaggactgga

SEQ ID NO: 1824955 - DNA, 19 bp, Homo sapiens
gcccctgaggactggagac

SEQ ID NO: 1824956 - DNA, 17 bp, Homo sapiens
gcccctggtaagcagag

SEQ ID NO: 1824957 - DNA, 18 bp, Homo sapiens
gcccctggtaagcagagg

SEQ ID NO: 1824958 - DNA, 19 bp, Homo sapiens
gcccctggtaagcagaggc

SEQ ID NO: 1824959 - DNA, 20 bp, Homo sapiens
gcccctggtaagcagaggct

SEQ ID NO: 1824960 - DNA, 20 bp, Homo sapiens
gccccttaagggttgaaggc

SEQ ID NO: 1824961 - DNA, 13 bp, Homo sapiens
gccccttgggcat

SEQ ID NO: 1824962 - DNA, 23 bp, Homo sapiens
gccccttgggcatccacccagtg

SEQ ID NO: 1824963 - DNA, 13 bp, Homo sapiens
gcccgctcccaca

SEQ ID NO: 1824964 - DNA, 18 bp, Homo sapiens
gcccgcttgcctcggctc

SEQ ID NO: 1824965 - DNA, 15 bp, Homo sapiens
gcccggcgccctctg

SEQ ID NO: 1824966 - DNA, 17 bp, Homo sapiens
gcccggcgccctctgtc

SEQ ID NO: 1824967 - DNA, 14 bp, Homo sapiens
gcccgtgaagcagt

SEQ ID NO: 1824968 - DNA, 20 bp, Homo sapiens
gcccgtgaagcagtgcctcg

SEQ ID NO: 1824969 - DNA, 17 bp, Homo sapiens
gcccgttgtctccctgg

SEQ ID NO: 1824970 - DNA, 23 bp, Homo sapiens
gcccgttgtctccctggccctca

SEQ ID NO: 1824971 - DNA, 21 bp, Homo sapiens
gccctcaaggcctcccacagt

SEQ ID NO: 1824972 - DNA, 22 bp, Homo sapiens
gccctcaaggcctcccacagtg

SEQ ID NO: 1824973 - DNA, 23 bp, Homo sapiens
gccctcaaggcctcccacagtga

SEQ ID NO: 1824974 - DNA, 14 bp, Homo sapiens
gccctccatgggct

SEQ ID NO: 1824975 - DNA, 13 bp, Homo sapiens
gccctcccgcccc

SEQ ID NO: 1824976 - DNA, 15 bp, Homo sapiens
gccctcccgcccctt

SEQ ID NO: 1824977 - DNA, 13 bp, Homo sapiens
gccctccctgtct

SEQ ID NO: 1824978 - DNA, 17 bp, Homo sapiens
gccctgcactgtcctgc

SEQ ID NO: 1824979 - DNA, 13 bp, Homo sapiens
gccctgccacctg

SEQ ID NO: 1824980 - DNA, 16 bp, Homo sapiens
gccctgccacctgtct

SEQ ID NO: 1824981 - DNA, 22 bp, Homo sapiens
gccctgcccccatctccccagg

SEQ ID NO: 1824982 - DNA, 13 bp, Homo sapiens
gccctgccctgcc

SEQ ID NO: 1824983 - DNA, 17 bp, Homo sapiens
gccctgccctgccacct

SEQ ID NO: 1824984 - DNA, 19 bp, Homo sapiens
gccctgcgttggagccact

SEQ ID NO: 1824985 - DNA, 13 bp, Homo sapiens
gcccttggggcct

SEQ ID NO: 1824986 - DNA, 14 bp, Homo sapiens
gcccttggggcctg

SEQ ID NO: 1824987 - DNA, 18 bp, Homo sapiens
gcccttggggcctggctt

SEQ ID NO: 1824988 - DNA, 19 bp, Homo sapiens
gcccttggggcctggcttg

SEQ ID NO: 1824989 - DNA, 20 bp, Homo sapiens
gcccttggggcctggcttgc

SEQ ID NO: 1824990 - DNA, 17 bp, Homo sapiens
gcccttgtcctgccagc

SEQ ID NO: 1824991 - DNA, 22 bp, Homo sapiens
gcccttgtcctgccagctgcct

SEQ ID NO: 1824992 - DNA, 15 bp, Homo sapiens
gccgcctcgcccacc

SEQ ID NO: 1824993 - DNA, 18 bp, Homo sapiens
gccgtccatggcaccagc

SEQ ID NO: 1824994 - DNA, 19 bp, Homo sapiens
gccgtccatggcaccagcc

SEQ ID NO: 1824995 - DNA, 16 bp, Homo sapiens
gccgttccccttggct

SEQ ID NO: 1824996 - DNA, 18 bp, Homo sapiens
gcctatcagtgtgccccc

SEQ ID NO: 1824997 - DNA, 15 bp, Homo sapiens
gcctatccatcctgc

SEQ ID NO: 1824998 - DNA, 15 bp, Homo sapiens
gcctcactggctggg

SEQ ID NO: 1824999 - DNA, 16 bp, Homo sapiens
gcctcactggctgggg

SEQ ID NO: 1825000 - DNA, 20 bp, Homo sapiens
gcctcagtttctccatcagc

SEQ ID NO: 1825001 - DNA, 12 bp, Homo sapiens
gcgtaggagaga

SEQ ID NO: 1825002 - DNA, 13 bp, Homo sapiens
gcgtcctgcagag

SEQ ID NO: 1825003 - DNA, 18 bp, Homo sapiens
gcgtcctgcagaggacca

SEQ ID NO: 1825004 - DNA, 19 bp, Homo sapiens
gcgtcctgcagaggaccac

SEQ ID NO: 1825005 - DNA, 14 bp, Homo sapiens
gcgtggctgtggca

SEQ ID NO: 1825006 - DNA, 15 bp, Homo sapiens
gcgttggagccactc

SEQ ID NO: 1825007 - DNA, 17 bp, Homo sapiens
gcgttggagccactcct

SEQ ID NO: 1825008 - DNA, 21 bp, Homo sapiens
gcgtttagtttctagaggcct

SEQ ID NO: 1825009 - DNA, 22 bp, Homo sapiens
gcgtttagtttctagaggcctc

SEQ ID NO: 1825010 - DNA, 23 bp, Homo sapiens
gcgtttagtttctagaggcctca

SEQ ID NO: 1825011 - DNA, 12 bp, Homo sapiens
gctaaatgaagt

SEQ ID NO: 1825012 - DNA, 19 bp, Homo sapiens
gctaacccccagcccacag

SEQ ID NO: 1825013 - DNA, 18 bp, Homo sapiens
gctaattctgggaaggga

SEQ ID NO: 1825014 - DNA, 22 bp, Homo sapiens
gctaccccccctcctgctgcct

SEQ ID NO: 1825015 - DNA, 13 bp, Homo sapiens
gctaccctccctg

SEQ ID NO: 1825016 - DNA, 16 bp, Homo sapiens
gctaccctccctgctg

SEQ ID NO: 1825017 - DNA, 14 bp, Homo sapiens
gctactctgtccag

SEQ ID NO: 1825018 - DNA, 14 bp, Homo sapiens
gctactggcagctc

SEQ ID NO: 1825019 - DNA, 15 bp, Homo sapiens
gctactggcagctcc

SEQ ID NO: 1825020 - DNA, 20 bp, Homo sapiens
gctagagcaacccctgtacc

SEQ ID NO: 1825021 - DNA, 14 bp, Homo sapiens
gctagccatatatt

SEQ ID NO: 1825022 - DNA, 18 bp, Homo sapiens
gctagtgtgagtggcagc

SEQ ID NO: 1825023 - DNA, 13 bp, Homo sapiens
taaatgttgcaca

SEQ ID NO: 1825024 - DNA, 22 bp, Homo sapiens
taaatgttgcacatcattcatt

SEQ ID NO: 1825025 - DNA, 13 bp, Homo sapiens
taaattacattaa

SEQ ID NO: 1825026 - DNA, 13 bp, Homo sapiens
taacacagatatt

SEQ ID NO: 1825027 - DNA, 17 bp, Homo sapiens
taaccccaagacagtct

SEQ ID NO: 1825028 - DNA, 14 bp, Homo sapiens
taacgtattttgat

SEQ ID NO: 1825029 - DNA, 22 bp, Homo sapiens
taactgtcttgagagaaaagaa

SEQ ID NO: 1825030 - DNA, 23 bp, Homo sapiens
taactgtcttgagagaaaagaaa

SEQ ID NO: 1825031 - DNA, 22 bp, Homo sapiens
taacttaacaattaattttcta

SEQ ID NO: 1825032 - DNA, 24 bp, Homo sapiens
taacttagaaggatggcatctcca

SEQ ID NO: 1825033 - DNA, 23 bp, Homo sapiens
taagaatgcagattcctgggcct

SEQ ID NO: 1825034 - DNA, 16 bp, Homo sapiens
taagaccgtgtcccaa

SEQ ID NO: 1825035 - DNA, 19 bp, Homo sapiens
taagatgagatttgccagc

SEQ ID NO: 1825036 - DNA, 22 bp, Homo sapiens
taagatggcttatttgtataat

SEQ ID NO: 1825037 - DNA, 17 bp, Homo sapiens
taagcaacttgcttcta

SEQ ID NO: 1825038 - DNA, 23 bp, Homo sapiens
taagcaggaggaggtgccaacag

SEQ ID NO: 1825039 - DNA, 20 bp, Homo sapiens
taagccctcgaaccaaggca

SEQ ID NO: 1825040 - DNA, 13 bp, Homo sapiens
taagcctgatgat

SEQ ID NO: 1825041 - DNA, 14 bp, Homo sapiens
taagctttctcctt

SEQ ID NO: 1825042 - DNA, 15 bp, Homo sapiens
taagctttctccttt

SEQ ID NO: 1825043 - DNA, 16 bp, Homo sapiens
taagggttgaaggcag

SEQ ID NO: 1825044 - DNA, 19 bp, Homo sapiens
taagtgggacattagtaac

SEQ ID NO: 1825045 - DNA, 17 bp, Homo sapiens
taagttatgtgcagggg

SEQ ID NO: 1825046 - DNA, 19 bp, Homo sapiens
taataaaaagtaacacacc

SEQ ID NO: 1825047 - DNA, 15 bp, Homo sapiens
taataatgtaatact

SEQ ID NO: 1825048 - DNA, 20 bp, Homo sapiens
taataatgtaatactgtaga

SEQ ID NO: 1825049 - DNA, 16 bp, Homo sapiens
taatacagattgaaag

SEQ ID NO: 1825050 - DNA, 21 bp, Homo sapiens
taatactgaaccactttgata

SEQ ID NO: 1825051 - DNA, 11 bp, Homo sapiens
taatactgtgt

SEQ ID NO: 1825052 - DNA, 15 bp, Homo sapiens
taatagttagccctc

SEQ ID NO: 1825053 - DNA, 20 bp, Homo sapiens
taatccatgtgctgctgtgg

SEQ ID NO: 1825054 - DNA, 18 bp, Homo sapiens
taatctagaaaatgaaaa

SEQ ID NO: 1825055 - DNA, 17 bp, Homo sapiens
taatgaagacccagtgt

SEQ ID NO: 1825056 - DNA, 17 bp, Homo sapiens
taatgaaggcatatttc

SEQ ID NO: 1825057 - DNA, 19 bp, Homo sapiens
taatgaaggcatatttcca

SEQ ID NO: 1825058 - DNA, 18 bp, Homo sapiens
taatgagtcacaaaataa

SEQ ID NO: 1825059 - DNA, 23 bp, Homo sapiens
taatgggatctatttttgcactg

SEQ ID NO: 1825060 - DNA, 13 bp, Homo sapiens
taatgttatttgg

SEQ ID NO: 1825061 - DNA, 15 bp, Homo sapiens
taattcttttcaaaa

SEQ ID NO: 1825062 - DNA, 16 bp, Homo sapiens
taattcttttcaaaat

SEQ ID NO: 1825063 - DNA, 17 bp, Homo sapiens
taattcttttcaaaatt

SEQ ID NO: 1825064 - DNA, 15 bp, Homo sapiens
taattgcaacaatgc

SEQ ID NO: 1825065 - DNA, 15 bp, Homo sapiens
taattggctttgcag

SEQ ID NO: 1825066 - DNA, 19 bp, Homo sapiens
taatttctcctcatttaat

SEQ ID NO: 1825067 - DNA, 20 bp, Homo sapiens
taatttctcctcatttaata

SEQ ID NO: 1825068 - DNA, 18 bp, Homo sapiens
tacaaaaacatacttcaa

SEQ ID NO: 1825069 - DNA, 20 bp, Homo sapiens
tacaaattttcttttgaaag

SEQ ID NO: 1825070 - DNA, 14 bp, Homo sapiens
tacacttggagccc

SEQ ID NO: 1825071 - DNA, 23 bp, Homo sapiens
tacagaatttatagaataatttc

SEQ ID NO: 1825072 - DNA, 14 bp, Homo sapiens
tacagtatcttcaa

SEQ ID NO: 1825073 - DNA, 16 bp, Homo sapiens
tacagtatcttcaaaa

SEQ ID NO: 1825074 - DNA, 18 bp, Homo sapiens
tacagtatcttcaaaaat

SEQ ID NO: 1825075 - DNA, 20 bp, Homo sapiens
tacagtatcttcaaaaatac

SEQ ID NO: 1825076 - DNA, 13 bp, Homo sapiens
tacagtgaggagg

SEQ ID NO: 1825077 - DNA, 16 bp, Homo sapiens
tacataaatgcccagc

SEQ ID NO: 1825078 - DNA, 15 bp, Homo sapiens
tacatcttcattaat

SEQ ID NO: 1825079 - DNA, 16 bp, Homo sapiens
tacattttatatgtga

SEQ ID NO: 1825080 - DNA, 21 bp, Homo sapiens
tacattttgcacaaagtaagc

SEQ ID NO: 1825081 - DNA, 18 bp, Homo sapiens
taccattacttgtataaa

SEQ ID NO: 1825082 - DNA, 12 bp, Homo sapiens
tacccccgccca

SEQ ID NO: 1825083 - DNA, 18 bp, Homo sapiens
taccctcccaccagaacg

SEQ ID NO: 1825084 - DNA, 18 bp, Homo sapiens
tacccttgttattatcta

SEQ ID NO: 1825085 - DNA, 19 bp, Homo sapiens
tacctatacctatgtgaaa

SEQ ID NO: 1825086 - DNA, 15 bp, Homo sapiens
tacctatgtgaaact

SEQ ID NO: 1825087 - DNA, 21 bp, Homo sapiens
tacctatgtgagtttcagaaa

SEQ ID NO: 1825088 - DNA, 13 bp, Homo sapiens
tacctcttggctg

SEQ ID NO: 1825089 - DNA, 11 bp, Homo sapiens
tacctgggaaa

SEQ ID NO: 1825090 - DNA, 18 bp, Homo sapiens
tacctgggaaaggaccca

SEQ ID NO: 1825091 - DNA, 19 bp, Homo sapiens
tacctgggaaaggacccac

SEQ ID NO: 1825092 - DNA, 12 bp, Homo sapiens
tacgtgttcaaa

SEQ ID NO: 1825093 - DNA, 13 bp, Homo sapiens
tacgtgttcaaaa

SEQ ID NO: 1825094 - DNA, 22 bp, Homo sapiens
tactagaaccttctaatccatg

SEQ ID NO: 1825095 - DNA, 16 bp, Homo sapiens
tactattcaatgcaat

SEQ ID NO: 1825096 - DNA, 17 bp, Homo sapiens
tactattcaatgcaatg

SEQ ID NO: 1825097 - DNA, 13 bp, Homo sapiens
tactcaatcaagc

SEQ ID NO: 1825098 - DNA, 14 bp, Homo sapiens
tactcagagcagag

SEQ ID NO: 1825099 - DNA, 21 bp, Homo sapiens
tactcagagcagagcaaatga

SEQ ID NO: 1825100 - DNA, 22 bp, Homo sapiens
tactcagcagcagagagccctg

SEQ ID NO: 1825101 - DNA, 14 bp, Homo sapiens
tcccgtggccccag

SEQ ID NO: 1825102 - DNA, 15 bp, Homo sapiens
tcccgtggccccagc

SEQ ID NO: 1825103 - DNA, 22 bp, Homo sapiens
tcccgtggccccagcctggccc

SEQ ID NO: 1825104 - DNA, 18 bp, Homo sapiens
tccctagcctgcttttgt

SEQ ID NO: 1825105 - DNA, 21 bp, Homo sapiens
tccctcccaacagagctgggc

SEQ ID NO: 1825106 - DNA, 15 bp, Homo sapiens
tccctcggacccacc

SEQ ID NO: 1825107 - DNA, 18 bp, Homo sapiens
tccctcgtccacaggggc

SEQ ID NO: 1825108 - DNA, 19 bp, Homo sapiens
tccctcgtccacaggggca

SEQ ID NO: 1825109 - DNA, 19 bp, Homo sapiens
tccctctgccccaagcagc

SEQ ID NO: 1825110 - DNA, 20 bp, Homo sapiens
tccctctgccccaagcagcc

SEQ ID NO: 1825111 - DNA, 23 bp, Homo sapiens
tccctgacactgcggggcttggc

SEQ ID NO: 1825112 - DNA, 11 bp, Homo sapiens
tccctgcaccc

SEQ ID NO: 1825113 - DNA, 15 bp, Homo sapiens
tccctgcaccctgga

SEQ ID NO: 1825114 - DNA, 18 bp, Homo sapiens
tccctgcctgctccttgg

SEQ ID NO: 1825115 - DNA, 13 bp, Homo sapiens
tccctgctgtccc

SEQ ID NO: 1825116 - DNA, 17 bp, Homo sapiens
tccctgctgtcccctct

SEQ ID NO: 1825117 - DNA, 21 bp, Homo sapiens
tccctgctgtcccctcttgcc

SEQ ID NO: 1825118 - DNA, 16 bp, Homo sapiens
tccctgcttgcccgct

SEQ ID NO: 1825119 - DNA, 22 bp, Homo sapiens
tccctggtccctcgtccacagg

SEQ ID NO: 1825120 - DNA, 18 bp, Homo sapiens
tccgcaccagctgctctg

SEQ ID NO: 1825121 - DNA, 20 bp, Homo sapiens
tccgcaccagctgctctgcc

SEQ ID NO: 1825122 - DNA, 21 bp, Homo sapiens
tccgcaccagctgctctgccc

SEQ ID NO: 1825123 - DNA, 12 bp, Homo sapiens
tccgctgccacc

SEQ ID NO: 1825124 - DNA, 14 bp, Homo sapiens
tccgctgccaccac

SEQ ID NO: 1825125 - DNA, 22 bp, Homo sapiens
tccgctgccaccacgtctgcca

SEQ ID NO: 1825126 - DNA, 23 bp, Homo sapiens
tctgtgtcactggctgcctccac

SEQ ID NO: 1825127 - DNA, 11 bp, Homo sapiens
tctgtgtgtgt

SEQ ID NO: 1825128 - DNA, 16 bp, Homo sapiens
tctgtgtgtttatgtg

SEQ ID NO: 1825129 - DNA, 15 bp, Homo sapiens
tcttaatctcacttc

SEQ ID NO: 1825130 - DNA, 15 bp, Homo sapiens
tcttatttttctagt

SEQ ID NO: 1825131 - DNA, 13 bp, Homo sapiens
tcttcaaaaatac

SEQ ID NO: 1825132 - DNA, 20 bp, Homo sapiens
tcttcaaaaatacagaattt

SEQ ID NO: 1825133 - DNA, 22 bp, Homo sapiens
tcttcaagctgtcccctctgtc

SEQ ID NO: 1825134 - DNA, 12 bp, Homo sapiens
tcttctgaagct

SEQ ID NO: 1825135 - DNA, 20 bp, Homo sapiens
tcttctgaagctagaaacaa

SEQ ID NO: 1825136 - DNA, 22 bp, Homo sapiens
tcttctgaagctagaaacaatc

SEQ ID NO: 1825137 - DNA, 21 bp, Homo sapiens
tcttcttgtggttgtatatat

SEQ ID NO: 1825138 - DNA, 15 bp, Homo sapiens
tcttgagagaaaaga

SEQ ID NO: 1825139 - DNA, 17 bp, Homo sapiens
tcttgagagaaaagaaa

SEQ ID NO: 1825140 - DNA, 21 bp, Homo sapiens
tcttgagagaaaagaaaaata

SEQ ID NO: 1825141 - DNA, 13 bp, Homo sapiens
tcttgcaggctga

SEQ ID NO: 1825142 - DNA, 23 bp, Homo sapiens
tcttgccccaacccccagcaccc

SEQ ID NO: 1825143 - DNA, 15 bp, Homo sapiens
tcttgggctactggc

SEQ ID NO: 1825144 - DNA, 22 bp, Homo sapiens
tcttgggctactggcagctcct

SEQ ID NO: 1825145 - DNA, 13 bp, Homo sapiens
tcttgggggaggc

SEQ ID NO: 1825146 - DNA, 15 bp, Homo sapiens
tcttggtatgatcat

SEQ ID NO: 1825147 - DNA, 14 bp, Homo sapiens
tcttggtccctggt

SEQ ID NO: 1825148 - DNA, 21 bp, Homo sapiens
tctttactcccttcctggcct

SEQ ID NO: 1825149 - DNA, 16 bp, Homo sapiens
tctttcaatatcatta

SEQ ID NO: 1825150 - DNA, 14 bp, Homo sapiens
tctttcatacatta

SEQ ID NO: 1825151 - DNA, 20 bp, Homo sapiens
tctttgctgcccctgtctgg

SEQ ID NO: 1825152 - DNA, 21 bp, Homo sapiens
tctttgctgcccctgtctgga

SEQ ID NO: 1825153 - DNA, 23 bp, Homo sapiens
tctttgggacacctcagaaaact

SEQ ID NO: 1825154 - DNA, 21 bp, Homo sapiens
tcttttcaaaattgttgcatc

SEQ ID NO: 1825155 - DNA, 17 bp, Homo sapiens
tcttttgttttcttcat

SEQ ID NO: 1825156 - DNA, 19 bp, Homo sapiens
tgaaaaagaaaaaaatgat

SEQ ID NO: 1825157 - DNA, 22 bp, Homo sapiens
tgaaacccagatcgctgtgtta

SEQ ID NO: 1825158 - DNA, 14 bp, Homo sapiens
tgaaagcagcagct

SEQ ID NO: 1825159 - DNA, 16 bp, Homo sapiens
tgaaagcagcagctag

SEQ ID NO: 1825160 - DNA, 22 bp, Homo sapiens
tgaaagcagcagctaggactga

SEQ ID NO: 1825161 - DNA, 12 bp, Homo sapiens
tgaaagctgaat

SEQ ID NO: 1825162 - DNA, 22 bp, Homo sapiens
tgaaagctgctctgctcagagt

SEQ ID NO: 1825163 - DNA, 22 bp, Homo sapiens
tgaaagggctatggcaaggggg

SEQ ID NO: 1825164 - DNA, 20 bp, Homo sapiens
tgaaagtctcctgtatcatt

SEQ ID NO: 1825165 - DNA, 21 bp, Homo sapiens
tgaaattcaacctgtgtctta

SEQ ID NO: 1825166 - DNA, 17 bp, Homo sapiens
tgaacaaaagcttttct

SEQ ID NO: 1825167 - DNA, 20 bp, Homo sapiens
tgaaccagagctggaacaca

SEQ ID NO: 1825168 - DNA, 15 bp, Homo sapiens
tgaaccccatgggct

SEQ ID NO: 1825169 - DNA, 16 bp, Homo sapiens
tgaaccccatgggctt

SEQ ID NO: 1825170 - DNA, 21 bp, Homo sapiens
tgaaccccatgggcttggact

SEQ ID NO: 1825171 - DNA, 14 bp, Homo sapiens
tgaaccgacttttc

SEQ ID NO: 1825172 - DNA, 23 bp, Homo sapiens
tgaacgttttaataatttttgct

SEQ ID NO: 1825173 - DNA, 14 bp, Homo sapiens
tgaactattttgaa

SEQ ID NO: 1825174 - DNA, 18 bp, Homo sapiens
tgaactattttgaagaaa

SEQ ID NO: 1825175 - DNA, 23 bp, Homo sapiens
tgaactattttgaagaaaacaca

SEQ ID NO: 1825176 - DNA, 24 bp, Homo sapiens
tgaactattttgaagaaaacacaa

SEQ ID NO: 1825177 - DNA, 16 bp, Homo sapiens
tgaacttgaggacaca

SEQ ID NO: 1825178 - DNA, 12 bp, Homo sapiens
tgaactttaaaa

SEQ ID NO: 1825179 - DNA, 20 bp, Homo sapiens
tgaagaaagggaggcccagc

SEQ ID NO: 1825180 - DNA, 20 bp, Homo sapiens
tgaagacccagtgtaaagaa

SEQ ID NO: 1825181 - DNA, 21 bp, Homo sapiens
tgaagacccagtgtaaagaat

SEQ ID NO: 1825182 - DNA, 16 bp, Homo sapiens
tgaagcaccatggtgt

SEQ ID NO: 1825183 - DNA, 18 bp, Homo sapiens
tgaagcaccatggtgtgt

SEQ ID NO: 1825184 - DNA, 18 bp, Homo sapiens
tgaagcagtgcctcgagg

SEQ ID NO: 1825185 - DNA, 15 bp, Homo sapiens
tgaagctagaaacaa

SEQ ID NO: 1825186 - DNA, 17 bp, Homo sapiens
tgaagctagaaacaatc

SEQ ID NO: 1825187 - DNA, 13 bp, Homo sapiens
tgaaggagaaaat

SEQ ID NO: 1825188 - DNA, 19 bp, Homo sapiens
tgaaggcagtctgaaccct

SEQ ID NO: 1825189 - DNA, 21 bp, Homo sapiens
tgaagtattaaaatgcatatt

SEQ ID NO: 1825190 - DNA, 13 bp, Homo sapiens
tgaagtccttcag

SEQ ID NO: 1825191 - DNA, 22 bp, Homo sapiens
tgaagtccttcagtgagcccct

SEQ ID NO: 1825192 - DNA, 23 bp, Homo sapiens
tgaagtccttcagtgagcccctc

SEQ ID NO: 1825193 - DNA, 20 bp, Homo sapiens
tgaagtgttgtggagaaaag

SEQ ID NO: 1825194 - DNA, 22 bp, Homo sapiens
tgaagtgttgtggagaaaagag

SEQ ID NO: 1825195 - DNA, 19 bp, Homo sapiens
tgaatattttattaaaaca

SEQ ID NO: 1825196 - DNA, 13 bp, Homo sapiens
tgaatccttagaa

SEQ ID NO: 1825197 - DNA, 14 bp, Homo sapiens
tgaatccttagaat

SEQ ID NO: 1825198 - DNA, 15 bp, Homo sapiens
tgaatcttactcctt

SEQ ID NO: 1825199 - DNA, 22 bp, Homo sapiens
tgaatgagtttccagctaagcc

SEQ ID NO: 1825200 - DNA, 16 bp, Homo sapiens
tgaatgtgttgatttg

SEQ ID NO: 1825201 - DNA, 20 bp, Homo sapiens
tgaattaatctagaaaatga

SEQ ID NO: 1825202 - DNA, 21 bp, Homo sapiens
tgaattaatctagaaaatgaa

SEQ ID NO: 1825203 - DNA, 23 bp, Homo sapiens
tgaattaatctagaaaatgaaaa

SEQ ID NO: 1825204 - DNA, 18 bp, Homo sapiens
tgaattgatgatgcagtt

SEQ ID NO: 1825205 - DNA, 17 bp, Homo sapiens
tgaattgctaattctga

SEQ ID NO: 1825206 - DNA, 15 bp, Homo sapiens
tgaattttcccactg

SEQ ID NO: 1825207 - DNA, 15 bp, Homo sapiens
tgacaaaaatgtttg

SEQ ID NO: 1825208 - DNA, 16 bp, Homo sapiens
tgacaaaaatgtttgt

SEQ ID NO: 1825209 - DNA, 14 bp, Homo sapiens
tgacaatggcagct

SEQ ID NO: 1825210 - DNA, 15 bp, Homo sapiens
tgacaatggcagcta

SEQ ID NO: 1825211 - DNA, 23 bp, Homo sapiens
tgacacaagtgtattatttctgg

SEQ ID NO: 1825212 - DNA, 21 bp, Homo sapiens
tgacacatccattgctggcaa

SEQ ID NO: 1825213 - DNA, 18 bp, Homo sapiens
tgaccagaaacagggaca

SEQ ID NO: 1825214 - DNA, 23 bp, Homo sapiens
tgaccattggctgcgctaacccc

SEQ ID NO: 1825215 - DNA, 22 bp, Homo sapiens
tgaccccttttcagcttctgct

SEQ ID NO: 1825216 - DNA, 12 bp, Homo sapiens
tgacccttcagg

SEQ ID NO: 1825217 - DNA, 14 bp, Homo sapiens
tgacccttcagggc

SEQ ID NO: 1825218 - DNA, 15 bp, Homo sapiens
tgacccttcagggcc

SEQ ID NO: 1825219 - DNA, 20 bp, Homo sapiens
tgacccttcagggccagaag

SEQ ID NO: 1825220 - DNA, 15 bp, Homo sapiens
tgacctcacttctgg

SEQ ID NO: 1825221 - DNA, 17 bp, Homo sapiens
tgactaggaagaaaaca

SEQ ID NO: 1825222 - DNA, 13 bp, Homo sapiens
tgactattaaatg

SEQ ID NO: 1825223 - DNA, 23 bp, Homo sapiens
tgactattaaatgttgcacatca

SEQ ID NO: 1825224 - DNA, 18 bp, Homo sapiens
taggataaattacattaa

SEQ ID NO: 1825225 - DNA, 15 bp, Homo sapiens
taggatacaatgtat

SEQ ID NO: 1825226 - DNA, 13 bp, Homo sapiens
taggcccttgtcc

SEQ ID NO: 1825227 - DNA, 15 bp, Homo sapiens
taggcccttgtcctg

SEQ ID NO: 1825228 - DNA, 18 bp, Homo sapiens
taggcccttgtcctgcca

SEQ ID NO: 1825229 - DNA, 21 bp, Homo sapiens
taggcccttgtcctgccagct

SEQ ID NO: 1825230 - DNA, 16 bp, Homo sapiens
taggtatgctattatc

SEQ ID NO: 1825231 - DNA, 22 bp, Homo sapiens
tagtaacaggccttgagcacaa

SEQ ID NO: 1825232 - DNA, 22 bp, Homo sapiens
tagtaataatgtaatactgtag

SEQ ID NO: 1825233 - DNA, 12 bp, Homo sapiens
tagtaatcattg

SEQ ID NO: 1825234 - DNA, 14 bp, Homo sapiens
tagtaccttcaaat

SEQ ID NO: 1825235 - DNA, 17 bp, Homo sapiens
tagtaccttcaaataat

SEQ ID NO: 1825236 - DNA, 14 bp, Homo sapiens
tagtactctctgct

SEQ ID NO: 1825237 - DNA, 13 bp, Homo sapiens
tagtagtgtcttc

SEQ ID NO: 1825238 - DNA, 20 bp, Homo sapiens
tagtatattagtttgattta

SEQ ID NO: 1825239 - DNA, 14 bp, Homo sapiens
tagtattcaggcac

SEQ ID NO: 1825240 - DNA, 12 bp, Homo sapiens
tagtcaagaaaa

SEQ ID NO: 1825241 - DNA, 14 bp, Homo sapiens
tagtgcccgcctag

SEQ ID NO: 1825242 - DNA, 13 bp, Homo sapiens
tagtggctgtcca

SEQ ID NO: 1825243 - DNA, 20 bp, Homo sapiens
tagtgtcttcctagtatatt

SEQ ID NO: 1825244 - DNA, 21 bp, Homo sapiens
tagtgtgagtggcagccatgc

SEQ ID NO: 1825245 - DNA, 20 bp, Homo sapiens
tagttgattgcgagaatttt

SEQ ID NO: 1825246 - DNA, 22 bp, Homo sapiens
tagttgattgcgagaattttca

SEQ ID NO: 1825247 - DNA, 17 bp, Homo sapiens
tagtttctagaggcctc

SEQ ID NO: 1825248 - DNA, 21 bp, Homo sapiens
tataaaatgcccatttcgaag

SEQ ID NO: 1825249 - DNA, 16 bp, Homo sapiens
tataaatgtaaaaatg

SEQ ID NO: 1825250 - DNA, 18 bp, Homo sapiens
tataaatgtaaaaatgaa

SEQ ID NO: 1825251 - DNA, 22 bp, Homo sapiens
tataacccactgctgaaaaaga

SEQ ID NO: 1825252 - DNA, 14 bp, Homo sapiens
tataagactagaga

SEQ ID NO: 1825253 - DNA, 19 bp, Homo sapiens
tatacctggcaattcacaa

SEQ ID NO: 1825254 - DNA, 21 bp, Homo sapiens
tatagtaaatctatgagcaac

SEQ ID NO: 1825255 - DNA, 14 bp, Homo sapiens
tatatagcttgaaa

SEQ ID NO: 1825256 - DNA, 14 bp, Homo sapiens
tatatatcataaag

SEQ ID NO: 1825257 - DNA, 15 bp, Homo sapiens
tatatatcataaagt

SEQ ID NO: 1825258 - DNA, 22 bp, Homo sapiens
tatatattctacacatatatgt

SEQ ID NO: 1825259 - DNA, 14 bp, Homo sapiens
tatatcataaagta

SEQ ID NO: 1825260 - DNA, 19 bp, Homo sapiens
tatatgtatatctatatct

SEQ ID NO: 1825261 - DNA, 22 bp, Homo sapiens
tatattccgggtgccattccca

SEQ ID NO: 1825262 - DNA, 22 bp, Homo sapiens
tatatttgagtttctttcagat

SEQ ID NO: 1825263 - DNA, 14 bp, Homo sapiens
tatcagtcatgact

SEQ ID NO: 1825264 - DNA, 15 bp, Homo sapiens
tatcagtgtgccccc

SEQ ID NO: 1825265 - DNA, 17 bp, Homo sapiens
tatcagtgtgcccccca

SEQ ID NO: 1825266 - DNA, 18 bp, Homo sapiens
tatcattactaacttctt

SEQ ID NO: 1825267 - DNA, 12 bp, Homo sapiens
tatctagaaaga

SEQ ID NO: 1825268 - DNA, 15 bp, Homo sapiens
tatctagaaagaaaa

SEQ ID NO: 1825269 - DNA, 18 bp, Homo sapiens
tatctagaaagaaaagac

SEQ ID NO: 1825270 - DNA, 21 bp, Homo sapiens
tatctagaaagaaaagaccct

SEQ ID NO: 1825271 - DNA, 14 bp, Homo sapiens
tatctatatctcta

SEQ ID NO: 1825272 - DNA, 23 bp, Homo sapiens
tatctatatctctaaactgctgt

SEQ ID NO: 1825273 - DNA, 17 bp, Homo sapiens
tatctcgctagccatat

SEQ ID NO: 1825274 - DNA, 13 bp, Homo sapiens
tatctgagaattg

SEQ ID NO: 1825275 - DNA, 17 bp, Homo sapiens
tatctgagaattgcaaa

SEQ ID NO: 1825276 - DNA, 11 bp, Homo sapiens
tatctgcctgg

SEQ ID NO: 1825277 - DNA, 19 bp, Homo sapiens
tatctgtactgaaagcaaa

SEQ ID NO: 1825278 - DNA, 17 bp, Homo sapiens
tatctgtttgcttctaa

SEQ ID NO: 1825279 - DNA, 20 bp, Homo sapiens
tatgaacttgaggacacatg

SEQ ID NO: 1825280 - DNA, 21 bp, Homo sapiens
tatgaacttgaggacacatgt

SEQ ID NO: 1825281 - DNA, 17 bp, Homo sapiens
tatgaagtattaaaatg

SEQ ID NO: 1825282 - DNA, 14 bp, Homo sapiens
tatgagactcttaa

SEQ ID NO: 1825283 - DNA, 16 bp, Homo sapiens
tatggctctcaagtga

SEQ ID NO: 1825284 - DNA, 16 bp, Homo sapiens
tatgtggaagtgtggg

SEQ ID NO: 1825285 - DNA, 22 bp, Homo sapiens
tatgtgtgtgtgttgtgtgtgg

SEQ ID NO: 1825286 - DNA, 23 bp, Homo sapiens
tatgtgtgtgtgttgtgtgtggg

SEQ ID NO: 1825287 - DNA, 14 bp, Homo sapiens
tattaaaatgcata

SEQ ID NO: 1825288 - DNA, 21 bp, Homo sapiens
tattagtttgatttaatatct

SEQ ID NO: 1825289 - DNA, 16 bp, Homo sapiens
tattatctactagtaa

SEQ ID NO: 1825290 - DNA, 18 bp, Homo sapiens
tattcaagcaacagcact

SEQ ID NO: 1825291 - DNA, 13 bp, Homo sapiens
tattcaatgcaat

SEQ ID NO: 1825292 - DNA, 12 bp, Homo sapiens
tattcccatgag

SEQ ID NO: 1825293 - DNA, 23 bp, Homo sapiens
tattcccatggtagactgtgaca

SEQ ID NO: 1825294 - DNA, 16 bp, Homo sapiens
tattctacacatatat

SEQ ID NO: 1825295 - DNA, 20 bp, Homo sapiens
tattctacacatatatgtat

SEQ ID NO: 1825296 - DNA, 22 bp, Homo sapiens
tattctcattggggttgcaaca

SEQ ID NO: 1825297 - DNA, 20 bp, Homo sapiens
tattgagacattaatttgta

SEQ ID NO: 1825298 - DNA, 15 bp, Homo sapiens
tattgatcaaaatca

SEQ ID NO: 1825299 - DNA, 12 bp, Homo sapiens
tattggaatttt

SEQ ID NO: 1825300 - DNA, 13 bp, Homo sapiens
tattggaattttc

SEQ ID NO: 1825301 - DNA, 15 bp, Homo sapiens
tatttactaaaagaa

SEQ ID NO: 1825302 - DNA, 16 bp, Homo sapiens
tatttactaaaagaat

SEQ ID NO: 1825303 - DNA, 20 bp, Homo sapiens
tatttagaatatattaaatc

SEQ ID NO: 1825304 - DNA, 13 bp, Homo sapiens
tatttatttatgt

SEQ ID NO: 1825305 - DNA, 14 bp, Homo sapiens
tatttatttatgta

SEQ ID NO: 1825306 - DNA, 16 bp, Homo sapiens
tgccttttaaaagaaa

SEQ ID NO: 1825307 - DNA, 14 bp, Homo sapiens
tgcgaccccatctg

SEQ ID NO: 1825308 - DNA, 15 bp, Homo sapiens
tgcgaccccatctgc

SEQ ID NO: 1825309 - DNA, 18 bp, Homo sapiens
tgcgaccccatctgccca

SEQ ID NO: 1825310 - DNA, 13 bp, Homo sapiens
tgcgagaattttc

SEQ ID NO: 1825311 - DNA, 12 bp, Homo sapiens
tgcgctcttggt

SEQ ID NO: 1825312 - DNA, 15 bp, Homo sapiens
tgcgggtctgaagga

SEQ ID NO: 1825313 - DNA, 13 bp, Homo sapiens
tgcgtcctgcaga

SEQ ID NO: 1825314 - DNA, 14 bp, Homo sapiens
tgcgtcctgcagag

SEQ ID NO: 1825315 - DNA, 14 bp, Homo sapiens
tgcgtggctgtggc

SEQ ID NO: 1825316 - DNA, 14 bp, Homo sapiens
tgcgttggagccac

SEQ ID NO: 1825317 - DNA, 12 bp, Homo sapiens
tgctaattctga

SEQ ID NO: 1825318 - DNA, 13 bp, Homo sapiens
tgctaattctgag

SEQ ID NO: 1825319 - DNA, 14 bp, Homo sapiens
tgctaattctgagg

SEQ ID NO: 1825320 - DNA, 23 bp, Homo sapiens
tgctaccctccctgctgtcccct

SEQ ID NO: 1825321 - DNA, 17 bp, Homo sapiens
tgctagagcaacccctg

SEQ ID NO: 1825322 - DNA, 17 bp, Homo sapiens
tgctatctcgctagcca

SEQ ID NO: 1825323 - DNA, 20 bp, Homo sapiens
tgctatgagctggggatgtc

SEQ ID NO: 1825324 - DNA, 18 bp, Homo sapiens
tgctattgtagagccaga

SEQ ID NO: 1825325 - DNA, 22 bp, Homo sapiens
tgctattgtagagccagaggtc

SEQ ID NO: 1825326 - DNA, 14 bp, Homo sapiens
tgctcaacccccct

SEQ ID NO: 1825327 - DNA, 19 bp, Homo sapiens
tgctcaacccccctcccag

SEQ ID NO: 1825328 - DNA, 23 bp, Homo sapiens
tgctcaacccccctcccagacag

SEQ ID NO: 1825329 - DNA, 16 bp, Homo sapiens
tgctcacttttgtgaa

SEQ ID NO: 1825330 - DNA, 20 bp, Homo sapiens
tgctcacttttgtgaaagct

SEQ ID NO: 1825331 - DNA, 13 bp, Homo sapiens
tgctccacagtgt

SEQ ID NO: 1825332 - DNA, 18 bp, Homo sapiens
tgctccttggcaccccca

SEQ ID NO: 1825333 - DNA, 14 bp, Homo sapiens
tgctcgggcccagg

SEQ ID NO: 1825334 - DNA, 15 bp, Homo sapiens
tgctcgggcccaggc

SEQ ID NO: 1825335 - DNA, 12 bp, Homo sapiens
tgctctagccag

SEQ ID NO: 1825336 - DNA, 14 bp, Homo sapiens
tgctctagccagga

SEQ ID NO: 1825337 - DNA, 15 bp, Homo sapiens
tgctctagccaggag

SEQ ID NO: 1825338 - DNA, 12 bp, Homo sapiens
tgctctagctgg

SEQ ID NO: 1825339 - DNA, 16 bp, Homo sapiens
tgctctagctggcagg

SEQ ID NO: 1825340 - DNA, 17 bp, Homo sapiens
tgctctagctggcagga

SEQ ID NO: 1825341 - DNA, 18 bp, Homo sapiens
tgctctagctggcaggac

SEQ ID NO: 1825342 - DNA, 19 bp, Homo sapiens
tgctctagctggcaggaca

SEQ ID NO: 1825343 - DNA, 19 bp, Homo sapiens
tgctctcctaccccacctc

SEQ ID NO: 1825344 - DNA, 12 bp, Homo sapiens
tgctctgcccct

SEQ ID NO: 1825345 - DNA, 13 bp, Homo sapiens
tgctctggcggct

SEQ ID NO: 1825346 - DNA, 23 bp, Homo sapiens
tgctctggcggcttcctgtccac

SEQ ID NO: 1825347 - DNA, 24 bp, Homo sapiens
tgctctggcggcttcctgtccact

SEQ ID NO: 1825348 - DNA, 18 bp, Homo sapiens
tgctcttagtgcccgcct

SEQ ID NO: 1825349 - DNA, 12 bp, Homo sapiens
tgctgagccact

SEQ ID NO: 1825350 - DNA, 14 bp, Homo sapiens
tgctgagcttagcc

SEQ ID NO: 1825351 - DNA, 24 bp, Homo sapiens
tgctgagcttagccttgtgccctg

SEQ ID NO: 1825352 - DNA, 14 bp, Homo sapiens
tgctgcaccaaccc

SEQ ID NO: 1825353 - DNA, 17 bp, Homo sapiens
tgctgcaccaacccagc

SEQ ID NO: 1825354 - DNA, 20 bp, Homo sapiens
tgctgcaccaacccagccgc

SEQ ID NO: 1825355 - DNA, 15 bp, Homo sapiens
tgctgcaccagagtg

SEQ ID NO: 1825356 - DNA, 22 bp, Homo sapiens
tgctgcagaggggcaggccctg

SEQ ID NO: 1825357 - DNA, 13 bp, Homo sapiens
tgctgccatgcca

SEQ ID NO: 1825358 - DNA, 16 bp, Homo sapiens
tgctgccatgccactg

SEQ ID NO: 1825359 - DNA, 21 bp, Homo sapiens
tgctgccatgccactgccagg

SEQ ID NO: 1825360 - DNA, 22 bp, Homo sapiens
tgctgccatgccactgccaggc

SEQ ID NO: 1825361 - DNA, 20 bp, Homo sapiens
tgctgccccgttccctgtca

SEQ ID NO: 1825362 - DNA, 22 bp, Homo sapiens
tgctgccccgttccctgtcaga

SEQ ID NO: 1825363 - DNA, 18 bp, Homo sapiens
tgctgcccctgtctggaa

SEQ ID NO: 1825364 - DNA, 13 bp, Homo sapiens
tgctgcctaataa

SEQ ID NO: 1825365 - DNA, 14 bp, Homo sapiens
tgctgcctaataaa

SEQ ID NO: 1825366 - DNA, 17 bp, Homo sapiens
tgctgcctaataaagag

SEQ ID NO: 1825367 - DNA, 22 bp, Homo sapiens
tgctgccttcagggagacaggc

SEQ ID NO: 1825368 - DNA, 9 bp, Homo sapiens
tgctgctgt

SEQ ID NO: 1825369 - DNA, 23 bp, Homo sapiens
tgctgctgtaactgctgagccac

SEQ ID NO: 1825370 - DNA, 18 bp, Homo sapiens
tgctgctttttggcacag

SEQ ID NO: 1825371 - DNA, 20 bp, Homo sapiens
tgctgggaaccccgcagccc

SEQ ID NO: 1825372 - DNA, 16 bp, Homo sapiens
tgctgggcactgccag

SEQ ID NO: 1825373 - DNA, 16 bp, Homo sapiens
tgctgggctgggtgcg

SEQ ID NO: 1825374 - DNA, 18 bp, Homo sapiens
tgctggggcatgtgtgcc

SEQ ID NO: 1825375 - DNA, 21 bp, Homo sapiens
tgctggggcatgtgtgcctgt

SEQ ID NO: 1825376 - DNA, 20 bp, Homo sapiens
tgctgggtggcccatccccc

SEQ ID NO: 1825377 - DNA, 17 bp, Homo sapiens
tgctgtaactgctgagc

SEQ ID NO: 1825378 - DNA, 15 bp, Homo sapiens
tgctgtagctgaaag

SEQ ID NO: 1825379 - DNA, 16 bp, Homo sapiens
tgctgtagctgaaaga

SEQ ID NO: 1825380 - DNA, 13 bp, Homo sapiens
tgctgtcccctct

SEQ ID NO: 1825381 - DNA, 11 bp, Homo sapiens
tgctgtgcctg

SEQ ID NO: 1825382 - DNA, 13 bp, Homo sapiens
tgctgtgcctgct

SEQ ID NO: 1825383 - DNA, 15 bp, Homo sapiens
tgctgttgccatagc

SEQ ID NO: 1825384 - DNA, 17 bp, Homo sapiens
tgcttaagtggatctgt

SEQ ID NO: 1825385 - DNA, 23 bp, Homo sapiens
tgcttctaaatgcccagttcact

SEQ ID NO: 1825386 - DNA, 13 bp, Homo sapiens
tgcttctccaaca

SEQ ID NO: 1825387 - DNA, 17 bp, Homo sapiens
tgcttctccaacactga

SEQ ID NO: 1825388 - DNA, 15 bp, Homo sapiens
tgcttggtggggctc

SEQ ID NO: 1825389 - DNA, 20 bp, Homo sapiens
tgcttggtggggctcgtggc

SEQ ID NO: 1825390 - DNA, 22 bp, Homo sapiens
tgcttggtggggctcgtggcct

SEQ ID NO: 1825391 - DNA, 17 bp, Homo sapiens
tgctttgggaggccaag

SEQ ID NO: 1825392 - DNA, 20 bp, Homo sapiens
tgctttgggaggccaaggca

SEQ ID NO: 1825393 - DNA, 18 bp, Homo sapiens
tgctttgggctttgcagg

SEQ ID NO: 1825394 - DNA, 12 bp, Homo sapiens
tgcttttccagg

SEQ ID NO: 1825395 - DNA, 13 bp, Homo sapiens
tgcttttccagga

SEQ ID NO: 1825396 - DNA, 22 bp, Homo sapiens
tgcttttccaggatcctgcagg

SEQ ID NO: 1825397 - DNA, 19 bp, Homo sapiens
tggaaccagggaggagagg

SEQ ID NO: 1825398 - DNA, 21 bp, Homo sapiens
tggaaccagggaggagaggaa

SEQ ID NO: 1825399 - DNA, 22 bp, Homo sapiens
tggaactgaccccctcccctga

SEQ ID NO: 1825400 - DNA, 12 bp, Homo sapiens
tggaagacgtgg

SEQ ID NO: 1825401 - DNA, 14 bp, Homo sapiens
tggaagagcagcct

SEQ ID NO: 1825402 - DNA, 15 bp, Homo sapiens
tggaagagcagcctg

SEQ ID NO: 1825403 - DNA, 14 bp, Homo sapiens
tggaaggctggctg

SEQ ID NO: 1825404 - DNA, 18 bp, Homo sapiens
tggaagggccttctccac

SEQ ID NO: 1825405 - DNA, 18 bp, Homo sapiens
tggaatctactagaacct

SEQ ID NO: 1825406 - DNA, 18 bp, Homo sapiens
tggaatgcagggaagagg

SEQ ID NO: 1825407 - DNA, 20 bp, Homo sapiens
tggaatgtacctatgtgagt

SEQ ID NO: 1825408 - DNA, 17 bp, Homo sapiens
tggaattcagcaccctg

SEQ ID NO: 1825409 - DNA, 19 bp, Homo sapiens
tggaattcagcaccctggg

SEQ ID NO: 1825410 - DNA, 21 bp, Homo sapiens
tggaattcagcaccctgggtg

SEQ ID NO: 1825411 - DNA, 12 bp, Homo sapiens
tggaattttaag

SEQ ID NO: 1825412 - DNA, 16 bp, Homo sapiens
tggacaagaagctgct

SEQ ID NO: 1825413 - DNA, 10 bp, Homo sapiens
tggacacctg

SEQ ID NO: 1825414 - DNA, 13 bp, Homo sapiens
tggacacctgccc

SEQ ID NO: 1825415 - DNA, 17 bp, Homo sapiens
tggacacctgccctgcc

SEQ ID NO: 1825416 - DNA, 23 bp, Homo sapiens
tggacacctgccctgccctgcca

SEQ ID NO: 1825417 - DNA, 12 bp, Homo sapiens
tggacagaagat

SEQ ID NO: 1825418 - DNA, 20 bp, Homo sapiens
tggaccgggtgggcctggcc

SEQ ID NO: 1825419 - DNA, 16 bp, Homo sapiens
tggactggtggcccct

SEQ ID NO: 1825420 - DNA, 20 bp, Homo sapiens
tggagaccgcttcacccctg

SEQ ID NO: 1825421 - DNA, 13 bp, Homo sapiens
tggagcccgtgca

SEQ ID NO: 1825422 - DNA, 17 bp, Homo sapiens
tggaggaaggtgctgag

SEQ ID NO: 1825423 - DNA, 18 bp, Homo sapiens
tggaggaaggtgctgagc

SEQ ID NO: 1825424 - DNA, 20 bp, Homo sapiens
tggaggaaggtgctgagctt

SEQ ID NO: 1825425 - DNA, 20 bp, Homo sapiens
tggaggcctgatgctgcccc

SEQ ID NO: 1825426 - DNA, 24 bp, Homo sapiens
tgcaggtacttcctcctgatggcc

SEQ ID NO: 1825427 - DNA, 13 bp, Homo sapiens
tgcagtacaggca

SEQ ID NO: 1825428 - DNA, 23 bp, Homo sapiens
tgcagtgatggcgcgggaggcac

SEQ ID NO: 1825429 - DNA, 16 bp, Homo sapiens
tgcatcccccttagaa

SEQ ID NO: 1825430 - DNA, 16 bp, Homo sapiens
tgcattagacagatga

SEQ ID NO: 1825431 - DNA, 21 bp, Homo sapiens
tgcattatatttgtaaattta

SEQ ID NO: 1825432 - DNA, 21 bp, Homo sapiens
tgcatttggtaggaagcctga

SEQ ID NO: 1825433 - DNA, 13 bp, Homo sapiens
tgcattttacagt

SEQ ID NO: 1825434 - DNA, 17 bp, Homo sapiens
tgccaaagcaaaagaag

SEQ ID NO: 1825435 - DNA, 18 bp, Homo sapiens
tgccaactaagccctcga

SEQ ID NO: 1825436 - DNA, 13 bp, Homo sapiens
tgccaaggctctc

SEQ ID NO: 1825437 - DNA, 15 bp, Homo sapiens
tgccaagtttttcag

SEQ ID NO: 1825438 - DNA, 12 bp, Homo sapiens
tcattttactaa

SEQ ID NO: 1825439 - DNA, 15 bp, Homo sapiens
tcattttactaaaat

SEQ ID NO: 1825440 - DNA, 14 bp, Homo sapiens
tcattttcattaaa

SEQ ID NO: 1825441 - DNA, 15 bp, Homo sapiens
tccaaagagccatgt

SEQ ID NO: 1825442 - DNA, 17 bp, Homo sapiens
tccaaaggggctgctgg

SEQ ID NO: 1825443 - DNA, 23 bp, Homo sapiens
tccaattgcctcttgcaggctga

SEQ ID NO: 1825444 - DNA, 16 bp, Homo sapiens
tccacaggggcaggcc

SEQ ID NO: 1825445 - DNA, 18 bp, Homo sapiens
tccacaggggcaggcctg

SEQ ID NO: 1825446 - DNA, 22 bp, Homo sapiens
tccacaggggcaggcctgggac

SEQ ID NO: 1825447 - DNA, 23 bp, Homo sapiens
tccacaggggcaggcctgggacc

SEQ ID NO: 1825448 - DNA, 22 bp, Homo sapiens
tccacagtgctgcttctcttgg

SEQ ID NO: 1825449 - DNA, 14 bp, Homo sapiens
tccacataaaggta

SEQ ID NO: 1825450 - DNA, 15 bp, Homo sapiens
tccacccaggctgca

SEQ ID NO: 1825451 - DNA, 18 bp, Homo sapiens
tccacccaggctgcactg

SEQ ID NO: 1825452 - DNA, 20 bp, Homo sapiens
tccacccaggctgcactgca

SEQ ID NO: 1825453 - DNA, 15 bp, Homo sapiens
tccacccagtgctgc

SEQ ID NO: 1825454 - DNA, 17 bp, Homo sapiens
tccacccagtgctgcca

SEQ ID NO: 1825455 - DNA, 19 bp, Homo sapiens
tccacccagtgctgccatg

SEQ ID NO: 1825456 - DNA, 13 bp, Homo sapiens
tccacctcctaga

SEQ ID NO: 1825457 - DNA, 16 bp, Homo sapiens
tccactcccccacctg

SEQ ID NO: 1825458 - DNA, 21 bp, Homo sapiens
tccactctcggggcccttggg

SEQ ID NO: 1825459 - DNA, 18 bp, Homo sapiens
tccactgccaaaacaatg

SEQ ID NO: 1825460 - DNA, 15 bp, Homo sapiens
tccacttttaaaact

SEQ ID NO: 1825461 - DNA, 21 bp, Homo sapiens
tccacttttaaaactatattt

SEQ ID NO: 1825462 - DNA, 16 bp, Homo sapiens
tccagaatctgctgtt

SEQ ID NO: 1825463 - DNA, 19 bp, Homo sapiens
tccagaatctgctgttgcc

SEQ ID NO: 1825464 - DNA, 10 bp, Homo sapiens
tccagagcca

SEQ ID NO: 1825465 - DNA, 16 bp, Homo sapiens
tccagagccagcctgg

SEQ ID NO: 1825466 - DNA, 14 bp, Homo sapiens
tccagagtctgagc

SEQ ID NO: 1825467 - DNA, 22 bp, Homo sapiens
tggagtcagtaggtccaagggc

SEQ ID NO: 1825468 - DNA, 19 bp, Homo sapiens
tggagtgaggcttccaggc

SEQ ID NO: 1825469 - DNA, 12 bp, Homo sapiens
tggagtgcgctc

SEQ ID NO: 1825470 - DNA, 15 bp, Homo sapiens
tggagtgcgctcttg

SEQ ID NO: 1825471 - DNA, 15 bp, Homo sapiens
tggatctggggactg

SEQ ID NO: 1825472 - DNA, 15 bp, Homo sapiens
tggatctgtgagggg

SEQ ID NO: 1825473 - DNA, 19 bp, Homo sapiens
tggatctgtgaggggctct

SEQ ID NO: 1825474 - DNA, 18 bp, Homo sapiens
tggatgggcattgggctg

SEQ ID NO: 1825475 - DNA, 19 bp, Homo sapiens
tggatgggcattgggctga

SEQ ID NO: 1825476 - DNA, 14 bp, Homo sapiens
tggcaaagtgctgt

SEQ ID NO: 1825477 - DNA, 15 bp, Homo sapiens
tggcaatgagtgtgc

SEQ ID NO: 1825478 - DNA, 23 bp, Homo sapiens
tggcacagacttctggaaggctg

SEQ ID NO: 1825479 - DNA, 16 bp, Homo sapiens
tggcacagtgtctggg

SEQ ID NO: 1825480 - DNA, 21 bp, Homo sapiens
tggcaccactagggtcctggc

SEQ ID NO: 1825481 - DNA, 12 bp, Homo sapiens
tggcaccagccc

SEQ ID NO: 1825482 - DNA, 18 bp, Homo sapiens
tggcaccagccccctgga

SEQ ID NO: 1825483 - DNA, 20 bp, Homo sapiens
tggcaccagccccctggatg

SEQ ID NO: 1825484 - DNA, 19 bp, Homo sapiens
tggcacccccatgctgcct

SEQ ID NO: 1825485 - DNA, 15 bp, Homo sapiens
tggcacctcctgaga

SEQ ID NO: 1825486 - DNA, 16 bp, Homo sapiens
tggcacctcctgagaa

SEQ ID NO: 1825487 - DNA, 13 bp, Homo sapiens
tggcagaaaagag

SEQ ID NO: 1825488 - DNA, 22 bp, Homo sapiens
tggcagaaaagaggagaccctg

SEQ ID NO: 1825489 - DNA, 23 bp, Homo sapiens
tggcagaaaagaggagaccctgg

SEQ ID NO: 1825490 - DNA, 16 bp, Homo sapiens
tggcagagaaggcctc

SEQ ID NO: 1825491 - DNA, 17 bp, Homo sapiens
tggcagagaaggcctct

SEQ ID NO: 1825492 - DNA, 18 bp, Homo sapiens
tggcagagaaggcctctt

SEQ ID NO: 1825493 - DNA, 15 bp, Homo sapiens
tggcagcaggtgctg

SEQ ID NO: 1825494 - DNA, 16 bp, Homo sapiens
tggcagcaggtgctgc

SEQ ID NO: 1825495 - DNA, 15 bp, Homo sapiens
tggcagccatgcctc

SEQ ID NO: 1825496 - DNA, 18 bp, Homo sapiens
tggcagccatgcctcatg

SEQ ID NO: 1825497 - DNA, 13 bp, Homo sapiens
tggcattggcagc

SEQ ID NO: 1825498 - DNA, 14 bp, Homo sapiens
tggcattggcagca

SEQ ID NO: 1825499 - DNA, 20 bp, Homo sapiens
tggcattggcagcaggtgct

SEQ ID NO: 1825500 - DNA, 16 bp, Homo sapiens
tggccaagggggtgga

SEQ ID NO: 1825501 - DNA, 17 bp, Homo sapiens
tggccagagagggccca

SEQ ID NO: 1825502 - DNA, 18 bp, Homo sapiens
tggccagagagggcccag

SEQ ID NO: 1825503 - DNA, 20 bp, Homo sapiens
tggccagagagggcccagct

SEQ ID NO: 1825504 - DNA, 15 bp, Homo sapiens
tggccagccccacag

SEQ ID NO: 1825505 - DNA, 20 bp, Homo sapiens
tggccagccccacagcccac

SEQ ID NO: 1825506 - DNA, 23 bp, Homo sapiens
tggccagccccacagcccacgtc

SEQ ID NO: 1825507 - DNA, 17 bp, Homo sapiens
tggccagtctgggtctg

SEQ ID NO: 1825508 - DNA, 15 bp, Homo sapiens
tggccagtggctgga

SEQ ID NO: 1825509 - DNA, 16 bp, Homo sapiens
tggccagtggctggat

SEQ ID NO: 1825510 - DNA, 18 bp, Homo sapiens
tggccatgctcaaccccc

SEQ ID NO: 1825511 - DNA, 19 bp, Homo sapiens
tggcccaatgcctataaaa

SEQ ID NO: 1825512 - DNA, 22 bp, Homo sapiens
tggcccagctcccccgggaggg

SEQ ID NO: 1825513 - DNA, 12 bp, Homo sapiens
tggcccatcccc

SEQ ID NO: 1825514 - DNA, 16 bp, Homo sapiens
tggcccatcccccctc

SEQ ID NO: 1825515 - DNA, 22 bp, Homo sapiens
tggcccatcccccctcaccagg

SEQ ID NO: 1825516 - DNA, 17 bp, Homo sapiens
tggccccagcctggccc

SEQ ID NO: 1825517 - DNA, 14 bp, Homo sapiens
tggcccccctccag

SEQ ID NO: 1825518 - DNA, 14 bp, Homo sapiens
tggcccctgccttg

SEQ ID NO: 1825519 - DNA, 18 bp, Homo sapiens
tggccctcaaggcctccc

SEQ ID NO: 1825520 - DNA, 23 bp, Homo sapiens
tggccctcattccaagcacttta

SEQ ID NO: 1825521 - DNA, 13 bp, Homo sapiens
tggccctcttctt

SEQ ID NO: 1825522 - DNA, 19 bp, Homo sapiens
tggccctgtgactatggct

SEQ ID NO: 1825523 - DNA, 23 bp, Homo sapiens
tggcctattttggacgtgtgagg

SEQ ID NO: 1825524 - DNA, 20 bp, Homo sapiens
tggcctcactggctggggca

SEQ ID NO: 1825525 - DNA, 17 bp, Homo sapiens
tggcctcccaataaagc

SEQ ID NO: 1825526 - DNA, 16 bp, Homo sapiens
tggcctcgcctggcct

SEQ ID NO: 1825527 - DNA, 12 bp, Homo sapiens
tggcctgagctg

SEQ ID NO: 1825528 - DNA, 14 bp, Homo sapiens
tggcctgagctggg

SEQ ID NO: 1825529 - DNA, 16 bp, Homo sapiens
tggcctgagctggggc

SEQ ID NO: 1825530 - DNA, 15 bp, Homo sapiens
tggcctgtgtccagc

SEQ ID NO: 1825531 - DNA, 18 bp, Homo sapiens
tggcctgtgtccagcagc

SEQ ID NO: 1825532 - DNA, 19 bp, Homo sapiens
tggcctgtgtccagcagct

SEQ ID NO: 1825533 - DNA, 21 bp, Homo sapiens
tggccttccccttttgcctgg

SEQ ID NO: 1825534 - DNA, 15 bp, Homo sapiens
tggcgcgggaggcac

SEQ ID NO: 1825535 - DNA, 18 bp, Homo sapiens
tggcgcgggaggcaccag

SEQ ID NO: 1825536 - DNA, 13 bp, Homo sapiens
tggcggcttcctg

SEQ ID NO: 1825537 - DNA, 16 bp, Homo sapiens
tggcgtaatgggcctg

SEQ ID NO: 1825538 - DNA, 14 bp, Homo sapiens
tggctcaggcaagc

SEQ ID NO: 1825539 - DNA, 16 bp, Homo sapiens
tggctcaggcaagccc

SEQ ID NO: 1825540 - DNA, 22 bp, Homo sapiens
tggctcatggcgtaatgggcct

SEQ ID NO: 1825541 - DNA, 22 bp, Homo sapiens
tggctccccacgagtcacctgc

SEQ ID NO: 1825542 - DNA, 16 bp, Homo sapiens
tggctctcaagtgaaa

SEQ ID NO: 1825543 - DNA, 20 bp, Homo sapiens
tggctctgggtgaggtaggc

SEQ ID NO: 1825544 - DNA, 21 bp, Homo sapiens
tggctgagtggaatgcaggga

SEQ ID NO: 1825545 - DNA, 22 bp, Homo sapiens
tggctgagtggaatgcagggaa

SEQ ID NO: 1825546 - DNA, 16 bp, Homo sapiens
tggctggggcagaggg

SEQ ID NO: 1825547 - DNA, 20 bp, Homo sapiens
tggctggggcagaggggcag

SEQ ID NO: 1825548 - DNA, 15 bp, Homo sapiens
tggctgtccagtgcc

SEQ ID NO: 1825549 - DNA, 13 bp, Homo sapiens
tggctgtggaggc

SEQ ID NO: 1825550 - DNA, 17 bp, Homo sapiens
tggctgtggaggcctga

SEQ ID NO: 1825551 - DNA, 13 bp, Homo sapiens
tggctgtggcaca

SEQ ID NO: 1825552 - DNA, 16 bp, Homo sapiens
tggctgtggcacagac

SEQ ID NO: 1825553 - DNA, 17 bp, Homo sapiens
tggctgtggcacagact

SEQ ID NO: 1825554 - DNA, 15 bp, Homo sapiens
tggcttcctccgtcc

SEQ ID NO: 1825555 - DNA, 16 bp, Homo sapiens
tggcttcctccgtcca

SEQ ID NO: 1825556 - DNA, 18 bp, Homo sapiens
tggcttgctccagggtct

SEQ ID NO: 1825557 - DNA, 19 bp, Homo sapiens
tgggaactccactctcctt

SEQ ID NO: 1825558 - DNA, 22 bp, Homo sapiens
tgggaagctgtactcagagcag

SEQ ID NO: 1825559 - DNA, 23 bp, Homo sapiens
tgggaagctgtactcagagcaga

SEQ ID NO: 1825560 - DNA, 22 bp, Homo sapiens
tgggaagggagagttctttgct

SEQ ID NO: 1825561 - DNA, 19 bp, Homo sapiens
tgggagaatgtcagtatgt

SEQ ID NO: 1825562 - DNA, 20 bp, Homo sapiens
tgggagaatgtcagtatgtg

SEQ ID NO: 1825563 - DNA, 12 bp, Homo sapiens
tgggaggccaag

SEQ ID NO: 1825564 - DNA, 23 bp, Homo sapiens
tgggagggggctatttctctccc

SEQ ID NO: 1825565 - DNA, 19 bp, Homo sapiens
tgggagtcattaccacgcc

SEQ ID NO: 1825566 - DNA, 22 bp, Homo sapiens
tgggatgtcctctttactccct

SEQ ID NO: 1825567 - DNA, 18 bp, Homo sapiens
tgggatttcttcgctgct

SEQ ID NO: 1825568 - DNA, 16 bp, Homo sapiens
tgggcactgctgggtg

SEQ ID NO: 1825569 - DNA, 17 bp, Homo sapiens
tgggcactgctgggtgg

SEQ ID NO: 1825570 - DNA, 13 bp, Homo sapiens
tgtcactggctgc

SEQ ID NO: 1825571 - DNA, 22 bp, Homo sapiens
tgtcactggctgcctccactcc

SEQ ID NO: 1825572 - DNA, 19 bp, Homo sapiens
tgtcagtatgtggaagtgt

SEQ ID NO: 1825573 - DNA, 14 bp, Homo sapiens
tgtcatcactccct

SEQ ID NO: 1825574 - DNA, 21 bp, Homo sapiens
tgtcatgctcacttttgtgaa

SEQ ID NO: 1825575 - DNA, 18 bp, Homo sapiens
tgtccactctcggggccc

SEQ ID NO: 1825576 - DNA, 21 bp, Homo sapiens
tgtccactctcggggcccttg

SEQ ID NO: 1825577 - DNA, 22 bp, Homo sapiens
tgtccagcagctgcgggtctga

SEQ ID NO: 1825578 - DNA, 16 bp, Homo sapiens
tgtccaggccactgtg

SEQ ID NO: 1825579 - DNA, 18 bp, Homo sapiens
tgtccaggccactgtggc

SEQ ID NO: 1825580 - DNA, 13 bp, Homo sapiens
tgtccagtgccca

SEQ ID NO: 1825581 - DNA, 14 bp, Homo sapiens
tgtccagtgcccat

SEQ ID NO: 1825582 - DNA, 13 bp, Homo sapiens
tgtccccagggcc

SEQ ID NO: 1825583 - DNA, 15 bp, Homo sapiens
tgtcccgccttcctc

SEQ ID NO: 1825584 - DNA, 23 bp, Homo sapiens
tgtcccgccttcctcctccacag

SEQ ID NO: 1825585 - DNA, 13 bp, Homo sapiens
tgtcctgccagct

SEQ ID NO: 1825586 - DNA, 14 bp, Homo sapiens
tgtcctgctccaca

SEQ ID NO: 1825587 - DNA, 14 bp, Homo sapiens
tgtcgcgccttctc

SEQ ID NO: 1825588 - DNA, 18 bp, Homo sapiens
tgtctattctgagccttg

SEQ ID NO: 1825589 - DNA, 19 bp, Homo sapiens
tgtctattctgagccttga

SEQ ID NO: 1825590 - DNA, 19 bp, Homo sapiens
tgtctcatttaggactggg

SEQ ID NO: 1825591 - DNA, 15 bp, Homo sapiens
tgtctccctggccct

SEQ ID NO: 1825592 - DNA, 18 bp, Homo sapiens
tgtctctcccaccccggc

SEQ ID NO: 1825593 - DNA, 22 bp, Homo sapiens
tgtctctcccaccccggcctcc

SEQ ID NO: 1825594 - DNA, 13 bp, Homo sapiens
tgtcttcctgtgg

SEQ ID NO: 1825595 - DNA, 14 bp, Homo sapiens
tgtcttcctgtggg

SEQ ID NO: 1825596 - DNA, 16 bp, Homo sapiens
tgtcttgagagaaaag

SEQ ID NO: 1825597 - DNA, 17 bp, Homo sapiens
tgtcttgtatggctctc

SEQ ID NO: 1825598 - DNA, 23 bp, Homo sapiens
tgtgaaattcaacctgtgtctta

SEQ ID NO: 1825599 - DNA, 17 bp, Homo sapiens
tgtgaactattttgaag

SEQ ID NO: 1825600 - DNA, 21 bp, Homo sapiens
tgtgaactattttgaagaaaa

SEQ ID NO: 1825601 - DNA, 17 bp, Homo sapiens
tgtgaagtgttgtggag

SEQ ID NO: 1825602 - DNA, 16 bp, Homo sapiens
tgtgaatatgagaaat

SEQ ID NO: 1825603 - DNA, 15 bp, Homo sapiens
tgtgactattaaatg

SEQ ID NO: 1825604 - DNA, 16 bp, Homo sapiens
tgtgactattaaatgt

SEQ ID NO: 1825605 - DNA, 19 bp, Homo sapiens
tgtgaggatgtggatggag

SEQ ID NO: 1825606 - DNA, 15 bp, Homo sapiens
tgtgagtggcagcca

SEQ ID NO: 1825607 - DNA, 20 bp, Homo sapiens
tgtgagtggcagccatgcct

SEQ ID NO: 1825608 - DNA, 19 bp, Homo sapiens
tgtgagtttcagaaattct

SEQ ID NO: 1825609 - DNA, 11 bp, Homo sapiens
tgtgatgtgtc

SEQ ID NO: 1825610 - DNA, 19 bp, Homo sapiens
tgtgatttcccgtggcccc

SEQ ID NO: 1825611 - DNA, 23 bp, Homo sapiens
tgtgatttcccgtggccccagcc

SEQ ID NO: 1825612 - DNA, 24 bp, Homo sapiens
tgtgatttcccgtggccccagcct

SEQ ID NO: 1825613 - DNA, 12 bp, Homo sapiens
tgtgcagcagcc

SEQ ID NO: 1825614 - DNA, 16 bp, Homo sapiens
tgtgcagcagcccagc

SEQ ID NO: 1825615 - DNA, 22 bp, Homo sapiens
tgtgcagcagcccagcttcctg

SEQ ID NO: 1825616 - DNA, 14 bp, Homo sapiens
tgtgccaccctggg

SEQ ID NO: 1825617 - DNA, 20 bp, Homo sapiens
tgtgcccatgggcactgctg

SEQ ID NO: 1825618 - DNA, 21 bp, Homo sapiens
tgtgcccatgggcactgctgg

SEQ ID NO: 1825619 - DNA, 22 bp, Homo sapiens
tgtgcccatgggcactgctggg

SEQ ID NO: 1825620 - DNA, 13 bp, Homo sapiens
tgtgcctgtggca

SEQ ID NO: 1825621 - DNA, 17 bp, Homo sapiens
tgtgcctttgggaggca

SEQ ID NO: 1825622 - DNA, 16 bp, Homo sapiens
tgtgccttttgccatc

SEQ ID NO: 1825623 - DNA, 20 bp, Homo sapiens
tgtgctctttgttcatcatt

SEQ ID NO: 1825624 - DNA, 18 bp, Homo sapiens
tgtgctgctgtggcatca

SEQ ID NO: 1825625 - DNA, 14 bp, Homo sapiens
tgtgctgtgcctgc

SEQ ID NO: 1825626 - DNA, 15 bp, Homo sapiens
tgtgctgtgcctgct

SEQ ID NO: 1825627 - DNA, 15 bp, Homo sapiens
tgtggaagtgtgggt

SEQ ID NO: 1825628 - DNA, 14 bp, Homo sapiens
tgtggagaggggtg

SEQ ID NO: 1825629 - DNA, 23 bp, Homo sapiens
tgtggagaggggtgcacccactc

SEQ ID NO: 1825630 - DNA, 17 bp, Homo sapiens
tgtggcatcaggaaagg

SEQ ID NO: 1825631 - DNA, 15 bp, Homo sapiens
tgtggccagagctgg

SEQ ID NO: 1825632 - DNA, 13 bp, Homo sapiens
tgtggcctgtgtc

SEQ ID NO: 1825633 - DNA, 15 bp, Homo sapiens
tgtggcctgtgtcca

SEQ ID NO: 1825634 - DNA, 21 bp, Homo sapiens
tgtggcctgtgtccagcagct

SEQ ID NO: 1825635 - DNA, 21 bp, Homo sapiens
tgtgggaagaagtaaactgga

SEQ ID NO: 1825636 - DNA, 15 bp, Homo sapiens
tgtgggatgtcctct

SEQ ID NO: 1825637 - DNA, 13 bp, Homo sapiens
tgtgggctgcact

SEQ ID NO: 1825638 - DNA, 14 bp, Homo sapiens
tgtgggctgcactc

SEQ ID NO: 1825639 - DNA, 11 bp, Homo sapiens
tgtgtaattta

SEQ ID NO: 1825640 - DNA, 18 bp, Homo sapiens
tgtgtaatttaaaattgt

SEQ ID NO: 1825641 - DNA, 19 bp, Homo sapiens
tgtgtaatttaaaattgtg

SEQ ID NO: 1825642 - DNA, 12 bp, Homo sapiens
tgtgtatgtggg

SEQ ID NO: 1825643 - DNA, 14 bp, Homo sapiens
tgtgtatgtggggg

SEQ ID NO: 1825644 - DNA, 15 bp, Homo sapiens
tgtgtcactggctgc

SEQ ID NO: 1825645 - DNA, 13 bp, Homo sapiens
tgtgtgcctgtgg

SEQ ID NO: 1825646 - DNA, 15 bp, Homo sapiens
tgtgtgcctgtggca

SEQ ID NO: 1825647 - DNA, 17 bp, Homo sapiens
tgtgtgcctgtggcaga

SEQ ID NO: 1825648 - DNA, 16 bp, Homo sapiens
tgtgtgggagtgtgta

SEQ ID NO: 1825649 - DNA, 13 bp, Homo sapiens
tgtgtgtgtgtat

SEQ ID NO: 1825650 - DNA, 16 bp, Homo sapiens
tgtgtgtgtgtatgtg

SEQ ID NO: 1825651 - DNA, 23 bp, Homo sapiens
tgtgtgttctgtaatggaactga

SEQ ID NO: 1825652 - DNA, 18 bp, Homo sapiens
tgtgtgttgtgtgtggga

SEQ ID NO: 1825653 - DNA, 14 bp, Homo sapiens
tgtgttgtgtgtgg

SEQ ID NO: 1825654 - DNA, 23 bp, Homo sapiens
tgtgttgtgtgtgggagtgtgta

SEQ ID NO: 1825655 - DNA, 15 bp, Homo sapiens
tgtgtttatgtgtgt

SEQ ID NO: 1825656 - DNA, 20 bp, Homo sapiens
tgttaactgtcttgagagaa

SEQ ID NO: 1825657 - DNA, 18 bp, Homo sapiens
tgttaattgattaaaatc

SEQ ID NO: 1825658 - DNA, 22 bp, Homo sapiens
tgttactaaagtcacatataaa

SEQ ID NO: 1825659 - DNA, 16 bp, Homo sapiens
tgttaggcctggcaca

SEQ ID NO: 1825660 - DNA, 14 bp, Homo sapiens
tgttattggaattt

SEQ ID NO: 1825661 - DNA, 21 bp, Homo sapiens
tgttattttttatttccacat

SEQ ID NO: 1825662 - DNA, 12 bp, Homo sapiens
tgttccctgcac

SEQ ID NO: 1825663 - DNA, 15 bp, Homo sapiens
tgttccctgcaccct

SEQ ID NO: 1825664 - DNA, 16 bp, Homo sapiens
tgttccctgcaccctg

SEQ ID NO: 1825665 - DNA, 16 bp, Homo sapiens
tgttcccttgaccatt

SEQ ID NO: 1825666 - DNA, 22 bp, Homo sapiens
tgttcccttgaccattggctgc

SEQ ID NO: 1825667 - DNA, 20 bp, Homo sapiens
tgttctgggtgttgaccact

SEQ ID NO: 1825668 - DNA, 22 bp, Homo sapiens
tgttctgtaatggaactgaccc

SEQ ID NO: 1825669 - DNA, 19 bp, Homo sapiens
tgttgaccactccagagaa

SEQ ID NO: 1825670 - DNA, 13 bp, Homo sapiens
tgttgcacatcat

SEQ ID NO: 1825671 - DNA, 17 bp, Homo sapiens
tgttgccaactaagccc

SEQ ID NO: 1825672 - DNA, 19 bp, Homo sapiens
tgttgccaactaagccctc

SEQ ID NO: 1825673 - DNA, 18 bp, Homo sapiens
tgttgggagtgaggatgt

SEQ ID NO: 1825674 - DNA, 15 bp, Homo sapiens
tgttgtgtgtgggag

SEQ ID NO: 1825675 - DNA, 17 bp, Homo sapiens
tgtttatggcatttagt

SEQ ID NO: 1825676 - DNA, 19 bp, Homo sapiens
tgtttatggcatttagtac

SEQ ID NO: 1825677 - DNA, 20 bp, Homo sapiens
tgtttggggaagttcaagtg

SEQ ID NO: 1825678 - DNA, 16 bp, Homo sapiens
tgttttagaagttaaa

SEQ ID NO: 1825679 - DNA, 15 bp, Homo sapiens
tgttttccactgtgc

SEQ ID NO: 1825680 - DNA, 17 bp, Homo sapiens
tgttttccactgtgcta

SEQ ID NO: 1825681 - DNA, 14 bp, Homo sapiens
tgttttctcagaac

SEQ ID NO: 1825682 - DNA, 20 bp, Homo sapiens
tgttttctcagaacagctga

SEQ ID NO: 1825683 - DNA, 23 bp, Homo sapiens
ttaaaaaacaaaaaccagcaggt

SEQ ID NO: 1825684 - DNA, 15 bp, Homo sapiens
acctcctagaggtgg

SEQ ID NO: 1825685 - DNA, 19 bp, Homo sapiens
acctctcaatattcaataa

SEQ ID NO: 1825686 - DNA, 20 bp, Homo sapiens
acctctcaatattcaataaa

SEQ ID NO: 1825687 - DNA, 23 bp, Homo sapiens
acctctcaatattcaataaagct

SEQ ID NO: 1825688 - DNA, 18 bp, Homo sapiens
acctgaaccccatgggct

SEQ ID NO: 1825689 - DNA, 22 bp, Homo sapiens
acctgagtcggccccacatggg

SEQ ID NO: 1825690 - DNA, 12 bp, Homo sapiens
acctgcaagccc

SEQ ID NO: 1825691 - DNA, 14 bp, Homo sapiens
acctgcaagcccca

SEQ ID NO: 1825692 - DNA, 17 bp, Homo sapiens
acctgcctatccatcct

SEQ ID NO: 1825693 - DNA, 14 bp, Homo sapiens
acctggcctgctgg

SEQ ID NO: 1825694 - DNA, 15 bp, Homo sapiens
acctggcctgctggg

SEQ ID NO: 1825695 - DNA, 17 bp, Homo sapiens
acctgggaaaggaccca

SEQ ID NO: 1825696 - DNA, 24 bp, Homo sapiens
acctgggaaaggacccacccatct

SEQ ID NO: 1825697 - DNA, 11 bp, Homo sapiens
acctgtctgtc

SEQ ID NO: 1825698 - DNA, 18 bp, Homo sapiens
acctgtctgtctgtctgt

SEQ ID NO: 1825699 - DNA, 20 bp, Homo sapiens
accttctaatccatgtgctg

SEQ ID NO: 1825700 - DNA, 23 bp, Homo sapiens
accttctaatccatgtgctgctg

SEQ ID NO: 1825701 - DNA, 17 bp, Homo sapiens
acctttttttctctcct

SEQ ID NO: 1825702 - DNA, 22 bp, Homo sapiens
acgaaggggccccggggctggc

SEQ ID NO: 1825703 - DNA, 23 bp, Homo sapiens
acgaaggggccccggggctggca

SEQ ID NO: 1825704 - DNA, 16 bp, Homo sapiens
acgagcactggccaga

SEQ ID NO: 1825705 - DNA, 18 bp, Homo sapiens
acgagcactggccagaga

SEQ ID NO: 1825706 - DNA, 12 bp, Homo sapiens
acgagtcacctg

SEQ ID NO: 1825707 - DNA, 16 bp, Homo sapiens
acgagtcacctgcaag

SEQ ID NO: 1825708 - DNA, 22 bp, Homo sapiens
acgccccgaacctcacctgacc

SEQ ID NO: 1825709 - DNA, 14 bp, Homo sapiens
acgctcccccgcag

SEQ ID NO: 1825710 - DNA, 21 bp, Homo sapiens
acgctcccccgcagtccccag

SEQ ID NO: 1825711 - DNA, 19 bp, Homo sapiens
acgtattttgatgttttgt

SEQ ID NO: 1825712 - DNA, 18 bp, Homo sapiens
acgtcctgtcagtgccgc

SEQ ID NO: 1825713 - DNA, 12 bp, Homo sapiens
acgtctgccagg

SEQ ID NO: 1825714 - DNA, 13 bp, Homo sapiens
acgtctgccaggc

SEQ ID NO: 1825715 - DNA, 17 bp, Homo sapiens
acgtctgccaggcccat

SEQ ID NO: 1825716 - DNA, 18 bp, Homo sapiens
acgtctgccaggcccatc

SEQ ID NO: 1825717 - DNA, 14 bp, Homo sapiens
acgttttaataatt

SEQ ID NO: 1825718 - DNA, 14 bp, Homo sapiens
actaaaagaatttg

SEQ ID NO: 1825719 - DNA, 14 bp, Homo sapiens
actaacttgtcttt

SEQ ID NO: 1825720 - DNA, 23 bp, Homo sapiens
actaagccctcgaaccaaggcag

SEQ ID NO: 1825721 - DNA, 17 bp, Homo sapiens
actaatacttactgtta

SEQ ID NO: 1825722 - DNA, 19 bp, Homo sapiens
actacctttgtccaggcct

SEQ ID NO: 1825723 - DNA, 23 bp, Homo sapiens
actactgtatttcattatctgta

SEQ ID NO: 1825724 - DNA, 13 bp, Homo sapiens
actagacaaaagt

SEQ ID NO: 1825725 - DNA, 15 bp, Homo sapiens
actagacaaaagttt

SEQ ID NO: 1825726 - DNA, 16 bp, Homo sapiens
actagccaaggctagt

SEQ ID NO: 1825727 - DNA, 14 bp, Homo sapiens
actagtaataatgt

SEQ ID NO: 1825728 - DNA, 18 bp, Homo sapiens
actatgcgtttttataaa

SEQ ID NO: 1825729 - DNA, 17 bp, Homo sapiens
actattcaatgcaatgc

SEQ ID NO: 1825730 - DNA, 19 bp, Homo sapiens
actattttgaagaaaacac

SEQ ID NO: 1825731 - DNA, 23 bp, Homo sapiens
actatttttattttcttatgtaa

SEQ ID NO: 1825732 - DNA, 15 bp, Homo sapiens
actcaagcagatctc

SEQ ID NO: 1825733 - DNA, 15 bp, Homo sapiens
actcaatcaagcaaa

SEQ ID NO: 1825734 - DNA, 23 bp, Homo sapiens
actcaccagggtccgcaccagct

SEQ ID NO: 1825735 - DNA, 15 bp, Homo sapiens
actcagagcagagca

SEQ ID NO: 1825736 - DNA, 20 bp, Homo sapiens
actcagtgtctgcctttaaa

SEQ ID NO: 1825737 - DNA, 17 bp, Homo sapiens
actccagagtctgagcc

SEQ ID NO: 1825738 - DNA, 17 bp, Homo sapiens
actcccacttccctgac

SEQ ID NO: 1825739 - DNA, 13 bp, Homo sapiens
actcccccacctg

SEQ ID NO: 1825740 - DNA, 12 bp, Homo sapiens
actccctgagct

SEQ ID NO: 1825741 - DNA, 13 bp, Homo sapiens
actcgcagtcgca

SEQ ID NO: 1825742 - DNA, 16 bp, Homo sapiens
actcgcagtcgcagga

SEQ ID NO: 1825743 - DNA, 19 bp, Homo sapiens
actcgggctcctgtgccct

SEQ ID NO: 1825744 - DNA, 18 bp, Homo sapiens
actctccttcgtgtctct

SEQ ID NO: 1825745 - DNA, 17 bp, Homo sapiens
actctcggggcccttgg

SEQ ID NO: 1825746 - DNA, 19 bp, Homo sapiens
actctcggggcccttgggg

SEQ ID NO: 1825747 - DNA, 17 bp, Homo sapiens
actctctgctctagcca

SEQ ID NO: 1825748 - DNA, 20 bp, Homo sapiens
actctctgctctagccagga

SEQ ID NO: 1825749 - DNA, 24 bp, Homo sapiens
actctctgctctagccaggagtct

SEQ ID NO: 1825750 - DNA, 23 bp, Homo sapiens
actctgaaaagcaattgccctgt

SEQ ID NO: 1825751 - DNA, 11 bp, Homo sapiens
actctgagccc

SEQ ID NO: 1825752 - DNA, 14 bp, Homo sapiens
actctgagcccagg

SEQ ID NO: 1825753 - DNA, 13 bp, Homo sapiens
actctgtccaggc

SEQ ID NO: 1825754 - DNA, 19 bp, Homo sapiens
actctgtccaggccactgt

SEQ ID NO: 1825755 - DNA, 16 bp, Homo sapiens
actctttttgtacctg

SEQ ID NO: 1825756 - DNA, 14 bp, Homo sapiens
actgaaagcagcag

SEQ ID NO: 1825757 - DNA, 20 bp, Homo sapiens
actgaaggggcacaccactg

SEQ ID NO: 1825758 - DNA, 16 bp, Homo sapiens
actgaagtgcttgcag

SEQ ID NO: 1825759 - DNA, 17 bp, Homo sapiens
actgaccccctcccctg

SEQ ID NO: 1825760 - DNA, 15 bp, Homo sapiens
actgaggccattatt

SEQ ID NO: 1825761 - DNA, 23 bp, Homo sapiens
actgagtgtgggagtgcagagaa

SEQ ID NO: 1825762 - DNA, 17 bp, Homo sapiens
actgattagtattcagg

SEQ ID NO: 1825763 - DNA, 19 bp, Homo sapiens
actgcacacacagctcctc

SEQ ID NO: 1825764 - DNA, 16 bp, Homo sapiens
actgcaccccctcctg

SEQ ID NO: 1825765 - DNA, 17 bp, Homo sapiens
actgccaggcacctggc

SEQ ID NO: 1825766 - DNA, 20 bp, Homo sapiens
actgccaggcacctggcctg

SEQ ID NO: 1825767 - DNA, 21 bp, Homo sapiens
actgccaggcacctggcctgc

SEQ ID NO: 1825768 - DNA, 12 bp, Homo sapiens
actgcccccaga

SEQ ID NO: 1825769 - DNA, 21 bp, Homo sapiens
actgcccccagaaagcctcct

SEQ ID NO: 1825770 - DNA, 11 bp, Homo sapiens
actgccctgcc

SEQ ID NO: 1825771 - DNA, 18 bp, Homo sapiens
actgcggggcttggctga

SEQ ID NO: 1825772 - DNA, 23 bp, Homo sapiens
actgctgaaaaagaaaaaaatga

SEQ ID NO: 1825773 - DNA, 13 bp, Homo sapiens
actgctgagccac

SEQ ID NO: 1825774 - DNA, 12 bp, Homo sapiens
actgctgcacca

SEQ ID NO: 1825775 - DNA, 15 bp, Homo sapiens
actgctgccttaccc

SEQ ID NO: 1825776 - DNA, 12 bp, Homo sapiens
actgctgggtgg

SEQ ID NO: 1825777 - DNA, 17 bp, Homo sapiens
actgctgggtggcccat

SEQ ID NO: 1825778 - DNA, 22 bp, Homo sapiens
actgctgttaattgattaaaat

SEQ ID NO: 1825779 - DNA, 23 bp, Homo sapiens
actggagaccgcttcacccctgc

SEQ ID NO: 1825780 - DNA, 21 bp, Homo sapiens
actggagacttggaagagttg

SEQ ID NO: 1825781 - DNA, 22 bp, Homo sapiens
actggagtgaggcttccaggct

SEQ ID NO: 1825782 - DNA, 12 bp, Homo sapiens
actggcaggtgc

SEQ ID NO: 1825783 - DNA, 14 bp, Homo sapiens
actggcaggtgcag

SEQ ID NO: 1825784 - DNA, 23 bp, Homo sapiens
actggcaggtgcagatgggctgt

SEQ ID NO: 1825785 - DNA, 23 bp, Homo sapiens
actggccagagagggcccagctg

SEQ ID NO: 1825786 - DNA, 16 bp, Homo sapiens
actggcctcgcctggc

SEQ ID NO: 1825787 - DNA, 17 bp, Homo sapiens
actggcctcgcctggcc

SEQ ID NO: 1825788 - DNA, 18 bp, Homo sapiens
actggcctcgcctggcct

SEQ ID NO: 1825789 - DNA, 23 bp, Homo sapiens
actggcctcgcctggcctgaggt

SEQ ID NO: 1825790 - DNA, 22 bp, Homo sapiens
actggctgcctccactcccact

SEQ ID NO: 1825791 - DNA, 21 bp, Homo sapiens
actggctggccagtctgggtc

SEQ ID NO: 1825792 - DNA, 11 bp, Homo sapiens
actggctgggg

SEQ ID NO: 1825793 - DNA, 14 bp, Homo sapiens
actggctggggcag

SEQ ID NO: 1825794 - DNA, 16 bp, Homo sapiens
actggctggggcagag

SEQ ID NO: 1825795 - DNA, 17 bp, Homo sapiens
actggtttacaaatata

SEQ ID NO: 1825796 - DNA, 17 bp, Homo sapiens
actgtactgatactatt

SEQ ID NO: 1825797 - DNA, 10 bp, Homo sapiens
actgtcctgc

SEQ ID NO: 1825798 - DNA, 13 bp, Homo sapiens
actgtcctgctcc

SEQ ID NO: 1825799 - DNA, 16 bp, Homo sapiens
actgtgaactattttg

SEQ ID NO: 1825800 - DNA, 18 bp, Homo sapiens
actgtgaatatgagaaat

SEQ ID NO: 1825801 - DNA, 16 bp, Homo sapiens
acttacacttggagcc

SEQ ID NO: 1825802 - DNA, 16 bp, Homo sapiens
acttactcccattttc

SEQ ID NO: 1825803 - DNA, 21 bp, Homo sapiens
acttagccgtccatggcacca

SEQ ID NO: 1825804 - DNA, 23 bp, Homo sapiens
acttagccgtccatggcaccagc

SEQ ID NO: 1825805 - DNA, 20 bp, Homo sapiens
acttataagtgggagctaaa

SEQ ID NO: 1825806 - DNA, 21 bp, Homo sapiens
acttatctagaaagaaaagac

SEQ ID NO: 1825807 - DNA, 19 bp, Homo sapiens
acttattaacaactgtgaa

SEQ ID NO: 1825808 - DNA, 22 bp, Homo sapiens
acttattaacaactgtgaatat

SEQ ID NO: 1825809 - DNA, 20 bp, Homo sapiens
acttatttacctataaaatg

SEQ ID NO: 1825810 - DNA, 17 bp, Homo sapiens
acttcagatttcaaatt

SEQ ID NO: 1825811 - DNA, 19 bp, Homo sapiens
acttcaggggctgcccgct

SEQ ID NO: 1825812 - DNA, 22 bp, Homo sapiens
acttcaggtggagagcactaga

SEQ ID NO: 1825813 - DNA, 13 bp, Homo sapiens
acttcatcaatca

SEQ ID NO: 1825814 - DNA, 14 bp, Homo sapiens
acttcatcaatcaa

SEQ ID NO: 1825815 - DNA, 17 bp, Homo sapiens
acttcatcaatcaaata

SEQ ID NO: 1825816 - DNA, 20 bp, Homo sapiens
acttcatcaatcaaatattt

SEQ ID NO: 1825817 - DNA, 16 bp, Homo sapiens
acttcccctcctaccc

SEQ ID NO: 1825818 - DNA, 22 bp, Homo sapiens
acttccctgacactgcggggct

SEQ ID NO: 1825819 - DNA, 20 bp, Homo sapiens
acttcctcctgatggccaag

SEQ ID NO: 1825820 - DNA, 23 bp, Homo sapiens
acttcctcctgatggccaagagc

SEQ ID NO: 1825821 - DNA, 21 bp, Homo sapiens
acttccttcagcatctcactt

SEQ ID NO: 1825822 - DNA, 22 bp, Homo sapiens
acttctggaaggctggctgagt

SEQ ID NO: 1825823 - DNA, 23 bp, Homo sapiens
acttcttccactttttccagaat

SEQ ID NO: 1825824 - DNA, 18 bp, Homo sapiens
acttgaattttcccactg

SEQ ID NO: 1825825 - DNA, 11 bp, Homo sapiens
acttgaggaca

SEQ ID NO: 1825826 - DNA, 14 bp, Homo sapiens
acttgaggacacat

SEQ ID NO: 1825827 - DNA, 14 bp, Homo sapiens
acttgcgtcctgca

SEQ ID NO: 1825828 - DNA, 17 bp, Homo sapiens
acttgcgtcctgcagag

SEQ ID NO: 1825829 - DNA, 20 bp, Homo sapiens
acttgcgtcctgcagaggac

SEQ ID NO: 1825830 - DNA, 23 bp, Homo sapiens
acttgcttctaaatgcccagttc

SEQ ID NO: 1825831 - DNA, 16 bp, Homo sapiens
acttggagcccgtgca

SEQ ID NO: 1825832 - DNA, 12 bp, Homo sapiens
acttgtctgagg

SEQ ID NO: 1825833 - DNA, 14 bp, Homo sapiens
acttgtctgaggcc

SEQ ID NO: 1825834 - DNA, 22 bp, Homo sapiens
acttgtctgaggcctcatccct

SEQ ID NO: 1825835 - DNA, 16 bp, Homo sapiens
acttgtgactgaaggg

SEQ ID NO: 1825836 - DNA, 15 bp, Homo sapiens
actttaaaataaaat

SEQ ID NO: 1825837 - DNA, 19 bp, Homo sapiens
actttacgctgtctgtaat

SEQ ID NO: 1825838 - DNA, 14 bp, Homo sapiens
actttgccaaggct

SEQ ID NO: 1825839 - DNA, 21 bp, Homo sapiens
acttttgtgaaagctgctctg

SEQ ID NO: 1825840 - DNA, 21 bp, Homo sapiens
actttttaatgttatttggaa

SEQ ID NO: 1825841 - DNA, 13 bp, Homo sapiens
actttttccagaa

SEQ ID NO: 1825842 - DNA, 21 bp, Homo sapiens
actttttccagaatttgaata

SEQ ID NO: 1825843 - DNA, 17 bp, Homo sapiens
agaaaaatatgagagaa

SEQ ID NO: 1825844 - DNA, 18 bp, Homo sapiens
agaaaagaccctgagact

SEQ ID NO: 1825845 - DNA, 18 bp, Homo sapiens
agaaaagttgctcttaaa

SEQ ID NO: 1825846 - DNA, 19 bp, Homo sapiens
agaaacacaaatgtaaaat

SEQ ID NO: 1825847 - DNA, 21 bp, Homo sapiens
agaaacagggacaaagaaatc

SEQ ID NO: 1825848 - DNA, 17 bp, Homo sapiens
agaaagaaaagaccctg

SEQ ID NO: 1825849 - DNA, 19 bp, Homo sapiens
agaaagaaaagaccctgag

SEQ ID NO: 1825850 - DNA, 18 bp, Homo sapiens
agaaagaaagggaaactg

SEQ ID NO: 1825851 - DNA, 16 bp, Homo sapiens
agaaagcctcctgccc

SEQ ID NO: 1825852 - DNA, 17 bp, Homo sapiens
agaaagggaggcccagc

SEQ ID NO: 1825853 - DNA, 16 bp, Homo sapiens
agaaatcacaggggcg

SEQ ID NO: 1825854 - DNA, 22 bp, Homo sapiens
agaaattttactgacagaaatg

SEQ ID NO: 1825855 - DNA, 19 bp, Homo sapiens
agaacaagtcacagctgca

SEQ ID NO: 1825856 - DNA, 20 bp, Homo sapiens
agaacaagtcacagctgcag

SEQ ID NO: 1825857 - DNA, 21 bp, Homo sapiens
agaacaagtcacagctgcagc

SEQ ID NO: 1825858 - DNA, 14 bp, Homo sapiens
agaacagaggcatt

SEQ ID NO: 1825859 - DNA, 22 bp, Homo sapiens
agaacatggattccactgaaat

SEQ ID NO: 1825860 - DNA, 14 bp, Homo sapiens
agaactattgtttg

SEQ ID NO: 1825861 - DNA, 15 bp, Homo sapiens
agaagagatgtggca

SEQ ID NO: 1825862 - DNA, 22 bp, Homo sapiens
agaagagatgtggcaaagtgct

SEQ ID NO: 1825863 - DNA, 19 bp, Homo sapiens
agaagcttcatgccaggtt

SEQ ID NO: 1825864 - DNA, 17 bp, Homo sapiens
agaaggaaaaagaaagt

SEQ ID NO: 1825865 - DNA, 14 bp, Homo sapiens
agaaggagaaggaa

SEQ ID NO: 1825866 - DNA, 16 bp, Homo sapiens
agaaggagcaagagaa

SEQ ID NO: 1825867 - DNA, 12 bp, Homo sapiens
agaaggagggca

SEQ ID NO: 1825868 - DNA, 15 bp, Homo sapiens
agaaggcgaggagag

SEQ ID NO: 1825869 - DNA, 17 bp, Homo sapiens
agaaggcgaggagagtg

SEQ ID NO: 1825870 - DNA, 14 bp, Homo sapiens
agaataaatccttg

SEQ ID NO: 1825871 - DNA, 23 bp, Homo sapiens
agaataaatccttgggagtcatt

SEQ ID NO: 1825872 - DNA, 13 bp, Homo sapiens
agaataaatgaat

SEQ ID NO: 1825873 - DNA, 14 bp, Homo sapiens
agaataatttctcc

SEQ ID NO: 1825874 - DNA, 14 bp, Homo sapiens
agaatcaagtctgt

SEQ ID NO: 1825875 - DNA, 18 bp, Homo sapiens
agaatctgctgttgccat

SEQ ID NO: 1825876 - DNA, 20 bp, Homo sapiens
agaatgcagattcctgggcc

SEQ ID NO: 1825877 - DNA, 23 bp, Homo sapiens
agaatgcagattcctgggcctgt

SEQ ID NO: 1825878 - DNA, 14 bp, Homo sapiens
agaatggaatagaa

SEQ ID NO: 1825879 - DNA, 19 bp, Homo sapiens
agaatggcctctttgtaga

SEQ ID NO: 1825880 - DNA, 16 bp, Homo sapiens
agaatgtcagtatgtg

SEQ ID NO: 1825881 - DNA, 17 bp, Homo sapiens
agaatgtcagtatgtgg

SEQ ID NO: 1825882 - DNA, 13 bp, Homo sapiens
agacaaaagtttc

SEQ ID NO: 1825883 - DNA, 12 bp, Homo sapiens
agaccatttgta

SEQ ID NO: 1825884 - DNA, 16 bp, Homo sapiens
agacccagtgtaaaga

SEQ ID NO: 1825885 - DNA, 22 bp, Homo sapiens
agacccagtgtaaagaataaat

SEQ ID NO: 1825886 - DNA, 13 bp, Homo sapiens
agaccctgagact

SEQ ID NO: 1825887 - DNA, 14 bp, Homo sapiens
agaccctgagactc

SEQ ID NO: 1825888 - DNA, 17 bp, Homo sapiens
agaccgcttcacccctg

SEQ ID NO: 1825889 - DNA, 22 bp, Homo sapiens
agaccgtgtcccaaggagctga

SEQ ID NO: 1825890 - DNA, 19 bp, Homo sapiens
agactccagaatctgctgt

SEQ ID NO: 1825891 - DNA, 22 bp, Homo sapiens
agactctttttgtacctggtga

SEQ ID NO: 1825892 - DNA, 16 bp, Homo sapiens
agactgaaagcagcag

SEQ ID NO: 1825893 - DNA, 18 bp, Homo sapiens
agactgaaagcagcagct

SEQ ID NO: 1825894 - DNA, 21 bp, Homo sapiens
agactggagtgaggcttccag

SEQ ID NO: 1825895 - DNA, 14 bp, Homo sapiens
agacttcagatttc

SEQ ID NO: 1825896 - DNA, 18 bp, Homo sapiens
agacttcagatttcaaat

SEQ ID NO: 1825897 - DNA, 20 bp, Homo sapiens
agacttctggaaggctggct

SEQ ID NO: 1825898 - DNA, 21 bp, Homo sapiens
agacttctggaaggctggctg

SEQ ID NO: 1825899 - DNA, 22 bp, Homo sapiens
agacttgaatttagttttttac

SEQ ID NO: 1825900 - DNA, 13 bp, Homo sapiens
agagaaaagaaaa

SEQ ID NO: 1825901 - DNA, 21 bp, Homo sapiens
agagaaaagaaaaatatgaga

SEQ ID NO: 1825902 - DNA, 16 bp, Homo sapiens
agagactgaaagcagc

SEQ ID NO: 1825903 - DNA, 16 bp, Homo sapiens
agagagattggatttt

SEQ ID NO: 1825904 - DNA, 22 bp, Homo sapiens
agagagccctgggtgacttcag

SEQ ID NO: 1825905 - DNA, 12 bp, Homo sapiens
agagagggggct

SEQ ID NO: 1825906 - DNA, 16 bp, Homo sapiens
agagcaaatgagggag

SEQ ID NO: 1825907 - DNA, 18 bp, Homo sapiens
agagcaaatgagggaggg

SEQ ID NO: 1825908 - DNA, 15 bp, Homo sapiens
agagcaacccctgta

SEQ ID NO: 1825909 - DNA, 14 bp, Homo sapiens
agccatggctcagg

SEQ ID NO: 1825910 - DNA, 19 bp, Homo sapiens
agccatggctcaggcaagc

SEQ ID NO: 1825911 - DNA, 20 bp, Homo sapiens
agccatggctcaggcaagcc

SEQ ID NO: 1825912 - DNA, 14 bp, Homo sapiens
agccatgggcctgg

SEQ ID NO: 1825913 - DNA, 17 bp, Homo sapiens
agccatgtgtcatgtaa

SEQ ID NO: 1825914 - DNA, 22 bp, Homo sapiens
agcccacgtcctgtcagtgccg

SEQ ID NO: 1825915 - DNA, 14 bp, Homo sapiens
agcccagcttcctg

SEQ ID NO: 1825916 - DNA, 18 bp, Homo sapiens
agcccagcttcctggtgt

SEQ ID NO: 1825917 - DNA, 21 bp, Homo sapiens
agcccaggccgttccccttgg

SEQ ID NO: 1825918 - DNA, 18 bp, Homo sapiens
agccccaactccaggggc

SEQ ID NO: 1825919 - DNA, 12 bp, Homo sapiens
agccccagggcc

SEQ ID NO: 1825920 - DNA, 16 bp, Homo sapiens
agccccagggcctggg

SEQ ID NO: 1825921 - DNA, 13 bp, Homo sapiens
agcccctcagccc

SEQ ID NO: 1825922 - DNA, 16 bp, Homo sapiens
agcccctcagcccttg

SEQ ID NO: 1825923 - DNA, 17 bp, Homo sapiens
agcccctcagcccttgc

SEQ ID NO: 1825924 - DNA, 19 bp, Homo sapiens
agccctcgaaccaaggcag

SEQ ID NO: 1825925 - DNA, 22 bp, Homo sapiens
agccctcgaaccaaggcagcct

SEQ ID NO: 1825926 - DNA, 16 bp, Homo sapiens
atcctggcccatcagt

SEQ ID NO: 1825927 - DNA, 22 bp, Homo sapiens
atcctggtaagaggcaaagaat

SEQ ID NO: 1825928 - DNA, 21 bp, Homo sapiens
atccttatgagactcttaaat

SEQ ID NO: 1825929 - DNA, 16 bp, Homo sapiens
atcgcttgagcccagg

SEQ ID NO: 1825930 - DNA, 22 bp, Homo sapiens
atcgtattctaattcttcatta

SEQ ID NO: 1825931 - DNA, 20 bp, Homo sapiens
atctaaattacagtgcagtt

SEQ ID NO: 1825932 - DNA, 22 bp, Homo sapiens
atctactagtaataatgtaata

SEQ ID NO: 1825933 - DNA, 21 bp, Homo sapiens
atctatatctctaaactgctg

SEQ ID NO: 1825934 - DNA, 14 bp, Homo sapiens
atctcacttcatca

SEQ ID NO: 1825935 - DNA, 21 bp, Homo sapiens
atctcacttcatcaatcaaat

SEQ ID NO: 1825936 - DNA, 15 bp, Homo sapiens
atctcacttcttctt

SEQ ID NO: 1825937 - DNA, 14 bp, Homo sapiens
atctcaggtgccac

SEQ ID NO: 1825938 - DNA, 15 bp, Homo sapiens
atctcaggtgccact

SEQ ID NO: 1825939 - DNA, 24 bp, Homo sapiens
atctcaggtgccactccctgagct

SEQ ID NO: 1825940 - DNA, 21 bp, Homo sapiens
atctcatgacattatatttga

SEQ ID NO: 1825941 - DNA, 15 bp, Homo sapiens
atctccaattgcctc

SEQ ID NO: 1825942 - DNA, 23 bp, Homo sapiens
atctccatgtagaataaatgaag

SEQ ID NO: 1825943 - DNA, 15 bp, Homo sapiens
atctccccaggcctc

SEQ ID NO: 1825944 - DNA, 16 bp, Homo sapiens
atctccccaggcctcc

SEQ ID NO: 1825945 - DNA, 18 bp, Homo sapiens
atctccccaggcctccag

SEQ ID NO: 1825946 - DNA, 20 bp, Homo sapiens
atctcctcccatggccttcc

SEQ ID NO: 1825947 - DNA, 22 bp, Homo sapiens
atctcctcccatggccttccct

SEQ ID NO: 1825948 - DNA, 13 bp, Homo sapiens
atctgcccaggac

SEQ ID NO: 1825949 - DNA, 15 bp, Homo sapiens
atctgcctggcctgg

SEQ ID NO: 1825950 - DNA, 18 bp, Homo sapiens
atctgcctggcctggctc

SEQ ID NO: 1825951 - DNA, 23 bp, Homo sapiens
atctgcctggcctggctccccac

SEQ ID NO: 1825952 - DNA, 11 bp, Homo sapiens
atctgcctggg

SEQ ID NO: 1825953 - DNA, 14 bp, Homo sapiens
atctgcctgggcct

SEQ ID NO: 1825954 - DNA, 19 bp, Homo sapiens
atctgcctgggcctgtgca

SEQ ID NO: 1825955 - DNA, 19 bp, Homo sapiens
atctgctgttgccatagcc

SEQ ID NO: 1825956 - DNA, 21 bp, Homo sapiens
atctgtgaggggctctctcat

SEQ ID NO: 1825957 - DNA, 17 bp, Homo sapiens
atctgtttgcttctaaa

SEQ ID NO: 1825958 - DNA, 12 bp, Homo sapiens
atcttcaaaaat

SEQ ID NO: 1825959 - DNA, 15 bp, Homo sapiens
atcttcaaaaataca

SEQ ID NO: 1825960 - DNA, 18 bp, Homo sapiens
atcttcaaaaatacagaa

SEQ ID NO: 1825961 - DNA, 18 bp, Homo sapiens
atcttccaggtggggtga

SEQ ID NO: 1825962 - DNA, 18 bp, Homo sapiens
atctttcaatatcattac

SEQ ID NO: 1825963 - DNA, 18 bp, Homo sapiens
atgaacttgaggacacat

SEQ ID NO: 1825964 - DNA, 19 bp, Homo sapiens
atgaacttgaggacacatg

SEQ ID NO: 1825965 - DNA, 21 bp, Homo sapiens
atgaacttgaggacacatgtc

SEQ ID NO: 1825966 - DNA, 22 bp, Homo sapiens
atgaacttgaggacacatgtcc

SEQ ID NO: 1825967 - DNA, 19 bp, Homo sapiens
atgaagaaagggaggccca

SEQ ID NO: 1825968 - DNA, 12 bp, Homo sapiens
atgaagacccag

SEQ ID NO: 1825969 - DNA, 19 bp, Homo sapiens
atgaagctgtttttgtgct

SEQ ID NO: 1825970 - DNA, 23 bp, Homo sapiens
atgaaggcatatttccaataact

SEQ ID NO: 1825971 - DNA, 15 bp, Homo sapiens
atgaagtattaaaat

SEQ ID NO: 1825972 - DNA, 13 bp, Homo sapiens
atgaatgctgacc

SEQ ID NO: 1825973 - DNA, 16 bp, Homo sapiens
atgaattcttcaacag

SEQ ID NO: 1825974 - DNA, 18 bp, Homo sapiens
atgacattatatttgagt

SEQ ID NO: 1825975 - DNA, 18 bp, Homo sapiens
atgactagtgcctagaaa

SEQ ID NO: 1825976 - DNA, 22 bp, Homo sapiens
atgactagtgcctagaaagcaa

SEQ ID NO: 1825977 - DNA, 23 bp, Homo sapiens
atgagaacaagtcacagctgcag

SEQ ID NO: 1825978 - DNA, 23 bp, Homo sapiens
agccctcgaaccaaggcagcctc

SEQ ID NO: 1825979 - DNA, 23 bp, Homo sapiens
agccctgggtgacttcaggtgga

SEQ ID NO: 1825980 - DNA, 14 bp, Homo sapiens
agcccttctgcctt

SEQ ID NO: 1825981 - DNA, 14 bp, Homo sapiens
agcccttgccccca

SEQ ID NO: 1825982 - DNA, 20 bp, Homo sapiens
agcccttgcccccatccctc

SEQ ID NO: 1825983 - DNA, 17 bp, Homo sapiens
agccgctgcccggcgcc

SEQ ID NO: 1825984 - DNA, 19 bp, Homo sapiens
agccgtccatggcaccagc

SEQ ID NO: 1825985 - DNA, 18 bp, Homo sapiens
agccgtctgactccagag

SEQ ID NO: 1825986 - DNA, 24 bp, Homo sapiens
agccgtctgactccagagtctgag

SEQ ID NO: 1825987 - DNA, 15 bp, Homo sapiens
agcctccagagccag

SEQ ID NO: 1825988 - DNA, 16 bp, Homo sapiens
agcctccagagccagc

SEQ ID NO: 1825989 - DNA, 19 bp, Homo sapiens
agcctccagagccagcctg

SEQ ID NO: 1825990 - DNA, 20 bp, Homo sapiens
agcctccagagccagcctgg

SEQ ID NO: 1825991 - DNA, 23 bp, Homo sapiens
agcctccagagccagcctgggac

SEQ ID NO: 1825992 - DNA, 17 bp, Homo sapiens
agcctcccctcccctgg

SEQ ID NO: 1825993 - DNA, 19 bp, Homo sapiens
agcctccgtttatgggcct

SEQ ID NO: 1825994 - DNA, 21 bp, Homo sapiens
agcctccgtttatgggccttg

SEQ ID NO: 1825995 - DNA, 22 bp, Homo sapiens
agcctccgtttatgggccttgc

SEQ ID NO: 1825996 - DNA, 16 bp, Homo sapiens
agcctcctgccccctg

SEQ ID NO: 1825997 - DNA, 20 bp, Homo sapiens
agcctcctgccccctgccag

SEQ ID NO: 1825998 - DNA, 21 bp, Homo sapiens
agcctctcccggctgcctgcc

SEQ ID NO: 1825999 - DNA, 18 bp, Homo sapiens
agcctctgtgtcactggc

SEQ ID NO: 1826000 - DNA, 13 bp, Homo sapiens
agcctgatggcca

SEQ ID NO: 1826001 - DNA, 16 bp, Homo sapiens
agcctgggactcccag

SEQ ID NO: 1826002 - DNA, 17 bp, Homo sapiens
agccttgtgccctgccc

SEQ ID NO: 1826003 - DNA, 14 bp, Homo sapiens
agcgagcacagtat

SEQ ID NO: 1826004 - DNA, 22 bp, Homo sapiens
agcgattattgatcaaaatcaa

SEQ ID NO: 1826005 - DNA, 14 bp, Homo sapiens
agcgggcagccccg

SEQ ID NO: 1826006 - DNA, 20 bp, Homo sapiens
agctactctgtccaggccac

SEQ ID NO: 1826007 - DNA, 17 bp, Homo sapiens
agctagaaacaatctat

SEQ ID NO: 1826008 - DNA, 21 bp, Homo sapiens
agctagactggagtgaggctt

SEQ ID NO: 1826009 - DNA, 13 bp, Homo sapiens
agctaggactgag

SEQ ID NO: 1826010 - DNA, 15 bp, Homo sapiens
agctaggactgagga

SEQ ID NO: 1826011 - DNA, 17 bp, Homo sapiens
agctcactggtttacaa

SEQ ID NO: 1826012 - DNA, 13 bp, Homo sapiens
agctcctctcctt

SEQ ID NO: 1826013 - DNA, 18 bp, Homo sapiens
agctcctctccttgggct

SEQ ID NO: 1826014 - DNA, 19 bp, Homo sapiens
agctcctctccttgggctc

SEQ ID NO: 1826015 - DNA, 13 bp, Homo sapiens
agctccttttgtc

SEQ ID NO: 1826016 - DNA, 22 bp, Homo sapiens
agctccttttgtccccagggcc

SEQ ID NO: 1826017 - DNA, 12 bp, Homo sapiens
agctctgtggcc

SEQ ID NO: 1826018 - DNA, 15 bp, Homo sapiens
agctctgtggcctgt

SEQ ID NO: 1826019 - DNA, 18 bp, Homo sapiens
agctctgtggcctgtgtc

SEQ ID NO: 1826020 - DNA, 19 bp, Homo sapiens
agctctgtggcctgtgtcc

SEQ ID NO: 1826021 - DNA, 14 bp, Homo sapiens
agctcttcaagctg

SEQ ID NO: 1826022 - DNA, 14 bp, Homo sapiens
agctgacagtcctc

SEQ ID NO: 1826023 - DNA, 21 bp, Homo sapiens
agctgacagtcctctccacct

SEQ ID NO: 1826024 - DNA, 13 bp, Homo sapiens
agctgagctggcc

SEQ ID NO: 1826025 - DNA, 22 bp, Homo sapiens
agctgagttacttgtctgaggc

SEQ ID NO: 1826026 - DNA, 18 bp, Homo sapiens
agctgatttccaggcccc

SEQ ID NO: 1826027 - DNA, 13 bp, Homo sapiens
agctgcagctggg

SEQ ID NO: 1826028 - DNA, 16 bp, Homo sapiens
agctgcagctgggccc

SEQ ID NO: 1826029 - DNA, 19 bp, Homo sapiens
agctgcagctgggccccat

SEQ ID NO: 1826030 - DNA, 14 bp, Homo sapiens
agctgcctgtgcct

SEQ ID NO: 1826031 - DNA, 18 bp, Homo sapiens
agctgcgggtctgaagga

SEQ ID NO: 1826032 - DNA, 13 bp, Homo sapiens
agctgctctgccc

SEQ ID NO: 1826033 - DNA, 14 bp, Homo sapiens
agctgctctgcccc

SEQ ID NO: 1826034 - DNA, 15 bp, Homo sapiens
agctgctctgcccct

SEQ ID NO: 1826035 - DNA, 19 bp, Homo sapiens
agctgctcttagtgcccgc

SEQ ID NO: 1826036 - DNA, 20 bp, Homo sapiens
agctgctcttagtgcccgcc

SEQ ID NO: 1826037 - DNA, 21 bp, Homo sapiens
agctgctcttagtgcccgcct

SEQ ID NO: 1826038 - DNA, 12 bp, Homo sapiens
agctggaaggca

SEQ ID NO: 1826039 - DNA, 15 bp, Homo sapiens
agctggaaggcaggg

SEQ ID NO: 1826040 - DNA, 18 bp, Homo sapiens
agctggaaggcagggcag

SEQ ID NO: 1826041 - DNA, 16 bp, Homo sapiens
agctggacaagaagct

SEQ ID NO: 1826042 - DNA, 19 bp, Homo sapiens
agctggacaagaagctgct

SEQ ID NO: 1826043 - DNA, 13 bp, Homo sapiens
agctggcaggaca

SEQ ID NO: 1826044 - DNA, 16 bp, Homo sapiens
agctgggccccaccta

SEQ ID NO: 1826045 - DNA, 17 bp, Homo sapiens
agctgggccccacctac

SEQ ID NO: 1826046 - DNA, 20 bp, Homo sapiens
agctgggccccatgctctgc

SEQ ID NO: 1826047 - DNA, 21 bp, Homo sapiens
agctggtggtgcagccttccc

SEQ ID NO: 1826048 - DNA, 13 bp, Homo sapiens
agctgtactcaga

SEQ ID NO: 1826049 - DNA, 15 bp, Homo sapiens
agctgtactcagagc

SEQ ID NO: 1826050 - DNA, 16 bp, Homo sapiens
agctgtactcagagca

SEQ ID NO: 1826051 - DNA, 21 bp, Homo sapiens
agctgtactcagagcagagca

SEQ ID NO: 1826052 - DNA, 14 bp, Homo sapiens
agctgtagccatgg

SEQ ID NO: 1826053 - DNA, 17 bp, Homo sapiens
agctgtcccctctgtca

SEQ ID NO: 1826054 - DNA, 19 bp, Homo sapiens
agctgtgccaccctgggct

SEQ ID NO: 1826055 - DNA, 21 bp, Homo sapiens
agctgtttttgtgctctttgt

SEQ ID NO: 1826056 - DNA, 22 bp, Homo sapiens
agcttagccttgtgccctgccc

SEQ ID NO: 1826057 - DNA, 13 bp, Homo sapiens
agcttcctgaggg

SEQ ID NO: 1826058 - DNA, 17 bp, Homo sapiens
agcttctgctgggctgg

SEQ ID NO: 1826059 - DNA, 18 bp, Homo sapiens
agcttctgctgggctggg

SEQ ID NO: 1826060 - DNA, 20 bp, Homo sapiens
agctttgggttggagctgtt

SEQ ID NO: 1826061 - DNA, 14 bp, Homo sapiens
agcttttcccagga

SEQ ID NO: 1826062 - DNA, 13 bp, Homo sapiens
aggaaaaaagaaa

SEQ ID NO: 1826063 - DNA, 21 bp, Homo sapiens
aggaacgagcactggccagag

SEQ ID NO: 1826064 - DNA, 22 bp, Homo sapiens
aggaactgctgggcttggcagc

SEQ ID NO: 1826065 - DNA, 19 bp, Homo sapiens
aggaagaggggtcttttat

SEQ ID NO: 1826066 - DNA, 19 bp, Homo sapiens
aggaaggcagctgctctta

SEQ ID NO: 1826067 - DNA, 14 bp, Homo sapiens
aggaaggtgctgag

SEQ ID NO: 1826068 - DNA, 17 bp, Homo sapiens
aggaatagccagagagg

SEQ ID NO: 1826069 - DNA, 18 bp, Homo sapiens
aggacaacctgcccctcc

SEQ ID NO: 1826070 - DNA, 19 bp, Homo sapiens
aggacacatcccggcctct

SEQ ID NO: 1826071 - DNA, 11 bp, Homo sapiens
aggacacatgt

SEQ ID NO: 1826072 - DNA, 17 bp, Homo sapiens
agttgtattttgacaaa

SEQ ID NO: 1826073 - DNA, 18 bp, Homo sapiens
agttgtctattctgagcc

SEQ ID NO: 1826074 - DNA, 20 bp, Homo sapiens
agttgtctattctgagcctt

SEQ ID NO: 1826075 - DNA, 13 bp, Homo sapiens
agtttagaacaga

SEQ ID NO: 1826076 - DNA, 19 bp, Homo sapiens
agtttcacaacagatttct

SEQ ID NO: 1826077 - DNA, 13 bp, Homo sapiens
agtttcagaaatt

SEQ ID NO: 1826078 - DNA, 17 bp, Homo sapiens
agtttgagacaagccct

SEQ ID NO: 1826079 - DNA, 19 bp, Homo sapiens
agtttgagacaagccctgg

SEQ ID NO: 1826080 - DNA, 21 bp, Homo sapiens
agtttgagacaagccctggca

SEQ ID NO: 1826081 - DNA, 17 bp, Homo sapiens
agttttgacagagttgg

SEQ ID NO: 1826082 - DNA, 12 bp, Homo sapiens
agtttttcagaa

SEQ ID NO: 1826083 - DNA, 19 bp, Homo sapiens
ataaaaataccttaaatct

SEQ ID NO: 1826084 - DNA, 22 bp, Homo sapiens
ataaacctctaatttattttgt

SEQ ID NO: 1826085 - DNA, 13 bp, Homo sapiens
ataaaggtattta

SEQ ID NO: 1826086 - DNA, 15 bp, Homo sapiens
ataaagtatgccttc

SEQ ID NO: 1826087 - DNA, 12 bp, Homo sapiens
ataaagtgaata

SEQ ID NO: 1826088 - DNA, 21 bp, Homo sapiens
ataaatgcccagcacaattca

SEQ ID NO: 1826089 - DNA, 17 bp, Homo sapiens
ataaatgtaaaaatgaa

SEQ ID NO: 1826090 - DNA, 14 bp, Homo sapiens
ataaattacattaa

SEQ ID NO: 1826091 - DNA, 23 bp, Homo sapiens
ataacacagatattgttataaat

SEQ ID NO: 1826092 - DNA, 15 bp, Homo sapiens
ataactttatatgaa

SEQ ID NO: 1826093 - DNA, 19 bp, Homo sapiens
ataagactagagagatatt

SEQ ID NO: 1826094 - DNA, 14 bp, Homo sapiens
ataagtcattgaaa

SEQ ID NO: 1826095 - DNA, 17 bp, Homo sapiens
ataagtgggagctaaat

SEQ ID NO: 1826096 - DNA, 20 bp, Homo sapiens
ataatgtaatactgtagaaa

SEQ ID NO: 1826097 - DNA, 16 bp, Homo sapiens
ataattcatcaagtaa

SEQ ID NO: 1826098 - DNA, 17 bp, Homo sapiens
ataattggctttgcaga

SEQ ID NO: 1826099 - DNA, 21 bp, Homo sapiens
ataattggctttgcagatatt

SEQ ID NO: 1826100 - DNA, 18 bp, Homo sapiens
atacaaaaacatacttca

SEQ ID NO: 1826101 - DNA, 22 bp, Homo sapiens
atacaaaaacatacttcaaaaa

SEQ ID NO: 1826102 - DNA, 12 bp, Homo sapiens
atacatcttcat

SEQ ID NO: 1826103 - DNA, 22 bp, Homo sapiens
atacatcttcattaatactgtg

SEQ ID NO: 1826104 - DNA, 23 bp, Homo sapiens
atacggggtggctgaaagtaaag

SEQ ID NO: 1826105 - DNA, 13 bp, Homo sapiens
atacgtgttcaaa

SEQ ID NO: 1826106 - DNA, 16 bp, Homo sapiens
atacgtgttcaaaaat

SEQ ID NO: 1826107 - DNA, 16 bp, Homo sapiens
atactattcaatgcaa

SEQ ID NO: 1826108 - DNA, 17 bp, Homo sapiens
atactattcaatgcaat

SEQ ID NO: 1826109 - DNA, 19 bp, Homo sapiens
atactattcaatgcaatgc

SEQ ID NO: 1826110 - DNA, 18 bp, Homo sapiens
atactgaaccactttgat

SEQ ID NO: 1826111 - DNA, 21 bp, Homo sapiens
atactgtactgatactattca

SEQ ID NO: 1826112 - DNA, 21 bp, Homo sapiens
atactgtgttaccttttaaaa

SEQ ID NO: 1826113 - DNA, 18 bp, Homo sapiens
atacttactgttaactgt

SEQ ID NO: 1826114 - DNA, 17 bp, Homo sapiens
atagagagggggctctc

SEQ ID NO: 1826115 - DNA, 11 bp, Homo sapiens
atagatgtgtg

SEQ ID NO: 1826116 - DNA, 18 bp, Homo sapiens
atagcacatgattttctt

SEQ ID NO: 1826117 - DNA, 11 bp, Homo sapiens
atagccagaga

SEQ ID NO: 1826118 - DNA, 18 bp, Homo sapiens
ataggataaattacatta

SEQ ID NO: 1826119 - DNA, 18 bp, Homo sapiens
atagttatacatcttcat

SEQ ID NO: 1826120 - DNA, 20 bp, Homo sapiens
ctgatggaccgggtgggcct

SEQ ID NO: 1826121 - DNA, 23 bp, Homo sapiens
ctgatggaccgggtgggcctggc

SEQ ID NO: 1826122 - DNA, 13 bp, Homo sapiens
ctgatggccaaga

SEQ ID NO: 1826123 - DNA, 17 bp, Homo sapiens
ctgatggccaagggggt

SEQ ID NO: 1826124 - DNA, 18 bp, Homo sapiens
ctgatggccaagggggtg

SEQ ID NO: 1826125 - DNA, 18 bp, Homo sapiens
ctgattagtattcaggca

SEQ ID NO: 1826126 - DNA, 16 bp, Homo sapiens
ctgattcggctgtctc

SEQ ID NO: 1826127 - DNA, 13 bp, Homo sapiens
ctgattgtattta

SEQ ID NO: 1826128 - DNA, 13 bp, Homo sapiens
ctgatttcaaggc

SEQ ID NO: 1826129 - DNA, 20 bp, Homo sapiens
ctgatttcaaggccatattt

SEQ ID NO: 1826130 - DNA, 14 bp, Homo sapiens
ctgatttccaggcc

SEQ ID NO: 1826131 - DNA, 18 bp, Homo sapiens
ctgatttccaggcccctg

SEQ ID NO: 1826132 - DNA, 22 bp, Homo sapiens
ctgcaaatattagcaaagaagc

SEQ ID NO: 1826133 - DNA, 13 bp, Homo sapiens
ctgcaactagcca

SEQ ID NO: 1826134 - DNA, 15 bp, Homo sapiens
ctgcaactagccaag

SEQ ID NO: 1826135 - DNA, 16 bp, Homo sapiens
ctgcaagccccagggc

SEQ ID NO: 1826136 - DNA, 18 bp, Homo sapiens
ctgcaagccccagggcct

SEQ ID NO: 1826137 - DNA, 19 bp, Homo sapiens
ctgcaagccccagggcctg

SEQ ID NO: 1826138 - DNA, 21 bp, Homo sapiens
ctgcaagccccagggcctggg

SEQ ID NO: 1826139 - DNA, 22 bp, Homo sapiens
ctgcaagccccagggcctgggg

SEQ ID NO: 1826140 - DNA, 13 bp, Homo sapiens
ctgcaatctccag

SEQ ID NO: 1826141 - DNA, 16 bp, Homo sapiens
ctgcaatctccagggc

SEQ ID NO: 1826142 - DNA, 17 bp, Homo sapiens
ctgcaatctccagggct

SEQ ID NO: 1826143 - DNA, 13 bp, Homo sapiens
ctgcacacacagc

SEQ ID NO: 1826144 - DNA, 24 bp, Homo sapiens
ctgcacagtttagaacagagggac

SEQ ID NO: 1826145 - DNA, 16 bp, Homo sapiens
ctgcaccaacccagcc

SEQ ID NO: 1826146 - DNA, 17 bp, Homo sapiens
ctgcaccaacccagccg

SEQ ID NO: 1826147 - DNA, 23 bp, Homo sapiens
ctgcaccaacccagccgctgccc

SEQ ID NO: 1826148 - DNA, 14 bp, Homo sapiens
ctgcaccagagtga

SEQ ID NO: 1826149 - DNA, 15 bp, Homo sapiens
ctgcaccagagtgaa

SEQ ID NO: 1826150 - DNA, 15 bp, Homo sapiens
ctgcaccaggagaca

SEQ ID NO: 1826151 - DNA, 17 bp, Homo sapiens
ctgcaccaggagacaga

SEQ ID NO: 1826152 - DNA, 16 bp, Homo sapiens
ctgcaccccctcctgc

SEQ ID NO: 1826153 - DNA, 20 bp, Homo sapiens
ctgcaccccctcctgctgca

SEQ ID NO: 1826154 - DNA, 18 bp, Homo sapiens
ctgcaccctggaaagggg

SEQ ID NO: 1826155 - DNA, 15 bp, Homo sapiens
ctgcacctcctaccc

SEQ ID NO: 1826156 - DNA, 14 bp, Homo sapiens
ctgcactctgtgcc

SEQ ID NO: 1826157 - DNA, 17 bp, Homo sapiens
ctgcactctgtgcccat

SEQ ID NO: 1826158 - DNA, 11 bp, Homo sapiens
ctgcactgtcc

SEQ ID NO: 1826159 - DNA, 14 bp, Homo sapiens
ctgcactgtcctgc

SEQ ID NO: 1826160 - DNA, 16 bp, Homo sapiens
ctgcacttcagacacc

SEQ ID NO: 1826161 - DNA, 21 bp, Homo sapiens
ctgcagaggggcaggccctgc

SEQ ID NO: 1826162 - DNA, 22 bp, Homo sapiens
ctgcagaggggcaggccctgca

SEQ ID NO: 1826163 - DNA, 12 bp, Homo sapiens
ctgcagctgggc

SEQ ID NO: 1826164 - DNA, 13 bp, Homo sapiens
ctgcagctgggcc

SEQ ID NO: 1826165 - DNA, 19 bp, Homo sapiens
ctgcagctgggccccatgc

SEQ ID NO: 1826166 - DNA, 21 bp, Homo sapiens
ccccgagggatgatgccacac

SEQ ID NO: 1826167 - DNA, 22 bp, Homo sapiens
ccccgagggatgatgccacacc

SEQ ID NO: 1826168 - DNA, 19 bp, Homo sapiens
ccccgcagtccccagccct

SEQ ID NO: 1826169 - DNA, 14 bp, Homo sapiens
ccccggggctggca

SEQ ID NO: 1826170 - DNA, 17 bp, Homo sapiens
cccctcaccaggggcag

SEQ ID NO: 1826171 - DNA, 15 bp, Homo sapiens
cccctcagcccttgc

SEQ ID NO: 1826172 - DNA, 12 bp, Homo sapiens
cccctcccagac

SEQ ID NO: 1826173 - DNA, 15 bp, Homo sapiens
cccctcccagacagg

SEQ ID NO: 1826174 - DNA, 20 bp, Homo sapiens
cccctcccagacaggccctc

SEQ ID NO: 1826175 - DNA, 21 bp, Homo sapiens
cccctcccagacaggccctcc

SEQ ID NO: 1826176 - DNA, 15 bp, Homo sapiens
cccctccccagccag

SEQ ID NO: 1826177 - DNA, 13 bp, Homo sapiens
cccctcccctgaa

SEQ ID NO: 1826178 - DNA, 19 bp, Homo sapiens
cccctcccctggggacgcc

SEQ ID NO: 1826179 - DNA, 22 bp, Homo sapiens
cccctcccgtctactcattccc

SEQ ID NO: 1826180 - DNA, 16 bp, Homo sapiens
cccctccctgcctgct

SEQ ID NO: 1826181 - DNA, 17 bp, Homo sapiens
cccctcgtcctgtccca

SEQ ID NO: 1826182 - DNA, 14 bp, Homo sapiens
cccctcgtgccagt

SEQ ID NO: 1826183 - DNA, 13 bp, Homo sapiens
cccctgcacagtt

SEQ ID NO: 1826184 - DNA, 22 bp, Homo sapiens
cccctggatgggcattgggctg

SEQ ID NO: 1826185 - DNA, 16 bp, Homo sapiens
cccctgtacccagctc

SEQ ID NO: 1826186 - DNA, 15 bp, Homo sapiens
cccctgtctggaaga

SEQ ID NO: 1826187 - DNA, 23 bp, Homo sapiens
ccccttaagggttgaaggcagtc

SEQ ID NO: 1826188 - DNA, 13 bp, Homo sapiens
ccccttgggcatc

SEQ ID NO: 1826189 - DNA, 23 bp, Homo sapiens
ccccttgggcatccacccagtgc

SEQ ID NO: 1826190 - DNA, 19 bp, Homo sapiens
ccccttttcagcttctgct

SEQ ID NO: 1826191 - DNA, 22 bp, Homo sapiens
ccccttttcagcttctgctggg

SEQ ID NO: 1826192 - DNA, 15 bp, Homo sapiens
ccccttttgcctggc

SEQ ID NO: 1826193 - DNA, 14 bp, Homo sapiens
cccgacactgctgc

SEQ ID NO: 1826194 - DNA, 20 bp, Homo sapiens
cccgagggatgatgccacac

SEQ ID NO: 1826195 - DNA, 14 bp, Homo sapiens
cccgcagtccccag

SEQ ID NO: 1826196 - DNA, 20 bp, Homo sapiens
cccgccccttccccgaggga

SEQ ID NO: 1826197 - DNA, 23 bp, Homo sapiens
cccgccttcctcctccacagtgc

SEQ ID NO: 1826198 - DNA, 16 bp, Homo sapiens
cccgcggtgctctggc

SEQ ID NO: 1826199 - DNA, 19 bp, Homo sapiens
cccgctcccacagcttcct

SEQ ID NO: 1826200 - DNA, 13 bp, Homo sapiens
cccgctcccagtg

SEQ ID NO: 1826201 - DNA, 17 bp, Homo sapiens
cccgcttgcctcggctc

SEQ ID NO: 1826202 - DNA, 19 bp, Homo sapiens
cccgcttgcctcggctcct

SEQ ID NO: 1826203 - DNA, 14 bp, Homo sapiens
cccggagcacagcc

SEQ ID NO: 1826204 - DNA, 16 bp, Homo sapiens
cccggagcacagccct

SEQ ID NO: 1826205 - DNA, 17 bp, Homo sapiens
cccggagcacagccctg

SEQ ID NO: 1826206 - DNA, 11 bp, Homo sapiens
cccggcctctt

SEQ ID NO: 1826207 - DNA, 14 bp, Homo sapiens
cccggcctcttcca

SEQ ID NO: 1826208 - DNA, 14 bp, Homo sapiens
cccggcgccctctg

SEQ ID NO: 1826209 - DNA, 20 bp, Homo sapiens
cccggcgccctctgtcctga

SEQ ID NO: 1826210 - DNA, 13 bp, Homo sapiens
cccggctgcctgc

SEQ ID NO: 1826211 - DNA, 18 bp, Homo sapiens
cccgggaggggcccgctt

SEQ ID NO: 1826212 - DNA, 22 bp, Homo sapiens
cccgggaggggcccgcttgcct

SEQ ID NO: 1826213 - DNA, 16 bp, Homo sapiens
cccggggctggcaagc

SEQ ID NO: 1826214 - DNA, 18 bp, Homo sapiens
cccgtgaagcagtgcctc

SEQ ID NO: 1826215 - DNA, 19 bp, Homo sapiens
cccgtgaagcagtgcctcg

SEQ ID NO: 1826216 - DNA, 11 bp, Homo sapiens
cccgtgcagta

SEQ ID NO: 1826217 - DNA, 15 bp, Homo sapiens
cccgtggccccagcc

SEQ ID NO: 1826218 - DNA, 18 bp, Homo sapiens
cccgtggccccagcctgg

SEQ ID NO: 1826219 - DNA, 20 bp, Homo sapiens
cccgtggccccagcctggcc

SEQ ID NO: 1826220 - DNA, 23 bp, Homo sapiens
cccgtggccccagcctggcccag

SEQ ID NO: 1826221 - DNA, 20 bp, Homo sapiens
cccgttccctgtcagaggct

SEQ ID NO: 1826222 - DNA, 17 bp, Homo sapiens
cccgttgtctccctggc

SEQ ID NO: 1826223 - DNA, 18 bp, Homo sapiens
ccctatagagagggggct

SEQ ID NO: 1826224 - DNA, 17 bp, Homo sapiens
ccctcaaggcctcccac

SEQ ID NO: 1826225 - DNA, 22 bp, Homo sapiens
ccctcaaggcctcccacagtga

SEQ ID NO: 1826226 - DNA, 14 bp, Homo sapiens
ccctcagcccttgc

SEQ ID NO: 1826227 - DNA, 18 bp, Homo sapiens
ccctcagtcagttcccgg

SEQ ID NO: 1826228 - DNA, 11 bp, Homo sapiens
ccctccaggca

SEQ ID NO: 1826229 - DNA, 21 bp, Homo sapiens
ccctcccaccagaacgcaccc

SEQ ID NO: 1826230 - DNA, 12 bp, Homo sapiens
ccctcccagaca

SEQ ID NO: 1826231 - DNA, 18 bp, Homo sapiens
ccctcccagacaggccct

SEQ ID NO: 1826232 - DNA, 16 bp, Homo sapiens
ccctccccacagtcct

SEQ ID NO: 1826233 - DNA, 17 bp, Homo sapiens
ccctccccagccagccc

SEQ ID NO: 1826234 - DNA, 14 bp, Homo sapiens
ccctccccagccct

SEQ ID NO: 1826235 - DNA, 22 bp, Homo sapiens
ccctcccgtctactcattcccc

SEQ ID NO: 1826236 - DNA, 15 bp, Homo sapiens
ccctccctgcctgct

SEQ ID NO: 1826237 - DNA, 16 bp, Homo sapiens
ccctccctgtctccag

SEQ ID NO: 1826238 - DNA, 21 bp, Homo sapiens
ccctcctacccctcccagctg

SEQ ID NO: 1826239 - DNA, 11 bp, Homo sapiens
ccctcctgctg

SEQ ID NO: 1826240 - DNA, 13 bp, Homo sapiens
ccctcctgctgca

SEQ ID NO: 1826241 - DNA, 24 bp, Homo sapiens
ccctcgaaccaaggcagcctccag

SEQ ID NO: 1826242 - DNA, 17 bp, Homo sapiens
ccctcggaagccgtctg

SEQ ID NO: 1826243 - DNA, 16 bp, Homo sapiens
ccctcgtgccagtcgc

SEQ ID NO: 1826244 - DNA, 16 bp, Homo sapiens
ccctcgtggacacctg

SEQ ID NO: 1826245 - DNA, 18 bp, Homo sapiens
ccctcgtggacacctgcc

SEQ ID NO: 1826246 - DNA, 19 bp, Homo sapiens
ccctcgtggacacctgccc

SEQ ID NO: 1826247 - DNA, 15 bp, Homo sapiens
ccctctcgccccatc

SEQ ID NO: 1826248 - DNA, 18 bp, Homo sapiens
cctagtactctctgctct

SEQ ID NO: 1826249 - DNA, 21 bp, Homo sapiens
cctagtactctctgctctagc

SEQ ID NO: 1826250 - DNA, 23 bp, Homo sapiens
cctagtactctctgctctagcca

SEQ ID NO: 1826251 - DNA, 16 bp, Homo sapiens
cctagtggctgtccag

SEQ ID NO: 1826252 - DNA, 17 bp, Homo sapiens
cctagtggctgtccagt

SEQ ID NO: 1826253 - DNA, 16 bp, Homo sapiens
cctataaaatgcccat

SEQ ID NO: 1826254 - DNA, 20 bp, Homo sapiens
cctatcagtgtgccccccat

SEQ ID NO: 1826255 - DNA, 15 bp, Homo sapiens
cctatcatcagttag

SEQ ID NO: 1826256 - DNA, 13 bp, Homo sapiens
cctatccatcctg

SEQ ID NO: 1826257 - DNA, 17 bp, Homo sapiens
cctatgagatggccatg

SEQ ID NO: 1826258 - DNA, 18 bp, Homo sapiens
cctatgagatggccatgc

SEQ ID NO: 1826259 - DNA, 15 bp, Homo sapiens
cctcaaggcctccca

SEQ ID NO: 1826260 - DNA, 18 bp, Homo sapiens
cctcaaggcctcccacag

SEQ ID NO: 1826261 - DNA, 21 bp, Homo sapiens
cctcaaggcctcccacagtga

SEQ ID NO: 1826262 - DNA, 16 bp, Homo sapiens
cctcacactactgtat

SEQ ID NO: 1826263 - DNA, 12 bp, Homo sapiens
cctcacagcctc

SEQ ID NO: 1826264 - DNA, 13 bp, Homo sapiens
cctcacagcctct

SEQ ID NO: 1826265 - DNA, 19 bp, Homo sapiens
cctcacagcctctccctta

SEQ ID NO: 1826266 - DNA, 19 bp, Homo sapiens
cctcaccttttcccgggga

SEQ ID NO: 1826267 - DNA, 17 bp, Homo sapiens
cctcagcccttgccccc

SEQ ID NO: 1826268 - DNA, 21 bp, Homo sapiens
cctcatcccctcgtcctgtcc

SEQ ID NO: 1826269 - DNA, 23 bp, Homo sapiens
cctcatcccctcgtcctgtccca

SEQ ID NO: 1826270 - DNA, 22 bp, Homo sapiens
cctcattttactaaaatcgtat

SEQ ID NO: 1826271 - DNA, 16 bp, Homo sapiens
cctccacagtgctgct

SEQ ID NO: 1826272 - DNA, 17 bp, Homo sapiens
cctccacagtgctgctt

SEQ ID NO: 1826273 - DNA, 12 bp, Homo sapiens
cctccactccca

SEQ ID NO: 1826274 - DNA, 14 bp, Homo sapiens
cctccactcccact

SEQ ID NO: 1826275 - DNA, 18 bp, Homo sapiens
cctccactcccacttccc

SEQ ID NO: 1826276 - DNA, 12 bp, Homo sapiens
cctccagagcca

SEQ ID NO: 1826277 - DNA, 14 bp, Homo sapiens
cctccagagccagc

SEQ ID NO: 1826278 - DNA, 20 bp, Homo sapiens
cctccagccacttatttcca

SEQ ID NO: 1826279 - DNA, 11 bp, Homo sapiens
cctccagcctc

SEQ ID NO: 1826280 - DNA, 16 bp, Homo sapiens
cctccagcctcccctc

SEQ ID NO: 1826281 - DNA, 19 bp, Homo sapiens
cctccaggcatgctggcct

SEQ ID NO: 1826282 - DNA, 19 bp, Homo sapiens
cctcccaacagagctgggc

SEQ ID NO: 1826283 - DNA, 23 bp, Homo sapiens
cctcccacagtgactcgggctcc

SEQ ID NO: 1826284 - DNA, 14 bp, Homo sapiens
cctcccagacaggc

SEQ ID NO: 1826285 - DNA, 19 bp, Homo sapiens
cctcccagacaggccctcc

SEQ ID NO: 1826286 - DNA, 20 bp, Homo sapiens
cctcccagacaggccctccc

SEQ ID NO: 1826287 - DNA, 22 bp, Homo sapiens
cctcccagacaggccctccctg

SEQ ID NO: 1826288 - DNA, 22 bp, Homo sapiens
ccaggcacctggcctgctggga

SEQ ID NO: 1826289 - DNA, 17 bp, Homo sapiens
ccaggcatgctggcctc

SEQ ID NO: 1826290 - DNA, 16 bp, Homo sapiens
ccaggccactgtggcc

SEQ ID NO: 1826291 - DNA, 18 bp, Homo sapiens
ccaggccactgtggccag

SEQ ID NO: 1826292 - DNA, 18 bp, Homo sapiens
ccaggccatcttccaggt

SEQ ID NO: 1826293 - DNA, 16 bp, Homo sapiens
ccaggcccatctcagg

SEQ ID NO: 1826294 - DNA, 18 bp, Homo sapiens
ccaggcccctgaggactg

SEQ ID NO: 1826295 - DNA, 23 bp, Homo sapiens
ccaggcccctgaggactggagac

SEQ ID NO: 1826296 - DNA, 22 bp, Homo sapiens
ccaggccctaggattcctcccc

SEQ ID NO: 1826297 - DNA, 20 bp, Homo sapiens
ccaggccctccatgggctag

SEQ ID NO: 1826298 - DNA, 17 bp, Homo sapiens
ccaggcctccagcctct

SEQ ID NO: 1826299 - DNA, 19 bp, Homo sapiens
ccaggcctccagcctctcc

SEQ ID NO: 1826300 - DNA, 16 bp, Homo sapiens
ccaggcgttggtgcca

SEQ ID NO: 1826301 - DNA, 16 bp, Homo sapiens
ccaggctgcactgcag

SEQ ID NO: 1826302 - DNA, 12 bp, Homo sapiens
ccaggctggcca

SEQ ID NO: 1826303 - DNA, 13 bp, Homo sapiens
ccaggctggccag

SEQ ID NO: 1826304 - DNA, 15 bp, Homo sapiens
ccaggctggccagcc

SEQ ID NO: 1826305 - DNA, 16 bp, Homo sapiens
ccaggctggccagccc

SEQ ID NO: 1826306 - DNA, 13 bp, Homo sapiens
ccagggaggagag

SEQ ID NO: 1826307 - DNA, 14 bp, Homo sapiens
ccagggaggagagg

SEQ ID NO: 1826308 - DNA, 15 bp, Homo sapiens
ccagggaggagagga

SEQ ID NO: 1826309 - DNA, 16 bp, Homo sapiens
ccagggcccccaccga

SEQ ID NO: 1826310 - DNA, 21 bp, Homo sapiens
ccagggcccccaccgaggttc

SEQ ID NO: 1826311 - DNA, 16 bp, Homo sapiens
ccagggcctgggggca

SEQ ID NO: 1826312 - DNA, 23 bp, Homo sapiens
ccagggctggagacttcctctgg

SEQ ID NO: 1826313 - DNA, 17 bp, Homo sapiens
ccaggggcaggcacagc

SEQ ID NO: 1826314 - DNA, 16 bp, Homo sapiens
ccagggtccgcaccag

SEQ ID NO: 1826315 - DNA, 17 bp, Homo sapiens
ccagggtccgcaccagc

SEQ ID NO: 1826316 - DNA, 21 bp, Homo sapiens
ccagggtcttgggctactggc

SEQ ID NO: 1826317 - DNA, 23 bp, Homo sapiens
ccaggtaagcaggaggaggtgcc

SEQ ID NO: 1826318 - DNA, 19 bp, Homo sapiens
ccaggtctcctccaccgcc

SEQ ID NO: 1826319 - DNA, 21 bp, Homo sapiens
ccaggtctcctccaccgccat

SEQ ID NO: 1826320 - DNA, 19 bp, Homo sapiens
ccaggtgggcgggcagcac

SEQ ID NO: 1826321 - DNA, 20 bp, Homo sapiens
ccaggtgggcgggcagcaca

SEQ ID NO: 1826322 - DNA, 20 bp, Homo sapiens
ccagtcgcgctgcctgtgtg

SEQ ID NO: 1826323 - DNA, 13 bp, Homo sapiens
ccagtcttgccta

SEQ ID NO: 1826324 - DNA, 16 bp, Homo sapiens
ccagtcttgcctaggc

SEQ ID NO: 1826325 - DNA, 22 bp, Homo sapiens
ccagtgaacttacacttggagc

SEQ ID NO: 1826326 - DNA, 18 bp, Homo sapiens
ccagtgcccattcctcac

SEQ ID NO: 1826327 - DNA, 23 bp, Homo sapiens
ccagtgctgccatgccactgcca

SEQ ID NO: 1826328 - DNA, 12 bp, Homo sapiens
ccagtgcttctc

SEQ ID NO: 1826329 - DNA, 21 bp, Homo sapiens
ccagtgcttctccaacactga

SEQ ID NO: 1826330 - DNA, 20 bp, Homo sapiens
ccagtgtaaagaataaatga

SEQ ID NO: 1826331 - DNA, 15 bp, Homo sapiens
ccagtgtcttcctgt

SEQ ID NO: 1826332 - DNA, 17 bp, Homo sapiens
ccagtgtcttcctgtgg

SEQ ID NO: 1826333 - DNA, 14 bp, Homo sapiens
ccagttctgatgag

SEQ ID NO: 1826334 - DNA, 17 bp, Homo sapiens
ccatattttaaaaaatc

SEQ ID NO: 1826335 - DNA, 22 bp, Homo sapiens
ccatcaggtcccccccaggtgc

SEQ ID NO: 1826336 - DNA, 22 bp, Homo sapiens
ccatcccccctcaccaggggca

SEQ ID NO: 1826337 - DNA, 11 bp, Homo sapiens
ccatcccctcc

SEQ ID NO: 1826338 - DNA, 14 bp, Homo sapiens
ccatcccctccctg

SEQ ID NO: 1826339 - DNA, 17 bp, Homo sapiens
ccatcccctccctgcct

SEQ ID NO: 1826340 - DNA, 19 bp, Homo sapiens
ccatcccctccctgcctgc

SEQ ID NO: 1826341 - DNA, 12 bp, Homo sapiens
ccatccctgctt

SEQ ID NO: 1826342 - DNA, 13 bp, Homo sapiens
ccatctcaggtgc

SEQ ID NO: 1826343 - DNA, 15 bp, Homo sapiens
ccatctcaggtgcca

SEQ ID NO: 1826344 - DNA, 15 bp, Homo sapiens
ccatctccccaggcc

SEQ ID NO: 1826345 - DNA, 18 bp, Homo sapiens
ccatctccccaggcctcc

SEQ ID NO: 1826346 - DNA, 23 bp, Homo sapiens
ccatctccccaggcctccagcct

SEQ ID NO: 1826347 - DNA, 15 bp, Homo sapiens
ccatcttccaggtgg

SEQ ID NO: 1826348 - DNA, 12 bp, Homo sapiens
ccatgccactgc

SEQ ID NO: 1826349 - DNA, 15 bp, Homo sapiens
ccatgcctcatgcca

SEQ ID NO: 1826350 - DNA, 17 bp, Homo sapiens
ccatgcctcatgccaca

SEQ ID NO: 1826351 - DNA, 23 bp, Homo sapiens
ccatgcctcatgccacaccttct

SEQ ID NO: 1826352 - DNA, 14 bp, Homo sapiens
ccatgctctgcccc

SEQ ID NO: 1826353 - DNA, 23 bp, Homo sapiens
ccatgctctgccccaagccccca

SEQ ID NO: 1826354 - DNA, 20 bp, Homo sapiens
ccatggattcccctggacat

SEQ ID NO: 1826355 - DNA, 15 bp, Homo sapiens
ccatggcaccagccc

SEQ ID NO: 1826356 - DNA, 16 bp, Homo sapiens
ccatggcaccagcccc

SEQ ID NO: 1826357 - DNA, 19 bp, Homo sapiens
ccatggcaccagccccctg

SEQ ID NO: 1826358 - DNA, 22 bp, Homo sapiens
ccatggcaccagccccctggat

SEQ ID NO: 1826359 - DNA, 17 bp, Homo sapiens
ccatggctcaggcaagc

SEQ ID NO: 1826360 - DNA, 15 bp, Homo sapiens
ccatgggcactgctg

SEQ ID NO: 1826361 - DNA, 16 bp, Homo sapiens
ccatgggcactgctgg

SEQ ID NO: 1826362 - DNA, 17 bp, Homo sapiens
ccatgggcactgctggg

SEQ ID NO: 1826363 - DNA, 18 bp, Homo sapiens
ccatgggcctgggcctgc

SEQ ID NO: 1826364 - DNA, 19 bp, Homo sapiens
ccatgggcctgggcctgct

SEQ ID NO: 1826365 - DNA, 20 bp, Homo sapiens
ccatgggcctgggcctgctt

SEQ ID NO: 1826366 - DNA, 20 bp, Homo sapiens
ccatgggctagtgtgagtgg

SEQ ID NO: 1826367 - DNA, 22 bp, Homo sapiens
ccatgggcttggacttcctggg

SEQ ID NO: 1826368 - DNA, 16 bp, Homo sapiens
ccatggtagactgtga

SEQ ID NO: 1826369 - DNA, 18 bp, Homo sapiens
ccatggtagactgtgaca

SEQ ID NO: 1826370 - DNA, 19 bp, Homo sapiens
ccatgtagaataaatgaag

SEQ ID NO: 1826371 - DNA, 15 bp, Homo sapiens
ccatgtgcctgcacc

SEQ ID NO: 1826372 - DNA, 17 bp, Homo sapiens
ccatgtgcctgcaccag

SEQ ID NO: 1826373 - DNA, 19 bp, Homo sapiens
ccatgtgcctgcaccagga

SEQ ID NO: 1826374 - DNA, 21 bp, Homo sapiens
ccatgtgtcatgtaatactga

SEQ ID NO: 1826375 - DNA, 18 bp, Homo sapiens
ccattacttgtataaata

SEQ ID NO: 1826376 - DNA, 18 bp, Homo sapiens
ccattcatctctaacata

SEQ ID NO: 1826377 - DNA, 24 bp, Homo sapiens
ccccagatctgcctgggcctgtgc

SEQ ID NO: 1826378 - DNA, 13 bp, Homo sapiens
ccccagcacccgg

SEQ ID NO: 1826379 - DNA, 16 bp, Homo sapiens
ccccagcccttctgcc

SEQ ID NO: 1826380 - DNA, 17 bp, Homo sapiens
ccccagcccttctgcct

SEQ ID NO: 1826381 - DNA, 13 bp, Homo sapiens
ccccagcctggcc

SEQ ID NO: 1826382 - DNA, 17 bp, Homo sapiens
ccccagcctggcccagc

SEQ ID NO: 1826383 - DNA, 22 bp, Homo sapiens
ccccagcctggcccagctcccc

SEQ ID NO: 1826384 - DNA, 14 bp, Homo sapiens
ccccaggcctccag

SEQ ID NO: 1826385 - DNA, 13 bp, Homo sapiens
ccccagggcccct

SEQ ID NO: 1826386 - DNA, 14 bp, Homo sapiens
ccccatccctgctt

SEQ ID NO: 1826387 - DNA, 15 bp, Homo sapiens
ccccatcctggccca

SEQ ID NO: 1826388 - DNA, 16 bp, Homo sapiens
ccccatcctggcccat

SEQ ID NO: 1826389 - DNA, 16 bp, Homo sapiens
ccccatctccccaggc

SEQ ID NO: 1826390 - DNA, 20 bp, Homo sapiens
ccccatctccccaggcctcc

SEQ ID NO: 1826391 - DNA, 21 bp, Homo sapiens
ccccatctcctcccatggcct

SEQ ID NO: 1826392 - DNA, 13 bp, Homo sapiens
ccccatctgccca

SEQ ID NO: 1826393 - DNA, 17 bp, Homo sapiens
ccccatgctctgcccca

SEQ ID NO: 1826394 - DNA, 14 bp, Homo sapiens
ccccatgggcttgg

SEQ ID NO: 1826395 - DNA, 22 bp, Homo sapiens
ccccatgggcttggacttcctg

SEQ ID NO: 1826396 - DNA, 12 bp, Homo sapiens
cccccagaaagc

SEQ ID NO: 1826397 - DNA, 21 bp, Homo sapiens
cccccagaaagcctcctgccc

SEQ ID NO: 1826398 - DNA, 19 bp, Homo sapiens
cccccagcccacagagcct

SEQ ID NO: 1826399 - DNA, 14 bp, Homo sapiens
cccccatgtggctg

SEQ ID NO: 1826400 - DNA, 14 bp, Homo sapiens
cccccctcaccagg

SEQ ID NO: 1826401 - DNA, 15 bp, Homo sapiens
cccccgggaggggcc

SEQ ID NO: 1826402 - DNA, 13 bp, Homo sapiens
ccccctcgtgcca

SEQ ID NO: 1826403 - DNA, 12 bp, Homo sapiens
ccccgacactgc

SEQ ID NO: 1826404 - DNA, 14 bp, Homo sapiens
ccccgacactgctg

SEQ ID NO: 1826405 - DNA, 18 bp, Homo sapiens
ccccgacactgctgcacc

SEQ ID NO: 1826406 - DNA, 19 bp, Homo sapiens
ccccgagggatgatgccac

SEQ ID NO: 1826407 - DNA, 20 bp, Homo sapiens
ccccgagggatgatgccaca

SEQ ID NO: 1826408 - DNA, 24 bp, Homo sapiens
caggagtttgagacaagccctggc

SEQ ID NO: 1826409 - DNA, 17 bp, Homo sapiens
caggatccgctgccacc

SEQ ID NO: 1826410 - DNA, 14 bp, Homo sapiens
caggatcctgcagg

SEQ ID NO: 1826411 - DNA, 15 bp, Homo sapiens
caggatcctgcagga

SEQ ID NO: 1826412 - DNA, 17 bp, Homo sapiens
caggcaaaacacgcaag

SEQ ID NO: 1826413 - DNA, 21 bp, Homo sapiens
caggcaaaacacgcaagggca

SEQ ID NO: 1826414 - DNA, 21 bp, Homo sapiens
caggcaagcccctcagccctt

SEQ ID NO: 1826415 - DNA, 24 bp, Homo sapiens
caggcaagcccctcagcccttgcc

SEQ ID NO: 1826416 - DNA, 22 bp, Homo sapiens
caggcacctggcctgctgggaa

SEQ ID NO: 1826417 - DNA, 16 bp, Homo sapiens
caggcactgagaatga

SEQ ID NO: 1826418 - DNA, 14 bp, Homo sapiens
caggcagcactgac

SEQ ID NO: 1826419 - DNA, 17 bp, Homo sapiens
caggcagccacgtctca

SEQ ID NO: 1826420 - DNA, 11 bp, Homo sapiens
caggcatgctg

SEQ ID NO: 1826421 - DNA, 12 bp, Homo sapiens
caggccactgtg

SEQ ID NO: 1826422 - DNA, 15 bp, Homo sapiens
caggccactgtggcc

SEQ ID NO: 1826423 - DNA, 18 bp, Homo sapiens
caggccactgtggccaga

SEQ ID NO: 1826424 - DNA, 19 bp, Homo sapiens
caggccactgtggccagag

SEQ ID NO: 1826425 - DNA, 16 bp, Homo sapiens
caggccatcttccagg

SEQ ID NO: 1826426 - DNA, 19 bp, Homo sapiens
caggccatcttccaggtgg

SEQ ID NO: 1826427 - DNA, 22 bp, Homo sapiens
caggcccatctcaggtgccact

SEQ ID NO: 1826428 - DNA, 16 bp, Homo sapiens
caggcccctgaggact

SEQ ID NO: 1826429 - DNA, 17 bp, Homo sapiens
caggcccctgaggactg

SEQ ID NO: 1826430 - DNA, 18 bp, Homo sapiens
caggcccctgaggactgg

SEQ ID NO: 1826431 - DNA, 19 bp, Homo sapiens
caggcccctgaggactgga

SEQ ID NO: 1826432 - DNA, 16 bp, Homo sapiens
caggccctccatgggc

SEQ ID NO: 1826433 - DNA, 18 bp, Homo sapiens
caggccctccatgggcta

SEQ ID NO: 1826434 - DNA, 12 bp, Homo sapiens
caggccctgcac

SEQ ID NO: 1826435 - DNA, 13 bp, Homo sapiens
caggccctgcact

SEQ ID NO: 1826436 - DNA, 16 bp, Homo sapiens
caggccctgcactgtc

SEQ ID NO: 1826437 - DNA, 18 bp, Homo sapiens
caggccgttccccttggc

SEQ ID NO: 1826438 - DNA, 17 bp, Homo sapiens
caggcctccagcctctc

SEQ ID NO: 1826439 - DNA, 18 bp, Homo sapiens
caggcctccagcctctcc

SEQ ID NO: 1826440 - DNA, 12 bp, Homo sapiens
caggcctgggac

SEQ ID NO: 1826441 - DNA, 16 bp, Homo sapiens
caggcctgggacccag

SEQ ID NO: 1826442 - DNA, 16 bp, Homo sapiens
caggcgttggtgccac

SEQ ID NO: 1826443 - DNA, 16 bp, Homo sapiens
caggctctgggctcag

SEQ ID NO: 1826444 - DNA, 17 bp, Homo sapiens
caggctctgggctcagg

SEQ ID NO: 1826445 - DNA, 14 bp, Homo sapiens
caggctcttcctgg

SEQ ID NO: 1826446 - DNA, 17 bp, Homo sapiens
caggctcttcctggacc

SEQ ID NO: 1826447 - DNA, 15 bp, Homo sapiens
caggctgcactgcag

SEQ ID NO: 1826448 - DNA, 16 bp, Homo sapiens
caggctgcactgcagt

SEQ ID NO: 1826449 - DNA, 17 bp, Homo sapiens
caggctgcactgcagtg

SEQ ID NO: 1826450 - DNA, 12 bp, Homo sapiens
caggctggccag

SEQ ID NO: 1826451 - DNA, 13 bp, Homo sapiens
caggctggccagc

SEQ ID NO: 1826452 - DNA, 15 bp, Homo sapiens
caggctggccagccc

SEQ ID NO: 1826453 - DNA, 17 bp, Homo sapiens
caggctggccagcccca

SEQ ID NO: 1826454 - DNA, 12 bp, Homo sapiens
cagggaaaacag

SEQ ID NO: 1826455 - DNA, 17 bp, Homo sapiens
cagggaagagggcagta

SEQ ID NO: 1826456 - DNA, 13 bp, Homo sapiens
cagggaccacagc

SEQ ID NO: 1826457 - DNA, 12 bp, Homo sapiens
cagggaggagag

SEQ ID NO: 1826458 - DNA, 13 bp, Homo sapiens
cagggcagaggga

SEQ ID NO: 1826459 - DNA, 21 bp, Homo sapiens
cagggccagaaggagggcaga

SEQ ID NO: 1826460 - DNA, 22 bp, Homo sapiens
cagggccagaaggagggcagag

SEQ ID NO: 1826461 - DNA, 19 bp, Homo sapiens
cagggcccctccctctgcc

SEQ ID NO: 1826462 - DNA, 20 bp, Homo sapiens
cagggcccctccctctgccc

SEQ ID NO: 1826463 - DNA, 22 bp, Homo sapiens
cagggcccctccctctgcccca

SEQ ID NO: 1826464 - DNA, 16 bp, Homo sapiens
cagggcctgggggcag

SEQ ID NO: 1826465 - DNA, 18 bp, Homo sapiens
cagggcctgggggcagtg

SEQ ID NO: 1826466 - DNA, 21 bp, Homo sapiens
cagggcctgggggcagtgact

SEQ ID NO: 1826467 - DNA, 23 bp, Homo sapiens
cagggcctgggggcagtgactgg

SEQ ID NO: 1826468 - DNA, 18 bp, Homo sapiens
cagggctgaggcctctca

SEQ ID NO: 1826469 - DNA, 22 bp, Homo sapiens
cagggctggagtgcgctcttgg

SEQ ID NO: 1826470 - DNA, 20 bp, Homo sapiens
caggggcaaagaactgcccc

SEQ ID NO: 1826471 - DNA, 22 bp, Homo sapiens
caggggcacctatgagatggcc

SEQ ID NO: 1826472 - DNA, 12 bp, Homo sapiens
caggggcaggcc

SEQ ID NO: 1826473 - DNA, 14 bp, Homo sapiens
caggggcaggcctg

SEQ ID NO: 1826474 - DNA, 15 bp, Homo sapiens
caggggcagtgcctt

SEQ ID NO: 1826475 - DNA, 12 bp, Homo sapiens
caggggccccag

SEQ ID NO: 1826476 - DNA, 14 bp, Homo sapiens
caggggccccagat

SEQ ID NO: 1826477 - DNA, 17 bp, Homo sapiens
caggggccccagatctg

SEQ ID NO: 1826478 - DNA, 19 bp, Homo sapiens
caggggccccagatctgcc

SEQ ID NO: 1826479 - DNA, 22 bp, Homo sapiens
caggggccccagatctgcctgg

SEQ ID NO: 1826480 - DNA, 14 bp, Homo sapiens
caggggcggggcag

SEQ ID NO: 1826481 - DNA, 18 bp, Homo sapiens
caggggcggggcaggaat

SEQ ID NO: 1826482 - DNA, 19 bp, Homo sapiens
caggggcggggcaggaatg

SEQ ID NO: 1826483 - DNA, 15 bp, Homo sapiens
cagggtccgcaccag

SEQ ID NO: 1826484 - DNA, 19 bp, Homo sapiens
cagggtccgcaccagctgc

SEQ ID NO: 1826485 - DNA, 17 bp, Homo sapiens
cagggtcttgggctact

SEQ ID NO: 1826486 - DNA, 20 bp, Homo sapiens
cagggtcttgggctactggc

SEQ ID NO: 1826487 - DNA, 22 bp, Homo sapiens
cagggtcttgggctactggcag

SEQ ID NO: 1826488 - DNA, 19 bp, Homo sapiens
caggtacttcctcctgatg

SEQ ID NO: 1826489 - DNA, 22 bp, Homo sapiens
caggtacttcctcctgatggcc

SEQ ID NO: 1826490 - DNA, 18 bp, Homo sapiens
caggtagatcgcttgagc

SEQ ID NO: 1826491 - DNA, 18 bp, Homo sapiens
caggtgccactccctgag

SEQ ID NO: 1826492 - DNA, 17 bp, Homo sapiens
caggtggagagcactag

SEQ ID NO: 1826493 - DNA, 21 bp, Homo sapiens
caggtgggcgggcagcacagc

SEQ ID NO: 1826494 - DNA, 21 bp, Homo sapiens
caggttgggccatactggcct

SEQ ID NO: 1826495 - DNA, 22 bp, Homo sapiens
caggttgggccatactggcctc

SEQ ID NO: 1826496 - DNA, 17 bp, Homo sapiens
cagtaaacatttgtaaa

SEQ ID NO: 1826497 - DNA, 18 bp, Homo sapiens
cagtaaacatttgtaaaa

SEQ ID NO: 1826498 - DNA, 22 bp, Homo sapiens
cagtaaacatttgtaaaaatac

SEQ ID NO: 1826499 - DNA, 15 bp, Homo sapiens
cagtaacatgcaaca

SEQ ID NO: 1826500 - DNA, 16 bp, Homo sapiens
cagtaacatgcaacaa

SEQ ID NO: 1826501 - DNA, 16 bp, Homo sapiens
cagtacacttcctgtg

SEQ ID NO: 1826502 - DNA, 13 bp, Homo sapiens
cagtacctgggaa

SEQ ID NO: 1826503 - DNA, 22 bp, Homo sapiens
cagtacctgggaaaggacccac

SEQ ID NO: 1826504 - DNA, 16 bp, Homo sapiens
cagtagtcgtcaagtt

SEQ ID NO: 1826505 - DNA, 12 bp, Homo sapiens
cagtatgtggaa

SEQ ID NO: 1826506 - DNA, 20 bp, Homo sapiens
cagtattatttctccatccc

SEQ ID NO: 1826507 - DNA, 15 bp, Homo sapiens
cagtatttgtgggga

SEQ ID NO: 1826508 - DNA, 18 bp, Homo sapiens
cagtcagttcccggagca

SEQ ID NO: 1826509 - DNA, 22 bp, Homo sapiens
cagtcagttcccggagcacagc

SEQ ID NO: 1826510 - DNA, 17 bp, Homo sapiens
cagtccccagcccttct

SEQ ID NO: 1826511 - DNA, 19 bp, Homo sapiens
cagtctgaacccttgtgct

SEQ ID NO: 1826512 - DNA, 19 bp, Homo sapiens
cagtcttatttttctagtc

SEQ ID NO: 1826513 - DNA, 16 bp, Homo sapiens
cagtcttgcctaggcc

SEQ ID NO: 1826514 - DNA, 17 bp, Homo sapiens
cagtcttgcctaggcca

SEQ ID NO: 1826515 - DNA, 19 bp, Homo sapiens
cagtgaacacactcagcag

SEQ ID NO: 1826516 - DNA, 19 bp, Homo sapiens
cagtgactcgggctcctgt

SEQ ID NO: 1826517 - DNA, 20 bp, Homo sapiens
cagtgactcgggctcctgtg

SEQ ID NO: 1826518 - DNA, 22 bp, Homo sapiens
cagtgactcgggctcctgtgcc

SEQ ID NO: 1826519 - DNA, 12 bp, Homo sapiens
cagtgactggca

SEQ ID NO: 1826520 - DNA, 19 bp, Homo sapiens
cagtgacttctgaatcctt

SEQ ID NO: 1826521 - DNA, 13 bp, Homo sapiens
cagtgagcccctc

SEQ ID NO: 1826522 - DNA, 18 bp, Homo sapiens
cagtgagcccctccccag

SEQ ID NO: 1826523 - DNA, 19 bp, Homo sapiens
cagtgagcccctccccagc

SEQ ID NO: 1826524 - DNA, 22 bp, Homo sapiens
catgctggcctcccaataaagc

SEQ ID NO: 1826525 - DNA, 23 bp, Homo sapiens
catgctggcctcccaataaagct

SEQ ID NO: 1826526 - DNA, 16 bp, Homo sapiens
catgctttctcctttt

SEQ ID NO: 1826527 - DNA, 17 bp, Homo sapiens
catgctttctccttttt

SEQ ID NO: 1826528 - DNA, 17 bp, Homo sapiens
catggattccactgaaa

SEQ ID NO: 1826529 - DNA, 13 bp, Homo sapiens
catggccttccct

SEQ ID NO: 1826530 - DNA, 14 bp, Homo sapiens
catggccttccctc

SEQ ID NO: 1826531 - DNA, 17 bp, Homo sapiens
catggcgtaatgggcct

SEQ ID NO: 1826532 - DNA, 18 bp, Homo sapiens
catggcgtaatgggcctg

SEQ ID NO: 1826533 - DNA, 20 bp, Homo sapiens
cacaccaagctgtgccaccc

SEQ ID NO: 1826534 - DNA, 22 bp, Homo sapiens
cacaccaagctgtgccaccctg

SEQ ID NO: 1826535 - DNA, 14 bp, Homo sapiens
cacaccactgccct

SEQ ID NO: 1826536 - DNA, 15 bp, Homo sapiens
cacaccactgccctg

SEQ ID NO: 1826537 - DNA, 19 bp, Homo sapiens
cacaccactgccctgcctg

SEQ ID NO: 1826538 - DNA, 14 bp, Homo sapiens
cacactactgtatt

SEQ ID NO: 1826539 - DNA, 15 bp, Homo sapiens
cacactcagcagccc

SEQ ID NO: 1826540 - DNA, 16 bp, Homo sapiens
cacagacttctggaag

SEQ ID NO: 1826541 - DNA, 17 bp, Homo sapiens
cacagacttctggaagg

SEQ ID NO: 1826542 - DNA, 19 bp, Homo sapiens
cacagagcctgaatttgta

SEQ ID NO: 1826543 - DNA, 22 bp, Homo sapiens
cacagcaaggaggctggctggg

SEQ ID NO: 1826544 - DNA, 23 bp, Homo sapiens
cacagcaaggaggctggctgggg

SEQ ID NO: 1826545 - DNA, 15 bp, Homo sapiens
cacagcaaggcacct

SEQ ID NO: 1826546 - DNA, 19 bp, Homo sapiens
cacagcaaggcacctgcag

SEQ ID NO: 1826547 - DNA, 17 bp, Homo sapiens
cacagcccacgtcctgt

SEQ ID NO: 1826548 - DNA, 14 bp, Homo sapiens
cacagccctcccgc

SEQ ID NO: 1826549 - DNA, 18 bp, Homo sapiens
cacagccctcccgcccct

SEQ ID NO: 1826550 - DNA, 20 bp, Homo sapiens
cacagccctcccgccccttc

SEQ ID NO: 1826551 - DNA, 11 bp, Homo sapiens
cacagccctgg

SEQ ID NO: 1826552 - DNA, 17 bp, Homo sapiens
cacagccctgggagggg

SEQ ID NO: 1826553 - DNA, 12 bp, Homo sapiens
cacagcctctcc

SEQ ID NO: 1826554 - DNA, 14 bp, Homo sapiens
cacagcctctccct

SEQ ID NO: 1826555 - DNA, 17 bp, Homo sapiens
cacagctgagctggcct

SEQ ID NO: 1826556 - DNA, 18 bp, Homo sapiens
cacagctgagctggccta

SEQ ID NO: 1826557 - DNA, 17 bp, Homo sapiens
cacagctgcagctgggc

SEQ ID NO: 1826558 - DNA, 13 bp, Homo sapiens
cacaggggcccca

SEQ ID NO: 1826559 - DNA, 14 bp, Homo sapiens
cacaggggccccag

SEQ ID NO: 1826560 - DNA, 23 bp, Homo sapiens
cacaggggccccagatctgcctg

SEQ ID NO: 1826561 - DNA, 16 bp, Homo sapiens
cacaggggcggggcag

SEQ ID NO: 1826562 - DNA, 19 bp, Homo sapiens
cacaggggcggggcaggaa

SEQ ID NO: 1826563 - DNA, 13 bp, Homo sapiens
cacagtcctcaca

SEQ ID NO: 1826564 - DNA, 16 bp, Homo sapiens
atgagatttgccagca

SEQ ID NO: 1826565 - DNA, 20 bp, Homo sapiens
atgaggcacgcctgccttct

SEQ ID NO: 1826566 - DNA, 15 bp, Homo sapiens
atgagtcacaaaata

SEQ ID NO: 1826567 - DNA, 21 bp, Homo sapiens
atgagtctacctgagcattca

SEQ ID NO: 1826568 - DNA, 18 bp, Homo sapiens
atgagttggctgggaata

SEQ ID NO: 1826569 - DNA, 17 bp, Homo sapiens
atgatattcatattcaa

SEQ ID NO: 1826570 - DNA, 12 bp, Homo sapiens
atgatgccacac

SEQ ID NO: 1826571 - DNA, 24 bp, Homo sapiens
atgatgccacaccaagctgtgcca

SEQ ID NO: 1826572 - DNA, 20 bp, Homo sapiens
atgcaaaagccaagaaagta

SEQ ID NO: 1826573 - DNA, 15 bp, Homo sapiens
atgcaatgaaaacaa

SEQ ID NO: 1826574 - DNA, 16 bp, Homo sapiens
atgcaatgcaattcaa

SEQ ID NO: 1826575 - DNA, 14 bp, Homo sapiens
atgcaattcaatgc

SEQ ID NO: 1826576 - DNA, 14 bp, Homo sapiens
atgcacatcctcat

SEQ ID NO: 1826577 - DNA, 16 bp, Homo sapiens
atgcagattcctgggc

SEQ ID NO: 1826578 - DNA, 15 bp, Homo sapiens
atgcatatttctatg

SEQ ID NO: 1826579 - DNA, 17 bp, Homo sapiens
atgcatatttctatgtt

SEQ ID NO: 1826580 - DNA, 22 bp, Homo sapiens
atgccacaccaagctgtgccac

SEQ ID NO: 1826581 - DNA, 23 bp, Homo sapiens
atgccacaccaagctgtgccacc

SEQ ID NO: 1826582 - DNA, 13 bp, Homo sapiens
atgccactgccag

SEQ ID NO: 1826583 - DNA, 23 bp, Homo sapiens
atgccactgccaggcacctggcc

SEQ ID NO: 1826584 - DNA, 19 bp, Homo sapiens
atgcccagcacaattcatt

SEQ ID NO: 1826585 - DNA, 18 bp, Homo sapiens
atgccccctcgtgccagt

SEQ ID NO: 1826586 - DNA, 17 bp, Homo sapiens
atgcctataaaatgccc

SEQ ID NO: 1826587 - DNA, 13 bp, Homo sapiens
atgcctggccccc

SEQ ID NO: 1826588 - DNA, 18 bp, Homo sapiens
atgcctggcccccctcca

SEQ ID NO: 1826589 - DNA, 19 bp, Homo sapiens
atgcctggcccccctccag

SEQ ID NO: 1826590 - DNA, 22 bp, Homo sapiens
atgcctggcccccctccaggca

SEQ ID NO: 1826591 - DNA, 19 bp, Homo sapiens
atgctcaacccccctccca

SEQ ID NO: 1826592 - DNA, 21 bp, Homo sapiens
atgctcaacccccctcccaga

SEQ ID NO: 1826593 - DNA, 21 bp, Homo sapiens
atgctgccccgttccctgtca

SEQ ID NO: 1826594 - DNA, 22 bp, Homo sapiens
atgctgccttcagggagacagg

SEQ ID NO: 1826595 - DNA, 19 bp, Homo sapiens
atgctgctttttggcacag

SEQ ID NO: 1826596 - DNA, 20 bp, Homo sapiens
atgctgctttttggcacagt

SEQ ID NO: 1826597 - DNA, 22 bp, Homo sapiens
atgctgggcactgccagactga

SEQ ID NO: 1826598 - DNA, 14 bp, Homo sapiens
atgctgggctgggt

SEQ ID NO: 1826599 - DNA, 16 bp, Homo sapiens
atgctgggctgggtgc

SEQ ID NO: 1826600 - DNA, 15 bp, Homo sapiens
atgctttctcctttt

SEQ ID NO: 1826601 - DNA, 18 bp, Homo sapiens
atgctttgggaggccaag

SEQ ID NO: 1826602 - DNA, 19 bp, Homo sapiens
atggaagggccttctccac

SEQ ID NO: 1826603 - DNA, 19 bp, Homo sapiens
atggaccgggtgggcctgg

SEQ ID NO: 1826604 - DNA, 20 bp, Homo sapiens
atggaccgggtgggcctggc

SEQ ID NO: 1826605 - DNA, 21 bp, Homo sapiens
atggaccgggtgggcctggcc

SEQ ID NO: 1826606 - DNA, 18 bp, Homo sapiens
atggagattctgattcag

SEQ ID NO: 1826607 - DNA, 14 bp, Homo sapiens
atggcaccagcccc

SEQ ID NO: 1826608 - DNA, 19 bp, Homo sapiens
atggcagctagactggagt

SEQ ID NO: 1826609 - DNA, 16 bp, Homo sapiens
atggccagcgattatt

SEQ ID NO: 1826610 - DNA, 12 bp, Homo sapiens
atggccttccct

SEQ ID NO: 1826611 - DNA, 14 bp, Homo sapiens
atggccttccctcc

SEQ ID NO: 1826612 - DNA, 18 bp, Homo sapiens
atggccttccctccccac

SEQ ID NO: 1826613 - DNA, 20 bp, Homo sapiens
atggcgtaatgggcctgccc

SEQ ID NO: 1826614 - DNA, 12 bp, Homo sapiens
atggctcaggca

SEQ ID NO: 1826615 - DNA, 16 bp, Homo sapiens
atggctcaggcaagcc

SEQ ID NO: 1826616 - DNA, 19 bp, Homo sapiens
atggctcaggcaagcccct

SEQ ID NO: 1826617 - DNA, 15 bp, Homo sapiens
atggctctcaagtga

SEQ ID NO: 1826618 - DNA, 21 bp, Homo sapiens
atggcttccaaggtggtctgc

SEQ ID NO: 1826619 - DNA, 13 bp, Homo sapiens
tctatttttgcac

SEQ ID NO: 1826620 - DNA, 18 bp, Homo sapiens
tagccatggctcaggcaa

SEQ ID NO: 1826621 - DNA, 21 bp, Homo sapiens
tagcctccgtttatgggcctt

SEQ ID NO: 1826622 - DNA, 16 bp, Homo sapiens
tagccttgtgccctgc

SEQ ID NO: 1826623 - DNA, 19 bp, Homo sapiens
tagccttgtgccctgcccc

SEQ ID NO: 1826624 - DNA, 17 bp, Homo sapiens
tagctgaacaatgaatg

SEQ ID NO: 1826625 - DNA, 11 bp, Homo sapiens
tagctggcagg

SEQ ID NO: 1826626 - DNA, 13 bp, Homo sapiens
tagctggcaggac

SEQ ID NO: 1826627 - DNA, 16 bp, Homo sapiens
tagctggcaggacaca

SEQ ID NO: 1826628 - DNA, 15 bp, Homo sapiens
tagcttgaaaacttg

SEQ ID NO: 1826629 - DNA, 17 bp, Homo sapiens
taggaagaaaaatgttt

SEQ ID NO: 1826630 - DNA, 16 bp, Homo sapiens
taggaagcctgaggca

SEQ ID NO: 1826631 - DNA, 12 bp, Homo sapiens
taggataaatta

SEQ ID NO: 1826632 - DNA, 21 bp, Homo sapiens
taggatactcttaatctcact

SEQ ID NO: 1826633 - DNA, 19 bp, Homo sapiens
taggcccttgtcctgccag

SEQ ID NO: 1826634 - DNA, 22 bp, Homo sapiens
tccacggtgcgtggctgtggca

SEQ ID NO: 1826635 - DNA, 23 bp, Homo sapiens
tccacggtgcgtggctgtggcac

SEQ ID NO: 1826636 - DNA, 12 bp, Homo sapiens
tccactcccact

SEQ ID NO: 1826637 - DNA, 18 bp, Homo sapiens
tccactcccccacctgac

SEQ ID NO: 1826638 - DNA, 21 bp, Homo sapiens
tccactgaaatagagtgaatt

SEQ ID NO: 1826639 - DNA, 17 bp, Homo sapiens
tccactttttccagaat

SEQ ID NO: 1826640 - DNA, 15 bp, Homo sapiens
tccagaatctgctgt

SEQ ID NO: 1826641 - DNA, 18 bp, Homo sapiens
tccagagccagcctggga

SEQ ID NO: 1826642 - DNA, 20 bp, Homo sapiens
tccagagccagcctgggact

SEQ ID NO: 1826643 - DNA, 22 bp, Homo sapiens
tccagagtctgagcccccggct

SEQ ID NO: 1826644 - DNA, 14 bp, Homo sapiens
tccagcagctgcgg

SEQ ID NO: 1826645 - DNA, 15 bp, Homo sapiens
tccagcagctgcggg

SEQ ID NO: 1826646 - DNA, 23 bp, Homo sapiens
tccagcagctgcgggtctgaagg

SEQ ID NO: 1826647 - DNA, 14 bp, Homo sapiens
tccagcatccagcc

SEQ ID NO: 1826648 - DNA, 18 bp, Homo sapiens
tccagcatccagcctgtg

SEQ ID NO: 1826649 - DNA, 15 bp, Homo sapiens
tccagcctcccctcc

SEQ ID NO: 1826650 - DNA, 19 bp, Homo sapiens
tccagcctcccctcccctg

SEQ ID NO: 1826651 - DNA, 13 bp, Homo sapiens
tccagcctctccc

SEQ ID NO: 1826652 - DNA, 23 bp, Homo sapiens
tccagcctctcccggctgcctgc

SEQ ID NO: 1826653 - DNA, 13 bp, Homo sapiens
tccaggaaggcag

SEQ ID NO: 1826654 - DNA, 15 bp, Homo sapiens
tccaggaaggcagct

SEQ ID NO: 1826655 - DNA, 18 bp, Homo sapiens
tccaggaaggcagctgct

SEQ ID NO: 1826656 - DNA, 21 bp, Homo sapiens
tccaggaaggcagctgctctt

SEQ ID NO: 1826657 - DNA, 16 bp, Homo sapiens
tccaggatcctgcagg

SEQ ID NO: 1826658 - DNA, 17 bp, Homo sapiens
tccaggatcctgcagga

SEQ ID NO: 1826659 - DNA, 18 bp, Homo sapiens
tccaggcatgctggcctc

SEQ ID NO: 1826660 - DNA, 19 bp, Homo sapiens
tccaggcatgctggcctcc

SEQ ID NO: 1826661 - DNA, 14 bp, Homo sapiens
tccaggccactgtg

SEQ ID NO: 1826662 - DNA, 23 bp, Homo sapiens
tccaggccactgtggccagagct

SEQ ID NO: 1826663 - DNA, 16 bp, Homo sapiens
tccaggcccctgagga

SEQ ID NO: 1826664 - DNA, 22 bp, Homo sapiens
tccaggcccctgaggactggag

SEQ ID NO: 1826665 - DNA, 14 bp, Homo sapiens
tccaggctcttcct

SEQ ID NO: 1826666 - DNA, 19 bp, Homo sapiens
tccaggctcttcctggacc

SEQ ID NO: 1826667 - DNA, 22 bp, Homo sapiens
tccaggctcttcctggacctga

SEQ ID NO: 1826668 - DNA, 13 bp, Homo sapiens
tccagggctgccc

SEQ ID NO: 1826669 - DNA, 15 bp, Homo sapiens
tccagggtcttgggc

SEQ ID NO: 1826670 - DNA, 17 bp, Homo sapiens
tccagttctgatgaggc

SEQ ID NO: 1826671 - DNA, 12 bp, Homo sapiens
tccataaggatt

SEQ ID NO: 1826672 - DNA, 13 bp, Homo sapiens
tccatcccctccc

SEQ ID NO: 1826673 - DNA, 16 bp, Homo sapiens
tccatcccctccctgc

SEQ ID NO: 1826674 - DNA, 18 bp, Homo sapiens
tccatcccctccctgcct

SEQ ID NO: 1826675 - DNA, 21 bp, Homo sapiens
tccatcccctccctgcctgct

SEQ ID NO: 1826676 - DNA, 16 bp, Homo sapiens
tccatggcaccagccc

SEQ ID NO: 1826677 - DNA, 18 bp, Homo sapiens
tccatggcaccagccccc

SEQ ID NO: 1826678 - DNA, 12 bp, Homo sapiens
tcccaataaagc

SEQ ID NO: 1826679 - DNA, 15 bp, Homo sapiens
tcccaataaagctgg

SEQ ID NO: 1826680 - DNA, 16 bp, Homo sapiens
tcccaataaagctgga

SEQ ID NO: 1826681 - DNA, 16 bp, Homo sapiens
tcccacagcttcctga

SEQ ID NO: 1826682 - DNA, 23 bp, Homo sapiens
tcccacagtgactcgggctcctg

SEQ ID NO: 1826683 - DNA, 21 bp, Homo sapiens
tcccaccagaacgcaccccac

SEQ ID NO: 1826684 - DNA, 17 bp, Homo sapiens
tcccaccccggcctcca

SEQ ID NO: 1826685 - DNA, 18 bp, Homo sapiens
tcccactgcaccccctcc

SEQ ID NO: 1826686 - DNA, 17 bp, Homo sapiens
tcccacttccctgacac

SEQ ID NO: 1826687 - DNA, 16 bp, Homo sapiens
tcccagacaggccctc

SEQ ID NO: 1826688 - DNA, 17 bp, Homo sapiens
tcccagacaggccctcc

SEQ ID NO: 1826689 - DNA, 22 bp, Homo sapiens
tcccagacaggccctccctgtc

SEQ ID NO: 1826690 - DNA, 20 bp, Homo sapiens
tcccagaggttatctgcctg

SEQ ID NO: 1826691 - DNA, 18 bp, Homo sapiens
tcccagctgacagtcctc

SEQ ID NO: 1826692 - DNA, 22 bp, Homo sapiens
tcccagctgacagtcctctcca

SEQ ID NO: 1826693 - DNA, 24 bp, Homo sapiens
tcccagctgacagtcctctccacc

SEQ ID NO: 1826694 - DNA, 19 bp, Homo sapiens
tcccaggtaagcaggagga

SEQ ID NO: 1826695 - DNA, 19 bp, Homo sapiens
tcccagtgtcttcctgtgg

SEQ ID NO: 1826696 - DNA, 13 bp, Homo sapiens
tcccatggccttc

SEQ ID NO: 1826697 - DNA, 23 bp, Homo sapiens
tcccatggtagactgtgacacag

SEQ ID NO: 1826698 - DNA, 23 bp, Homo sapiens
tccccacagtcctcacagcctct

SEQ ID NO: 1826699 - DNA, 20 bp, Homo sapiens
tccccacgagtcacctgcaa

SEQ ID NO: 1826700 - DNA, 12 bp, Homo sapiens
tccccagccctt

SEQ ID NO: 1826701 - DNA, 16 bp, Homo sapiens
tccccagcccttctgc

SEQ ID NO: 1826702 - DNA, 12 bp, Homo sapiens
tccccaggcctc

SEQ ID NO: 1826703 - DNA, 15 bp, Homo sapiens
tccccaggcctccag

SEQ ID NO: 1826704 - DNA, 21 bp, Homo sapiens
tccccaggcctccagcctctc

SEQ ID NO: 1826705 - DNA, 15 bp, Homo sapiens
tccccagggcccctc

SEQ ID NO: 1826706 - DNA, 21 bp, Homo sapiens
tccccagggcccctccctctg

SEQ ID NO: 1826707 - DNA, 20 bp, Homo sapiens
tccccatgtgcctgcaccag

SEQ ID NO: 1826708 - DNA, 17 bp, Homo sapiens
tcccccatgtggctgaa

SEQ ID NO: 1826709 - DNA, 14 bp, Homo sapiens
tcccccccggggct

SEQ ID NO: 1826710 - DNA, 14 bp, Homo sapiens
tcccccctcaccag

SEQ ID NO: 1826711 - DNA, 18 bp, Homo sapiens
tcccccgacactgctgca

SEQ ID NO: 1826712 - DNA, 21 bp, Homo sapiens
tccccgagggatgatgccaca

SEQ ID NO: 1826713 - DNA, 22 bp, Homo sapiens
tccccgagggatgatgccacac

SEQ ID NO: 1826714 - DNA, 18 bp, Homo sapiens
tcccctccctgcctgctc

SEQ ID NO: 1826715 - DNA, 20 bp, Homo sapiens
tcccctcgtcctgtcccaga

SEQ ID NO: 1826716 - DNA, 23 bp, Homo sapiens
tcccctcgtcctgtcccagaggt

SEQ ID NO: 1826717 - DNA, 15 bp, Homo sapiens
tccccttttgcctgg

SEQ ID NO: 1826718 - DNA, 17 bp, Homo sapiens
tccccttttgcctggct

SEQ ID NO: 1826719 - DNA, 12 bp, Homo sapiens
tcccggctgcct

SEQ ID NO: 1826720 - DNA, 16 bp, Homo sapiens
tcccgtggccccagcc

SEQ ID NO: 1826721 - DNA, 17 bp, Homo sapiens
tcccgtggccccagcct

SEQ ID NO: 1826722 - DNA, 18 bp, Homo sapiens
tcccgtggccccagcctg

SEQ ID NO: 1826723 - DNA, 20 bp, Homo sapiens
tcccgtggccccagcctggc

SEQ ID NO: 1826724 - DNA, 16 bp, Homo sapiens
tccctgacactgcggg

SEQ ID NO: 1826725 - DNA, 23 bp, Homo sapiens
tccctgcctgctccttggcaccc

SEQ ID NO: 1826726 - DNA, 15 bp, Homo sapiens
tccctgcttgcccgc

SEQ ID NO: 1826727 - DNA, 22 bp, Homo sapiens
tccctggatgtgtggggcatgg

SEQ ID NO: 1826728 - DNA, 14 bp, Homo sapiens
tccctgtcagaggc

SEQ ID NO: 1826729 - DNA, 23 bp, Homo sapiens
tccctgtctccagggcccccacc

SEQ ID NO: 1826730 - DNA, 16 bp, Homo sapiens
tcccttcctggcctca

SEQ ID NO: 1826731 - DNA, 13 bp, Homo sapiens
tcccttgaccatt

SEQ ID NO: 1826732 - DNA, 22 bp, Homo sapiens
tcccttgaccattggctgcgct

SEQ ID NO: 1826733 - DNA, 23 bp, Homo sapiens
tccgcaccagctgctctgcccct

SEQ ID NO: 1826734 - DNA, 16 bp, Homo sapiens
tccggggtctgtgctg

SEQ ID NO: 1826735 - DNA, 18 bp, Homo sapiens
tccggggtctgtgctgtg

SEQ ID NO: 1826736 - DNA, 14 bp, Homo sapiens
tccgggtgccattc

SEQ ID NO: 1826737 - DNA, 14 bp, Homo sapiens
tccgtccacccagg

SEQ ID NO: 1826738 - DNA, 17 bp, Homo sapiens
tccgtccacccaggctg

SEQ ID NO: 1826739 - DNA, 20 bp, Homo sapiens
tccgtccacccaggctgcac

SEQ ID NO: 1826740 - DNA, 21 bp, Homo sapiens
tccgtccacccaggctgcact

SEQ ID NO: 1826741 - DNA, 22 bp, Homo sapiens
tccgtccacccaggctgcactg

SEQ ID NO: 1826742 - DNA, 18 bp, Homo sapiens
tccgtttatgggccttgc

SEQ ID NO: 1826743 - DNA, 18 bp, Homo sapiens
tcctaaagagttattcaa

SEQ ID NO: 1826744 - DNA, 13 bp, Homo sapiens
ggccccagatctg

SEQ ID NO: 1826745 - DNA, 17 bp, Homo sapiens
ggccccagatctgcctg

SEQ ID NO: 1826746 - DNA, 21 bp, Homo sapiens
ggccccagatctgcctgggcc

SEQ ID NO: 1826747 - DNA, 13 bp, Homo sapiens
ggccccagcctgg

SEQ ID NO: 1826748 - DNA, 14 bp, Homo sapiens
ggccccagcctggc

SEQ ID NO: 1826749 - DNA, 15 bp, Homo sapiens
ggccccagcctggcc

SEQ ID NO: 1826750 - DNA, 19 bp, Homo sapiens
ggccccagcctggcccagc

SEQ ID NO: 1826751 - DNA, 17 bp, Homo sapiens
ggccccatgctctgccc

SEQ ID NO: 1826752 - DNA, 18 bp, Homo sapiens
ggccccatgctctgcccc

SEQ ID NO: 1826753 - DNA, 21 bp, Homo sapiens
ggccccatgctctgccccaag

SEQ ID NO: 1826754 - DNA, 14 bp, Homo sapiens
ggcccccctccagg

SEQ ID NO: 1826755 - DNA, 18 bp, Homo sapiens
ggcccccctccaggcatg

SEQ ID NO: 1826756 - DNA, 19 bp, Homo sapiens
ggcccccctccaggcatgc

SEQ ID NO: 1826757 - DNA, 13 bp, Homo sapiens
ggccccggggctg

SEQ ID NO: 1826758 - DNA, 18 bp, Homo sapiens
ggccccggggctggcaag

SEQ ID NO: 1826759 - DNA, 14 bp, Homo sapiens
ggcccctccctctg

SEQ ID NO: 1826760 - DNA, 18 bp, Homo sapiens
ggcccctccctctgcccc

SEQ ID NO: 1826761 - DNA, 19 bp, Homo sapiens
ggcccctccctctgcccca

SEQ ID NO: 1826762 - DNA, 21 bp, Homo sapiens
ggcccctccctctgccccaag

SEQ ID NO: 1826763 - DNA, 14 bp, Homo sapiens
ggcccctgccttgg

SEQ ID NO: 1826764 - DNA, 13 bp, Homo sapiens
ggcccgcttgcct

SEQ ID NO: 1826765 - DNA, 17 bp, Homo sapiens
ggcccgcttgcctcggc

SEQ ID NO: 1826766 - DNA, 23 bp, Homo sapiens
ggcccgcttgcctcggctcctgc

SEQ ID NO: 1826767 - DNA, 19 bp, Homo sapiens
ggcccgttgtctccctggc

SEQ ID NO: 1826768 - DNA, 20 bp, Homo sapiens
ggcccgttgtctccctggcc

SEQ ID NO: 1826769 - DNA, 20 bp, Homo sapiens
ggccctcaaggcctcccaca

SEQ ID NO: 1826770 - DNA, 21 bp, Homo sapiens
ggccctgcactgtcctgctcc

SEQ ID NO: 1826771 - DNA, 18 bp, Homo sapiens
ggcccttggggcctggct

SEQ ID NO: 1826772 - DNA, 20 bp, Homo sapiens
ggcccttggggcctggcttg

SEQ ID NO: 1826773 - DNA, 15 bp, Homo sapiens
ggcccttgtcctgcc

SEQ ID NO: 1826774 - DNA, 19 bp, Homo sapiens
ggcccttgtcctgccagct

SEQ ID NO: 1826775 - DNA, 21 bp, Homo sapiens
ggcccttgtcctgccagctgc

SEQ ID NO: 1826776 - DNA, 22 bp, Homo sapiens
ggcccttgtcctgccagctgcc

SEQ ID NO: 1826777 - DNA, 14 bp, Homo sapiens
ggccggccaggtgg

SEQ ID NO: 1826778 - DNA, 19 bp, Homo sapiens
ggcctcactggctggggca

SEQ ID NO: 1826779 - DNA, 21 bp, Homo sapiens
ggcctcagtttctccatcagc

SEQ ID NO: 1826780 - DNA, 13 bp, Homo sapiens
ggcctcatccctc

SEQ ID NO: 1826781 - DNA, 14 bp, Homo sapiens
ggcctcatccctcg

SEQ ID NO: 1826782 - DNA, 12 bp, Homo sapiens
ggcctccactcc

SEQ ID NO: 1826783 - DNA, 14 bp, Homo sapiens
ggcctccactcccc

SEQ ID NO: 1826784 - DNA, 18 bp, Homo sapiens
ggcctccagcctctcccg

SEQ ID NO: 1826785 - DNA, 17 bp, Homo sapiens
ggcctcccaataaagct

SEQ ID NO: 1826786 - DNA, 19 bp, Homo sapiens
ggcctcccaataaagctgg

SEQ ID NO: 1826787 - DNA, 20 bp, Homo sapiens
ggcctcccaataaagctgga

SEQ ID NO: 1826788 - DNA, 15 bp, Homo sapiens
ggcctcgcctggcct

SEQ ID NO: 1826789 - DNA, 16 bp, Homo sapiens
ggcctcttccacccat

SEQ ID NO: 1826790 - DNA, 16 bp, Homo sapiens
ggcctgactctcagca

SEQ ID NO: 1826791 - DNA, 17 bp, Homo sapiens
ggcctgagctggggcca

SEQ ID NO: 1826792 - DNA, 15 bp, Homo sapiens
ggcctgatgctgccc

SEQ ID NO: 1826793 - DNA, 16 bp, Homo sapiens
ggcctgatgctgcccc

SEQ ID NO: 1826794 - DNA, 15 bp, Homo sapiens
ggcctgcccaatgct

SEQ ID NO: 1826795 - DNA, 21 bp, Homo sapiens
ggcctgcccaatgctttggga

SEQ ID NO: 1826796 - DNA, 22 bp, Homo sapiens
ggcctgctgggaaccccgcagc

SEQ ID NO: 1826797 - DNA, 13 bp, Homo sapiens
gtcatgtaatact

SEQ ID NO: 1826798 - DNA, 15 bp, Homo sapiens
gtcatgtaatactga

SEQ ID NO: 1826799 - DNA, 13 bp, Homo sapiens
gtccaagggccat

SEQ ID NO: 1826800 - DNA, 21 bp, Homo sapiens
gtccaagggccatacttttga

SEQ ID NO: 1826801 - DNA, 19 bp, Homo sapiens
gtccacaggggcaggcctg

SEQ ID NO: 1826802 - DNA, 20 bp, Homo sapiens
gtccacaggggcaggcctgg

SEQ ID NO: 1826803 - DNA, 14 bp, Homo sapiens
gtccacccaggctg

SEQ ID NO: 1826804 - DNA, 15 bp, Homo sapiens
gtccacccaggctgc

SEQ ID NO: 1826805 - DNA, 16 bp, Homo sapiens
gtccacccaggctgca

SEQ ID NO: 1826806 - DNA, 20 bp, Homo sapiens
gtccagcagctgcgggtctg

SEQ ID NO: 1826807 - DNA, 16 bp, Homo sapiens
gtccaggaaggcagct

SEQ ID NO: 1826808 - DNA, 19 bp, Homo sapiens
gtccaggaaggcagctgct

SEQ ID NO: 1826809 - DNA, 20 bp, Homo sapiens
gtccaggaaggcagctgctc

SEQ ID NO: 1826810 - DNA, 21 bp, Homo sapiens
gtccaggaaggcagctgctct

SEQ ID NO: 1826811 - DNA, 12 bp, Homo sapiens
gtccagtgccca

SEQ ID NO: 1826812 - DNA, 24 bp, Homo sapiens
gtccagtgggaggtgagaccacct

SEQ ID NO: 1826813 - DNA, 16 bp, Homo sapiens
gtccatggcaccagcc

SEQ ID NO: 1826814 - DNA, 18 bp, Homo sapiens
gtccatggcaccagcccc

SEQ ID NO: 1826815 - DNA, 21 bp, Homo sapiens
gtcccaagtagtagtgtcttc

SEQ ID NO: 1826816 - DNA, 21 bp, Homo sapiens
gtcccacttcccctcctaccc

SEQ ID NO: 1826817 - DNA, 22 bp, Homo sapiens
gtcccagaggttatctgcctgg

SEQ ID NO: 1826818 - DNA, 23 bp, Homo sapiens
gtcccagaggttatctgcctggc

SEQ ID NO: 1826819 - DNA, 12 bp, Homo sapiens
gtccccagggcc

SEQ ID NO: 1826820 - DNA, 22 bp, Homo sapiens
gtcccctctgtcatcactccct

SEQ ID NO: 1826821 - DNA, 13 bp, Homo sapiens
gtcccctcttgcc

SEQ ID NO: 1826822 - DNA, 19 bp, Homo sapiens
gtcccgccttcctcctcca

SEQ ID NO: 1826823 - DNA, 15 bp, Homo sapiens
gtccctggtccctcg

SEQ ID NO: 1826824 - DNA, 19 bp, Homo sapiens
gtccgcaccagctgctctg

SEQ ID NO: 1826825 - DNA, 20 bp, Homo sapiens
gtccgcaccagctgctctgc

SEQ ID NO: 1826826 - DNA, 19 bp, Homo sapiens
gtcctcacctggttgaccc

SEQ ID NO: 1826827 - DNA, 13 bp, Homo sapiens
gtcctctccacct

SEQ ID NO: 1826828 - DNA, 20 bp, Homo sapiens
gtcctctccacctagtggct

SEQ ID NO: 1826829 - DNA, 23 bp, Homo sapiens
gtcctctttactcccttcctggc

SEQ ID NO: 1826830 - DNA, 15 bp, Homo sapiens
gtcctgacgccctgc

SEQ ID NO: 1826831 - DNA, 17 bp, Homo sapiens
gtcctgacttcaggggc

SEQ ID NO: 1826832 - DNA, 17 bp, Homo sapiens
gtcctgcaatctccagg

SEQ ID NO: 1826833 - DNA, 13 bp, Homo sapiens
gtcctgcagagga

SEQ ID NO: 1826834 - DNA, 11 bp, Homo sapiens
gtcctgccagc

SEQ ID NO: 1826835 - DNA, 14 bp, Homo sapiens
gtcctgctccacag

SEQ ID NO: 1826836 - DNA, 14 bp, Homo sapiens
gtcctgtcagtgcc

SEQ ID NO: 1826837 - DNA, 19 bp, Homo sapiens
gtcctgtcagtgccgccgc

SEQ ID NO: 1826838 - DNA, 20 bp, Homo sapiens
gtccttcagtgagcccctcc

SEQ ID NO: 1826839 - DNA, 17 bp, Homo sapiens
gtcgcaggatccgctgc

SEQ ID NO: 1826840 - DNA, 13 bp, Homo sapiens
gtcgcgctgcctg

SEQ ID NO: 1826841 - DNA, 17 bp, Homo sapiens
gtcggactgcccccaga

SEQ ID NO: 1826842 - DNA, 13 bp, Homo sapiens
gtctaaacaatga

SEQ ID NO: 1826843 - DNA, 23 bp, Homo sapiens
gtctaaacaatgaattcttcaac

SEQ ID NO: 1826844 - DNA, 17 bp, Homo sapiens
gtctacctgagcattca

SEQ ID NO: 1826845 - DNA, 14 bp, Homo sapiens
gtctattctgagcc

SEQ ID NO: 1826846 - DNA, 16 bp, Homo sapiens
gtctattctgagcctt

SEQ ID NO: 1826847 - DNA, 18 bp, Homo sapiens
gtctattctgagccttga

SEQ ID NO: 1826848 - DNA, 16 bp, Homo sapiens
gtctcatttaggactg

SEQ ID NO: 1826849 - DNA, 14 bp, Homo sapiens
gtctccctggccct

SEQ ID NO: 1826850 - DNA, 14 bp, Homo sapiens
gtctcctccaccgc

SEQ ID NO: 1826851 - DNA, 18 bp, Homo sapiens
gtctcctgtatcatttct

SEQ ID NO: 1826852 - DNA, 18 bp, Homo sapiens
gtctccttactctgagcc

SEQ ID NO: 1826853 - DNA, 19 bp, Homo sapiens
gtctccttactctgagccc

SEQ ID NO: 1826854 - DNA, 20 bp, Homo sapiens
gtctccttactctgagccca

SEQ ID NO: 1826855 - DNA, 22 bp, Homo sapiens
gtctccttactctgagcccagg

SEQ ID NO: 1826856 - DNA, 19 bp, Homo sapiens
gtctcgctgatgctgggct

SEQ ID NO: 1826857 - DNA, 16 bp, Homo sapiens
gtctcggtggtaccag

SEQ ID NO: 1826858 - DNA, 14 bp, Homo sapiens
gtctgactccagag

SEQ ID NO: 1826859 - DNA, 16 bp, Homo sapiens
gtctgactccagagtc

SEQ ID NO: 1826860 - DNA, 20 bp, Homo sapiens
gtctgactccagagtctgag

SEQ ID NO: 1826861 - DNA, 14 bp, Homo sapiens
gtctgaggcctcat

SEQ ID NO: 1826862 - DNA, 19 bp, Homo sapiens
gtctgaggcctcatccctc

SEQ ID NO: 1826863 - DNA, 22 bp, Homo sapiens
gtctgctcgggcccaggccatc

SEQ ID NO: 1826864 - DNA, 11 bp, Homo sapiens
gtctgggctga

SEQ ID NO: 1826865 - DNA, 14 bp, Homo sapiens
gtctgtctgtctgt

SEQ ID NO: 1826866 - DNA, 15 bp, Homo sapiens
gtctgtgctgtgcct

SEQ ID NO: 1826867 - DNA, 11 bp, Homo sapiens
gtctgtgtgtg

SEQ ID NO: 1826868 - DNA, 16 bp, Homo sapiens
gtctgtgtgtgtgtat

SEQ ID NO: 1826869 - DNA, 14 bp, Homo sapiens
gtcttatttttcta

SEQ ID NO: 1826870 - DNA, 14 bp, Homo sapiens
gtcttcctgtgggg

SEQ ID NO: 1826871 - DNA, 20 bp, Homo sapiens
gtcttgagagaaaagaaaaa

SEQ ID NO: 1826872 - DNA, 16 bp, Homo sapiens
gtcttgggctactggc

SEQ ID NO: 1826873 - DNA, 22 bp, Homo sapiens
gtcttgggctactggcagctcc

SEQ ID NO: 1826874 - DNA, 22 bp, Homo sapiens
gtgaaattcaacctgtgtctta

SEQ ID NO: 1826875 - DNA, 20 bp, Homo sapiens
gtgaactattttgaagaaaa

SEQ ID NO: 1826876 - DNA, 16 bp, Homo sapiens
gtgaagcagtgcctcg

SEQ ID NO: 1826877 - DNA, 17 bp, Homo sapiens
taatgagtcacaaaata

SEQ ID NO: 1826878 - DNA, 13 bp, Homo sapiens
taatgcacatcct

SEQ ID NO: 1826879 - DNA, 21 bp, Homo sapiens
taatgcacatcctcattcact

SEQ ID NO: 1826880 - DNA, 20 bp, Homo sapiens
taatgccacacattgtgctt

SEQ ID NO: 1826881 - DNA, 14 bp, Homo sapiens
taatgggcctgccc

SEQ ID NO: 1826882 - DNA, 19 bp, Homo sapiens
taatggtgttactaaagtc

SEQ ID NO: 1826883 - DNA, 21 bp, Homo sapiens
taatgtaatactgtagaaata

SEQ ID NO: 1826884 - DNA, 17 bp, Homo sapiens
taattctgggaagggag

SEQ ID NO: 1826885 - DNA, 15 bp, Homo sapiens
taattcttcattata

SEQ ID NO: 1826886 - DNA, 19 bp, Homo sapiens
taattctttgacctgttgg

SEQ ID NO: 1826887 - DNA, 13 bp, Homo sapiens
taattcttttcaa

SEQ ID NO: 1826888 - DNA, 14 bp, Homo sapiens
taattcttttcaaa

SEQ ID NO: 1826889 - DNA, 19 bp, Homo sapiens
taattcttttcaaaattgt

SEQ ID NO: 1826890 - DNA, 18 bp, Homo sapiens
taattgcaacaatgcaaa

SEQ ID NO: 1826891 - DNA, 19 bp, Homo sapiens
taattgcaacaatgcaaaa

SEQ ID NO: 1826892 - DNA, 14 bp, Homo sapiens
taattgcatttaaa

SEQ ID NO: 1826893 - DNA, 20 bp, Homo sapiens
taatttaaaattgtgatgtg

SEQ ID NO: 1826894 - DNA, 20 bp, Homo sapiens
taatttttgctgaattcctt

SEQ ID NO: 1826895 - DNA, 20 bp, Homo sapiens
tacaaaaacatacttcaaaa

SEQ ID NO: 1826896 - DNA, 15 bp, Homo sapiens
tacaactaaataaca

SEQ ID NO: 1826897 - DNA, 23 bp, Homo sapiens
tacacataagaccgtgtcccaag

SEQ ID NO: 1826898 - DNA, 17 bp, Homo sapiens
tacacatatatgtatat

SEQ ID NO: 1826899 - DNA, 16 bp, Homo sapiens
tacactaaatgatatt

SEQ ID NO: 1826900 - DNA, 15 bp, Homo sapiens
tacactgcatctcaa

SEQ ID NO: 1826901 - DNA, 13 bp, Homo sapiens
tacagaatgaatc

SEQ ID NO: 1826902 - DNA, 19 bp, Homo sapiens
tacagaatttatagaataa

SEQ ID NO: 1826903 - DNA, 14 bp, Homo sapiens
tacagaggacagta

SEQ ID NO: 1826904 - DNA, 20 bp, Homo sapiens
tacaggcaaaacacgcaagg

SEQ ID NO: 1826905 - DNA, 16 bp, Homo sapiens
tacaggggcagtgcct

SEQ ID NO: 1826906 - DNA, 19 bp, Homo sapiens
tacagtatcttcaaaaata

SEQ ID NO: 1826907 - DNA, 12 bp, Homo sapiens
tacagtgcagtt

SEQ ID NO: 1826908 - DNA, 16 bp, Homo sapiens
tacattatattcctct

SEQ ID NO: 1826909 - DNA, 15 bp, Homo sapiens
tacattatgttattg

SEQ ID NO: 1826910 - DNA, 21 bp, Homo sapiens
tacattatgttattggaattt

SEQ ID NO: 1826911 - DNA, 22 bp, Homo sapiens
tacattatgttattggaatttt

SEQ ID NO: 1826912 - DNA, 13 bp, Homo sapiens
tacattttcctgt

SEQ ID NO: 1826913 - DNA, 14 bp, Homo sapiens
tacattttcctgtg

SEQ ID NO: 1826914 - DNA, 14 bp, Homo sapiens
taccaggtctcctc

SEQ ID NO: 1826915 - DNA, 18 bp, Homo sapiens
taccaggtctcctccacc

SEQ ID NO: 1826916 - DNA, 22 bp, Homo sapiens
taccaggtctcctccaccgcca

SEQ ID NO: 1826917 - DNA, 13 bp, Homo sapiens
taccatgctgctt

SEQ ID NO: 1826918 - DNA, 19 bp, Homo sapiens
taccccaagtccacctgcc

SEQ ID NO: 1826919 - DNA, 20 bp, Homo sapiens
taccccaagtccacctgcct

SEQ ID NO: 1826920 - DNA, 21 bp, Homo sapiens
taccccacctcatgcctggcc

SEQ ID NO: 1826921 - DNA, 19 bp, Homo sapiens
taccccccctcctgctgcc

SEQ ID NO: 1826922 - DNA, 20 bp, Homo sapiens
tacccccgcccaggctggcc

SEQ ID NO: 1826923 - DNA, 22 bp, Homo sapiens
tacccccgcccaggctggccag

SEQ ID NO: 1826924 - DNA, 10 bp, Homo sapiens
tacccctccc

SEQ ID NO: 1826925 - DNA, 13 bp, Homo sapiens
tacccctcccagc

SEQ ID NO: 1826926 - DNA, 16 bp, Homo sapiens
tacccctcccagctga

SEQ ID NO: 1826927 - DNA, 12 bp, Homo sapiens
taccctcccacc

SEQ ID NO: 1826928 - DNA, 14 bp, Homo sapiens
taccctccctgctg

SEQ ID NO: 1826929 - DNA, 15 bp, Homo sapiens
taccctccctgctgt

SEQ ID NO: 1826930 - DNA, 22 bp, Homo sapiens
taccctccctgctgtcccctct

SEQ ID NO: 1826931 - DNA, 14 bp, Homo sapiens
tacccttccacctc

SEQ ID NO: 1826932 - DNA, 14 bp, Homo sapiens
tacctatgtgagtt

SEQ ID NO: 1826933 - DNA, 15 bp, Homo sapiens
tacctgagcattcag

SEQ ID NO: 1826934 - DNA, 16 bp, Homo sapiens
tactagaaccttctaa

SEQ ID NO: 1826935 - DNA, 12 bp, Homo sapiens
tactcagagcag

SEQ ID NO: 1826936 - DNA, 21 bp, Homo sapiens
tactcagcagcagagagccct

SEQ ID NO: 1826937 - DNA, 13 bp, Homo sapiens
tactcccttcctg

SEQ ID NO: 1826938 - DNA, 15 bp, Homo sapiens
tactcccttcctggc

SEQ ID NO: 1826939 - DNA, 16 bp, Homo sapiens
tactctctgctctagc

SEQ ID NO: 1826940 - DNA, 11 bp, Homo sapiens
tactctgagcc

SEQ ID NO: 1826941 - DNA, 13 bp, Homo sapiens
tactctgagccca

SEQ ID NO: 1826942 - DNA, 15 bp, Homo sapiens
tactctgagcccagg

SEQ ID NO: 1826943 - DNA, 13 bp, Homo sapiens
tactctgtccagg

SEQ ID NO: 1826944 - DNA, 16 bp, Homo sapiens
tactctgtccaggcca

SEQ ID NO: 1826945 - DNA, 20 bp, Homo sapiens
tactcttaatctcacttcat

SEQ ID NO: 1826946 - DNA, 16 bp, Homo sapiens
tactgaaccactttga

SEQ ID NO: 1826947 - DNA, 14 bp, Homo sapiens
tactgacagaaatg

SEQ ID NO: 1826948 - DNA, 16 bp, Homo sapiens
tactgatactattcaa

SEQ ID NO: 1826949 - DNA, 21 bp, Homo sapiens
tactgatactattcaatgcaa

SEQ ID NO: 1826950 - DNA, 13 bp, Homo sapiens
tactgcacatttt

SEQ ID NO: 1826951 - DNA, 19 bp, Homo sapiens
tactggcagctcctctcct

SEQ ID NO: 1826952 - DNA, 21 bp, Homo sapiens
tactgtactgatactattcaa

SEQ ID NO: 1826953 - DNA, 16 bp, Homo sapiens
tactgtatttcattat

SEQ ID NO: 1826954 - DNA, 16 bp, Homo sapiens
tacttcctcctgatgg

SEQ ID NO: 1826955 - DNA, 16 bp, Homo sapiens
tacttttggcatgaaa

SEQ ID NO: 1826956 - DNA, 22 bp, Homo sapiens
tactttttaatgttatttggaa

SEQ ID NO: 1826957 - DNA, 20 bp, Homo sapiens
tagaaatattgctctaattc

SEQ ID NO: 1826958 - DNA, 15 bp, Homo sapiens
tagaataaatgaaga

SEQ ID NO: 1826959 - DNA, 15 bp, Homo sapiens
tagaatcaagtctgt

SEQ ID NO: 1826960 - DNA, 18 bp, Homo sapiens
tagaatcaagtctgtgaa

SEQ ID NO: 1826961 - DNA, 19 bp, Homo sapiens
tagacaaaagtttcacaac

SEQ ID NO: 1826962 - DNA, 16 bp, Homo sapiens
tagaggtgggcagctg

SEQ ID NO: 1826963 - DNA, 20 bp, Homo sapiens
tagaggtgggcagctgggcc

SEQ ID NO: 1826964 - DNA, 15 bp, Homo sapiens
tagatcgcttgagcc

SEQ ID NO: 1826965 - DNA, 17 bp, Homo sapiens
tagatcgcttgagccca

SEQ ID NO: 1826966 - DNA, 11 bp, Homo sapiens
tagatgtgtgg

SEQ ID NO: 1826967 - DNA, 15 bp, Homo sapiens
tagccagagaggagc

SEQ ID NO: 1826968 - DNA, 17 bp, Homo sapiens
tagccagagaggagcac

SEQ ID NO: 1826969 - DNA, 16 bp, Homo sapiens
tagccaggagtctgtg

SEQ ID NO: 1826970 - DNA, 16 bp, Homo sapiens
tagccatggctcaggc

SEQ ID NO: 1826971 - DNA, 19 bp, Homo sapiens
tctttcatacattatattc

SEQ ID NO: 1826972 - DNA, 13 bp, Homo sapiens
tctttgcagagcc

SEQ ID NO: 1826973 - DNA, 15 bp, Homo sapiens
tctttgcagagcctt

SEQ ID NO: 1826974 - DNA, 15 bp, Homo sapiens
tctttgctgcccctg

SEQ ID NO: 1826975 - DNA, 17 bp, Homo sapiens
tctttgctgcccctgtc

SEQ ID NO: 1826976 - DNA, 19 bp, Homo sapiens
tctttgctgcccctgtctg

SEQ ID NO: 1826977 - DNA, 21 bp, Homo sapiens
tctttgggacacctcagaaaa

SEQ ID NO: 1826978 - DNA, 13 bp, Homo sapiens
tcttttcaaaatt

SEQ ID NO: 1826979 - DNA, 11 bp, Homo sapiens
tgaaaaagaaa

SEQ ID NO: 1826980 - DNA, 18 bp, Homo sapiens
tgaaaagcaattgccctg

SEQ ID NO: 1826981 - DNA, 14 bp, Homo sapiens
tgaaactctattat

SEQ ID NO: 1826982 - DNA, 19 bp, Homo sapiens
tgaaaggacctcttctgaa

SEQ ID NO: 1826983 - DNA, 16 bp, Homo sapiens
tgaaagggctatggca

SEQ ID NO: 1826984 - DNA, 17 bp, Homo sapiens
tgaaattcaacctgtgt

SEQ ID NO: 1826985 - DNA, 18 bp, Homo sapiens
tgaaccagagctggaaca

SEQ ID NO: 1826986 - DNA, 13 bp, Homo sapiens
tgaaccccatggg

SEQ ID NO: 1826987 - DNA, 16 bp, Homo sapiens
tgaactattttgaaga

SEQ ID NO: 1826988 - DNA, 19 bp, Homo sapiens
tgaactattttgaagaaaa

SEQ ID NO: 1826989 - DNA, 23 bp, Homo sapiens
tgaacttacacttggagcccgtg

SEQ ID NO: 1826990 - DNA, 17 bp, Homo sapiens
tgaacttgaggacacat

SEQ ID NO: 1826991 - DNA, 18 bp, Homo sapiens
tgaacttgaggacacatg

SEQ ID NO: 1826992 - DNA, 14 bp, Homo sapiens
tgaagaaaacacaa

SEQ ID NO: 1826993 - DNA, 19 bp, Homo sapiens
tgaagacccagtgtaaaga

SEQ ID NO: 1826994 - DNA, 23 bp, Homo sapiens
tgaagacccagtgtaaagaataa

SEQ ID NO: 1826995 - DNA, 20 bp, Homo sapiens
tgaagagaagggcagggctg

SEQ ID NO: 1826996 - DNA, 22 bp, Homo sapiens
tgaagagaagggcagggctgag

SEQ ID NO: 1826997 - DNA, 13 bp, Homo sapiens
tgaagcagtgcct

SEQ ID NO: 1826998 - DNA, 15 bp, Homo sapiens
tgaagcagtgcctcg

SEQ ID NO: 1826999 - DNA, 13 bp, Homo sapiens
tgaagctagaaac

SEQ ID NO: 1827000 - DNA, 17 bp, Homo sapiens
tgaaggaatagccagag

SEQ ID NO: 1827001 - DNA, 20 bp, Homo sapiens
tgaaggaatagccagagagg

SEQ ID NO: 1827002 - DNA, 15 bp, Homo sapiens
tgaaggaattacatt

SEQ ID NO: 1827003 - DNA, 23 bp, Homo sapiens
tgaaggagaaaatgcattatgtg

SEQ ID NO: 1827004 - DNA, 18 bp, Homo sapiens
tgaaggcagtctgaaccc

SEQ ID NO: 1827005 - DNA, 18 bp, Homo sapiens
tgaaggcatatttccaat

SEQ ID NO: 1827006 - DNA, 19 bp, Homo sapiens
tgaaggggcacaccactgc

SEQ ID NO: 1827007 - DNA, 14 bp, Homo sapiens
tgaagtgcttgcag

SEQ ID NO: 1827008 - DNA, 18 bp, Homo sapiens
tgaagtgttgtggagaaa

SEQ ID NO: 1827009 - DNA, 17 bp, Homo sapiens
tgaatacacttacagtt

SEQ ID NO: 1827010 - DNA, 13 bp, Homo sapiens
tgaatacattttg

SEQ ID NO: 1827011 - DNA, 13 bp, Homo sapiens
tgaatatgagaaa

SEQ ID NO: 1827012 - DNA, 19 bp, Homo sapiens
tgaattaatctagaaaatg

SEQ ID NO: 1827013 - DNA, 21 bp, Homo sapiens
tgaattcttcaacagggaaaa

SEQ ID NO: 1827014 - DNA, 16 bp, Homo sapiens
tgaattgctaattctg

SEQ ID NO: 1827015 - DNA, 21 bp, Homo sapiens
tgaatttgtaagcaacttgct

SEQ ID NO: 1827016 - DNA, 22 bp, Homo sapiens
tgaatttgtaagcaacttgctt

SEQ ID NO: 1827017 - DNA, 14 bp, Homo sapiens
tgaattttcccact

SEQ ID NO: 1827018 - DNA, 16 bp, Homo sapiens
tgaattttcccactgc

SEQ ID NO: 1827019 - DNA, 23 bp, Homo sapiens
tgacaagaatggaatagaaatgt

SEQ ID NO: 1827020 - DNA, 17 bp, Homo sapiens
tgacaatagttatgcct

SEQ ID NO: 1827021 - DNA, 16 bp, Homo sapiens
tgacaatggcagctag

SEQ ID NO: 1827022 - DNA, 20 bp, Homo sapiens
tgacactgcggggcttggct

SEQ ID NO: 1827023 - DNA, 13 bp, Homo sapiens
tgacagaatggtg

SEQ ID NO: 1827024 - DNA, 19 bp, Homo sapiens
tgacagagttggtgttcat

SEQ ID NO: 1827025 - DNA, 23 bp, Homo sapiens
tgacagttctgttggtctacaga

SEQ ID NO: 1827026 - DNA, 17 bp, Homo sapiens
tgacatacatccaacat

SEQ ID NO: 1827027 - DNA, 16 bp, Homo sapiens
tgaccactccagagaa

SEQ ID NO: 1827028 - DNA, 15 bp, Homo sapiens
tgaccccctcccctg

SEQ ID NO: 1827029 - DNA, 16 bp, Homo sapiens
tgacccttcagggcca

SEQ ID NO: 1827030 - DNA, 17 bp, Homo sapiens
tgacctcaactaaccct

SEQ ID NO: 1827031 - DNA, 12 bp, Homo sapiens
tgacgccctgcg

SEQ ID NO: 1827032 - DNA, 21 bp, Homo sapiens
tgacgccctgcgttggagcca

SEQ ID NO: 1827033 - DNA, 23 bp, Homo sapiens
tgacgccctgcgttggagccact

SEQ ID NO: 1827034 - DNA, 18 bp, Homo sapiens
tgactactatggctgttt

SEQ ID NO: 1827035 - DNA, 22 bp, Homo sapiens
tgactagtgcctagaaagcaat

SEQ ID NO: 1827036 - DNA, 20 bp, Homo sapiens
tgactatggctctggcacca

SEQ ID NO: 1827037 - DNA, 19 bp, Homo sapiens
tgactcgggctcctgtgcc

SEQ ID NO: 1827038 - DNA, 16 bp, Homo sapiens
tgactggcaggtgcag

SEQ ID NO: 1827039 - DNA, 24 bp, Homo sapiens
tgactggcaggtgcagatgggctg

SEQ ID NO: 1827040 - DNA, 21 bp, Homo sapiens
tgacttcaggggctgcccgct

SEQ ID NO: 1827041 - DNA, 24 bp, Homo sapiens
tgacttcaggtggagagcactaga

SEQ ID NO: 1827042 - DNA, 19 bp, Homo sapiens
tgagaacaagtcacagctg

SEQ ID NO: 1827043 - DNA, 21 bp, Homo sapiens
tgagaacaagtcacagctgca

SEQ ID NO: 1827044 - DNA, 16 bp, Homo sapiens
tgagaaggcgaggaga

SEQ ID NO: 1827045 - DNA, 14 bp, Homo sapiens
tgagaagtgtatat

SEQ ID NO: 1827046 - DNA, 16 bp, Homo sapiens
tgagacaagccctggc

SEQ ID NO: 1827047 - DNA, 17 bp, Homo sapiens
tgagacaagccctggca

SEQ ID NO: 1827048 - DNA, 19 bp, Homo sapiens
tgagacaagccctggcaac

SEQ ID NO: 1827049 - DNA, 19 bp, Homo sapiens
tgagaccacctctcaatat

SEQ ID NO: 1827050 - DNA, 18 bp, Homo sapiens
tgagactatgcgttttta

SEQ ID NO: 1827051 - DNA, 13 bp, Homo sapiens
tgagactccagaa

SEQ ID NO: 1827052 - DNA, 21 bp, Homo sapiens
tgagactccagaatctgctgt

SEQ ID NO: 1827053 - DNA, 22 bp, Homo sapiens
tgagactccagaatctgctgtt

SEQ ID NO: 1827054 - DNA, 15 bp, Homo sapiens
tgagactcttaaata

SEQ ID NO: 1827055 - DNA, 14 bp, Homo sapiens
tgagagaaaagaaa

SEQ ID NO: 1827056 - DNA, 19 bp, Homo sapiens
tgagagaaaagaaaaatat

SEQ ID NO: 1827057 - DNA, 14 bp, Homo sapiens
tgagagttccagat

SEQ ID NO: 1827058 - DNA, 19 bp, Homo sapiens
tgagcattagctacttttc

SEQ ID NO: 1827059 - DNA, 15 bp, Homo sapiens
tgagcattcaggcag

SEQ ID NO: 1827060 - DNA, 13 bp, Homo sapiens
tgagcccaggagt

SEQ ID NO: 1827061 - DNA, 15 bp, Homo sapiens
tgagcccccggctag

SEQ ID NO: 1827062 - DNA, 19 bp, Homo sapiens
tgagcccctccccagccag

SEQ ID NO: 1827063 - DNA, 21 bp, Homo sapiens
tgagctgggaagctgtactca

SEQ ID NO: 1827064 - DNA, 20 bp, Homo sapiens
tgagctggggatgtctctca

SEQ ID NO: 1827065 - DNA, 15 bp, Homo sapiens
tgagctggggccaca

SEQ ID NO: 1827066 - DNA, 23 bp, Homo sapiens
tgagctttggggacagttggcag

SEQ ID NO: 1827067 - DNA, 13 bp, Homo sapiens
tgaggacacatgt

SEQ ID NO: 1827068 - DNA, 14 bp, Homo sapiens
tgaggacacatgtc

SEQ ID NO: 1827069 - DNA, 18 bp, Homo sapiens
tgaggagggtggaggaag

SEQ ID NO: 1827070 - DNA, 21 bp, Homo sapiens
tgaggagtattaagaatgcag

SEQ ID NO: 1827071 - DNA, 22 bp, Homo sapiens
tgaggcagtgggtcccacttcc

SEQ ID NO: 1827072 - DNA, 23 bp, Homo sapiens
tgaggcagtgggtcccacttccc

SEQ ID NO: 1827073 - DNA, 16 bp, Homo sapiens
tgaggccccaggccct

SEQ ID NO: 1827074 - DNA, 14 bp, Homo sapiens
tgaggcctcatccc

SEQ ID NO: 1827075 - DNA, 17 bp, Homo sapiens
tgaggcttccaggctct

SEQ ID NO: 1827076 - DNA, 21 bp, Homo sapiens
tggcttcctccgtccacccag

SEQ ID NO: 1827077 - DNA, 19 bp, Homo sapiens
tgggaaaggacccacccat

SEQ ID NO: 1827078 - DNA, 14 bp, Homo sapiens
tgggaaccccgcag

SEQ ID NO: 1827079 - DNA, 12 bp, Homo sapiens
tgggaagaagta

SEQ ID NO: 1827080 - DNA, 15 bp, Homo sapiens
tgggaagctgtactc

SEQ ID NO: 1827081 - DNA, 21 bp, Homo sapiens
tgggaagctgtactcagagca

SEQ ID NO: 1827082 - DNA, 14 bp, Homo sapiens
tgggaaggctaagt

SEQ ID NO: 1827083 - DNA, 21 bp, Homo sapiens
tgggacacctcagaaaactta

SEQ ID NO: 1827084 - DNA, 18 bp, Homo sapiens
tgggacccagctactctg

SEQ ID NO: 1827085 - DNA, 20 bp, Homo sapiens
tgggacccagctactctgtc

SEQ ID NO: 1827086 - DNA, 22 bp, Homo sapiens
tgggacccagctactctgtcca

SEQ ID NO: 1827087 - DNA, 17 bp, Homo sapiens
tgggactgtgcctttgg

SEQ ID NO: 1827088 - DNA, 13 bp, Homo sapiens
tgggaggcagcat

SEQ ID NO: 1827089 - DNA, 16 bp, Homo sapiens
tgggaggccaaggcag

SEQ ID NO: 1827090 - DNA, 18 bp, Homo sapiens
tgggaggccaaggcaggt

SEQ ID NO: 1827091 - DNA, 19 bp, Homo sapiens
tgggatctatttttgcact

SEQ ID NO: 1827092 - DNA, 19 bp, Homo sapiens
tgggatttcttcgctgctc

SEQ ID NO: 1827093 - DNA, 21 bp, Homo sapiens
tgggatttcttcgctgctcta

SEQ ID NO: 1827094 - DNA, 14 bp, Homo sapiens
tgggcactgctggg

SEQ ID NO: 1827095 - DNA, 16 bp, Homo sapiens
tgggcagagctggaca

SEQ ID NO: 1827096 - DNA, 23 bp, Homo sapiens
tgggcatccacccagtgctgcca

SEQ ID NO: 1827097 - DNA, 13 bp, Homo sapiens
tgggcattgggct

SEQ ID NO: 1827098 - DNA, 16 bp, Homo sapiens
tgggcattgggctgac

SEQ ID NO: 1827099 - DNA, 17 bp, Homo sapiens
tgggcattgggctgaca

SEQ ID NO: 1827100 - DNA, 18 bp, Homo sapiens
tgggcattgggctgacac

SEQ ID NO: 1827101 - DNA, 18 bp, Homo sapiens
tgggccacacccaggaag

SEQ ID NO: 1827102 - DNA, 17 bp, Homo sapiens
tgggccatactggcctc

SEQ ID NO: 1827103 - DNA, 14 bp, Homo sapiens
tgggccccacctac

SEQ ID NO: 1827104 - DNA, 18 bp, Homo sapiens
tgggccccatgctctgcc

SEQ ID NO: 1827105 - DNA, 12 bp, Homo sapiens
tgggcctgccca

SEQ ID NO: 1827106 - DNA, 16 bp, Homo sapiens
tgggcctgcccaatgc

SEQ ID NO: 1827107 - DNA, 21 bp, Homo sapiens
tgggcctgcttttccaggatc

SEQ ID NO: 1827108 - DNA, 17 bp, Homo sapiens
tgggcctggcctgagct

SEQ ID NO: 1827109 - DNA, 13 bp, Homo sapiens
tgggcctgggcct

SEQ ID NO: 1827110 - DNA, 17 bp, Homo sapiens
tgggcctgggcctgctt

SEQ ID NO: 1827111 - DNA, 14 bp, Homo sapiens
tgggcctgtccccc

SEQ ID NO: 1827112 - DNA, 16 bp, Homo sapiens
tgggcctgtgcagcag

SEQ ID NO: 1827113 - DNA, 23 bp, Homo sapiens
tgggcctgtgcagcagcccagct

SEQ ID NO: 1827114 - DNA, 16 bp, Homo sapiens
tgggccttgctttggg

SEQ ID NO: 1827115 - DNA, 13 bp, Homo sapiens
tgggcgggcagca

SEQ ID NO: 1827116 - DNA, 16 bp, Homo sapiens
tgggctactggcagct

SEQ ID NO: 1827117 - DNA, 17 bp, Homo sapiens
tgggctactggcagctc

SEQ ID NO: 1827118 - DNA, 19 bp, Homo sapiens
tgggctactggcagctcct

SEQ ID NO: 1827119 - DNA, 19 bp, Homo sapiens
tgggctagtgtgagtggca

SEQ ID NO: 1827120 - DNA, 11 bp, Homo sapiens
tgggctcctgg

SEQ ID NO: 1827121 - DNA, 13 bp, Homo sapiens
tgggctcctggct

SEQ ID NO: 1827122 - DNA, 14 bp, Homo sapiens
tgggctcctggctg

SEQ ID NO: 1827123 - DNA, 20 bp, Homo sapiens
tgggctcctggctgccaggc

SEQ ID NO: 1827124 - DNA, 21 bp, Homo sapiens
tgggctcctggctgccaggcg

SEQ ID NO: 1827125 - DNA, 19 bp, Homo sapiens
tgggctgacacctaccatg

SEQ ID NO: 1827126 - DNA, 22 bp, Homo sapiens
tgggctgacacctaccatgctg

SEQ ID NO: 1827127 - DNA, 18 bp, Homo sapiens
tgggctggggcctgatgg

SEQ ID NO: 1827128 - DNA, 18 bp, Homo sapiens
tgggctttctccggggtc

SEQ ID NO: 1827129 - DNA, 17 bp, Homo sapiens
tggggaagttcaagtga

SEQ ID NO: 1827130 - DNA, 15 bp, Homo sapiens
tggggacagttggca

SEQ ID NO: 1827131 - DNA, 16 bp, Homo sapiens
tggggatagatgtgtg

SEQ ID NO: 1827132 - DNA, 19 bp, Homo sapiens
tggggcctatcagtgtgcc

SEQ ID NO: 1827133 - DNA, 12 bp, Homo sapiens
tggggcctggct

SEQ ID NO: 1827134 - DNA, 13 bp, Homo sapiens
tggggcctggctt

SEQ ID NO: 1827135 - DNA, 16 bp, Homo sapiens
tggggcctggcttgct

SEQ ID NO: 1827136 - DNA, 20 bp, Homo sapiens
tggggcctggcttgctccag

SEQ ID NO: 1827137 - DNA, 22 bp, Homo sapiens
tggggcctggcttgctccaggg

SEQ ID NO: 1827138 - DNA, 15 bp, Homo sapiens
tggggctcagagtgg

SEQ ID NO: 1827139 - DNA, 14 bp, Homo sapiens
tggggctgattgta

SEQ ID NO: 1827140 - DNA, 19 bp, Homo sapiens
tgggggaagagcacagccc

SEQ ID NO: 1827141 - DNA, 21 bp, Homo sapiens
tgggggaagagcacagccctc

SEQ ID NO: 1827142 - DNA, 18 bp, Homo sapiens
tgggggaggccaccccaa

SEQ ID NO: 1827143 - DNA, 11 bp, Homo sapiens
tgggggatgta

SEQ ID NO: 1827144 - DNA, 20 bp, Homo sapiens
tgggggcagtgactggcagg

SEQ ID NO: 1827145 - DNA, 21 bp, Homo sapiens
tggggtaggttgggagaatgt

SEQ ID NO: 1827146 - DNA, 20 bp, Homo sapiens
tggggtcttgctatattgcc

SEQ ID NO: 1827147 - DNA, 13 bp, Homo sapiens
tggggtgggccca

SEQ ID NO: 1827148 - DNA, 12 bp, Homo sapiens
tgggtccaggaa

SEQ ID NO: 1827149 - DNA, 21 bp, Homo sapiens
tgggtccaggaaggcagctgc

SEQ ID NO: 1827150 - DNA, 22 bp, Homo sapiens
tgggtcctgcaatctccagggc

SEQ ID NO: 1827151 - DNA, 12 bp, Homo sapiens
tgggtctgtgtg

SEQ ID NO: 1827152 - DNA, 13 bp, Homo sapiens
tgggtgcgacccc

SEQ ID NO: 1827153 - DNA, 14 bp, Homo sapiens
tgggtggcacctcc

SEQ ID NO: 1827154 - DNA, 17 bp, Homo sapiens
tgggttttttcacataa

SEQ ID NO: 1827155 - DNA, 18 bp, Homo sapiens
tggtaaaaagattatata

SEQ ID NO: 1827156 - DNA, 12 bp, Homo sapiens
tggtagaaattt

SEQ ID NO: 1827157 - DNA, 19 bp, Homo sapiens
tgtagcctatgtcttgtat

SEQ ID NO: 1827158 - DNA, 21 bp, Homo sapiens
tgtagctgaaagagtatgtac

SEQ ID NO: 1827159 - DNA, 22 bp, Homo sapiens
tgtagtaataaaaagtaacaca

SEQ ID NO: 1827160 - DNA, 13 bp, Homo sapiens
tgtagtggaagag

SEQ ID NO: 1827161 - DNA, 15 bp, Homo sapiens
tgtatagtaatcatt

SEQ ID NO: 1827162 - DNA, 19 bp, Homo sapiens
tgtatatctatatctctaa

SEQ ID NO: 1827163 - DNA, 16 bp, Homo sapiens
tgtatatgtatatcta

SEQ ID NO: 1827164 - DNA, 18 bp, Homo sapiens
tgtatggctctcaagtga

SEQ ID NO: 1827165 - DNA, 21 bp, Homo sapiens
tgtatggctctcaagtgaaag

SEQ ID NO: 1827166 - DNA, 17 bp, Homo sapiens
tgtatgtgacaacattt

SEQ ID NO: 1827167 - DNA, 15 bp, Homo sapiens
tgtcaataactttat

SEQ ID NO: 1827168 - DNA, 14 bp, Homo sapiens
tgtcactggctgcc

SEQ ID NO: 1827169 - DNA, 16 bp, Homo sapiens
tgtcactggctgcctc

SEQ ID NO: 1827170 - DNA, 18 bp, Homo sapiens
tgtcactggctgcctcca

SEQ ID NO: 1827171 - DNA, 21 bp, Homo sapiens
tgtcactggctgcctccactc

SEQ ID NO: 1827172 - DNA, 13 bp, Homo sapiens
tgtcatctgagga

SEQ ID NO: 1827173 - DNA, 15 bp, Homo sapiens
tgtcatctgaggagt

SEQ ID NO: 1827174 - DNA, 18 bp, Homo sapiens
tgtcatgctcacttttgt

SEQ ID NO: 1827175 - DNA, 14 bp, Homo sapiens
tgtcatgtaatact

SEQ ID NO: 1827176 - DNA, 13 bp, Homo sapiens
tgtccagcagctg

SEQ ID NO: 1827177 - DNA, 14 bp, Homo sapiens
tgtccagcagctgc

SEQ ID NO: 1827178 - DNA, 21 bp, Homo sapiens
tgtccagcagctgcgggtctg

SEQ ID NO: 1827179 - DNA, 12 bp, Homo sapiens
tgtccaggccac

SEQ ID NO: 1827180 - DNA, 19 bp, Homo sapiens
tgtccaggccactgtggcc

SEQ ID NO: 1827181 - DNA, 21 bp, Homo sapiens
tgtccaggccactgtggccag

SEQ ID NO: 1827182 - DNA, 17 bp, Homo sapiens
tgtccagtgcccattcc

SEQ ID NO: 1827183 - DNA, 18 bp, Homo sapiens
tgtccagtgcccattcct

SEQ ID NO: 1827184 - DNA, 13 bp, Homo sapiens
tgtccagtttcca

SEQ ID NO: 1827185 - DNA, 13 bp, Homo sapiens
tgtccataaagta

SEQ ID NO: 1827186 - DNA, 12 bp, Homo sapiens
tgtccccagggc

SEQ ID NO: 1827187 - DNA, 14 bp, Homo sapiens
tgtccccagggccc

SEQ ID NO: 1827188 - DNA, 17 bp, Homo sapiens
tgtccccagggcccctc

SEQ ID NO: 1827189 - DNA, 15 bp, Homo sapiens
tgtcccctcttgccc

SEQ ID NO: 1827190 - DNA, 23 bp, Homo sapiens
tgtcctctttactcccttcctgg

SEQ ID NO: 1827191 - DNA, 12 bp, Homo sapiens
tgtcctgccagc

SEQ ID NO: 1827192 - DNA, 14 bp, Homo sapiens
tgtcctgccagctg

SEQ ID NO: 1827193 - DNA, 15 bp, Homo sapiens
tgtcctgccagctgc

SEQ ID NO: 1827194 - DNA, 17 bp, Homo sapiens
tgtcctgccagctgcct

SEQ ID NO: 1827195 - DNA, 16 bp, Homo sapiens
tgtcctgctccacagt

SEQ ID NO: 1827196 - DNA, 16 bp, Homo sapiens
tgtccttcagagctct

SEQ ID NO: 1827197 - DNA, 16 bp, Homo sapiens
tgtctattctgagcct

SEQ ID NO: 1827198 - DNA, 17 bp, Homo sapiens
tgtctattctgagcctt

SEQ ID NO: 1827199 - DNA, 18 bp, Homo sapiens
tgtctccagggcccccac

SEQ ID NO: 1827200 - DNA, 19 bp, Homo sapiens
tgtctccagggcccccacc

SEQ ID NO: 1827201 - DNA, 14 bp, Homo sapiens
tgtctccctggccc

SEQ ID NO: 1827202 - DNA, 11 bp, Homo sapiens
tgtctctccca

SEQ ID NO: 1827203 - DNA, 16 bp, Homo sapiens
tgtctgaggcctcatc

SEQ ID NO: 1827204 - DNA, 18 bp, Homo sapiens
tgtctgaggcctcatccc

SEQ ID NO: 1827205 - DNA, 23 bp, Homo sapiens
tgtctgtaatgggatctattttt

SEQ ID NO: 1827206 - DNA, 14 bp, Homo sapiens
tgtctgtctgtccc

SEQ ID NO: 1827207 - DNA, 15 bp, Homo sapiens
tgtctgtctgtccca

SEQ ID NO: 1827208 - DNA, 20 bp, Homo sapiens
tgtgaaactctattatggaa

SEQ ID NO: 1827209 - DNA, 15 bp, Homo sapiens
tgtgaaagtctcctg

SEQ ID NO: 1827210 - DNA, 19 bp, Homo sapiens
tgtgaaattcaacctgtgt

SEQ ID NO: 1827211 - DNA, 13 bp, Homo sapiens
tgtgaactatttt

SEQ ID NO: 1827212 - DNA, 18 bp, Homo sapiens
tgtgaagtgttgtggaga

SEQ ID NO: 1827213 - DNA, 13 bp, Homo sapiens
tgtgactgaaggg

SEQ ID NO: 1827214 - DNA, 18 bp, Homo sapiens
tgtgaggggctctctcat

SEQ ID NO: 1827215 - DNA, 16 bp, Homo sapiens
tgtgagtggcagccat

SEQ ID NO: 1827216 - DNA, 18 bp, Homo sapiens
tgtgagtggcagccatgc

SEQ ID NO: 1827217 - DNA, 16 bp, Homo sapiens
tgtgagtttcagaaat

SEQ ID NO: 1827218 - DNA, 22 bp, Homo sapiens
tgtgatttcccgtggccccagc

SEQ ID NO: 1827219 - DNA, 14 bp, Homo sapiens
tgtgcagcagccca

SEQ ID NO: 1827220 - DNA, 12 bp, Homo sapiens
tgtgccaccctg

SEQ ID NO: 1827221 - DNA, 22 bp, Homo sapiens
tgtgccaccctgggctctgtgg

SEQ ID NO: 1827222 - DNA, 19 bp, Homo sapiens
tgtgcccatgggcactgct

SEQ ID NO: 1827223 - DNA, 16 bp, Homo sapiens
tgtgcccatttgtcct

SEQ ID NO: 1827224 - DNA, 16 bp, Homo sapiens
tgtgccccccatcctg

SEQ ID NO: 1827225 - DNA, 18 bp, Homo sapiens
tgtgccccccatcctggc

SEQ ID NO: 1827226 - DNA, 19 bp, Homo sapiens
tgtgccccccatcctggcc

SEQ ID NO: 1827227 - DNA, 20 bp, Homo sapiens
tgtgccccccatcctggccc

SEQ ID NO: 1827228 - DNA, 22 bp, Homo sapiens
tgtgccccccatcctggcccat

SEQ ID NO: 1827229 - DNA, 16 bp, Homo sapiens
tgtgcctgcaccagga

SEQ ID NO: 1827230 - DNA, 19 bp, Homo sapiens
tgtgcctgcaccaggagac

SEQ ID NO: 1827231 - DNA, 20 bp, Homo sapiens
tgtgcctgctagagcaaccc

SEQ ID NO: 1827232 - DNA, 15 bp, Homo sapiens
tgtgctgctgtggca

SEQ ID NO: 1827233 - DNA, 17 bp, Homo sapiens
tgtgctgtgcctgctag

SEQ ID NO: 1827234 - DNA, 21 bp, Homo sapiens
tgtggagaggggtgcacccac

SEQ ID NO: 1827235 - DNA, 13 bp, Homo sapiens
tgtggaggcctga

SEQ ID NO: 1827236 - DNA, 23 bp, Homo sapiens
tgtggatggaggtgatgaaaacc

SEQ ID NO: 1827237 - DNA, 15 bp, Homo sapiens
tgtggcaaagtgctg

SEQ ID NO: 1827238 - DNA, 16 bp, Homo sapiens
tgtggcaaagtgctgt

SEQ ID NO: 1827239 - DNA, 22 bp, Homo sapiens
tgtggcacagacttctggaagg

SEQ ID NO: 1827240 - DNA, 15 bp, Homo sapiens
tgtggcagaaaagag

SEQ ID NO: 1827241 - DNA, 22 bp, Homo sapiens
tgtggccagagctggaaggcag

SEQ ID NO: 1827242 - DNA, 16 bp, Homo sapiens
tgtggcctgtgtccag

SEQ ID NO: 1827243 - DNA, 22 bp, Homo sapiens
tgtggcctgtgtccagcagctg

SEQ ID NO: 1827244 - DNA, 14 bp, Homo sapiens
tgtgggagtgtgta

SEQ ID NO: 1827245 - DNA, 20 bp, Homo sapiens
tgtgggctgcactctgtgcc

SEQ ID NO: 1827246 - DNA, 23 bp, Homo sapiens
tgtgggggaagagcacagccctc

SEQ ID NO: 1827247 - DNA, 20 bp, Homo sapiens
tgtgggtctgtgtgtgtgta

SEQ ID NO: 1827248 - DNA, 20 bp, Homo sapiens
tgtgtagggcttttttttga

SEQ ID NO: 1827249 - DNA, 11 bp, Homo sapiens
tgtgtatgtgg

SEQ ID NO: 1827250 - DNA, 13 bp, Homo sapiens
tgtgtcactggct

SEQ ID NO: 1827251 - DNA, 17 bp, Homo sapiens
tgtgtcactggctgcct

SEQ ID NO: 1827252 - DNA, 22 bp, Homo sapiens
tgtgtcactggctgcctccact

SEQ ID NO: 1827253 - DNA, 23 bp, Homo sapiens
tgtgtcactggctgcctccactc

SEQ ID NO: 1827254 - DNA, 14 bp, Homo sapiens
tgtgtccagcagct

SEQ ID NO: 1827255 - DNA, 16 bp, Homo sapiens
tgtgtccagcagctgc

SEQ ID NO: 1827256 - DNA, 17 bp, Homo sapiens
tgtgtgaattctgcaac

SEQ ID NO: 1827257 - DNA, 16 bp, Homo sapiens
tgtgtgcctgtggcag

SEQ ID NO: 1827258 - DNA, 15 bp, Homo sapiens
tgtgtgggagtgtgt

SEQ ID NO: 1827259 - DNA, 13 bp, Homo sapiens
tgtgtttatgtgt

SEQ ID NO: 1827260 - DNA, 19 bp, Homo sapiens
tgttaactgtcttgagaga

SEQ ID NO: 1827261 - DNA, 14 bp, Homo sapiens
tgttataaataaaa

SEQ ID NO: 1827262 - DNA, 16 bp, Homo sapiens
tgttattggaattttc

SEQ ID NO: 1827263 - DNA, 23 bp, Homo sapiens
tgttcatacggggtggctgaaag

SEQ ID NO: 1827264 - DNA, 17 bp, Homo sapiens
tgttccctgcaccctgg

SEQ ID NO: 1827265 - DNA, 20 bp, Homo sapiens
tgttccctgcaccctggaaa

SEQ ID NO: 1827266 - DNA, 13 bp, Homo sapiens
tgttcctgtgtat

SEQ ID NO: 1827267 - DNA, 14 bp, Homo sapiens
tgttcgtattacaa

SEQ ID NO: 1827268 - DNA, 20 bp, Homo sapiens
tgttctgtccagtttccaaa

SEQ ID NO: 1827269 - DNA, 20 bp, Homo sapiens
tgttgccaactaagccctcg

SEQ ID NO: 1827270 - DNA, 14 bp, Homo sapiens
tgttggcaattgag

SEQ ID NO: 1827271 - DNA, 15 bp, Homo sapiens
tgttggcgagaggag

SEQ ID NO: 1827272 - DNA, 14 bp, Homo sapiens
tgttgtggagaaaa

SEQ ID NO: 1827273 - DNA, 15 bp, Homo sapiens
tgttgtggagaaaag

SEQ ID NO: 1827274 - DNA, 16 bp, Homo sapiens
tgttgtgtgtgggagt

SEQ ID NO: 1827275 - DNA, 21 bp, Homo sapiens
tgtttacagaggacagtattt

SEQ ID NO: 1827276 - DNA, 15 bp, Homo sapiens
ggtccgcaccagctg

SEQ ID NO: 1827277 - DNA, 16 bp, Homo sapiens
ggtccgcaccagctgc

SEQ ID NO: 1827278 - DNA, 20 bp, Homo sapiens
ggtccgcaccagctgctctg

SEQ ID NO: 1827279 - DNA, 23 bp, Homo sapiens
ggtccgcaccagctgctctgccc

SEQ ID NO: 1827280 - DNA, 18 bp, Homo sapiens
ggtcctgcaatctccagg

SEQ ID NO: 1827281 - DNA, 22 bp, Homo sapiens
ggtctcctccaccgccatggct

SEQ ID NO: 1827282 - DNA, 22 bp, Homo sapiens
ggtctgaaggaatagccagaga

SEQ ID NO: 1827283 - DNA, 23 bp, Homo sapiens
ggtctgaaggaatagccagagag

SEQ ID NO: 1827284 - DNA, 16 bp, Homo sapiens
ggtctgctcgggccca

SEQ ID NO: 1827285 - DNA, 17 bp, Homo sapiens
ggtctgctcgggcccag

SEQ ID NO: 1827286 - DNA, 15 bp, Homo sapiens
ggtctgtgctgtgcc

SEQ ID NO: 1827287 - DNA, 19 bp, Homo sapiens
ggtctgtgctgtgcctgct

SEQ ID NO: 1827288 - DNA, 16 bp, Homo sapiens
ggtcttgggctactgg

SEQ ID NO: 1827289 - DNA, 19 bp, Homo sapiens
ggtgcacccactcaccagg

SEQ ID NO: 1827290 - DNA, 17 bp, Homo sapiens
ggtgcactggccccacc

SEQ ID NO: 1827291 - DNA, 19 bp, Homo sapiens
ggtgcagccttcccctccc

SEQ ID NO: 1827292 - DNA, 21 bp, Homo sapiens
ggtgcagccttcccctccctg

SEQ ID NO: 1827293 - DNA, 22 bp, Homo sapiens
ggtgccaacagtgttaggcctg

SEQ ID NO: 1827294 - DNA, 18 bp, Homo sapiens
ggtgcctgattcggctgt

SEQ ID NO: 1827295 - DNA, 22 bp, Homo sapiens
ggtgcgaccccatctgcccagg

SEQ ID NO: 1827296 - DNA, 15 bp, Homo sapiens
ggtgcgtggctgtgg

SEQ ID NO: 1827297 - DNA, 18 bp, Homo sapiens
ggtgcgtggctgtggcac

SEQ ID NO: 1827298 - DNA, 20 bp, Homo sapiens
ggtgcgtggctgtggcacag

SEQ ID NO: 1827299 - DNA, 10 bp, Homo sapiens
ggtgctctgg

SEQ ID NO: 1827300 - DNA, 12 bp, Homo sapiens
ggtgctctggcg

SEQ ID NO: 1827301 - DNA, 12 bp, Homo sapiens
ggtgctgagctt

SEQ ID NO: 1827302 - DNA, 16 bp, Homo sapiens
ggtgctgctaccctcc

SEQ ID NO: 1827303 - DNA, 19 bp, Homo sapiens
ggtgctgctaccctccctg

SEQ ID NO: 1827304 - DNA, 23 bp, Homo sapiens
ggtgctgctaccctccctgctgt

SEQ ID NO: 1827305 - DNA, 16 bp, Homo sapiens
ggtggagagcactaga

SEQ ID NO: 1827306 - DNA, 13 bp, Homo sapiens
ggtggcacctcct

SEQ ID NO: 1827307 - DNA, 20 bp, Homo sapiens
ggtggcacctcctgagaagg

SEQ ID NO: 1827308 - DNA, 15 bp, Homo sapiens
ggtggtaccaggtct

SEQ ID NO: 1827309 - DNA, 22 bp, Homo sapiens
ggtggtaccaggtctcctccac

SEQ ID NO: 1827310 - DNA, 13 bp, Homo sapiens
ggtggtctgctcg

SEQ ID NO: 1827311 - DNA, 14 bp, Homo sapiens
ggtggtctgctcgg

SEQ ID NO: 1827312 - DNA, 15 bp, Homo sapiens
ggtgtcgcgccttct

SEQ ID NO: 1827313 - DNA, 22 bp, Homo sapiens
ggtgttgaccactccagagaag

SEQ ID NO: 1827314 - DNA, 14 bp, Homo sapiens
ggttatctgcctgg

SEQ ID NO: 1827315 - DNA, 18 bp, Homo sapiens
ggttatctgcctggcctg

SEQ ID NO: 1827316 - DNA, 16 bp, Homo sapiens
ggttgaaggcagtctg

SEQ ID NO: 1827317 - DNA, 17 bp, Homo sapiens
ggttggcgcaccctccc

SEQ ID NO: 1827318 - DNA, 18 bp, Homo sapiens
ggttggcgcaccctcccc

SEQ ID NO: 1827319 - DNA, 22 bp, Homo sapiens
ggttgttgccaactaagccctc

SEQ ID NO: 1827320 - DNA, 19 bp, Homo sapiens
ggttttattgtccttcaga

SEQ ID NO: 1827321 - DNA, 15 bp, Homo sapiens
ggttttggagtcagt

SEQ ID NO: 1827322 - DNA, 20 bp, Homo sapiens
gtaaaaagattatatatcat

SEQ ID NO: 1827323 - DNA, 13 bp, Homo sapiens
gtaaacatttgta

SEQ ID NO: 1827324 - DNA, 14 bp, Homo sapiens
gtaaacatttgtaa

SEQ ID NO: 1827325 - DNA, 19 bp, Homo sapiens
gtaaacatttgtaaaaata

SEQ ID NO: 1827326 - DNA, 17 bp, Homo sapiens
gtaaactggatactgta

SEQ ID NO: 1827327 - DNA, 16 bp, Homo sapiens
gtaaatttatgtgatg

SEQ ID NO: 1827328 - DNA, 23 bp, Homo sapiens
gtaacaggccttgagcacaaaat

SEQ ID NO: 1827329 - DNA, 14 bp, Homo sapiens
gtaacatgcaacaa

SEQ ID NO: 1827330 - DNA, 17 bp, Homo sapiens
gtaactgctgagccact

SEQ ID NO: 1827331 - DNA, 19 bp, Homo sapiens
gtaagacttcagatttcaa

SEQ ID NO: 1827332 - DNA, 21 bp, Homo sapiens
gtaaggaacggcccttttagt

SEQ ID NO: 1827333 - DNA, 13 bp, Homo sapiens
gtaagtttgcata

SEQ ID NO: 1827334 - DNA, 18 bp, Homo sapiens
gtaagtttgcatatcagt

SEQ ID NO: 1827335 - DNA, 19 bp, Homo sapiens
gtaataaaaagtaacacac

SEQ ID NO: 1827336 - DNA, 23 bp, Homo sapiens
gtaatgggatctatttttgcact

SEQ ID NO: 1827337 - DNA, 14 bp, Homo sapiens
gtaatgggcctgcc

SEQ ID NO: 1827338 - DNA, 12 bp, Homo sapiens
gtaattattgtg

SEQ ID NO: 1827339 - DNA, 23 bp, Homo sapiens
gtaattattgtgatttcccgtgg

SEQ ID NO: 1827340 - DNA, 23 bp, Homo sapiens
gtaatttaaaattgtgatgtgtc

SEQ ID NO: 1827341 - DNA, 23 bp, Homo sapiens
gtaattttttacattttcctgtg

SEQ ID NO: 1827342 - DNA, 19 bp, Homo sapiens
gtaccaggtctcctccacc

SEQ ID NO: 1827343 - DNA, 22 bp, Homo sapiens
gtaccaggtctcctccaccgcc

SEQ ID NO: 1827344 - DNA, 18 bp, Homo sapiens
gtacccccgcccaggctg

SEQ ID NO: 1827345 - DNA, 20 bp, Homo sapiens
gtacccttgttattatctac

SEQ ID NO: 1827346 - DNA, 22 bp, Homo sapiens
gtacctatgtgagtttcagaaa

SEQ ID NO: 1827347 - DNA, 12 bp, Homo sapiens
gtacctgggaaa

SEQ ID NO: 1827348 - DNA, 18 bp, Homo sapiens
gtacctgggaaaggaccc

SEQ ID NO: 1827349 - DNA, 13 bp, Homo sapiens
gtactcagagcag

SEQ ID NO: 1827350 - DNA, 14 bp, Homo sapiens
ctccccaggcctcc

SEQ ID NO: 1827351 - DNA, 15 bp, Homo sapiens
ctccccaggcctcca

SEQ ID NO: 1827352 - DNA, 16 bp, Homo sapiens
ctccccaggcctccag

SEQ ID NO: 1827353 - DNA, 17 bp, Homo sapiens
ctccccaggcctccagc

SEQ ID NO: 1827354 - DNA, 16 bp, Homo sapiens
ctccccatgtgcctgc

SEQ ID NO: 1827355 - DNA, 20 bp, Homo sapiens
ctccccatgtgcctgcacca

SEQ ID NO: 1827356 - DNA, 21 bp, Homo sapiens
ctccccatgtgcctgcaccag

SEQ ID NO: 1827357 - DNA, 14 bp, Homo sapiens
ctcccccagagcca

SEQ ID NO: 1827358 - DNA, 14 bp, Homo sapiens
ctcccccccggggc

SEQ ID NO: 1827359 - DNA, 15 bp, Homo sapiens
ctcccccccggggct

SEQ ID NO: 1827360 - DNA, 21 bp, Homo sapiens
ctcccccccggggctgggttg

SEQ ID NO: 1827361 - DNA, 16 bp, Homo sapiens
ctcccccgacactgct

SEQ ID NO: 1827362 - DNA, 22 bp, Homo sapiens
ctcccctctcgccccatccctg

SEQ ID NO: 1827363 - DNA, 16 bp, Homo sapiens
ctcccggctgcctgcc

SEQ ID NO: 1827364 - DNA, 12 bp, Homo sapiens
ctccctctgccc

SEQ ID NO: 1827365 - DNA, 13 bp, Homo sapiens
ctccctctgcccc

SEQ ID NO: 1827366 - DNA, 13 bp, Homo sapiens
ctccctgcctgct

SEQ ID NO: 1827367 - DNA, 15 bp, Homo sapiens
ctccctgcctgctcc

SEQ ID NO: 1827368 - DNA, 18 bp, Homo sapiens
ctccctgctgtcccctct

SEQ ID NO: 1827369 - DNA, 19 bp, Homo sapiens
ctccctgctgtcccctctt

SEQ ID NO: 1827370 - DNA, 20 bp, Homo sapiens
ctccctgctgtcccctcttg

SEQ ID NO: 1827371 - DNA, 19 bp, Homo sapiens
ctccctggatgtgtggggc

SEQ ID NO: 1827372 - DNA, 13 bp, Homo sapiens
ctccctggccctc

SEQ ID NO: 1827373 - DNA, 17 bp, Homo sapiens
ctccctgtataagacac

SEQ ID NO: 1827374 - DNA, 23 bp, Homo sapiens
ctccctgtctccagggcccccac

SEQ ID NO: 1827375 - DNA, 17 bp, Homo sapiens
ctcccttttgtccttcc

SEQ ID NO: 1827376 - DNA, 23 bp, Homo sapiens
ctccgtccacccaggctgcactg

SEQ ID NO: 1827377 - DNA, 15 bp, Homo sapiens
ctccgtttatgggcc

SEQ ID NO: 1827378 - DNA, 18 bp, Homo sapiens
ctcctacccctcccagct

SEQ ID NO: 1827379 - DNA, 23 bp, Homo sapiens
ctcctacccctcccagctgacag

SEQ ID NO: 1827380 - DNA, 18 bp, Homo sapiens
ctcctagaggtgggcagc

SEQ ID NO: 1827381 - DNA, 21 bp, Homo sapiens
ctcctagaggtgggcagctgg

SEQ ID NO: 1827382 - DNA, 23 bp, Homo sapiens
ctcctagaggtgggcagctgggc

SEQ ID NO: 1827383 - DNA, 21 bp, Homo sapiens
ctcctcatttaatatttttca

SEQ ID NO: 1827384 - DNA, 14 bp, Homo sapiens
ctcctccacagtgc

SEQ ID NO: 1827385 - DNA, 15 bp, Homo sapiens
ctcctccacagtgct

SEQ ID NO: 1827386 - DNA, 17 bp, Homo sapiens
ctcctccacagtgctgc

SEQ ID NO: 1827387 - DNA, 18 bp, Homo sapiens
ctcctccacagtgctgct

SEQ ID NO: 1827388 - DNA, 13 bp, Homo sapiens
ctcctccaccgcc

SEQ ID NO: 1827389 - DNA, 15 bp, Homo sapiens
ctcctccaccgccat

SEQ ID NO: 1827390 - DNA, 19 bp, Homo sapiens
ctcctccaccgccatggct

SEQ ID NO: 1827391 - DNA, 14 bp, Homo sapiens
ctcctcccatggcc

SEQ ID NO: 1827392 - DNA, 17 bp, Homo sapiens
ctcctctccttgggctc

SEQ ID NO: 1827393 - DNA, 21 bp, Homo sapiens
ctcctctccttgggctcctgg

SEQ ID NO: 1827394 - DNA, 21 bp, Homo sapiens
ctcctcttaccgtagcctccg

SEQ ID NO: 1827395 - DNA, 20 bp, Homo sapiens
ctcctgagaaggcgaggaga

SEQ ID NO: 1827396 - DNA, 22 bp, Homo sapiens
ctcctgagaaggcgaggagagt

SEQ ID NO: 1827397 - DNA, 20 bp, Homo sapiens
ctcctgatggccaagagcat

SEQ ID NO: 1827398 - DNA, 22 bp, Homo sapiens
ctcctgctgcaccaacccagcc

SEQ ID NO: 1827399 - DNA, 12 bp, Homo sapiens
ctcctgctgcag

SEQ ID NO: 1827400 - DNA, 19 bp, Homo sapiens
ctcctggctgccaggcgtt

SEQ ID NO: 1827401 - DNA, 13 bp, Homo sapiens
ctcctgtcccgcc

SEQ ID NO: 1827402 - DNA, 19 bp, Homo sapiens
ctcctgtctccatgataac

SEQ ID NO: 1827403 - DNA, 15 bp, Homo sapiens
ctccttactctgagc

SEQ ID NO: 1827404 - DNA, 17 bp, Homo sapiens
ctccttactctgagccc

SEQ ID NO: 1827405 - DNA, 19 bp, Homo sapiens
ctccttactctgagcccag

SEQ ID NO: 1827406 - DNA, 23 bp, Homo sapiens
ctccttactctgagcccaggccg

SEQ ID NO: 1827407 - DNA, 14 bp, Homo sapiens
ctccttcgtgtctc

SEQ ID NO: 1827408 - DNA, 21 bp, Homo sapiens
ctccttcgtgtctctcccacc

SEQ ID NO: 1827409 - DNA, 22 bp, Homo sapiens
ctccttgggctcctggctgcca

SEQ ID NO: 1827410 - DNA, 19 bp, Homo sapiens
ctccttttgtccccagggc

SEQ ID NO: 1827411 - DNA, 21 bp, Homo sapiens
ctccttttgtccccagggccc

SEQ ID NO: 1827412 - DNA, 17 bp, Homo sapiens
ctcctttttctaccttt

SEQ ID NO: 1827413 - DNA, 16 bp, Homo sapiens
ctcgaaccaaggcagc

SEQ ID NO: 1827414 - DNA, 23 bp, Homo sapiens
ctcgaagaacaatgtcagaaact

SEQ ID NO: 1827415 - DNA, 14 bp, Homo sapiens
ctcgaggcaccggc

SEQ ID NO: 1827416 - DNA, 18 bp, Homo sapiens
ctcgaggcaccggcgctg

SEQ ID NO: 1827417 - DNA, 22 bp, Homo sapiens
ctcgcccaccgcatgccccctc

SEQ ID NO: 1827418 - DNA, 22 bp, Homo sapiens
ctcgctgatgctgggctgggtg

SEQ ID NO: 1827419 - DNA, 17 bp, Homo sapiens
ctcggaagccgtctgac

SEQ ID NO: 1827420 - DNA, 23 bp, Homo sapiens
ctcggacccaccaaactgcacac

SEQ ID NO: 1827421 - DNA, 17 bp, Homo sapiens
ctcggctcctgctgcac

SEQ ID NO: 1827422 - DNA, 12 bp, Homo sapiens
ctcgggcccagg

SEQ ID NO: 1827423 - DNA, 14 bp, Homo sapiens
ctcgggcccaggcc

SEQ ID NO: 1827424 - DNA, 15 bp, Homo sapiens
ctcgggctcctgtgc

SEQ ID NO: 1827425 - DNA, 20 bp, Homo sapiens
ctcggggcccttggggcctg

SEQ ID NO: 1827426 - DNA, 21 bp, Homo sapiens
ctcggggcccttggggcctgg

SEQ ID NO: 1827427 - DNA, 16 bp, Homo sapiens
ctcgtccacaggggca

SEQ ID NO: 1827428 - DNA, 21 bp, Homo sapiens
ctcgtccacaggggcaggcct

SEQ ID NO: 1827429 - DNA, 22 bp, Homo sapiens
ctcgtccacaggggcaggcctg

SEQ ID NO: 1827430 - DNA, 13 bp, Homo sapiens
ctcgtcctgtccc

SEQ ID NO: 1827431 - DNA, 14 bp, Homo sapiens
ctcgtcctgtccca

SEQ ID NO: 1827432 - DNA, 15 bp, Homo sapiens
ctcgtcctgtcccag

SEQ ID NO: 1827433 - DNA, 15 bp, Homo sapiens
ctcgtggacacctgc

SEQ ID NO: 1827434 - DNA, 11 bp, Homo sapiens
ctcgtggcctt

SEQ ID NO: 1827435 - DNA, 16 bp, Homo sapiens
ctctaatttattttgt

SEQ ID NO: 1827436 - DNA, 14 bp, Homo sapiens
ctctagctggcagg

SEQ ID NO: 1827437 - DNA, 18 bp, Homo sapiens
ctctagctggcaggacac

SEQ ID NO: 1827438 - DNA, 11 bp, Homo sapiens
ctctcaagtga

SEQ ID NO: 1827439 - DNA, 20 bp, Homo sapiens
ctctccacctagtggctgtc

SEQ ID NO: 1827440 - DNA, 15 bp, Homo sapiens
ctctcccaccccggc

SEQ ID NO: 1827441 - DNA, 23 bp, Homo sapiens
ctctcccctctcgccccatccct

SEQ ID NO: 1827442 - DNA, 19 bp, Homo sapiens
ctctcccggctgcctgccg

SEQ ID NO: 1827443 - DNA, 21 bp, Homo sapiens
ctctcctaccccacctcatgc

SEQ ID NO: 1827444 - DNA, 22 bp, Homo sapiens
ctctcctaccccacctcatgcc

SEQ ID NO: 1827445 - DNA, 21 bp, Homo sapiens
ctctccttcgtgtctctccca

SEQ ID NO: 1827446 - DNA, 13 bp, Homo sapiens
ctctccttgggct

SEQ ID NO: 1827447 - DNA, 17 bp, Homo sapiens
ctctccttgggctcctg

SEQ ID NO: 1827448 - DNA, 18 bp, Homo sapiens
ctctcgccccatccctgc

SEQ ID NO: 1827449 - DNA, 14 bp, Homo sapiens
ctctctgctctagc

SEQ ID NO: 1827450 - DNA, 16 bp, Homo sapiens
ctctctgctctagcca

SEQ ID NO: 1827451 - DNA, 17 bp, Homo sapiens
ctctctgctctagccag

SEQ ID NO: 1827452 - DNA, 18 bp, Homo sapiens
ctctctgctctagccagg

SEQ ID NO: 1827453 - DNA, 17 bp, Homo sapiens
ctctgagcccaggccgt

SEQ ID NO: 1827454 - DNA, 16 bp, Homo sapiens
ctctgccccaagcagc

SEQ ID NO: 1827455 - DNA, 18 bp, Homo sapiens
ctctgccccaagcagcca

SEQ ID NO: 1827456 - DNA, 19 bp, Homo sapiens
ctctgccccaagcagccag

SEQ ID NO: 1827457 - DNA, 21 bp, Homo sapiens
ctctgccccaagcagccagcc

SEQ ID NO: 1827458 - DNA, 22 bp, Homo sapiens
ctctgccccaagcagccagcca

SEQ ID NO: 1827459 - DNA, 17 bp, Homo sapiens
ctctgctctagccagga

SEQ ID NO: 1827460 - DNA, 19 bp, Homo sapiens
ctctgggctcagggctgga

SEQ ID NO: 1827461 - DNA, 21 bp, Homo sapiens
ctctggtaaacattcctccag

SEQ ID NO: 1827462 - DNA, 20 bp, Homo sapiens
ctctgtcatcactccctgga

SEQ ID NO: 1827463 - DNA, 17 bp, Homo sapiens
ctctgtccaggccactg

SEQ ID NO: 1827464 - DNA, 22 bp, Homo sapiens
ctctgtccaggccactgtggcc

SEQ ID NO: 1827465 - DNA, 13 bp, Homo sapiens
ctctgtcctgact

SEQ ID NO: 1827466 - DNA, 17 bp, Homo sapiens
gctgtaactgctgagcc

SEQ ID NO: 1827467 - DNA, 21 bp, Homo sapiens
gctgtaactgctgagccactc

SEQ ID NO: 1827468 - DNA, 17 bp, Homo sapiens
gctgtacccttccacct

SEQ ID NO: 1827469 - DNA, 20 bp, Homo sapiens
gctgtacccttccacctcct

SEQ ID NO: 1827470 - DNA, 13 bp, Homo sapiens
gctgtactcagag

SEQ ID NO: 1827471 - DNA, 20 bp, Homo sapiens
gctgtagacatttgctatga

SEQ ID NO: 1827472 - DNA, 14 bp, Homo sapiens
gctgtagccatggc

SEQ ID NO: 1827473 - DNA, 21 bp, Homo sapiens
gctgtagccatggctcaggca

SEQ ID NO: 1827474 - DNA, 14 bp, Homo sapiens
gctgtccagtgccc

SEQ ID NO: 1827475 - DNA, 23 bp, Homo sapiens
gctgtccagtgcccattcctcac

SEQ ID NO: 1827476 - DNA, 15 bp, Homo sapiens
gctgtcccctctgtc

SEQ ID NO: 1827477 - DNA, 16 bp, Homo sapiens
gctgtcccctctgtca

SEQ ID NO: 1827478 - DNA, 17 bp, Homo sapiens
gctgtcccctcttgccc

SEQ ID NO: 1827479 - DNA, 19 bp, Homo sapiens
gctgtcccctcttgcccca

SEQ ID NO: 1827480 - DNA, 12 bp, Homo sapiens
gctgtgccaccc

SEQ ID NO: 1827481 - DNA, 18 bp, Homo sapiens
gctgtgccaccctgggct

SEQ ID NO: 1827482 - DNA, 21 bp, Homo sapiens
gctgtgccaccctgggctctg

SEQ ID NO: 1827483 - DNA, 14 bp, Homo sapiens
gctgtgcctgctag

SEQ ID NO: 1827484 - DNA, 12 bp, Homo sapiens
gctgtggaggcc

SEQ ID NO: 1827485 - DNA, 15 bp, Homo sapiens
gctgtggcacagact

SEQ ID NO: 1827486 - DNA, 19 bp, Homo sapiens
gctgtggcatcaggaaagg

SEQ ID NO: 1827487 - DNA, 15 bp, Homo sapiens
gctgttgccatagcc

SEQ ID NO: 1827488 - DNA, 17 bp, Homo sapiens
gcttagccttgtgccct

SEQ ID NO: 1827489 - DNA, 19 bp, Homo sapiens
gcttagccttgtgccctgc

SEQ ID NO: 1827490 - DNA, 21 bp, Homo sapiens
gcttagccttgtgccctgccc

SEQ ID NO: 1827491 - DNA, 17 bp, Homo sapiens
gcttcacccctgcactt

SEQ ID NO: 1827492 - DNA, 13 bp, Homo sapiens
gcttccaggctct

SEQ ID NO: 1827493 - DNA, 21 bp, Homo sapiens
gcttccaggctcttcctggac

SEQ ID NO: 1827494 - DNA, 19 bp, Homo sapiens
gcttcctccgtccacccag

SEQ ID NO: 1827495 - DNA, 20 bp, Homo sapiens
gcttcctccgtccacccagg

SEQ ID NO: 1827496 - DNA, 21 bp, Homo sapiens
gcttcctccgtccacccaggc

SEQ ID NO: 1827497 - DNA, 15 bp, Homo sapiens
gcttcctgagggcta

SEQ ID NO: 1827498 - DNA, 23 bp, Homo sapiens
gcttctaggagtcaactggctgg

SEQ ID NO: 1827499 - DNA, 19 bp, Homo sapiens
gcttctgccacttcccagg

SEQ ID NO: 1827500 - DNA, 21 bp, Homo sapiens
gcttctgccacttcccaggta

SEQ ID NO: 1827501 - DNA, 17 bp, Homo sapiens
gcttctgctgggctggg

SEQ ID NO: 1827502 - DNA, 21 bp, Homo sapiens
gcttgaaaacttgctgaaaaa

SEQ ID NO: 1827503 - DNA, 17 bp, Homo sapiens
gcttgcccgctcccaca

SEQ ID NO: 1827504 - DNA, 16 bp, Homo sapiens
gcttgcctcggctcct

SEQ ID NO: 1827505 - DNA, 21 bp, Homo sapiens
gcttgcctcggctcctgctgc

SEQ ID NO: 1827506 - DNA, 23 bp, Homo sapiens
gcttgcctcggctcctgctgcac

SEQ ID NO: 1827507 - DNA, 22 bp, Homo sapiens
gcttggacttcctggggccccg

SEQ ID NO: 1827508 - DNA, 20 bp, Homo sapiens
gcttggtggggctcgtggcc

SEQ ID NO: 1827509 - DNA, 21 bp, Homo sapiens
gcttggtggggctcgtggcct

SEQ ID NO: 1827510 - DNA, 21 bp, Homo sapiens
gctttctccggggtctgtgct

SEQ ID NO: 1827511 - DNA, 23 bp, Homo sapiens
gctttctccggggtctgtgctgt

SEQ ID NO: 1827512 - DNA, 18 bp, Homo sapiens
gctttgcaggctctgggc

SEQ ID NO: 1827513 - DNA, 19 bp, Homo sapiens
gctttgcaggctctgggct

SEQ ID NO: 1827514 - DNA, 17 bp, Homo sapiens
gctttgggaggccaagg

SEQ ID NO: 1827515 - DNA, 18 bp, Homo sapiens
gctttgggaggccaaggc

SEQ ID NO: 1827516 - DNA, 19 bp, Homo sapiens
gctttgggaggccaaggca

SEQ ID NO: 1827517 - DNA, 20 bp, Homo sapiens
gctttggggacagttggcag

SEQ ID NO: 1827518 - DNA, 23 bp, Homo sapiens
gctttggggacagttggcagaga

SEQ ID NO: 1827519 - DNA, 20 bp, Homo sapiens
gctttggggtcctagcccag

SEQ ID NO: 1827520 - DNA, 21 bp, Homo sapiens
gcttttccaggatcctgcagg

SEQ ID NO: 1827521 - DNA, 22 bp, Homo sapiens
gcttttcctcaaagggagagag

SEQ ID NO: 1827522 - DNA, 13 bp, Homo sapiens
ggaaaaaggcttc

SEQ ID NO: 1827523 - DNA, 15 bp, Homo sapiens
ggaaagcgggcagcc

SEQ ID NO: 1827524 - DNA, 12 bp, Homo sapiens
ggaaaggaccca

SEQ ID NO: 1827525 - DNA, 13 bp, Homo sapiens
ggaaataaatgat

SEQ ID NO: 1827526 - DNA, 17 bp, Homo sapiens
ggaacacaataatgtgt

SEQ ID NO: 1827527 - DNA, 16 bp, Homo sapiens
ggaaccagggaggaga

SEQ ID NO: 1827528 - DNA, 19 bp, Homo sapiens
ggaaccagggaggagagga

SEQ ID NO: 1827529 - DNA, 18 bp, Homo sapiens
ggaaccccgcagcccgtg

SEQ ID NO: 1827530 - DNA, 13 bp, Homo sapiens
ggaactccactct

SEQ ID NO: 1827531 - DNA, 13 bp, Homo sapiens
ggaagagcagcct

SEQ ID NO: 1827532 - DNA, 16 bp, Homo sapiens
ctgtaactgctgagcc

SEQ ID NO: 1827533 - DNA, 15 bp, Homo sapiens
ctgtacccagctcct

SEQ ID NO: 1827534 - DNA, 21 bp, Homo sapiens
ctgtacccttccacctcctag

SEQ ID NO: 1827535 - DNA, 18 bp, Homo sapiens
ctgtactaaggagcatga

SEQ ID NO: 1827536 - DNA, 16 bp, Homo sapiens
ctgtactcagagcaga

SEQ ID NO: 1827537 - DNA, 20 bp, Homo sapiens
ctgtactcagagcagagcaa

SEQ ID NO: 1827538 - DNA, 22 bp, Homo sapiens
ctgtactgatactattcaatgc

SEQ ID NO: 1827539 - DNA, 12 bp, Homo sapiens
ctgtagccatgg

SEQ ID NO: 1827540 - DNA, 16 bp, Homo sapiens
ctgtagccatggctca

SEQ ID NO: 1827541 - DNA, 21 bp, Homo sapiens
ctgtagccatggctcaggcaa

SEQ ID NO: 1827542 - DNA, 23 bp, Homo sapiens
ctgtagccatggctcaggcaagc

SEQ ID NO: 1827543 - DNA, 16 bp, Homo sapiens
ctgtatagtaatcatt

SEQ ID NO: 1827544 - DNA, 20 bp, Homo sapiens
ctgtatagtaatcattgact

SEQ ID NO: 1827545 - DNA, 19 bp, Homo sapiens
ctgtatattccctgtggaa

SEQ ID NO: 1827546 - DNA, 14 bp, Homo sapiens
ctgtatcatttctt

SEQ ID NO: 1827547 - DNA, 12 bp, Homo sapiens
ctgtcagaggct

SEQ ID NO: 1827548 - DNA, 18 bp, Homo sapiens
ctgtcagtgccgccgcct

SEQ ID NO: 1827549 - DNA, 12 bp, Homo sapiens
ctgtccactctc

SEQ ID NO: 1827550 - DNA, 12 bp, Homo sapiens
ctgtccaggcca

SEQ ID NO: 1827551 - DNA, 13 bp, Homo sapiens
ctgtccaggccac

SEQ ID NO: 1827552 - DNA, 17 bp, Homo sapiens
ctgtccaggccactgtg

SEQ ID NO: 1827553 - DNA, 22 bp, Homo sapiens
ctgtccaggccactgtggccag

SEQ ID NO: 1827554 - DNA, 13 bp, Homo sapiens
ctgtcccagaggt

SEQ ID NO: 1827555 - DNA, 22 bp, Homo sapiens
ctgtcccagaggttatctgcct

SEQ ID NO: 1827556 - DNA, 16 bp, Homo sapiens
ctgtcccctctgtcat

SEQ ID NO: 1827557 - DNA, 16 bp, Homo sapiens
ctgtcccctcttgccc

SEQ ID NO: 1827558 - DNA, 20 bp, Homo sapiens
ctgtcccctcttgccccaac

SEQ ID NO: 1827559 - DNA, 15 bp, Homo sapiens
ctgtcccgccttcct

SEQ ID NO: 1827560 - DNA, 13 bp, Homo sapiens
ctgtcctgctcca

SEQ ID NO: 1827561 - DNA, 15 bp, Homo sapiens
ctgtcctgctccaca

SEQ ID NO: 1827562 - DNA, 16 bp, Homo sapiens
ctgtctgtctgtccca

SEQ ID NO: 1827563 - DNA, 20 bp, Homo sapiens
ctgtcttgagagaaaagaaa

SEQ ID NO: 1827564 - DNA, 21 bp, Homo sapiens
ctgtgaaagtctcctgtatca

SEQ ID NO: 1827565 - DNA, 16 bp, Homo sapiens
ctgtgaatatgagaaa

SEQ ID NO: 1827566 - DNA, 16 bp, Homo sapiens
ctgtgacacagctgag

SEQ ID NO: 1827567 - DNA, 15 bp, Homo sapiens
ctgtgccaccctggg

SEQ ID NO: 1827568 - DNA, 18 bp, Homo sapiens
ctgtgcccatgggcactg

SEQ ID NO: 1827569 - DNA, 18 bp, Homo sapiens
ctgtgcctgctagagcaa

SEQ ID NO: 1827570 - DNA, 19 bp, Homo sapiens
ctgtgcctgctagagcaac

SEQ ID NO: 1827571 - DNA, 21 bp, Homo sapiens
ctgtgcctgctagagcaaccc

SEQ ID NO: 1827572 - DNA, 21 bp, Homo sapiens
ctgtgctcttttggtggggag

SEQ ID NO: 1827573 - DNA, 13 bp, Homo sapiens
ctgtgctgtgcct

SEQ ID NO: 1827574 - DNA, 15 bp, Homo sapiens
ctgtggaggcctgat

SEQ ID NO: 1827575 - DNA, 17 bp, Homo sapiens
ctgtggaggcctgatgc

SEQ ID NO: 1827576 - DNA, 22 bp, Homo sapiens
ctgtggaggcctgatgctgccc

SEQ ID NO: 1827577 - DNA, 23 bp, Homo sapiens
ctgtggcacagacttctggaagg

SEQ ID NO: 1827578 - DNA, 19 bp, Homo sapiens
ctgtggcagaaaagaggag

SEQ ID NO: 1827579 - DNA, 20 bp, Homo sapiens
ctgtggccagagctggaagg

SEQ ID NO: 1827580 - DNA, 23 bp, Homo sapiens
ctgtggccagagctggaaggcag

SEQ ID NO: 1827581 - DNA, 20 bp, Homo sapiens
ctgtgggctgcactctgtgc

SEQ ID NO: 1827582 - DNA, 21 bp, Homo sapiens
ctgtgggctgcactctgtgcc

SEQ ID NO: 1827583 - DNA, 19 bp, Homo sapiens
ctgtgggggaagagcacag

SEQ ID NO: 1827584 - DNA, 22 bp, Homo sapiens
ctgtgggggaagagcacagccc

SEQ ID NO: 1827585 - DNA, 23 bp, Homo sapiens
ctgtgggggaagagcacagccct

SEQ ID NO: 1827586 - DNA, 14 bp, Homo sapiens
ctgtgtattctcat

SEQ ID NO: 1827587 - DNA, 14 bp, Homo sapiens
ctgtgtcactggct

SEQ ID NO: 1827588 - DNA, 17 bp, Homo sapiens
ctgtgtcactggctgcc

SEQ ID NO: 1827589 - DNA, 19 bp, Homo sapiens
ctgtgtcactggctgcctc

SEQ ID NO: 1827590 - DNA, 18 bp, Homo sapiens
ctgtgtccagcagctgcg

SEQ ID NO: 1827591 - DNA, 18 bp, Homo sapiens
ctgtgtgtgtgtatgtgg

SEQ ID NO: 1827592 - DNA, 20 bp, Homo sapiens
ctgtgtgtgtgtatgtgggg

SEQ ID NO: 1827593 - DNA, 17 bp, Homo sapiens
ctgtgtgtttatgtgtg

SEQ ID NO: 1827594 - DNA, 21 bp, Homo sapiens
ctgtgttactaatgatcactc

SEQ ID NO: 1827595 - DNA, 15 bp, Homo sapiens
ctgttgccatagccc

SEQ ID NO: 1827596 - DNA, 18 bp, Homo sapiens
ctgttgccatagccccat

SEQ ID NO: 1827597 - DNA, 15 bp, Homo sapiens
cttaaaggcctggaa

SEQ ID NO: 1827598 - DNA, 16 bp, Homo sapiens
cttaaaggcctggaac

SEQ ID NO: 1827599 - DNA, 19 bp, Homo sapiens
cttaagggttgaaggcagt

SEQ ID NO: 1827600 - DNA, 16 bp, Homo sapiens
cttactctgagcccag

SEQ ID NO: 1827601 - DNA, 17 bp, Homo sapiens
cttactctgagcccagg

SEQ ID NO: 1827602 - DNA, 20 bp, Homo sapiens
cttactctgagcccaggccg

SEQ ID NO: 1827603 - DNA, 22 bp, Homo sapiens
cttactctgagcccaggccgtt

SEQ ID NO: 1827604 - DNA, 23 bp, Homo sapiens
cttagaatgtttctatttccata

SEQ ID NO: 1827605 - DNA, 18 bp, Homo sapiens
cttagccgtccatggcac

SEQ ID NO: 1827606 - DNA, 11 bp, Homo sapiens
cttagccttgt

SEQ ID NO: 1827607 - DNA, 15 bp, Homo sapiens
cttagccttgtgccc

SEQ ID NO: 1827608 - DNA, 16 bp, Homo sapiens
cttagccttgtgccct

SEQ ID NO: 1827609 - DNA, 17 bp, Homo sapiens
cttagccttgtgccctg

SEQ ID NO: 1827610 - DNA, 21 bp, Homo sapiens
cttagtgcccgcctaggagtt

SEQ ID NO: 1827611 - DNA, 20 bp, Homo sapiens
cttatgagactcttaaatat

SEQ ID NO: 1827612 - DNA, 23 bp, Homo sapiens
cttatgtaagtttgcatatcagt

SEQ ID NO: 1827613 - DNA, 21 bp, Homo sapiens
gcaataaagtgtagcaccctg

SEQ ID NO: 1827614 - DNA, 17 bp, Homo sapiens
gcaatgagtgtgccaga

SEQ ID NO: 1827615 - DNA, 14 bp, Homo sapiens
gcaatgcaattcaa

SEQ ID NO: 1827616 - DNA, 20 bp, Homo sapiens
gcaattcaatgcaatgaaaa

SEQ ID NO: 1827617 - DNA, 14 bp, Homo sapiens
gcacaagctcagaa

SEQ ID NO: 1827618 - DNA, 13 bp, Homo sapiens
gcacaccactgcc

SEQ ID NO: 1827619 - DNA, 17 bp, Homo sapiens
gcacaccactgccctgc

SEQ ID NO: 1827620 - DNA, 20 bp, Homo sapiens
gcacaccactgccctgcctg

SEQ ID NO: 1827621 - DNA, 22 bp, Homo sapiens
gcacaccactgccctgcctgcc

SEQ ID NO: 1827622 - DNA, 14 bp, Homo sapiens
gcacagacttctgg

SEQ ID NO: 1827623 - DNA, 13 bp, Homo sapiens
gcacagccctccc

SEQ ID NO: 1827624 - DNA, 17 bp, Homo sapiens
gcacagccctcccgccc

SEQ ID NO: 1827625 - DNA, 18 bp, Homo sapiens
gcacagccctcccgcccc

SEQ ID NO: 1827626 - DNA, 22 bp, Homo sapiens
gcacagccctcccgccccttcc

SEQ ID NO: 1827627 - DNA, 12 bp, Homo sapiens
gcacagccctgg

SEQ ID NO: 1827628 - DNA, 13 bp, Homo sapiens
gcacagccctggg

SEQ ID NO: 1827629 - DNA, 14 bp, Homo sapiens
gcacagccctggga

SEQ ID NO: 1827630 - DNA, 15 bp, Homo sapiens
gcacaggggccccag

SEQ ID NO: 1827631 - DNA, 20 bp, Homo sapiens
gcacaggggccccagatctg

SEQ ID NO: 1827632 - DNA, 19 bp, Homo sapiens
gcacagtgtctgggctgac

SEQ ID NO: 1827633 - DNA, 21 bp, Homo sapiens
gcacagttgtctattctgagc

SEQ ID NO: 1827634 - DNA, 23 bp, Homo sapiens
gcacagttgtctattctgagcct

SEQ ID NO: 1827635 - DNA, 20 bp, Homo sapiens
gcacatcattcattcactgt

SEQ ID NO: 1827636 - DNA, 15 bp, Homo sapiens
gcaccaacccagccg

SEQ ID NO: 1827637 - DNA, 16 bp, Homo sapiens
gcaccaacccagccgc

SEQ ID NO: 1827638 - DNA, 22 bp, Homo sapiens
gcaccagagtgaaagggctatg

SEQ ID NO: 1827639 - DNA, 14 bp, Homo sapiens
gcaccagccccctg

SEQ ID NO: 1827640 - DNA, 14 bp, Homo sapiens
gcaccagctctgtg

SEQ ID NO: 1827641 - DNA, 17 bp, Homo sapiens
gcaccagctctgtggcc

SEQ ID NO: 1827642 - DNA, 19 bp, Homo sapiens
gcaccagctctgtggcctg

SEQ ID NO: 1827643 - DNA, 23 bp, Homo sapiens
gcaccagctctgtggcctgtgtc

SEQ ID NO: 1827644 - DNA, 13 bp, Homo sapiens
gcaccagctgctc

SEQ ID NO: 1827645 - DNA, 20 bp, Homo sapiens
gcaccagctgctctgcccct

SEQ ID NO: 1827646 - DNA, 21 bp, Homo sapiens
gcaccagctgctctgcccctt

SEQ ID NO: 1827647 - DNA, 12 bp, Homo sapiens
gcaccaggagac

SEQ ID NO: 1827648 - DNA, 17 bp, Homo sapiens
gcacccccatgctgcct

SEQ ID NO: 1827649 - DNA, 12 bp, Homo sapiens
gcaccccctcct

SEQ ID NO: 1827650 - DNA, 17 bp, Homo sapiens
gcacccgggctcaggga

SEQ ID NO: 1827651 - DNA, 21 bp, Homo sapiens
gcacccgggctcagggaccac

SEQ ID NO: 1827652 - DNA, 22 bp, Homo sapiens
gcacccgggctcagggaccaca

SEQ ID NO: 1827653 - DNA, 23 bp, Homo sapiens
gcacccgggctcagggaccacag

SEQ ID NO: 1827654 - DNA, 13 bp, Homo sapiens
gcaccctgggtgc

SEQ ID NO: 1827655 - DNA, 22 bp, Homo sapiens
gcaccctgggtgccattcccag

SEQ ID NO: 1827656 - DNA, 15 bp, Homo sapiens
gcaccggcgctgcag

SEQ ID NO: 1827657 - DNA, 17 bp, Homo sapiens
gcaccggcgctgcaggt

SEQ ID NO: 1827658 - DNA, 22 bp, Homo sapiens
gcacctatgagatggccatgct

SEQ ID NO: 1827659 - DNA, 23 bp, Homo sapiens
gcacctatgagatggccatgctc

SEQ ID NO: 1827660 - DNA, 24 bp, Homo sapiens
gcacctatgagatggccatgctca

SEQ ID NO: 1827661 - DNA, 13 bp, Homo sapiens
gcacctcctgaga

SEQ ID NO: 1827662 - DNA, 15 bp, Homo sapiens
gcacctcctgagaag

SEQ ID NO: 1827663 - DNA, 20 bp, Homo sapiens
gcacctcctgagaaggcgag

SEQ ID NO: 1827664 - DNA, 19 bp, Homo sapiens
gcacctgaaccccatgggc

SEQ ID NO: 1827665 - DNA, 15 bp, Homo sapiens
gcacctgcaggttgg

SEQ ID NO: 1827666 - DNA, 14 bp, Homo sapiens
gcacctggcctgct

SEQ ID NO: 1827667 - DNA, 15 bp, Homo sapiens
gcacctggcctgctg

SEQ ID NO: 1827668 - DNA, 16 bp, Homo sapiens
gcacctggcctgctgg

SEQ ID NO: 1827669 - DNA, 18 bp, Homo sapiens
gcacctggcctgctggga

SEQ ID NO: 1827670 - DNA, 15 bp, Homo sapiens
gcacgcctgccttct

SEQ ID NO: 1827671 - DNA, 11 bp, Homo sapiens
gcactctgtgc

SEQ ID NO: 1827672 - DNA, 13 bp, Homo sapiens
gcactctgtgccc

SEQ ID NO: 1827673 - DNA, 14 bp, Homo sapiens
gcactctgtgccca

SEQ ID NO: 1827674 - DNA, 15 bp, Homo sapiens
gcactgccagactga

SEQ ID NO: 1827675 - DNA, 19 bp, Homo sapiens
gcactgctgggtggcccat

SEQ ID NO: 1827676 - DNA, 18 bp, Homo sapiens
gcactggccagagagggc

SEQ ID NO: 1827677 - DNA, 15 bp, Homo sapiens
gcactggccccaccc

SEQ ID NO: 1827678 - DNA, 14 bp, Homo sapiens
gcactgtcctgctc

SEQ ID NO: 1827679 - DNA, 16 bp, Homo sapiens
gcactgtcctgctcca

SEQ ID NO: 1827680 - DNA, 18 bp, Homo sapiens
gcactgtcctgctccaca

SEQ ID NO: 1827681 - DNA, 17 bp, Homo sapiens
gcacttgcgtcctgcag

SEQ ID NO: 1827682 - DNA, 15 bp, Homo sapiens
gcacttttaacaaaa

SEQ ID NO: 1827683 - DNA, 19 bp, Homo sapiens
gcagaaaagaggagaccct

SEQ ID NO: 1827684 - DNA, 22 bp, Homo sapiens
gcagaaaagaggagaccctgga

SEQ ID NO: 1827685 - DNA, 15 bp, Homo sapiens
gcagagaaggcctct

SEQ ID NO: 1827686 - DNA, 19 bp, Homo sapiens
gcagagcaaatgagggagg

SEQ ID NO: 1827687 - DNA, 17 bp, Homo sapiens
gcagagccatgggcctg

SEQ ID NO: 1827688 - DNA, 21 bp, Homo sapiens
gcagagccatgggcctgggcc

SEQ ID NO: 1827689 - DNA, 13 bp, Homo sapiens
gcagaggaccaca

SEQ ID NO: 1827690 - DNA, 21 bp, Homo sapiens
gcagagggaatgttccctgca

SEQ ID NO: 1827691 - DNA, 17 bp, Homo sapiens
gcagaggggcagccgct

SEQ ID NO: 1827692 - DNA, 15 bp, Homo sapiens
gcagatctttttgtg

SEQ ID NO: 1827693 - DNA, 16 bp, Homo sapiens
gcagattcctgggcct

SEQ ID NO: 1827694 - DNA, 22 bp, Homo sapiens
gcagattcctgggcctgtcccc

SEQ ID NO: 1827695 - DNA, 16 bp, Homo sapiens
gcagcagagagccctg

SEQ ID NO: 1827696 - DNA, 13 bp, Homo sapiens
gcagcagcccagc

SEQ ID NO: 1827697 - DNA, 14 bp, Homo sapiens
gcagcagcccagct

SEQ ID NO: 1827698 - DNA, 12 bp, Homo sapiens
gcagcagctagg

SEQ ID NO: 1827699 - DNA, 20 bp, Homo sapiens
gcagcagctaggactgagga

SEQ ID NO: 1827700 - DNA, 12 bp, Homo sapiens
gcagcaggtgct

SEQ ID NO: 1827701 - DNA, 15 bp, Homo sapiens
gcagcaggtgctgct

SEQ ID NO: 1827702 - DNA, 19 bp, Homo sapiens
gcagcaggtgctgctaccc

SEQ ID NO: 1827703 - DNA, 23 bp, Homo sapiens
gcagccagccagtcttgcctagg

SEQ ID NO: 1827704 - DNA, 16 bp, Homo sapiens
gcagccatgcctcatg

SEQ ID NO: 1827705 - DNA, 18 bp, Homo sapiens
gcagccatgcctcatgcc

SEQ ID NO: 1827706 - DNA, 18 bp, Homo sapiens
gcagccccgttttgggga

SEQ ID NO: 1827707 - DNA, 21 bp, Homo sapiens
gcagcccgtgaagcagtgcct

SEQ ID NO: 1827708 - DNA, 22 bp, Homo sapiens
gcagcccgtgaagcagtgcctc

SEQ ID NO: 1827709 - DNA, 14 bp, Homo sapiens
gcagcctccagagc

SEQ ID NO: 1827710 - DNA, 16 bp, Homo sapiens
gcagcctccagagcca

SEQ ID NO: 1827711 - DNA, 17 bp, Homo sapiens
gcagcctccagagccag

SEQ ID NO: 1827712 - DNA, 19 bp, Homo sapiens
gcagcctccagagccagcc

SEQ ID NO: 1827713 - DNA, 12 bp, Homo sapiens
gcagcctgatgg

SEQ ID NO: 1827714 - DNA, 13 bp, Homo sapiens
gcagcctgatggc

SEQ ID NO: 1827715 - DNA, 15 bp, Homo sapiens
gcagcctgatggcca

SEQ ID NO: 1827716 - DNA, 17 bp, Homo sapiens
gcagctaggactgagga

SEQ ID NO: 1827717 - DNA, 21 bp, Homo sapiens
gcagctaggactgaggagtgg

SEQ ID NO: 1827718 - DNA, 17 bp, Homo sapiens
gcagctcctctccttgg

SEQ ID NO: 1827719 - DNA, 18 bp, Homo sapiens
gcagctgggccccaccta

SEQ ID NO: 1827720 - DNA, 15 bp, Homo sapiens
gcagcttctgccact

SEQ ID NO: 1827721 - DNA, 14 bp, Homo sapiens
gcaggaacgagcac

SEQ ID NO: 1827722 - DNA, 15 bp, Homo sapiens
gcaggaacgagcact

SEQ ID NO: 1827723 - DNA, 21 bp, Homo sapiens
gcaggaacgagcactggccag

SEQ ID NO: 1827724 - DNA, 17 bp, Homo sapiens
gcaggacacatcccggc

SEQ ID NO: 1827725 - DNA, 22 bp, Homo sapiens
gcaggacacatcccggcctctt

SEQ ID NO: 1827726 - DNA, 14 bp, Homo sapiens
gcaggaggaggtgc

SEQ ID NO: 1827727 - DNA, 20 bp, Homo sapiens
gcaggaggaggtgccaacag

SEQ ID NO: 1827728 - DNA, 17 bp, Homo sapiens
gcaggatccgctgccac

SEQ ID NO: 1827729 - DNA, 18 bp, Homo sapiens
gcaggcacagcacaggga

SEQ ID NO: 1827730 - DNA, 16 bp, Homo sapiens
cacctggcctgctggg

SEQ ID NO: 1827731 - DNA, 17 bp, Homo sapiens
cacctggcctgctggga

SEQ ID NO: 1827732 - DNA, 18 bp, Homo sapiens
cacctggcctgctgggaa

SEQ ID NO: 1827733 - DNA, 22 bp, Homo sapiens
cacctggttgacccaaaaatgt

SEQ ID NO: 1827734 - DNA, 11 bp, Homo sapiens
cacctgtctgt

SEQ ID NO: 1827735 - DNA, 13 bp, Homo sapiens
cacctgtctgtct

SEQ ID NO: 1827736 - DNA, 22 bp, Homo sapiens
cacctgtctgtctgtctgtccc

SEQ ID NO: 1827737 - DNA, 18 bp, Homo sapiens
cacgagtcacctgcaagc

SEQ ID NO: 1827738 - DNA, 14 bp, Homo sapiens
cacggtgcgtggct

SEQ ID NO: 1827739 - DNA, 17 bp, Homo sapiens
cacggtgcgtggctgtg

SEQ ID NO: 1827740 - DNA, 19 bp, Homo sapiens
cacggtgcgtggctgtggc

SEQ ID NO: 1827741 - DNA, 16 bp, Homo sapiens
cacgtcctgtcagtgc

SEQ ID NO: 1827742 - DNA, 12 bp, Homo sapiens
cacgtctgccag

SEQ ID NO: 1827743 - DNA, 13 bp, Homo sapiens
cacgtctgccagg

SEQ ID NO: 1827744 - DNA, 17 bp, Homo sapiens
cacgtctgccaggccca

SEQ ID NO: 1827745 - DNA, 20 bp, Homo sapiens
cacgtctgccaggcccatct

SEQ ID NO: 1827746 - DNA, 21 bp, Homo sapiens
cacgtctgccaggcccatctc

SEQ ID NO: 1827747 - DNA, 22 bp, Homo sapiens
cacgtctgccaggcccatctca

SEQ ID NO: 1827748 - DNA, 17 bp, Homo sapiens
cactaagctttctcctt

SEQ ID NO: 1827749 - DNA, 19 bp, Homo sapiens
cactactgtatttcattat

SEQ ID NO: 1827750 - DNA, 16 bp, Homo sapiens
cactagtcaagaaaaa

SEQ ID NO: 1827751 - DNA, 19 bp, Homo sapiens
cactagtcaagaaaaatat

SEQ ID NO: 1827752 - DNA, 15 bp, Homo sapiens
cactcaccagggtcc

SEQ ID NO: 1827753 - DNA, 12 bp, Homo sapiens
cactcagcagcc

SEQ ID NO: 1827754 - DNA, 23 bp, Homo sapiens
ggggctgcacctcctaccctccc

SEQ ID NO: 1827755 - DNA, 13 bp, Homo sapiens
ggggctgggttgg

SEQ ID NO: 1827756 - DNA, 23 bp, Homo sapiens
ggggctgggttggcgcaccctcc

SEQ ID NO: 1827757 - DNA, 21 bp, Homo sapiens
gggggctatttctctccccac

SEQ ID NO: 1827758 - DNA, 14 bp, Homo sapiens
ggggtcctagccca

SEQ ID NO: 1827759 - DNA, 14 bp, Homo sapiens
ggggtctgtgctgt

SEQ ID NO: 1827760 - DNA, 17 bp, Homo sapiens
ggggtctgtgctgtgcc

SEQ ID NO: 1827761 - DNA, 18 bp, Homo sapiens
ggggtctgtgctgtgcct

SEQ ID NO: 1827762 - DNA, 16 bp, Homo sapiens
gggtccaggaaggcag

SEQ ID NO: 1827763 - DNA, 19 bp, Homo sapiens
gggtccaggaaggcagctg

SEQ ID NO: 1827764 - DNA, 20 bp, Homo sapiens
gggtccaggaaggcagctgc

SEQ ID NO: 1827765 - DNA, 22 bp, Homo sapiens
gggtccaggaaggcagctgctc

SEQ ID NO: 1827766 - DNA, 16 bp, Homo sapiens
gggtccgcaccagctg

SEQ ID NO: 1827767 - DNA, 21 bp, Homo sapiens
gggtccgcaccagctgctctg

SEQ ID NO: 1827768 - DNA, 22 bp, Homo sapiens
gggtccgcaccagctgctctgc

SEQ ID NO: 1827769 - DNA, 22 bp, Homo sapiens
gggtcctcacctggttgaccca

SEQ ID NO: 1827770 - DNA, 22 bp, Homo sapiens
gggtctgaaggaatagccagag

SEQ ID NO: 1827771 - DNA, 17 bp, Homo sapiens
gggtctgtgctgtgcct

SEQ ID NO: 1827772 - DNA, 18 bp, Homo sapiens
gggtctgtgctgtgcctg

SEQ ID NO: 1827773 - DNA, 20 bp, Homo sapiens
gggtctgtgctgtgcctgct

SEQ ID NO: 1827774 - DNA, 17 bp, Homo sapiens
gggtcttgggctactgg

SEQ ID NO: 1827775 - DNA, 22 bp, Homo sapiens
gggtcttgggctactggcagct

SEQ ID NO: 1827776 - DNA, 11 bp, Homo sapiens
gggtggcccat

SEQ ID NO: 1827777 - DNA, 19 bp, Homo sapiens
gggtggcccatcccccctc

SEQ ID NO: 1827778 - DNA, 13 bp, Homo sapiens
gggtgggcctggc

SEQ ID NO: 1827779 - DNA, 15 bp, Homo sapiens
gggtgggcctggcct

SEQ ID NO: 1827780 - DNA, 19 bp, Homo sapiens
gggtgggcctggcctgagc

SEQ ID NO: 1827781 - DNA, 23 bp, Homo sapiens
gggtgggcctggcctgagctggg

SEQ ID NO: 1827782 - DNA, 18 bp, Homo sapiens
gggttgaaggcagtctga

SEQ ID NO: 1827783 - DNA, 19 bp, Homo sapiens
ggtagatcgcttgagccca

SEQ ID NO: 1827784 - DNA, 20 bp, Homo sapiens
ggtagatcgcttgagcccag

SEQ ID NO: 1827785 - DNA, 16 bp, Homo sapiens
ggtaggaactgctggg

SEQ ID NO: 1827786 - DNA, 18 bp, Homo sapiens
ggtaggaactgctgggct

SEQ ID NO: 1827787 - DNA, 16 bp, Homo sapiens
ggtaggcccttgtcct

SEQ ID NO: 1827788 - DNA, 20 bp, Homo sapiens
ggtaggcccttgtcctgcca

SEQ ID NO: 1827789 - DNA, 16 bp, Homo sapiens
ggtatgaacttgagga

SEQ ID NO: 1827790 - DNA, 19 bp, Homo sapiens
ggtatgaacttgaggacac

SEQ ID NO: 1827791 - DNA, 22 bp, Homo sapiens
ggtcaagaaatgagtctgtttg

SEQ ID NO: 1827792 - DNA, 14 bp, Homo sapiens
ggtcagtgtggaga

SEQ ID NO: 1827793 - DNA, 19 bp, Homo sapiens
ggtcagtgtggagaggggt

SEQ ID NO: 1827794 - DNA, 14 bp, Homo sapiens
ggtccaggaaggca

SEQ ID NO: 1827795 - DNA, 18 bp, Homo sapiens
ggtccaggaaggcagctg

SEQ ID NO: 1827796 - DNA, 19 bp, Homo sapiens
ggtccaggaaggcagctgc

SEQ ID NO: 1827797 - DNA, 22 bp, Homo sapiens
ggtccaggaaggcagctgctct

SEQ ID NO: 1827798 - DNA, 12 bp, Homo sapiens
ggtcccacttcc

SEQ ID NO: 1827799 - DNA, 19 bp, Homo sapiens
ggtccctggtccctcgtcc

SEQ ID NO: 1827800 - DNA, 19 bp, Homo sapiens
ggtccgcaccagctgctct

SEQ ID NO: 1827801 - DNA, 19 bp, Homo sapiens
ggtcctagcccagtgcttc

SEQ ID NO: 1827802 - DNA, 23 bp, Homo sapiens
ggtcctgcaatctccagggctgc

SEQ ID NO: 1827803 - DNA, 19 bp, Homo sapiens
ggtctccttactctgagcc

SEQ ID NO: 1827804 - DNA, 20 bp, Homo sapiens
ggtctccttactctgagccc

SEQ ID NO: 1827805 - DNA, 19 bp, Homo sapiens
ggtctcgctgatgctgggc

SEQ ID NO: 1827806 - DNA, 22 bp, Homo sapiens
ggtctcgctgatgctgggctgg

SEQ ID NO: 1827807 - DNA, 17 bp, Homo sapiens
ggtctgtgctgtgcctg

SEQ ID NO: 1827808 - DNA, 21 bp, Homo sapiens
ggtctgtgctgtgcctgctag

SEQ ID NO: 1827809 - DNA, 17 bp, Homo sapiens
ggtctgtgtgtgtgtat

SEQ ID NO: 1827810 - DNA, 21 bp, Homo sapiens
ggtctgtgtgtgtgtatgtgg

SEQ ID NO: 1827811 - DNA, 21 bp, Homo sapiens
ggtcttgggctactggcagct

SEQ ID NO: 1827812 - DNA, 13 bp, Homo sapiens
ggtgacacatcca

SEQ ID NO: 1827813 - DNA, 21 bp, Homo sapiens
ggtgacttcaggtggagagca

SEQ ID NO: 1827814 - DNA, 14 bp, Homo sapiens
ggtgagaccacctc

SEQ ID NO: 1827815 - DNA, 20 bp, Homo sapiens
ggtgcacccactcaccaggg

SEQ ID NO: 1827816 - DNA, 22 bp, Homo sapiens
ggtgcatacacccccacctcct

SEQ ID NO: 1827817 - DNA, 13 bp, Homo sapiens
ggtgccactccct

SEQ ID NO: 1827818 - DNA, 18 bp, Homo sapiens
gtttaaaaaaagtatata

SEQ ID NO: 1827819 - DNA, 20 bp, Homo sapiens
gtttaaaaaaagtatatatt

SEQ ID NO: 1827820 - DNA, 23 bp, Homo sapiens
gtttaaaaaaagtatatattcta

SEQ ID NO: 1827821 - DNA, 19 bp, Homo sapiens
gtttagtttctagaggcct

SEQ ID NO: 1827822 - DNA, 16 bp, Homo sapiens
gtttatgtgtgtgtgt

SEQ ID NO: 1827823 - DNA, 16 bp, Homo sapiens
gtttcacaacagattt

SEQ ID NO: 1827824 - DNA, 22 bp, Homo sapiens
gtttcacaacagatttctaagt

SEQ ID NO: 1827825 - DNA, 13 bp, Homo sapiens
gtttcctcatttt

SEQ ID NO: 1827826 - DNA, 21 bp, Homo sapiens
gtttctctcaatttgaaacac

SEQ ID NO: 1827827 - DNA, 13 bp, Homo sapiens
gtttctttcagat

SEQ ID NO: 1827828 - DNA, 17 bp, Homo sapiens
gtttgagacaagccctg

SEQ ID NO: 1827829 - DNA, 18 bp, Homo sapiens
gtttgagacaagccctgg

SEQ ID NO: 1827830 - DNA, 15 bp, Homo sapiens
gttttagaagttaaa

SEQ ID NO: 1827831 - DNA, 23 bp, Homo sapiens
gtttttataaaaaatggtgcctg

SEQ ID NO: 1827832 - DNA, 11 bp, Homo sapiens
gtttttcagaa

SEQ ID NO: 1827833 - DNA, 18 bp, Homo sapiens
taaaaaaagtatatattc

SEQ ID NO: 1827834 - DNA, 11 bp, Homo sapiens
taaaaaacaac

SEQ ID NO: 1827835 - DNA, 14 bp, Homo sapiens
taaaaaatcaaaag

SEQ ID NO: 1827836 - DNA, 15 bp, Homo sapiens
taaaaaatggtgcct

SEQ ID NO: 1827837 - DNA, 17 bp, Homo sapiens
taaaaaatggtgcctga

SEQ ID NO: 1827838 - DNA, 23 bp, Homo sapiens
taaaaagaggatgatttcagaag

SEQ ID NO: 1827839 - DNA, 16 bp, Homo sapiens
taaaaggaaaaaagaa

SEQ ID NO: 1827840 - DNA, 19 bp, Homo sapiens
taaaaggaaaaaagaaaaa

SEQ ID NO: 1827841 - DNA, 17 bp, Homo sapiens
taaaatcgtattctaat

SEQ ID NO: 1827842 - DNA, 20 bp, Homo sapiens
taaaatctggcaaagttata

SEQ ID NO: 1827843 - DNA, 20 bp, Homo sapiens
taaaatgcatatttctatgt

SEQ ID NO: 1827844 - DNA, 19 bp, Homo sapiens
taaaatgcccatttcgaag

SEQ ID NO: 1827845 - DNA, 19 bp, Homo sapiens
taaacaatgaattcttcaa

SEQ ID NO: 1827846 - DNA, 21 bp, Homo sapiens
taaacattcctccagcctccc

SEQ ID NO: 1827847 - DNA, 23 bp, Homo sapiens
taaacattcctccagcctcccct

SEQ ID NO: 1827848 - DNA, 20 bp, Homo sapiens
taaacattggtatatttcca

SEQ ID NO: 1827849 - DNA, 21 bp, Homo sapiens
taaacatttgtaaaaatactg

SEQ ID NO: 1827850 - DNA, 18 bp, Homo sapiens
taaagctggacaagaagc

SEQ ID NO: 1827851 - DNA, 23 bp, Homo sapiens
taaaggcctggaaccagggagga

SEQ ID NO: 1827852 - DNA, 15 bp, Homo sapiens
taaagtgtagcaccc

SEQ ID NO: 1827853 - DNA, 12 bp, Homo sapiens
taaataaaattg

SEQ ID NO: 1827854 - DNA, 20 bp, Homo sapiens
taaatcattttcattaaaag

SEQ ID NO: 1827855 - DNA, 19 bp, Homo sapiens
taaatccttgggagtcatt

SEQ ID NO: 1827856 - DNA, 19 bp, Homo sapiens
taaatctgacagtctcaaa

SEQ ID NO: 1827857 - DNA, 13 bp, Homo sapiens
taaatgtaaaaat

SEQ ID NO: 1827858 - DNA, 14 bp, Homo sapiens
gtgcctgtggcaga

SEQ ID NO: 1827859 - DNA, 18 bp, Homo sapiens
gtgcgaccccatctgccc

SEQ ID NO: 1827860 - DNA, 20 bp, Homo sapiens
gtgcgaccccatctgcccag

SEQ ID NO: 1827861 - DNA, 13 bp, Homo sapiens
gtgcgtggctgtg

SEQ ID NO: 1827862 - DNA, 12 bp, Homo sapiens
gtgctacctgca

SEQ ID NO: 1827863 - DNA, 23 bp, Homo sapiens
gtgctattgtagagccagaggtc

SEQ ID NO: 1827864 - DNA, 11 bp, Homo sapiens
gtgctctggcg

SEQ ID NO: 1827865 - DNA, 13 bp, Homo sapiens
gtgctctggcggc

SEQ ID NO: 1827866 - DNA, 19 bp, Homo sapiens
gtgctctttgttcatcatt

SEQ ID NO: 1827867 - DNA, 12 bp, Homo sapiens
gtgctgccatgc

SEQ ID NO: 1827868 - DNA, 13 bp, Homo sapiens
gtgctgccatgcc

SEQ ID NO: 1827869 - DNA, 16 bp, Homo sapiens
gtgctgccatgccact

SEQ ID NO: 1827870 - DNA, 17 bp, Homo sapiens
gtgctgccatgccactg

SEQ ID NO: 1827871 - DNA, 23 bp, Homo sapiens
gtgctgccatgccactgccaggc

SEQ ID NO: 1827872 - DNA, 17 bp, Homo sapiens
gtgctgctaccctccct

SEQ ID NO: 1827873 - DNA, 12 bp, Homo sapiens
gtgctgtgcctg

SEQ ID NO: 1827874 - DNA, 20 bp, Homo sapiens
gtgctgtgcctgctagagca

SEQ ID NO: 1827875 - DNA, 13 bp, Homo sapiens
gtggaagagcagc

SEQ ID NO: 1827876 - DNA, 17 bp, Homo sapiens
gtggaagagcagcctga

SEQ ID NO: 1827877 - DNA, 15 bp, Homo sapiens
gtggaagtgtgggtc

SEQ ID NO: 1827878 - DNA, 20 bp, Homo sapiens
gtggaagtgtgggtctgtgt

SEQ ID NO: 1827879 - DNA, 22 bp, Homo sapiens
gtggaagtgtgggtctgtgtgt

SEQ ID NO: 1827880 - DNA, 11 bp, Homo sapiens
gtggacacctg

SEQ ID NO: 1827881 - DNA, 16 bp, Homo sapiens
gtggacatcatgaagc

SEQ ID NO: 1827882 - DNA, 12 bp, Homo sapiens
gtggaggaaggt

SEQ ID NO: 1827883 - DNA, 19 bp, Homo sapiens
gtggaggaaggtgctgagc

SEQ ID NO: 1827884 - DNA, 11 bp, Homo sapiens
gtggaggcctg

SEQ ID NO: 1827885 - DNA, 17 bp, Homo sapiens
gtggaggcctgatgctg

SEQ ID NO: 1827886 - DNA, 14 bp, Homo sapiens
gtggatctggggac

SEQ ID NO: 1827887 - DNA, 18 bp, Homo sapiens
gtggattcagttcattcg

SEQ ID NO: 1827888 - DNA, 14 bp, Homo sapiens
gtggcagccatgcc

SEQ ID NO: 1827889 - DNA, 17 bp, Homo sapiens
gtggcagccatgcctca

SEQ ID NO: 1827890 - DNA, 19 bp, Homo sapiens
gtggcagccatgcctcatg

SEQ ID NO: 1827891 - DNA, 14 bp, Homo sapiens
gtggccagagctgg

SEQ ID NO: 1827892 - DNA, 15 bp, Homo sapiens
gtggccagagctgga

SEQ ID NO: 1827893 - DNA, 15 bp, Homo sapiens
gtggccccagcctgg

SEQ ID NO: 1827894 - DNA, 15 bp, Homo sapiens
gtggcctgtgtccag

SEQ ID NO: 1827895 - DNA, 20 bp, Homo sapiens
gtggcctgtgtccagcagct

SEQ ID NO: 1827896 - DNA, 22 bp, Homo sapiens
gtggctcatggcgtaatgggcc

SEQ ID NO: 1827897 - DNA, 13 bp, Homo sapiens
gtgggagtgtgta

SEQ ID NO: 1827898 - DNA, 14 bp, Homo sapiens
gtgggagtgtgtaa

SEQ ID NO: 1827899 - DNA, 19 bp, Homo sapiens
gtgggcctggcctgagctg

SEQ ID NO: 1827900 - DNA, 19 bp, Homo sapiens
gtgggcgggcagcacagca

SEQ ID NO: 1827901 - DNA, 22 bp, Homo sapiens
gtggggagcacttgcgtcctgc

SEQ ID NO: 1827902 - DNA, 21 bp, Homo sapiens
gtgggggaagagcacagccct

SEQ ID NO: 1827903 - DNA, 13 bp, Homo sapiens
gtccagtgcccat

SEQ ID NO: 1827904 - DNA, 12 bp, Homo sapiens
gtccataaagta

SEQ ID NO: 1827905 - DNA, 12 bp, Homo sapiens
gtccatggcacc

SEQ ID NO: 1827906 - DNA, 17 bp, Homo sapiens
gtccatggcaccagccc

SEQ ID NO: 1827907 - DNA, 20 bp, Homo sapiens
gtccatggcaccagccccct

SEQ ID NO: 1827908 - DNA, 14 bp, Homo sapiens
gtcccaaggagctg

SEQ ID NO: 1827909 - DNA, 23 bp, Homo sapiens
gtcccaaggagctgatttccagg

SEQ ID NO: 1827910 - DNA, 19 bp, Homo sapiens
gtcccagaggttatctgcc

SEQ ID NO: 1827911 - DNA, 20 bp, Homo sapiens
gtcccagaggttatctgcct

SEQ ID NO: 1827912 - DNA, 24 bp, Homo sapiens
gtcccagaggttatctgcctggcc

SEQ ID NO: 1827913 - DNA, 13 bp, Homo sapiens
gtccccagggccc

SEQ ID NO: 1827914 - DNA, 22 bp, Homo sapiens
gtcccccaaggttttggagtca

SEQ ID NO: 1827915 - DNA, 15 bp, Homo sapiens
gtcccctcttgcccc

SEQ ID NO: 1827916 - DNA, 16 bp, Homo sapiens
gtcccctcttgcccca

SEQ ID NO: 1827917 - DNA, 21 bp, Homo sapiens
gtcccctcttgccccaacccc

SEQ ID NO: 1827918 - DNA, 22 bp, Homo sapiens
gtcccgccttcctcctccacag

SEQ ID NO: 1827919 - DNA, 16 bp, Homo sapiens
gtccctcgtccacagg

SEQ ID NO: 1827920 - DNA, 16 bp, Homo sapiens
gtccctgaagagaagg

SEQ ID NO: 1827921 - DNA, 13 bp, Homo sapiens
gtccgcaccagct

SEQ ID NO: 1827922 - DNA, 15 bp, Homo sapiens
gtccgcaccagctgc

SEQ ID NO: 1827923 - DNA, 16 bp, Homo sapiens
gtccgcaccagctgct

SEQ ID NO: 1827924 - DNA, 18 bp, Homo sapiens
gtccgcaccagctgctct

SEQ ID NO: 1827925 - DNA, 17 bp, Homo sapiens
gtcctcacagcctctcc

SEQ ID NO: 1827926 - DNA, 18 bp, Homo sapiens
gtcctcacagcctctccc

SEQ ID NO: 1827927 - DNA, 20 bp, Homo sapiens
gtcctcacagcctctccctt

SEQ ID NO: 1827928 - DNA, 14 bp, Homo sapiens
gtcctctccaccta

SEQ ID NO: 1827929 - DNA, 23 bp, Homo sapiens
gtcctgacttcaggggctgcccg

SEQ ID NO: 1827930 - DNA, 18 bp, Homo sapiens
gtcctgcaatctccaggg

SEQ ID NO: 1827931 - DNA, 21 bp, Homo sapiens
gtcctgcaatctccagggctg

SEQ ID NO: 1827932 - DNA, 12 bp, Homo sapiens
gtcctgcagagg

SEQ ID NO: 1827933 - DNA, 20 bp, Homo sapiens
gtcctgcagaggaccacagt

SEQ ID NO: 1827934 - DNA, 21 bp, Homo sapiens
gtcctgcagaggaccacagtg

SEQ ID NO: 1827935 - DNA, 15 bp, Homo sapiens
gtcctgccagctgcc

SEQ ID NO: 1827936 - DNA, 16 bp, Homo sapiens
gtcctgccagctgcct

SEQ ID NO: 1827937 - DNA, 16 bp, Homo sapiens
gtcctgctccacagtg

SEQ ID NO: 1827938 - DNA, 17 bp, Homo sapiens
gtcctgctccacagtgt

SEQ ID NO: 1827939 - DNA, 15 bp, Homo sapiens
gtcctgtcccagagg

SEQ ID NO: 1827940 - DNA, 16 bp, Homo sapiens
gtcctgtcccagaggt

SEQ ID NO: 1827941 - DNA, 17 bp, Homo sapiens
gtccttcctgtgccctg

SEQ ID NO: 1827942 - DNA, 17 bp, Homo sapiens
gtcgcgctgcctgtgtg

SEQ ID NO: 1827943 - DNA, 18 bp, Homo sapiens
gtcgcgctgcctgtgtgg

SEQ ID NO: 1827944 - DNA, 16 bp, Homo sapiens
gtcggactgcccccag

SEQ ID NO: 1827945 - DNA, 17 bp, Homo sapiens
gtctattctgagccttg

SEQ ID NO: 1827946 - DNA, 21 bp, Homo sapiens
gtctcatttaggactgggttc

SEQ ID NO: 1827947 - DNA, 22 bp, Homo sapiens
gtctcatttaggactgggttcc

SEQ ID NO: 1827948 - DNA, 20 bp, Homo sapiens
gtctccagggcccccaccga

SEQ ID NO: 1827949 - DNA, 12 bp, Homo sapiens
gtctccctggcc

SEQ ID NO: 1827950 - DNA, 15 bp, Homo sapiens
cctgtgcagcagccc

SEQ ID NO: 1827951 - DNA, 19 bp, Homo sapiens
cctgtgcagcagcccagct

SEQ ID NO: 1827952 - DNA, 23 bp, Homo sapiens
cctgtgcagcagcccagcttcct

SEQ ID NO: 1827953 - DNA, 15 bp, Homo sapiens
cctgtgcccttattc

SEQ ID NO: 1827954 - DNA, 17 bp, Homo sapiens
cctgtgccttttgccat

SEQ ID NO: 1827955 - DNA, 21 bp, Homo sapiens
cctgtgggggaagagcacagc

SEQ ID NO: 1827956 - DNA, 17 bp, Homo sapiens
cctgtgtaaaaacaaca

SEQ ID NO: 1827957 - DNA, 17 bp, Homo sapiens
cctgtgtccagcagctg

SEQ ID NO: 1827958 - DNA, 16 bp, Homo sapiens
cctgttgggcagagct

SEQ ID NO: 1827959 - DNA, 17 bp, Homo sapiens
cctgttgggcagagctg

SEQ ID NO: 1827960 - DNA, 22 bp, Homo sapiens
cctgttgggcagagctggacaa

SEQ ID NO: 1827961 - DNA, 17 bp, Homo sapiens
cctgtttaaaaaaagta

SEQ ID NO: 1827962 - DNA, 14 bp, Homo sapiens
ccttaaaaatgcac

SEQ ID NO: 1827963 - DNA, 22 bp, Homo sapiens
ccttaagggttgaaggcagtct

SEQ ID NO: 1827964 - DNA, 15 bp, Homo sapiens
ccttactctgagccc

SEQ ID NO: 1827965 - DNA, 16 bp, Homo sapiens
ccttactctgagccca

SEQ ID NO: 1827966 - DNA, 21 bp, Homo sapiens
ccttactctgagcccaggccg

SEQ ID NO: 1827967 - DNA, 19 bp, Homo sapiens
ccttacttcggttcctctg

SEQ ID NO: 1827968 - DNA, 13 bp, Homo sapiens
ccttcagggccag

SEQ ID NO: 1827969 - DNA, 19 bp, Homo sapiens
ccttcagggccagaaggag

SEQ ID NO: 1827970 - DNA, 22 bp, Homo sapiens
ccttcagggccagaaggagggc

SEQ ID NO: 1827971 - DNA, 20 bp, Homo sapiens
ccttcccaaggttactcagc

SEQ ID NO: 1827972 - DNA, 22 bp, Homo sapiens
ccttccccttttgcctggctgt

SEQ ID NO: 1827973 - DNA, 12 bp, Homo sapiens
ccttccctggcc

SEQ ID NO: 1827974 - DNA, 14 bp, Homo sapiens
ccttccctggcccc

SEQ ID NO: 1827975 - DNA, 14 bp, Homo sapiens
ccttccctgggaag

SEQ ID NO: 1827976 - DNA, 15 bp, Homo sapiens
ccttcctcctccaca

SEQ ID NO: 1827977 - DNA, 11 bp, Homo sapiens
ccttcctggcc

SEQ ID NO: 1827978 - DNA, 14 bp, Homo sapiens
ccttcctggcctca

SEQ ID NO: 1827979 - DNA, 22 bp, Homo sapiens
ccttcctggcctcactggctgg

SEQ ID NO: 1827980 - DNA, 15 bp, Homo sapiens
ccttcctgtgccctg

SEQ ID NO: 1827981 - DNA, 14 bp, Homo sapiens
ccttccttcttgct

SEQ ID NO: 1827982 - DNA, 17 bp, Homo sapiens
ccttcgtgtctctccca

SEQ ID NO: 1827983 - DNA, 18 bp, Homo sapiens
ccttcgtgtctctcccac

SEQ ID NO: 1827984 - DNA, 20 bp, Homo sapiens
ccttcgtgtctctcccaccc

SEQ ID NO: 1827985 - DNA, 19 bp, Homo sapiens
ccttgccttttaaaagaaa

SEQ ID NO: 1827986 - DNA, 18 bp, Homo sapiens
ccttgctttgggctttgc

SEQ ID NO: 1827987 - DNA, 18 bp, Homo sapiens
ccttggcacccccatgct

SEQ ID NO: 1827988 - DNA, 21 bp, Homo sapiens
ccttggcacccccatgctgcc

SEQ ID NO: 1827989 - DNA, 22 bp, Homo sapiens
ccttgggcatccacccagtgct

SEQ ID NO: 1827990 - DNA, 23 bp, Homo sapiens
ccttgggcatccacccagtgctg

SEQ ID NO: 1827991 - DNA, 18 bp, Homo sapiens
ccttgggctcctggctgc

SEQ ID NO: 1827992 - DNA, 19 bp, Homo sapiens
ccttgggctcctggctgcc

SEQ ID NO: 1827993 - DNA, 20 bp, Homo sapiens
ccttgggctcctggctgcca

SEQ ID NO: 1827994 - DNA, 23 bp, Homo sapiens
ccttgggctcctggctgccaggc

SEQ ID NO: 1827995 - DNA, 15 bp, Homo sapiens
ccttgtcctgccagc

SEQ ID NO: 1827996 - DNA, 16 bp, Homo sapiens
ccttgtcctgccagct

SEQ ID NO: 1827997 - DNA, 19 bp, Homo sapiens
ccttgtcctgccagctgcc

SEQ ID NO: 1827998 - DNA, 21 bp, Homo sapiens
ccttgtcctgccagctgcctt

SEQ ID NO: 1827999 - DNA, 23 bp, Homo sapiens
atccttgtctttactgacaagaa

SEQ ID NO: 1828000 - DNA, 17 bp, Homo sapiens
atcgctgccttgccatg

SEQ ID NO: 1828001 - DNA, 17 bp, Homo sapiens
atcgcttgagcccagga

SEQ ID NO: 1828002 - DNA, 17 bp, Homo sapiens
atcgtattctaattctt

SEQ ID NO: 1828003 - DNA, 20 bp, Homo sapiens
atcgtattctaattcttcat

SEQ ID NO: 1828004 - DNA, 23 bp, Homo sapiens
atcgtattctaattcttcattat

SEQ ID NO: 1828005 - DNA, 16 bp, Homo sapiens
atcgtgacccttcagg

SEQ ID NO: 1828006 - DNA, 13 bp, Homo sapiens
atctagaaaatga

SEQ ID NO: 1828007 - DNA, 17 bp, Homo sapiens
atctagaaagaaaagac

SEQ ID NO: 1828008 - DNA, 18 bp, Homo sapiens
atctatatctctaaactg

SEQ ID NO: 1828009 - DNA, 15 bp, Homo sapiens
atctatttttgcact

SEQ ID NO: 1828010 - DNA, 21 bp, Homo sapiens
atctatttttgcactggaata

SEQ ID NO: 1828011 - DNA, 23 bp, Homo sapiens
atctatttttgcactggaatatc

SEQ ID NO: 1828012 - DNA, 19 bp, Homo sapiens
atctcacttcatcaatcaa

SEQ ID NO: 1828013 - DNA, 17 bp, Homo sapiens
atctcaggtgccactcc

SEQ ID NO: 1828014 - DNA, 17 bp, Homo sapiens
atctccagggctgcccc

SEQ ID NO: 1828015 - DNA, 12 bp, Homo sapiens
atctccccaggc

SEQ ID NO: 1828016 - DNA, 13 bp, Homo sapiens
atctccccaggcc

SEQ ID NO: 1828017 - DNA, 22 bp, Homo sapiens
atctccccaggcctccagcctc

SEQ ID NO: 1828018 - DNA, 17 bp, Homo sapiens
atctcctcccatggcct

SEQ ID NO: 1828019 - DNA, 15 bp, Homo sapiens
atctctaaactgctg

SEQ ID NO: 1828020 - DNA, 16 bp, Homo sapiens
atctctaaactgctgt

SEQ ID NO: 1828021 - DNA, 21 bp, Homo sapiens
atctcttcaatcactagtcaa

SEQ ID NO: 1828022 - DNA, 19 bp, Homo sapiens
atctgagaagtgtatatag

SEQ ID NO: 1828023 - DNA, 17 bp, Homo sapiens
atctgatacttatttac

SEQ ID NO: 1828024 - DNA, 13 bp, Homo sapiens
atctgcctggcct

SEQ ID NO: 1828025 - DNA, 14 bp, Homo sapiens
atctgcctggcctg

SEQ ID NO: 1828026 - DNA, 12 bp, Homo sapiens
atctgcctgggc

SEQ ID NO: 1828027 - DNA, 13 bp, Homo sapiens
atctgcctgggcc

SEQ ID NO: 1828028 - DNA, 15 bp, Homo sapiens
atctgcctgggcctg

SEQ ID NO: 1828029 - DNA, 17 bp, Homo sapiens
atctgcctgggcctgtg

SEQ ID NO: 1828030 - DNA, 21 bp, Homo sapiens
atctgcctgggcctgtgcagc

SEQ ID NO: 1828031 - DNA, 14 bp, Homo sapiens
atctgctgttgcca

SEQ ID NO: 1828032 - DNA, 16 bp, Homo sapiens
atctgtactgaaagca

SEQ ID NO: 1828033 - DNA, 22 bp, Homo sapiens
atctgtcaaagaaaacttccaa

SEQ ID NO: 1828034 - DNA, 14 bp, Homo sapiens
atctgtttgcttct

SEQ ID NO: 1828035 - DNA, 19 bp, Homo sapiens
atcttcaaaaatacagaat

SEQ ID NO: 1828036 - DNA, 14 bp, Homo sapiens
atcttcctgctgct

SEQ ID NO: 1828037 - DNA, 16 bp, Homo sapiens
atcttcctgctgctgt

SEQ ID NO: 1828038 - DNA, 15 bp, Homo sapiens
atctttcaatatcat

SEQ ID NO: 1828039 - DNA, 21 bp, Homo sapiens
atctttgggacacctcagaaa

SEQ ID NO: 1828040 - DNA, 17 bp, Homo sapiens
atgaacttgaggacaca

SEQ ID NO: 1828041 - DNA, 20 bp, Homo sapiens
atgaacttgaggacacatgt

SEQ ID NO: 1828042 - DNA, 12 bp, Homo sapiens
atgaactttaaa

SEQ ID NO: 1828043 - DNA, 23 bp, Homo sapiens
atgaagaaagggaggcccagccg

SEQ ID NO: 1828044 - DNA, 17 bp, Homo sapiens
atgaagacccagtgtaa

SEQ ID NO: 1828045 - DNA, 13 bp, Homo sapiens
atgaaggaattac

SEQ ID NO: 1828046 - DNA, 18 bp, Homo sapiens
atgaagtattaaaatgca

SEQ ID NO: 1828047 - DNA, 18 bp, Homo sapiens
atgaatgtgttgatttga

SEQ ID NO: 1828048 - DNA, 16 bp, Homo sapiens
atgagactcttaaata

SEQ ID NO: 1828049 - DNA, 18 bp, Homo sapiens
atgagagttccagattgt

SEQ ID NO: 1828050 - DNA, 19 bp, Homo sapiens
atgagatttgccagcacag

SEQ ID NO: 1828051 - DNA, 22 bp, Homo sapiens
atgagggagggggcgctcagga

SEQ ID NO: 1828052 - DNA, 14 bp, Homo sapiens
atgagtcacaaaat

SEQ ID NO: 1828053 - DNA, 22 bp, Homo sapiens
atgagtctacctgagcattcag

SEQ ID NO: 1828054 - DNA, 18 bp, Homo sapiens
atgagtctgtttgaaatg

SEQ ID NO: 1828055 - DNA, 20 bp, Homo sapiens
atgagtttccagctaagcct

SEQ ID NO: 1828056 - DNA, 18 bp, Homo sapiens
atgatgccacaccaagct

SEQ ID NO: 1828057 - DNA, 16 bp, Homo sapiens
atgatgggtcagttgt

SEQ ID NO: 1828058 - DNA, 21 bp, Homo sapiens
atgattgttttagaagttaaa

SEQ ID NO: 1828059 - DNA, 19 bp, Homo sapiens
atgcaaaagccaagaaagt

SEQ ID NO: 1828060 - DNA, 14 bp, Homo sapiens
atgcaaaagtgggg

SEQ ID NO: 1828061 - DNA, 12 bp, Homo sapiens
atgcaacaaaaa

SEQ ID NO: 1828062 - DNA, 13 bp, Homo sapiens
atgcaacaaaaat

SEQ ID NO: 1828063 - DNA, 16 bp, Homo sapiens
atgcaacaaaaatgtg

SEQ ID NO: 1828064 - DNA, 15 bp, Homo sapiens
atgcaattcaatgca

SEQ ID NO: 1828065 - DNA, 21 bp, Homo sapiens
atgcaattcaatgcaatgaaa

SEQ ID NO: 1828066 - DNA, 21 bp, Homo sapiens
atgcagattcctgggcctgtc

SEQ ID NO: 1828067 - DNA, 22 bp, Homo sapiens
atgcagattcctgggcctgtcc

SEQ ID NO: 1828068 - DNA, 23 bp, Homo sapiens
atgcagggaagagggcagtacct

SEQ ID NO: 1828069 - DNA, 12 bp, Homo sapiens
atgcatatttct

SEQ ID NO: 1828070 - DNA, 13 bp, Homo sapiens
atgcatatttcta

SEQ ID NO: 1828071 - DNA, 16 bp, Homo sapiens
atgccactgccaggca

SEQ ID NO: 1828072 - DNA, 17 bp, Homo sapiens
atgccactgccaggcac

SEQ ID NO: 1828073 - DNA, 20 bp, Homo sapiens
atgccactgccaggcacctg

SEQ ID NO: 1828074 - DNA, 22 bp, Homo sapiens
atgccactgccaggcacctggc

SEQ ID NO: 1828075 - DNA, 23 bp, Homo sapiens
atgccaggttaggaaggcagcat

SEQ ID NO: 1828076 - DNA, 18 bp, Homo sapiens
atgcccagcacaattcat

SEQ ID NO: 1828077 - DNA, 17 bp, Homo sapiens
atgccccctcgtgccag

SEQ ID NO: 1828078 - DNA, 18 bp, Homo sapiens
atgcctcatgccacacct

SEQ ID NO: 1828079 - DNA, 20 bp, Homo sapiens
atgcctggcccccctccagg

SEQ ID NO: 1828080 - DNA, 21 bp, Homo sapiens
atgctatctcgctagccatat

SEQ ID NO: 1828081 - DNA, 18 bp, Homo sapiens
atgctattgttgtgggct

SEQ ID NO: 1828082 - DNA, 17 bp, Homo sapiens
atgctcaacccccctcc

SEQ ID NO: 1828083 - DNA, 12 bp, Homo sapiens
atgctctgcccc

SEQ ID NO: 1828084 - DNA, 22 bp, Homo sapiens
atgctgctttttggcacagttg

SEQ ID NO: 1828085 - DNA, 15 bp, Homo sapiens
atgctgggctgggtg

SEQ ID NO: 1828086 - DNA, 13 bp, Homo sapiens
atgctttctcctt

SEQ ID NO: 1828087 - DNA, 15 bp, Homo sapiens
atgctttgggaggcc

SEQ ID NO: 1828088 - DNA, 21 bp, Homo sapiens
atgctttgggaggccaaggca

SEQ ID NO: 1828089 - DNA, 15 bp, Homo sapiens
atgctttgtgactat

SEQ ID NO: 1828090 - DNA, 14 bp, Homo sapiens
atggaactgacccc

SEQ ID NO: 1828091 - DNA, 16 bp, Homo sapiens
atggacatatgggttt

SEQ ID NO: 1828092 - DNA, 22 bp, Homo sapiens
atggaccgggtgggcctggcct

SEQ ID NO: 1828093 - DNA, 17 bp, Homo sapiens
atggagagggggtacaa

SEQ ID NO: 1828094 - DNA, 18 bp, Homo sapiens
atggagcatttttcagag

SEQ ID NO: 1828095 - DNA, 18 bp, Homo sapiens
atggaggtgatgaaaacc

SEQ ID NO: 1828096 - DNA, 13 bp, Homo sapiens
atggatggggaga

SEQ ID NO: 1828097 - DNA, 23 bp, Homo sapiens
atggcaagggggtgtcatctgag

SEQ ID NO: 1828098 - DNA, 17 bp, Homo sapiens
atggcaccagccccctg

SEQ ID NO: 1828099 - DNA, 22 bp, Homo sapiens
atggcaccagccccctggatgg

SEQ ID NO: 1828100 - DNA, 17 bp, Homo sapiens
atggcatcgttgcattt

SEQ ID NO: 1828101 - DNA, 16 bp, Homo sapiens
atggcctctttgtaga

SEQ ID NO: 1828102 - DNA, 15 bp, Homo sapiens
atggcgcgggaggca

SEQ ID NO: 1828103 - DNA, 19 bp, Homo sapiens
atggcgcgggaggcaccag

SEQ ID NO: 1828104 - DNA, 23 bp, Homo sapiens
atggcgcgggaggcaccagctct

SEQ ID NO: 1828105 - DNA, 21 bp, Homo sapiens
atggcgtaatgggcctgccca

SEQ ID NO: 1828106 - DNA, 22 bp, Homo sapiens
atggctcaggcaagcccctcag

SEQ ID NO: 1828107 - DNA, 17 bp, Homo sapiens
atggctctcaagtgaaa

SEQ ID NO: 1828108 - DNA, 14 bp, Homo sapiens
atgggcactgctgg

SEQ ID NO: 1828109 - DNA, 18 bp, Homo sapiens
atgggcattgggctgaca

SEQ ID NO: 1828110 - DNA, 14 bp, Homo sapiens
atgggcctgcccaa

SEQ ID NO: 1828111 - DNA, 21 bp, Homo sapiens
atgggcctgcccaatgctttg

SEQ ID NO: 1828112 - DNA, 12 bp, Homo sapiens
atgggcctgggc

SEQ ID NO: 1828113 - DNA, 17 bp, Homo sapiens
atgggcctgggcctgct

SEQ ID NO: 1828114 - DNA, 22 bp, Homo sapiens
atgggccttgctttgggctttg

SEQ ID NO: 1828115 - DNA, 15 bp, Homo sapiens
cacccactcaccagg

SEQ ID NO: 1828116 - DNA, 11 bp, Homo sapiens
cacccaggaag

SEQ ID NO: 1828117 - DNA, 15 bp, Homo sapiens
cacccaggctgcact

SEQ ID NO: 1828118 - DNA, 17 bp, Homo sapiens
cacccaggctgcactgc

SEQ ID NO: 1828119 - DNA, 18 bp, Homo sapiens
cacccaggctgcactgca

SEQ ID NO: 1828120 - DNA, 18 bp, Homo sapiens
cacccagtgctgccatgc

SEQ ID NO: 1828121 - DNA, 21 bp, Homo sapiens
cacccagtgctgccatgccac

SEQ ID NO: 1828122 - DNA, 14 bp, Homo sapiens
cacccatcttcctg

SEQ ID NO: 1828123 - DNA, 21 bp, Homo sapiens
cacccattcccccatgtggct

SEQ ID NO: 1828124 - DNA, 14 bp, Homo sapiens
cacccccatgctgc

SEQ ID NO: 1828125 - DNA, 16 bp, Homo sapiens
cacccccatgctgcct

SEQ ID NO: 1828126 - DNA, 20 bp, Homo sapiens
cacccccatgctgccttcag

SEQ ID NO: 1828127 - DNA, 14 bp, Homo sapiens
caccccctcctgct

SEQ ID NO: 1828128 - DNA, 15 bp, Homo sapiens
caccccctcctgctg

SEQ ID NO: 1828129 - DNA, 14 bp, Homo sapiens
caccccggcctcca

SEQ ID NO: 1828130 - DNA, 12 bp, Homo sapiens
cacccctgcact

SEQ ID NO: 1828131 - DNA, 17 bp, Homo sapiens
caccctcgtggacacct

SEQ ID NO: 1828132 - DNA, 22 bp, Homo sapiens
caccctgggctctgtgggctgc

SEQ ID NO: 1828133 - DNA, 12 bp, Homo sapiens
caccctgggtgc

SEQ ID NO: 1828134 - DNA, 17 bp, Homo sapiens
caccctgggtgccattc

SEQ ID NO: 1828135 - DNA, 22 bp, Homo sapiens
caccgagaggaaaaaggcttct

SEQ ID NO: 1828136 - DNA, 14 bp, Homo sapiens
caccgaggttccca

SEQ ID NO: 1828137 - DNA, 19 bp, Homo sapiens
caccgaggttcccagggct

SEQ ID NO: 1828138 - DNA, 15 bp, Homo sapiens
caccggcgctgcagg

SEQ ID NO: 1828139 - DNA, 16 bp, Homo sapiens
caccggcgctgcaggt

SEQ ID NO: 1828140 - DNA, 13 bp, Homo sapiens
cacctaccatgct

SEQ ID NO: 1828141 - DNA, 15 bp, Homo sapiens
cacctagtggctgtc

SEQ ID NO: 1828142 - DNA, 21 bp, Homo sapiens
cacctatgagatggccatgct

SEQ ID NO: 1828143 - DNA, 19 bp, Homo sapiens
cacctcatgcctggccccc

SEQ ID NO: 1828144 - DNA, 23 bp, Homo sapiens
cacctcatgcctggcccccctcc

SEQ ID NO: 1828145 - DNA, 17 bp, Homo sapiens
cacctcctaccctccca

SEQ ID NO: 1828146 - DNA, 22 bp, Homo sapiens
cacctcctagaggtgggcagct

SEQ ID NO: 1828147 - DNA, 23 bp, Homo sapiens
cacctcctagaggtgggcagctg

SEQ ID NO: 1828148 - DNA, 23 bp, Homo sapiens
cacctcctgagaaggcgaggaga

SEQ ID NO: 1828149 - DNA, 18 bp, Homo sapiens
cacctcttatgcacacct

SEQ ID NO: 1828150 - DNA, 15 bp, Homo sapiens
cacctgaaccccatg

SEQ ID NO: 1828151 - DNA, 19 bp, Homo sapiens
cacctgaaccccatgggct

SEQ ID NO: 1828152 - DNA, 23 bp, Homo sapiens
cacctgaaccccatgggcttgga

SEQ ID NO: 1828153 - DNA, 18 bp, Homo sapiens
cacctgacaatggcagct

SEQ ID NO: 1828154 - DNA, 17 bp, Homo sapiens
cacctgcaagccccagg

SEQ ID NO: 1828155 - DNA, 21 bp, Homo sapiens
cacctgcaagccccagggcct

SEQ ID NO: 1828156 - DNA, 22 bp, Homo sapiens
cacctgcaagccccagggcctg

SEQ ID NO: 1828157 - DNA, 18 bp, Homo sapiens
cacctgcaggttgggcca

SEQ ID NO: 1828158 - DNA, 12 bp, Homo sapiens
cacctgccctgc

SEQ ID NO: 1828159 - DNA, 16 bp, Homo sapiens
cacctgccctgccctg

SEQ ID NO: 1828160 - DNA, 21 bp, Homo sapiens
cacctgccctgccctgccacc

SEQ ID NO: 1828161 - DNA, 22 bp, Homo sapiens
cacctgccctgccctgccacct

SEQ ID NO: 1828162 - DNA, 20 bp, Homo sapiens
cacctgcctatccatcctgc

SEQ ID NO: 1828163 - DNA, 19 bp, Homo sapiens
cacctggcctgctgggaac

SEQ ID NO: 1828164 - DNA, 12 bp, Homo sapiens
cacctgtctgtc

SEQ ID NO: 1828165 - DNA, 19 bp, Homo sapiens
cacgagtcacctgcaagcc

SEQ ID NO: 1828166 - DNA, 20 bp, Homo sapiens
cacgcaagggcatcaggcac

SEQ ID NO: 1828167 - DNA, 23 bp, Homo sapiens
cacgcaagggcatcaggcactgg

SEQ ID NO: 1828168 - DNA, 21 bp, Homo sapiens
cacggtgcgtggctgtggcac

SEQ ID NO: 1828169 - DNA, 18 bp, Homo sapiens
cactaaatgatattcata

SEQ ID NO: 1828170 - DNA, 20 bp, Homo sapiens
cactactgtatttcattatc

SEQ ID NO: 1828171 - DNA, 14 bp, Homo sapiens
cactcaccagggtc

SEQ ID NO: 1828172 - DNA, 22 bp, Homo sapiens
cactcaccagggtccgcaccag

SEQ ID NO: 1828173 - DNA, 15 bp, Homo sapiens
cactcagcagccccc

SEQ ID NO: 1828174 - DNA, 13 bp, Homo sapiens
cactctgtgccca

SEQ ID NO: 1828175 - DNA, 18 bp, Homo sapiens
cactgaaatagagtgaat

SEQ ID NO: 1828176 - DNA, 18 bp, Homo sapiens
cactgaagtgcttgcaga

SEQ ID NO: 1828177 - DNA, 17 bp, Homo sapiens
cactgagaatgatagta

SEQ ID NO: 1828178 - DNA, 14 bp, Homo sapiens
cactgcaccccctc

SEQ ID NO: 1828179 - DNA, 15 bp, Homo sapiens
cactgcaccccctcc

SEQ ID NO: 1828180 - DNA, 19 bp, Homo sapiens
cactgcaccccctcctgct

SEQ ID NO: 1828181 - DNA, 20 bp, Homo sapiens
cactgcaccccctcctgctg

SEQ ID NO: 1828182 - DNA, 22 bp, Homo sapiens
cactgcaccccctcctgctgca

SEQ ID NO: 1828183 - DNA, 14 bp, Homo sapiens
cactgccaggcacc

SEQ ID NO: 1828184 - DNA, 19 bp, Homo sapiens
cactgccaggcacctggcc

SEQ ID NO: 1828185 - DNA, 23 bp, Homo sapiens
cactgccaggcacctggcctgct

SEQ ID NO: 1828186 - DNA, 12 bp, Homo sapiens
cactgccctgcc

SEQ ID NO: 1828187 - DNA, 13 bp, Homo sapiens
cactgccctgcct

SEQ ID NO: 1828188 - DNA, 18 bp, Homo sapiens
cactgccctgcctgccca

SEQ ID NO: 1828189 - DNA, 19 bp, Homo sapiens
cactgcggggcttggctga

SEQ ID NO: 1828190 - DNA, 21 bp, Homo sapiens
cactgcggggcttggctgaga

SEQ ID NO: 1828191 - DNA, 18 bp, Homo sapiens
cactgctgaaaaagaaaa

SEQ ID NO: 1828192 - DNA, 21 bp, Homo sapiens
cactgctgaaaaagaaaaaaa

SEQ ID NO: 1828193 - DNA, 15 bp, Homo sapiens
cactgctgcaccaga

SEQ ID NO: 1828194 - DNA, 23 bp, Homo sapiens
cactgctgggtggcccatccccc

SEQ ID NO: 1828195 - DNA, 11 bp, Homo sapiens
cactggccaga

SEQ ID NO: 1828196 - DNA, 15 bp, Homo sapiens
cactggccagagagg

SEQ ID NO: 1828197 - DNA, 22 bp, Homo sapiens
cactggccagagagggcccagc

SEQ ID NO: 1828198 - DNA, 13 bp, Homo sapiens
cactggccccacc

SEQ ID NO: 1828199 - DNA, 14 bp, Homo sapiens
cactggccccaccc

SEQ ID NO: 1828200 - DNA, 16 bp, Homo sapiens
cactggccccaccctc

SEQ ID NO: 1828201 - DNA, 13 bp, Homo sapiens
cactggctgcctc

SEQ ID NO: 1828202 - DNA, 21 bp, Homo sapiens
cactggctgcctccactccca

SEQ ID NO: 1828203 - DNA, 15 bp, Homo sapiens
cactggctggggcag

SEQ ID NO: 1828204 - DNA, 18 bp, Homo sapiens
cactggctggggcagagg

SEQ ID NO: 1828205 - DNA, 20 bp, Homo sapiens
cactggctggggcagagggg

SEQ ID NO: 1828206 - DNA, 12 bp, Homo sapiens
cactgggagagc

SEQ ID NO: 1828207 - DNA, 14 bp, Homo sapiens
cactgggagagctg

SEQ ID NO: 1828208 - DNA, 17 bp, Homo sapiens
cactggttgtaagtaat

SEQ ID NO: 1828209 - DNA, 18 bp, Homo sapiens
cactgtatagtaatcatt

SEQ ID NO: 1828210 - DNA, 13 bp, Homo sapiens
cactgtcctgctc

SEQ ID NO: 1828211 - DNA, 23 bp, Homo sapiens
cactgtgaactattttgaagaaa

SEQ ID NO: 1828212 - DNA, 16 bp, Homo sapiens
cactgtggccagagct

SEQ ID NO: 1828213 - DNA, 17 bp, Homo sapiens
cacttacagttaggatt

SEQ ID NO: 1828214 - DNA, 15 bp, Homo sapiens
cacttatctgatact

SEQ ID NO: 1828215 - DNA, 15 bp, Homo sapiens
cacttcatcaatcaa

SEQ ID NO: 1828216 - DNA, 13 bp, Homo sapiens
cacttcccctcct

SEQ ID NO: 1828217 - DNA, 15 bp, Homo sapiens
cacttcccctcctac

SEQ ID NO: 1828218 - DNA, 17 bp, Homo sapiens
cacttccttcagcatct

SEQ ID NO: 1828219 - DNA, 18 bp, Homo sapiens
cacttcttaaaggcctgg

SEQ ID NO: 1828220 - DNA, 15 bp, Homo sapiens
cacttgcgtcctgca

SEQ ID NO: 1828221 - DNA, 16 bp, Homo sapiens
cacttgcgtcctgcag

SEQ ID NO: 1828222 - DNA, 19 bp, Homo sapiens
cacttgcgtcctgcagagg

SEQ ID NO: 1828223 - DNA, 18 bp, Homo sapiens
cacttggagcccgtgcag

SEQ ID NO: 1828224 - DNA, 23 bp, Homo sapiens
cacttttaacaaaaaaggaaaat

SEQ ID NO: 1828225 - DNA, 21 bp, Homo sapiens
cagaaaagaggagaccctgga

SEQ ID NO: 1828226 - DNA, 21 bp, Homo sapiens
cagaaacagggacaaagaaat

SEQ ID NO: 1828227 - DNA, 17 bp, Homo sapiens
cagaaagcctcctgccc

SEQ ID NO: 1828228 - DNA, 15 bp, Homo sapiens
cagaacagaggcatt

SEQ ID NO: 1828229 - DNA, 14 bp, Homo sapiens
cagaacgcacccca

SEQ ID NO: 1828230 - DNA, 16 bp, Homo sapiens
cagaacgcaccccact

SEQ ID NO: 1828231 - DNA, 14 bp, Homo sapiens
caggtaggcccttg

SEQ ID NO: 1828232 - DNA, 19 bp, Homo sapiens
caggtaggcccttgtcctg

SEQ ID NO: 1828233 - DNA, 20 bp, Homo sapiens
caggtaggcccttgtcctgc

SEQ ID NO: 1828234 - DNA, 23 bp, Homo sapiens
caggtaggcccttgtcctgccag

SEQ ID NO: 1828235 - DNA, 16 bp, Homo sapiens
caggtcccccccaggt

SEQ ID NO: 1828236 - DNA, 17 bp, Homo sapiens
caggtgcagatgggctg

SEQ ID NO: 1828237 - DNA, 18 bp, Homo sapiens
caggtgcagatgggctgt

SEQ ID NO: 1828238 - DNA, 14 bp, Homo sapiens
caggtgccactccc

SEQ ID NO: 1828239 - DNA, 20 bp, Homo sapiens
caggtgccactccctgagct

SEQ ID NO: 1828240 - DNA, 21 bp, Homo sapiens
caggtgccactccctgagctt

SEQ ID NO: 1828241 - DNA, 16 bp, Homo sapiens
caggtgctgctaccct

SEQ ID NO: 1828242 - DNA, 22 bp, Homo sapiens
caggtgctgctaccctccctgc

SEQ ID NO: 1828243 - DNA, 20 bp, Homo sapiens
caggtggagagcactagaag

SEQ ID NO: 1828244 - DNA, 22 bp, Homo sapiens
caggtgggcgggcagcacagca

SEQ ID NO: 1828245 - DNA, 17 bp, Homo sapiens
caggtgtggtggctcat

SEQ ID NO: 1828246 - DNA, 19 bp, Homo sapiens
caggtgtggtggctcatgg

SEQ ID NO: 1828247 - DNA, 17 bp, Homo sapiens
caggttgggccatactg

SEQ ID NO: 1828248 - DNA, 19 bp, Homo sapiens
cagtaacatgcaacaaaaa

SEQ ID NO: 1828249 - DNA, 14 bp, Homo sapiens
cagtacctgggaaa

SEQ ID NO: 1828250 - DNA, 23 bp, Homo sapiens
cagtacctgggaaaggacccacc

SEQ ID NO: 1828251 - DNA, 15 bp, Homo sapiens
cagtatcttcaaaaa

SEQ ID NO: 1828252 - DNA, 17 bp, Homo sapiens
cagtatcttcaaaaata

SEQ ID NO: 1828253 - DNA, 18 bp, Homo sapiens
cagtatcttcaaaaatac

SEQ ID NO: 1828254 - DNA, 22 bp, Homo sapiens
cagtatcttcaaaaatacagaa

SEQ ID NO: 1828255 - DNA, 17 bp, Homo sapiens
cagtattctcagtgctc

SEQ ID NO: 1828256 - DNA, 19 bp, Homo sapiens
cagtcagttcccggagcac

SEQ ID NO: 1828257 - DNA, 20 bp, Homo sapiens
cagtcagttcccggagcaca

SEQ ID NO: 1828258 - DNA, 23 bp, Homo sapiens
cagtcagttcccggagcacagcc

SEQ ID NO: 1828259 - DNA, 15 bp, Homo sapiens
cagtccccagccctt

SEQ ID NO: 1828260 - DNA, 19 bp, Homo sapiens
cagtccccagcccttctgc

SEQ ID NO: 1828261 - DNA, 22 bp, Homo sapiens
cagtcctcacagcctctccctt

SEQ ID NO: 1828262 - DNA, 20 bp, Homo sapiens
cagtcctctccacctagtgg

SEQ ID NO: 1828263 - DNA, 20 bp, Homo sapiens
cagtcgcaggatccgctgcc

SEQ ID NO: 1828264 - DNA, 21 bp, Homo sapiens
cagtcgcaggatccgctgcca

SEQ ID NO: 1828265 - DNA, 22 bp, Homo sapiens
cagtcgcaggatccgctgccac

SEQ ID NO: 1828266 - DNA, 23 bp, Homo sapiens
cagtcgcaggatccgctgccacc

SEQ ID NO: 1828267 - DNA, 14 bp, Homo sapiens
cagtcgcgctgcct

SEQ ID NO: 1828268 - DNA, 15 bp, Homo sapiens
cagtcgcgctgcctg

SEQ ID NO: 1828269 - DNA, 18 bp, Homo sapiens
cagtctgggtctgggttt

SEQ ID NO: 1828270 - DNA, 20 bp, Homo sapiens
cagtcttatttttctagtca

SEQ ID NO: 1828271 - DNA, 18 bp, Homo sapiens
cagtcttgcctaggccaa

SEQ ID NO: 1828272 - DNA, 20 bp, Homo sapiens
cagtgaacttacacttggag

SEQ ID NO: 1828273 - DNA, 23 bp, Homo sapiens
cagtgaacttacacttggagccc

SEQ ID NO: 1828274 - DNA, 21 bp, Homo sapiens
cagtgactcgggctcctgtgc

SEQ ID NO: 1828275 - DNA, 18 bp, Homo sapiens
cagtgactggcaggtgca

SEQ ID NO: 1828276 - DNA, 14 bp, Homo sapiens
cagtgaggagggtg

SEQ ID NO: 1828277 - DNA, 21 bp, Homo sapiens
cagtgatggcgcgggaggcac

SEQ ID NO: 1828278 - DNA, 15 bp, Homo sapiens
cagtgcccagctaat

SEQ ID NO: 1828279 - DNA, 19 bp, Homo sapiens
cagtgcccattcctcacct

SEQ ID NO: 1828280 - DNA, 19 bp, Homo sapiens
cagtgccgccgcctcgccc

SEQ ID NO: 1828281 - DNA, 20 bp, Homo sapiens
cagtgccgccgcctcgccca

SEQ ID NO: 1828282 - DNA, 23 bp, Homo sapiens
cagtgccgccgcctcgcccaccg

SEQ ID NO: 1828283 - DNA, 14 bp, Homo sapiens
cagtgcctcgaggc

SEQ ID NO: 1828284 - DNA, 17 bp, Homo sapiens
cagtgcctcgaggcacc

SEQ ID NO: 1828285 - DNA, 18 bp, Homo sapiens
cagtgcctcgaggcaccg

SEQ ID NO: 1828286 - DNA, 13 bp, Homo sapiens
cagtgctgccatg

SEQ ID NO: 1828287 - DNA, 23 bp, Homo sapiens
cagtgctgccatgccactgccag

SEQ ID NO: 1828288 - DNA, 23 bp, Homo sapiens
cagtgcttctccaacactgaagt

SEQ ID NO: 1828289 - DNA, 16 bp, Homo sapiens
cagtggctggatctgt

SEQ ID NO: 1828290 - DNA, 23 bp, Homo sapiens
cagtgggtcccacttcccctcct

SEQ ID NO: 1828291 - DNA, 18 bp, Homo sapiens
cagtgtaaagaataaatg

SEQ ID NO: 1828292 - DNA, 16 bp, Homo sapiens
cagtgtacccccgccc

SEQ ID NO: 1828293 - DNA, 18 bp, Homo sapiens
cagtgtacccccgcccag

SEQ ID NO: 1828294 - DNA, 21 bp, Homo sapiens
cagtgtacccccgcccaggct

SEQ ID NO: 1828295 - DNA, 23 bp, Homo sapiens
cagtgtacccccgcccaggctgg

SEQ ID NO: 1828296 - DNA, 19 bp, Homo sapiens
cagtgtctgcctttaaata

SEQ ID NO: 1828297 - DNA, 13 bp, Homo sapiens
cagtgtgcccccc

SEQ ID NO: 1828298 - DNA, 17 bp, Homo sapiens
cagtgtgccccccatcc

SEQ ID NO: 1828299 - DNA, 22 bp, Homo sapiens
cagtgtgccccccatcctggcc

SEQ ID NO: 1828300 - DNA, 15 bp, Homo sapiens
cagtgtggagagggg

SEQ ID NO: 1828301 - DNA, 18 bp, Homo sapiens
cagtgttaggcctggcac

SEQ ID NO: 1828302 - DNA, 20 bp, Homo sapiens
cagtgttaggcctggcacag

SEQ ID NO: 1828303 - DNA, 23 bp, Homo sapiens
cagttcacttctttgcagagcct

SEQ ID NO: 1828304 - DNA, 19 bp, Homo sapiens
cagttcccggagcacagcc

SEQ ID NO: 1828305 - DNA, 20 bp, Homo sapiens
cagttcccggagcacagccc

SEQ ID NO: 1828306 - DNA, 22 bp, Homo sapiens
cagttcccggagcacagccctg

SEQ ID NO: 1828307 - DNA, 23 bp, Homo sapiens
cagttcccggagcacagccctgg

SEQ ID NO: 1828308 - DNA, 20 bp, Homo sapiens
cagttggcagagaaggcctc

SEQ ID NO: 1828309 - DNA, 16 bp, Homo sapiens
cagtttagaacagagg

SEQ ID NO: 1828310 - DNA, 16 bp, Homo sapiens
cataaaggtatttaga

SEQ ID NO: 1828311 - DNA, 23 bp, Homo sapiens
cataaatgcccagcacaattcat

SEQ ID NO: 1828312 - DNA, 15 bp, Homo sapiens
cataagaccgtgtcc

SEQ ID NO: 1828313 - DNA, 17 bp, Homo sapiens
cataatagttagccctc

SEQ ID NO: 1828314 - DNA, 12 bp, Homo sapiens
cataattctttt

SEQ ID NO: 1828315 - DNA, 17 bp, Homo sapiens
catacattaaggagcag

SEQ ID NO: 1828316 - DNA, 23 bp, Homo sapiens
catacattaaggagcagggtcct

SEQ ID NO: 1828317 - DNA, 13 bp, Homo sapiens
catacattatatt

SEQ ID NO: 1828318 - DNA, 14 bp, Homo sapiens
catacattatattc

SEQ ID NO: 1828319 - DNA, 21 bp, Homo sapiens
catactggcctcgcctggcct

SEQ ID NO: 1828320 - DNA, 17 bp, Homo sapiens
catacttttgagagggg

SEQ ID NO: 1828321 - DNA, 20 bp, Homo sapiens
catatggagcatttttcaga

SEQ ID NO: 1828322 - DNA, 13 bp, Homo sapiens
catatttctatgt

SEQ ID NO: 1828323 - DNA, 15 bp, Homo sapiens
catcactccctggat

SEQ ID NO: 1828324 - DNA, 11 bp, Homo sapiens
catcaggcact

SEQ ID NO: 1828325 - DNA, 14 bp, Homo sapiens
catcaggcactggt

SEQ ID NO: 1828326 - DNA, 16 bp, Homo sapiens
catcaggcactggtgg

SEQ ID NO: 1828327 - DNA, 21 bp, Homo sapiens
catcagtgtacccccgcccag

SEQ ID NO: 1828328 - DNA, 13 bp, Homo sapiens
catcatgtttaca

SEQ ID NO: 1828329 - DNA, 13 bp, Homo sapiens
catcattcattca

SEQ ID NO: 1828330 - DNA, 17 bp, Homo sapiens
catcattcattcactgt

SEQ ID NO: 1828331 - DNA, 22 bp, Homo sapiens
catcattggccctcattccaag

SEQ ID NO: 1828332 - DNA, 15 bp, Homo sapiens
catccacccagtgct

SEQ ID NO: 1828333 - DNA, 18 bp, Homo sapiens
catccacccagtgctgcc

SEQ ID NO: 1828334 - DNA, 13 bp, Homo sapiens
catccagcctgtg

SEQ ID NO: 1828335 - DNA, 15 bp, Homo sapiens
catccagcctgtgtg

SEQ ID NO: 1828336 - DNA, 17 bp, Homo sapiens
catcccctccctgcctg

SEQ ID NO: 1828337 - DNA, 20 bp, Homo sapiens
catcccctccctgcctgctc

SEQ ID NO: 1828338 - DNA, 17 bp, Homo sapiens
catcccctcgtcctgtc

SEQ ID NO: 1828339 - DNA, 22 bp, Homo sapiens
catcccctcgtcctgtcccaga

SEQ ID NO: 1828340 - DNA, 14 bp, Homo sapiens
catcccggcctctt

SEQ ID NO: 1828341 - DNA, 19 bp, Homo sapiens
catccctcggaagccgtct

SEQ ID NO: 1828342 - DNA, 11 bp, Homo sapiens
catcctggccc

SEQ ID NO: 1828343 - DNA, 12 bp, Homo sapiens
catcctggccca

SEQ ID NO: 1828344 - DNA, 14 bp, Homo sapiens
catcctggcccatc

SEQ ID NO: 1828345 - DNA, 16 bp, Homo sapiens
catcctggcccatcag

SEQ ID NO: 1828346 - DNA, 16 bp, Homo sapiens
aatattcaataaagct

SEQ ID NO: 1828347 - DNA, 17 bp, Homo sapiens
aatattgattttaaata

SEQ ID NO: 1828348 - DNA, 13 bp, Homo sapiens
aatattttccaaa

SEQ ID NO: 1828349 - DNA, 11 bp, Homo sapiens
aatatttttca

SEQ ID NO: 1828350 - DNA, 19 bp, Homo sapiens
aatatttttcaaaatcaaa

SEQ ID NO: 1828351 - DNA, 22 bp, Homo sapiens
aatatttttcaaaatcaaagtt

SEQ ID NO: 1828352 - DNA, 18 bp, Homo sapiens
aatcaaaaggtaatgcac

SEQ ID NO: 1828353 - DNA, 23 bp, Homo sapiens
aatcaaaaggtaatgcacatcct

SEQ ID NO: 1828354 - DNA, 20 bp, Homo sapiens
aatcaagcaaaatttctgta

SEQ ID NO: 1828355 - DNA, 15 bp, Homo sapiens
aatccatgtgctgct

SEQ ID NO: 1828356 - DNA, 19 bp, Homo sapiens
aatccatgtgctgctgtgg

SEQ ID NO: 1828357 - DNA, 12 bp, Homo sapiens
aatccttagaat

SEQ ID NO: 1828358 - DNA, 13 bp, Homo sapiens
aatctagaaaatg

SEQ ID NO: 1828359 - DNA, 15 bp, Homo sapiens
aatctcacttcatca

SEQ ID NO: 1828360 - DNA, 19 bp, Homo sapiens
aatctcacttcatcaatca

SEQ ID NO: 1828361 - DNA, 11 bp, Homo sapiens
aatctccaggg

SEQ ID NO: 1828362 - DNA, 18 bp, Homo sapiens
aatctccagggctgcccc

SEQ ID NO: 1828363 - DNA, 11 bp, Homo sapiens
aatctgctgtt

SEQ ID NO: 1828364 - DNA, 21 bp, Homo sapiens
aatctgctgttgccatagccc

SEQ ID NO: 1828365 - DNA, 19 bp, Homo sapiens
aatctggcaaagttatatt

SEQ ID NO: 1828366 - DNA, 23 bp, Homo sapiens
aatctttctatattttttaaatt

SEQ ID NO: 1828367 - DNA, 14 bp, Homo sapiens
aatgaattcttcaa

SEQ ID NO: 1828368 - DNA, 15 bp, Homo sapiens
aatgaattcttcaac

SEQ ID NO: 1828369 - DNA, 14 bp, Homo sapiens
aatgagcattagct

SEQ ID NO: 1828370 - DNA, 18 bp, Homo sapiens
aatgagtgtgccagagtt

SEQ ID NO: 1828371 - DNA, 20 bp, Homo sapiens
aatgagtttccagctaagcc

SEQ ID NO: 1828372 - DNA, 21 bp, Homo sapiens
aatgattgttttagaagttaa

SEQ ID NO: 1828373 - DNA, 17 bp, Homo sapiens
aatgcacaagctcagaa

SEQ ID NO: 1828374 - DNA, 12 bp, Homo sapiens
aatgcacatcct

SEQ ID NO: 1828375 - DNA, 21 bp, Homo sapiens
aatgcacatcctcattcacta

SEQ ID NO: 1828376 - DNA, 21 bp, Homo sapiens
aatgcagattcctgggcctgt

SEQ ID NO: 1828377 - DNA, 18 bp, Homo sapiens
aatgcagggaagagggca

SEQ ID NO: 1828378 - DNA, 13 bp, Homo sapiens
aatgcccagttca

SEQ ID NO: 1828379 - DNA, 12 bp, Homo sapiens
aatgggatctat

SEQ ID NO: 1828380 - DNA, 23 bp, Homo sapiens
aatgtcagaaactcgatgaatgt

SEQ ID NO: 1828381 - DNA, 15 bp, Homo sapiens
aatgtcagtatgtgg

SEQ ID NO: 1828382 - DNA, 23 bp, Homo sapiens
aatgtgatggtcaggatctcatg

SEQ ID NO: 1828383 - DNA, 17 bp, Homo sapiens
aatgtgttgatttgaga

SEQ ID NO: 1828384 - DNA, 22 bp, Homo sapiens
aatgtgttgatttgagaaattt

SEQ ID NO: 1828385 - DNA, 15 bp, Homo sapiens
aatgttccctgcacc

SEQ ID NO: 1828386 - DNA, 20 bp, Homo sapiens
aatgttccctgcaccctgga

SEQ ID NO: 1828387 - DNA, 13 bp, Homo sapiens
aatgtttctattt

SEQ ID NO: 1828388 - DNA, 18 bp, Homo sapiens
aatgtttctatttccata

SEQ ID NO: 1828389 - DNA, 16 bp, Homo sapiens
aattattgtgatttcc

SEQ ID NO: 1828390 - DNA, 21 bp, Homo sapiens
aattcaatgcaatgaaaacaa

SEQ ID NO: 1828391 - DNA, 19 bp, Homo sapiens
aattcattgttaaaaaaca

SEQ ID NO: 1828392 - DNA, 16 bp, Homo sapiens
aattccacaccctcac

SEQ ID NO: 1828393 - DNA, 17 bp, Homo sapiens
aattcctttacaactaa

SEQ ID NO: 1828394 - DNA, 21 bp, Homo sapiens
aattcctttacaactaaataa

SEQ ID NO: 1828395 - DNA, 13 bp, Homo sapiens
aattctagaaaat

SEQ ID NO: 1828396 - DNA, 20 bp, Homo sapiens
aattctgcaactagccaagg

SEQ ID NO: 1828397 - DNA, 12 bp, Homo sapiens
aattcttcaaca

SEQ ID NO: 1828398 - DNA, 19 bp, Homo sapiens
aattcttcaacagggaaaa

SEQ ID NO: 1828399 - DNA, 22 bp, Homo sapiens
aattcttcaacagggaaaacag

SEQ ID NO: 1828400 - DNA, 14 bp, Homo sapiens
aattcttcattata

SEQ ID NO: 1828401 - DNA, 22 bp, Homo sapiens
aattctttgacctgttgggagt

SEQ ID NO: 1828402 - DNA, 17 bp, Homo sapiens
aattgcaaaactagaca

SEQ ID NO: 1828403 - DNA, 19 bp, Homo sapiens
aattgcaaaactagacaaa

SEQ ID NO: 1828404 - DNA, 22 bp, Homo sapiens
aattgcaaaactagacaaaagt

SEQ ID NO: 1828405 - DNA, 19 bp, Homo sapiens
acccaggccctccatgggc

SEQ ID NO: 1828406 - DNA, 14 bp, Homo sapiens
acccaggctgcact

SEQ ID NO: 1828407 - DNA, 17 bp, Homo sapiens
acccaggctgcactgca

SEQ ID NO: 1828408 - DNA, 20 bp, Homo sapiens
acccaggctgcactgcagtg

SEQ ID NO: 1828409 - DNA, 14 bp, Homo sapiens
acccagtgctgcca

SEQ ID NO: 1828410 - DNA, 17 bp, Homo sapiens
acccagtgctgccatgc

SEQ ID NO: 1828411 - DNA, 22 bp, Homo sapiens
acccagtgctgccatgccactg

SEQ ID NO: 1828412 - DNA, 14 bp, Homo sapiens
acccagtgtaaaga

SEQ ID NO: 1828413 - DNA, 20 bp, Homo sapiens
acccagtgtaaagaataaat

SEQ ID NO: 1828414 - DNA, 16 bp, Homo sapiens
accccaaaccccagcc

SEQ ID NO: 1828415 - DNA, 17 bp, Homo sapiens
accccaaaccccagccc

SEQ ID NO: 1828416 - DNA, 20 bp, Homo sapiens
accccaagacagtcttttat

SEQ ID NO: 1828417 - DNA, 22 bp, Homo sapiens
accccacctcatgcctggcccc

SEQ ID NO: 1828418 - DNA, 14 bp, Homo sapiens
accccatgggcttg

SEQ ID NO: 1828419 - DNA, 15 bp, Homo sapiens
acccccatgctgcct

SEQ ID NO: 1828420 - DNA, 17 bp, Homo sapiens
acccccctcccagacag

SEQ ID NO: 1828421 - DNA, 21 bp, Homo sapiens
acccccgcccaggctggccag

SEQ ID NO: 1828422 - DNA, 23 bp, Homo sapiens
acccccgcccaggctggccagcc

SEQ ID NO: 1828423 - DNA, 15 bp, Homo sapiens
accccgcggtgctct

SEQ ID NO: 1828424 - DNA, 21 bp, Homo sapiens
accccggcctccactccccca

SEQ ID NO: 1828425 - DNA, 15 bp, Homo sapiens
acccctcccagctga

SEQ ID NO: 1828426 - DNA, 20 bp, Homo sapiens
accccttttcagcttctgct

SEQ ID NO: 1828427 - DNA, 23 bp, Homo sapiens
accccttttcagcttctgctggg

SEQ ID NO: 1828428 - DNA, 19 bp, Homo sapiens
acccgccttttataaacct

SEQ ID NO: 1828429 - DNA, 23 bp, Homo sapiens
accctatagagagggggctctcc

SEQ ID NO: 1828430 - DNA, 13 bp, Homo sapiens
accctccctgctg

SEQ ID NO: 1828431 - DNA, 15 bp, Homo sapiens
accctccctgctgtc

SEQ ID NO: 1828432 - DNA, 20 bp, Homo sapiens
accctccctgctgtcccctc

SEQ ID NO: 1828433 - DNA, 15 bp, Homo sapiens
accctcgtggacacc

SEQ ID NO: 1828434 - DNA, 22 bp, Homo sapiens
accctcgtggacacctgccctg

SEQ ID NO: 1828435 - DNA, 23 bp, Homo sapiens
accctcgtggacacctgccctgc

SEQ ID NO: 1828436 - DNA, 19 bp, Homo sapiens
accctggaaaggggagttg

SEQ ID NO: 1828437 - DNA, 10 bp, Homo sapiens
accctggaat

SEQ ID NO: 1828438 - DNA, 18 bp, Homo sapiens
accctggaattcagcacc

SEQ ID NO: 1828439 - DNA, 20 bp, Homo sapiens
accctgggtgccattcccag

SEQ ID NO: 1828440 - DNA, 21 bp, Homo sapiens
accctgggtgccattcccagc

SEQ ID NO: 1828441 - DNA, 14 bp, Homo sapiens
acccttgttattat

SEQ ID NO: 1828442 - DNA, 24 bp, Homo sapiens
acccttgttattatctactagtaa

SEQ ID NO: 1828443 - DNA, 20 bp, Homo sapiens
accgcttcacccctgcactt

SEQ ID NO: 1828444 - DNA, 15 bp, Homo sapiens
accgggtgggcctgg

SEQ ID NO: 1828445 - DNA, 17 bp, Homo sapiens
accgggtgggcctggcc

SEQ ID NO: 1828446 - DNA, 20 bp, Homo sapiens
accgtgtcccaaggagctga

SEQ ID NO: 1828447 - DNA, 20 bp, Homo sapiens
acctagtactctctgctcta

SEQ ID NO: 1828448 - DNA, 21 bp, Homo sapiens
acctagtactctctgctctag

SEQ ID NO: 1828449 - DNA, 17 bp, Homo sapiens
acctatacctatgtgaa

SEQ ID NO: 1828450 - DNA, 21 bp, Homo sapiens
acctatgtgagtttcagaaat

SEQ ID NO: 1828451 - DNA, 15 bp, Homo sapiens
acctcaactaaccct

SEQ ID NO: 1828452 - DNA, 17 bp, Homo sapiens
acctcaactaaccctta

SEQ ID NO: 1828453 - DNA, 10 bp, Homo sapiens
acctcacact

SEQ ID NO: 1828454 - DNA, 19 bp, Homo sapiens
acctcacttctggcactgt

SEQ ID NO: 1828455 - DNA, 17 bp, Homo sapiens
acctcagaaaacttatt

SEQ ID NO: 1828456 - DNA, 12 bp, Homo sapiens
acctcctaccct

SEQ ID NO: 1828457 - DNA, 14 bp, Homo sapiens
acctcctaccctcc

SEQ ID NO: 1828458 - DNA, 17 bp, Homo sapiens
acctcctaccctcccac

SEQ ID NO: 1828459 - DNA, 21 bp, Homo sapiens
cagaggggcagccgctaggag

SEQ ID NO: 1828460 - DNA, 22 bp, Homo sapiens
cagaggggcaggccctgcactg

SEQ ID NO: 1828461 - DNA, 17 bp, Homo sapiens
cagaggttatctgcctg

SEQ ID NO: 1828462 - DNA, 22 bp, Homo sapiens
cagaggttatctgcctggcctg

SEQ ID NO: 1828463 - DNA, 23 bp, Homo sapiens
cagaggttatctgcctggcctgg

SEQ ID NO: 1828464 - DNA, 13 bp, Homo sapiens
cagagtctgagcc

SEQ ID NO: 1828465 - DNA, 15 bp, Homo sapiens
cagagtctgagcccc

SEQ ID NO: 1828466 - DNA, 15 bp, Homo sapiens
cagagtgaaagggct

SEQ ID NO: 1828467 - DNA, 22 bp, Homo sapiens
aagggagagttctttgctgccc

SEQ ID NO: 1828468 - DNA, 16 bp, Homo sapiens
aagggcatcaggcact

SEQ ID NO: 1828469 - DNA, 23 bp, Homo sapiens
aaggggcacaccactgccctgcc

SEQ ID NO: 1828470 - DNA, 12 bp, Homo sapiens
aaggggctgctg

SEQ ID NO: 1828471 - DNA, 20 bp, Homo sapiens
aaggggtcggctaagtggga

SEQ ID NO: 1828472 - DNA, 17 bp, Homo sapiens
aagggttgaaggcagtc

SEQ ID NO: 1828473 - DNA, 20 bp, Homo sapiens
aaggtctccttactctgagc

SEQ ID NO: 1828474 - DNA, 14 bp, Homo sapiens
aaggtgctgagctt

SEQ ID NO: 1828475 - DNA, 22 bp, Homo sapiens
aaggtgggtccaggaaggcagc

SEQ ID NO: 1828476 - DNA, 22 bp, Homo sapiens
aaggtggtctgctcgggcccag

SEQ ID NO: 1828477 - DNA, 17 bp, Homo sapiens
aaggtttcactgttcat

SEQ ID NO: 1828478 - DNA, 22 bp, Homo sapiens
aagtaaaagctaattaggattt

SEQ ID NO: 1828479 - DNA, 14 bp, Homo sapiens
aagtagtagtgtct

SEQ ID NO: 1828480 - DNA, 14 bp, Homo sapiens
aagtatatattcta

SEQ ID NO: 1828481 - DNA, 23 bp, Homo sapiens
aagtatatattctacacatatat

SEQ ID NO: 1828482 - DNA, 16 bp, Homo sapiens
aagtattaaaatgcat

SEQ ID NO: 1828483 - DNA, 23 bp, Homo sapiens
aagtattaaaatgcatatttcta

SEQ ID NO: 1828484 - DNA, 22 bp, Homo sapiens
aagtcaatattgattttaaata

SEQ ID NO: 1828485 - DNA, 12 bp, Homo sapiens
aagtcacagctg

SEQ ID NO: 1828486 - DNA, 14 bp, Homo sapiens
aagtcacagctgca

SEQ ID NO: 1828487 - DNA, 17 bp, Homo sapiens
aagtcacagctgcagct

SEQ ID NO: 1828488 - DNA, 19 bp, Homo sapiens
aagtcacagctgcagctgg

SEQ ID NO: 1828489 - DNA, 17 bp, Homo sapiens
aagtccacctgcctatc

SEQ ID NO: 1828490 - DNA, 20 bp, Homo sapiens
aagtccttcagtgagcccct

SEQ ID NO: 1828491 - DNA, 21 bp, Homo sapiens
aagtccttcagtgagcccctc

SEQ ID NO: 1828492 - DNA, 22 bp, Homo sapiens
aagtccttcagtgagcccctcc

SEQ ID NO: 1828493 - DNA, 22 bp, Homo sapiens
aagtctcagtacacttcctgtg

SEQ ID NO: 1828494 - DNA, 14 bp, Homo sapiens
aagtgatctttcaa

SEQ ID NO: 1828495 - DNA, 22 bp, Homo sapiens
aagtgctgtacccttccacctc

SEQ ID NO: 1828496 - DNA, 17 bp, Homo sapiens
aagtgtattatttctgg

SEQ ID NO: 1828497 - DNA, 18 bp, Homo sapiens
aagtgtgggtctgtgtgt

SEQ ID NO: 1828498 - DNA, 20 bp, Homo sapiens
aagtgtgggtctgtgtgtgt

SEQ ID NO: 1828499 - DNA, 18 bp, Homo sapiens
aagttaaatcattttcat

SEQ ID NO: 1828500 - DNA, 12 bp, Homo sapiens
aagttatattta

SEQ ID NO: 1828501 - DNA, 12 bp, Homo sapiens
aagttcaagtga

SEQ ID NO: 1828502 - DNA, 22 bp, Homo sapiens
aagttgatgtgggaagaagtaa

SEQ ID NO: 1828503 - DNA, 22 bp, Homo sapiens
aagtttcacaacagatttctaa

SEQ ID NO: 1828504 - DNA, 20 bp, Homo sapiens
aagtttttcagaaagtttga

SEQ ID NO: 1828505 - DNA, 22 bp, Homo sapiens
aataaagctggacaagaagctg

SEQ ID NO: 1828506 - DNA, 22 bp, Homo sapiens
aataaagctgtgacagttctgt

SEQ ID NO: 1828507 - DNA, 14 bp, Homo sapiens
aataaagtgaatac

SEQ ID NO: 1828508 - DNA, 16 bp, Homo sapiens
aataaagtgaatacat

SEQ ID NO: 1828509 - DNA, 14 bp, Homo sapiens
aataaatgaagaaa

SEQ ID NO: 1828510 - DNA, 12 bp, Homo sapiens
aataactagtga

SEQ ID NO: 1828511 - DNA, 17 bp, Homo sapiens
aataagtgccaggatgg

SEQ ID NO: 1828512 - DNA, 13 bp, Homo sapiens
aataattggcttt

SEQ ID NO: 1828513 - DNA, 22 bp, Homo sapiens
aataatttctcctcatttaata

SEQ ID NO: 1828514 - DNA, 19 bp, Homo sapiens
aataatttttgctgaattc

SEQ ID NO: 1828515 - DNA, 21 bp, Homo sapiens
aataatttttgctgaattcct

SEQ ID NO: 1828516 - DNA, 23 bp, Homo sapiens
aatacattttgcacaaagtaagc

SEQ ID NO: 1828517 - DNA, 13 bp, Homo sapiens
aatacttactgtt

SEQ ID NO: 1828518 - DNA, 14 bp, Homo sapiens
aatacttactgtta

SEQ ID NO: 1828519 - DNA, 14 bp, Homo sapiens
aatagagtgaatta

SEQ ID NO: 1828520 - DNA, 13 bp, Homo sapiens
aatagcacatgat

SEQ ID NO: 1828521 - DNA, 14 bp, Homo sapiens
aatagcacatgatt

SEQ ID NO: 1828522 - DNA, 22 bp, Homo sapiens
aatagccagagaggagcacctg

SEQ ID NO: 1828523 - DNA, 21 bp, Homo sapiens
aataggatgataggaaataaa

SEQ ID NO: 1828524 - DNA, 22 bp, Homo sapiens
aatagtaattttttacattttc

SEQ ID NO: 1828525 - DNA, 13 bp, Homo sapiens
aatataaaaacaa

SEQ ID NO: 1828526 - DNA, 14 bp, Homo sapiens
aatataagtaatga

SEQ ID NO: 1828527 - DNA, 18 bp, Homo sapiens
aatatgagaaatacagaa

SEQ ID NO: 1828528 - DNA, 22 bp, Homo sapiens
aatatgagaaatacagaagaaa

SEQ ID NO: 1828529 - DNA, 12 bp, Homo sapiens
aatatttttcaa

SEQ ID NO: 1828530 - DNA, 18 bp, Homo sapiens
aatcaaaaggcactgtga

SEQ ID NO: 1828531 - DNA, 19 bp, Homo sapiens
aatcaaagcaagggctcca

SEQ ID NO: 1828532 - DNA, 17 bp, Homo sapiens
aatcaagcaaaatttct

SEQ ID NO: 1828533 - DNA, 19 bp, Homo sapiens
aatcaagcaaaatttctgt

SEQ ID NO: 1828534 - DNA, 18 bp, Homo sapiens
aatcaagtctgtgaaagt

SEQ ID NO: 1828535 - DNA, 12 bp, Homo sapiens
aatcattgacta

SEQ ID NO: 1828536 - DNA, 19 bp, Homo sapiens
aatcattgactaaagccat

SEQ ID NO: 1828537 - DNA, 14 bp, Homo sapiens
aatcattttcatta

SEQ ID NO: 1828538 - DNA, 14 bp, Homo sapiens
aatccttagaatgg

SEQ ID NO: 1828539 - DNA, 17 bp, Homo sapiens
aatccttgggagtcatt

SEQ ID NO: 1828540 - DNA, 13 bp, Homo sapiens
aatctcacttcat

SEQ ID NO: 1828541 - DNA, 23 bp, Homo sapiens
aatctccagggctgcccctgtag

SEQ ID NO: 1828542 - DNA, 21 bp, Homo sapiens
aatctgacagtctcaaatttt

SEQ ID NO: 1828543 - DNA, 18 bp, Homo sapiens
aatctggcaaagttatat

SEQ ID NO: 1828544 - DNA, 19 bp, Homo sapiens
aatgaaaacaaaattccat

SEQ ID NO: 1828545 - DNA, 22 bp, Homo sapiens
aatgaaaagatggagttgtatt

SEQ ID NO: 1828546 - DNA, 21 bp, Homo sapiens
aatgaagaaagggaggcccag

SEQ ID NO: 1828547 - DNA, 13 bp, Homo sapiens
aatgaaggaatta

SEQ ID NO: 1828548 - DNA, 20 bp, Homo sapiens
aatgaaggcatatttccaat

SEQ ID NO: 1828549 - DNA, 14 bp, Homo sapiens
aatgagactatgcg

SEQ ID NO: 1828550 - DNA, 16 bp, Homo sapiens
aatgagtcacaaaata

SEQ ID NO: 1828551 - DNA, 20 bp, Homo sapiens
aatgatcactctggaaatgc

SEQ ID NO: 1828552 - DNA, 16 bp, Homo sapiens
aatgattgttttagaa

SEQ ID NO: 1828553 - DNA, 15 bp, Homo sapiens
aatgcaatgaaaaca

SEQ ID NO: 1828554 - DNA, 18 bp, Homo sapiens
aatgcaattcaatgcaat

SEQ ID NO: 1828555 - DNA, 15 bp, Homo sapiens
aatgcacatcctcat

SEQ ID NO: 1828556 - DNA, 18 bp, Homo sapiens
aatgcacatcctcattca

SEQ ID NO: 1828557 - DNA, 16 bp, Homo sapiens
aatgcatatttctatg

SEQ ID NO: 1828558 - DNA, 19 bp, Homo sapiens
aatgctattgttgtgggct

SEQ ID NO: 1828559 - DNA, 21 bp, Homo sapiens
aatgctttgggaggccaaggc

SEQ ID NO: 1828560 - DNA, 17 bp, Homo sapiens
aatgctttgtgactatt

SEQ ID NO: 1828561 - DNA, 14 bp, Homo sapiens
aatggaactgaccc

SEQ ID NO: 1828562 - DNA, 18 bp, Homo sapiens
aatgggagatggtcagtg

SEQ ID NO: 1828563 - DNA, 17 bp, Homo sapiens
aatggtgttactaaagt

SEQ ID NO: 1828564 - DNA, 18 bp, Homo sapiens
aatgtaatactgtagaaa

SEQ ID NO: 1828565 - DNA, 20 bp, Homo sapiens
aatgtaatactgtagaaata

SEQ ID NO: 1828566 - DNA, 22 bp, Homo sapiens
aatgtcagtatgtggaagtgtg

SEQ ID NO: 1828567 - DNA, 22 bp, Homo sapiens
aatgttgcacatcattcattca

SEQ ID NO: 1828568 - DNA, 14 bp, Homo sapiens
aatgtttctatttc

SEQ ID NO: 1828569 - DNA, 19 bp, Homo sapiens
aatgtttctatttccataa

SEQ ID NO: 1828570 - DNA, 12 bp, Homo sapiens
aatgtttgtact

SEQ ID NO: 1828571 - DNA, 14 bp, Homo sapiens
aattaatctagaaa

SEQ ID NO: 1828572 - DNA, 13 bp, Homo sapiens
aattaatctttct

SEQ ID NO: 1828573 - DNA, 16 bp, Homo sapiens
aattaatctttctata

SEQ ID NO: 1828574 - DNA, 19 bp, Homo sapiens
aattagaaacaccattcat

SEQ ID NO: 1828575 - DNA, 13 bp, Homo sapiens
aattattgtgatt

SEQ ID NO: 1828576 - DNA, 14 bp, Homo sapiens
aattcagcaccctg

SEQ ID NO: 1828577 - DNA, 13 bp, Homo sapiens
aattcattgttaa

SEQ ID NO: 1828578 - DNA, 13 bp, Homo sapiens
aattcttttcaaa

SEQ ID NO: 1828579 - DNA, 14 bp, Homo sapiens
aattcttttcaaaa

SEQ ID NO: 1828580 - DNA, 15 bp, Homo sapiens
aattcttttcaaaat

SEQ ID NO: 1828581 - DNA, 17 bp, Homo sapiens
aattgaaggagaaaatg

SEQ ID NO: 1828582 - DNA, 20 bp, Homo sapiens
aattgaaggagaaaatgcat

SEQ ID NO: 1828583 - DNA, 17 bp, Homo sapiens
agagggcagtacctggg

SEQ ID NO: 1828584 - DNA, 13 bp, Homo sapiens
agagggcccagct

SEQ ID NO: 1828585 - DNA, 14 bp, Homo sapiens
agagggcccagctg

SEQ ID NO: 1828586 - DNA, 16 bp, Homo sapiens
agagggcccagctgta

SEQ ID NO: 1828587 - DNA, 15 bp, Homo sapiens
agaggggcagccgct

SEQ ID NO: 1828588 - DNA, 14 bp, Homo sapiens
agaggtgggcagct

SEQ ID NO: 1828589 - DNA, 15 bp, Homo sapiens
agaggtgggcagctg

SEQ ID NO: 1828590 - DNA, 17 bp, Homo sapiens
agaggtgggcagctggg

SEQ ID NO: 1828591 - DNA, 22 bp, Homo sapiens
agaggttatctgcctggcctgg

SEQ ID NO: 1828592 - DNA, 16 bp, Homo sapiens
agagtctatcaacatt

SEQ ID NO: 1828593 - DNA, 12 bp, Homo sapiens
agagtctgagcc

SEQ ID NO: 1828594 - DNA, 14 bp, Homo sapiens
agagtctgagcccc

SEQ ID NO: 1828595 - DNA, 15 bp, Homo sapiens
agagtctgagccccc

SEQ ID NO: 1828596 - DNA, 19 bp, Homo sapiens
agagtctgagcccccggct

SEQ ID NO: 1828597 - DNA, 16 bp, Homo sapiens
agagtgaaagggctat

SEQ ID NO: 1828598 - DNA, 17 bp, Homo sapiens
agagtgaaagggctatg

SEQ ID NO: 1828599 - DNA, 19 bp, Homo sapiens
agagtggggtaggttggga

SEQ ID NO: 1828600 - DNA, 19 bp, Homo sapiens
agagtggttgttgccaact

SEQ ID NO: 1828601 - DNA, 15 bp, Homo sapiens
agagttattcaaatg

SEQ ID NO: 1828602 - DNA, 14 bp, Homo sapiens
agagttctttgctg

SEQ ID NO: 1828603 - DNA, 15 bp, Homo sapiens
agagttctttgctgc

SEQ ID NO: 1828604 - DNA, 22 bp, Homo sapiens
agagttctttgctgcccctgtc

SEQ ID NO: 1828605 - DNA, 17 bp, Homo sapiens
agagtttctgcagttcc

SEQ ID NO: 1828606 - DNA, 21 bp, Homo sapiens
agataaccccaagacagtctt

SEQ ID NO: 1828607 - DNA, 23 bp, Homo sapiens
agatatatatttactaaaagaat

SEQ ID NO: 1828608 - DNA, 15 bp, Homo sapiens
agatattaagtctca

SEQ ID NO: 1828609 - DNA, 18 bp, Homo sapiens
agatattgttataaataa

SEQ ID NO: 1828610 - DNA, 22 bp, Homo sapiens
agatcatctggggacctggttt

SEQ ID NO: 1828611 - DNA, 23 bp, Homo sapiens
agatctgatggtgagctgggaag

SEQ ID NO: 1828612 - DNA, 12 bp, Homo sapiens
agatctgcctgg

SEQ ID NO: 1828613 - DNA, 15 bp, Homo sapiens
agatctgcctgggcc

SEQ ID NO: 1828614 - DNA, 16 bp, Homo sapiens
agatctgcctgggcct

SEQ ID NO: 1828615 - DNA, 22 bp, Homo sapiens
agatctgcctgggcctgtgcag

SEQ ID NO: 1828616 - DNA, 20 bp, Homo sapiens
agatgaagctgtttttgtgc

SEQ ID NO: 1828617 - DNA, 17 bp, Homo sapiens
agatgagatttgccagc

SEQ ID NO: 1828618 - DNA, 20 bp, Homo sapiens
agatgagatttgccagcaca

SEQ ID NO: 1828619 - DNA, 21 bp, Homo sapiens
agatgagatttgccagcacag

SEQ ID NO: 1828620 - DNA, 14 bp, Homo sapiens
agatggtcagtgtg

SEQ ID NO: 1828621 - DNA, 17 bp, Homo sapiens
agatgtaagaagctaaa

SEQ ID NO: 1828622 - DNA, 20 bp, Homo sapiens
agatgttcgctcgtgcagta

SEQ ID NO: 1828623 - DNA, 15 bp, Homo sapiens
agattatatatcata

SEQ ID NO: 1828624 - DNA, 19 bp, Homo sapiens
agattatatatcataaagt

SEQ ID NO: 1828625 - DNA, 20 bp, Homo sapiens
agattatatatcataaagta

SEQ ID NO: 1828626 - DNA, 22 bp, Homo sapiens
agattatatatcataaagtatg

SEQ ID NO: 1828627 - DNA, 18 bp, Homo sapiens
agatttttgctcttctgt

SEQ ID NO: 1828628 - DNA, 13 bp, Homo sapiens
agcaaagaagctt

SEQ ID NO: 1828629 - DNA, 19 bp, Homo sapiens
agcaaagccacattttgca

SEQ ID NO: 1828630 - DNA, 19 bp, Homo sapiens
agcaacccctgtacccagc

SEQ ID NO: 1828631 - DNA, 20 bp, Homo sapiens
agcaacccctgtacccagct

SEQ ID NO: 1828632 - DNA, 22 bp, Homo sapiens
agcaacccctgtacccagctcc

SEQ ID NO: 1828633 - DNA, 23 bp, Homo sapiens
agcaacccctgtacccagctcct

SEQ ID NO: 1828634 - DNA, 15 bp, Homo sapiens
agcaacttgcttcta

SEQ ID NO: 1828635 - DNA, 16 bp, Homo sapiens
agcaaggcacctgcag

SEQ ID NO: 1828636 - DNA, 18 bp, Homo sapiens
agcaagggacagaaaaga

SEQ ID NO: 1828637 - DNA, 16 bp, Homo sapiens
agcaagggctccagca

SEQ ID NO: 1828638 - DNA, 18 bp, Homo sapiens
agcaagggctccagcatc

SEQ ID NO: 1828639 - DNA, 14 bp, Homo sapiens
agcacaattcattg

SEQ ID NO: 1828640 - DNA, 22 bp, Homo sapiens
agcacagcaaggaggctggctg

SEQ ID NO: 1828641 - DNA, 14 bp, Homo sapiens
agcacagccctccc

SEQ ID NO: 1828642 - DNA, 15 bp, Homo sapiens
agcacagccctcccg

SEQ ID NO: 1828643 - DNA, 16 bp, Homo sapiens
agcacagccctcccgc

SEQ ID NO: 1828644 - DNA, 22 bp, Homo sapiens
agcacagccctcccgccccttc

SEQ ID NO: 1828645 - DNA, 13 bp, Homo sapiens
agcacagccctgg

SEQ ID NO: 1828646 - DNA, 14 bp, Homo sapiens
agcacagccctggg

SEQ ID NO: 1828647 - DNA, 19 bp, Homo sapiens
agcacaggggccccagatc

SEQ ID NO: 1828648 - DNA, 20 bp, Homo sapiens
agcacatgattttcttttgt

SEQ ID NO: 1828649 - DNA, 14 bp, Homo sapiens
agcaccctgggtgc

SEQ ID NO: 1828650 - DNA, 13 bp, Homo sapiens
agcacctgaaccc

SEQ ID NO: 1828651 - DNA, 17 bp, Homo sapiens
agcactggccagagagg

SEQ ID NO: 1828652 - DNA, 16 bp, Homo sapiens
agcacttgcgtcctgc

SEQ ID NO: 1828653 - DNA, 17 bp, Homo sapiens
agcacttgcgtcctgca

SEQ ID NO: 1828654 - DNA, 13 bp, Homo sapiens
agcagagagccct

SEQ ID NO: 1828655 - DNA, 17 bp, Homo sapiens
agcagagcaaatgaggg

SEQ ID NO: 1828656 - DNA, 16 bp, Homo sapiens
agcagatctcatctca

SEQ ID NO: 1828657 - DNA, 18 bp, Homo sapiens
agcagcagagagccctgg

SEQ ID NO: 1828658 - DNA, 22 bp, Homo sapiens
agcagcagagagccctgggtga

SEQ ID NO: 1828659 - DNA, 11 bp, Homo sapiens
agcagccagcc

SEQ ID NO: 1828660 - DNA, 13 bp, Homo sapiens
agcagccagccag

SEQ ID NO: 1828661 - DNA, 17 bp, Homo sapiens
agcagcccagcttcctg

SEQ ID NO: 1828662 - DNA, 20 bp, Homo sapiens
agcagcttctgccacttccc

SEQ ID NO: 1828663 - DNA, 22 bp, Homo sapiens
agcagcttctgccacttcccag

SEQ ID NO: 1828664 - DNA, 19 bp, Homo sapiens
agcagggaaagctccacgg

SEQ ID NO: 1828665 - DNA, 16 bp, Homo sapiens
agcaggtgctgctacc

SEQ ID NO: 1828666 - DNA, 20 bp, Homo sapiens
agcaggtgctgctaccctcc

SEQ ID NO: 1828667 - DNA, 19 bp, Homo sapiens
agcaggtgtggtggctcat

SEQ ID NO: 1828668 - DNA, 11 bp, Homo sapiens
agcatatataa

SEQ ID NO: 1828669 - DNA, 12 bp, Homo sapiens
agcatccagcct

SEQ ID NO: 1828670 - DNA, 18 bp, Homo sapiens
agcatcgtgacccttcag

SEQ ID NO: 1828671 - DNA, 22 bp, Homo sapiens
agcatcgtgacccttcagggcc

SEQ ID NO: 1828672 - DNA, 23 bp, Homo sapiens
agcatcgtgacccttcagggcca

SEQ ID NO: 1828673 - DNA, 21 bp, Homo sapiens
agcatgggactgtgcctttgg

SEQ ID NO: 1828674 - DNA, 22 bp, Homo sapiens
agcatgggactgtgcctttggg

SEQ ID NO: 1828675 - DNA, 15 bp, Homo sapiens
agcatttttcagagt

SEQ ID NO: 1828676 - DNA, 23 bp, Homo sapiens
agccactcctgtcccgccttcct

SEQ ID NO: 1828677 - DNA, 19 bp, Homo sapiens
agccagcccttccctggcc

SEQ ID NO: 1828678 - DNA, 16 bp, Homo sapiens
agccagcctgggactc

SEQ ID NO: 1828679 - DNA, 23 bp, Homo sapiens
agccagcctgggactcccagtga

SEQ ID NO: 1828680 - DNA, 17 bp, Homo sapiens
agccaggagtctgtgct

SEQ ID NO: 1828681 - DNA, 14 bp, Homo sapiens
agccatgcctcatg

SEQ ID NO: 1828682 - DNA, 15 bp, Homo sapiens
agccatggctcaggc

SEQ ID NO: 1828683 - DNA, 16 bp, Homo sapiens
agccatgggcctgggc

SEQ ID NO: 1828684 - DNA, 17 bp, Homo sapiens
agccatgggcctgggcc

SEQ ID NO: 1828685 - DNA, 21 bp, Homo sapiens
agccatgggcctgggcctgct

SEQ ID NO: 1828686 - DNA, 18 bp, Homo sapiens
agccatgtgtcatgtaat

SEQ ID NO: 1828687 - DNA, 19 bp, Homo sapiens
agccatgtgtcatgtaata

SEQ ID NO: 1828688 - DNA, 16 bp, Homo sapiens
agcccacagagcctga

SEQ ID NO: 1828689 - DNA, 15 bp, Homo sapiens
agcccacgtcctgtc

SEQ ID NO: 1828690 - DNA, 17 bp, Homo sapiens
agcccacgtcctgtcag

SEQ ID NO: 1828691 - DNA, 19 bp, Homo sapiens
agcccacgtcctgtcagtg

SEQ ID NO: 1828692 - DNA, 21 bp, Homo sapiens
agcccacgtcctgtcagtgcc

SEQ ID NO: 1828693 - DNA, 17 bp, Homo sapiens
agcccagcttcctggtg

SEQ ID NO: 1828694 - DNA, 13 bp, Homo sapiens
agcccaggccgtt

SEQ ID NO: 1828695 - DNA, 21 bp, Homo sapiens
agccccaactccaggggcacc

SEQ ID NO: 1828696 - DNA, 22 bp, Homo sapiens
agccccaactccaggggcacct

SEQ ID NO: 1828697 - DNA, 12 bp, Homo sapiens
agccccacagcc

SEQ ID NO: 1828698 - DNA, 14 bp, Homo sapiens
agccccacagccca

SEQ ID NO: 1828699 - DNA, 21 bp, Homo sapiens
catctcaagatgtttatctga

SEQ ID NO: 1828700 - DNA, 14 bp, Homo sapiens
catctcaggtgcca

SEQ ID NO: 1828701 - DNA, 21 bp, Homo sapiens
catctcaggtgccactccctg

SEQ ID NO: 1828702 - DNA, 22 bp, Homo sapiens
catctcaggtgccactccctga

SEQ ID NO: 1828703 - DNA, 16 bp, Homo sapiens
catctccatgtagaat

SEQ ID NO: 1828704 - DNA, 22 bp, Homo sapiens
catctccatgtagaataaatga

SEQ ID NO: 1828705 - DNA, 22 bp, Homo sapiens
catctccccaggcctccagcct

SEQ ID NO: 1828706 - DNA, 19 bp, Homo sapiens
catcttcattaatactgtg

SEQ ID NO: 1828707 - DNA, 16 bp, Homo sapiens
catcttccaggtgggg

SEQ ID NO: 1828708 - DNA, 18 bp, Homo sapiens
catcttcctgctgctgta

SEQ ID NO: 1828709 - DNA, 22 bp, Homo sapiens
catctttgggacacctcagaaa

SEQ ID NO: 1828710 - DNA, 16 bp, Homo sapiens
catgcaacaaaaatgt

SEQ ID NO: 1828711 - DNA, 21 bp, Homo sapiens
catgccactgccaggcacctg

SEQ ID NO: 1828712 - DNA, 14 bp, Homo sapiens
catgcctcatgcca

SEQ ID NO: 1828713 - DNA, 16 bp, Homo sapiens
catgcctcatgccaca

SEQ ID NO: 1828714 - DNA, 17 bp, Homo sapiens
catgcctcatgccacac

SEQ ID NO: 1828715 - DNA, 18 bp, Homo sapiens
catgcctggcccccctcc

SEQ ID NO: 1828716 - DNA, 23 bp, Homo sapiens
catgcctggcccccctccaggca

SEQ ID NO: 1828717 - DNA, 18 bp, Homo sapiens
catgctcaacccccctcc

SEQ ID NO: 1828718 - DNA, 19 bp, Homo sapiens
catgctcaacccccctccc

SEQ ID NO: 1828719 - DNA, 19 bp, Homo sapiens
catgctcacttttgtgaaa

SEQ ID NO: 1828720 - DNA, 12 bp, Homo sapiens
catgctctgccc

SEQ ID NO: 1828721 - DNA, 18 bp, Homo sapiens
catgctctgccccaagcc

SEQ ID NO: 1828722 - DNA, 16 bp, Homo sapiens
catgctggcctcccaa

SEQ ID NO: 1828723 - DNA, 14 bp, Homo sapiens
catgctttctcctt

SEQ ID NO: 1828724 - DNA, 14 bp, Homo sapiens
catggcaccagccc

SEQ ID NO: 1828725 - DNA, 12 bp, Homo sapiens
catggccttccc

SEQ ID NO: 1828726 - DNA, 21 bp, Homo sapiens
catggcgtaatgggcctgccc

SEQ ID NO: 1828727 - DNA, 22 bp, Homo sapiens
catggcgtaatgggcctgccca

SEQ ID NO: 1828728 - DNA, 20 bp, Homo sapiens
catggctcaggcaagcccct

SEQ ID NO: 1828729 - DNA, 15 bp, Homo sapiens
catgggactgtgcct

SEQ ID NO: 1828730 - DNA, 14 bp, Homo sapiens
catgggcactgctg

SEQ ID NO: 1828731 - DNA, 16 bp, Homo sapiens
catgggcactgctggg

SEQ ID NO: 1828732 - DNA, 23 bp, Homo sapiens
catgggcactgctgggtggccca

SEQ ID NO: 1828733 - DNA, 10 bp, Homo sapiens
catgggcctg

SEQ ID NO: 1828734 - DNA, 11 bp, Homo sapiens
catgggcctgg

SEQ ID NO: 1828735 - DNA, 15 bp, Homo sapiens
catgggcctgggcct

SEQ ID NO: 1828736 - DNA, 18 bp, Homo sapiens
catgggcctgggcctgct

SEQ ID NO: 1828737 - DNA, 19 bp, Homo sapiens
catgggcctgggcctgctt

SEQ ID NO: 1828738 - DNA, 14 bp, Homo sapiens
catgtaaaggcctt

SEQ ID NO: 1828739 - DNA, 13 bp, Homo sapiens
catgtaatactga

SEQ ID NO: 1828740 - DNA, 20 bp, Homo sapiens
catgtgaagtgttgtggaga

SEQ ID NO: 1828741 - DNA, 22 bp, Homo sapiens
catgtgaagtgttgtggagaaa

SEQ ID NO: 1828742 - DNA, 16 bp, Homo sapiens
catgtgcctgcaccag

SEQ ID NO: 1828743 - DNA, 17 bp, Homo sapiens
catgtgcctgcaccagg

SEQ ID NO: 1828744 - DNA, 20 bp, Homo sapiens
catgtgcctgcaccaggaga

SEQ ID NO: 1828745 - DNA, 21 bp, Homo sapiens
catgtgcctgcaccaggagac

SEQ ID NO: 1828746 - DNA, 11 bp, Homo sapiens
catgtggctga

SEQ ID NO: 1828747 - DNA, 14 bp, Homo sapiens
catgtgtcatgtaa

SEQ ID NO: 1828748 - DNA, 12 bp, Homo sapiens
catgtgtgcctg

SEQ ID NO: 1828749 - DNA, 19 bp, Homo sapiens
catgtgtgcctgtggcaga

SEQ ID NO: 1828750 - DNA, 14 bp, Homo sapiens
cattatagtaaatc

SEQ ID NO: 1828751 - DNA, 20 bp, Homo sapiens
cattatattcctctaaaact

SEQ ID NO: 1828752 - DNA, 15 bp, Homo sapiens
cattatctgtactga

SEQ ID NO: 1828753 - DNA, 21 bp, Homo sapiens
cattatgttattggaattttc

SEQ ID NO: 1828754 - DNA, 22 bp, Homo sapiens
cattatgttattggaattttct

SEQ ID NO: 1828755 - DNA, 19 bp, Homo sapiens
cattcactaagccatgcca

SEQ ID NO: 1828756 - DNA, 19 bp, Homo sapiens
cattcaggtgttctcttct

SEQ ID NO: 1828757 - DNA, 22 bp, Homo sapiens
cattcatgccaaagcaaaagaa

SEQ ID NO: 1828758 - DNA, 14 bp, Homo sapiens
cattccagaggaag

SEQ ID NO: 1828759 - DNA, 23 bp, Homo sapiens
cattcctcaccttttcccgggga

SEQ ID NO: 1828760 - DNA, 19 bp, Homo sapiens
cattcctccagcctcccct

SEQ ID NO: 1828761 - DNA, 14 bp, Homo sapiens
cattgaatatcagt

SEQ ID NO: 1828762 - DNA, 22 bp, Homo sapiens
cattgaatatcagttgacagaa

SEQ ID NO: 1828763 - DNA, 19 bp, Homo sapiens
cattgctggcaatgagtgt

SEQ ID NO: 1828764 - DNA, 16 bp, Homo sapiens
cattggcagcaggtgc

SEQ ID NO: 1828765 - DNA, 17 bp, Homo sapiens
cattggcagcaggtgct

SEQ ID NO: 1828766 - DNA, 20 bp, Homo sapiens
cattggcagcaggtgctgct

SEQ ID NO: 1828767 - DNA, 24 bp, Homo sapiens
cattggcagcaggtgctgctaccc

SEQ ID NO: 1828768 - DNA, 22 bp, Homo sapiens
cattgggctgacacctaccatg

SEQ ID NO: 1828769 - DNA, 19 bp, Homo sapiens
catttaatatttttcaaaa

SEQ ID NO: 1828770 - DNA, 17 bp, Homo sapiens
catttaggactgggttc

SEQ ID NO: 1828771 - DNA, 22 bp, Homo sapiens
catttagtaccttcaaataatt

SEQ ID NO: 1828772 - DNA, 15 bp, Homo sapiens
catttgtaaaaatac

SEQ ID NO: 1828773 - DNA, 20 bp, Homo sapiens
catttgtaaaaatactgttt

SEQ ID NO: 1828774 - DNA, 16 bp, Homo sapiens
cattttacagtatctt

SEQ ID NO: 1828775 - DNA, 22 bp, Homo sapiens
cattttactaaaatcgtattct

SEQ ID NO: 1828776 - DNA, 18 bp, Homo sapiens
cattttcattaaaaggaa

SEQ ID NO: 1828777 - DNA, 16 bp, Homo sapiens
catttttgtacattat

SEQ ID NO: 1828778 - DNA, 23 bp, Homo sapiens
catttttgtacattatgttattg

SEQ ID NO: 1828779 - DNA, 16 bp, Homo sapiens
ccaaaagtacttaccc

SEQ ID NO: 1828780 - DNA, 18 bp, Homo sapiens
ccaaatgcacaagctcag

SEQ ID NO: 1828781 - DNA, 13 bp, Homo sapiens
ccaaattgcttct

SEQ ID NO: 1828782 - DNA, 15 bp, Homo sapiens
ccaacccccagcacc

SEQ ID NO: 1828783 - DNA, 21 bp, Homo sapiens
ccaaccccgcggtgctctggc

SEQ ID NO: 1828784 - DNA, 11 bp, Homo sapiens
ccaagcagcca

SEQ ID NO: 1828785 - DNA, 12 bp, Homo sapiens
ccaagcagccag

SEQ ID NO: 1828786 - DNA, 16 bp, Homo sapiens
ccaagcagccagccag

SEQ ID NO: 1828787 - DNA, 19 bp, Homo sapiens
ccaagccttggctctaccc

SEQ ID NO: 1828788 - DNA, 21 bp, Homo sapiens
ccaagctgtgccaccctgggc

SEQ ID NO: 1828789 - DNA, 23 bp, Homo sapiens
ccaaggagctgatttccaggccc

SEQ ID NO: 1828790 - DNA, 16 bp, Homo sapiens
ccaaggcagcctccag

SEQ ID NO: 1828791 - DNA, 19 bp, Homo sapiens
ccaaggcagcctccagagc

SEQ ID NO: 1828792 - DNA, 18 bp, Homo sapiens
ccaaggctctcccctctc

SEQ ID NO: 1828793 - DNA, 13 bp, Homo sapiens
ccaaggtggtctg

SEQ ID NO: 1828794 - DNA, 17 bp, Homo sapiens
ccaaggttactcagcag

SEQ ID NO: 1828795 - DNA, 18 bp, Homo sapiens
ccaagtttttcagaaagt

SEQ ID NO: 1828796 - DNA, 13 bp, Homo sapiens
ccaataaagctgg

SEQ ID NO: 1828797 - DNA, 22 bp, Homo sapiens
ccaattgcctcttgcaggctga

SEQ ID NO: 1828798 - DNA, 19 bp, Homo sapiens
ccacaaatcaaagcaaggg

SEQ ID NO: 1828799 - DNA, 13 bp, Homo sapiens
ccacacccaggaa

SEQ ID NO: 1828800 - DNA, 14 bp, Homo sapiens
ccacacccaggaag

SEQ ID NO: 1828801 - DNA, 17 bp, Homo sapiens
ccacacccaggaaggga

SEQ ID NO: 1828802 - DNA, 19 bp, Homo sapiens
ccacagcaaggcacctgca

SEQ ID NO: 1828803 - DNA, 20 bp, Homo sapiens
ccacagcaaggcacctgcag

SEQ ID NO: 1828804 - DNA, 15 bp, Homo sapiens
ccacaggggcaggcc

SEQ ID NO: 1828805 - DNA, 16 bp, Homo sapiens
ccacaggggcaggcct

SEQ ID NO: 1828806 - DNA, 15 bp, Homo sapiens
ccacagtcctcacag

SEQ ID NO: 1828807 - DNA, 15 bp, Homo sapiens
ccacagtgacagtca

SEQ ID NO: 1828808 - DNA, 18 bp, Homo sapiens
ccacagtgacagtcactt

SEQ ID NO: 1828809 - DNA, 23 bp, Homo sapiens
ccacagtgactcgggctcctgtg

SEQ ID NO: 1828810 - DNA, 19 bp, Homo sapiens
ccacagtgcccagctaatt

SEQ ID NO: 1828811 - DNA, 13 bp, Homo sapiens
ccacagtgctgct

SEQ ID NO: 1828812 - DNA, 14 bp, Homo sapiens
ccacagtgctgctt

SEQ ID NO: 1828813 - DNA, 18 bp, Homo sapiens
ccacagtgctgcttctct

SEQ ID NO: 1828814 - DNA, 14 bp, Homo sapiens
ccacagtgggtggc

SEQ ID NO: 1828815 - DNA, 13 bp, Homo sapiens
ccctgcaccctgg

SEQ ID NO: 1828816 - DNA, 16 bp, Homo sapiens
ccctgcaccctggaaa

SEQ ID NO: 1828817 - DNA, 18 bp, Homo sapiens
ccctgcaccctggaaagg

SEQ ID NO: 1828818 - DNA, 16 bp, Homo sapiens
ccctgcactgtcctgc

SEQ ID NO: 1828819 - DNA, 17 bp, Homo sapiens
ccctgcactgtcctgct

SEQ ID NO: 1828820 - DNA, 22 bp, Homo sapiens
ccctgcactgtcctgctccaca

SEQ ID NO: 1828821 - DNA, 15 bp, Homo sapiens
ccctgccacctgtct

SEQ ID NO: 1828822 - DNA, 16 bp, Homo sapiens
ccctgccacctgtctg

SEQ ID NO: 1828823 - DNA, 20 bp, Homo sapiens
ccctgccatcatgtttacag

SEQ ID NO: 1828824 - DNA, 16 bp, Homo sapiens
ccctgcccccatctcc

SEQ ID NO: 1828825 - DNA, 19 bp, Homo sapiens
ccctgcccccatctcccca

SEQ ID NO: 1828826 - DNA, 20 bp, Homo sapiens
ccctgcccccatctccccag

SEQ ID NO: 1828827 - DNA, 22 bp, Homo sapiens
ccctgcccccatctccccaggc

SEQ ID NO: 1828828 - DNA, 19 bp, Homo sapiens
ccctgcccgaccccatctc

SEQ ID NO: 1828829 - DNA, 17 bp, Homo sapiens
ccctgcgttggagccac

SEQ ID NO: 1828830 - DNA, 19 bp, Homo sapiens
ccctgcgttggagccactc

SEQ ID NO: 1828831 - DNA, 22 bp, Homo sapiens
ccctgcgttggagccactcctg

SEQ ID NO: 1828832 - DNA, 13 bp, Homo sapiens
ccctgctgtcccc

SEQ ID NO: 1828833 - DNA, 17 bp, Homo sapiens
ccctgctgtcccctctt

SEQ ID NO: 1828834 - DNA, 19 bp, Homo sapiens
ccctgctgtcccctcttgc

SEQ ID NO: 1828835 - DNA, 23 bp, Homo sapiens
ccctgctgtcccctcttgcccca

SEQ ID NO: 1828836 - DNA, 21 bp, Homo sapiens
ccctgcttgcccgctcccaca

SEQ ID NO: 1828837 - DNA, 23 bp, Homo sapiens
ccctggatgggcattgggctgac

SEQ ID NO: 1828838 - DNA, 20 bp, Homo sapiens
ccctggatgtgtggggcatg

SEQ ID NO: 1828839 - DNA, 23 bp, Homo sapiens
ccctggccctcaaggcctcccac

SEQ ID NO: 1828840 - DNA, 16 bp, Homo sapiens
ccctgggaaggctaag

SEQ ID NO: 1828841 - DNA, 17 bp, Homo sapiens
ccctgggctctgtgggc

SEQ ID NO: 1828842 - DNA, 20 bp, Homo sapiens
ccctgggctctgtgggctgc

SEQ ID NO: 1828843 - DNA, 13 bp, Homo sapiens
ccctgggtgccat

SEQ ID NO: 1828844 - DNA, 19 bp, Homo sapiens
ccctgggtgccattcccag

SEQ ID NO: 1828845 - DNA, 13 bp, Homo sapiens
ccctgtacccagc

SEQ ID NO: 1828846 - DNA, 14 bp, Homo sapiens
ccctgtacccagct

SEQ ID NO: 1828847 - DNA, 23 bp, Homo sapiens
ccctgtattcccacccctggact

SEQ ID NO: 1828848 - DNA, 23 bp, Homo sapiens
ccctgtctccagggcccccaccg

SEQ ID NO: 1828849 - DNA, 13 bp, Homo sapiens
ccctgtctggaag

SEQ ID NO: 1828850 - DNA, 14 bp, Homo sapiens
ccctgtctggaaga

SEQ ID NO: 1828851 - DNA, 18 bp, Homo sapiens
cccttccacctcctagag

SEQ ID NO: 1828852 - DNA, 14 bp, Homo sapiens
cccttccccgaggg

SEQ ID NO: 1828853 - DNA, 15 bp, Homo sapiens
cccttccctggcccc

SEQ ID NO: 1828854 - DNA, 15 bp, Homo sapiens
cccttcctggcctca

SEQ ID NO: 1828855 - DNA, 18 bp, Homo sapiens
cccttcctggcctcactg

SEQ ID NO: 1828856 - DNA, 21 bp, Homo sapiens
cccttcctggcctcactggct

SEQ ID NO: 1828857 - DNA, 22 bp, Homo sapiens
cccttcctggcctcactggctg

SEQ ID NO: 1828858 - DNA, 18 bp, Homo sapiens
cccttgcccccatccctc

SEQ ID NO: 1828859 - DNA, 18 bp, Homo sapiens
cccttggcttcctccgtc

SEQ ID NO: 1828860 - DNA, 19 bp, Homo sapiens
cccttggcttcctccgtcc

SEQ ID NO: 1828861 - DNA, 23 bp, Homo sapiens
cccttggggcctggcttgctcca

SEQ ID NO: 1828862 - DNA, 18 bp, Homo sapiens
cccttgtcctgccagctg

SEQ ID NO: 1828863 - DNA, 19 bp, Homo sapiens
cccttgtcctgccagctgc

SEQ ID NO: 1828864 - DNA, 14 bp, Homo sapiens
cccttttgcctggc

SEQ ID NO: 1828865 - DNA, 17 bp, Homo sapiens
cccttttgcctggctgt

SEQ ID NO: 1828866 - DNA, 16 bp, Homo sapiens
ccgacactgctgcacc

SEQ ID NO: 1828867 - DNA, 20 bp, Homo sapiens
ccgacttgaattttcccact

SEQ ID NO: 1828868 - DNA, 22 bp, Homo sapiens
ccgacttgaattttcccactgc

SEQ ID NO: 1828869 - DNA, 23 bp, Homo sapiens
ccgacttgaattttcccactgca

SEQ ID NO: 1828870 - DNA, 19 bp, Homo sapiens
ccgagggatgatgccacac

SEQ ID NO: 1828871 - DNA, 22 bp, Homo sapiens
ccgcagcccgtgaagcagtgcc

SEQ ID NO: 1828872 - DNA, 15 bp, Homo sapiens
ccgcagtccccagcc

SEQ ID NO: 1828873 - DNA, 16 bp, Homo sapiens
ccgcagtccccagccc

SEQ ID NO: 1828874 - DNA, 12 bp, Homo sapiens
ccgcatgccccc

SEQ ID NO: 1828875 - DNA, 19 bp, Homo sapiens
ccgcatgccccctcgtgcc

SEQ ID NO: 1828876 - DNA, 23 bp, Homo sapiens
ccgcatgccccctcgtgccagtc

SEQ ID NO: 1828877 - DNA, 18 bp, Homo sapiens
ccgcccaggctggccagc

SEQ ID NO: 1828878 - DNA, 17 bp, Homo sapiens
ccgccccttccccgagg

SEQ ID NO: 1828879 - DNA, 19 bp, Homo sapiens
ccgccccttccccgaggga

SEQ ID NO: 1828880 - DNA, 17 bp, Homo sapiens
ccgccgcctcgcccacc

SEQ ID NO: 1828881 - DNA, 18 bp, Homo sapiens
ccgcctcgcccaccgcat

SEQ ID NO: 1828882 - DNA, 12 bp, Homo sapiens
ccgcggtgctct

SEQ ID NO: 1828883 - DNA, 13 bp, Homo sapiens
ccgctcccacagc

SEQ ID NO: 1828884 - DNA, 14 bp, Homo sapiens
ccgctcccagtgtc

SEQ ID NO: 1828885 - DNA, 21 bp, Homo sapiens
ccgctgccaccacgtctgcca

SEQ ID NO: 1828886 - DNA, 23 bp, Homo sapiens
ccgctgcccggcgccctctgtcc

SEQ ID NO: 1828887 - DNA, 18 bp, Homo sapiens
ccgcttgcctcggctcct

SEQ ID NO: 1828888 - DNA, 21 bp, Homo sapiens
ccggagcacagccctgggagg

SEQ ID NO: 1828889 - DNA, 15 bp, Homo sapiens
ccggccaggtgggcg

SEQ ID NO: 1828890 - DNA, 15 bp, Homo sapiens
ccggcctccactccc

SEQ ID NO: 1828891 - DNA, 14 bp, Homo sapiens
ccggcgccctctgt

SEQ ID NO: 1828892 - DNA, 13 bp, Homo sapiens
ccggctgcctgcc

SEQ ID NO: 1828893 - DNA, 14 bp, Homo sapiens
ccggctgcctgccg

SEQ ID NO: 1828894 - DNA, 20 bp, Homo sapiens
ccgggctcagggaccacagc

SEQ ID NO: 1828895 - DNA, 23 bp, Homo sapiens
ccggggaggagagagcagcttct

SEQ ID NO: 1828896 - DNA, 15 bp, Homo sapiens
ccggggctgggttgg

SEQ ID NO: 1828897 - DNA, 13 bp, Homo sapiens
ccggggtctgtgc

SEQ ID NO: 1828898 - DNA, 15 bp, Homo sapiens
ccggggtctgtgctg

SEQ ID NO: 1828899 - DNA, 20 bp, Homo sapiens
ccggggtctgtgctgtgcct

SEQ ID NO: 1828900 - DNA, 22 bp, Homo sapiens
ccgggtcatctgtacctctgcc

SEQ ID NO: 1828901 - DNA, 17 bp, Homo sapiens
ccgggtgggcctggcct

SEQ ID NO: 1828902 - DNA, 13 bp, Homo sapiens
ccgtccatggcac

SEQ ID NO: 1828903 - DNA, 14 bp, Homo sapiens
ccgtctgactccag

SEQ ID NO: 1828904 - DNA, 16 bp, Homo sapiens
ccgtctgactccagag

SEQ ID NO: 1828905 - DNA, 20 bp, Homo sapiens
ccgtctgactccagagtctg

SEQ ID NO: 1828906 - DNA, 16 bp, Homo sapiens
ccgtgcagtacaggca

SEQ ID NO: 1828907 - DNA, 19 bp, Homo sapiens
ccgtggccccagcctggcc

SEQ ID NO: 1828908 - DNA, 22 bp, Homo sapiens
ccgtggccccagcctggcccag

SEQ ID NO: 1828909 - DNA, 15 bp, Homo sapiens
ccgtgtcccaaggag

SEQ ID NO: 1828910 - DNA, 17 bp, Homo sapiens
ccgtgtcccaaggagct

SEQ ID NO: 1828911 - DNA, 14 bp, Homo sapiens
ccgttccccttggc

SEQ ID NO: 1828912 - DNA, 21 bp, Homo sapiens
ccgttgtctccctggccctca

SEQ ID NO: 1828913 - DNA, 18 bp, Homo sapiens
cctaaagagttattcaaa

SEQ ID NO: 1828914 - DNA, 14 bp, Homo sapiens
cctaccatgctgct

SEQ ID NO: 1828915 - DNA, 20 bp, Homo sapiens
cctaccccacctcatgcctg

SEQ ID NO: 1828916 - DNA, 15 bp, Homo sapiens
cctacccctcccagc

SEQ ID NO: 1828917 - DNA, 18 bp, Homo sapiens
cctacccctcccagctga

SEQ ID NO: 1828918 - DNA, 19 bp, Homo sapiens
cctacttgtgactgaaggg

SEQ ID NO: 1828919 - DNA, 18 bp, Homo sapiens
cctagaggtgggcagctg

SEQ ID NO: 1828920 - DNA, 15 bp, Homo sapiens
cctagcccagtgctt

SEQ ID NO: 1828921 - DNA, 13 bp, Homo sapiens
cctaggagttgag

SEQ ID NO: 1828922 - DNA, 16 bp, Homo sapiens
cctaggattcctcccc

SEQ ID NO: 1828923 - DNA, 22 bp, Homo sapiens
cctaggccaaatgcacaagctc

SEQ ID NO: 1828924 - DNA, 17 bp, Homo sapiens
cctagtactctctgctc

SEQ ID NO: 1828925 - DNA, 19 bp, Homo sapiens
cctagtactctctgctcta

SEQ ID NO: 1828926 - DNA, 22 bp, Homo sapiens
cctagtactctctgctctagcc

SEQ ID NO: 1828927 - DNA, 18 bp, Homo sapiens
cctagtggctgtccagtg

SEQ ID NO: 1828928 - DNA, 15 bp, Homo sapiens
cctatagagaggggg

SEQ ID NO: 1828929 - DNA, 21 bp, Homo sapiens
cctatagagagggggctctcc

SEQ ID NO: 1828930 - DNA, 12 bp, Homo sapiens
cctatcagtgtg

SEQ ID NO: 1828931 - DNA, 18 bp, Homo sapiens
cgggaggcaccagctctg

SEQ ID NO: 1828932 - DNA, 23 bp, Homo sapiens
cgggaggcaccagctctgtggcc

SEQ ID NO: 1828933 - DNA, 19 bp, Homo sapiens
cgggaggggcccgcttgcc

SEQ ID NO: 1828934 - DNA, 11 bp, Homo sapiens
cgggcagcccc

SEQ ID NO: 1828935 - DNA, 16 bp, Homo sapiens
cgggctggcctgtgcc

SEQ ID NO: 1828936 - DNA, 17 bp, Homo sapiens
cgggctggcctgtgcct

SEQ ID NO: 1828937 - DNA, 14 bp, Homo sapiens
cggggcgtttcttt

SEQ ID NO: 1828938 - DNA, 11 bp, Homo sapiens
cggggctggca

SEQ ID NO: 1828939 - DNA, 19 bp, Homo sapiens
cggggctggcaagcaggga

SEQ ID NO: 1828940 - DNA, 14 bp, Homo sapiens
cggggcttggctga

SEQ ID NO: 1828941 - DNA, 17 bp, Homo sapiens
cggggtctgtgctgtgc

SEQ ID NO: 1828942 - DNA, 21 bp, Homo sapiens
cggggtctgtgctgtgcctgc

SEQ ID NO: 1828943 - DNA, 15 bp, Homo sapiens
cgggtcatctgtacc

SEQ ID NO: 1828944 - DNA, 18 bp, Homo sapiens
cgggtgggcctggcctga

SEQ ID NO: 1828945 - DNA, 19 bp, Homo sapiens
cgggtgggcctggcctgag

SEQ ID NO: 1828946 - DNA, 14 bp, Homo sapiens
cggtgacacatcca

SEQ ID NO: 1828947 - DNA, 15 bp, Homo sapiens
cggtgacacatccat

SEQ ID NO: 1828948 - DNA, 17 bp, Homo sapiens
cggtgcgtggctgtggc

SEQ ID NO: 1828949 - DNA, 18 bp, Homo sapiens
cggtgcgtggctgtggca

SEQ ID NO: 1828950 - DNA, 20 bp, Homo sapiens
cggtgcgtggctgtggcaca

SEQ ID NO: 1828951 - DNA, 24 bp, Homo sapiens
cggtgcgtggctgtggcacagact

SEQ ID NO: 1828952 - DNA, 11 bp, Homo sapiens
cggtgctctgg

SEQ ID NO: 1828953 - DNA, 17 bp, Homo sapiens
cgtaagatggcttattt

SEQ ID NO: 1828954 - DNA, 16 bp, Homo sapiens
cgtaatgggcctgccc

SEQ ID NO: 1828955 - DNA, 21 bp, Homo sapiens
cgtagatttttgctcttctgt

SEQ ID NO: 1828956 - DNA, 17 bp, Homo sapiens
cgtccacaggggcaggc

SEQ ID NO: 1828957 - DNA, 20 bp, Homo sapiens
cgtccacaggggcaggcctg

SEQ ID NO: 1828958 - DNA, 22 bp, Homo sapiens
cgtccacaggggcaggcctggg

SEQ ID NO: 1828959 - DNA, 13 bp, Homo sapiens
cgtccacccaggc

SEQ ID NO: 1828960 - DNA, 17 bp, Homo sapiens
cgtccacccaggctgca

SEQ ID NO: 1828961 - DNA, 19 bp, Homo sapiens
cgtccacccaggctgcact

SEQ ID NO: 1828962 - DNA, 15 bp, Homo sapiens
cgtccatggcaccag

SEQ ID NO: 1828963 - DNA, 18 bp, Homo sapiens
cgtccatggcaccagccc

SEQ ID NO: 1828964 - DNA, 20 bp, Homo sapiens
cgtcctgacgccctgcgttg

SEQ ID NO: 1828965 - DNA, 15 bp, Homo sapiens
cgtcctgcagaggac

SEQ ID NO: 1828966 - DNA, 14 bp, Homo sapiens
cgtcctgtcagtgc

SEQ ID NO: 1828967 - DNA, 16 bp, Homo sapiens
cgtcctgtcagtgccg

SEQ ID NO: 1828968 - DNA, 17 bp, Homo sapiens
cgtcggactgcccccag

SEQ ID NO: 1828969 - DNA, 14 bp, Homo sapiens
cgtctgactccaga

SEQ ID NO: 1828970 - DNA, 14 bp, Homo sapiens
cgtctgccaggccc

SEQ ID NO: 1828971 - DNA, 18 bp, Homo sapiens
cgtctgccaggcccatct

SEQ ID NO: 1828972 - DNA, 17 bp, Homo sapiens
cgtgaagcagtgcctcg

SEQ ID NO: 1828973 - DNA, 14 bp, Homo sapiens
cgtgacccttcagg

SEQ ID NO: 1828974 - DNA, 18 bp, Homo sapiens
cgtgacccttcagggcca

SEQ ID NO: 1828975 - DNA, 19 bp, Homo sapiens
cgtgacccttcagggccag

SEQ ID NO: 1828976 - DNA, 15 bp, Homo sapiens
cgtgagtgtgacttt

SEQ ID NO: 1828977 - DNA, 20 bp, Homo sapiens
cgtgccagtcgcgctgcctg

SEQ ID NO: 1828978 - DNA, 13 bp, Homo sapiens
cgtggacacctgc

SEQ ID NO: 1828979 - DNA, 14 bp, Homo sapiens
cgtggacacctgcc

SEQ ID NO: 1828980 - DNA, 17 bp, Homo sapiens
cgtggacacctgccctg

SEQ ID NO: 1828981 - DNA, 17 bp, Homo sapiens
cgtggccccagcctggc

SEQ ID NO: 1828982 - DNA, 23 bp, Homo sapiens
cgtggccccagcctggcccagct

SEQ ID NO: 1828983 - DNA, 17 bp, Homo sapiens
cgtggctgtggcacaga

SEQ ID NO: 1828984 - DNA, 20 bp, Homo sapiens
cgtgtagtggaagagcagcc

SEQ ID NO: 1828985 - DNA, 21 bp, Homo sapiens
cgtgtagtggaagagcagcct

SEQ ID NO: 1828986 - DNA, 23 bp, Homo sapiens
cgtgtagtggaagagcagcctga

SEQ ID NO: 1828987 - DNA, 18 bp, Homo sapiens
cgttccccttggcttcct

SEQ ID NO: 1828988 - DNA, 21 bp, Homo sapiens
cgttccccttggcttcctccg

SEQ ID NO: 1828989 - DNA, 11 bp, Homo sapiens
cgttggagcca

SEQ ID NO: 1828990 - DNA, 17 bp, Homo sapiens
cgttgtctccctggccc

SEQ ID NO: 1828991 - DNA, 18 bp, Homo sapiens
cgttgtctccctggccct

SEQ ID NO: 1828992 - DNA, 19 bp, Homo sapiens
cgtttagtttctagaggcc

SEQ ID NO: 1828993 - DNA, 18 bp, Homo sapiens
ctaaaatcgtattctaat

SEQ ID NO: 1828994 - DNA, 21 bp, Homo sapiens
ctaaagagttattcaaatgaa

SEQ ID NO: 1828995 - DNA, 14 bp, Homo sapiens
ctaaagccatttgt

SEQ ID NO: 1828996 - DNA, 11 bp, Homo sapiens
ctaaatgaagt

SEQ ID NO: 1828997 - DNA, 12 bp, Homo sapiens
ctaaatgcccag

SEQ ID NO: 1828998 - DNA, 22 bp, Homo sapiens
ctaaatgtggacatcatgaagc

SEQ ID NO: 1828999 - DNA, 19 bp, Homo sapiens
ctaacttcttccacttttt

SEQ ID NO: 1829000 - DNA, 22 bp, Homo sapiens
ctaagatgagatttgccagcac

SEQ ID NO: 1829001 - DNA, 24 bp, Homo sapiens
ctaagatgagatttgccagcacag

SEQ ID NO: 1829002 - DNA, 13 bp, Homo sapiens
ctaagccatgcca

SEQ ID NO: 1829003 - DNA, 18 bp, Homo sapiens
ctaagccctcgaaccaag

SEQ ID NO: 1829004 - DNA, 14 bp, Homo sapiens
ctaagctttctcct

SEQ ID NO: 1829005 - DNA, 17 bp, Homo sapiens
ctaagctttctcctttg

SEQ ID NO: 1829006 - DNA, 16 bp, Homo sapiens
ctaataaagagactga

SEQ ID NO: 1829007 - DNA, 19 bp, Homo sapiens
ctaatgatcactctggaaa

SEQ ID NO: 1829008 - DNA, 19 bp, Homo sapiens
ctaattctgggaagggaga

SEQ ID NO: 1829009 - DNA, 14 bp, Homo sapiens
ctaatttattttgt

SEQ ID NO: 1829010 - DNA, 19 bp, Homo sapiens
ctacacatatatgtatatg

SEQ ID NO: 1829011 - DNA, 13 bp, Homo sapiens
ctaccatgctgct

SEQ ID NO: 1829012 - DNA, 14 bp, Homo sapiens
ctaccatgctgctt

SEQ ID NO: 1829013 - DNA, 17 bp, Homo sapiens
ctacccctcccagctga

SEQ ID NO: 1829014 - DNA, 14 bp, Homo sapiens
ctaccctccctgct

SEQ ID NO: 1829015 - DNA, 18 bp, Homo sapiens
ctaccctccctgctgtcc

SEQ ID NO: 1829016 - DNA, 14 bp, Homo sapiens
ctacctttttttct

SEQ ID NO: 1829017 - DNA, 19 bp, Homo sapiens
ctacctttttttctctcct

SEQ ID NO: 1829018 - DNA, 19 bp, Homo sapiens
ctactagtaataatgtaat

SEQ ID NO: 1829019 - DNA, 16 bp, Homo sapiens
ctactatggctgttta

SEQ ID NO: 1829020 - DNA, 20 bp, Homo sapiens
ctactctgtccaggccactg

SEQ ID NO: 1829021 - DNA, 15 bp, Homo sapiens
ctactgtatttcatt

SEQ ID NO: 1829022 - DNA, 17 bp, Homo sapiens
ctactgtatttcattat

SEQ ID NO: 1829023 - DNA, 17 bp, Homo sapiens
ctacttgtgactgaagg

SEQ ID NO: 1829024 - DNA, 14 bp, Homo sapiens
ctagactggagtga

SEQ ID NO: 1829025 - DNA, 23 bp, Homo sapiens
ctagactggagtgaggcttccag

SEQ ID NO: 1829026 - DNA, 24 bp, Homo sapiens
ctagactggagtgaggcttccagg

SEQ ID NO: 1829027 - DNA, 14 bp, Homo sapiens
ctagagcaacccct

SEQ ID NO: 1829028 - DNA, 16 bp, Homo sapiens
ctagagcaacccctgt

SEQ ID NO: 1829029 - DNA, 23 bp, Homo sapiens
ctagagcaacccctgtacccagc

SEQ ID NO: 1829030 - DNA, 11 bp, Homo sapiens
ctagaggcctc

SEQ ID NO: 1829031 - DNA, 12 bp, Homo sapiens
ctagccaggagt

SEQ ID NO: 1829032 - DNA, 17 bp, Homo sapiens
ctagccaggagtctgtg

SEQ ID NO: 1829033 - DNA, 21 bp, Homo sapiens
ctagccaggagtctgtgctct

SEQ ID NO: 1829034 - DNA, 13 bp, Homo sapiens
ctagccatatatt

SEQ ID NO: 1829035 - DNA, 17 bp, Homo sapiens
ctagccatatattttct

SEQ ID NO: 1829036 - DNA, 15 bp, Homo sapiens
ctagcccagtgcttc

SEQ ID NO: 1829037 - DNA, 12 bp, Homo sapiens
ctagctggcagg

SEQ ID NO: 1829038 - DNA, 14 bp, Homo sapiens
ctagctggcaggac

SEQ ID NO: 1829039 - DNA, 14 bp, Homo sapiens
ctagcttgaaaact

SEQ ID NO: 1829040 - DNA, 19 bp, Homo sapiens
ctaggagtcaactggctgg

SEQ ID NO: 1829041 - DNA, 15 bp, Homo sapiens
ctaggattcctcccc

SEQ ID NO: 1829042 - DNA, 19 bp, Homo sapiens
ctaggccaaatgcacaagc

SEQ ID NO: 1829043 - DNA, 23 bp, Homo sapiens
ctagtaataatgtaatactgtag

SEQ ID NO: 1829044 - DNA, 19 bp, Homo sapiens
ctagtaccctatagagagg

SEQ ID NO: 1829045 - DNA, 23 bp, Homo sapiens
ctagtgatatggcatcgttgcat

SEQ ID NO: 1829046 - DNA, 17 bp, Homo sapiens
ctagtggctgtccagtg

SEQ ID NO: 1829047 - DNA, 22 bp, Homo sapiens
ctagtggctgtccagtgcccat

SEQ ID NO: 1829048 - DNA, 24 bp, Homo sapiens
ctgtagccatggctcaggcaagcc

SEQ ID NO: 1829049 - DNA, 20 bp, Homo sapiens
ctgtataagacactttgcca

SEQ ID NO: 1829050 - DNA, 15 bp, Homo sapiens
ctgtatattccctgt

SEQ ID NO: 1829051 - DNA, 19 bp, Homo sapiens
ctgtatgtgacaacatttt

SEQ ID NO: 1829052 - DNA, 22 bp, Homo sapiens
ctgtattgaatattttattaaa

SEQ ID NO: 1829053 - DNA, 20 bp, Homo sapiens
ctgtcaaagaaaacttccaa

SEQ ID NO: 1829054 - DNA, 15 bp, Homo sapiens
ctgtcagaggctaag

SEQ ID NO: 1829055 - DNA, 14 bp, Homo sapiens
ctgtcagtgccgcc

SEQ ID NO: 1829056 - DNA, 19 bp, Homo sapiens
ctgtcatcactccctggat

SEQ ID NO: 1829057 - DNA, 21 bp, Homo sapiens
ctgtcatcactccctggatgt

SEQ ID NO: 1829058 - DNA, 14 bp, Homo sapiens
ctgtccactctcgg

SEQ ID NO: 1829059 - DNA, 23 bp, Homo sapiens
ctgtccactctcggggcccttgg

SEQ ID NO: 1829060 - DNA, 20 bp, Homo sapiens
ctgtccaggccactgtggcc

SEQ ID NO: 1829061 - DNA, 13 bp, Homo sapiens
ctgtccagtgccc

SEQ ID NO: 1829062 - DNA, 14 bp, Homo sapiens
ctgtccagtgccca

SEQ ID NO: 1829063 - DNA, 12 bp, Homo sapiens
ctgtcccagagg

SEQ ID NO: 1829064 - DNA, 15 bp, Homo sapiens
ctgtcccctctgtca

SEQ ID NO: 1829065 - DNA, 18 bp, Homo sapiens
ctgtcccctcttgcccca

SEQ ID NO: 1829066 - DNA, 16 bp, Homo sapiens
ctgtcctgctccacag

SEQ ID NO: 1829067 - DNA, 17 bp, Homo sapiens
ctgtcctgctccacagt

SEQ ID NO: 1829068 - DNA, 17 bp, Homo sapiens
ctgtctccagggccccc

SEQ ID NO: 1829069 - DNA, 20 bp, Homo sapiens
ctgtctccagggcccccacc

SEQ ID NO: 1829070 - DNA, 21 bp, Homo sapiens
ctgtctccagggcccccaccg

SEQ ID NO: 1829071 - DNA, 23 bp, Homo sapiens
ctgtctccatgataactgcattt

SEQ ID NO: 1829072 - DNA, 12 bp, Homo sapiens
ctgtctggaaga

SEQ ID NO: 1829073 - DNA, 20 bp, Homo sapiens
ctgtctggaagacgtggctc

SEQ ID NO: 1829074 - DNA, 23 bp, Homo sapiens
ctgtctggaagacgtggctctgg

SEQ ID NO: 1829075 - DNA, 15 bp, Homo sapiens
ctgtctgtctgtccc

SEQ ID NO: 1829076 - DNA, 22 bp, Homo sapiens
ctgtgaaagtctcctgtatcat

SEQ ID NO: 1829077 - DNA, 20 bp, Homo sapiens
ctgtgaactattttgaagaa

SEQ ID NO: 1829078 - DNA, 17 bp, Homo sapiens
ctgtgaatatgagaaat

SEQ ID NO: 1829079 - DNA, 18 bp, Homo sapiens
ctgtgaatatgagaaata

SEQ ID NO: 1829080 - DNA, 19 bp, Homo sapiens
ctgtgaggggctctctcat

SEQ ID NO: 1829081 - DNA, 14 bp, Homo sapiens
ctgtgcagcagccc

SEQ ID NO: 1829082 - DNA, 17 bp, Homo sapiens
ctgtgcagcagcccagc

SEQ ID NO: 1829083 - DNA, 23 bp, Homo sapiens
ctgtgcagcagcccagcttcctg

SEQ ID NO: 1829084 - DNA, 17 bp, Homo sapiens
ctgtgccaccctgggct

SEQ ID NO: 1829085 - DNA, 12 bp, Homo sapiens
ctgtgcccatgg

SEQ ID NO: 1829086 - DNA, 20 bp, Homo sapiens
ctgtgcccatgggcactgct

SEQ ID NO: 1829087 - DNA, 12 bp, Homo sapiens
ctgtgcctgcta

SEQ ID NO: 1829088 - DNA, 13 bp, Homo sapiens
ctgtgcctgctag

SEQ ID NO: 1829089 - DNA, 12 bp, Homo sapiens
ctgtgcctttgg

SEQ ID NO: 1829090 - DNA, 18 bp, Homo sapiens
ctgtgcctttgggaggca

SEQ ID NO: 1829091 - DNA, 16 bp, Homo sapiens
ctgtgccttttgccat

SEQ ID NO: 1829092 - DNA, 16 bp, Homo sapiens
ctgtgctcttttggtg

SEQ ID NO: 1829093 - DNA, 14 bp, Homo sapiens
ctgtgctgtgcctg

SEQ ID NO: 1829094 - DNA, 17 bp, Homo sapiens
ctgtgctgtgcctgcta

SEQ ID NO: 1829095 - DNA, 21 bp, Homo sapiens
ctgtgctgtgcctgctagagc

SEQ ID NO: 1829096 - DNA, 13 bp, Homo sapiens
ctgtggaggcctg

SEQ ID NO: 1829097 - DNA, 21 bp, Homo sapiens
ctgtggaggcctgatgctgcc

SEQ ID NO: 1829098 - DNA, 12 bp, Homo sapiens
ctgtggcacaga

SEQ ID NO: 1829099 - DNA, 22 bp, Homo sapiens
ctgtggcacagacttctggaag

SEQ ID NO: 1829100 - DNA, 13 bp, Homo sapiens
ctgtggccagagc

SEQ ID NO: 1829101 - DNA, 17 bp, Homo sapiens
ctgtggccagagctgga

SEQ ID NO: 1829102 - DNA, 19 bp, Homo sapiens
ctgtggccagagctggaag

SEQ ID NO: 1829103 - DNA, 15 bp, Homo sapiens
ctgtggcctgtgtcc

SEQ ID NO: 1829104 - DNA, 17 bp, Homo sapiens
ctgtggcctgtgtccag

SEQ ID NO: 1829105 - DNA, 20 bp, Homo sapiens
ctgtggcctgtgtccagcag

SEQ ID NO: 1829106 - DNA, 22 bp, Homo sapiens
ctgtggcctgtgtccagcagct

SEQ ID NO: 1829107 - DNA, 24 bp, Homo sapiens
ctgtggcctgtgtccagcagctgc

SEQ ID NO: 1829108 - DNA, 18 bp, Homo sapiens
ctgtgggctgcactctgt

SEQ ID NO: 1829109 - DNA, 23 bp, Homo sapiens
ctgtgggctgcactctgtgccca

SEQ ID NO: 1829110 - DNA, 15 bp, Homo sapiens
ctgtgtcactggctg

SEQ ID NO: 1829111 - DNA, 20 bp, Homo sapiens
ctgtgtcactggctgcctcc

SEQ ID NO: 1829112 - DNA, 14 bp, Homo sapiens
ctgtgtccagcagc

SEQ ID NO: 1829113 - DNA, 15 bp, Homo sapiens
ctgtgtccagcagct

SEQ ID NO: 1829114 - DNA, 16 bp, Homo sapiens
ctgtgtgtgtgtatgt

SEQ ID NO: 1829115 - DNA, 21 bp, Homo sapiens
ctgtgtgtgtgtatgtggggg

SEQ ID NO: 1829116 - DNA, 22 bp, Homo sapiens
ctgttaactgtcttgagagaaa

SEQ ID NO: 1829117 - DNA, 19 bp, Homo sapiens
ctgttattttttatttcca

SEQ ID NO: 1829118 - DNA, 16 bp, Homo sapiens
ctgttctggtggcagt

SEQ ID NO: 1829119 - DNA, 17 bp, Homo sapiens
ctgttgggcagagctgg

SEQ ID NO: 1829120 - DNA, 17 bp, Homo sapiens
ctgttggtctacagaaa

SEQ ID NO: 1829121 - DNA, 18 bp, Homo sapiens
ctgtttaaaaaaagtata

SEQ ID NO: 1829122 - DNA, 21 bp, Homo sapiens
ctgtttaaaaaaagtatatat

SEQ ID NO: 1829123 - DNA, 22 bp, Homo sapiens
ctgtttaaaaaaagtatatatt

SEQ ID NO: 1829124 - DNA, 17 bp, Homo sapiens
ctgtttcactaatactt

SEQ ID NO: 1829125 - DNA, 16 bp, Homo sapiens
ctgtttgaaatgctta

SEQ ID NO: 1829126 - DNA, 13 bp, Homo sapiens
ctgtttgcttcta

SEQ ID NO: 1829127 - DNA, 14 bp, Homo sapiens
cttaaacttgaccc

SEQ ID NO: 1829128 - DNA, 16 bp, Homo sapiens
cttaaacttgacccag

SEQ ID NO: 1829129 - DNA, 13 bp, Homo sapiens
cttaaaggcctgg

SEQ ID NO: 1829130 - DNA, 14 bp, Homo sapiens
cttaaaggcctgga

SEQ ID NO: 1829131 - DNA, 18 bp, Homo sapiens
cttaagggttgaaggcag

SEQ ID NO: 1829132 - DNA, 20 bp, Homo sapiens
cttaagggttgaaggcagtc

SEQ ID NO: 1829133 - DNA, 17 bp, Homo sapiens
cttaagtggatctgttt

SEQ ID NO: 1829134 - DNA, 19 bp, Homo sapiens
cttaatctcacttcatcaa

SEQ ID NO: 1829135 - DNA, 18 bp, Homo sapiens
cttacacttggagcccgt

SEQ ID NO: 1829136 - DNA, 19 bp, Homo sapiens
cttacatctttgtttacca

SEQ ID NO: 1829137 - DNA, 14 bp, Homo sapiens
cttagccttgtgcc

SEQ ID NO: 1829138 - DNA, 18 bp, Homo sapiens
cttagccttgtgccctgc

SEQ ID NO: 1829139 - DNA, 19 bp, Homo sapiens
cttagccttgtgccctgcc

SEQ ID NO: 1829140 - DNA, 23 bp, Homo sapiens
cttagccttgtgccctgccccca

SEQ ID NO: 1829141 - DNA, 20 bp, Homo sapiens
cttagctgaacaatgaatgc

SEQ ID NO: 1829142 - DNA, 15 bp, Homo sapiens
cttaggccagcacca

SEQ ID NO: 1829143 - DNA, 22 bp, Homo sapiens
cttataagtgggagctaaataa

SEQ ID NO: 1829144 - DNA, 17 bp, Homo sapiens
cttatgtaagtttgcat

SEQ ID NO: 1829145 - DNA, 20 bp, Homo sapiens
cttattaacaactgtgaata

SEQ ID NO: 1829146 - DNA, 14 bp, Homo sapiens
cttatttgtataat

SEQ ID NO: 1829147 - DNA, 20 bp, Homo sapiens
cttatttttctagtcagtaa

SEQ ID NO: 1829148 - DNA, 23 bp, Homo sapiens
cttatttttctagtcagtaaaca

SEQ ID NO: 1829149 - DNA, 12 bp, Homo sapiens
cttcaaaaatac

SEQ ID NO: 1829150 - DNA, 13 bp, Homo sapiens
cttcaaaaataca

SEQ ID NO: 1829151 - DNA, 17 bp, Homo sapiens
cttcaaaaatacagaat

SEQ ID NO: 1829152 - DNA, 19 bp, Homo sapiens
cttcaaaaatacagaattt

SEQ ID NO: 1829153 - DNA, 15 bp, Homo sapiens
cttcacccctgcact

SEQ ID NO: 1829154 - DNA, 17 bp, Homo sapiens
cttcagaacagaggcat

SEQ ID NO: 1829155 - DNA, 14 bp, Homo sapiens
cttcagatttcaaa

SEQ ID NO: 1829156 - DNA, 14 bp, Homo sapiens
cttcaggggctgcc

SEQ ID NO: 1829157 - DNA, 18 bp, Homo sapiens
cttcaggggctgcccgct

SEQ ID NO: 1829158 - DNA, 19 bp, Homo sapiens
cttcaggggctgcccgctc

SEQ ID NO: 1829159 - DNA, 20 bp, Homo sapiens
cttcaggggctgcccgctcc

SEQ ID NO: 1829160 - DNA, 18 bp, Homo sapiens
cttcaggtggagagcact

SEQ ID NO: 1829161 - DNA, 15 bp, Homo sapiens
cttcagtgagcccct

SEQ ID NO: 1829162 - DNA, 19 bp, Homo sapiens
cttcagtgagcccctcccc

SEQ ID NO: 1829163 - DNA, 16 bp, Homo sapiens
cttcatcaatcaaata

SEQ ID NO: 1829164 - DNA, 14 bp, Homo sapiens
gcaattgccctgta

SEQ ID NO: 1829165 - DNA, 12 bp, Homo sapiens
gcacaagctcag

SEQ ID NO: 1829166 - DNA, 13 bp, Homo sapiens
gcacaagctcaga

SEQ ID NO: 1829167 - DNA, 18 bp, Homo sapiens
gcacaagctcagaataga

SEQ ID NO: 1829168 - DNA, 13 bp, Homo sapiens
gcacacacagctc

SEQ ID NO: 1829169 - DNA, 16 bp, Homo sapiens
gcacacacagctcctc

SEQ ID NO: 1829170 - DNA, 12 bp, Homo sapiens
gcacaccactgc

SEQ ID NO: 1829171 - DNA, 19 bp, Homo sapiens
gcacaccactgccctgcct

SEQ ID NO: 1829172 - DNA, 18 bp, Homo sapiens
gcacagacttctggaagg

SEQ ID NO: 1829173 - DNA, 14 bp, Homo sapiens
gcacagcaaggagg

SEQ ID NO: 1829174 - DNA, 22 bp, Homo sapiens
gcacagcaaggaggctggctgg

SEQ ID NO: 1829175 - DNA, 12 bp, Homo sapiens
gcacagccctcc

SEQ ID NO: 1829176 - DNA, 19 bp, Homo sapiens
gcacagccctcccgcccct

SEQ ID NO: 1829177 - DNA, 21 bp, Homo sapiens
gcacagccctcccgccccttc

SEQ ID NO: 1829178 - DNA, 11 bp, Homo sapiens
gcacagccctg

SEQ ID NO: 1829179 - DNA, 17 bp, Homo sapiens
gcacagtgtctgggctg

SEQ ID NO: 1829180 - DNA, 22 bp, Homo sapiens
gcacagttgtctattctgagcc

SEQ ID NO: 1829181 - DNA, 14 bp, Homo sapiens
gcacatgattttct

SEQ ID NO: 1829182 - DNA, 14 bp, Homo sapiens
gcaccaacccagcc

SEQ ID NO: 1829183 - DNA, 17 bp, Homo sapiens
gcaccaacccagccgct

SEQ ID NO: 1829184 - DNA, 18 bp, Homo sapiens
gcaccaacccagccgctg

SEQ ID NO: 1829185 - DNA, 20 bp, Homo sapiens
gcaccaacccagccgctgcc

SEQ ID NO: 1829186 - DNA, 20 bp, Homo sapiens
gcaccagctctgtggcctgt

SEQ ID NO: 1829187 - DNA, 14 bp, Homo sapiens
gcaccagctgctct

SEQ ID NO: 1829188 - DNA, 15 bp, Homo sapiens
gcaccagctgctctg

SEQ ID NO: 1829189 - DNA, 13 bp, Homo sapiens
gcaccaggagaca

SEQ ID NO: 1829190 - DNA, 18 bp, Homo sapiens
gcacccactcaccagggt

SEQ ID NO: 1829191 - DNA, 15 bp, Homo sapiens
gcaccccactgggag

SEQ ID NO: 1829192 - DNA, 14 bp, Homo sapiens
gcacccccatgctg

SEQ ID NO: 1829193 - DNA, 16 bp, Homo sapiens
gcaccccctcctgctg

SEQ ID NO: 1829194 - DNA, 18 bp, Homo sapiens
gcaccccctcctgctgca

SEQ ID NO: 1829195 - DNA, 14 bp, Homo sapiens
gcaccctcccctcc

SEQ ID NO: 1829196 - DNA, 15 bp, Homo sapiens
gcaccctcccctccc

SEQ ID NO: 1829197 - DNA, 23 bp, Homo sapiens
gcaccctggaaaggggagttgag

SEQ ID NO: 1829198 - DNA, 21 bp, Homo sapiens
gcacctatgagatggccatgc

SEQ ID NO: 1829199 - DNA, 18 bp, Homo sapiens
gcacctcctaccctccca

SEQ ID NO: 1829200 - DNA, 21 bp, Homo sapiens
gcacctcctaccctcccacca

SEQ ID NO: 1829201 - DNA, 21 bp, Homo sapiens
gcacctgcaggttgggccata

SEQ ID NO: 1829202 - DNA, 13 bp, Homo sapiens
gcacctggcctgc

SEQ ID NO: 1829203 - DNA, 17 bp, Homo sapiens
gcacctggcctgctggg

SEQ ID NO: 1829204 - DNA, 20 bp, Homo sapiens
gcacctggcctgctgggaac

SEQ ID NO: 1829205 - DNA, 12 bp, Homo sapiens
gcactctgtgcc

SEQ ID NO: 1829206 - DNA, 19 bp, Homo sapiens
gcactctgtgcccatgggc

SEQ ID NO: 1829207 - DNA, 21 bp, Homo sapiens
gcactgctgggtggcccatcc

SEQ ID NO: 1829208 - DNA, 20 bp, Homo sapiens
gcactggaatatctgagaat

SEQ ID NO: 1829209 - DNA, 12 bp, Homo sapiens
gcactggccaga

SEQ ID NO: 1829210 - DNA, 14 bp, Homo sapiens
gcactggccagaga

SEQ ID NO: 1829211 - DNA, 16 bp, Homo sapiens
gcactggccagagagg

SEQ ID NO: 1829212 - DNA, 22 bp, Homo sapiens
gcactgtcctgctccacagtgt

SEQ ID NO: 1829213 - DNA, 20 bp, Homo sapiens
gcactgtgaactattttgaa

SEQ ID NO: 1829214 - DNA, 18 bp, Homo sapiens
gcacttgcgtcctgcaga

SEQ ID NO: 1829215 - DNA, 13 bp, Homo sapiens
gcacttttaacaa

SEQ ID NO: 1829216 - DNA, 16 bp, Homo sapiens
gcagaaaagaggagac

SEQ ID NO: 1829217 - DNA, 13 bp, Homo sapiens
gcagagaaagaaa

SEQ ID NO: 1829218 - DNA, 18 bp, Homo sapiens
gcagagagccctgggtga

SEQ ID NO: 1829219 - DNA, 12 bp, Homo sapiens
gcagagccatgg

SEQ ID NO: 1829220 - DNA, 14 bp, Homo sapiens
gcagagccatgggc

SEQ ID NO: 1829221 - DNA, 13 bp, Homo sapiens
gcagagctggaca

SEQ ID NO: 1829222 - DNA, 13 bp, Homo sapiens
gcagaggggcagc

SEQ ID NO: 1829223 - DNA, 14 bp, Homo sapiens
gcagaggggcagcc

SEQ ID NO: 1829224 - DNA, 18 bp, Homo sapiens
gcagaggggcagccgcta

SEQ ID NO: 1829225 - DNA, 21 bp, Homo sapiens
gcagaggggcagccgctagga

SEQ ID NO: 1829226 - DNA, 22 bp, Homo sapiens
gcagaggggcagccgctaggag

SEQ ID NO: 1829227 - DNA, 14 bp, Homo sapiens
gcagatcatctggg

SEQ ID NO: 1829228 - DNA, 12 bp, Homo sapiens
gcagatgggctg

SEQ ID NO: 1829229 - DNA, 14 bp, Homo sapiens
gcagattcctgggc

SEQ ID NO: 1829230 - DNA, 21 bp, Homo sapiens
gcagattcctgggcctgtccc

SEQ ID NO: 1829231 - DNA, 14 bp, Homo sapiens
gcagcagagagccc

SEQ ID NO: 1829232 - DNA, 17 bp, Homo sapiens
gcagcagagagccctgg

SEQ ID NO: 1829233 - DNA, 15 bp, Homo sapiens
gcagcagcccagctt

SEQ ID NO: 1829234 - DNA, 17 bp, Homo sapiens
gcagcagctaggactga

SEQ ID NO: 1829235 - DNA, 23 bp, Homo sapiens
gcagcagctaggactgaggagtg

SEQ ID NO: 1829236 - DNA, 13 bp, Homo sapiens
gcagcaggtgctg

SEQ ID NO: 1829237 - DNA, 22 bp, Homo sapiens
gcagcaggtgctgctaccctcc

SEQ ID NO: 1829238 - DNA, 12 bp, Homo sapiens
gcagccagccag

SEQ ID NO: 1829239 - DNA, 17 bp, Homo sapiens
gcagccatgcctcatgc

SEQ ID NO: 1829240 - DNA, 23 bp, Homo sapiens
gcagccatgcctcatgccacacc

SEQ ID NO: 1829241 - DNA, 13 bp, Homo sapiens
gcagcccagcttc

SEQ ID NO: 1829242 - DNA, 16 bp, Homo sapiens
gcagccgctaggagag

SEQ ID NO: 1829243 - DNA, 19 bp, Homo sapiens
gcagccgctaggagagact

SEQ ID NO: 1829244 - DNA, 15 bp, Homo sapiens
gcagcctccagagcc

SEQ ID NO: 1829245 - DNA, 18 bp, Homo sapiens
gcagcctccagagccagc

SEQ ID NO: 1829246 - DNA, 19 bp, Homo sapiens
gcagcctgatggccaaggg

SEQ ID NO: 1829247 - DNA, 20 bp, Homo sapiens
gcagcctgatggccaagggg

SEQ ID NO: 1829248 - DNA, 23 bp, Homo sapiens
gcagcctgatggccaagggggtg

SEQ ID NO: 1829249 - DNA, 16 bp, Homo sapiens
gcagccttcccctccc

SEQ ID NO: 1829250 - DNA, 18 bp, Homo sapiens
gcagccttcccctccctg

SEQ ID NO: 1829251 - DNA, 19 bp, Homo sapiens
gcagccttcccctccctgt

SEQ ID NO: 1829252 - DNA, 21 bp, Homo sapiens
gcagccttcccctccctgtat

SEQ ID NO: 1829253 - DNA, 19 bp, Homo sapiens
gcagctagactggagtgag

SEQ ID NO: 1829254 - DNA, 21 bp, Homo sapiens
gcagctagactggagtgaggc

SEQ ID NO: 1829255 - DNA, 20 bp, Homo sapiens
gcagctaggactgaggagtg

SEQ ID NO: 1829256 - DNA, 13 bp, Homo sapiens
gcagctcctctcc

SEQ ID NO: 1829257 - DNA, 13 bp, Homo sapiens
gcagctgctctta

SEQ ID NO: 1829258 - DNA, 18 bp, Homo sapiens
gcagctgctcttagtgcc

SEQ ID NO: 1829259 - DNA, 17 bp, Homo sapiens
gcagctgggccccacct

SEQ ID NO: 1829260 - DNA, 17 bp, Homo sapiens
gcagctgggccccatgc

SEQ ID NO: 1829261 - DNA, 20 bp, Homo sapiens
gcagctgggccccatgctct

SEQ ID NO: 1829262 - DNA, 22 bp, Homo sapiens
gcagctgggccccatgctctgc

SEQ ID NO: 1829263 - DNA, 18 bp, Homo sapiens
gcagcttctgccacttcc

SEQ ID NO: 1829264 - DNA, 17 bp, Homo sapiens
gcaggaacgagcactgg

SEQ ID NO: 1829265 - DNA, 22 bp, Homo sapiens
gcaggaacgagcactggccaga

SEQ ID NO: 1829266 - DNA, 20 bp, Homo sapiens
gcaggacacatcccggcctc

SEQ ID NO: 1829267 - DNA, 23 bp, Homo sapiens
gcaggacacatcccggcctcttc

SEQ ID NO: 1829268 - DNA, 19 bp, Homo sapiens
gcaggatccgctgccacca

SEQ ID NO: 1829269 - DNA, 21 bp, Homo sapiens
gcaggccctgcactgtcctgc

SEQ ID NO: 1829270 - DNA, 12 bp, Homo sapiens
gcaggcctggga

SEQ ID NO: 1829271 - DNA, 14 bp, Homo sapiens
gcaggcctgggacc

SEQ ID NO: 1829272 - DNA, 18 bp, Homo sapiens
gcaggcctgggacccagc

SEQ ID NO: 1829273 - DNA, 12 bp, Homo sapiens
gcaggctctggg

SEQ ID NO: 1829274 - DNA, 13 bp, Homo sapiens
gcaggctctgggc

SEQ ID NO: 1829275 - DNA, 15 bp, Homo sapiens
gcaggctctgggctc

SEQ ID NO: 1829276 - DNA, 22 bp, Homo sapiens
gcaggctctgggctcagggctg

SEQ ID NO: 1829277 - DNA, 16 bp, Homo sapiens
gcagggaaagctccac

SEQ ID NO: 1829278 - DNA, 17 bp, Homo sapiens
gcagggaagagggcagt

SEQ ID NO: 1829279 - DNA, 17 bp, Homo sapiens
gcagggagggcttgggg

SEQ ID NO: 1829280 - DNA, 18 bp, Homo sapiens
gcaggtacttcctcctga

SEQ ID NO: 1829281 - DNA, 21 bp, Homo sapiens
gcgttggagccactcctgtcc

SEQ ID NO: 1829282 - DNA, 23 bp, Homo sapiens
gcgttggtgccacttcttaaagg

SEQ ID NO: 1829283 - DNA, 21 bp, Homo sapiens
gctaacccccagcccacagag

SEQ ID NO: 1829284 - DNA, 22 bp, Homo sapiens
gctaacccccagcccacagagc

SEQ ID NO: 1829285 - DNA, 23 bp, Homo sapiens
gctaagatgagatttgccagcac

SEQ ID NO: 1829286 - DNA, 12 bp, Homo sapiens
gctactctgtcc

SEQ ID NO: 1829287 - DNA, 20 bp, Homo sapiens
gctactctgtccaggccact

SEQ ID NO: 1829288 - DNA, 21 bp, Homo sapiens
gctactctgtccaggccactg

SEQ ID NO: 1829289 - DNA, 13 bp, Homo sapiens
gctactggcagct

SEQ ID NO: 1829290 - DNA, 19 bp, Homo sapiens
gctactggcagctcctctc

SEQ ID NO: 1829291 - DNA, 20 bp, Homo sapiens
gctactggcagctcctctcc

SEQ ID NO: 1829292 - DNA, 15 bp, Homo sapiens
gctagaaacaatcta

SEQ ID NO: 1829293 - DNA, 12 bp, Homo sapiens
gctaggactgag

SEQ ID NO: 1829294 - DNA, 15 bp, Homo sapiens
gctaggactgaggag

SEQ ID NO: 1829295 - DNA, 17 bp, Homo sapiens
gctaggactgaggagtg

SEQ ID NO: 1829296 - DNA, 20 bp, Homo sapiens
gctagtaccctatagagagg

SEQ ID NO: 1829297 - DNA, 21 bp, Homo sapiens
gctagtaccctatagagaggg

SEQ ID NO: 1829298 - DNA, 17 bp, Homo sapiens
gctagtgtgagtggcag

SEQ ID NO: 1829299 - DNA, 20 bp, Homo sapiens
gctagtgtgagtggcagcca

SEQ ID NO: 1829300 - DNA, 22 bp, Homo sapiens
gctagtgtgagtggcagccatg

SEQ ID NO: 1829301 - DNA, 17 bp, Homo sapiens
gctatgagctggggatg

SEQ ID NO: 1829302 - DNA, 19 bp, Homo sapiens
gctatggggatagatgtgt

SEQ ID NO: 1829303 - DNA, 13 bp, Homo sapiens
gctatttctctcc

SEQ ID NO: 1829304 - DNA, 19 bp, Homo sapiens
gctcaacccccctcccaga

SEQ ID NO: 1829305 - DNA, 20 bp, Homo sapiens
gctcaacccccctcccagac

SEQ ID NO: 1829306 - DNA, 23 bp, Homo sapiens
gctcacgctcccccgcagtcccc

SEQ ID NO: 1829307 - DNA, 17 bp, Homo sapiens
gctcagaatagatctga

SEQ ID NO: 1829308 - DNA, 13 bp, Homo sapiens
gctcaggacccag

SEQ ID NO: 1829309 - DNA, 17 bp, Homo sapiens
gctcaggacccaggccc

SEQ ID NO: 1829310 - DNA, 18 bp, Homo sapiens
gctcaggacccaggccct

SEQ ID NO: 1829311 - DNA, 12 bp, Homo sapiens
gctcaggcaagc

SEQ ID NO: 1829312 - DNA, 16 bp, Homo sapiens
gctcaggcaagcccct

SEQ ID NO: 1829313 - DNA, 17 bp, Homo sapiens
gctcaggcaagcccctc

SEQ ID NO: 1829314 - DNA, 18 bp, Homo sapiens
gctcaggcaagcccctca

SEQ ID NO: 1829315 - DNA, 19 bp, Homo sapiens
gctcaggcaagcccctcag

SEQ ID NO: 1829316 - DNA, 21 bp, Homo sapiens
gctcaggcaagcccctcagcc

SEQ ID NO: 1829317 - DNA, 22 bp, Homo sapiens
gctcaggcaagcccctcagccc

SEQ ID NO: 1829318 - DNA, 20 bp, Homo sapiens
gctcagggaccacagcaagg

SEQ ID NO: 1829319 - DNA, 18 bp, Homo sapiens
gctcatggcgtaatgggc

SEQ ID NO: 1829320 - DNA, 20 bp, Homo sapiens
gctccacggtgcgtggctgt

SEQ ID NO: 1829321 - DNA, 14 bp, Homo sapiens
gctccagcatccag

SEQ ID NO: 1829322 - DNA, 18 bp, Homo sapiens
gctccagcatccagcctg

SEQ ID NO: 1829323 - DNA, 19 bp, Homo sapiens
gctccagcatccagcctgt

SEQ ID NO: 1829324 - DNA, 20 bp, Homo sapiens
gctccagcatccagcctgtg

SEQ ID NO: 1829325 - DNA, 17 bp, Homo sapiens
gctccagggtcttgggc

SEQ ID NO: 1829326 - DNA, 19 bp, Homo sapiens
gctccagggtcttgggcta

SEQ ID NO: 1829327 - DNA, 15 bp, Homo sapiens
gctcccacagcttcc

SEQ ID NO: 1829328 - DNA, 22 bp, Homo sapiens
gctcccagtgtcttcctgtggg

SEQ ID NO: 1829329 - DNA, 19 bp, Homo sapiens
gctcccccgcagtccccag

SEQ ID NO: 1829330 - DNA, 17 bp, Homo sapiens
gctcccccgggaggggc

SEQ ID NO: 1829331 - DNA, 17 bp, Homo sapiens
gctcctctccttgggct

SEQ ID NO: 1829332 - DNA, 19 bp, Homo sapiens
gctcctctccttgggctcc

SEQ ID NO: 1829333 - DNA, 23 bp, Homo sapiens
gctcctctccttgggctcctggc

SEQ ID NO: 1829334 - DNA, 20 bp, Homo sapiens
gctcctcttaccgtagcctc

SEQ ID NO: 1829335 - DNA, 23 bp, Homo sapiens
gctcctcttaccgtagcctccgt

SEQ ID NO: 1829336 - DNA, 12 bp, Homo sapiens
gctcctgctgca

SEQ ID NO: 1829337 - DNA, 18 bp, Homo sapiens
gctcctgctgcaccaacc

SEQ ID NO: 1829338 - DNA, 22 bp, Homo sapiens
gctcctgctgcaccaacccagc

SEQ ID NO: 1829339 - DNA, 14 bp, Homo sapiens
gctcctggctgcca

SEQ ID NO: 1829340 - DNA, 17 bp, Homo sapiens
gctcctggctgccaggc

SEQ ID NO: 1829341 - DNA, 12 bp, Homo sapiens
gctcctgtgccc

SEQ ID NO: 1829342 - DNA, 13 bp, Homo sapiens
gctcctgtgccct

SEQ ID NO: 1829343 - DNA, 21 bp, Homo sapiens
gctccttggcacccccatgct

SEQ ID NO: 1829344 - DNA, 17 bp, Homo sapiens
gctccttttgtccccag

SEQ ID NO: 1829345 - DNA, 18 bp, Homo sapiens
gctccttttgtccccagg

SEQ ID NO: 1829346 - DNA, 22 bp, Homo sapiens
gctccttttgtccccagggccc

SEQ ID NO: 1829347 - DNA, 23 bp, Homo sapiens
gctccttttgtccccagggcccc

SEQ ID NO: 1829348 - DNA, 13 bp, Homo sapiens
gctcgggcccagg

SEQ ID NO: 1829349 - DNA, 15 bp, Homo sapiens
gctcgtggccttccc

SEQ ID NO: 1829350 - DNA, 19 bp, Homo sapiens
gctctaattcttttcaaaa

SEQ ID NO: 1829351 - DNA, 16 bp, Homo sapiens
gctctagctggcagga

SEQ ID NO: 1829352 - DNA, 18 bp, Homo sapiens
gctctagctggcaggaca

SEQ ID NO: 1829353 - DNA, 21 bp, Homo sapiens
gctctccaaaggggctgctgg

SEQ ID NO: 1829354 - DNA, 23 bp, Homo sapiens
gctctccaaaggggctgctgggg

SEQ ID NO: 1829355 - DNA, 18 bp, Homo sapiens
gctctgccccaagccccc

SEQ ID NO: 1829356 - DNA, 22 bp, Homo sapiens
gctctgccccttgggcatccac

SEQ ID NO: 1829357 - DNA, 20 bp, Homo sapiens
gctctgccctccctccttcc

SEQ ID NO: 1829358 - DNA, 17 bp, Homo sapiens
gctctggcggcttcctg

SEQ ID NO: 1829359 - DNA, 21 bp, Homo sapiens
gctctggcggcttcctgtcca

SEQ ID NO: 1829360 - DNA, 11 bp, Homo sapiens
gctctgggctc

SEQ ID NO: 1829361 - DNA, 12 bp, Homo sapiens
gctctgggctca

SEQ ID NO: 1829362 - DNA, 14 bp, Homo sapiens
gctctgggctcagg

SEQ ID NO: 1829363 - DNA, 16 bp, Homo sapiens
gctctgggctcagggc

SEQ ID NO: 1829364 - DNA, 17 bp, Homo sapiens
gctctgggctcagggct

SEQ ID NO: 1829365 - DNA, 18 bp, Homo sapiens
gctctgggctcagggctg

SEQ ID NO: 1829366 - DNA, 18 bp, Homo sapiens
gctctgggtgaggtaggc

SEQ ID NO: 1829367 - DNA, 13 bp, Homo sapiens
gctctgtggcctg

SEQ ID NO: 1829368 - DNA, 15 bp, Homo sapiens
gctctgtggcctgtg

SEQ ID NO: 1829369 - DNA, 23 bp, Homo sapiens
gctctgtgggctgcactctgtgc

SEQ ID NO: 1829370 - DNA, 14 bp, Homo sapiens
gctcttcctggacc

SEQ ID NO: 1829371 - DNA, 15 bp, Homo sapiens
gctcttcctggacct

SEQ ID NO: 1829372 - DNA, 16 bp, Homo sapiens
gctcttcctggacctg

SEQ ID NO: 1829373 - DNA, 16 bp, Homo sapiens
gctcttggtccctggt

SEQ ID NO: 1829374 - DNA, 17 bp, Homo sapiens
gctcttggtccctggtc

SEQ ID NO: 1829375 - DNA, 15 bp, Homo sapiens
gctctttgttcatca

SEQ ID NO: 1829376 - DNA, 20 bp, Homo sapiens
gctgaaaaagaaaaaaatga

SEQ ID NO: 1829377 - DNA, 21 bp, Homo sapiens
gctgaattcctttacaactaa

SEQ ID NO: 1829378 - DNA, 20 bp, Homo sapiens
gctgacaatactgctgcctt

SEQ ID NO: 1829379 - DNA, 12 bp, Homo sapiens
gctgacagtcct

SEQ ID NO: 1829380 - DNA, 13 bp, Homo sapiens
gctgagccactcg

SEQ ID NO: 1829381 - DNA, 17 bp, Homo sapiens
gctgagccactcgcagt

SEQ ID NO: 1829382 - DNA, 22 bp, Homo sapiens
gctgagcttagccttgtgccct

SEQ ID NO: 1829383 - DNA, 18 bp, Homo sapiens
gctgagtggaatgcaggg

SEQ ID NO: 1829384 - DNA, 19 bp, Homo sapiens
gctgagtggaatgcaggga

SEQ ID NO: 1829385 - DNA, 22 bp, Homo sapiens
gctgagttacttgtctgaggcc

SEQ ID NO: 1829386 - DNA, 23 bp, Homo sapiens
gctgagttacttgtctgaggcct

SEQ ID NO: 1829387 - DNA, 16 bp, Homo sapiens
gctgatgctgggctgg

SEQ ID NO: 1829388 - DNA, 19 bp, Homo sapiens
gctgatgctgggctgggtg

SEQ ID NO: 1829389 - DNA, 19 bp, Homo sapiens
gctgatttccaggcccctg

SEQ ID NO: 1829390 - DNA, 13 bp, Homo sapiens
gctgcaccaaccc

SEQ ID NO: 1829391 - DNA, 16 bp, Homo sapiens
gctgcaccaacccagc

SEQ ID NO: 1829392 - DNA, 17 bp, Homo sapiens
gctgcaccaacccagcc

SEQ ID NO: 1829393 - DNA, 20 bp, Homo sapiens
gctgcaccaacccagccgct

SEQ ID NO: 1829394 - DNA, 23 bp, Homo sapiens
gctgcacctcctaccctcccacc

SEQ ID NO: 1829395 - DNA, 16 bp, Homo sapiens
gctgcactctgtgccc

SEQ ID NO: 1829396 - DNA, 21 bp, Homo sapiens
ggcctgcttttccaggatcct

SEQ ID NO: 1829397 - DNA, 22 bp, Homo sapiens
ggcctggcacagtgtctgggct

SEQ ID NO: 1829398 - DNA, 11 bp, Homo sapiens
ggcctggcctg

SEQ ID NO: 1829399 - DNA, 13 bp, Homo sapiens
ggcctggcctgag

SEQ ID NO: 1829400 - DNA, 16 bp, Homo sapiens
ggcctggcctgagctg

SEQ ID NO: 1829401 - DNA, 17 bp, Homo sapiens
ggcctggcctgagctgg

SEQ ID NO: 1829402 - DNA, 16 bp, Homo sapiens
ggcctggcttgctcca

SEQ ID NO: 1829403 - DNA, 17 bp, Homo sapiens
ggcctggcttgctccag

SEQ ID NO: 1829404 - DNA, 16 bp, Homo sapiens
ggcctgggacccagct

SEQ ID NO: 1829405 - DNA, 13 bp, Homo sapiens
ggcctgggcctgc

SEQ ID NO: 1829406 - DNA, 15 bp, Homo sapiens
ggcctgggcctgctt

SEQ ID NO: 1829407 - DNA, 20 bp, Homo sapiens
ggcctgggggcagtgactgg

SEQ ID NO: 1829408 - DNA, 13 bp, Homo sapiens
ggcctgtccccca

SEQ ID NO: 1829409 - DNA, 14 bp, Homo sapiens
ggcctgtgcagcag

SEQ ID NO: 1829410 - DNA, 15 bp, Homo sapiens
ggcctgtgcagcagc

SEQ ID NO: 1829411 - DNA, 16 bp, Homo sapiens
ggcctgtgcagcagcc

SEQ ID NO: 1829412 - DNA, 19 bp, Homo sapiens
ggcctgtgcagcagcccag

SEQ ID NO: 1829413 - DNA, 17 bp, Homo sapiens
ggcctgtgtccagcagc

SEQ ID NO: 1829414 - DNA, 18 bp, Homo sapiens
ggcctgtgtccagcagct

SEQ ID NO: 1829415 - DNA, 20 bp, Homo sapiens
ggcctgtgtccagcagctgc

SEQ ID NO: 1829416 - DNA, 22 bp, Homo sapiens
ggcctgtgtccagcagctgcgg

SEQ ID NO: 1829417 - DNA, 22 bp, Homo sapiens
ggcctgttgggcagagctggac

SEQ ID NO: 1829418 - DNA, 21 bp, Homo sapiens
ggccttccccttttgcctggc

SEQ ID NO: 1829419 - DNA, 15 bp, Homo sapiens
ggccttgagcacaaa

SEQ ID NO: 1829420 - DNA, 14 bp, Homo sapiens
ggcgagaggagggg

SEQ ID NO: 1829421 - DNA, 15 bp, Homo sapiens
ggcgcgggaggcacc

SEQ ID NO: 1829422 - DNA, 18 bp, Homo sapiens
ggcgcgggaggcaccagc

SEQ ID NO: 1829423 - DNA, 19 bp, Homo sapiens
ggcgctcaggacccaggcc

SEQ ID NO: 1829424 - DNA, 17 bp, Homo sapiens
ggcggcttcctgtccac

SEQ ID NO: 1829425 - DNA, 15 bp, Homo sapiens
ggcgtaatgggcctg

SEQ ID NO: 1829426 - DNA, 17 bp, Homo sapiens
ggcgttggtgccacttc

SEQ ID NO: 1829427 - DNA, 11 bp, Homo sapiens
ggcgtttcttt

SEQ ID NO: 1829428 - DNA, 21 bp, Homo sapiens
ggctaacatcctgctttgatt

SEQ ID NO: 1829429 - DNA, 22 bp, Homo sapiens
ggctaagatgagatttgccagc

SEQ ID NO: 1829430 - DNA, 19 bp, Homo sapiens
ggctaccccccctcctgct

SEQ ID NO: 1829431 - DNA, 13 bp, Homo sapiens
ggctactggcagc

SEQ ID NO: 1829432 - DNA, 14 bp, Homo sapiens
ggctactggcagct

SEQ ID NO: 1829433 - DNA, 15 bp, Homo sapiens
ggctactggcagctc

SEQ ID NO: 1829434 - DNA, 16 bp, Homo sapiens
ggctactggcagctcc

SEQ ID NO: 1829435 - DNA, 17 bp, Homo sapiens
ggctactggcagctcct

SEQ ID NO: 1829436 - DNA, 23 bp, Homo sapiens
ggctactggcagctcctctcctt

SEQ ID NO: 1829437 - DNA, 18 bp, Homo sapiens
ggctagtgtgagtggcag

SEQ ID NO: 1829438 - DNA, 24 bp, Homo sapiens
ggctagtgtgagtggcagccatgc

SEQ ID NO: 1829439 - DNA, 18 bp, Homo sapiens
ggctatggcaagggggtg

SEQ ID NO: 1829440 - DNA, 14 bp, Homo sapiens
ggctcagagtgggg

SEQ ID NO: 1829441 - DNA, 18 bp, Homo sapiens
ggctcagggaccacagca

SEQ ID NO: 1829442 - DNA, 12 bp, Homo sapiens
ggctcagggctg

SEQ ID NO: 1829443 - DNA, 14 bp, Homo sapiens
ggctcagggctgga

SEQ ID NO: 1829444 - DNA, 16 bp, Homo sapiens
ggctcagggctggagt

SEQ ID NO: 1829445 - DNA, 22 bp, Homo sapiens
ggctcatggcgtaatgggcctg

SEQ ID NO: 1829446 - DNA, 23 bp, Homo sapiens
ggctccccacgagtcacctgcaa

SEQ ID NO: 1829447 - DNA, 11 bp, Homo sapiens
ggctcctgctg

SEQ ID NO: 1829448 - DNA, 23 bp, Homo sapiens
ggctcctgctgcaccaacccagc

SEQ ID NO: 1829449 - DNA, 13 bp, Homo sapiens
ggctcctggctgc

SEQ ID NO: 1829450 - DNA, 17 bp, Homo sapiens
ggctcctggctgccagg

SEQ ID NO: 1829451 - DNA, 19 bp, Homo sapiens
ggctcctggctgccaggcg

SEQ ID NO: 1829452 - DNA, 13 bp, Homo sapiens
ggctcgtggcctt

SEQ ID NO: 1829453 - DNA, 22 bp, Homo sapiens
ggctctcccctctcgccccatc

SEQ ID NO: 1829454 - DNA, 15 bp, Homo sapiens
ggctctgggctcagg

SEQ ID NO: 1829455 - DNA, 18 bp, Homo sapiens
ggctctgggctcagggct

SEQ ID NO: 1829456 - DNA, 19 bp, Homo sapiens
ggctctgggctcagggctg

SEQ ID NO: 1829457 - DNA, 20 bp, Homo sapiens
ggctgacacctaccatgctg

SEQ ID NO: 1829458 - DNA, 22 bp, Homo sapiens
ggctgacacctaccatgctgct

SEQ ID NO: 1829459 - DNA, 15 bp, Homo sapiens
ggctgagagagtggc

SEQ ID NO: 1829460 - DNA, 17 bp, Homo sapiens
ggctgagagagtggcat

SEQ ID NO: 1829461 - DNA, 20 bp, Homo sapiens
ggctgagtggaatgcaggga

SEQ ID NO: 1829462 - DNA, 16 bp, Homo sapiens
ggctgcactctgtgcc

SEQ ID NO: 1829463 - DNA, 20 bp, Homo sapiens
ggctgcactctgtgcccatg

SEQ ID NO: 1829464 - DNA, 21 bp, Homo sapiens
ggctgcactctgtgcccatgg

SEQ ID NO: 1829465 - DNA, 13 bp, Homo sapiens
ggctgcccgctcc

SEQ ID NO: 1829466 - DNA, 19 bp, Homo sapiens
ggctgcctccactcccact

SEQ ID NO: 1829467 - DNA, 12 bp, Homo sapiens
ggctgcctgccg

SEQ ID NO: 1829468 - DNA, 21 bp, Homo sapiens
ggctgctggggcatgtgtgcc

SEQ ID NO: 1829469 - DNA, 22 bp, Homo sapiens
ggctgctggggcatgtgtgcct

SEQ ID NO: 1829470 - DNA, 20 bp, Homo sapiens
ggctggagtgcagtggtgcg

SEQ ID NO: 1829471 - DNA, 15 bp, Homo sapiens
ggctggcaagcaggg

SEQ ID NO: 1829472 - DNA, 14 bp, Homo sapiens
ggctggccagcccc

SEQ ID NO: 1829473 - DNA, 19 bp, Homo sapiens
ggctggccagccccacagc

SEQ ID NO: 1829474 - DNA, 15 bp, Homo sapiens
ggctggggcagaggg

SEQ ID NO: 1829475 - DNA, 16 bp, Homo sapiens
ggctggggcagagggg

SEQ ID NO: 1829476 - DNA, 21 bp, Homo sapiens
ggctggggcctatcagtgtgc

SEQ ID NO: 1829477 - DNA, 10 bp, Homo sapiens
ggctgggtgc

SEQ ID NO: 1829478 - DNA, 20 bp, Homo sapiens
ggctgggttggcgcaccctc

SEQ ID NO: 1829479 - DNA, 11 bp, Homo sapiens
ggctgtccagt

SEQ ID NO: 1829480 - DNA, 15 bp, Homo sapiens
ggctgtccagtgccc

SEQ ID NO: 1829481 - DNA, 15 bp, Homo sapiens
ggctgtggaggcctg

SEQ ID NO: 1829482 - DNA, 21 bp, Homo sapiens
ggctgtggaggcctgatgctg

SEQ ID NO: 1829483 - DNA, 22 bp, Homo sapiens
ggctgtggaggcctgatgctgc

SEQ ID NO: 1829484 - DNA, 14 bp, Homo sapiens
ggctgtggcacaga

SEQ ID NO: 1829485 - DNA, 19 bp, Homo sapiens
ggcttccaaggtggtctgc

SEQ ID NO: 1829486 - DNA, 12 bp, Homo sapiens
ggcttccaggct

SEQ ID NO: 1829487 - DNA, 22 bp, Homo sapiens
ggcttcctccgtccacccaggc

SEQ ID NO: 1829488 - DNA, 16 bp, Homo sapiens
ggcttgctccagggtc

SEQ ID NO: 1829489 - DNA, 17 bp, Homo sapiens
ggcttggacttcctggg

SEQ ID NO: 1829490 - DNA, 22 bp, Homo sapiens
ggcttggacttcctggggcccc

SEQ ID NO: 1829491 - DNA, 13 bp, Homo sapiens
ggctttgcaggct

SEQ ID NO: 1829492 - DNA, 14 bp, Homo sapiens
ggctttgcaggctc

SEQ ID NO: 1829493 - DNA, 19 bp, Homo sapiens
ggctttgcaggctctgggc

SEQ ID NO: 1829494 - DNA, 12 bp, Homo sapiens
ggctttggccca

SEQ ID NO: 1829495 - DNA, 15 bp, Homo sapiens
ggctttggggtccta

SEQ ID NO: 1829496 - DNA, 12 bp, Homo sapiens
gggaaactggct

SEQ ID NO: 1829497 - DNA, 16 bp, Homo sapiens
gggaaaggacccaccc

SEQ ID NO: 1829498 - DNA, 15 bp, Homo sapiens
gggaaccccgcagcc

SEQ ID NO: 1829499 - DNA, 19 bp, Homo sapiens
gggaacctagtactctctg

SEQ ID NO: 1829500 - DNA, 21 bp, Homo sapiens
gggaacctagtactctctgct

SEQ ID NO: 1829501 - DNA, 15 bp, Homo sapiens
gggaactccactctc

SEQ ID NO: 1829502 - DNA, 18 bp, Homo sapiens
gggaagagcacagccctc

SEQ ID NO: 1829503 - DNA, 21 bp, Homo sapiens
gggaagagggcagtacctggg

SEQ ID NO: 1829504 - DNA, 18 bp, Homo sapiens
gggaatggatggggagaa

SEQ ID NO: 1829505 - DNA, 20 bp, Homo sapiens
gggaatggatggggagaatg

SEQ ID NO: 1829506 - DNA, 14 bp, Homo sapiens
gggacaaagaaatc

SEQ ID NO: 1829507 - DNA, 15 bp, Homo sapiens
gggacagtattctca

SEQ ID NO: 1829508 - DNA, 16 bp, Homo sapiens
gggacagttggcagag

SEQ ID NO: 1829509 - DNA, 19 bp, Homo sapiens
gggaccacagcaaggcacc

SEQ ID NO: 1829510 - DNA, 19 bp, Homo sapiens
gggagaatgtcagtatgtg

SEQ ID NO: 1829511 - DNA, 22 bp, Homo sapiens
gggagatggtcagtgtggagag

SEQ ID NO: 1829512 - DNA, 16 bp, Homo sapiens
gggaggcaccagctct

SEQ ID NO: 1829513 - DNA, 22 bp, Homo sapiens
gtctgccaggcccatctcaggt

SEQ ID NO: 1829514 - DNA, 21 bp, Homo sapiens
gtctgtgaaagtctcctgtat

SEQ ID NO: 1829515 - DNA, 19 bp, Homo sapiens
gtctgtgctgtgcctgcta

SEQ ID NO: 1829516 - DNA, 20 bp, Homo sapiens
gtctgtgtgtgtgtatgtgg

SEQ ID NO: 1829517 - DNA, 11 bp, Homo sapiens
gtctgtgtgtt

SEQ ID NO: 1829518 - DNA, 22 bp, Homo sapiens
gtctgtgtgtttatgtgtgtgt

SEQ ID NO: 1829519 - DNA, 18 bp, Homo sapiens
gtcttgagagaaaagaaa

SEQ ID NO: 1829520 - DNA, 17 bp, Homo sapiens
gtcttgggctactggca

SEQ ID NO: 1829521 - DNA, 18 bp, Homo sapiens
gtcttgggctactggcag

SEQ ID NO: 1829522 - DNA, 12 bp, Homo sapiens
gtgaaagggcta

SEQ ID NO: 1829523 - DNA, 21 bp, Homo sapiens
gtgaactattttgaagaaaac

SEQ ID NO: 1829524 - DNA, 22 bp, Homo sapiens
gtgaagcagtgcctcgaggcac

SEQ ID NO: 1829525 - DNA, 23 bp, Homo sapiens
gtgaagcagtgcctcgaggcacc

SEQ ID NO: 1829526 - DNA, 21 bp, Homo sapiens
gtgaagtccttcagtgagccc

SEQ ID NO: 1829527 - DNA, 14 bp, Homo sapiens
gtgaatatgagaaa

SEQ ID NO: 1829528 - DNA, 16 bp, Homo sapiens
gtgaatatgagaaata

SEQ ID NO: 1829529 - DNA, 20 bp, Homo sapiens
gtgacaacatttttgtacat

SEQ ID NO: 1829530 - DNA, 22 bp, Homo sapiens
gtgacaacatttttgtacatta

SEQ ID NO: 1829531 - DNA, 20 bp, Homo sapiens
gtgacacagctgagctggcc

SEQ ID NO: 1829532 - DNA, 13 bp, Homo sapiens
gtgacacatccat

SEQ ID NO: 1829533 - DNA, 15 bp, Homo sapiens
gtgacagtcacttcc

SEQ ID NO: 1829534 - DNA, 19 bp, Homo sapiens
gtgaccccttttcagcttc

SEQ ID NO: 1829535 - DNA, 17 bp, Homo sapiens
gtgacccttcagggcca

SEQ ID NO: 1829536 - DNA, 21 bp, Homo sapiens
gtgactatggagctgagcagg

SEQ ID NO: 1829537 - DNA, 21 bp, Homo sapiens
gtgactattaaatgttgcaca

SEQ ID NO: 1829538 - DNA, 12 bp, Homo sapiens
gtgactgaaggg

SEQ ID NO: 1829539 - DNA, 22 bp, Homo sapiens
gtgactgaaggggcacaccact

SEQ ID NO: 1829540 - DNA, 17 bp, Homo sapiens
gtgacttctgaatcctt

SEQ ID NO: 1829541 - DNA, 13 bp, Homo sapiens
gtgaggcagtggg

SEQ ID NO: 1829542 - DNA, 23 bp, Homo sapiens
gtgaggcagtgggtcccacttcc

SEQ ID NO: 1829543 - DNA, 15 bp, Homo sapiens
gtgaggcttccaggc

SEQ ID NO: 1829544 - DNA, 15 bp, Homo sapiens
gtgagtgtgactttt

SEQ ID NO: 1829545 - DNA, 21 bp, Homo sapiens
gtgatggcgcgggaggcacca

SEQ ID NO: 1829546 - DNA, 13 bp, Homo sapiens
gtgcacccactca

SEQ ID NO: 1829547 - DNA, 19 bp, Homo sapiens
gtgcacccactcaccaggg

SEQ ID NO: 1829548 - DNA, 21 bp, Homo sapiens
gtgcacccactcaccagggtc

SEQ ID NO: 1829549 - DNA, 16 bp, Homo sapiens
gtgcactggccccacc

SEQ ID NO: 1829550 - DNA, 15 bp, Homo sapiens
gtgcagatgggctgt

SEQ ID NO: 1829551 - DNA, 12 bp, Homo sapiens
gtgcagcagccc

SEQ ID NO: 1829552 - DNA, 16 bp, Homo sapiens
gtgcagcagcccagct

SEQ ID NO: 1829553 - DNA, 18 bp, Homo sapiens
gtgcagcagcccagcttc

SEQ ID NO: 1829554 - DNA, 18 bp, Homo sapiens
gtgcagccttcccctccc

SEQ ID NO: 1829555 - DNA, 22 bp, Homo sapiens
gtgccaagtttttcagaaagtt

SEQ ID NO: 1829556 - DNA, 15 bp, Homo sapiens
gtgccaccctgggct

SEQ ID NO: 1829557 - DNA, 20 bp, Homo sapiens
gtgccaccctgggctctgtg

SEQ ID NO: 1829558 - DNA, 21 bp, Homo sapiens
gtgccaccctgggctctgtgg

SEQ ID NO: 1829559 - DNA, 13 bp, Homo sapiens
gtgccactccctg

SEQ ID NO: 1829560 - DNA, 15 bp, Homo sapiens
gtgccactccctgag

SEQ ID NO: 1829561 - DNA, 22 bp, Homo sapiens
gtgccacttcttaaaggcctgg

SEQ ID NO: 1829562 - DNA, 23 bp, Homo sapiens
gtgccacttcttaaaggcctgga

SEQ ID NO: 1829563 - DNA, 18 bp, Homo sapiens
gtgccagtcgcgctgcct

SEQ ID NO: 1829564 - DNA, 16 bp, Homo sapiens
gtgccatgttattcag

SEQ ID NO: 1829565 - DNA, 16 bp, Homo sapiens
gtgccattcccagcgt

SEQ ID NO: 1829566 - DNA, 14 bp, Homo sapiens
gtgcccagctaatt

SEQ ID NO: 1829567 - DNA, 16 bp, Homo sapiens
gtgcccatgggcactg

SEQ ID NO: 1829568 - DNA, 19 bp, Homo sapiens
gtgcccatgggcactgctg

SEQ ID NO: 1829569 - DNA, 20 bp, Homo sapiens
gtgcccatgggcactgctgg

SEQ ID NO: 1829570 - DNA, 17 bp, Homo sapiens
gtgcccattcctcacct

SEQ ID NO: 1829571 - DNA, 17 bp, Homo sapiens
gtgccccttaagggttg

SEQ ID NO: 1829572 - DNA, 14 bp, Homo sapiens
gtgccctgccccca

SEQ ID NO: 1829573 - DNA, 22 bp, Homo sapiens
gtgccgccgcctcgcccaccgc

SEQ ID NO: 1829574 - DNA, 16 bp, Homo sapiens
gtgcctagaaagcaat

SEQ ID NO: 1829575 - DNA, 14 bp, Homo sapiens
gtgcctcgaggcac

SEQ ID NO: 1829576 - DNA, 22 bp, Homo sapiens
gtgcctcgaggcaccggcgctg

SEQ ID NO: 1829577 - DNA, 18 bp, Homo sapiens
gtgcctgattcggctgtc

SEQ ID NO: 1829578 - DNA, 16 bp, Homo sapiens
gtgcctgctagagcaa

SEQ ID NO: 1829579 - DNA, 15 bp, Homo sapiens
gtgcgtggctgtggc

SEQ ID NO: 1829580 - DNA, 16 bp, Homo sapiens
gtgcgtggctgtggca

SEQ ID NO: 1829581 - DNA, 14 bp, Homo sapiens
gtgctcacgctccc

SEQ ID NO: 1829582 - DNA, 19 bp, Homo sapiens
gtgctctggcggcttcctg

SEQ ID NO: 1829583 - DNA, 19 bp, Homo sapiens
gtgctgccatgccactgcc

SEQ ID NO: 1829584 - DNA, 19 bp, Homo sapiens
gtgctgctaccctccctgc

SEQ ID NO: 1829585 - DNA, 22 bp, Homo sapiens
gtgctgctaccctccctgctgt

SEQ ID NO: 1829586 - DNA, 21 bp, Homo sapiens
gtgctgtacccttccacctcc

SEQ ID NO: 1829587 - DNA, 19 bp, Homo sapiens
gtgcttctccaacactgaa

SEQ ID NO: 1829588 - DNA, 14 bp, Homo sapiens
gtggaagagcagcc

SEQ ID NO: 1829589 - DNA, 15 bp, Homo sapiens
gtggaagagcagcct

SEQ ID NO: 1829590 - DNA, 16 bp, Homo sapiens
gtggaagagcagcctg

SEQ ID NO: 1829591 - DNA, 21 bp, Homo sapiens
gtggaagtgtgggtctgtgtg

SEQ ID NO: 1829592 - DNA, 18 bp, Homo sapiens
gtggaatgcagggaagag

SEQ ID NO: 1829593 - DNA, 13 bp, Homo sapiens
gtggacacctgcc

SEQ ID NO: 1829594 - DNA, 14 bp, Homo sapiens
gtggacacctgccc

SEQ ID NO: 1829595 - DNA, 17 bp, Homo sapiens
gtggacacctgccctgc

SEQ ID NO: 1829596 - DNA, 18 bp, Homo sapiens
gtggacacctgccctgcc

SEQ ID NO: 1829597 - DNA, 23 bp, Homo sapiens
gtggactgaaccgacttttctaa

SEQ ID NO: 1829598 - DNA, 15 bp, Homo sapiens
gtggaggcctgatgc

SEQ ID NO: 1829599 - DNA, 18 bp, Homo sapiens
gtggaggcctgatgctgc

SEQ ID NO: 1829600 - DNA, 19 bp, Homo sapiens
gtggaggcctgatgctgcc

SEQ ID NO: 1829601 - DNA, 14 bp, Homo sapiens
gtggcaaagtgctg

SEQ ID NO: 1829602 - DNA, 15 bp, Homo sapiens
gtggcaaagtgctgt

SEQ ID NO: 1829603 - DNA, 12 bp, Homo sapiens
gtggcacctcct

SEQ ID NO: 1829604 - DNA, 16 bp, Homo sapiens
gtggcacctcctgaga

SEQ ID NO: 1829605 - DNA, 18 bp, Homo sapiens
gtggcacctcctgagaag

SEQ ID NO: 1829606 - DNA, 20 bp, Homo sapiens
gtggcacctcctgagaaggc

SEQ ID NO: 1829607 - DNA, 14 bp, Homo sapiens
gtggcagaaaagag

SEQ ID NO: 1829608 - DNA, 20 bp, Homo sapiens
gtggcagaaaagaggagacc

SEQ ID NO: 1829609 - DNA, 13 bp, Homo sapiens
gtggcagccatgc

SEQ ID NO: 1829610 - DNA, 15 bp, Homo sapiens
gtggcagccatgcct

SEQ ID NO: 1829611 - DNA, 16 bp, Homo sapiens
gtggcattggcagcag

SEQ ID NO: 1829612 - DNA, 18 bp, Homo sapiens
gtggcattggcagcaggt

SEQ ID NO: 1829613 - DNA, 18 bp, Homo sapiens
gtggccagagctggaagg

SEQ ID NO: 1829614 - DNA, 21 bp, Homo sapiens
gtggcccatcccccctcacca

SEQ ID NO: 1829615 - DNA, 13 bp, Homo sapiens
gtggccccagcct

SEQ ID NO: 1829616 - DNA, 14 bp, Homo sapiens
gtggccccagcctg

SEQ ID NO: 1829617 - DNA, 18 bp, Homo sapiens
gtggccccagcctggccc

SEQ ID NO: 1829618 - DNA, 21 bp, Homo sapiens
gtggccccagcctggcccagc

SEQ ID NO: 1829619 - DNA, 22 bp, Homo sapiens
gtggccccagcctggcccagct

SEQ ID NO: 1829620 - DNA, 16 bp, Homo sapiens
gtggcctgtgtccagc

SEQ ID NO: 1829621 - DNA, 19 bp, Homo sapiens
gtggcctgtgtccagcagc

SEQ ID NO: 1829622 - DNA, 23 bp, Homo sapiens
gtggcctgtgtccagcagctgcg

SEQ ID NO: 1829623 - DNA, 21 bp, Homo sapiens
gtggccttccccttttgcctg

SEQ ID NO: 1829624 - DNA, 22 bp, Homo sapiens
gtggccttccccttttgcctgg

SEQ ID NO: 1829625 - DNA, 22 bp, Homo sapiens
gtggctagcaaattagaaacac

SEQ ID NO: 1829626 - DNA, 17 bp, Homo sapiens
gtggctggatctgtgag

SEQ ID NO: 1829627 - DNA, 17 bp, Homo sapiens
gtgggaggtgagaccac

SEQ ID NO: 1829628 - DNA, 12 bp, Homo sapiens
gtgggcagctgg

SEQ ID NO: 1829629 - DNA, 21 bp, Homo sapiens
tattcccatggtagactgtga

SEQ ID NO: 1829630 - DNA, 22 bp, Homo sapiens
tattctacacatatatgtatat

SEQ ID NO: 1829631 - DNA, 11 bp, Homo sapiens
tattctgagcc

SEQ ID NO: 1829632 - DNA, 23 bp, Homo sapiens
tattgaatattttattaaaacat

SEQ ID NO: 1829633 - DNA, 16 bp, Homo sapiens
tattgagacattaatt

SEQ ID NO: 1829634 - DNA, 19 bp, Homo sapiens
tattgagacattaatttgt

SEQ ID NO: 1829635 - DNA, 13 bp, Homo sapiens
tattgatcaaaat

SEQ ID NO: 1829636 - DNA, 17 bp, Homo sapiens
tattgatcaaaatcaaa

SEQ ID NO: 1829637 - DNA, 20 bp, Homo sapiens
tattgctctaattcttttca

SEQ ID NO: 1829638 - DNA, 22 bp, Homo sapiens
tattgctctaattcttttcaaa

SEQ ID NO: 1829639 - DNA, 18 bp, Homo sapiens
tattgtccttcagagctc

SEQ ID NO: 1829640 - DNA, 15 bp, Homo sapiens
tattgttataaataa

SEQ ID NO: 1829641 - DNA, 16 bp, Homo sapiens
tatttcattatctgta

SEQ ID NO: 1829642 - DNA, 23 bp, Homo sapiens
tatttctccatcccctccctgcc

SEQ ID NO: 1829643 - DNA, 13 bp, Homo sapiens
tattttaaaaaat

SEQ ID NO: 1829644 - DNA, 15 bp, Homo sapiens
tattttaaaaaatca

SEQ ID NO: 1829645 - DNA, 19 bp, Homo sapiens
tattttggacgtgtgagga

SEQ ID NO: 1829646 - DNA, 12 bp, Homo sapiens
tatttttcaaaa

SEQ ID NO: 1829647 - DNA, 13 bp, Homo sapiens
tatttttcaaaat

SEQ ID NO: 1829648 - DNA, 15 bp, Homo sapiens
tatttttcaaaatca

SEQ ID NO: 1829649 - DNA, 17 bp, Homo sapiens
tatttttcaaaatcaaa

SEQ ID NO: 1829650 - DNA, 18 bp, Homo sapiens
tatttttcaaaatcaaag

SEQ ID NO: 1829651 - DNA, 12 bp, Homo sapiens
tatttttctagt

SEQ ID NO: 1829652 - DNA, 13 bp, Homo sapiens
tcaaaaatttctg

SEQ ID NO: 1829653 - DNA, 17 bp, Homo sapiens
tcaaaaggcactgtgaa

SEQ ID NO: 1829654 - DNA, 19 bp, Homo sapiens
tcaaaatacgtgttcaaaa

SEQ ID NO: 1829655 - DNA, 11 bp, Homo sapiens
tcaaaatcaaa

SEQ ID NO: 1829656 - DNA, 22 bp, Homo sapiens
tcaaaatcaaaaggtaatgcac

SEQ ID NO: 1829657 - DNA, 17 bp, Homo sapiens
tcaaaattgttgcatcc

SEQ ID NO: 1829658 - DNA, 13 bp, Homo sapiens
tcaaagcaagggc

SEQ ID NO: 1829659 - DNA, 18 bp, Homo sapiens
tcaaagcaagggctccag

SEQ ID NO: 1829660 - DNA, 19 bp, Homo sapiens
tcaaagcaagggctccagc

SEQ ID NO: 1829661 - DNA, 16 bp, Homo sapiens
tcaaatgaaggtggtt

SEQ ID NO: 1829662 - DNA, 19 bp, Homo sapiens
tcaaattaatctttctata

SEQ ID NO: 1829663 - DNA, 16 bp, Homo sapiens
tcaaatttttcatctc

SEQ ID NO: 1829664 - DNA, 14 bp, Homo sapiens
tcaacattgaatat

SEQ ID NO: 1829665 - DNA, 17 bp, Homo sapiens
tcaacattgaatatcag

SEQ ID NO: 1829666 - DNA, 16 bp, Homo sapiens
tcaaccgcttgccata

SEQ ID NO: 1829667 - DNA, 15 bp, Homo sapiens
tcaacctgtgtctta

SEQ ID NO: 1829668 - DNA, 12 bp, Homo sapiens
tcaagctgtccc

SEQ ID NO: 1829669 - DNA, 13 bp, Homo sapiens
tcaagctgtcccc

SEQ ID NO: 1829670 - DNA, 14 bp, Homo sapiens
tcaaggcctcccac

SEQ ID NO: 1829671 - DNA, 16 bp, Homo sapiens
tcaaggcctcccacag

SEQ ID NO: 1829672 - DNA, 14 bp, Homo sapiens
tcaagtctgtgaaa

SEQ ID NO: 1829673 - DNA, 13 bp, Homo sapiens
tcaagtgaaagac

SEQ ID NO: 1829674 - DNA, 23 bp, Homo sapiens
tcaagtgatctttcaatatcatt

SEQ ID NO: 1829675 - DNA, 15 bp, Homo sapiens
tcaatattcaataaa

SEQ ID NO: 1829676 - DNA, 20 bp, Homo sapiens
tcaatattgattttaaatat

SEQ ID NO: 1829677 - DNA, 17 bp, Homo sapiens
tcaatcaaatatttttt

SEQ ID NO: 1829678 - DNA, 22 bp, Homo sapiens
tcaatcaagcaaaatttctgta

SEQ ID NO: 1829679 - DNA, 23 bp, Homo sapiens
tcaatcaagcaaaatttctgtat

SEQ ID NO: 1829680 - DNA, 15 bp, Homo sapiens
tcaatcactagtcaa

SEQ ID NO: 1829681 - DNA, 16 bp, Homo sapiens
tcaatgcaatgaaaac

SEQ ID NO: 1829682 - DNA, 19 bp, Homo sapiens
tcaatgcaatgaaaacaaa

SEQ ID NO: 1829683 - DNA, 21 bp, Homo sapiens
tcaattccatttaaaaaacaa

SEQ ID NO: 1829684 - DNA, 23 bp, Homo sapiens
tcacaaaataaagctgtgacagt

SEQ ID NO: 1829685 - DNA, 23 bp, Homo sapiens
tcacagcaagtcactggccagtg

SEQ ID NO: 1829686 - DNA, 14 bp, Homo sapiens
tcacagctgcagct

SEQ ID NO: 1829687 - DNA, 15 bp, Homo sapiens
tcacagctgcagctg

SEQ ID NO: 1829688 - DNA, 16 bp, Homo sapiens
tcacagctgcagctgg

SEQ ID NO: 1829689 - DNA, 19 bp, Homo sapiens
tcacagctgcagctgggcc

SEQ ID NO: 1829690 - DNA, 21 bp, Homo sapiens
tcacatataaaagttaaacta

SEQ ID NO: 1829691 - DNA, 15 bp, Homo sapiens
tcaccaggggcaggc

SEQ ID NO: 1829692 - DNA, 18 bp, Homo sapiens
tcaccaggggcaggcaca

SEQ ID NO: 1829693 - DNA, 21 bp, Homo sapiens
tcaccagggtccgcaccagct

SEQ ID NO: 1829694 - DNA, 22 bp, Homo sapiens
tcaccagggtccgcaccagctg

SEQ ID NO: 1829695 - DNA, 23 bp, Homo sapiens
tcaccagggtccgcaccagctgc

SEQ ID NO: 1829696 - DNA, 18 bp, Homo sapiens
tcacctgcaagccccagg

SEQ ID NO: 1829697 - DNA, 20 bp, Homo sapiens
tcacctgcaagccccagggc

SEQ ID NO: 1829698 - DNA, 22 bp, Homo sapiens
tcacctgcaagccccagggcct

SEQ ID NO: 1829699 - DNA, 15 bp, Homo sapiens
tcacctggttgaccc

SEQ ID NO: 1829700 - DNA, 21 bp, Homo sapiens
tcacgctcccccgcagtcccc

SEQ ID NO: 1829701 - DNA, 14 bp, Homo sapiens
tcactaagccatgc

SEQ ID NO: 1829702 - DNA, 15 bp, Homo sapiens
tcactagtcaagaaa

SEQ ID NO: 1829703 - DNA, 20 bp, Homo sapiens
tcactggctgcctccactcc

SEQ ID NO: 1829704 - DNA, 21 bp, Homo sapiens
tcactggctgcctccactccc

SEQ ID NO: 1829705 - DNA, 13 bp, Homo sapiens
tcactggctgggg

SEQ ID NO: 1829706 - DNA, 19 bp, Homo sapiens
tcactggctggggcagagg

SEQ ID NO: 1829707 - DNA, 18 bp, Homo sapiens
tcactgtatagtaatcat

SEQ ID NO: 1829708 - DNA, 18 bp, Homo sapiens
tcacttctttgcagagcc

SEQ ID NO: 1829709 - DNA, 19 bp, Homo sapiens
tcacttctttgcagagcct

SEQ ID NO: 1829710 - DNA, 15 bp, Homo sapiens
tcagaaagtttgaag

SEQ ID NO: 1829711 - DNA, 15 bp, Homo sapiens
tcagaacagaggcat

SEQ ID NO: 1829712 - DNA, 15 bp, Homo sapiens
tcagaaggagaagga

SEQ ID NO: 1829713 - DNA, 17 bp, Homo sapiens
tcagaattgaaggagaa

SEQ ID NO: 1829714 - DNA, 15 bp, Homo sapiens
tcagagcagagcaaa

SEQ ID NO: 1829715 - DNA, 13 bp, Homo sapiens
tcagagttttcta

SEQ ID NO: 1829716 - DNA, 15 bp, Homo sapiens
tcagagttttctaac

SEQ ID NO: 1829717 - DNA, 12 bp, Homo sapiens
tcagcaccctgg

SEQ ID NO: 1829718 - DNA, 16 bp, Homo sapiens
tcagcaccctgggtgc

SEQ ID NO: 1829719 - DNA, 23 bp, Homo sapiens
tcagcaccctgggtgccattccc

SEQ ID NO: 1829720 - DNA, 19 bp, Homo sapiens
tcagcagcagagagccctg

SEQ ID NO: 1829721 - DNA, 12 bp, Homo sapiens
tcagcagccccc

SEQ ID NO: 1829722 - DNA, 13 bp, Homo sapiens
tcagcccttgccc

SEQ ID NO: 1829723 - DNA, 21 bp, Homo sapiens
tcagcccttgcccccatccct

SEQ ID NO: 1829724 - DNA, 13 bp, Homo sapiens
tcagccttctcct

SEQ ID NO: 1829725 - DNA, 16 bp, Homo sapiens
tcagcttctgctgggc

SEQ ID NO: 1829726 - DNA, 22 bp, Homo sapiens
tcaggaaaggaagatgtaagaa

SEQ ID NO: 1829727 - DNA, 17 bp, Homo sapiens
tcaggacccaggccctc

SEQ ID NO: 1829728 - DNA, 22 bp, Homo sapiens
tcaggacccaggccctccatgg

SEQ ID NO: 1829729 - DNA, 20 bp, Homo sapiens
tcaggcaagcccctcagccc

SEQ ID NO: 1829730 - DNA, 21 bp, Homo sapiens
tcaggcaagcccctcagccct

SEQ ID NO: 1829731 - DNA, 24 bp, Homo sapiens
tcaggcaagcccctcagcccttgc

SEQ ID NO: 1829732 - DNA, 19 bp, Homo sapiens
tcagggccagaaggagggc

SEQ ID NO: 1829733 - DNA, 23 bp, Homo sapiens
tcagggctggagtgcgctcttgg

SEQ ID NO: 1829734 - DNA, 20 bp, Homo sapiens
tcaggggctgcccgctccca

SEQ ID NO: 1829735 - DNA, 15 bp, Homo sapiens
tcaggtaggcccttg

SEQ ID NO: 1829736 - DNA, 23 bp, Homo sapiens
tcaggtaggcccttgtcctgcca

SEQ ID NO: 1829737 - DNA, 16 bp, Homo sapiens
tcaggtgccactccct

SEQ ID NO: 1829738 - DNA, 20 bp, Homo sapiens
tcaggtgccactccctgagc

SEQ ID NO: 1829739 - DNA, 22 bp, Homo sapiens
tcagtaaacatttgtaaaaata

SEQ ID NO: 1829740 - DNA, 19 bp, Homo sapiens
tcagtaggtccaagggcca

SEQ ID NO: 1829741 - DNA, 13 bp, Homo sapiens
tcagtcagttccc

SEQ ID NO: 1829742 - DNA, 23 bp, Homo sapiens
tcagtcagttcccggagcacagc

SEQ ID NO: 1829743 - DNA, 15 bp, Homo sapiens
tcagtgacttctgaa

SEQ ID NO: 1829744 - DNA, 15 bp, Homo sapiens
tcagtgagcccctcc

SEQ ID NO: 1829745 - DNA, 11 bp, Homo sapiens
tcgagccatgg

SEQ ID NO: 1829746 - DNA, 22 bp, Homo sapiens
tcgaggcaccggcgctgcaggt

SEQ ID NO: 1829747 - DNA, 19 bp, Homo sapiens
tcgcaggatccgctgccac

SEQ ID NO: 1829748 - DNA, 17 bp, Homo sapiens
tcgctgatgctgggctg

SEQ ID NO: 1829749 - DNA, 16 bp, Homo sapiens
tcgctgccttgccatg

SEQ ID NO: 1829750 - DNA, 15 bp, Homo sapiens
tcgcttgagcccagg

SEQ ID NO: 1829751 - DNA, 21 bp, Homo sapiens
tcggacccaccaaactgcaca

SEQ ID NO: 1829752 - DNA, 22 bp, Homo sapiens
tcggacccaccaaactgcacac

SEQ ID NO: 1829753 - DNA, 19 bp, Homo sapiens
tcggactgcccccagaaag

SEQ ID NO: 1829754 - DNA, 12 bp, Homo sapiens
tcggctcctgct

SEQ ID NO: 1829755 - DNA, 17 bp, Homo sapiens
tcggctcctgctgcacc

SEQ ID NO: 1829756 - DNA, 23 bp, Homo sapiens
tcggggcccttggggcctggctt

SEQ ID NO: 1829757 - DNA, 22 bp, Homo sapiens
tcgtccacaggggcaggcctgg

SEQ ID NO: 1829758 - DNA, 19 bp, Homo sapiens
tcgtgacccttcagggcca

SEQ ID NO: 1829759 - DNA, 23 bp, Homo sapiens
tcgtgccagtcgcgctgcctgtg

SEQ ID NO: 1829760 - DNA, 13 bp, Homo sapiens
tcgtggacacctg

SEQ ID NO: 1829761 - DNA, 14 bp, Homo sapiens
tcgtggacacctgc

SEQ ID NO: 1829762 - DNA, 15 bp, Homo sapiens
tcgtggacacctgcc

SEQ ID NO: 1829763 - DNA, 20 bp, Homo sapiens
tcgtggacacctgccctgcc

SEQ ID NO: 1829764 - DNA, 22 bp, Homo sapiens
tcgtgtagtggaagagcagcct

SEQ ID NO: 1829765 - DNA, 22 bp, Homo sapiens
tctaaacaatgaattcttcaac

SEQ ID NO: 1829766 - DNA, 18 bp, Homo sapiens
tctaacatatgatactga

SEQ ID NO: 1829767 - DNA, 22 bp, Homo sapiens
tctaacccagtcttatttttct

SEQ ID NO: 1829768 - DNA, 15 bp, Homo sapiens
tctaagttaaatcat

SEQ ID NO: 1829769 - DNA, 16 bp, Homo sapiens
tctaattcttcattat

SEQ ID NO: 1829770 - DNA, 15 bp, Homo sapiens
tctaattcttttcaa

SEQ ID NO: 1829771 - DNA, 17 bp, Homo sapiens
tctacacatatatgtat

SEQ ID NO: 1829772 - DNA, 21 bp, Homo sapiens
tctactagtaataatgtaata

SEQ ID NO: 1829773 - DNA, 20 bp, Homo sapiens
tctagaaagaaaagaccctg

SEQ ID NO: 1829774 - DNA, 15 bp, Homo sapiens
tctagctggcaggac

SEQ ID NO: 1829775 - DNA, 18 bp, Homo sapiens
tctaggagtcaactggct

SEQ ID NO: 1829776 - DNA, 20 bp, Homo sapiens
tctattattataaaaataat

SEQ ID NO: 1829777 - DNA, 16 bp, Homo sapiens
tctattctgagccttg

SEQ ID NO: 1829778 - DNA, 13 bp, Homo sapiens
tctatttccataa

SEQ ID NO: 1829779 - DNA, 18 bp, Homo sapiens
tctcaagatgtttatctg

SEQ ID NO: 1829780 - DNA, 18 bp, Homo sapiens
tctcaagtgaaagacttg

SEQ ID NO: 1829781 - DNA, 17 bp, Homo sapiens
tctcaatattcaataaa

SEQ ID NO: 1829782 - DNA, 20 bp, Homo sapiens
tctcaatattcaataaagct

SEQ ID NO: 1829783 - DNA, 18 bp, Homo sapiens
tctcaatttgaaacacaa

SEQ ID NO: 1829784 - DNA, 20 bp, Homo sapiens
tctcattggggttgcaacaa

SEQ ID NO: 1829785 - DNA, 15 bp, Homo sapiens
tctccaaaggggctg

SEQ ID NO: 1829786 - DNA, 18 bp, Homo sapiens
tctccaaaggggctgctg

SEQ ID NO: 1829787 - DNA, 17 bp, Homo sapiens
tctccaacaagttgcct

SEQ ID NO: 1829788 - DNA, 16 bp, Homo sapiens
tctccacaacctcctc

SEQ ID NO: 1829789 - DNA, 22 bp, Homo sapiens
tctccacagggacacagtctgg

SEQ ID NO: 1829790 - DNA, 16 bp, Homo sapiens
tctccacctagtggct

SEQ ID NO: 1829791 - DNA, 22 bp, Homo sapiens
tctccacctagtggctgtccag

SEQ ID NO: 1829792 - DNA, 23 bp, Homo sapiens
tctccacctagtggctgtccagt

SEQ ID NO: 1829793 - DNA, 13 bp, Homo sapiens
tctccatcccctc

SEQ ID NO: 1829794 - DNA, 19 bp, Homo sapiens
tctccatcccctccctgcc

SEQ ID NO: 1829795 - DNA, 23 bp, Homo sapiens
tctccatcccctccctgcctgct

SEQ ID NO: 1829796 - DNA, 17 bp, Homo sapiens
tctccatgtagaataaa

SEQ ID NO: 1829797 - DNA, 22 bp, Homo sapiens
tctccatgtagaataaatgaag

SEQ ID NO: 1829798 - DNA, 19 bp, Homo sapiens
tctccccaggcctccagcc

SEQ ID NO: 1829799 - DNA, 20 bp, Homo sapiens
tctccccaggcctccagcct

SEQ ID NO: 1829800 - DNA, 20 bp, Homo sapiens
tctcccccccggggctgggt

SEQ ID NO: 1829801 - DNA, 19 bp, Homo sapiens
tctcccccgacactgctgc

SEQ ID NO: 1829802 - DNA, 21 bp, Homo sapiens
tctcccccgacactgctgcac

SEQ ID NO: 1829803 - DNA, 12 bp, Homo sapiens
tctcccctctcg

SEQ ID NO: 1829804 - DNA, 20 bp, Homo sapiens
tctcccctctcgccccatcc

SEQ ID NO: 1829805 - DNA, 13 bp, Homo sapiens
tctccctggccct

SEQ ID NO: 1829806 - DNA, 16 bp, Homo sapiens
tctccggggtctgtgc

SEQ ID NO: 1829807 - DNA, 18 bp, Homo sapiens
tctccggggtctgtgctg

SEQ ID NO: 1829808 - DNA, 20 bp, Homo sapiens
tctccggggtctgtgctgtg

SEQ ID NO: 1829809 - DNA, 23 bp, Homo sapiens
tctccggggtctgtgctgtgcct

SEQ ID NO: 1829810 - DNA, 16 bp, Homo sapiens
tctcctaccccacctc

SEQ ID NO: 1829811 - DNA, 19 bp, Homo sapiens
tctcctaccccacctcatg

SEQ ID NO: 1829812 - DNA, 22 bp, Homo sapiens
tctcctcatttaatatttttca

SEQ ID NO: 1829813 - DNA, 14 bp, Homo sapiens
tctcctgtatcatt

SEQ ID NO: 1829814 - DNA, 22 bp, Homo sapiens
tctccttactctgagcccaggc

SEQ ID NO: 1829815 - DNA, 17 bp, Homo sapiens
tctccttgggctcctgg

SEQ ID NO: 1829816 - DNA, 19 bp, Homo sapiens
tctccttgggctcctggct

SEQ ID NO: 1829817 - DNA, 20 bp, Homo sapiens
tctccttgggctcctggctg

SEQ ID NO: 1829818 - DNA, 19 bp, Homo sapiens
tctctcccaccccggcctc

SEQ ID NO: 1829819 - DNA, 20 bp, Homo sapiens
tctctgctctagccaggagt

SEQ ID NO: 1829820 - DNA, 13 bp, Homo sapiens
tctgacagtctca

SEQ ID NO: 1829821 - DNA, 16 bp, Homo sapiens
tctgactccagagtct

SEQ ID NO: 1829822 - DNA, 19 bp, Homo sapiens
tctgactccagagtctgag

SEQ ID NO: 1829823 - DNA, 22 bp, Homo sapiens
tctgactccagagtctgagccc

SEQ ID NO: 1829824 - DNA, 14 bp, Homo sapiens
tctgagaagtgtat

SEQ ID NO: 1829825 - DNA, 16 bp, Homo sapiens
tctgagaattgcaaaa

SEQ ID NO: 1829826 - DNA, 20 bp, Homo sapiens
tctgagaattgcaaaactag

SEQ ID NO: 1829827 - DNA, 12 bp, Homo sapiens
tctgagcccagg

SEQ ID NO: 1829828 - DNA, 13 bp, Homo sapiens
tctgagcccaggc

SEQ ID NO: 1829829 - DNA, 23 bp, Homo sapiens
tctgagcccccggctagtaccct

SEQ ID NO: 1829830 - DNA, 21 bp, Homo sapiens
tctgaggcctcatccctcgga

SEQ ID NO: 1829831 - DNA, 18 bp, Homo sapiens
tctgagggaatttaacca

SEQ ID NO: 1829832 - DNA, 18 bp, Homo sapiens
tctgatggtgagctggga

SEQ ID NO: 1829833 - DNA, 17 bp, Homo sapiens
tctgcaactagccaagg

SEQ ID NO: 1829834 - DNA, 15 bp, Homo sapiens
tctgccacttcccag

SEQ ID NO: 1829835 - DNA, 16 bp, Homo sapiens
tctgccaggcccatct

SEQ ID NO: 1829836 - DNA, 12 bp, Homo sapiens
tctgcccaggac

SEQ ID NO: 1829837 - DNA, 13 bp, Homo sapiens
tctgccccaagca

SEQ ID NO: 1829838 - DNA, 14 bp, Homo sapiens
tctgccccaagcag

SEQ ID NO: 1829839 - DNA, 14 bp, Homo sapiens
tctgccccaagccc

SEQ ID NO: 1829840 - DNA, 15 bp, Homo sapiens
tctgccccttgggca

SEQ ID NO: 1829841 - DNA, 19 bp, Homo sapiens
tctgccccttgggcatcca

SEQ ID NO: 1829842 - DNA, 13 bp, Homo sapiens
tctgcctggcctg

SEQ ID NO: 1829843 - DNA, 16 bp, Homo sapiens
tctgcctggcctggct

SEQ ID NO: 1829844 - DNA, 18 bp, Homo sapiens
tctgcctggcctggctcc

SEQ ID NO: 1829845 - DNA, 10 bp, Homo sapiens
tctgcctggg

SEQ ID NO: 1829846 - DNA, 12 bp, Homo sapiens
tctgcctgggcc

SEQ ID NO: 1829847 - DNA, 14 bp, Homo sapiens
tctgcctgggcctg

SEQ ID NO: 1829848 - DNA, 15 bp, Homo sapiens
tctgcctgggcctgt

SEQ ID NO: 1829849 - DNA, 19 bp, Homo sapiens
tctgcctgggcctgtgcag

SEQ ID NO: 1829850 - DNA, 23 bp, Homo sapiens
tctgctaacatggtacactgcat

SEQ ID NO: 1829851 - DNA, 18 bp, Homo sapiens
tctgctcagagtctatca

SEQ ID NO: 1829852 - DNA, 17 bp, Homo sapiens
tctgctcgggcccaggc

SEQ ID NO: 1829853 - DNA, 12 bp, Homo sapiens
tctgctctagcc

SEQ ID NO: 1829854 - DNA, 13 bp, Homo sapiens
tctgctctagcca

SEQ ID NO: 1829855 - DNA, 15 bp, Homo sapiens
tctgctctagccagg

SEQ ID NO: 1829856 - DNA, 18 bp, Homo sapiens
tctgctctagccaggagt

SEQ ID NO: 1829857 - DNA, 12 bp, Homo sapiens
tctgctgggctg

SEQ ID NO: 1829858 - DNA, 22 bp, Homo sapiens
tctgctgggctggggcctgatg

SEQ ID NO: 1829859 - DNA, 12 bp, Homo sapiens
tctgctgttgcc

SEQ ID NO: 1829860 - DNA, 19 bp, Homo sapiens
tctgctgttgccatagccc

SEQ ID NO: 1829861 - DNA, 16 bp, Homo sapiens
tgcaggaacgagcact

SEQ ID NO: 1829862 - DNA, 20 bp, Homo sapiens
tgcaggaacgagcactggcc

SEQ ID NO: 1829863 - DNA, 14 bp, Homo sapiens
tgcaggctctgggc

SEQ ID NO: 1829864 - DNA, 15 bp, Homo sapiens
tgcaggctctgggct

SEQ ID NO: 1829865 - DNA, 22 bp, Homo sapiens
tgcaggctctgggctcagggct

SEQ ID NO: 1829866 - DNA, 18 bp, Homo sapiens
tgcagggaagagggcagt

SEQ ID NO: 1829867 - DNA, 11 bp, Homo sapiens
tgcaggtgctg

SEQ ID NO: 1829868 - DNA, 14 bp, Homo sapiens
tgcagtacaggcaa

SEQ ID NO: 1829869 - DNA, 17 bp, Homo sapiens
tgcatcccccttagaat

SEQ ID NO: 1829870 - DNA, 15 bp, Homo sapiens
tgcattttacagtat

SEQ ID NO: 1829871 - DNA, 20 bp, Homo sapiens
tgcattttacagtatcttca

SEQ ID NO: 1829872 - DNA, 16 bp, Homo sapiens
tgccaaagcaaaagaa

SEQ ID NO: 1829873 - DNA, 13 bp, Homo sapiens
tgccaactaagcc

SEQ ID NO: 1829874 - DNA, 18 bp, Homo sapiens
tgccaaggctctcccctc

SEQ ID NO: 1829875 - DNA, 14 bp, Homo sapiens
tgccacacactgtt

SEQ ID NO: 1829876 - DNA, 18 bp, Homo sapiens
tgccacacattgtgcttg

SEQ ID NO: 1829877 - DNA, 15 bp, Homo sapiens
tgccaccacgtctgc

SEQ ID NO: 1829878 - DNA, 17 bp, Homo sapiens
tgccaccacgtctgcca

SEQ ID NO: 1829879 - DNA, 18 bp, Homo sapiens
tgccaccacgtctgccag

SEQ ID NO: 1829880 - DNA, 23 bp, Homo sapiens
tgccaccacgtctgccaggccca

SEQ ID NO: 1829881 - DNA, 13 bp, Homo sapiens
tgccaccctgggc

SEQ ID NO: 1829882 - DNA, 15 bp, Homo sapiens
tgccaccctgggctc

SEQ ID NO: 1829883 - DNA, 18 bp, Homo sapiens
tgccaccctgggctctgt

SEQ ID NO: 1829884 - DNA, 20 bp, Homo sapiens
tgccaccctgggctctgtgg

SEQ ID NO: 1829885 - DNA, 21 bp, Homo sapiens
tgccaccctgggctctgtggg

SEQ ID NO: 1829886 - DNA, 11 bp, Homo sapiens
tgccacctgtc

SEQ ID NO: 1829887 - DNA, 13 bp, Homo sapiens
tgccacctgtctg

SEQ ID NO: 1829888 - DNA, 13 bp, Homo sapiens
tgccactccctga

SEQ ID NO: 1829889 - DNA, 17 bp, Homo sapiens
tgccactccctgagctt

SEQ ID NO: 1829890 - DNA, 15 bp, Homo sapiens
tgccagcacaggggc

SEQ ID NO: 1829891 - DNA, 17 bp, Homo sapiens
tgccagcacaggggccc

SEQ ID NO: 1829892 - DNA, 18 bp, Homo sapiens
tgccagcacaggggcccc

SEQ ID NO: 1829893 - DNA, 13 bp, Homo sapiens
tgccagctgcctt

SEQ ID NO: 1829894 - DNA, 14 bp, Homo sapiens
tgccagctgccttc

SEQ ID NO: 1829895 - DNA, 21 bp, Homo sapiens
tgccagctgccttcctcatcc

SEQ ID NO: 1829896 - DNA, 14 bp, Homo sapiens
tgccaggcacctgg

SEQ ID NO: 1829897 - DNA, 17 bp, Homo sapiens
tgccaggcacctggcct

SEQ ID NO: 1829898 - DNA, 22 bp, Homo sapiens
tgccaggcacctggcctgctgg

SEQ ID NO: 1829899 - DNA, 21 bp, Homo sapiens
tgccaggcccatctcaggtgc

SEQ ID NO: 1829900 - DNA, 18 bp, Homo sapiens
tgccaggcgttggtgcca

SEQ ID NO: 1829901 - DNA, 19 bp, Homo sapiens
tgccaggcgttggtgccac

SEQ ID NO: 1829902 - DNA, 21 bp, Homo sapiens
tgccaggcgttggtgccactt

SEQ ID NO: 1829903 - DNA, 17 bp, Homo sapiens
tgccagtcgcgctgcct

SEQ ID NO: 1829904 - DNA, 22 bp, Homo sapiens
tgccagtcgcgctgcctgtgtg

SEQ ID NO: 1829905 - DNA, 22 bp, Homo sapiens
tgccatgccactgccaggcacc

SEQ ID NO: 1829906 - DNA, 22 bp, Homo sapiens
tgccatgtcttgttcagaagac

SEQ ID NO: 1829907 - DNA, 16 bp, Homo sapiens
tgcccaatgctttggg

SEQ ID NO: 1829908 - DNA, 22 bp, Homo sapiens
tgcccacttagccgtccatggc

SEQ ID NO: 1829909 - DNA, 13 bp, Homo sapiens
tgcccagttcact

SEQ ID NO: 1829910 - DNA, 23 bp, Homo sapiens
tgcccatttcgaagatatacaaa

SEQ ID NO: 1829911 - DNA, 14 bp, Homo sapiens
tgccccaagcagcc

SEQ ID NO: 1829912 - DNA, 16 bp, Homo sapiens
tgccccaagcagccag

SEQ ID NO: 1829913 - DNA, 17 bp, Homo sapiens
tgccccatctcctccca

SEQ ID NO: 1829914 - DNA, 22 bp, Homo sapiens
tgccccatctcctcccatggcc

SEQ ID NO: 1829915 - DNA, 18 bp, Homo sapiens
tgcccccagaaagcctcc

SEQ ID NO: 1829916 - DNA, 20 bp, Homo sapiens
tgcccccatctccccaggcc

SEQ ID NO: 1829917 - DNA, 22 bp, Homo sapiens
tgcccccatctccccaggcctc

SEQ ID NO: 1829918 - DNA, 18 bp, Homo sapiens
tgccccccatcctggccc

SEQ ID NO: 1829919 - DNA, 19 bp, Homo sapiens
tgccccccatcctggccca

SEQ ID NO: 1829920 - DNA, 20 bp, Homo sapiens
tgccccccatcctggcccat

SEQ ID NO: 1829921 - DNA, 21 bp, Homo sapiens
tgccccccatcctggcccatc

SEQ ID NO: 1829922 - DNA, 18 bp, Homo sapiens
tgccccctcgtgccagtc

SEQ ID NO: 1829923 - DNA, 13 bp, Homo sapiens
tgccccctgccag

SEQ ID NO: 1829924 - DNA, 16 bp, Homo sapiens
tgcccctgtctggaag

SEQ ID NO: 1829925 - DNA, 22 bp, Homo sapiens
tgccccttaagggttgaaggca

SEQ ID NO: 1829926 - DNA, 12 bp, Homo sapiens
tgcccgcctagg

SEQ ID NO: 1829927 - DNA, 18 bp, Homo sapiens
tgcccggcgccctctgtc

SEQ ID NO: 1829928 - DNA, 14 bp, Homo sapiens
tgccctgccctgcc

SEQ ID NO: 1829929 - DNA, 13 bp, Homo sapiens
tgccctgcctgcc

SEQ ID NO: 1829930 - DNA, 14 bp, Homo sapiens
tgccctgcctgccc

SEQ ID NO: 1829931 - DNA, 15 bp, Homo sapiens
tgccgccgcctcgcc

SEQ ID NO: 1829932 - DNA, 16 bp, Homo sapiens
tgccgccgcctcgccc

SEQ ID NO: 1829933 - DNA, 22 bp, Homo sapiens
tgcctaggccaaatgcacaagc

SEQ ID NO: 1829934 - DNA, 14 bp, Homo sapiens
tgcctatccatcct

SEQ ID NO: 1829935 - DNA, 16 bp, Homo sapiens
tgcctatccatcctgc

SEQ ID NO: 1829936 - DNA, 14 bp, Homo sapiens
tgcctcatgccaca

SEQ ID NO: 1829937 - DNA, 14 bp, Homo sapiens
tgcctccactccca

SEQ ID NO: 1829938 - DNA, 15 bp, Homo sapiens
tgcctcgaggcaccg

SEQ ID NO: 1829939 - DNA, 23 bp, Homo sapiens
tgcctcgaggcaccggcgctgca

SEQ ID NO: 1829940 - DNA, 16 bp, Homo sapiens
tgcctcggctcctgct

SEQ ID NO: 1829941 - DNA, 20 bp, Homo sapiens
tgcctcggctcctgctgcac

SEQ ID NO: 1829942 - DNA, 20 bp, Homo sapiens
tgcctgattcggctgtctca

SEQ ID NO: 1829943 - DNA, 21 bp, Homo sapiens
tgcctgattcggctgtctcag

SEQ ID NO: 1829944 - DNA, 14 bp, Homo sapiens
tgcctgcaccagga

SEQ ID NO: 1829945 - DNA, 15 bp, Homo sapiens
tgcctgcaccaggag

SEQ ID NO: 1829946 - DNA, 20 bp, Homo sapiens
tgcctgcaccaggagacaga

SEQ ID NO: 1829947 - DNA, 13 bp, Homo sapiens
tgcctggcctggc

SEQ ID NO: 1829948 - DNA, 14 bp, Homo sapiens
tgcctggcctggct

SEQ ID NO: 1829949 - DNA, 15 bp, Homo sapiens
tgcctggctgtggag

SEQ ID NO: 1829950 - DNA, 19 bp, Homo sapiens
tgcctggctgtggaggcct

SEQ ID NO: 1829951 - DNA, 12 bp, Homo sapiens
tgcctgggcctg

SEQ ID NO: 1829952 - DNA, 15 bp, Homo sapiens
tgcctgggcctgtgc

SEQ ID NO: 1829953 - DNA, 17 bp, Homo sapiens
tgcctgggcctgtgcag

SEQ ID NO: 1829954 - DNA, 22 bp, Homo sapiens
tgcctgggcctgtgcagcagcc

SEQ ID NO: 1829955 - DNA, 17 bp, Homo sapiens
tgccttcctcatcccct

SEQ ID NO: 1829956 - DNA, 16 bp, Homo sapiens
tgccttggtgtgctgt

SEQ ID NO: 1829957 - DNA, 17 bp, Homo sapiens
tgcgctcttggtccctg

SEQ ID NO: 1829958 - DNA, 21 bp, Homo sapiens
tgcgctcttggtccctggtcc

SEQ ID NO: 1829959 - DNA, 18 bp, Homo sapiens
tgcgtcctgacgccctgc

SEQ ID NO: 1829960 - DNA, 16 bp, Homo sapiens
tgcgtggctgtggcac

SEQ ID NO: 1829961 - DNA, 21 bp, Homo sapiens
tgcgtggctgtggcacagact

SEQ ID NO: 1829962 - DNA, 15 bp, Homo sapiens
tgcgttggagccact

SEQ ID NO: 1829963 - DNA, 16 bp, Homo sapiens
tgcgttggagccactc

SEQ ID NO: 1829964 - DNA, 19 bp, Homo sapiens
tgctaccctccctgctgtc

SEQ ID NO: 1829965 - DNA, 14 bp, Homo sapiens
tgctagagcaaccc

SEQ ID NO: 1829966 - DNA, 22 bp, Homo sapiens
tgctatgagctggggatgtctc

SEQ ID NO: 1829967 - DNA, 20 bp, Homo sapiens
tgctattatcccttcttata

SEQ ID NO: 1829968 - DNA, 13 bp, Homo sapiens
tgctcaacccccc

SEQ ID NO: 1829969 - DNA, 22 bp, Homo sapiens
tgctcaacccccctcccagaca

SEQ ID NO: 1829970 - DNA, 23 bp, Homo sapiens
tgctcacttttgtgaaagctgct

SEQ ID NO: 1829971 - DNA, 12 bp, Homo sapiens
tgctccacagtg

SEQ ID NO: 1829972 - DNA, 14 bp, Homo sapiens
tgctccagggtctt

SEQ ID NO: 1829973 - DNA, 18 bp, Homo sapiens
tgctccagggtcttgggc

SEQ ID NO: 1829974 - DNA, 23 bp, Homo sapiens
tgctccagggtcttgggctactg

SEQ ID NO: 1829975 - DNA, 16 bp, Homo sapiens
tgctccttggcacccc

SEQ ID NO: 1829976 - DNA, 19 bp, Homo sapiens
tgctccttggcacccccat

SEQ ID NO: 1829977 - DNA, 23 bp, Homo sapiens
tgctccttggcacccccatgctg

SEQ ID NO: 1829978 - DNA, 17 bp, Homo sapiens
ttataaacctctaattt

SEQ ID NO: 1829979 - DNA, 13 bp, Homo sapiens
ttatacatcttca

SEQ ID NO: 1829980 - DNA, 12 bp, Homo sapiens
ttatatatcata

SEQ ID NO: 1829981 - DNA, 17 bp, Homo sapiens
ttatatatcataaagta

SEQ ID NO: 1829982 - DNA, 23 bp, Homo sapiens
ttatatttgagtttctttcagat

SEQ ID NO: 1829983 - DNA, 14 bp, Homo sapiens
ttatcaacatttgt

SEQ ID NO: 1829984 - DNA, 19 bp, Homo sapiens
ttatctgacacaagtgtat

SEQ ID NO: 1829985 - DNA, 15 bp, Homo sapiens
ttatctgcctggcct

SEQ ID NO: 1829986 - DNA, 16 bp, Homo sapiens
ttatctgcctggcctg

SEQ ID NO: 1829987 - DNA, 12 bp, Homo sapiens
ttattaaaacat

SEQ ID NO: 1829988 - DNA, 11 bp, Homo sapiens
ttattatctac

SEQ ID NO: 1829989 - DNA, 14 bp, Homo sapiens
ttattgatcaaaat

SEQ ID NO: 1829990 - DNA, 18 bp, Homo sapiens
ttattgatcaaaatcaaa

SEQ ID NO: 1829991 - DNA, 16 bp, Homo sapiens
ttattgtgatttcccg

SEQ ID NO: 1829992 - DNA, 16 bp, Homo sapiens
ttatttctccatcccc

SEQ ID NO: 1829993 - DNA, 14 bp, Homo sapiens
ttattttcttatgt

SEQ ID NO: 1829994 - DNA, 12 bp, Homo sapiens
ttcaaagctgag

SEQ ID NO: 1829995 - DNA, 12 bp, Homo sapiens
ttcaaatgaagg

SEQ ID NO: 1829996 - DNA, 18 bp, Homo sapiens
ttcaaccgcttgccatat

SEQ ID NO: 1829997 - DNA, 16 bp, Homo sapiens
ttcaaggccatatttt

SEQ ID NO: 1829998 - DNA, 18 bp, Homo sapiens
ttcaagtgatctttcaat

SEQ ID NO: 1829999 - DNA, 22 bp, Homo sapiens
ttcaagtgatctttcaatatca

SEQ ID NO: 1830000 - DNA, 16 bp, Homo sapiens
ttcaatatcattacta

SEQ ID NO: 1830001 - DNA, 23 bp, Homo sapiens
ttcaatgcaatgaaaacaaaatt

SEQ ID NO: 1830002 - DNA, 15 bp, Homo sapiens
ttcacaacagatttc

SEQ ID NO: 1830003 - DNA, 17 bp, Homo sapiens
ttcacccctgcacttca

SEQ ID NO: 1830004 - DNA, 18 bp, Homo sapiens
ttcagaaattctcaaaat

SEQ ID NO: 1830005 - DNA, 13 bp, Homo sapiens
ttcagaacagagg

SEQ ID NO: 1830006 - DNA, 22 bp, Homo sapiens
ttcagaagacacaggggagcag

SEQ ID NO: 1830007 - DNA, 18 bp, Homo sapiens
ttcagaaggagaaggaaa

SEQ ID NO: 1830008 - DNA, 22 bp, Homo sapiens
ttcagaattgaaggagaaaatg

SEQ ID NO: 1830009 - DNA, 16 bp, Homo sapiens
ttcagatttgccttat

SEQ ID NO: 1830010 - DNA, 20 bp, Homo sapiens
ttcagcttctgctgggctgg

SEQ ID NO: 1830011 - DNA, 22 bp, Homo sapiens
ttcagcttctgctgggctgggg

SEQ ID NO: 1830012 - DNA, 19 bp, Homo sapiens
ttcaggaaaagcctctgtg

SEQ ID NO: 1830013 - DNA, 12 bp, Homo sapiens
ttcaggcactga

SEQ ID NO: 1830014 - DNA, 23 bp, Homo sapiens
ttcagggccagaaggagggcaga

SEQ ID NO: 1830015 - DNA, 14 bp, Homo sapiens
ttcaggtaggccct

SEQ ID NO: 1830016 - DNA, 22 bp, Homo sapiens
ttcaggtaggcccttgtcctgc

SEQ ID NO: 1830017 - DNA, 16 bp, Homo sapiens
ttcagtgagcccctcc

SEQ ID NO: 1830018 - DNA, 21 bp, Homo sapiens
ttcagtgagcccctccccagc

SEQ ID NO: 1830019 - DNA, 15 bp, Homo sapiens
ttcatcaatcaaata

SEQ ID NO: 1830020 - DNA, 13 bp, Homo sapiens
ttcatctcttcaa

SEQ ID NO: 1830021 - DNA, 16 bp, Homo sapiens
ttcatctcttcaatca

SEQ ID NO: 1830022 - DNA, 18 bp, Homo sapiens
ttcatgatgaattacttc

SEQ ID NO: 1830023 - DNA, 16 bp, Homo sapiens
ttcattaaaaggaaaa

SEQ ID NO: 1830024 - DNA, 22 bp, Homo sapiens
ttcattatctgtactgaaagca

SEQ ID NO: 1830025 - DNA, 12 bp, Homo sapiens
ttcattgttaaa

SEQ ID NO: 1830026 - DNA, 23 bp, Homo sapiens
ttccaaagagccatgtgtcatgt

SEQ ID NO: 1830027 - DNA, 14 bp, Homo sapiens
ttccacccattccc

SEQ ID NO: 1830028 - DNA, 18 bp, Homo sapiens
ttccactgccaaaacaat

SEQ ID NO: 1830029 - DNA, 19 bp, Homo sapiens
ttccactgccaaaacaatg

SEQ ID NO: 1830030 - DNA, 21 bp, Homo sapiens
ttccagctaagcctgatgatg

SEQ ID NO: 1830031 - DNA, 16 bp, Homo sapiens
ttccaggatcctgcag

SEQ ID NO: 1830032 - DNA, 12 bp, Homo sapiens
ttccaggcccct

SEQ ID NO: 1830033 - DNA, 21 bp, Homo sapiens
ttccaggcccctgaggactgg

SEQ ID NO: 1830034 - DNA, 23 bp, Homo sapiens
ttccattacaggggcagtgcctt

SEQ ID NO: 1830035 - DNA, 20 bp, Homo sapiens
ttcccactaagctttctcct

SEQ ID NO: 1830036 - DNA, 23 bp, Homo sapiens
ttcccactgcaccccctcctgct

SEQ ID NO: 1830037 - DNA, 15 bp, Homo sapiens
ttcccaggagaccat

SEQ ID NO: 1830038 - DNA, 19 bp, Homo sapiens
ttcccatggtagactgtga

SEQ ID NO: 1830039 - DNA, 22 bp, Homo sapiens
ttccccacagtgacagtcactt

SEQ ID NO: 1830040 - DNA, 19 bp, Homo sapiens
ttcccctcctacccctccc

SEQ ID NO: 1830041 - DNA, 17 bp, Homo sapiens
ttcccggagcacagccc

SEQ ID NO: 1830042 - DNA, 23 bp, Homo sapiens
ttcccggagcacagccctgggag

SEQ ID NO: 1830043 - DNA, 22 bp, Homo sapiens
ttccctcccaacagagctgggc

SEQ ID NO: 1830044 - DNA, 20 bp, Homo sapiens
ttccctccccacagtcctca

SEQ ID NO: 1830045 - DNA, 13 bp, Homo sapiens
ttcccttgaccat

SEQ ID NO: 1830046 - DNA, 23 bp, Homo sapiens
ttccgaagagggaatggatgggg

SEQ ID NO: 1830047 - DNA, 20 bp, Homo sapiens
ttcctcatcccctcgtcctg

SEQ ID NO: 1830048 - DNA, 17 bp, Homo sapiens
ttcctccagcctcccct

SEQ ID NO: 1830049 - DNA, 19 bp, Homo sapiens
ttcctccagcctcccctcc

SEQ ID NO: 1830050 - DNA, 20 bp, Homo sapiens
ttcctccagcctcccctccc

SEQ ID NO: 1830051 - DNA, 21 bp, Homo sapiens
ttcctccagcctcccctcccc

SEQ ID NO: 1830052 - DNA, 16 bp, Homo sapiens
ttcctcctccacagtg

SEQ ID NO: 1830053 - DNA, 13 bp, Homo sapiens
ttcctgagggcta

SEQ ID NO: 1830054 - DNA, 11 bp, Homo sapiens
ttcctgctgct

SEQ ID NO: 1830055 - DNA, 19 bp, Homo sapiens
ttcctgcttaaacttgacc

SEQ ID NO: 1830056 - DNA, 21 bp, Homo sapiens
ttcctggcctcactggctggg

SEQ ID NO: 1830057 - DNA, 22 bp, Homo sapiens
ttcctggcctcactggctgggg

SEQ ID NO: 1830058 - DNA, 11 bp, Homo sapiens
ttcctgggcct

SEQ ID NO: 1830059 - DNA, 18 bp, Homo sapiens
ttcctgtgtattctcatt

SEQ ID NO: 1830060 - DNA, 20 bp, Homo sapiens
ttccttttgcaacaagacaa

SEQ ID NO: 1830061 - DNA, 17 bp, Homo sapiens
ttcgcagtgatatactt

SEQ ID NO: 1830062 - DNA, 15 bp, Homo sapiens
ttcgctgctctagct

SEQ ID NO: 1830063 - DNA, 17 bp, Homo sapiens
ttcgtgtctctcccacc

SEQ ID NO: 1830064 - DNA, 13 bp, Homo sapiens
ttctaattcttca

SEQ ID NO: 1830065 - DNA, 17 bp, Homo sapiens
ttctaattcttcattat

SEQ ID NO: 1830066 - DNA, 18 bp, Homo sapiens
ttctacacatatatgtat

SEQ ID NO: 1830067 - DNA, 19 bp, Homo sapiens
ttctaggagtcaactggct

SEQ ID NO: 1830068 - DNA, 16 bp, Homo sapiens
ttctatcagtgacttc

SEQ ID NO: 1830069 - DNA, 12 bp, Homo sapiens
ttctatgttgta

SEQ ID NO: 1830070 - DNA, 14 bp, Homo sapiens
ttctatttccataa

SEQ ID NO: 1830071 - DNA, 15 bp, Homo sapiens
ttctcaaaatacgtg

SEQ ID NO: 1830072 - DNA, 21 bp, Homo sapiens
ttctcaaaatacgtgttcaaa

SEQ ID NO: 1830073 - DNA, 23 bp, Homo sapiens
ttctcaaaatacgtgttcaaaaa

SEQ ID NO: 1830074 - DNA, 13 bp, Homo sapiens
ttctcagaacagc

SEQ ID NO: 1830075 - DNA, 16 bp, Homo sapiens
ttctcatagccccggt

SEQ ID NO: 1830076 - DNA, 17 bp, Homo sapiens
ttctcatagccccggtg

SEQ ID NO: 1830077 - DNA, 20 bp, Homo sapiens
ttctcattggggttgcaaca

SEQ ID NO: 1830078 - DNA, 18 bp, Homo sapiens
ttctccaacaagttgcct

SEQ ID NO: 1830079 - DNA, 20 bp, Homo sapiens
ttctcccccccggggctggg

SEQ ID NO: 1830080 - DNA, 21 bp, Homo sapiens
ttctcccccgacactgctgca

SEQ ID NO: 1830081 - DNA, 20 bp, Homo sapiens
ttctccggggtctgtgctgt

SEQ ID NO: 1830082 - DNA, 14 bp, Homo sapiens
ttctcctcatttaa

SEQ ID NO: 1830083 - DNA, 19 bp, Homo sapiens
ttctctcaatttgaaacac

SEQ ID NO: 1830084 - DNA, 22 bp, Homo sapiens
ttctctcaatttgaaacacaag

SEQ ID NO: 1830085 - DNA, 13 bp, Homo sapiens
ttctgaagctaga

SEQ ID NO: 1830086 - DNA, 17 bp, Homo sapiens
ttctgaagctagaaaca

SEQ ID NO: 1830087 - DNA, 23 bp, Homo sapiens
ttctgaagctagaaacaatctat

SEQ ID NO: 1830088 - DNA, 15 bp, Homo sapiens
ttctgcaactagcca

SEQ ID NO: 1830089 - DNA, 20 bp, Homo sapiens
ttctgcaactagccaaggct

SEQ ID NO: 1830090 - DNA, 15 bp, Homo sapiens
ttctgctgggctggg

SEQ ID NO: 1830091 - DNA, 14 bp, Homo sapiens
ttctgcttttgcat

SEQ ID NO: 1830092 - DNA, 18 bp, Homo sapiens
ttctggaaggctggctga

SEQ ID NO: 1830093 - DNA, 14 bp, Homo sapiens
ttctgggaagggag

SEQ ID NO: 1830094 - DNA, 16 bp, Homo sapiens
aaaagttaaactactt

SEQ ID NO: 1830095 - DNA, 18 bp, Homo sapiens
aaaagttggagttatatt

SEQ ID NO: 1830096 - DNA, 19 bp, Homo sapiens
aaaagtttcacaacagatt

SEQ ID NO: 1830097 - DNA, 19 bp, Homo sapiens
aaaatactgtttcactaat

SEQ ID NO: 1830098 - DNA, 16 bp, Homo sapiens
aaaatagcacatgatt

SEQ ID NO: 1830099 - DNA, 15 bp, Homo sapiens
aaaatgcattatgtg

SEQ ID NO: 1830100 - DNA, 20 bp, Homo sapiens
aaaatgttaaacccttacca

SEQ ID NO: 1830101 - DNA, 16 bp, Homo sapiens
aaaattgtgatgtgtc

SEQ ID NO: 1830102 - DNA, 23 bp, Homo sapiens
aaaattttgtatgtcaataactt

SEQ ID NO: 1830103 - DNA, 19 bp, Homo sapiens
aaacaaataaactagtctg

SEQ ID NO: 1830104 - DNA, 23 bp, Homo sapiens
aaacattcctccagcctcccctc

SEQ ID NO: 1830105 - DNA, 23 bp, Homo sapiens
aaacatttgtaaaaatactgttt

SEQ ID NO: 1830106 - DNA, 17 bp, Homo sapiens
aaaccctatctgtgatt

SEQ ID NO: 1830107 - DNA, 18 bp, Homo sapiens
aaacctctaatttatttt

SEQ ID NO: 1830108 - DNA, 14 bp, Homo sapiens
aaactagacaaaag

SEQ ID NO: 1830109 - DNA, 21 bp, Homo sapiens
aaactagacaaaagtttcaca

SEQ ID NO: 1830110 - DNA, 24 bp, Homo sapiens
aaactagacaaaagtttcacaaca

SEQ ID NO: 1830111 - DNA, 19 bp, Homo sapiens
aaactagtctgttggcaat

SEQ ID NO: 1830112 - DNA, 19 bp, Homo sapiens
aaactgaggccattatttc

SEQ ID NO: 1830113 - DNA, 20 bp, Homo sapiens
aaactgaggccattatttca

SEQ ID NO: 1830114 - DNA, 19 bp, Homo sapiens
aaactgatgtttaaaagtc

SEQ ID NO: 1830115 - DNA, 16 bp, Homo sapiens
aaactggatactgtac

SEQ ID NO: 1830116 - DNA, 16 bp, Homo sapiens
aaagaagtaaaagcta

SEQ ID NO: 1830117 - DNA, 20 bp, Homo sapiens
aaagaccctgagactccaga

SEQ ID NO: 1830118 - DNA, 16 bp, Homo sapiens
aaagactaactaaaat

SEQ ID NO: 1830119 - DNA, 17 bp, Homo sapiens
aaagagccatgtgtcat

SEQ ID NO: 1830120 - DNA, 16 bp, Homo sapiens
aaagagttattcaaat

SEQ ID NO: 1830121 - DNA, 21 bp, Homo sapiens
aaagattatatatcataaagt

SEQ ID NO: 1830122 - DNA, 13 bp, Homo sapiens
aaagcaaaagaag

SEQ ID NO: 1830123 - DNA, 22 bp, Homo sapiens
aaagcaagggctccagcatcca

SEQ ID NO: 1830124 - DNA, 14 bp, Homo sapiens
aaagcaattgccct

SEQ ID NO: 1830125 - DNA, 19 bp, Homo sapiens
aaagcaattgccctgtaac

SEQ ID NO: 1830126 - DNA, 17 bp, Homo sapiens
aaagcagttaaactgat

SEQ ID NO: 1830127 - DNA, 13 bp, Homo sapiens
aaagccacatttt

SEQ ID NO: 1830128 - DNA, 16 bp, Homo sapiens
aaagccatttgtctgt

SEQ ID NO: 1830129 - DNA, 21 bp, Homo sapiens
aaagcctctgtgtcactggct

SEQ ID NO: 1830130 - DNA, 16 bp, Homo sapiens
aaagcgggcagccccg

SEQ ID NO: 1830131 - DNA, 20 bp, Homo sapiens
aaagctaagtcttgtctcat

SEQ ID NO: 1830132 - DNA, 21 bp, Homo sapiens
aaagctggacaagaagctgct

SEQ ID NO: 1830133 - DNA, 19 bp, Homo sapiens
aaagctgtgacagttctgt

SEQ ID NO: 1830134 - DNA, 23 bp, Homo sapiens
aaaggacctcttctgaagctaga

SEQ ID NO: 1830135 - DNA, 13 bp, Homo sapiens
aaaggcactgtga

SEQ ID NO: 1830136 - DNA, 12 bp, Homo sapiens
aaaggcctggaa

SEQ ID NO: 1830137 - DNA, 13 bp, Homo sapiens
aaaggcttctcca

SEQ ID NO: 1830138 - DNA, 17 bp, Homo sapiens
aaagggctatggcaagg

SEQ ID NO: 1830139 - DNA, 13 bp, Homo sapiens
aaaggtatttaga

SEQ ID NO: 1830140 - DNA, 17 bp, Homo sapiens
aaaggttttattttgta

SEQ ID NO: 1830141 - DNA, 21 bp, Homo sapiens
acctcctgagaaggcgaggag

SEQ ID NO: 1830142 - DNA, 18 bp, Homo sapiens
acctctaatttattttgt

SEQ ID NO: 1830143 - DNA, 21 bp, Homo sapiens
acctcttctgaagctagaaac

SEQ ID NO: 1830144 - DNA, 14 bp, Homo sapiens
acctgagcattcag

SEQ ID NO: 1830145 - DNA, 18 bp, Homo sapiens
acctgagcattcaggcag

SEQ ID NO: 1830146 - DNA, 15 bp, Homo sapiens
acctgcaagccccag

SEQ ID NO: 1830147 - DNA, 19 bp, Homo sapiens
acctgcaagccccagggcc

SEQ ID NO: 1830148 - DNA, 22 bp, Homo sapiens
acctgcaagccccagggcctgg

SEQ ID NO: 1830149 - DNA, 17 bp, Homo sapiens
acctgcaggttgggcca

SEQ ID NO: 1830150 - DNA, 22 bp, Homo sapiens
acctgcaggttgggccatactg

SEQ ID NO: 1830151 - DNA, 14 bp, Homo sapiens
acctgcccctcccc

SEQ ID NO: 1830152 - DNA, 13 bp, Homo sapiens
acctgccctgccc

SEQ ID NO: 1830153 - DNA, 18 bp, Homo sapiens
acctgccctgccctgcca

SEQ ID NO: 1830154 - DNA, 18 bp, Homo sapiens
acctgcctatccatcctg

SEQ ID NO: 1830155 - DNA, 17 bp, Homo sapiens
acctggcctgctgggaa

SEQ ID NO: 1830156 - DNA, 15 bp, Homo sapiens
acctgggaaaggacc

SEQ ID NO: 1830157 - DNA, 15 bp, Homo sapiens
acctgtccataaagt

SEQ ID NO: 1830158 - DNA, 12 bp, Homo sapiens
acctgtgtctta

SEQ ID NO: 1830159 - DNA, 17 bp, Homo sapiens
acctttgtccaggcctg

SEQ ID NO: 1830160 - DNA, 18 bp, Homo sapiens
acctttttttctctccta

SEQ ID NO: 1830161 - DNA, 15 bp, Homo sapiens
acgagcactggccag

SEQ ID NO: 1830162 - DNA, 13 bp, Homo sapiens
acgagtcacctgc

SEQ ID NO: 1830163 - DNA, 14 bp, Homo sapiens
acgagtcacctgca

SEQ ID NO: 1830164 - DNA, 18 bp, Homo sapiens
acgcaccccactgggaga

SEQ ID NO: 1830165 - DNA, 15 bp, Homo sapiens
acggggccggccagg

SEQ ID NO: 1830166 - DNA, 20 bp, Homo sapiens
acggtgcgtggctgtggcac

SEQ ID NO: 1830167 - DNA, 15 bp, Homo sapiens
acgtctgccaggccc

SEQ ID NO: 1830168 - DNA, 20 bp, Homo sapiens
acgtctgccaggcccatctc

SEQ ID NO: 1830169 - DNA, 20 bp, Homo sapiens
actaaagccatttgtctgtg

SEQ ID NO: 1830170 - DNA, 21 bp, Homo sapiens
actaaataacacagatattgt

SEQ ID NO: 1830171 - DNA, 17 bp, Homo sapiens
actaagccatgccatgc

SEQ ID NO: 1830172 - DNA, 18 bp, Homo sapiens
actaagctttctcctttg

SEQ ID NO: 1830173 - DNA, 21 bp, Homo sapiens
actaatagtaacaggccttga

SEQ ID NO: 1830174 - DNA, 18 bp, Homo sapiens
actactgtatttcattat

SEQ ID NO: 1830175 - DNA, 17 bp, Homo sapiens
actagtcaagaaaaata

SEQ ID NO: 1830176 - DNA, 18 bp, Homo sapiens
actagtcaagaaaaatat

SEQ ID NO: 1830177 - DNA, 16 bp, Homo sapiens
actagtgcctagaaag

SEQ ID NO: 1830178 - DNA, 20 bp, Homo sapiens
actagtgcctagaaagcaat

SEQ ID NO: 1830179 - DNA, 14 bp, Homo sapiens
actatgcgttttta

SEQ ID NO: 1830180 - DNA, 22 bp, Homo sapiens
actattaaatgttgcacatcat

SEQ ID NO: 1830181 - DNA, 14 bp, Homo sapiens
actattcaatgcaa

SEQ ID NO: 1830182 - DNA, 21 bp, Homo sapiens
actattttgaagaaaacacaa

SEQ ID NO: 1830183 - DNA, 22 bp, Homo sapiens
actatttttattttcttatgta

SEQ ID NO: 1830184 - DNA, 22 bp, Homo sapiens
actcaatcaagcaaaatttctg

SEQ ID NO: 1830185 - DNA, 13 bp, Homo sapiens
actcaccagggtc

SEQ ID NO: 1830186 - DNA, 15 bp, Homo sapiens
actcaccagggtccg

SEQ ID NO: 1830187 - DNA, 11 bp, Homo sapiens
actcagagcag

SEQ ID NO: 1830188 - DNA, 12 bp, Homo sapiens
actcagagcaga

SEQ ID NO: 1830189 - DNA, 15 bp, Homo sapiens
actcagcagcagaga

SEQ ID NO: 1830190 - DNA, 19 bp, Homo sapiens
actcagcagcagagagccc

SEQ ID NO: 1830191 - DNA, 13 bp, Homo sapiens
actcagtctttaa

SEQ ID NO: 1830192 - DNA, 22 bp, Homo sapiens
actccactctccttcgtgtctc

SEQ ID NO: 1830193 - DNA, 23 bp, Homo sapiens
actccactctccttcgtgtctct

SEQ ID NO: 1830194 - DNA, 16 bp, Homo sapiens
actccagaatctgctg

SEQ ID NO: 1830195 - DNA, 22 bp, Homo sapiens
actccagaatctgctgttgcca

SEQ ID NO: 1830196 - DNA, 12 bp, Homo sapiens
actccagagaag

SEQ ID NO: 1830197 - DNA, 16 bp, Homo sapiens
actccagagtctgagc

SEQ ID NO: 1830198 - DNA, 18 bp, Homo sapiens
actccagagtctgagccc

SEQ ID NO: 1830199 - DNA, 20 bp, Homo sapiens
actcccacttccctgacact

SEQ ID NO: 1830200 - DNA, 21 bp, Homo sapiens
actccctggatgtgtggggca

SEQ ID NO: 1830201 - DNA, 17 bp, Homo sapiens
actcccttcctggcctc

SEQ ID NO: 1830202 - DNA, 18 bp, Homo sapiens
actcccttcctggcctca

SEQ ID NO: 1830203 - DNA, 20 bp, Homo sapiens
actcccttcctggcctcact

SEQ ID NO: 1830204 - DNA, 21 bp, Homo sapiens
actcctgaaggtttcctggtc

SEQ ID NO: 1830205 - DNA, 13 bp, Homo sapiens
agaatgtcagtat

SEQ ID NO: 1830206 - DNA, 14 bp, Homo sapiens
agaatgtttctatt

SEQ ID NO: 1830207 - DNA, 18 bp, Homo sapiens
agaatgtttctatttcca

SEQ ID NO: 1830208 - DNA, 15 bp, Homo sapiens
agaattctagaaaat

SEQ ID NO: 1830209 - DNA, 19 bp, Homo sapiens
agaattgaaggagaaaatg

SEQ ID NO: 1830210 - DNA, 14 bp, Homo sapiens
agaatttgaatatt

SEQ ID NO: 1830211 - DNA, 13 bp, Homo sapiens
agacaagccctgg

SEQ ID NO: 1830212 - DNA, 16 bp, Homo sapiens
agacaagccctggcaa

SEQ ID NO: 1830213 - DNA, 18 bp, Homo sapiens
agacaagccctggcaaca

SEQ ID NO: 1830214 - DNA, 24 bp, Homo sapiens
agacaattttcataacttgataaa

SEQ ID NO: 1830215 - DNA, 19 bp, Homo sapiens
agacaggcagggagggctt

SEQ ID NO: 1830216 - DNA, 18 bp, Homo sapiens
agacaggccctccctgtc

SEQ ID NO: 1830217 - DNA, 18 bp, Homo sapiens
agaccctgagactccaga

SEQ ID NO: 1830218 - DNA, 20 bp, Homo sapiens
agaccctggaattcagcacc

SEQ ID NO: 1830219 - DNA, 22 bp, Homo sapiens
agaccctggaattcagcaccct

SEQ ID NO: 1830220 - DNA, 21 bp, Homo sapiens
agactcaaggcctccagccac

SEQ ID NO: 1830221 - DNA, 14 bp, Homo sapiens
agactccagaatct

SEQ ID NO: 1830222 - DNA, 22 bp, Homo sapiens
agactccagaatctgctgttgc

SEQ ID NO: 1830223 - DNA, 23 bp, Homo sapiens
agactctttttgtacctggtgac

SEQ ID NO: 1830224 - DNA, 21 bp, Homo sapiens
agactgaaagcagcagctagg

SEQ ID NO: 1830225 - DNA, 14 bp, Homo sapiens
agactggagtgagg

SEQ ID NO: 1830226 - DNA, 22 bp, Homo sapiens
agactggtttcccggtgacaca

SEQ ID NO: 1830227 - DNA, 23 bp, Homo sapiens
agactgtatgttttaattgcatt

SEQ ID NO: 1830228 - DNA, 14 bp, Homo sapiens
agacttatcaacat

SEQ ID NO: 1830229 - DNA, 17 bp, Homo sapiens
agacttcagatttcaaa

SEQ ID NO: 1830230 - DNA, 19 bp, Homo sapiens
agacttcagatttcaaatt

SEQ ID NO: 1830231 - DNA, 15 bp, Homo sapiens
agacttctggaaggc

SEQ ID NO: 1830232 - DNA, 16 bp, Homo sapiens
agacttctggaaggct

SEQ ID NO: 1830233 - DNA, 18 bp, Homo sapiens
agacttctggaaggctgg

SEQ ID NO: 1830234 - DNA, 14 bp, Homo sapiens
agagaaaagaaaaa

SEQ ID NO: 1830235 - DNA, 23 bp, Homo sapiens
agagaaagaaagggaaactggct

SEQ ID NO: 1830236 - DNA, 14 bp, Homo sapiens
agagaactattgtt

SEQ ID NO: 1830237 - DNA, 20 bp, Homo sapiens
agagaaggcctcttgtgctc

SEQ ID NO: 1830238 - DNA, 19 bp, Homo sapiens
agagactgaaagcagcagc

SEQ ID NO: 1830239 - DNA, 20 bp, Homo sapiens
agagactgaaagcagcagct

SEQ ID NO: 1830240 - DNA, 17 bp, Homo sapiens
agagagcagcttctgcc

SEQ ID NO: 1830241 - DNA, 21 bp, Homo sapiens
agagagccctgggtgacttca

SEQ ID NO: 1830242 - DNA, 15 bp, Homo sapiens
agagagggggctctc

SEQ ID NO: 1830243 - DNA, 13 bp, Homo sapiens
agagcaacccctg

SEQ ID NO: 1830244 - DNA, 14 bp, Homo sapiens
agagcacagccctc

SEQ ID NO: 1830245 - DNA, 15 bp, Homo sapiens
agagcacagccctcc

SEQ ID NO: 1830246 - DNA, 19 bp, Homo sapiens
agagcacttttaacaaaaa

SEQ ID NO: 1830247 - DNA, 18 bp, Homo sapiens
agagcagagcaaatgagg

SEQ ID NO: 1830248 - DNA, 12 bp, Homo sapiens
agagcagcctga

SEQ ID NO: 1830249 - DNA, 13 bp, Homo sapiens
agagcagcctgat

SEQ ID NO: 1830250 - DNA, 22 bp, Homo sapiens
agccatgggcctgggcctgctt

SEQ ID NO: 1830251 - DNA, 14 bp, Homo sapiens
agcccacagagcct

SEQ ID NO: 1830252 - DNA, 23 bp, Homo sapiens
agcccaggccgttccccttggct

SEQ ID NO: 1830253 - DNA, 15 bp, Homo sapiens
agcccagtgcttctc

SEQ ID NO: 1830254 - DNA, 19 bp, Homo sapiens
agccccaactccaggggca

SEQ ID NO: 1830255 - DNA, 11 bp, Homo sapiens
agccccacagc

SEQ ID NO: 1830256 - DNA, 13 bp, Homo sapiens
agccccagggcct

SEQ ID NO: 1830257 - DNA, 20 bp, Homo sapiens
agccccagggcctgggggca

SEQ ID NO: 1830258 - DNA, 20 bp, Homo sapiens
agcccccaaccccgcggtgc

SEQ ID NO: 1830259 - DNA, 21 bp, Homo sapiens
agcccccaaccccgcggtgct

SEQ ID NO: 1830260 - DNA, 16 bp, Homo sapiens
agccccgttttgggga

SEQ ID NO: 1830261 - DNA, 21 bp, Homo sapiens
agcccctcagcccttgccccc

SEQ ID NO: 1830262 - DNA, 12 bp, Homo sapiens
agcccctcccca

SEQ ID NO: 1830263 - DNA, 14 bp, Homo sapiens
agcccctccccagc

SEQ ID NO: 1830264 - DNA, 15 bp, Homo sapiens
agcccctccccagcc

SEQ ID NO: 1830265 - DNA, 17 bp, Homo sapiens
agcccgtgaagcagtgc

SEQ ID NO: 1830266 - DNA, 20 bp, Homo sapiens
agcccgtgaagcagtgcctc

SEQ ID NO: 1830267 - DNA, 20 bp, Homo sapiens
agcccgtgcagtacaggcaa

SEQ ID NO: 1830268 - DNA, 23 bp, Homo sapiens
agccctcagtcagttcccggagc

SEQ ID NO: 1830269 - DNA, 18 bp, Homo sapiens
agccctcgaaccaaggca

SEQ ID NO: 1830270 - DNA, 20 bp, Homo sapiens
agccctcgaaccaaggcagc

SEQ ID NO: 1830271 - DNA, 21 bp, Homo sapiens
agccctgggtgacttcaggtg

SEQ ID NO: 1830272 - DNA, 19 bp, Homo sapiens
agcccttgcccccatccct

SEQ ID NO: 1830273 - DNA, 22 bp, Homo sapiens
agcccttgcccccatccctcgg

SEQ ID NO: 1830274 - DNA, 20 bp, Homo sapiens
agccctttgcaggcccagca

SEQ ID NO: 1830275 - DNA, 15 bp, Homo sapiens
agccgctaggagaga

SEQ ID NO: 1830276 - DNA, 22 bp, Homo sapiens
agccgctgcccggcgccctctg

SEQ ID NO: 1830277 - DNA, 14 bp, Homo sapiens
agccgtccatggca

SEQ ID NO: 1830278 - DNA, 15 bp, Homo sapiens
agccgtccatggcac

SEQ ID NO: 1830279 - DNA, 16 bp, Homo sapiens
agccgtccatggcacc

SEQ ID NO: 1830280 - DNA, 19 bp, Homo sapiens
agccgtctgactccagagt

SEQ ID NO: 1830281 - DNA, 23 bp, Homo sapiens
agccgtctgactccagagtctga

SEQ ID NO: 1830282 - DNA, 10 bp, Homo sapiens
agcctatgtc

SEQ ID NO: 1830283 - DNA, 15 bp, Homo sapiens
agcctatgtcttgta

SEQ ID NO: 1830284 - DNA, 13 bp, Homo sapiens
agcctccagagcc

SEQ ID NO: 1830285 - DNA, 22 bp, Homo sapiens
agcctccagagccagcctggga

SEQ ID NO: 1830286 - DNA, 24 bp, Homo sapiens
agcctccagagccagcctgggact

SEQ ID NO: 1830287 - DNA, 10 bp, Homo sapiens
agcctcccct

SEQ ID NO: 1830288 - DNA, 14 bp, Homo sapiens
agcctctgtgtcac

SEQ ID NO: 1830289 - DNA, 15 bp, Homo sapiens
agcctctgtgtcact

SEQ ID NO: 1830290 - DNA, 19 bp, Homo sapiens
agcctctgtgtcactggct

SEQ ID NO: 1830291 - DNA, 20 bp, Homo sapiens
agcctctgtgtcactggctg

SEQ ID NO: 1830292 - DNA, 21 bp, Homo sapiens
agcctctgtgtcactggctgc

SEQ ID NO: 1830293 - DNA, 23 bp, Homo sapiens
agcctctgtgtcactggctgcct

SEQ ID NO: 1830294 - DNA, 16 bp, Homo sapiens
agcctgatggccaagg

SEQ ID NO: 1830295 - DNA, 23 bp, Homo sapiens
agcctgatggccaagggggtgga

SEQ ID NO: 1830296 - DNA, 14 bp, Homo sapiens
agcctggcccagct

SEQ ID NO: 1830297 - DNA, 17 bp, Homo sapiens
agcctggcccagctccc

SEQ ID NO: 1830298 - DNA, 13 bp, Homo sapiens
agccttcccctcc

SEQ ID NO: 1830299 - DNA, 17 bp, Homo sapiens
agccttcccctccctgt

SEQ ID NO: 1830300 - DNA, 21 bp, Homo sapiens
agccttgccttttaaaagaaa

SEQ ID NO: 1830301 - DNA, 14 bp, Homo sapiens
agccttgtgccctg

SEQ ID NO: 1830302 - DNA, 19 bp, Homo sapiens
agccttgtgccctgccccc

SEQ ID NO: 1830303 - DNA, 21 bp, Homo sapiens
agccttgtgccctgcccccat

SEQ ID NO: 1830304 - DNA, 16 bp, Homo sapiens
agcgagcaagccggca

SEQ ID NO: 1830305 - DNA, 18 bp, Homo sapiens
agcgagcaagccggcaag

SEQ ID NO: 1830306 - DNA, 22 bp, Homo sapiens
agcggaaaaggttttattttgt

SEQ ID NO: 1830307 - DNA, 11 bp, Homo sapiens
agcgggcagcc

SEQ ID NO: 1830308 - DNA, 23 bp, Homo sapiens
agcgtttagtttctagaggcctc

SEQ ID NO: 1830309 - DNA, 17 bp, Homo sapiens
agctaagtcttgtctca

SEQ ID NO: 1830310 - DNA, 19 bp, Homo sapiens
agctaattctttgacctgt

SEQ ID NO: 1830311 - DNA, 23 bp, Homo sapiens
agctactctgtccaggccactgt

SEQ ID NO: 1830312 - DNA, 17 bp, Homo sapiens
agctagactggagtgag

SEQ ID NO: 1830313 - DNA, 14 bp, Homo sapiens
agctagcttgaaaa

SEQ ID NO: 1830314 - DNA, 15 bp, Homo sapiens
agctattagcaactg

SEQ ID NO: 1830315 - DNA, 18 bp, Homo sapiens
agctattagcaactgtgc

SEQ ID NO: 1830316 - DNA, 19 bp, Homo sapiens
agctcactggtttacaaat

SEQ ID NO: 1830317 - DNA, 20 bp, Homo sapiens
agctcactggtttacaaata

SEQ ID NO: 1830318 - DNA, 23 bp, Homo sapiens
agctcactggtttacaaatatag

SEQ ID NO: 1830319 - DNA, 22 bp, Homo sapiens
agctccacggtgcgtggctgtg

SEQ ID NO: 1830320 - DNA, 20 bp, Homo sapiens
agctcctctccttgggctcc

SEQ ID NO: 1830321 - DNA, 21 bp, Homo sapiens
agctcctctccttgggctcct

SEQ ID NO: 1830322 - DNA, 22 bp, Homo sapiens
agctcctctccttgggctcctg

SEQ ID NO: 1830323 - DNA, 24 bp, Homo sapiens
agctcctctccttgggctcctggc

SEQ ID NO: 1830324 - DNA, 20 bp, Homo sapiens
agctcctcttaccgtagcct

SEQ ID NO: 1830325 - DNA, 17 bp, Homo sapiens
agctccttttgtcccca

SEQ ID NO: 1830326 - DNA, 18 bp, Homo sapiens
agctccttttgtccccag

SEQ ID NO: 1830327 - DNA, 13 bp, Homo sapiens
agctctgtggcct

SEQ ID NO: 1830328 - DNA, 14 bp, Homo sapiens
agctctgtggcctg

SEQ ID NO: 1830329 - DNA, 16 bp, Homo sapiens
agctctgtggcctgtg

SEQ ID NO: 1830330 - DNA, 20 bp, Homo sapiens
agctctgtggcctgtgtcca

SEQ ID NO: 1830331 - DNA, 21 bp, Homo sapiens
agctgaaacattccgaagagg

SEQ ID NO: 1830332 - DNA, 16 bp, Homo sapiens
agctgaacaatgaatg

SEQ ID NO: 1830333 - DNA, 13 bp, Homo sapiens
agctgacagtcct

SEQ ID NO: 1830334 - DNA, 16 bp, Homo sapiens
agctgacagtcctctc

SEQ ID NO: 1830335 - DNA, 14 bp, Homo sapiens
agctgagcaggtgt

SEQ ID NO: 1830336 - DNA, 17 bp, Homo sapiens
agctgatttccaggccc

SEQ ID NO: 1830337 - DNA, 21 bp, Homo sapiens
agctgatttccaggcccctga

SEQ ID NO: 1830338 - DNA, 14 bp, Homo sapiens
agctgcagctgggc

SEQ ID NO: 1830339 - DNA, 15 bp, Homo sapiens
agctgcagctgggcc

SEQ ID NO: 1830340 - DNA, 22 bp, Homo sapiens
agctgcagctgggccccatgct

SEQ ID NO: 1830341 - DNA, 18 bp, Homo sapiens
agctgccttcctcatccc

SEQ ID NO: 1830342 - DNA, 19 bp, Homo sapiens
agctgccttcctcatcccc

SEQ ID NO: 1830343 - DNA, 14 bp, Homo sapiens
agctgcgggtctga

SEQ ID NO: 1830344 - DNA, 12 bp, Homo sapiens
agctgctctgcc

SEQ ID NO: 1830345 - DNA, 21 bp, Homo sapiens
agctgctttcgaataaagtga

SEQ ID NO: 1830346 - DNA, 14 bp, Homo sapiens
agctggaacacaat

SEQ ID NO: 1830347 - DNA, 16 bp, Homo sapiens
agctggaaggcagggc

SEQ ID NO: 1830348 - DNA, 20 bp, Homo sapiens
agctggacaagaagctgcta

SEQ ID NO: 1830349 - DNA, 11 bp, Homo sapiens
agctggcagga

SEQ ID NO: 1830350 - DNA, 19 bp, Homo sapiens
agctggcaggacacatccc

SEQ ID NO: 1830351 - DNA, 18 bp, Homo sapiens
agctgggaagctgtactc

SEQ ID NO: 1830352 - DNA, 16 bp, Homo sapiens
agctgggccccatgct

SEQ ID NO: 1830353 - DNA, 19 bp, Homo sapiens
agctgggccccatgctctg

SEQ ID NO: 1830354 - DNA, 15 bp, Homo sapiens
agctggggatgtctc

SEQ ID NO: 1830355 - DNA, 19 bp, Homo sapiens
agctgtactcagagcagag

SEQ ID NO: 1830356 - DNA, 20 bp, Homo sapiens
agctgtactcagagcagagc

SEQ ID NO: 1830357 - DNA, 16 bp, Homo sapiens
agctgtagccatggct

SEQ ID NO: 1830358 - DNA, 22 bp, Homo sapiens
agctgtgccaccctgggctctg

SEQ ID NO: 1830359 - DNA, 15 bp, Homo sapiens
agcttagccttgtgc

SEQ ID NO: 1830360 - DNA, 16 bp, Homo sapiens
agcttagccttgtgcc

SEQ ID NO: 1830361 - DNA, 20 bp, Homo sapiens
agcttagccttgtgccctgc

SEQ ID NO: 1830362 - DNA, 21 bp, Homo sapiens
agcttagccttgtgccctgcc

SEQ ID NO: 1830363 - DNA, 20 bp, Homo sapiens
agcttatgggatccttgtct

SEQ ID NO: 1830364 - DNA, 17 bp, Homo sapiens
aggccctgcactgtcct

SEQ ID NO: 1830365 - DNA, 18 bp, Homo sapiens
aggcccttgtcctgccag

SEQ ID NO: 1830366 - DNA, 20 bp, Homo sapiens
aggcccttgtcctgccagct

SEQ ID NO: 1830367 - DNA, 13 bp, Homo sapiens
aggccgttcccct

SEQ ID NO: 1830368 - DNA, 18 bp, Homo sapiens
aggccgttccccttggct

SEQ ID NO: 1830369 - DNA, 14 bp, Homo sapiens
aggcctcatccctc

SEQ ID NO: 1830370 - DNA, 15 bp, Homo sapiens
aggcctccagcctct

SEQ ID NO: 1830371 - DNA, 16 bp, Homo sapiens
aggcctccagcctctc

SEQ ID NO: 1830372 - DNA, 18 bp, Homo sapiens
aggcctccagcctctccc

SEQ ID NO: 1830373 - DNA, 21 bp, Homo sapiens
aggcctccagcctctcccggc

SEQ ID NO: 1830374 - DNA, 12 bp, Homo sapiens
aggcctcccaca

SEQ ID NO: 1830375 - DNA, 13 bp, Homo sapiens
aggcctcccacag

SEQ ID NO: 1830376 - DNA, 15 bp, Homo sapiens
aggcctcccacagtg

SEQ ID NO: 1830377 - DNA, 15 bp, Homo sapiens
aggcctgatgctgcc

SEQ ID NO: 1830378 - DNA, 16 bp, Homo sapiens
aggcctgatgctgccc

SEQ ID NO: 1830379 - DNA, 17 bp, Homo sapiens
aggcctggaaccaggga

SEQ ID NO: 1830380 - DNA, 16 bp, Homo sapiens
aggcctgggacccagc

SEQ ID NO: 1830381 - DNA, 19 bp, Homo sapiens
aggcctgggacccagctac

SEQ ID NO: 1830382 - DNA, 14 bp, Homo sapiens
aggccttgagcaca

SEQ ID NO: 1830383 - DNA, 15 bp, Homo sapiens
aggccttgagcacaa

SEQ ID NO: 1830384 - DNA, 21 bp, Homo sapiens
aggctaagttcagttctgttt

SEQ ID NO: 1830385 - DNA, 16 bp, Homo sapiens
aggctctcccctctcg

SEQ ID NO: 1830386 - DNA, 23 bp, Homo sapiens
aggctctgggctcagggctggag

SEQ ID NO: 1830387 - DNA, 16 bp, Homo sapiens
aggctcttcctggacc

SEQ ID NO: 1830388 - DNA, 17 bp, Homo sapiens
aggctcttcctggacct

SEQ ID NO: 1830389 - DNA, 18 bp, Homo sapiens
aggctcttcctggacctg

SEQ ID NO: 1830390 - DNA, 19 bp, Homo sapiens
aggctcttcctggacctga

SEQ ID NO: 1830391 - DNA, 22 bp, Homo sapiens
aggctcttcctggacctgagtc

SEQ ID NO: 1830392 - DNA, 14 bp, Homo sapiens
aggctggccagccc

SEQ ID NO: 1830393 - DNA, 15 bp, Homo sapiens
aggctggccagcccc

SEQ ID NO: 1830394 - DNA, 13 bp, Homo sapiens
aggctggtcttga

SEQ ID NO: 1830395 - DNA, 16 bp, Homo sapiens
aggcttccaggctctt

SEQ ID NO: 1830396 - DNA, 12 bp, Homo sapiens
aggcttctccac

SEQ ID NO: 1830397 - DNA, 22 bp, Homo sapiens
aggctttggggtcctagcccag

SEQ ID NO: 1830398 - DNA, 12 bp, Homo sapiens
agtatcttcaaa

SEQ ID NO: 1830399 - DNA, 14 bp, Homo sapiens
agtatcttcaaaaa

SEQ ID NO: 1830400 - DNA, 17 bp, Homo sapiens
agtatcttcaaaaatac

SEQ ID NO: 1830401 - DNA, 17 bp, Homo sapiens
agtatgtggaagtgtgg

SEQ ID NO: 1830402 - DNA, 16 bp, Homo sapiens
agtattaaaatgcata

SEQ ID NO: 1830403 - DNA, 20 bp, Homo sapiens
agtattaaaatgcatatttc

SEQ ID NO: 1830404 - DNA, 18 bp, Homo sapiens
agtattcaggcactgaga

SEQ ID NO: 1830405 - DNA, 12 bp, Homo sapiens
agtcaactggct

SEQ ID NO: 1830406 - DNA, 20 bp, Homo sapiens
agtcaatattgattttaaat

SEQ ID NO: 1830407 - DNA, 14 bp, Homo sapiens
agtcacaaaataaa

SEQ ID NO: 1830408 - DNA, 12 bp, Homo sapiens
agtcacagctgc

SEQ ID NO: 1830409 - DNA, 19 bp, Homo sapiens
agtcacagctgcagctggg

SEQ ID NO: 1830410 - DNA, 16 bp, Homo sapiens
agtcacctgcaagccc

SEQ ID NO: 1830411 - DNA, 19 bp, Homo sapiens
agtcacctgcaagccccag

SEQ ID NO: 1830412 - DNA, 20 bp, Homo sapiens
agtcacctgcaagccccagg

SEQ ID NO: 1830413 - DNA, 22 bp, Homo sapiens
agtcacctgcaagccccagggc

SEQ ID NO: 1830414 - DNA, 13 bp, Homo sapiens
agtcagtaaacat

SEQ ID NO: 1830415 - DNA, 20 bp, Homo sapiens
agtcagtaaacatttgtaaa

SEQ ID NO: 1830416 - DNA, 17 bp, Homo sapiens
agtcagttcccggagca

SEQ ID NO: 1830417 - DNA, 20 bp, Homo sapiens
agtcagttcccggagcacag

SEQ ID NO: 1830418 - DNA, 22 bp, Homo sapiens
agtcagttcccggagcacagcc

SEQ ID NO: 1830419 - DNA, 20 bp, Homo sapiens
agtcatgactagtgcctaga

SEQ ID NO: 1830420 - DNA, 13 bp, Homo sapiens
agtccccagccct

SEQ ID NO: 1830421 - DNA, 18 bp, Homo sapiens
agtccccagcccttctgc

SEQ ID NO: 1830422 - DNA, 20 bp, Homo sapiens
agtccccagcccttctgcct

SEQ ID NO: 1830423 - DNA, 13 bp, Homo sapiens
agtcctcacagcc

SEQ ID NO: 1830424 - DNA, 14 bp, Homo sapiens
agtcctcacagcct

SEQ ID NO: 1830425 - DNA, 21 bp, Homo sapiens
agtcctcacagcctctccctt

SEQ ID NO: 1830426 - DNA, 21 bp, Homo sapiens
agtcctctccacctagtggct

SEQ ID NO: 1830427 - DNA, 13 bp, Homo sapiens
agtccttcagtga

SEQ ID NO: 1830428 - DNA, 19 bp, Homo sapiens
agtccttcagtgagcccct

SEQ ID NO: 1830429 - DNA, 14 bp, Homo sapiens
agtctaaacaatga

SEQ ID NO: 1830430 - DNA, 19 bp, Homo sapiens
agtctatcaacattgaata

SEQ ID NO: 1830431 - DNA, 15 bp, Homo sapiens
agtctgagcccccgg

SEQ ID NO: 1830432 - DNA, 16 bp, Homo sapiens
agtctgtttgaaatgc

SEQ ID NO: 1830433 - DNA, 17 bp, Homo sapiens
agtgaatacattttgca

SEQ ID NO: 1830434 - DNA, 20 bp, Homo sapiens
agtgactcgggctcctgtgc

SEQ ID NO: 1830435 - DNA, 15 bp, Homo sapiens
agtgactggcaggtg

SEQ ID NO: 1830436 - DNA, 17 bp, Homo sapiens
agtgactggcaggtgca

SEQ ID NO: 1830437 - DNA, 18 bp, Homo sapiens
agtgagcccctccccagc

SEQ ID NO: 1830438 - DNA, 14 bp, Homo sapiens
agtgaggcttccag

SEQ ID NO: 1830439 - DNA, 19 bp, Homo sapiens
agtgaggcttccaggctct

SEQ ID NO: 1830440 - DNA, 14 bp, Homo sapiens
agtgatctttcaat

SEQ ID NO: 1830441 - DNA, 21 bp, Homo sapiens
agtgatggcgcgggaggcacc

SEQ ID NO: 1830442 - DNA, 22 bp, Homo sapiens
agtgcagtggtgcgatcttggc

SEQ ID NO: 1830443 - DNA, 18 bp, Homo sapiens
agtgccaggatggaatga

SEQ ID NO: 1830444 - DNA, 13 bp, Homo sapiens
agtgcccattcct

SEQ ID NO: 1830445 - DNA, 19 bp, Homo sapiens
agtgcccgcctaggagttg

SEQ ID NO: 1830446 - DNA, 20 bp, Homo sapiens
agtgcccgcctaggagttga

SEQ ID NO: 1830447 - DNA, 17 bp, Homo sapiens
agtgccgccgcctcgcc

SEQ ID NO: 1830448 - DNA, 19 bp, Homo sapiens
agtgccgccgcctcgccca

SEQ ID NO: 1830449 - DNA, 20 bp, Homo sapiens
agtgccgccgcctcgcccac

SEQ ID NO: 1830450 - DNA, 23 bp, Homo sapiens
agtgccgccgcctcgcccaccgc

SEQ ID NO: 1830451 - DNA, 16 bp, Homo sapiens
agtgcctagaaagcaa

SEQ ID NO: 1830452 - DNA, 13 bp, Homo sapiens
agtgcctcgaggc

SEQ ID NO: 1830453 - DNA, 15 bp, Homo sapiens
agtgcctcgaggcac

SEQ ID NO: 1830454 - DNA, 13 bp, Homo sapiens
agtgcctttgtag

SEQ ID NO: 1830455 - DNA, 18 bp, Homo sapiens
agtgcgctcttggtccct

SEQ ID NO: 1830456 - DNA, 20 bp, Homo sapiens
agtgcgctcttggtccctgg

SEQ ID NO: 1830457 - DNA, 14 bp, Homo sapiens
agtgctgccatgcc

SEQ ID NO: 1830458 - DNA, 16 bp, Homo sapiens
agtgctgccatgccac

SEQ ID NO: 1830459 - DNA, 17 bp, Homo sapiens
agtgctgccatgccact

SEQ ID NO: 1830460 - DNA, 18 bp, Homo sapiens
agtgctgtacccttccac

SEQ ID NO: 1830461 - DNA, 19 bp, Homo sapiens
agtgcttctccaacactga

SEQ ID NO: 1830462 - DNA, 13 bp, Homo sapiens
agtggaagagcag

SEQ ID NO: 1830463 - DNA, 24 bp, Homo sapiens
agtggaagagcagcctgatggcca

SEQ ID NO: 1830464 - DNA, 15 bp, Homo sapiens
agtggaatgcaggga

SEQ ID NO: 1830465 - DNA, 19 bp, Homo sapiens
agtggaatgcagggaagag

SEQ ID NO: 1830466 - DNA, 20 bp, Homo sapiens
agtggaatgcagggaagagg

SEQ ID NO: 1830467 - DNA, 13 bp, Homo sapiens
agtggcagccatg

SEQ ID NO: 1830468 - DNA, 18 bp, Homo sapiens
agtggcattggcagcagg

SEQ ID NO: 1830469 - DNA, 20 bp, Homo sapiens
agtggcattggcagcaggtg

SEQ ID NO: 1830470 - DNA, 17 bp, Homo sapiens
agtggggctaaatgaag

SEQ ID NO: 1830471 - DNA, 18 bp, Homo sapiens
agtggggctaaatgaagt

SEQ ID NO: 1830472 - DNA, 15 bp, Homo sapiens
agtgggtggcacctc

SEQ ID NO: 1830473 - DNA, 17 bp, Homo sapiens
agtgtaaagaataaatg

SEQ ID NO: 1830474 - DNA, 23 bp, Homo sapiens
agtgtacccccgcccaggctggc

SEQ ID NO: 1830475 - DNA, 13 bp, Homo sapiens
agtgtattatttc

SEQ ID NO: 1830476 - DNA, 14 bp, Homo sapiens
agtgtctgggctga

SEQ ID NO: 1830477 - DNA, 14 bp, Homo sapiens
agtgtgagtggcag

SEQ ID NO: 1830478 - DNA, 19 bp, Homo sapiens
agtgtgagtggcagccatg

SEQ ID NO: 1830479 - DNA, 22 bp, Homo sapiens
agtgtgagtggcagccatgcct

SEQ ID NO: 1830480 - DNA, 22 bp, Homo sapiens
agtgtgccccccatcctggccc

SEQ ID NO: 1830481 - DNA, 15 bp, Homo sapiens
agtgtgggtctgtgt

SEQ ID NO: 1830482 - DNA, 12 bp, Homo sapiens
agtgtgtgcagc

SEQ ID NO: 1830483 - DNA, 15 bp, Homo sapiens
agtgttaggcctggc

SEQ ID NO: 1830484 - DNA, 17 bp, Homo sapiens
agtgttaggcctggcac

SEQ ID NO: 1830485 - DNA, 14 bp, Homo sapiens
agttaaactgatta

SEQ ID NO: 1830486 - DNA, 12 bp, Homo sapiens
agttaaagtcaa

SEQ ID NO: 1830487 - DNA, 13 bp, Homo sapiens
agttatacatctt

SEQ ID NO: 1830488 - DNA, 15 bp, Homo sapiens
agttatacatcttca

SEQ ID NO: 1830489 - DNA, 23 bp, Homo sapiens
agttatggtttcctcattttact

SEQ ID NO: 1830490 - DNA, 22 bp, Homo sapiens
agttcccggagcacagccctgg

SEQ ID NO: 1830491 - DNA, 17 bp, Homo sapiens
agttctagttgattgcg

SEQ ID NO: 1830492 - DNA, 18 bp, Homo sapiens
agttctagttgattgcga

SEQ ID NO: 1830493 - DNA, 12 bp, Homo sapiens
agttctgatgag

SEQ ID NO: 1830494 - DNA, 21 bp, Homo sapiens
agttcttgggggaggccaccc

SEQ ID NO: 1830495 - DNA, 20 bp, Homo sapiens
agttctttgctgcccctgtc

SEQ ID NO: 1830496 - DNA, 19 bp, Homo sapiens
agttgattgcgagaatttt

SEQ ID NO: 1830497 - DNA, 14 bp, Homo sapiens
agttggcagagaag

SEQ ID NO: 1830498 - DNA, 23 bp, Homo sapiens
agttggtgaaacccagatcgctg

SEQ ID NO: 1830499 - DNA, 20 bp, Homo sapiens
agttgtatcagcacgtgtgg

SEQ ID NO: 1830500 - DNA, 15 bp, Homo sapiens
agtttagaacagagg

SEQ ID NO: 1830501 - DNA, 22 bp, Homo sapiens
agtttcacaacagatttctaag

SEQ ID NO: 1830502 - DNA, 23 bp, Homo sapiens
agtttcacaacagatttctaagt

SEQ ID NO: 1830503 - DNA, 22 bp, Homo sapiens
agtttccaaagggcagtaaagt

SEQ ID NO: 1830504 - DNA, 19 bp, Homo sapiens
agtttccagctaagcctga

SEQ ID NO: 1830505 - DNA, 20 bp, Homo sapiens
agtttcgaggggtcctcacc

SEQ ID NO: 1830506 - DNA, 18 bp, Homo sapiens
agtttctagaggcctcag

SEQ ID NO: 1830507 - DNA, 14 bp, Homo sapiens
agtttctttcagat

SEQ ID NO: 1830508 - DNA, 19 bp, Homo sapiens
agtttctttcagatcattt

SEQ ID NO: 1830509 - DNA, 19 bp, Homo sapiens
agtttgatttaatatctga

SEQ ID NO: 1830510 - DNA, 19 bp, Homo sapiens
agtttgtggtaaaaagatt

SEQ ID NO: 1830511 - DNA, 13 bp, Homo sapiens
agtttttcagaaa

SEQ ID NO: 1830512 - DNA, 18 bp, Homo sapiens
agtttttcagaaagtttg

SEQ ID NO: 1830513 - DNA, 11 bp, Homo sapiens
ataaaaaatgg

SEQ ID NO: 1830514 - DNA, 17 bp, Homo sapiens
ataaaaacaacaaatac

SEQ ID NO: 1830515 - DNA, 15 bp, Homo sapiens
ataaaaataccttaa

SEQ ID NO: 1830516 - DNA, 18 bp, Homo sapiens
ataaacctctaatttatt

SEQ ID NO: 1830517 - DNA, 22 bp, Homo sapiens
atctttgggacacctcagaaaa

SEQ ID NO: 1830518 - DNA, 21 bp, Homo sapiens
atgaaaaatagtgtgtccatg

SEQ ID NO: 1830519 - DNA, 14 bp, Homo sapiens
atgaaaacaaaatt

SEQ ID NO: 1830520 - DNA, 19 bp, Homo sapiens
atgaaaaccaccctatcat

SEQ ID NO: 1830521 - DNA, 15 bp, Homo sapiens
atgaacttgaggaca

SEQ ID NO: 1830522 - DNA, 20 bp, Homo sapiens
atgaagaaagggaggcccag

SEQ ID NO: 1830523 - DNA, 22 bp, Homo sapiens
atgaagaaagggaggcccagcc

SEQ ID NO: 1830524 - DNA, 22 bp, Homo sapiens
atgaagacccagtgtaaagaat

SEQ ID NO: 1830525 - DNA, 20 bp, Homo sapiens
atgaatacgtaaactgcgta

SEQ ID NO: 1830526 - DNA, 13 bp, Homo sapiens
atgaattcttcaa

SEQ ID NO: 1830527 - DNA, 14 bp, Homo sapiens
atgaccagaaacag

SEQ ID NO: 1830528 - DNA, 19 bp, Homo sapiens
atgaccagaaacagggaca

SEQ ID NO: 1830529 - DNA, 22 bp, Homo sapiens
atgactggatacagaatgaatc

SEQ ID NO: 1830530 - DNA, 17 bp, Homo sapiens
atgagaaatacagaaga

SEQ ID NO: 1830531 - DNA, 18 bp, Homo sapiens
atgagaaatacagaagaa

SEQ ID NO: 1830532 - DNA, 21 bp, Homo sapiens
atgagaacaagtcacagctgc

SEQ ID NO: 1830533 - DNA, 17 bp, Homo sapiens
atgagatggccatgctc

SEQ ID NO: 1830534 - DNA, 18 bp, Homo sapiens
atgagtcacaaaataaag

SEQ ID NO: 1830535 - DNA, 14 bp, Homo sapiens
atgagtgtgccaga

SEQ ID NO: 1830536 - DNA, 13 bp, Homo sapiens
atgatactgatgc

SEQ ID NO: 1830537 - DNA, 19 bp, Homo sapiens
atgatagtaataggataca

SEQ ID NO: 1830538 - DNA, 22 bp, Homo sapiens
atgatgccacaccaagctgtgc

SEQ ID NO: 1830539 - DNA, 22 bp, Homo sapiens
atgatggaagggccttctccac

SEQ ID NO: 1830540 - DNA, 14 bp, Homo sapiens
atgattttcttttg

SEQ ID NO: 1830541 - DNA, 23 bp, Homo sapiens
atgcaatgaaaacaaaattccat

SEQ ID NO: 1830542 - DNA, 22 bp, Homo sapiens
atgcaattcaatgcaatgaaaa

SEQ ID NO: 1830543 - DNA, 17 bp, Homo sapiens
atgcacatcctcattca

SEQ ID NO: 1830544 - DNA, 18 bp, Homo sapiens
atgcacatcctcattcac

SEQ ID NO: 1830545 - DNA, 17 bp, Homo sapiens
atgcagattcctgggcc

SEQ ID NO: 1830546 - DNA, 20 bp, Homo sapiens
atgcagattcctgggcctgt

SEQ ID NO: 1830547 - DNA, 17 bp, Homo sapiens
atgcagggaagagggca

SEQ ID NO: 1830548 - DNA, 18 bp, Homo sapiens
atgcagggaagagggcag

SEQ ID NO: 1830549 - DNA, 20 bp, Homo sapiens
atgccacaccaagctgtgcc

SEQ ID NO: 1830550 - DNA, 19 bp, Homo sapiens
atgccactgccaggcacct

SEQ ID NO: 1830551 - DNA, 17 bp, Homo sapiens
atgccaggttaggaagg

SEQ ID NO: 1830552 - DNA, 21 bp, Homo sapiens
atgccaggttaggaaggcagc

SEQ ID NO: 1830553 - DNA, 22 bp, Homo sapiens
atgccaggttaggaaggcagca

SEQ ID NO: 1830554 - DNA, 14 bp, Homo sapiens
atgccatgcccagg

SEQ ID NO: 1830555 - DNA, 21 bp, Homo sapiens
atgcctggcccccctccaggc

SEQ ID NO: 1830556 - DNA, 18 bp, Homo sapiens
atgctatctcgctagcca

SEQ ID NO: 1830557 - DNA, 19 bp, Homo sapiens
atgctatctcgctagccat

SEQ ID NO: 1830558 - DNA, 22 bp, Homo sapiens
atgctcaacccccctcccagac

SEQ ID NO: 1830559 - DNA, 23 bp, Homo sapiens
atgctcaacccccctcccagaca

SEQ ID NO: 1830560 - DNA, 17 bp, Homo sapiens
atgctcacttttgtgaa

SEQ ID NO: 1830561 - DNA, 23 bp, Homo sapiens
atgctggcctcccaataaagctg

SEQ ID NO: 1830562 - DNA, 14 bp, Homo sapiens
atgctttctccttt

SEQ ID NO: 1830563 - DNA, 16 bp, Homo sapiens
atgctttgggaggcca

SEQ ID NO: 1830564 - DNA, 19 bp, Homo sapiens
atgctttgggaggccaagg

SEQ ID NO: 1830565 - DNA, 20 bp, Homo sapiens
atgctttgggaggccaaggc

SEQ ID NO: 1830566 - DNA, 21 bp, Homo sapiens
atggaatgatgggtcagttgt

SEQ ID NO: 1830567 - DNA, 18 bp, Homo sapiens
atggaccgggtgggcctg

SEQ ID NO: 1830568 - DNA, 18 bp, Homo sapiens
atggattcccctggacat

SEQ ID NO: 1830569 - DNA, 18 bp, Homo sapiens
atggcaccagccccctgg

SEQ ID NO: 1830570 - DNA, 19 bp, Homo sapiens
atggcaccagccccctgga

SEQ ID NO: 1830571 - DNA, 20 bp, Homo sapiens
atggcaccagccccctggat

SEQ ID NO: 1830572 - DNA, 23 bp, Homo sapiens
atggcatttagtaccttcaaata

SEQ ID NO: 1830573 - DNA, 13 bp, Homo sapiens
atggccaagagca

SEQ ID NO: 1830574 - DNA, 15 bp, Homo sapiens
atggccaagagcatc

SEQ ID NO: 1830575 - DNA, 13 bp, Homo sapiens
atggccatgctca

SEQ ID NO: 1830576 - DNA, 17 bp, Homo sapiens
atggcgcgggaggcacc

SEQ ID NO: 1830577 - DNA, 18 bp, Homo sapiens
atggcgcgggaggcacca

SEQ ID NO: 1830578 - DNA, 18 bp, Homo sapiens
atggcgtaatgggcctgc

SEQ ID NO: 1830579 - DNA, 18 bp, Homo sapiens
atggctctcaagtgaaag

SEQ ID NO: 1830580 - DNA, 19 bp, Homo sapiens
atggcttatttgtataatg

SEQ ID NO: 1830581 - DNA, 16 bp, Homo sapiens
atggcttccaaggtgg

SEQ ID NO: 1830582 - DNA, 23 bp, Homo sapiens
atgggaacctagtactctctgct

SEQ ID NO: 1830583 - DNA, 16 bp, Homo sapiens
atgggagatggtcagt

SEQ ID NO: 1830584 - DNA, 23 bp, Homo sapiens
atgggcactgctgggtggcccat

SEQ ID NO: 1830585 - DNA, 14 bp, Homo sapiens
atgggcattgggct

SEQ ID NO: 1830586 - DNA, 13 bp, Homo sapiens
atgggcctgggcc

SEQ ID NO: 1830587 - DNA, 16 bp, Homo sapiens
atgggcctgggcctgc

SEQ ID NO: 1830588 - DNA, 12 bp, Homo sapiens
atgggccttgct

SEQ ID NO: 1830589 - DNA, 15 bp, Homo sapiens
atgggccttgctttg

SEQ ID NO: 1830590 - DNA, 21 bp, Homo sapiens
atgggctagtgtgagtggcag

SEQ ID NO: 1830591 - DNA, 20 bp, Homo sapiens
atggtcaggatctcatgaca

SEQ ID NO: 1830592 - DNA, 20 bp, Homo sapiens
atggtcagtgtggagagggg

SEQ ID NO: 1830593 - DNA, 14 bp, Homo sapiens
atggtgagctggga

SEQ ID NO: 1830594 - DNA, 20 bp, Homo sapiens
atggttccttccctgggaag

SEQ ID NO: 1830595 - DNA, 21 bp, Homo sapiens
atggtttcctcattttactaa

SEQ ID NO: 1830596 - DNA, 20 bp, Homo sapiens
atgtaaaaatgaaggaatta

SEQ ID NO: 1830597 - DNA, 17 bp, Homo sapiens
atgtaagtttgcatatc

SEQ ID NO: 1830598 - DNA, 13 bp, Homo sapiens
atgtaatactgaa

SEQ ID NO: 1830599 - DNA, 18 bp, Homo sapiens
atgtaatactgtagaaat

SEQ ID NO: 1830600 - DNA, 23 bp, Homo sapiens
atgtacctatgtgagtttcagaa

SEQ ID NO: 1830601 - DNA, 18 bp, Homo sapiens
atgtagaataaatgaaga

SEQ ID NO: 1830602 - DNA, 13 bp, Homo sapiens
atgtatatctata

SEQ ID NO: 1830603 - DNA, 20 bp, Homo sapiens
atgtatatctatatctctaa

SEQ ID NO: 1830604 - DNA, 21 bp, Homo sapiens
atgtcaataactttatatgaa

SEQ ID NO: 1830605 - DNA, 13 bp, Homo sapiens
atgtcagaaactc

SEQ ID NO: 1830606 - DNA, 16 bp, Homo sapiens
atgtcagtatgtggaa

SEQ ID NO: 1830607 - DNA, 16 bp, Homo sapiens
atgtgacaacattttt

SEQ ID NO: 1830608 - DNA, 17 bp, Homo sapiens
atgtgagtttcagaaat

SEQ ID NO: 1830609 - DNA, 13 bp, Homo sapiens
atgtggaagtgtg

SEQ ID NO: 1830610 - DNA, 22 bp, Homo sapiens
atgtggaagtgtgggtctgtgt

SEQ ID NO: 1830611 - DNA, 18 bp, Homo sapiens
atttgtaaatttatgtga

SEQ ID NO: 1830612 - DNA, 18 bp, Homo sapiens
atttgtaagcaacttgct

SEQ ID NO: 1830613 - DNA, 22 bp, Homo sapiens
atttgtggggagggatttgggg

SEQ ID NO: 1830614 - DNA, 15 bp, Homo sapiens
attttaagttctatc

SEQ ID NO: 1830615 - DNA, 21 bp, Homo sapiens
attttacagtatcttcaaaaa

SEQ ID NO: 1830616 - DNA, 18 bp, Homo sapiens
attttactgacagaaatg

SEQ ID NO: 1830617 - DNA, 17 bp, Homo sapiens
attttcccactgcaccc

SEQ ID NO: 1830618 - DNA, 14 bp, Homo sapiens
attttcctgtgtaa

SEQ ID NO: 1830619 - DNA, 18 bp, Homo sapiens
attttctgagtagcatat

SEQ ID NO: 1830620 - DNA, 14 bp, Homo sapiens
attttcttatgtaa

SEQ ID NO: 1830621 - DNA, 15 bp, Homo sapiens
attttcttatgtaag

SEQ ID NO: 1830622 - DNA, 16 bp, Homo sapiens
attttcttatgtaagt

SEQ ID NO: 1830623 - DNA, 23 bp, Homo sapiens
attttcttatgtaagtttgcata

SEQ ID NO: 1830624 - DNA, 12 bp, Homo sapiens
caaggcagcctc

SEQ ID NO: 1830625 - DNA, 13 bp, Homo sapiens
caaggcagcctcc

SEQ ID NO: 1830626 - DNA, 15 bp, Homo sapiens
caaggcagcctccag

SEQ ID NO: 1830627 - DNA, 18 bp, Homo sapiens
caaggcagcctccagagc

SEQ ID NO: 1830628 - DNA, 22 bp, Homo sapiens
caaggcagcctccagagccagc

SEQ ID NO: 1830629 - DNA, 24 bp, Homo sapiens
caaggcagcctccagagccagcct

SEQ ID NO: 1830630 - DNA, 16 bp, Homo sapiens
caaggcctccagccac

SEQ ID NO: 1830631 - DNA, 15 bp, Homo sapiens
caaggcctcccacag

SEQ ID NO: 1830632 - DNA, 15 bp, Homo sapiens
caagggcatcaggca

SEQ ID NO: 1830633 - DNA, 17 bp, Homo sapiens
caagggcatcaggcact

SEQ ID NO: 1830634 - DNA, 16 bp, Homo sapiens
caccatggtgtgtcat

SEQ ID NO: 1830635 - DNA, 18 bp, Homo sapiens
cacccactcaccagggtc

SEQ ID NO: 1830636 - DNA, 23 bp, Homo sapiens
cagctactctgtccaggccactg

SEQ ID NO: 1830637 - DNA, 13 bp, Homo sapiens
cagctagactgga

SEQ ID NO: 1830638 - DNA, 15 bp, Homo sapiens
cagctagactggagt

SEQ ID NO: 1830639 - DNA, 12 bp, Homo sapiens
cagctaggactg

SEQ ID NO: 1830640 - DNA, 20 bp, Homo sapiens
cagctaggactgaggagtgg

SEQ ID NO: 1830641 - DNA, 17 bp, Homo sapiens
cagctcctctccttggg

SEQ ID NO: 1830642 - DNA, 19 bp, Homo sapiens
cagctcctctccttgggct

SEQ ID NO: 1830643 - DNA, 22 bp, Homo sapiens
cagctcctctccttgggctcct

SEQ ID NO: 1830644 - DNA, 20 bp, Homo sapiens
cagctccttttgtccccagg

SEQ ID NO: 1830645 - DNA, 20 bp, Homo sapiens
cagctctgtggcctgtgtcc

SEQ ID NO: 1830646 - DNA, 23 bp, Homo sapiens
cagctctgtggcctgtgtccagc

SEQ ID NO: 1830647 - DNA, 24 bp, Homo sapiens
cagctctgtggcctgtgtccagca

SEQ ID NO: 1830648 - DNA, 14 bp, Homo sapiens
cagctgacagtcct

SEQ ID NO: 1830649 - DNA, 21 bp, Homo sapiens
cagctgggccccatgctctgc

SEQ ID NO: 1830650 - DNA, 16 bp, Homo sapiens
cagctgtagccatggc

SEQ ID NO: 1830651 - DNA, 18 bp, Homo sapiens
cagctgtagccatggctc

SEQ ID NO: 1830652 - DNA, 22 bp, Homo sapiens
cagctgtagccatggctcaggc

SEQ ID NO: 1830653 - DNA, 17 bp, Homo sapiens
cagcttcctgagggcta

SEQ ID NO: 1830654 - DNA, 19 bp, Homo sapiens
cagcttctgccacttccca

SEQ ID NO: 1830655 - DNA, 20 bp, Homo sapiens
cagcttctgccacttcccag

SEQ ID NO: 1830656 - DNA, 23 bp, Homo sapiens
cagcttctgccacttcccaggta

SEQ ID NO: 1830657 - DNA, 15 bp, Homo sapiens
cagcttctgctgggc

SEQ ID NO: 1830658 - DNA, 18 bp, Homo sapiens
cagcttctgctgggctgg

SEQ ID NO: 1830659 - DNA, 15 bp, Homo sapiens
cagcttttcccagga

SEQ ID NO: 1830660 - DNA, 18 bp, Homo sapiens
caggaaaagcctctgtgt

SEQ ID NO: 1830661 - DNA, 19 bp, Homo sapiens
caggaaaagcctctgtgtc

SEQ ID NO: 1830662 - DNA, 15 bp, Homo sapiens
caggaaaggaagatg

SEQ ID NO: 1830663 - DNA, 13 bp, Homo sapiens
caggaacgagcac

SEQ ID NO: 1830664 - DNA, 18 bp, Homo sapiens
caggaacgagcactggcc

SEQ ID NO: 1830665 - DNA, 21 bp, Homo sapiens
caggaacgagcactggccaga

SEQ ID NO: 1830666 - DNA, 12 bp, Homo sapiens
caggaaggcagc

SEQ ID NO: 1830667 - DNA, 15 bp, Homo sapiens
caggaaggcagctgc

SEQ ID NO: 1830668 - DNA, 21 bp, Homo sapiens
caggacacatcccggcctctt

SEQ ID NO: 1830669 - DNA, 22 bp, Homo sapiens
caggacacatcccggcctcttc

SEQ ID NO: 1830670 - DNA, 13 bp, Homo sapiens
caggacccaggcc

SEQ ID NO: 1830671 - DNA, 24 bp, Homo sapiens
caggacccaggccctccatgggct

SEQ ID NO: 1830672 - DNA, 16 bp, Homo sapiens
caggacggggccggcc

SEQ ID NO: 1830673 - DNA, 19 bp, Homo sapiens
caggacggggccggccagg

SEQ ID NO: 1830674 - DNA, 20 bp, Homo sapiens
caggacggggccggccaggt

SEQ ID NO: 1830675 - DNA, 24 bp, Homo sapiens
caggacggggccggccaggtgggc

SEQ ID NO: 1830676 - DNA, 19 bp, Homo sapiens
caggaggaggtgccaacag

SEQ ID NO: 1830677 - DNA, 15 bp, Homo sapiens
caggagtctgtgctc

SEQ ID NO: 1830678 - DNA, 16 bp, Homo sapiens
caggagtctgtgctct

SEQ ID NO: 1830679 - DNA, 22 bp, Homo sapiens
caggagtttgagacaagccctg

SEQ ID NO: 1830680 - DNA, 20 bp, Homo sapiens
caggcaaaacacgcaagggc

SEQ ID NO: 1830681 - DNA, 19 bp, Homo sapiens
caggcaagcccctcagccc

SEQ ID NO: 1830682 - DNA, 23 bp, Homo sapiens
caggcaagcccctcagcccttgc

SEQ ID NO: 1830683 - DNA, 14 bp, Homo sapiens
caggcacagcacag

SEQ ID NO: 1830684 - DNA, 16 bp, Homo sapiens
caggcacagcacaggg

SEQ ID NO: 1830685 - DNA, 15 bp, Homo sapiens
caggcacctggcctg

SEQ ID NO: 1830686 - DNA, 20 bp, Homo sapiens
caggcacctggcctgctggg

SEQ ID NO: 1830687 - DNA, 21 bp, Homo sapiens
caggcacctggcctgctggga

SEQ ID NO: 1830688 - DNA, 16 bp, Homo sapiens
caggcagccacgtctc

SEQ ID NO: 1830689 - DNA, 19 bp, Homo sapiens
caggcatgctggcctccca

SEQ ID NO: 1830690 - DNA, 13 bp, Homo sapiens
caggccatcttcc

SEQ ID NO: 1830691 - DNA, 19 bp, Homo sapiens
caggcccatctcaggtgcc

SEQ ID NO: 1830692 - DNA, 17 bp, Homo sapiens
caggccctccatgggct

SEQ ID NO: 1830693 - DNA, 16 bp, Homo sapiens
caggccctccctgtct

SEQ ID NO: 1830694 - DNA, 11 bp, Homo sapiens
caggccctgca

SEQ ID NO: 1830695 - DNA, 20 bp, Homo sapiens
caggccctgcactgtcctgc

SEQ ID NO: 1830696 - DNA, 23 bp, Homo sapiens
caggccctgcactgtcctgctcc

SEQ ID NO: 1830697 - DNA, 13 bp, Homo sapiens
caggcctccagcc

SEQ ID NO: 1830698 - DNA, 20 bp, Homo sapiens
caggcctccagcctctcccg

SEQ ID NO: 1830699 - DNA, 18 bp, Homo sapiens
caggcctgggacccagct

SEQ ID NO: 1830700 - DNA, 24 bp, Homo sapiens
caggcctgggacccagctactctg

SEQ ID NO: 1830701 - DNA, 18 bp, Homo sapiens
caggcgttggtgccactt

SEQ ID NO: 1830702 - DNA, 13 bp, Homo sapiens
caggctctgggct

SEQ ID NO: 1830703 - DNA, 15 bp, Homo sapiens
caggctctgggctca

SEQ ID NO: 1830704 - DNA, 19 bp, Homo sapiens
caggctctgggctcagggc

SEQ ID NO: 1830705 - DNA, 23 bp, Homo sapiens
caggctctgggctcagggctgga

SEQ ID NO: 1830706 - DNA, 16 bp, Homo sapiens
caggctcttcctggac

SEQ ID NO: 1830707 - DNA, 18 bp, Homo sapiens
caggctgcactgcagtga

SEQ ID NO: 1830708 - DNA, 21 bp, Homo sapiens
caggctgcactgcagtgatgg

SEQ ID NO: 1830709 - DNA, 11 bp, Homo sapiens
caggctggcca

SEQ ID NO: 1830710 - DNA, 15 bp, Homo sapiens
cagggaaagctccac

SEQ ID NO: 1830711 - DNA, 18 bp, Homo sapiens
cagggaaatactgtattg

SEQ ID NO: 1830712 - DNA, 12 bp, Homo sapiens
cagggaagaggg

SEQ ID NO: 1830713 - DNA, 15 bp, Homo sapiens
cagggaagagggcag

SEQ ID NO: 1830714 - DNA, 16 bp, Homo sapiens
cagggaagagggcagt

SEQ ID NO: 1830715 - DNA, 13 bp, Homo sapiens
cagggacaaagaa

SEQ ID NO: 1830716 - DNA, 15 bp, Homo sapiens
cagggaccacagcaa

SEQ ID NO: 1830717 - DNA, 20 bp, Homo sapiens
cagggaccacagcaaggcac

SEQ ID NO: 1830718 - DNA, 21 bp, Homo sapiens
cagggagacaggcagggaggg

SEQ ID NO: 1830719 - DNA, 12 bp, Homo sapiens
cagggcagaggg

SEQ ID NO: 1830720 - DNA, 11 bp, Homo sapiens
cagggccagaa

SEQ ID NO: 1830721 - DNA, 14 bp, Homo sapiens
cagggccagaagga

SEQ ID NO: 1830722 - DNA, 20 bp, Homo sapiens
cagggccagaaggagggcag

SEQ ID NO: 1830723 - DNA, 23 bp, Homo sapiens
cagggccagaaggagggcagagc

SEQ ID NO: 1830724 - DNA, 15 bp, Homo sapiens
cagggcccctccctc

SEQ ID NO: 1830725 - DNA, 12 bp, Homo sapiens
cagggcctgggg

SEQ ID NO: 1830726 - DNA, 13 bp, Homo sapiens
cagggcctggggg

SEQ ID NO: 1830727 - DNA, 19 bp, Homo sapiens
cagggcctgggggcagtga

SEQ ID NO: 1830728 - DNA, 22 bp, Homo sapiens
cagggcctgggggcagtgactg

SEQ ID NO: 1830729 - DNA, 12 bp, Homo sapiens
cagggctgcccc

SEQ ID NO: 1830730 - DNA, 18 bp, Homo sapiens
cagggctgcccctgtagg

SEQ ID NO: 1830731 - DNA, 15 bp, Homo sapiens
caggggcaggcctgg

SEQ ID NO: 1830732 - DNA, 17 bp, Homo sapiens
caggggcaggcctggga

SEQ ID NO: 1830733 - DNA, 15 bp, Homo sapiens
caggggccccagatc

SEQ ID NO: 1830734 - DNA, 16 bp, Homo sapiens
caggggccccagatct

SEQ ID NO: 1830735 - DNA, 12 bp, Homo sapiens
caggggctgccc

SEQ ID NO: 1830736 - DNA, 13 bp, Homo sapiens
caggggctgcccg

SEQ ID NO: 1830737 - DNA, 14 bp, Homo sapiens
caggggctgcccgc

SEQ ID NO: 1830738 - DNA, 16 bp, Homo sapiens
caggggctgcccgctc

SEQ ID NO: 1830739 - DNA, 16 bp, Homo sapiens
cagggtccgcaccagc

SEQ ID NO: 1830740 - DNA, 20 bp, Homo sapiens
cagggtccgcaccagctgct

SEQ ID NO: 1830741 - DNA, 21 bp, Homo sapiens
cagggtccgcaccagctgctc

SEQ ID NO: 1830742 - DNA, 22 bp, Homo sapiens
cagggtccgcaccagctgctct

SEQ ID NO: 1830743 - DNA, 23 bp, Homo sapiens
cagggtccgcaccagctgctctg

SEQ ID NO: 1830744 - DNA, 19 bp, Homo sapiens
cagggtcttgggctactgg

SEQ ID NO: 1830745 - DNA, 21 bp, Homo sapiens
cagggtcttgggctactggca

SEQ ID NO: 1830746 - DNA, 23 bp, Homo sapiens
cagggtcttgggctactggcagc

SEQ ID NO: 1830747 - DNA, 21 bp, Homo sapiens
caggtacttcctcctgatggc

SEQ ID NO: 1830748 - DNA, 13 bp, Homo sapiens
caggtaggccctt

SEQ ID NO: 1830749 - DNA, 21 bp, Homo sapiens
caggtaggcccttgtcctgcc

SEQ ID NO: 1830750 - DNA, 22 bp, Homo sapiens
caggtaggcccttgtcctgcca

SEQ ID NO: 1830751 - DNA, 22 bp, Homo sapiens
cccaccgcatgccccctcgtgc

SEQ ID NO: 1830752 - DNA, 16 bp, Homo sapiens
cccacctcatgcctgg

SEQ ID NO: 1830753 - DNA, 21 bp, Homo sapiens
cccacctgacaatggcagcta

SEQ ID NO: 1830754 - DNA, 14 bp, Homo sapiens
cccacgagtcacct

SEQ ID NO: 1830755 - DNA, 19 bp, Homo sapiens
cccacgagtcacctgcaag

SEQ ID NO: 1830756 - DNA, 13 bp, Homo sapiens
cccacgtcctgtc

SEQ ID NO: 1830757 - DNA, 19 bp, Homo sapiens
cccacgtcctgtcagtgcc

SEQ ID NO: 1830758 - DNA, 22 bp, Homo sapiens
cccacgtcctgtcagtgccgcc

SEQ ID NO: 1830759 - DNA, 15 bp, Homo sapiens
cccactcaccagggt

SEQ ID NO: 1830760 - DNA, 17 bp, Homo sapiens
cccactcaccagggtcc

SEQ ID NO: 1830761 - DNA, 15 bp, Homo sapiens
cccactgcaccccct

SEQ ID NO: 1830762 - DNA, 18 bp, Homo sapiens
cccactgcaccccctcct

SEQ ID NO: 1830763 - DNA, 20 bp, Homo sapiens
cccactgcaccccctcctgc

SEQ ID NO: 1830764 - DNA, 23 bp, Homo sapiens
cccactgcaccccctcctgctgc

SEQ ID NO: 1830765 - DNA, 23 bp, Homo sapiens
cccacttagccgtccatggcacc

SEQ ID NO: 1830766 - DNA, 16 bp, Homo sapiens
cccacttccctgacac

SEQ ID NO: 1830767 - DNA, 14 bp, Homo sapiens
cccagacaggccct

SEQ ID NO: 1830768 - DNA, 20 bp, Homo sapiens
cccagacaggccctccctgt

SEQ ID NO: 1830769 - DNA, 18 bp, Homo sapiens
cccagatctgcctgggcc

SEQ ID NO: 1830770 - DNA, 21 bp, Homo sapiens
cccagatctgcctgggcctgt

SEQ ID NO: 1830771 - DNA, 12 bp, Homo sapiens
cccagcacccgg

SEQ ID NO: 1830772 - DNA, 19 bp, Homo sapiens
cccagcacccgggctcagg

SEQ ID NO: 1830773 - DNA, 16 bp, Homo sapiens
cccagccagcccttcc

SEQ ID NO: 1830774 - DNA, 14 bp, Homo sapiens
cccagcccacagag

SEQ ID NO: 1830775 - DNA, 15 bp, Homo sapiens
cccagcccacagagc

SEQ ID NO: 1830776 - DNA, 18 bp, Homo sapiens
cccagcccacagagcctg

SEQ ID NO: 1830777 - DNA, 16 bp, Homo sapiens
cccagcccttctgcct

SEQ ID NO: 1830778 - DNA, 18 bp, Homo sapiens
cccagcccttctgccttt

SEQ ID NO: 1830779 - DNA, 13 bp, Homo sapiens
cccagccgcagga

SEQ ID NO: 1830780 - DNA, 14 bp, Homo sapiens
cccagccgctgccc

SEQ ID NO: 1830781 - DNA, 17 bp, Homo sapiens
cccagccgctgcccggc

SEQ ID NO: 1830782 - DNA, 17 bp, Homo sapiens
cccagctactctgtcca

SEQ ID NO: 1830783 - DNA, 18 bp, Homo sapiens
cccagctactctgtccag

SEQ ID NO: 1830784 - DNA, 22 bp, Homo sapiens
cccagctactctgtccaggcca

SEQ ID NO: 1830785 - DNA, 24 bp, Homo sapiens
cccagctactctgtccaggccact

SEQ ID NO: 1830786 - DNA, 20 bp, Homo sapiens
cccagctccttttgtcccca

SEQ ID NO: 1830787 - DNA, 22 bp, Homo sapiens
cccagctccttttgtccccagg

SEQ ID NO: 1830788 - DNA, 17 bp, Homo sapiens
cccagctgacagtcctc

SEQ ID NO: 1830789 - DNA, 13 bp, Homo sapiens
cccagctgtagcc

SEQ ID NO: 1830790 - DNA, 15 bp, Homo sapiens
cccagctgtagccat

SEQ ID NO: 1830791 - DNA, 15 bp, Homo sapiens
cccagcttcctggtg

SEQ ID NO: 1830792 - DNA, 18 bp, Homo sapiens
cccaggccatcttccagg

SEQ ID NO: 1830793 - DNA, 22 bp, Homo sapiens
cccaggccatcttccaggtggg

SEQ ID NO: 1830794 - DNA, 19 bp, Homo sapiens
cccaggccctccatgggct

SEQ ID NO: 1830795 - DNA, 13 bp, Homo sapiens
cccaggcctccag

SEQ ID NO: 1830796 - DNA, 18 bp, Homo sapiens
cccaggcctccagcctct

SEQ ID NO: 1830797 - DNA, 15 bp, Homo sapiens
cccaggctgcactgc

SEQ ID NO: 1830798 - DNA, 16 bp, Homo sapiens
cccaggctgcactgca

SEQ ID NO: 1830799 - DNA, 20 bp, Homo sapiens
cccaggctgcactgcagtga

SEQ ID NO: 1830800 - DNA, 13 bp, Homo sapiens
cccaggctggcca

SEQ ID NO: 1830801 - DNA, 20 bp, Homo sapiens
cccaggctggccagccccac

SEQ ID NO: 1830802 - DNA, 23 bp, Homo sapiens
cccaggctggccagccccacagc

SEQ ID NO: 1830803 - DNA, 13 bp, Homo sapiens
cccagggcccctc

SEQ ID NO: 1830804 - DNA, 17 bp, Homo sapiens
cccagggcccctccctc

SEQ ID NO: 1830805 - DNA, 22 bp, Homo sapiens
cccagggcccctccctctgccc

SEQ ID NO: 1830806 - DNA, 13 bp, Homo sapiens
cccagggcctggg

SEQ ID NO: 1830807 - DNA, 14 bp, Homo sapiens
cccagggcctgggg

SEQ ID NO: 1830808 - DNA, 23 bp, Homo sapiens
cccagggcctgggggcagtgact

SEQ ID NO: 1830809 - DNA, 14 bp, Homo sapiens
cccagggctggaga

SEQ ID NO: 1830810 - DNA, 12 bp, Homo sapiens
cccagtgctgcc

SEQ ID NO: 1830811 - DNA, 20 bp, Homo sapiens
cccagtgctgccatgccact

SEQ ID NO: 1830812 - DNA, 14 bp, Homo sapiens
cccagtgcttctcc

SEQ ID NO: 1830813 - DNA, 22 bp, Homo sapiens
cccagtgcttctccaacactga

SEQ ID NO: 1830814 - DNA, 20 bp, Homo sapiens
cccagtgtaaagaataaatg

SEQ ID NO: 1830815 - DNA, 15 bp, Homo sapiens
cccagtgtcttcctg

SEQ ID NO: 1830816 - DNA, 21 bp, Homo sapiens
cccataatagttagccctcag

SEQ ID NO: 1830817 - DNA, 12 bp, Homo sapiens
cccatcccccct

SEQ ID NO: 1830818 - DNA, 15 bp, Homo sapiens
cccatcccccctcac

SEQ ID NO: 1830819 - DNA, 16 bp, Homo sapiens
cccatcccccctcacc

SEQ ID NO: 1830820 - DNA, 17 bp, Homo sapiens
cccatccctcggaccca

SEQ ID NO: 1830821 - DNA, 13 bp, Homo sapiens
cccatccctgctt

SEQ ID NO: 1830822 - DNA, 16 bp, Homo sapiens
cccatcctggcccatc

SEQ ID NO: 1830823 - DNA, 13 bp, Homo sapiens
cccatctcctccc

SEQ ID NO: 1830824 - DNA, 15 bp, Homo sapiens
cccatctcctcccat

SEQ ID NO: 1830825 - DNA, 12 bp, Homo sapiens
cccatctgccca

SEQ ID NO: 1830826 - DNA, 13 bp, Homo sapiens
cccatctgcccag

SEQ ID NO: 1830827 - DNA, 16 bp, Homo sapiens
cccatctgcccaggac

SEQ ID NO: 1830828 - DNA, 15 bp, Homo sapiens
cccatcttcctgctg

SEQ ID NO: 1830829 - DNA, 20 bp, Homo sapiens
cccatcttcctgctgctgta

SEQ ID NO: 1830830 - DNA, 17 bp, Homo sapiens
cccatgctctgccccaa

SEQ ID NO: 1830831 - DNA, 12 bp, Homo sapiens
cccatgctgcct

SEQ ID NO: 1830832 - DNA, 17 bp, Homo sapiens
cccatgggcactgctgg

SEQ ID NO: 1830833 - DNA, 21 bp, Homo sapiens
cccatgggcactgctgggtgg

SEQ ID NO: 1830834 - DNA, 16 bp, Homo sapiens
cccatgggcttggact

SEQ ID NO: 1830835 - DNA, 14 bp, Homo sapiens
ccccaaaccccagc

SEQ ID NO: 1830836 - DNA, 16 bp, Homo sapiens
ccccaaccccgcggtg

SEQ ID NO: 1830837 - DNA, 15 bp, Homo sapiens
ccccaactccagggg

SEQ ID NO: 1830838 - DNA, 14 bp, Homo sapiens
ccccaagcagccag

SEQ ID NO: 1830839 - DNA, 19 bp, Homo sapiens
ccccaagcagccagccagt

SEQ ID NO: 1830840 - DNA, 22 bp, Homo sapiens
ccccaagtccacctgcctatcc

SEQ ID NO: 1830841 - DNA, 15 bp, Homo sapiens
ccccacagcccacgt

SEQ ID NO: 1830842 - DNA, 16 bp, Homo sapiens
ccccacagcccacgtc

SEQ ID NO: 1830843 - DNA, 19 bp, Homo sapiens
ccccacagcccacgtcctg

SEQ ID NO: 1830844 - DNA, 22 bp, Homo sapiens
ccccacagcccacgtcctgtca

SEQ ID NO: 1830845 - DNA, 23 bp, Homo sapiens
ccccaccctcgtggacacctgcc

SEQ ID NO: 1830846 - DNA, 23 bp, Homo sapiens
ccccaccgaggttcccagggctg

SEQ ID NO: 1830847 - DNA, 18 bp, Homo sapiens
ccccacctcatgcctggc

SEQ ID NO: 1830848 - DNA, 23 bp, Homo sapiens
ccccacctgacaatggcagctag

SEQ ID NO: 1830849 - DNA, 19 bp, Homo sapiens
ccccacgagtcacctgcaa

SEQ ID NO: 1830850 - DNA, 23 bp, Homo sapiens
ccccacgagtcacctgcaagccc

SEQ ID NO: 1830851 - DNA, 19 bp, Homo sapiens
ccccagaaagcctcctgcc

SEQ ID NO: 1830852 - DNA, 22 bp, Homo sapiens
ccccagagccactacctttgtc

SEQ ID NO: 1830853 - DNA, 15 bp, Homo sapiens
ccccagatctgcctg

SEQ ID NO: 1830854 - DNA, 18 bp, Homo sapiens
ccccagatctgcctgggc

SEQ ID NO: 1830855 - DNA, 20 bp, Homo sapiens
ccccagatctgcctgggcct

SEQ ID NO: 1830856 - DNA, 21 bp, Homo sapiens
ccccagatctgcctgggcctg

SEQ ID NO: 1830857 - DNA, 22 bp, Homo sapiens
ccccagatctgcctgggcctgt

SEQ ID NO: 1830858 - DNA, 20 bp, Homo sapiens
ccccagcccacagagcctga

SEQ ID NO: 1830859 - DNA, 16 bp, Homo sapiens
ccccagcctggcccag

SEQ ID NO: 1830860 - DNA, 19 bp, Homo sapiens
ccccagcctggcccagctc

SEQ ID NO: 1830861 - DNA, 16 bp, Homo sapiens
ccccaggcctccagcc

SEQ ID NO: 1830862 - DNA, 17 bp, Homo sapiens
ccccaggcctccagcct

SEQ ID NO: 1830863 - DNA, 18 bp, Homo sapiens
ccccaggcctccagcctc

SEQ ID NO: 1830864 - DNA, 13 bp, Homo sapiens
ccccatcctggcc

SEQ ID NO: 1830865 - DNA, 19 bp, Homo sapiens
ccccatctccccaggcctc

SEQ ID NO: 1830866 - DNA, 14 bp, Homo sapiens
ccccatctgcccag

SEQ ID NO: 1830867 - DNA, 13 bp, Homo sapiens
ccccatgctctgc

SEQ ID NO: 1830868 - DNA, 15 bp, Homo sapiens
ccccatgctctgccc

SEQ ID NO: 1830869 - DNA, 19 bp, Homo sapiens
ccccatgctgccttcaggg

SEQ ID NO: 1830870 - DNA, 14 bp, Homo sapiens
ccccatgtgcctgc

SEQ ID NO: 1830871 - DNA, 23 bp, Homo sapiens
ccccatgtgcctgcaccaggaga

SEQ ID NO: 1830872 - DNA, 21 bp, Homo sapiens
cccccaaacatctggcatggc

SEQ ID NO: 1830873 - DNA, 15 bp, Homo sapiens
cccccagaaagcctc

SEQ ID NO: 1830874 - DNA, 17 bp, Homo sapiens
cccccatctccccaggc

SEQ ID NO: 1830875 - DNA, 19 bp, Homo sapiens
cccccatctccccaggcct

SEQ ID NO: 1830876 - DNA, 15 bp, Homo sapiens
cccccatgctgcctt

SEQ ID NO: 1830877 - DNA, 19 bp, Homo sapiens
cccccatgctgccttcagg

SEQ ID NO: 1830878 - DNA, 13 bp, Homo sapiens
cccccgacactgc

SEQ ID NO: 1830879 - DNA, 17 bp, Homo sapiens
cccccgacactgctgca

SEQ ID NO: 1830880 - DNA, 23 bp, Homo sapiens
cccccgacactgctgcaccagag

SEQ ID NO: 1830881 - DNA, 22 bp, Homo sapiens
cccccgcagtccccagcccttc

SEQ ID NO: 1830882 - DNA, 23 bp, Homo sapiens
cccccgcagtccccagcccttct

SEQ ID NO: 1830883 - DNA, 20 bp, Homo sapiens
cccccgggaggggcccgctt

SEQ ID NO: 1830884 - DNA, 22 bp, Homo sapiens
cccccgggaggggcccgcttgc

SEQ ID NO: 1830885 - DNA, 16 bp, Homo sapiens
cccccggggctgggtt

SEQ ID NO: 1830886 - DNA, 12 bp, Homo sapiens
ccccctcccaga

SEQ ID NO: 1830887 - DNA, 12 bp, Homo sapiens
ccccctcctgct

SEQ ID NO: 1830888 - DNA, 13 bp, Homo sapiens
ccccctcctgctg

SEQ ID NO: 1830889 - DNA, 14 bp, Homo sapiens
ccccctcctgctgc

SEQ ID NO: 1830890 - DNA, 16 bp, Homo sapiens
ccccctcctgctgcag

SEQ ID NO: 1830891 - DNA, 12 bp, Homo sapiens
ccccgcagtccc

SEQ ID NO: 1830892 - DNA, 17 bp, Homo sapiens
ccctgtacccagctcct

SEQ ID NO: 1830893 - DNA, 14 bp, Homo sapiens
ccctgtaggttgct

SEQ ID NO: 1830894 - DNA, 13 bp, Homo sapiens
ccctgtcagaggc

SEQ ID NO: 1830895 - DNA, 14 bp, Homo sapiens
ccctgtcagaggct

SEQ ID NO: 1830896 - DNA, 18 bp, Homo sapiens
ccctgtgactatggctct

SEQ ID NO: 1830897 - DNA, 13 bp, Homo sapiens
cccttcagggcca

SEQ ID NO: 1830898 - DNA, 14 bp, Homo sapiens
cccttcagggccag

SEQ ID NO: 1830899 - DNA, 16 bp, Homo sapiens
cccttccctggccccg

SEQ ID NO: 1830900 - DNA, 23 bp, Homo sapiens
cccttcctggcctcactggctgg

SEQ ID NO: 1830901 - DNA, 24 bp, Homo sapiens
cccttcctggcctcactggctggg

SEQ ID NO: 1830902 - DNA, 12 bp, Homo sapiens
cccttctgcctt

SEQ ID NO: 1830903 - DNA, 15 bp, Homo sapiens
cccttgaccattggc

SEQ ID NO: 1830904 - DNA, 19 bp, Homo sapiens
cccttgggcatccacccag

SEQ ID NO: 1830905 - DNA, 23 bp, Homo sapiens
cccttgggcatccacccagtgct

SEQ ID NO: 1830906 - DNA, 14 bp, Homo sapiens
cccttggggcctgg

SEQ ID NO: 1830907 - DNA, 15 bp, Homo sapiens
cccttggggcctggc

SEQ ID NO: 1830908 - DNA, 16 bp, Homo sapiens
cccttggggcctggct

SEQ ID NO: 1830909 - DNA, 14 bp, Homo sapiens
cccttgtcctgcca

SEQ ID NO: 1830910 - DNA, 21 bp, Homo sapiens
cccttgtcctgccagctgcct

SEQ ID NO: 1830911 - DNA, 22 bp, Homo sapiens
cccttgtcctgccagctgcctt

SEQ ID NO: 1830912 - DNA, 16 bp, Homo sapiens
cccttttcagcttctg

SEQ ID NO: 1830913 - DNA, 15 bp, Homo sapiens
cccttttgcctggct

SEQ ID NO: 1830914 - DNA, 19 bp, Homo sapiens
cccttttgcctggctgtgg

SEQ ID NO: 1830915 - DNA, 18 bp, Homo sapiens
ccgagggatgatgccaca

SEQ ID NO: 1830916 - DNA, 14 bp, Homo sapiens
ccgaggttcccagg

SEQ ID NO: 1830917 - DNA, 14 bp, Homo sapiens
ccgcaccagctgct

SEQ ID NO: 1830918 - DNA, 16 bp, Homo sapiens
ccgcaccagctgctct

SEQ ID NO: 1830919 - DNA, 18 bp, Homo sapiens
ccgcaccagctgctctgc

SEQ ID NO: 1830920 - DNA, 22 bp, Homo sapiens
ccgcaccagctgctctgcccct

SEQ ID NO: 1830921 - DNA, 21 bp, Homo sapiens
ccgcagcccgtgaagcagtgc

SEQ ID NO: 1830922 - DNA, 14 bp, Homo sapiens
ccgcaggaaggcag

SEQ ID NO: 1830923 - DNA, 13 bp, Homo sapiens
ccgcatgccccct

SEQ ID NO: 1830924 - DNA, 21 bp, Homo sapiens
ccgcatgccccctcgtgccag

SEQ ID NO: 1830925 - DNA, 22 bp, Homo sapiens
ccgcatgccccctcgtgccagt

SEQ ID NO: 1830926 - DNA, 14 bp, Homo sapiens
ccgcccaggctggc

SEQ ID NO: 1830927 - DNA, 19 bp, Homo sapiens
ccgcctcgcccaccgcatg

SEQ ID NO: 1830928 - DNA, 21 bp, Homo sapiens
ccgcctcgcccaccgcatgcc

SEQ ID NO: 1830929 - DNA, 14 bp, Homo sapiens
ccgccttcctcctc

SEQ ID NO: 1830930 - DNA, 19 bp, Homo sapiens
ccgctcccacagcttcctg

SEQ ID NO: 1830931 - DNA, 23 bp, Homo sapiens
ccgctcccacagcttcctgaggg

SEQ ID NO: 1830932 - DNA, 22 bp, Homo sapiens
ccgctgcccggcgccctctgtc

SEQ ID NO: 1830933 - DNA, 18 bp, Homo sapiens
ccgcttcacccctgcact

SEQ ID NO: 1830934 - DNA, 22 bp, Homo sapiens
ccgcttgcctcggctcctgctg

SEQ ID NO: 1830935 - DNA, 14 bp, Homo sapiens
ccggagcacagccc

SEQ ID NO: 1830936 - DNA, 16 bp, Homo sapiens
ccggagcacagccctg

SEQ ID NO: 1830937 - DNA, 18 bp, Homo sapiens
ccggagcacagccctggg

SEQ ID NO: 1830938 - DNA, 20 bp, Homo sapiens
ccggagcacagccctgggag

SEQ ID NO: 1830939 - DNA, 18 bp, Homo sapiens
ccggcaagcgagcacagt

SEQ ID NO: 1830940 - DNA, 19 bp, Homo sapiens
ccggcaagcgagcacagta

SEQ ID NO: 1830941 - DNA, 23 bp, Homo sapiens
ccggcctccactcccccacctga

SEQ ID NO: 1830942 - DNA, 16 bp, Homo sapiens
ccggcctcttccaccc

SEQ ID NO: 1830943 - DNA, 15 bp, Homo sapiens
ccggcgccctctgtc

SEQ ID NO: 1830944 - DNA, 21 bp, Homo sapiens
ccggcgccctctgtcctgact

SEQ ID NO: 1830945 - DNA, 13 bp, Homo sapiens
ccggcgctgcagg

SEQ ID NO: 1830946 - DNA, 14 bp, Homo sapiens
ccggcgctgcaggt

SEQ ID NO: 1830947 - DNA, 22 bp, Homo sapiens
ccgggctcagggaccacagcaa

SEQ ID NO: 1830948 - DNA, 16 bp, Homo sapiens
ccggggctggcaagca

SEQ ID NO: 1830949 - DNA, 20 bp, Homo sapiens
ccggggctggcaagcaggga

SEQ ID NO: 1830950 - DNA, 14 bp, Homo sapiens
ccgggtgccattcc

SEQ ID NO: 1830951 - DNA, 13 bp, Homo sapiens
ccgggtgggcctg

SEQ ID NO: 1830952 - DNA, 14 bp, Homo sapiens
ccgggtgggcctgg

SEQ ID NO: 1830953 - DNA, 15 bp, Homo sapiens
ccgggtgggcctggc

SEQ ID NO: 1830954 - DNA, 16 bp, Homo sapiens
ccgggtgggcctggcc

SEQ ID NO: 1830955 - DNA, 16 bp, Homo sapiens
ccgtccacccaggctg

SEQ ID NO: 1830956 - DNA, 23 bp, Homo sapiens
ccgtccacccaggctgcactgca

SEQ ID NO: 1830957 - DNA, 24 bp, Homo sapiens
ccgtccacccaggctgcactgcag

SEQ ID NO: 1830958 - DNA, 16 bp, Homo sapiens
ccgtccatggcaccag

SEQ ID NO: 1830959 - DNA, 18 bp, Homo sapiens
ccgtcggactgcccccag

SEQ ID NO: 1830960 - DNA, 19 bp, Homo sapiens
ccgtctgactccagagtct

SEQ ID NO: 1830961 - DNA, 22 bp, Homo sapiens
ccgtctgactccagagtctgag

SEQ ID NO: 1830962 - DNA, 14 bp, Homo sapiens
ccgtgaagcagtgc

SEQ ID NO: 1830963 - DNA, 17 bp, Homo sapiens
ccgtgaagcagtgcctc

SEQ ID NO: 1830964 - DNA, 15 bp, Homo sapiens
ccgtgcagtacaggc

SEQ ID NO: 1830965 - DNA, 13 bp, Homo sapiens
ccgttccctgtca

SEQ ID NO: 1830966 - DNA, 14 bp, Homo sapiens
ccgttccctgtcag

SEQ ID NO: 1830967 - DNA, 15 bp, Homo sapiens
ccgttccctgtcaga

SEQ ID NO: 1830968 - DNA, 14 bp, Homo sapiens
ccgttgtctccctg

SEQ ID NO: 1830969 - DNA, 19 bp, Homo sapiens
ccgttgtctccctggccct

SEQ ID NO: 1830970 - DNA, 20 bp, Homo sapiens
ccgttgtctccctggccctc

SEQ ID NO: 1830971 - DNA, 13 bp, Homo sapiens
cctaataaagaga

SEQ ID NO: 1830972 - DNA, 15 bp, Homo sapiens
cctaataaagagact

SEQ ID NO: 1830973 - DNA, 14 bp, Homo sapiens
cctacccctcccag

SEQ ID NO: 1830974 - DNA, 14 bp, Homo sapiens
cctaccctcccacc

SEQ ID NO: 1830975 - DNA, 14 bp, Homo sapiens
cctacttgtgactg

SEQ ID NO: 1830976 - DNA, 13 bp, Homo sapiens
cctagcccagtgc

SEQ ID NO: 1830977 - DNA, 17 bp, Homo sapiens
cctagcccagtgcttct

SEQ ID NO: 1830978 - DNA, 22 bp, Homo sapiens
cctaggagttgagtacagtgag

SEQ ID NO: 1830979 - DNA, 17 bp, Homo sapiens
cctaggattcctccccc

SEQ ID NO: 1830980 - DNA, 15 bp, Homo sapiens
cctagtactctctgc

SEQ ID NO: 1830981 - DNA, 20 bp, Homo sapiens
cctagtactctctgctctag

SEQ ID NO: 1830982 - DNA, 21 bp, Homo sapiens
cctagtggctgtccagtgccc

SEQ ID NO: 1830983 - DNA, 23 bp, Homo sapiens
cctagtggctgtccagtgcccat

SEQ ID NO: 1830984 - DNA, 17 bp, Homo sapiens
cctatacctatgtgaaa

SEQ ID NO: 1830985 - DNA, 13 bp, Homo sapiens
cctatagagaggg

SEQ ID NO: 1830986 - DNA, 24 bp, Homo sapiens
cctatcagtgtgccccccatcctg

SEQ ID NO: 1830987 - DNA, 19 bp, Homo sapiens
cctatgagatggccatgct

SEQ ID NO: 1830988 - DNA, 21 bp, Homo sapiens
cctatgagatggccatgctca

SEQ ID NO: 1830989 - DNA, 18 bp, Homo sapiens
cctatgtgagtttcagaa

SEQ ID NO: 1830990 - DNA, 21 bp, Homo sapiens
cctatgtgagtttcagaaatt

SEQ ID NO: 1830991 - DNA, 20 bp, Homo sapiens
cctcaaggcctcccacagtg

SEQ ID NO: 1830992 - DNA, 18 bp, Homo sapiens
cctcacagcctctccctt

SEQ ID NO: 1830993 - DNA, 19 bp, Homo sapiens
cctcaccaggggcaggcac

SEQ ID NO: 1830994 - DNA, 20 bp, Homo sapiens
cctcaccaggggcaggcaca

SEQ ID NO: 1830995 - DNA, 13 bp, Homo sapiens
cctcagcccttgc

SEQ ID NO: 1830996 - DNA, 15 bp, Homo sapiens
cctcagtcagttccc

SEQ ID NO: 1830997 - DNA, 20 bp, Homo sapiens
cctcagtcagttcccggagc

SEQ ID NO: 1830998 - DNA, 22 bp, Homo sapiens
cctcagtcagttcccggagcac

SEQ ID NO: 1830999 - DNA, 23 bp, Homo sapiens
cctcagtcagttcccggagcaca

SEQ ID NO: 1831000 - DNA, 18 bp, Homo sapiens
cctcatcccctcgtcctg

SEQ ID NO: 1831001 - DNA, 21 bp, Homo sapiens
cctcatttaatatttttcaaa

SEQ ID NO: 1831002 - DNA, 22 bp, Homo sapiens
cctcatttaatatttttcaaaa

SEQ ID NO: 1831003 - DNA, 18 bp, Homo sapiens
cctccacagtgctgcttc

SEQ ID NO: 1831004 - DNA, 20 bp, Homo sapiens
cctccactcccccacctgac

SEQ ID NO: 1831005 - DNA, 13 bp, Homo sapiens
cctccagagccag

SEQ ID NO: 1831006 - DNA, 15 bp, Homo sapiens
cctccagagccagcc

SEQ ID NO: 1831007 - DNA, 16 bp, Homo sapiens
cctccagagccagcct

SEQ ID NO: 1831008 - DNA, 20 bp, Homo sapiens
cctccagagccagcctggga

SEQ ID NO: 1831009 - DNA, 23 bp, Homo sapiens
cctccagagccagcctgggactc

SEQ ID NO: 1831010 - DNA, 13 bp, Homo sapiens
cctccagcctccc

SEQ ID NO: 1831011 - DNA, 14 bp, Homo sapiens
cctccagcctcccc

SEQ ID NO: 1831012 - DNA, 18 bp, Homo sapiens
cctccagcctcccctccc

SEQ ID NO: 1831013 - DNA, 16 bp, Homo sapiens
cctccaggcatgctgg

SEQ ID NO: 1831014 - DNA, 20 bp, Homo sapiens
cctccaggcatgctggcctc

SEQ ID NO: 1831015 - DNA, 16 bp, Homo sapiens
cctccagttctgatga

SEQ ID NO: 1831016 - DNA, 13 bp, Homo sapiens
cctccatgggcta

SEQ ID NO: 1831017 - DNA, 16 bp, Homo sapiens
cctcccaataaagctg

SEQ ID NO: 1831018 - DNA, 17 bp, Homo sapiens
cctcccaataaagctgg

SEQ ID NO: 1831019 - DNA, 11 bp, Homo sapiens
cctcccaccag

SEQ ID NO: 1831020 - DNA, 18 bp, Homo sapiens
cctcccagacaggccctc

SEQ ID NO: 1831021 - DNA, 23 bp, Homo sapiens
cctcccagacaggccctccctgt

SEQ ID NO: 1831022 - DNA, 23 bp, Homo sapiens
cctccccacagtcctcacagcct

SEQ ID NO: 1831023 - DNA, 15 bp, Homo sapiens
cctcccctcccgtct

SEQ ID NO: 1831024 - DNA, 13 bp, Homo sapiens
cctccctctgccc

SEQ ID NO: 1831025 - DNA, 14 bp, Homo sapiens
cctccctgctgtcc

SEQ ID NO: 1831026 - DNA, 19 bp, Homo sapiens
cctccctgctgtcccctct

SEQ ID NO: 1831027 - DNA, 19 bp, Homo sapiens
cctccgtttatgggccttg

SEQ ID NO: 1831028 - DNA, 20 bp, Homo sapiens
cctccgtttatgggccttgc

SEQ ID NO: 1831029 - DNA, 17 bp, Homo sapiens
cctcctaccctcccacc

SEQ ID NO: 1831030 - DNA, 20 bp, Homo sapiens
cctcctagaggtgggcagct

SEQ ID NO: 1831031 - DNA, 23 bp, Homo sapiens
cctcctagaggtgggcagctggg

SEQ ID NO: 1831032 - DNA, 21 bp, Homo sapiens
cctcctccagttctgatgagg

SEQ ID NO: 1831033 - DNA, 20 bp, Homo sapiens
cctcctgagaaggcgaggag

SEQ ID NO: 1831034 - DNA, 19 bp, Homo sapiens
cctcctgccccctgccagt

SEQ ID NO: 1831035 - DNA, 11 bp, Homo sapiens
cctcctgctgc

SEQ ID NO: 1831036 - DNA, 18 bp, Homo sapiens
cctcctgctgcagagggg

SEQ ID NO: 1831037 - DNA, 19 bp, Homo sapiens
cctcgaaccaaggcagcct

SEQ ID NO: 1831038 - DNA, 20 bp, Homo sapiens
cctcgaaccaaggcagcctc

SEQ ID NO: 1831039 - DNA, 22 bp, Homo sapiens
cctcgaaccaaggcagcctcca

SEQ ID NO: 1831040 - DNA, 13 bp, Homo sapiens
cctcgaggcaccg

SEQ ID NO: 1831041 - DNA, 21 bp, Homo sapiens
cctcgcccaccgcatgccccc

SEQ ID NO: 1831042 - DNA, 13 bp, Homo sapiens
cctcgcctggcct

SEQ ID NO: 1831043 - DNA, 15 bp, Homo sapiens
cctcgcctggcctga

SEQ ID NO: 1831044 - DNA, 22 bp, Homo sapiens
cctcggaagccgtctgactcca

SEQ ID NO: 1831045 - DNA, 14 bp, Homo sapiens
cctcggctcctgct

SEQ ID NO: 1831046 - DNA, 17 bp, Homo sapiens
cctcggctcctgctgca

SEQ ID NO: 1831047 - DNA, 20 bp, Homo sapiens
cctcggctcctgctgcacca

SEQ ID NO: 1831048 - DNA, 18 bp, Homo sapiens
cctcgtcctgtcccagag

SEQ ID NO: 1831049 - DNA, 12 bp, Homo sapiens
cctcgtgccagt

SEQ ID NO: 1831050 - DNA, 17 bp, Homo sapiens
cctcgtggacacctgcc

SEQ ID NO: 1831051 - DNA, 18 bp, Homo sapiens
cctcgtggacacctgccc

SEQ ID NO: 1831052 - DNA, 20 bp, Homo sapiens
cctcgtggacacctgccctg

SEQ ID NO: 1831053 - DNA, 17 bp, Homo sapiens
cctctccacctagtggc

SEQ ID NO: 1831054 - DNA, 18 bp, Homo sapiens
cctctcccggctgcctgc

SEQ ID NO: 1831055 - DNA, 14 bp, Homo sapiens
cctctccttgggct

SEQ ID NO: 1831056 - DNA, 18 bp, Homo sapiens
cctctgccccaagcagcc

SEQ ID NO: 1831057 - DNA, 20 bp, Homo sapiens
cctctgccccaagcagccag

SEQ ID NO: 1831058 - DNA, 21 bp, Homo sapiens
cctctgccccaagcagccagc

SEQ ID NO: 1831059 - DNA, 22 bp, Homo sapiens
cctctgccccaagcagccagcc

SEQ ID NO: 1831060 - DNA, 23 bp, Homo sapiens
cctctggtaaacattcctccagc

SEQ ID NO: 1831061 - DNA, 19 bp, Homo sapiens
cctctgtcatcactccctg

SEQ ID NO: 1831062 - DNA, 20 bp, Homo sapiens
cctctgtcatcactccctgg

SEQ ID NO: 1831063 - DNA, 13 bp, Homo sapiens
cctctgtcctgac

SEQ ID NO: 1831064 - DNA, 16 bp, Homo sapiens
cctctgtgtcactggc

SEQ ID NO: 1831065 - DNA, 21 bp, Homo sapiens
cctctgtgtcactggctgcct

SEQ ID NO: 1831066 - DNA, 22 bp, Homo sapiens
cctctgtgtcactggctgcctc

SEQ ID NO: 1831067 - DNA, 18 bp, Homo sapiens
cctcttaccgtagcctcc

SEQ ID NO: 1831068 - DNA, 19 bp, Homo sapiens
cctcttaccgtagcctccg

SEQ ID NO: 1831069 - DNA, 19 bp, Homo sapiens
cctgaaaacgaaggggccc

SEQ ID NO: 1831070 - DNA, 15 bp, Homo sapiens
cctgaattattccaa

SEQ ID NO: 1831071 - DNA, 21 bp, Homo sapiens
cctgacgccctgcgttggagc

SEQ ID NO: 1831072 - DNA, 22 bp, Homo sapiens
cctgacgccctgcgttggagcc

SEQ ID NO: 1831073 - DNA, 21 bp, Homo sapiens
cctgacttcaggggctgcccg

SEQ ID NO: 1831074 - DNA, 14 bp, Homo sapiens
cctgagaaggcgag

SEQ ID NO: 1831075 - DNA, 19 bp, Homo sapiens
cctgagaaggcgaggagag

SEQ ID NO: 1831076 - DNA, 19 bp, Homo sapiens
cctgagtcggccccacatg

SEQ ID NO: 1831077 - DNA, 14 bp, Homo sapiens
cctgatgctgcccc

SEQ ID NO: 1831078 - DNA, 14 bp, Homo sapiens
cctgatggccaaga

SEQ ID NO: 1831079 - DNA, 21 bp, Homo sapiens
cctgatggccaagggggtgga

SEQ ID NO: 1831080 - DNA, 17 bp, Homo sapiens
cctgatggccaggccag

SEQ ID NO: 1831081 - DNA, 20 bp, Homo sapiens
cctgcaagccccagggcctg

SEQ ID NO: 1831082 - DNA, 21 bp, Homo sapiens
cctgcaagccccagggcctgg

SEQ ID NO: 1831083 - DNA, 22 bp, Homo sapiens
cctgcaagccccagggcctggg

SEQ ID NO: 1831084 - DNA, 16 bp, Homo sapiens
cctgcaatctccaggg

SEQ ID NO: 1831085 - DNA, 12 bp, Homo sapiens
cctgcactgtcc

SEQ ID NO: 1831086 - DNA, 17 bp, Homo sapiens
cctgcacttcagacacc

SEQ ID NO: 1831087 - DNA, 17 bp, Homo sapiens
cctgcaggaacgagcac

SEQ ID NO: 1831088 - DNA, 17 bp, Homo sapiens
cctgcaggttgggccat

SEQ ID NO: 1831089 - DNA, 15 bp, Homo sapiens
cctgccacctgtctg

SEQ ID NO: 1831090 - DNA, 17 bp, Homo sapiens
cctgccacctgtctgtc

SEQ ID NO: 1831091 - DNA, 21 bp, Homo sapiens
cctgcccaatgctttgggagg

SEQ ID NO: 1831092 - DNA, 13 bp, Homo sapiens
cctgcccccatct

SEQ ID NO: 1831093 - DNA, 14 bp, Homo sapiens
cctgcccccatctc

SEQ ID NO: 1831094 - DNA, 21 bp, Homo sapiens
cctgcccccatctccccaggc

SEQ ID NO: 1831095 - DNA, 22 bp, Homo sapiens
cctgcccccatctccccaggcc

SEQ ID NO: 1831096 - DNA, 13 bp, Homo sapiens
cctgccccctgcc

SEQ ID NO: 1831097 - DNA, 16 bp, Homo sapiens
cctgccccctgccagt

SEQ ID NO: 1831098 - DNA, 17 bp, Homo sapiens
cctgcccctccccagcc

SEQ ID NO: 1831099 - DNA, 16 bp, Homo sapiens
cctgccctgccctgcc

SEQ ID NO: 1831100 - DNA, 14 bp, Homo sapiens
cctgccgcccaaag

SEQ ID NO: 1831101 - DNA, 12 bp, Homo sapiens
cctgcctgctcc

SEQ ID NO: 1831102 - DNA, 15 bp, Homo sapiens
cctgcgttggagcca

SEQ ID NO: 1831103 - DNA, 19 bp, Homo sapiens
cctgcgttggagccactcc

SEQ ID NO: 1831104 - DNA, 14 bp, Homo sapiens
cctgctagagcaac

SEQ ID NO: 1831105 - DNA, 23 bp, Homo sapiens
cctgctagagcaacccctgtacc

SEQ ID NO: 1831106 - DNA, 13 bp, Homo sapiens
cctgctccacagt

SEQ ID NO: 1831107 - DNA, 12 bp, Homo sapiens
cctgctgcacca

SEQ ID NO: 1831108 - DNA, 17 bp, Homo sapiens
cctgctgcaccaaccca

SEQ ID NO: 1831109 - DNA, 18 bp, Homo sapiens
cctgctgcaccaacccag

SEQ ID NO: 1831110 - DNA, 19 bp, Homo sapiens
cctgctgcaccaacccagc

SEQ ID NO: 1831111 - DNA, 21 bp, Homo sapiens
cctgctgcaccaacccagccg

SEQ ID NO: 1831112 - DNA, 22 bp, Homo sapiens
cctgctgcctaataaagagact

SEQ ID NO: 1831113 - DNA, 20 bp, Homo sapiens
cctgctgctgtaactgctga

SEQ ID NO: 1831114 - DNA, 21 bp, Homo sapiens
cctgctgctgtaactgctgag

SEQ ID NO: 1831115 - DNA, 22 bp, Homo sapiens
cctgctgctgtaactgctgagc

SEQ ID NO: 1831116 - DNA, 19 bp, Homo sapiens
cctgctgggaaccccgcag

SEQ ID NO: 1831117 - DNA, 21 bp, Homo sapiens
cctgctgggaaccccgcagcc

SEQ ID NO: 1831118 - DNA, 12 bp, Homo sapiens
cctgctgtcccc

SEQ ID NO: 1831119 - DNA, 17 bp, Homo sapiens
cctgcttgcccgctccc

SEQ ID NO: 1831120 - DNA, 20 bp, Homo sapiens
cctgcttgcccgctcccaca

SEQ ID NO: 1831121 - DNA, 19 bp, Homo sapiens
cctgcttttccaggatcct

SEQ ID NO: 1831122 - DNA, 19 bp, Homo sapiens
cctggaaaggggagttgag

SEQ ID NO: 1831123 - DNA, 14 bp, Homo sapiens
cctggaaccaggga

SEQ ID NO: 1831124 - DNA, 16 bp, Homo sapiens
cctggaaccagggagg

SEQ ID NO: 1831125 - DNA, 17 bp, Homo sapiens
cctggaattcagcaccc

SEQ ID NO: 1831126 - DNA, 19 bp, Homo sapiens
cctggaattcagcaccctg

SEQ ID NO: 1831127 - DNA, 23 bp, Homo sapiens
cctggaattcagcaccctgggtg

SEQ ID NO: 1831128 - DNA, 20 bp, Homo sapiens
cctggatgggcattgggctg

SEQ ID NO: 1831129 - DNA, 17 bp, Homo sapiens
cctggatgtgtggggca

SEQ ID NO: 1831130 - DNA, 18 bp, Homo sapiens
cctggatgtgtggggcat

SEQ ID NO: 1831131 - DNA, 21 bp, Homo sapiens
cctggatgtgtggggcatggt

SEQ ID NO: 1831132 - DNA, 12 bp, Homo sapiens
cctggcacagtg

SEQ ID NO: 1831133 - DNA, 13 bp, Homo sapiens
cctggcacagtgt

SEQ ID NO: 1831134 - DNA, 23 bp, Homo sapiens
cctggcacagtgtctgggctgac

SEQ ID NO: 1831135 - DNA, 12 bp, Homo sapiens
cctggcccagct

SEQ ID NO: 1831136 - DNA, 14 bp, Homo sapiens
cctggcccagctcc

SEQ ID NO: 1831137 - DNA, 20 bp, Homo sapiens
cctggcccatcagtgtaccc

SEQ ID NO: 1831138 - DNA, 14 bp, Homo sapiens
cctggccctcttct

SEQ ID NO: 1831139 - DNA, 15 bp, Homo sapiens
cctggccctcttctt

SEQ ID NO: 1831140 - DNA, 17 bp, Homo sapiens
cctggcctcaagcaatc

SEQ ID NO: 1831141 - DNA, 13 bp, Homo sapiens
cctggcctcactg

SEQ ID NO: 1831142 - DNA, 19 bp, Homo sapiens
cctggcctcactggctggg

SEQ ID NO: 1831143 - DNA, 13 bp, Homo sapiens
cctggcctgagct

SEQ ID NO: 1831144 - DNA, 15 bp, Homo sapiens
cctggcctgagctgg

SEQ ID NO: 1831145 - DNA, 17 bp, Homo sapiens
cctggcctgagctgggg

SEQ ID NO: 1831146 - DNA, 19 bp, Homo sapiens
cctggcctgagctggggcc

SEQ ID NO: 1831147 - DNA, 22 bp, Homo sapiens
cctggctccccacgagtcacct

SEQ ID NO: 1831148 - DNA, 12 bp, Homo sapiens
cctggctgtgga

SEQ ID NO: 1831149 - DNA, 15 bp, Homo sapiens
cctggctgtggaggc

SEQ ID NO: 1831150 - DNA, 19 bp, Homo sapiens
cctggctgtggaggcctga

SEQ ID NO: 1831151 - DNA, 21 bp, Homo sapiens
cctggctgtggaggcctgatg

SEQ ID NO: 1831152 - DNA, 22 bp, Homo sapiens
cctggctgtggaggcctgatgc

SEQ ID NO: 1831153 - DNA, 14 bp, Homo sapiens
cctggcttgctcca

SEQ ID NO: 1831154 - DNA, 16 bp, Homo sapiens
cctggcttgctccagg

SEQ ID NO: 1831155 - DNA, 19 bp, Homo sapiens
cctggcttgctccagggtc

SEQ ID NO: 1831156 - DNA, 15 bp, Homo sapiens
cctgggaaaggaccc

SEQ ID NO: 1831157 - DNA, 16 bp, Homo sapiens
cctgggaaaggaccca

SEQ ID NO: 1831158 - DNA, 21 bp, Homo sapiens
cctgggaaaggacccacccat

SEQ ID NO: 1831159 - DNA, 12 bp, Homo sapiens
cctgggacccag

SEQ ID NO: 1831160 - DNA, 14 bp, Homo sapiens
cctgggacccagct

SEQ ID NO: 1831161 - DNA, 16 bp, Homo sapiens
cctgggacccagctac

SEQ ID NO: 1831162 - DNA, 18 bp, Homo sapiens
cctgggacccagctactc

SEQ ID NO: 1831163 - DNA, 23 bp, Homo sapiens
cctgggacccagctactctgtcc

SEQ ID NO: 1831164 - DNA, 18 bp, Homo sapiens
cctgggcctgtgcagcag

SEQ ID NO: 1831165 - DNA, 22 bp, Homo sapiens
cctgggcctgtgcagcagccca

SEQ ID NO: 1831166 - DNA, 12 bp, Homo sapiens
cctgggctctgt

SEQ ID NO: 1831167 - DNA, 13 bp, Homo sapiens
cctgggctctgtg

SEQ ID NO: 1831168 - DNA, 14 bp, Homo sapiens
cctgggctctgtgg

SEQ ID NO: 1831169 - DNA, 17 bp, Homo sapiens
cctggggccccgctggg

SEQ ID NO: 1831170 - DNA, 18 bp, Homo sapiens
cctggggccccgctggga

SEQ ID NO: 1831171 - DNA, 14 bp, Homo sapiens
cctgggggcagtga

SEQ ID NO: 1831172 - DNA, 18 bp, Homo sapiens
cctgggggcagtgactgg

SEQ ID NO: 1831173 - DNA, 20 bp, Homo sapiens
cctgggggcagtgactggca

SEQ ID NO: 1831174 - DNA, 22 bp, Homo sapiens
cctgggggcagtgactggcagg

SEQ ID NO: 1831175 - DNA, 16 bp, Homo sapiens
cctgggtgacttcagg

SEQ ID NO: 1831176 - DNA, 19 bp, Homo sapiens
cctgggtgacttcaggtgg

SEQ ID NO: 1831177 - DNA, 18 bp, Homo sapiens
cctggtactgcacatttt

SEQ ID NO: 1831178 - DNA, 21 bp, Homo sapiens
cctggtccctcgtccacaggg

SEQ ID NO: 1831179 - DNA, 15 bp, Homo sapiens
cctgtataagacact

SEQ ID NO: 1831180 - DNA, 13 bp, Homo sapiens
cctgtcagaggct

SEQ ID NO: 1831181 - DNA, 12 bp, Homo sapiens
cctgtcagtgcc

SEQ ID NO: 1831182 - DNA, 14 bp, Homo sapiens
cctgtcagtgccgc

SEQ ID NO: 1831183 - DNA, 23 bp, Homo sapiens
cctgtccactctcggggcccttg

SEQ ID NO: 1831184 - DNA, 23 bp, Homo sapiens
cctgtcccagaggttatctgcct

SEQ ID NO: 1831185 - DNA, 14 bp, Homo sapiens
cctgtcccccaagg

SEQ ID NO: 1831186 - DNA, 21 bp, Homo sapiens
cctgtctgtctgtctgtccca

SEQ ID NO: 1831187 - DNA, 15 bp, Homo sapiens
cctgtgactatggct

SEQ ID NO: 1831188 - DNA, 16 bp, Homo sapiens
cctgtgcagcagccca

SEQ ID NO: 1831189 - DNA, 18 bp, Homo sapiens
cctgtgcagcagcccagc

SEQ ID NO: 1831190 - DNA, 22 bp, Homo sapiens
cctgtgcagcagcccagcttcc

SEQ ID NO: 1831191 - DNA, 16 bp, Homo sapiens
cctgtggcagaaaaga

SEQ ID NO: 1831192 - DNA, 20 bp, Homo sapiens
cctgtggcagaaaagaggag

SEQ ID NO: 1831193 - DNA, 23 bp, Homo sapiens
cctgtggcagaaaagaggagacc

SEQ ID NO: 1831194 - DNA, 18 bp, Homo sapiens
cctgtgtccagcagctgc

SEQ ID NO: 1831195 - DNA, 21 bp, Homo sapiens
ccttaccaacagcttttccca

SEQ ID NO: 1831196 - DNA, 18 bp, Homo sapiens
ccttactctgagcccagg

SEQ ID NO: 1831197 - DNA, 17 bp, Homo sapiens
ccttcagaacagaggca

SEQ ID NO: 1831198 - DNA, 12 bp, Homo sapiens
ccttcagggcca

SEQ ID NO: 1831199 - DNA, 18 bp, Homo sapiens
ccttcagggccagaagga

SEQ ID NO: 1831200 - DNA, 15 bp, Homo sapiens
ccttcagtgagcccc

SEQ ID NO: 1831201 - DNA, 17 bp, Homo sapiens
ccttcagtgagcccctc

SEQ ID NO: 1831202 - DNA, 21 bp, Homo sapiens
ccttcccaaggttactcagca

SEQ ID NO: 1831203 - DNA, 23 bp, Homo sapiens
ccttccccgagggatgatgccac

SEQ ID NO: 1831204 - DNA, 18 bp, Homo sapiens
ccttccccttttgcctgg

SEQ ID NO: 1831205 - DNA, 13 bp, Homo sapiens
ccttccctggccc

SEQ ID NO: 1831206 - DNA, 22 bp, Homo sapiens
ccttcgtgtctctcccaccccg

SEQ ID NO: 1831207 - DNA, 14 bp, Homo sapiens
ccttctcccccccg

SEQ ID NO: 1831208 - DNA, 16 bp, Homo sapiens
ccttctcccccccggg

SEQ ID NO: 1831209 - DNA, 14 bp, Homo sapiens
ccttgaccattggc

SEQ ID NO: 1831210 - DNA, 16 bp, Homo sapiens
ccttggcacccccatg

SEQ ID NO: 1831211 - DNA, 22 bp, Homo sapiens
ccttgggagtcattaccacgcc

SEQ ID NO: 1831212 - DNA, 24 bp, Homo sapiens
ccttgggcatccacccagtgctgc

SEQ ID NO: 1831213 - DNA, 14 bp, Homo sapiens
ccttgggctcctgg

SEQ ID NO: 1831214 - DNA, 17 bp, Homo sapiens
ccttgggctcctggctg

SEQ ID NO: 1831215 - DNA, 22 bp, Homo sapiens
ccttgggctcctggctgccagg

SEQ ID NO: 1831216 - DNA, 14 bp, Homo sapiens
ccttggggcctggc

SEQ ID NO: 1831217 - DNA, 17 bp, Homo sapiens
ccttggggcctggcttg

SEQ ID NO: 1831218 - DNA, 18 bp, Homo sapiens
ccttgtcctgccagctgc

SEQ ID NO: 1831219 - DNA, 12 bp, Homo sapiens
ccttgtgcttgg

SEQ ID NO: 1831220 - DNA, 21 bp, Homo sapiens
ccttgtgcttggtggggctcg

SEQ ID NO: 1831221 - DNA, 22 bp, Homo sapiens
cctttgagggcagtggggagca

SEQ ID NO: 1831222 - DNA, 15 bp, Homo sapiens
ccttttacccctgca

SEQ ID NO: 1831223 - DNA, 16 bp, Homo sapiens
ccttttgcctggctgt

SEQ ID NO: 1831224 - DNA, 16 bp, Homo sapiens
cctttttttctctcct

SEQ ID NO: 1831225 - DNA, 20 bp, Homo sapiens
cgaaacctgtccataaagta

SEQ ID NO: 1831226 - DNA, 20 bp, Homo sapiens
cgaaccaaggcagcctccag

SEQ ID NO: 1831227 - DNA, 22 bp, Homo sapiens
cgaaggggccccggggctggca

SEQ ID NO: 1831228 - DNA, 16 bp, Homo sapiens
cgacactgctgcacca

SEQ ID NO: 1831229 - DNA, 20 bp, Homo sapiens
cgacactgctgcaccagagt

SEQ ID NO: 1831230 - DNA, 21 bp, Homo sapiens
cgacactgctgcaccagagtg

SEQ ID NO: 1831231 - DNA, 14 bp, Homo sapiens
cgaccccatctgcc

SEQ ID NO: 1831232 - DNA, 20 bp, Homo sapiens
cgacttgaattttcccactg

SEQ ID NO: 1831233 - DNA, 22 bp, Homo sapiens
cgacttttctaaagctctgaac

SEQ ID NO: 1831234 - DNA, 14 bp, Homo sapiens
cgagaggaggggcc

SEQ ID NO: 1831235 - DNA, 15 bp, Homo sapiens
cgagaggaggggccc

SEQ ID NO: 1831236 - DNA, 21 bp, Homo sapiens
cgagatgttcgctcgtgcagt

SEQ ID NO: 1831237 - DNA, 14 bp, Homo sapiens
cgagcaagccggca

SEQ ID NO: 1831238 - DNA, 16 bp, Homo sapiens
cgagcactggccagag

SEQ ID NO: 1831239 - DNA, 16 bp, Homo sapiens
cgaggcaccggcgctg

SEQ ID NO: 1831240 - DNA, 17 bp, Homo sapiens
cgaggttcccagggctg

SEQ ID NO: 1831241 - DNA, 21 bp, Homo sapiens
cgaggttcccagggctggaga

SEQ ID NO: 1831242 - DNA, 20 bp, Homo sapiens
cgatcttggctcactgcaac

SEQ ID NO: 1831243 - DNA, 18 bp, Homo sapiens
cgcaagggcatcaggcac

SEQ ID NO: 1831244 - DNA, 19 bp, Homo sapiens
cgcaagggcatcaggcact

SEQ ID NO: 1831245 - DNA, 13 bp, Homo sapiens
cgcaccagctgct

SEQ ID NO: 1831246 - DNA, 15 bp, Homo sapiens
ccccgcagtccccag

SEQ ID NO: 1831247 - DNA, 18 bp, Homo sapiens
ccccgcagtccccagccc

SEQ ID NO: 1831248 - DNA, 21 bp, Homo sapiens
ccccgcagtccccagcccttc

SEQ ID NO: 1831249 - DNA, 14 bp, Homo sapiens
ccccgcccaggctg

SEQ ID NO: 1831250 - DNA, 15 bp, Homo sapiens
ccccgcccaggctgg

SEQ ID NO: 1831251 - DNA, 16 bp, Homo sapiens
ccccgcccaggctggc

SEQ ID NO: 1831252 - DNA, 17 bp, Homo sapiens
ccccgcggtgctctggc

SEQ ID NO: 1831253 - DNA, 21 bp, Homo sapiens
ccccggggcgtttctttgccg

SEQ ID NO: 1831254 - DNA, 16 bp, Homo sapiens
ccccggggctggcaag

SEQ ID NO: 1831255 - DNA, 15 bp, Homo sapiens
ccccgtcggactgcc

SEQ ID NO: 1831256 - DNA, 14 bp, Homo sapiens
cccctcagcccttg

SEQ ID NO: 1831257 - DNA, 17 bp, Homo sapiens
cccctcagcccttgccc

SEQ ID NO: 1831258 - DNA, 11 bp, Homo sapiens
cccctccaggc

SEQ ID NO: 1831259 - DNA, 12 bp, Homo sapiens
cccctcccagct

SEQ ID NO: 1831260 - DNA, 13 bp, Homo sapiens
cccctcccagctg

SEQ ID NO: 1831261 - DNA, 22 bp, Homo sapiens
cccctcccagctgacagtcctc

SEQ ID NO: 1831262 - DNA, 12 bp, Homo sapiens
cccctccccagc

SEQ ID NO: 1831263 - DNA, 13 bp, Homo sapiens
cccctccccagcc

SEQ ID NO: 1831264 - DNA, 14 bp, Homo sapiens
cccctccccagccc

SEQ ID NO: 1831265 - DNA, 14 bp, Homo sapiens
cccctccctctgcc

SEQ ID NO: 1831266 - DNA, 17 bp, Homo sapiens
cccctccctctgcccca

SEQ ID NO: 1831267 - DNA, 14 bp, Homo sapiens
cccctccctgcctg

SEQ ID NO: 1831268 - DNA, 15 bp, Homo sapiens
cccctccctgcctgc

SEQ ID NO: 1831269 - DNA, 13 bp, Homo sapiens
cccctcctgctgc

SEQ ID NO: 1831270 - DNA, 14 bp, Homo sapiens
cccctcctgctgca

SEQ ID NO: 1831271 - DNA, 22 bp, Homo sapiens
cccctcctgctgcagaggggca

SEQ ID NO: 1831272 - DNA, 15 bp, Homo sapiens
cccctcgtgccagtc

SEQ ID NO: 1831273 - DNA, 13 bp, Homo sapiens
cccctctcgcccc

SEQ ID NO: 1831274 - DNA, 22 bp, Homo sapiens
cccctctgtcatcactccctgg

SEQ ID NO: 1831275 - DNA, 12 bp, Homo sapiens
cccctcttgccc

SEQ ID NO: 1831276 - DNA, 18 bp, Homo sapiens
cccctcttgccccaaccc

SEQ ID NO: 1831277 - DNA, 22 bp, Homo sapiens
cccctcttgccccaacccccag

SEQ ID NO: 1831278 - DNA, 14 bp, Homo sapiens
cccctgaggactgg

SEQ ID NO: 1831279 - DNA, 23 bp, Homo sapiens
cccctggtgcactggccccaccc

SEQ ID NO: 1831280 - DNA, 22 bp, Homo sapiens
ccccttaagggttgaaggcagt

SEQ ID NO: 1831281 - DNA, 16 bp, Homo sapiens
ccccttgggcatccac

SEQ ID NO: 1831282 - DNA, 16 bp, Homo sapiens
ccccttttcagcttct

SEQ ID NO: 1831283 - DNA, 18 bp, Homo sapiens
cccgacactgctgcacca

SEQ ID NO: 1831284 - DNA, 22 bp, Homo sapiens
cccgacactgctgcaccagagt

SEQ ID NO: 1831285 - DNA, 22 bp, Homo sapiens
cccgagggatgatgccacacca

SEQ ID NO: 1831286 - DNA, 19 bp, Homo sapiens
cccgcagtccccagccctt

SEQ ID NO: 1831287 - DNA, 12 bp, Homo sapiens
cccgcccaggct

SEQ ID NO: 1831288 - DNA, 18 bp, Homo sapiens
cccgcccaggctggccag

SEQ ID NO: 1831289 - DNA, 16 bp, Homo sapiens
cccgccttcctcctcc

SEQ ID NO: 1831290 - DNA, 15 bp, Homo sapiens
cccgcggtgctctgg

SEQ ID NO: 1831291 - DNA, 19 bp, Homo sapiens
cccgcggtgctctggcggc

SEQ ID NO: 1831292 - DNA, 12 bp, Homo sapiens
cccgctcccaca

SEQ ID NO: 1831293 - DNA, 21 bp, Homo sapiens
cccgctgggatttcttcgctg

SEQ ID NO: 1831294 - DNA, 12 bp, Homo sapiens
cccgcttgcctc

SEQ ID NO: 1831295 - DNA, 13 bp, Homo sapiens
cccggagcacagc

SEQ ID NO: 1831296 - DNA, 18 bp, Homo sapiens
cccggagcacagccctgg

SEQ ID NO: 1831297 - DNA, 21 bp, Homo sapiens
cccggagcacagccctgggag

SEQ ID NO: 1831298 - DNA, 22 bp, Homo sapiens
cccggagcacagccctgggagg

SEQ ID NO: 1831299 - DNA, 15 bp, Homo sapiens
cccggcctcttccac

SEQ ID NO: 1831300 - DNA, 19 bp, Homo sapiens
cccggcgccctctgtcctg

SEQ ID NO: 1831301 - DNA, 17 bp, Homo sapiens
cccgggaggggcccgct

SEQ ID NO: 1831302 - DNA, 23 bp, Homo sapiens
cccgggaggggcccgcttgcctc

SEQ ID NO: 1831303 - DNA, 20 bp, Homo sapiens
cccgtcggactgcccccaga

SEQ ID NO: 1831304 - DNA, 17 bp, Homo sapiens
cccgtgcagtacaggca

SEQ ID NO: 1831305 - DNA, 17 bp, Homo sapiens
cccgtggccccagcctg

SEQ ID NO: 1831306 - DNA, 16 bp, Homo sapiens
cccgttgtctccctgg

SEQ ID NO: 1831307 - DNA, 19 bp, Homo sapiens
cccgttgtctccctggccc

SEQ ID NO: 1831308 - DNA, 14 bp, Homo sapiens
ccctatctgtgatt

SEQ ID NO: 1831309 - DNA, 19 bp, Homo sapiens
ccctcaaggcctcccacag

SEQ ID NO: 1831310 - DNA, 20 bp, Homo sapiens
ccctcaaggcctcccacagt

SEQ ID NO: 1831311 - DNA, 22 bp, Homo sapiens
ccctccaggcatgctggcctcc

SEQ ID NO: 1831312 - DNA, 23 bp, Homo sapiens
ccctcccaacagagctgggctac

SEQ ID NO: 1831313 - DNA, 17 bp, Homo sapiens
ccctcccagctgacagt

SEQ ID NO: 1831314 - DNA, 18 bp, Homo sapiens
ccctccccacagtcctca

SEQ ID NO: 1831315 - DNA, 12 bp, Homo sapiens
ccctccccagcc

SEQ ID NO: 1831316 - DNA, 14 bp, Homo sapiens
ccctccccagccag

SEQ ID NO: 1831317 - DNA, 18 bp, Homo sapiens
ccctccccagccagccct

SEQ ID NO: 1831318 - DNA, 20 bp, Homo sapiens
ccctccccagccagcccttc

SEQ ID NO: 1831319 - DNA, 18 bp, Homo sapiens
ccctcccctggggacgcc

SEQ ID NO: 1831320 - DNA, 14 bp, Homo sapiens
ccctccctccttcc

SEQ ID NO: 1831321 - DNA, 13 bp, Homo sapiens
ccctccctctgcc

SEQ ID NO: 1831322 - DNA, 13 bp, Homo sapiens
ccctccctgcctg

SEQ ID NO: 1831323 - DNA, 16 bp, Homo sapiens
ccctccctgcctgctc

SEQ ID NO: 1831324 - DNA, 19 bp, Homo sapiens
ccctccctgctgtcccctc

SEQ ID NO: 1831325 - DNA, 20 bp, Homo sapiens
ccctcctacccctcccagct

SEQ ID NO: 1831326 - DNA, 22 bp, Homo sapiens
ccctcctacccctcccagctga

SEQ ID NO: 1831327 - DNA, 19 bp, Homo sapiens
ccctcgaaccaaggcagcc

SEQ ID NO: 1831328 - DNA, 21 bp, Homo sapiens
ccctcgaaccaaggcagcctc

SEQ ID NO: 1831329 - DNA, 22 bp, Homo sapiens
ccctcgaaccaaggcagcctcc

SEQ ID NO: 1831330 - DNA, 22 bp, Homo sapiens
ccctcggaagccgtctgactcc

SEQ ID NO: 1831331 - DNA, 19 bp, Homo sapiens
ccctcgtccacaggggcag

SEQ ID NO: 1831332 - DNA, 24 bp, Homo sapiens
ccctcgtccacaggggcaggcctg

SEQ ID NO: 1831333 - DNA, 13 bp, Homo sapiens
ccctcgtgccagt

SEQ ID NO: 1831334 - DNA, 17 bp, Homo sapiens
ccctcgtggacacctgc

SEQ ID NO: 1831335 - DNA, 22 bp, Homo sapiens
ccctcgtggacacctgccctgc

SEQ ID NO: 1831336 - DNA, 23 bp, Homo sapiens
ccctcgtggacacctgccctgcc

SEQ ID NO: 1831337 - DNA, 22 bp, Homo sapiens
ccctctcgccccatccctgctt

SEQ ID NO: 1831338 - DNA, 20 bp, Homo sapiens
ccctctgccccaagcagcca

SEQ ID NO: 1831339 - DNA, 22 bp, Homo sapiens
ccctctgccccaagcagccagc

SEQ ID NO: 1831340 - DNA, 15 bp, Homo sapiens
ccctctgtcctgact

SEQ ID NO: 1831341 - DNA, 15 bp, Homo sapiens
ccctgagactccaga

SEQ ID NO: 1831342 - DNA, 16 bp, Homo sapiens
ccctgaggactggaga

SEQ ID NO: 1831343 - DNA, 18 bp, Homo sapiens
ccctgaggactggagacc

SEQ ID NO: 1831344 - DNA, 15 bp, Homo sapiens
ccctgcactgtcctg

SEQ ID NO: 1831345 - DNA, 18 bp, Homo sapiens
ccctgcactgtcctgctc

SEQ ID NO: 1831346 - DNA, 19 bp, Homo sapiens
ccctgcactgtcctgctcc

SEQ ID NO: 1831347 - DNA, 20 bp, Homo sapiens
ccctgcactgtcctgctcca

SEQ ID NO: 1831348 - DNA, 14 bp, Homo sapiens
ccctgccagtgaag

SEQ ID NO: 1831349 - DNA, 12 bp, Homo sapiens
ccctgcctgccc

SEQ ID NO: 1831350 - DNA, 21 bp, Homo sapiens
ccctgcgtcctgacgccctgc

SEQ ID NO: 1831351 - DNA, 12 bp, Homo sapiens
ccctgctgtccc

SEQ ID NO: 1831352 - DNA, 16 bp, Homo sapiens
ccctgctgtcccctct

SEQ ID NO: 1831353 - DNA, 18 bp, Homo sapiens
ccctgctgtcccctcttg

SEQ ID NO: 1831354 - DNA, 19 bp, Homo sapiens
ccctgcttgcccgctccca

SEQ ID NO: 1831355 - DNA, 9 bp, Homo sapiens
ccctggaat

SEQ ID NO: 1831356 - DNA, 23 bp, Homo sapiens
ccctggaattcagcaccctgggt

SEQ ID NO: 1831357 - DNA, 23 bp, Homo sapiens
ccctggactggtggcccctgcct

SEQ ID NO: 1831358 - DNA, 17 bp, Homo sapiens
ccctggatgggcattgg

SEQ ID NO: 1831359 - DNA, 21 bp, Homo sapiens
ccctggatgtgtggggcatgg

SEQ ID NO: 1831360 - DNA, 13 bp, Homo sapiens
ccctggccctcaa

SEQ ID NO: 1831361 - DNA, 14 bp, Homo sapiens
ccctgggctctgtg

SEQ ID NO: 1831362 - DNA, 20 bp, Homo sapiens
ccctgggtgccattcccagc

SEQ ID NO: 1831363 - DNA, 15 bp, Homo sapiens
ccctggtaagcagag

SEQ ID NO: 1831364 - DNA, 18 bp, Homo sapiens
ccctggtaagcagaggct

SEQ ID NO: 1831365 - DNA, 13 bp, Homo sapiens
cgcagtccccagc

SEQ ID NO: 1831366 - DNA, 16 bp, Homo sapiens
cgcagtccccagccct

SEQ ID NO: 1831367 - DNA, 21 bp, Homo sapiens
cgcagtccccagcccttctgc

SEQ ID NO: 1831368 - DNA, 13 bp, Homo sapiens
cgcatgccccctc

SEQ ID NO: 1831369 - DNA, 19 bp, Homo sapiens
cgccaaggaggtgggccac

SEQ ID NO: 1831370 - DNA, 20 bp, Homo sapiens
cgccatggcttccaaggtgg

SEQ ID NO: 1831371 - DNA, 13 bp, Homo sapiens
cgcccaccgcatg

SEQ ID NO: 1831372 - DNA, 18 bp, Homo sapiens
cgcccaccgcatgccccc

SEQ ID NO: 1831373 - DNA, 19 bp, Homo sapiens
cgcccaggctggccagccc

SEQ ID NO: 1831374 - DNA, 14 bp, Homo sapiens
cgccctctgtcctg

SEQ ID NO: 1831375 - DNA, 17 bp, Homo sapiens
cgccctctgtcctgact

SEQ ID NO: 1831376 - DNA, 16 bp, Homo sapiens
cgccgcctcgcccacc

SEQ ID NO: 1831377 - DNA, 14 bp, Homo sapiens
cgcctcgcccaccg

SEQ ID NO: 1831378 - DNA, 16 bp, Homo sapiens
cgcctcgcccaccgca

SEQ ID NO: 1831379 - DNA, 18 bp, Homo sapiens
cgccttcctcctccacag

SEQ ID NO: 1831380 - DNA, 13 bp, Homo sapiens
cgccttctccccc

SEQ ID NO: 1831381 - DNA, 19 bp, Homo sapiens
cgccttgaccttcccaagg

SEQ ID NO: 1831382 - DNA, 15 bp, Homo sapiens
cgcgggaggcaccag

SEQ ID NO: 1831383 - DNA, 13 bp, Homo sapiens
cgcggtgctctgg

SEQ ID NO: 1831384 - DNA, 15 bp, Homo sapiens
cgcggtgctctggcg

SEQ ID NO: 1831385 - DNA, 16 bp, Homo sapiens
cgcggtgctctggcgg

SEQ ID NO: 1831386 - DNA, 15 bp, Homo sapiens
cgctaggagagactg

SEQ ID NO: 1831387 - DNA, 15 bp, Homo sapiens
cgctcaggacccagg

SEQ ID NO: 1831388 - DNA, 20 bp, Homo sapiens
cgctcaggacccaggccctc

SEQ ID NO: 1831389 - DNA, 22 bp, Homo sapiens
cgctcaggacccaggccctcca

SEQ ID NO: 1831390 - DNA, 14 bp, Homo sapiens
cgctcccagtgtct

SEQ ID NO: 1831391 - DNA, 21 bp, Homo sapiens
cgctcccagtgtcttcctgtg

SEQ ID NO: 1831392 - DNA, 19 bp, Homo sapiens
cgctcccccgcagtcccca

SEQ ID NO: 1831393 - DNA, 22 bp, Homo sapiens
cgctcccccgcagtccccagcc

SEQ ID NO: 1831394 - DNA, 16 bp, Homo sapiens
cgctgatgctgggctg

SEQ ID NO: 1831395 - DNA, 18 bp, Homo sapiens
cgctgccaccacgtctgc

SEQ ID NO: 1831396 - DNA, 23 bp, Homo sapiens
cgctgccaccacgtctgccaggc

SEQ ID NO: 1831397 - DNA, 19 bp, Homo sapiens
cgctgcccggcgccctctg

SEQ ID NO: 1831398 - DNA, 21 bp, Homo sapiens
cgctgcccggcgccctctgtc

SEQ ID NO: 1831399 - DNA, 17 bp, Homo sapiens
cgctgctctagctggca

SEQ ID NO: 1831400 - DNA, 22 bp, Homo sapiens
cgctgggatttcttcgctgctc

SEQ ID NO: 1831401 - DNA, 22 bp, Homo sapiens
cgctgtgttactaatgatcact

SEQ ID NO: 1831402 - DNA, 16 bp, Homo sapiens
cgcttcacccctgcac

SEQ ID NO: 1831403 - DNA, 17 bp, Homo sapiens
cgcttgagcccaggagt

SEQ ID NO: 1831404 - DNA, 11 bp, Homo sapiens
cgcttgcctcg

SEQ ID NO: 1831405 - DNA, 14 bp, Homo sapiens
cgcttgcctcggct

SEQ ID NO: 1831406 - DNA, 16 bp, Homo sapiens
cgcttgcctcggctcc

SEQ ID NO: 1831407 - DNA, 22 bp, Homo sapiens
cgcttgcctcggctcctgctgc

SEQ ID NO: 1831408 - DNA, 20 bp, Homo sapiens
cggacccaccaaactgcaca

SEQ ID NO: 1831409 - DNA, 16 bp, Homo sapiens
cggactgcccccagaa

SEQ ID NO: 1831410 - DNA, 14 bp, Homo sapiens
cggagcacagccct

SEQ ID NO: 1831411 - DNA, 16 bp, Homo sapiens
cggagcacagccctgg

SEQ ID NO: 1831412 - DNA, 14 bp, Homo sapiens
cggatgtataaatg

SEQ ID NO: 1831413 - DNA, 15 bp, Homo sapiens
cggatgtataaatgt

SEQ ID NO: 1831414 - DNA, 14 bp, Homo sapiens
cggcctccactccc

SEQ ID NO: 1831415 - DNA, 22 bp, Homo sapiens
cggcctccactcccccacctga

SEQ ID NO: 1831416 - DNA, 17 bp, Homo sapiens
cggcctcttccacccat

SEQ ID NO: 1831417 - DNA, 17 bp, Homo sapiens
cggcgccctctgtcctg

SEQ ID NO: 1831418 - DNA, 18 bp, Homo sapiens
cggcgccctctgtcctga

SEQ ID NO: 1831419 - DNA, 13 bp, Homo sapiens
cggcgctgcaggt

SEQ ID NO: 1831420 - DNA, 23 bp, Homo sapiens
cggctcctgctgcaccaacccag

SEQ ID NO: 1831421 - DNA, 13 bp, Homo sapiens
cggctgcctgccg

SEQ ID NO: 1831422 - DNA, 14 bp, Homo sapiens
cggctgcctgccgc

SEQ ID NO: 1831423 - DNA, 22 bp, Homo sapiens
cggctgcctgccgcccaaagag

SEQ ID NO: 1831424 - DNA, 20 bp, Homo sapiens
cgggaaaggatggagtgttt

SEQ ID NO: 1831425 - DNA, 19 bp, Homo sapiens
cgggaggcaccagctctgt

SEQ ID NO: 1831426 - DNA, 21 bp, Homo sapiens
cgggaggcaccagctctgtgg

SEQ ID NO: 1831427 - DNA, 13 bp, Homo sapiens
cgggcccaggcca

SEQ ID NO: 1831428 - DNA, 14 bp, Homo sapiens
cgggctcctgtgcc

SEQ ID NO: 1831429 - DNA, 15 bp, Homo sapiens
cgggctcctgtgccc

SEQ ID NO: 1831430 - DNA, 16 bp, Homo sapiens
cgggctcctgtgccct

SEQ ID NO: 1831431 - DNA, 17 bp, Homo sapiens
cgggctcctgtgccctt

SEQ ID NO: 1831432 - DNA, 16 bp, Homo sapiens
cggggcaaggtctcct

SEQ ID NO: 1831433 - DNA, 12 bp, Homo sapiens
cggggctggcaa

SEQ ID NO: 1831434 - DNA, 21 bp, Homo sapiens
cggggctgggttggcgcaccc

SEQ ID NO: 1831435 - DNA, 19 bp, Homo sapiens
cggggtctgtgctgtgcct

SEQ ID NO: 1831436 - DNA, 22 bp, Homo sapiens
cgggtcatctgtacctctgcct

SEQ ID NO: 1831437 - DNA, 14 bp, Homo sapiens
cgggtgggcctggc

SEQ ID NO: 1831438 - DNA, 16 bp, Homo sapiens
cgggtgggcctggcct

SEQ ID NO: 1831439 - DNA, 20 bp, Homo sapiens
cgggtgggcctggcctgagc

SEQ ID NO: 1831440 - DNA, 22 bp, Homo sapiens
cgggtgggcctggcctgagctg

SEQ ID NO: 1831441 - DNA, 13 bp, Homo sapiens
cggtgctctggcg

SEQ ID NO: 1831442 - DNA, 21 bp, Homo sapiens
cggtggtaccaggtctcctcc

SEQ ID NO: 1831443 - DNA, 19 bp, Homo sapiens
cgtaagatggcttatttgt

SEQ ID NO: 1831444 - DNA, 13 bp, Homo sapiens
cgtaatgggcctg

SEQ ID NO: 1831445 - DNA, 14 bp, Homo sapiens
cgtaatgggcctgc

SEQ ID NO: 1831446 - DNA, 17 bp, Homo sapiens
cgtaatgggcctgccca

SEQ ID NO: 1831447 - DNA, 23 bp, Homo sapiens
cgtattacaagagaaacaaataa

SEQ ID NO: 1831448 - DNA, 14 bp, Homo sapiens
cgtattctaattct

SEQ ID NO: 1831449 - DNA, 23 bp, Homo sapiens
cgtcaagttgcagatctttttgt

SEQ ID NO: 1831450 - DNA, 15 bp, Homo sapiens
cgtccacaggggcag

SEQ ID NO: 1831451 - DNA, 19 bp, Homo sapiens
cgtccatggcaccagcccc

SEQ ID NO: 1831452 - DNA, 12 bp, Homo sapiens
cgtcctgcagag

SEQ ID NO: 1831453 - DNA, 16 bp, Homo sapiens
cgtcctgtcccagagg

SEQ ID NO: 1831454 - DNA, 15 bp, Homo sapiens
cgtctgactccagag

SEQ ID NO: 1831455 - DNA, 17 bp, Homo sapiens
cgtctgactccagagtc

SEQ ID NO: 1831456 - DNA, 18 bp, Homo sapiens
cgtctgactccagagtct

SEQ ID NO: 1831457 - DNA, 19 bp, Homo sapiens
cgtctgactccagagtctg

SEQ ID NO: 1831458 - DNA, 23 bp, Homo sapiens
cgtctgactccagagtctgagcc

SEQ ID NO: 1831459 - DNA, 12 bp, Homo sapiens
cgtctgccaggc

SEQ ID NO: 1831460 - DNA, 13 bp, Homo sapiens
cgtctgccaggcc

SEQ ID NO: 1831461 - DNA, 15 bp, Homo sapiens
cgtgaagcagtgcct

SEQ ID NO: 1831462 - DNA, 20 bp, Homo sapiens
cgtgaagcagtgcctcgagg

SEQ ID NO: 1831463 - DNA, 20 bp, Homo sapiens
cgtgacccttcagggccaga

SEQ ID NO: 1831464 - DNA, 17 bp, Homo sapiens
cgtgccagtcgcgctgc

SEQ ID NO: 1831465 - DNA, 22 bp, Homo sapiens
cgtgccagtcgcgctgcctgtg

SEQ ID NO: 1831466 - DNA, 12 bp, Homo sapiens
cgtggaaacaca

SEQ ID NO: 1831467 - DNA, 12 bp, Homo sapiens
cgtggacacctg

SEQ ID NO: 1831468 - DNA, 13 bp, Homo sapiens
cgtggccccagcc

SEQ ID NO: 1831469 - DNA, 15 bp, Homo sapiens
cgtggccccagcctg

SEQ ID NO: 1831470 - DNA, 16 bp, Homo sapiens
cgtggccccagcctgg

SEQ ID NO: 1831471 - DNA, 18 bp, Homo sapiens
cgtggccccagcctggcc

SEQ ID NO: 1831472 - DNA, 21 bp, Homo sapiens
cgtggccccagcctggcccag

SEQ ID NO: 1831473 - DNA, 12 bp, Homo sapiens
cgtggctgtggc

SEQ ID NO: 1831474 - DNA, 13 bp, Homo sapiens
cgtggctgtggca

SEQ ID NO: 1831475 - DNA, 23 bp, Homo sapiens
cgtgtctctcccaccccggcctc

SEQ ID NO: 1831476 - DNA, 14 bp, Homo sapiens
cgttccccttggct

SEQ ID NO: 1831477 - DNA, 13 bp, Homo sapiens
cgttccctgtcag

SEQ ID NO: 1831478 - DNA, 18 bp, Homo sapiens
cgttccctgtcagaggct

SEQ ID NO: 1831479 - DNA, 12 bp, Homo sapiens
cgttggagccac

SEQ ID NO: 1831480 - DNA, 13 bp, Homo sapiens
cgttgtctccctg

SEQ ID NO: 1831481 - DNA, 12 bp, Homo sapiens
ctaaaatcgtat

SEQ ID NO: 1831482 - DNA, 15 bp, Homo sapiens
ctaaaatcgtattct

SEQ ID NO: 1831483 - DNA, 22 bp, Homo sapiens
ctaaaatcgtattctaattctt

SEQ ID NO: 1831484 - DNA, 23 bp, Homo sapiens
ctaaagagttattcaaatgaagg

SEQ ID NO: 1831485 - DNA, 19 bp, Homo sapiens
ctaaagccatttgtctgtg

SEQ ID NO: 1831486 - DNA, 22 bp, Homo sapiens
ctaaaggtgtaagacttcagat

SEQ ID NO: 1831487 - DNA, 16 bp, Homo sapiens
ctaaagtcacatataa

SEQ ID NO: 1831488 - DNA, 16 bp, Homo sapiens
ctaaataacacagata

SEQ ID NO: 1831489 - DNA, 15 bp, Homo sapiens
ctaaatgcccagttc

SEQ ID NO: 1831490 - DNA, 18 bp, Homo sapiens
ctaacatcctgctttgat

SEQ ID NO: 1831491 - DNA, 19 bp, Homo sapiens
ctaacccccagcccacaga

SEQ ID NO: 1831492 - DNA, 21 bp, Homo sapiens
ctaacccccagcccacagagc

SEQ ID NO: 1831493 - DNA, 20 bp, Homo sapiens
ctaagatgagatttgccagc

SEQ ID NO: 1831494 - DNA, 21 bp, Homo sapiens
ctaagccctcgaaccaaggca

SEQ ID NO: 1831495 - DNA, 13 bp, Homo sapiens
ctaagtcttgtct

SEQ ID NO: 1831496 - DNA, 16 bp, Homo sapiens
ctaagtcttgtctcat

SEQ ID NO: 1831497 - DNA, 15 bp, Homo sapiens
ctaagttaaatcatt

SEQ ID NO: 1831498 - DNA, 18 bp, Homo sapiens
ctaagttaaatcattttc

SEQ ID NO: 1831499 - DNA, 21 bp, Homo sapiens
ctaagttaaatcattttcatt

SEQ ID NO: 1831500 - DNA, 15 bp, Homo sapiens
ctaagttcagttctg

SEQ ID NO: 1831501 - DNA, 15 bp, Homo sapiens
ctaatacttactgtt

SEQ ID NO: 1831502 - DNA, 18 bp, Homo sapiens
ctaatccatgtgctgctg

SEQ ID NO: 1831503 - DNA, 13 bp, Homo sapiens
ctaattctgggaa

SEQ ID NO: 1831504 - DNA, 22 bp, Homo sapiens
ctaattctttgacctgttggga

SEQ ID NO: 1831505 - DNA, 14 bp, Homo sapiens
ctaattgtggtaga

SEQ ID NO: 1831506 - DNA, 18 bp, Homo sapiens
ctaattgtggtagaaatt

SEQ ID NO: 1831507 - DNA, 19 bp, Homo sapiens
ctaattgtggtagaaattt

SEQ ID NO: 1831508 - DNA, 18 bp, Homo sapiens
ctacacatatatgtatat

SEQ ID NO: 1831509 - DNA, 18 bp, Homo sapiens
ctaccccccctcctgctg

SEQ ID NO: 1831510 - DNA, 13 bp, Homo sapiens
ctaccctccctgc

SEQ ID NO: 1831511 - DNA, 15 bp, Homo sapiens
ctaccctccctgctg

SEQ ID NO: 1831512 - DNA, 20 bp, Homo sapiens
ctacctttttttctctccta

SEQ ID NO: 1831513 - DNA, 22 bp, Homo sapiens
ctactctggaggtttgtttaga

SEQ ID NO: 1831514 - DNA, 13 bp, Homo sapiens
ctactctgtccag

SEQ ID NO: 1831515 - DNA, 18 bp, Homo sapiens
ctactctgtccaggccac

SEQ ID NO: 1831516 - DNA, 21 bp, Homo sapiens
ctactgataacgtattttgat

SEQ ID NO: 1831517 - DNA, 14 bp, Homo sapiens
ctactggcagctcc

SEQ ID NO: 1831518 - DNA, 15 bp, Homo sapiens
ctactggcagctcct

SEQ ID NO: 1831519 - DNA, 18 bp, Homo sapiens
ctacttgtgactgaaggg

SEQ ID NO: 1831520 - DNA, 13 bp, Homo sapiens
ctacttttcagaa

SEQ ID NO: 1831521 - DNA, 12 bp, Homo sapiens
ctagaaaatgaa

SEQ ID NO: 1831522 - DNA, 14 bp, Homo sapiens
ctagaaagaaaaga

SEQ ID NO: 1831523 - DNA, 16 bp, Homo sapiens
ctagactggagtgagg

SEQ ID NO: 1831524 - DNA, 19 bp, Homo sapiens
ctagactggagtgaggctt

SEQ ID NO: 1831525 - DNA, 18 bp, Homo sapiens
ctagactttcctttgcac

SEQ ID NO: 1831526 - DNA, 20 bp, Homo sapiens
ctagactttcctttgcacca

SEQ ID NO: 1831527 - DNA, 21 bp, Homo sapiens
ctagagcaacccctgtaccca

SEQ ID NO: 1831528 - DNA, 12 bp, Homo sapiens
ctagaggcctca

SEQ ID NO: 1831529 - DNA, 17 bp, Homo sapiens
ctagaggtgggcagctg

SEQ ID NO: 1831530 - DNA, 19 bp, Homo sapiens
ctagaggtgggcagctggg

SEQ ID NO: 1831531 - DNA, 20 bp, Homo sapiens
ctagaggtgggcagctgggc

SEQ ID NO: 1831532 - DNA, 14 bp, Homo sapiens
ctagccaaggctag

SEQ ID NO: 1831533 - DNA, 14 bp, Homo sapiens
ctagccaggagtct

SEQ ID NO: 1831534 - DNA, 17 bp, Homo sapiens
ctagcccagtgcttctc

SEQ ID NO: 1831535 - DNA, 13 bp, Homo sapiens
ctagctggcagga

SEQ ID NO: 1831536 - DNA, 14 bp, Homo sapiens
ctaggactgaggag

SEQ ID NO: 1831537 - DNA, 18 bp, Homo sapiens
ctaggactgaggagtggg

SEQ ID NO: 1831538 - DNA, 23 bp, Homo sapiens
ctaggagttgagtacagtgagga

SEQ ID NO: 1831539 - DNA, 14 bp, Homo sapiens
ctaggattcctccc

SEQ ID NO: 1831540 - DNA, 22 bp, Homo sapiens
ctaggattcctcccccagagcc

SEQ ID NO: 1831541 - DNA, 22 bp, Homo sapiens
ctaggccaaatgcacaagctca

SEQ ID NO: 1831542 - DNA, 21 bp, Homo sapiens
ctagtaccctatagagagggg

SEQ ID NO: 1831543 - DNA, 15 bp, Homo sapiens
ctagtactctctgct

SEQ ID NO: 1831544 - DNA, 16 bp, Homo sapiens
ctagtactctctgctc

SEQ ID NO: 1831545 - DNA, 18 bp, Homo sapiens
ctagtactctctgctcta

SEQ ID NO: 1831546 - DNA, 21 bp, Homo sapiens
ctagtatattagtttgattta

SEQ ID NO: 1831547 - DNA, 18 bp, Homo sapiens
ctagtgcctagaaagcaa

SEQ ID NO: 1831548 - DNA, 19 bp, Homo sapiens
ctagtgcctagaaagcaat

SEQ ID NO: 1831549 - DNA, 16 bp, Homo sapiens
ctagtggctgtccagt

SEQ ID NO: 1831550 - DNA, 18 bp, Homo sapiens
ctagtggctgtccagtgc

SEQ ID NO: 1831551 - DNA, 18 bp, Homo sapiens
ctagtgtgagtggcagcc

SEQ ID NO: 1831552 - DNA, 21 bp, Homo sapiens
ctagtgtgagtggcagccatg

SEQ ID NO: 1831553 - DNA, 14 bp, Homo sapiens
ctatagagaggggg

SEQ ID NO: 1831554 - DNA, 16 bp, Homo sapiens
ctatatggtttttcca

SEQ ID NO: 1831555 - DNA, 13 bp, Homo sapiens
ctatatttattta

SEQ ID NO: 1831556 - DNA, 16 bp, Homo sapiens
ctatattttttaaatt

SEQ ID NO: 1831557 - DNA, 13 bp, Homo sapiens
ctcagagcagagc

SEQ ID NO: 1831558 - DNA, 14 bp, Homo sapiens
ctcagagcagagca

SEQ ID NO: 1831559 - DNA, 15 bp, Homo sapiens
ctcagagtctatcaa

SEQ ID NO: 1831560 - DNA, 14 bp, Homo sapiens
ctcagcagccccct

SEQ ID NO: 1831561 - DNA, 18 bp, Homo sapiens
ctcagcagccccctgccc

SEQ ID NO: 1831562 - DNA, 13 bp, Homo sapiens
ctcagcccttgcc

SEQ ID NO: 1831563 - DNA, 18 bp, Homo sapiens
ctcagcccttgcccccat

SEQ ID NO: 1831564 - DNA, 13 bp, Homo sapiens
ctcaggacccagg

SEQ ID NO: 1831565 - DNA, 14 bp, Homo sapiens
ctcaggacccaggc

SEQ ID NO: 1831566 - DNA, 19 bp, Homo sapiens
ctcaggacccaggccctcc

SEQ ID NO: 1831567 - DNA, 20 bp, Homo sapiens
ctcaggcaagcccctcagcc

SEQ ID NO: 1831568 - DNA, 21 bp, Homo sapiens
ctcaggcaagcccctcagccc

SEQ ID NO: 1831569 - DNA, 22 bp, Homo sapiens
ctcaggcaagcccctcagccct

SEQ ID NO: 1831570 - DNA, 20 bp, Homo sapiens
ctcaggtgccactccctgag

SEQ ID NO: 1831571 - DNA, 21 bp, Homo sapiens
ctcaggtgccactccctgagc

SEQ ID NO: 1831572 - DNA, 22 bp, Homo sapiens
ctcaggtgccactccctgagct

SEQ ID NO: 1831573 - DNA, 21 bp, Homo sapiens
ctcagtacacttcctgtgcca

SEQ ID NO: 1831574 - DNA, 20 bp, Homo sapiens
ctcagtcagttcccggagca

SEQ ID NO: 1831575 - DNA, 16 bp, Homo sapiens
ctcagtttctccatca

SEQ ID NO: 1831576 - DNA, 18 bp, Homo sapiens
ctcagtttctccatcagc

SEQ ID NO: 1831577 - DNA, 19 bp, Homo sapiens
ctcagtttctccatcagct

SEQ ID NO: 1831578 - DNA, 17 bp, Homo sapiens
ctcatcccctcgtcctg

SEQ ID NO: 1831579 - DNA, 21 bp, Homo sapiens
ctcatgcctggcccccctcca

SEQ ID NO: 1831580 - DNA, 19 bp, Homo sapiens
ctcatggcgtaatgggcct

SEQ ID NO: 1831581 - DNA, 16 bp, Homo sapiens
ctcattccaagcactt

SEQ ID NO: 1831582 - DNA, 14 bp, Homo sapiens
ctcattccccgggg

SEQ ID NO: 1831583 - DNA, 18 bp, Homo sapiens
ctcattggggttgcaaca

SEQ ID NO: 1831584 - DNA, 20 bp, Homo sapiens
ctcatttaatatttttcaaa

SEQ ID NO: 1831585 - DNA, 22 bp, Homo sapiens
ctcatttaatatttttcaaaat

SEQ ID NO: 1831586 - DNA, 16 bp, Homo sapiens
ctcattttactaaaat

SEQ ID NO: 1831587 - DNA, 13 bp, Homo sapiens
ctccacagtgttg

SEQ ID NO: 1831588 - DNA, 16 bp, Homo sapiens
ctccaccgccatggct

SEQ ID NO: 1831589 - DNA, 22 bp, Homo sapiens
ctccacggtgcgtggctgtggc

SEQ ID NO: 1831590 - DNA, 14 bp, Homo sapiens
ctccactcccactt

SEQ ID NO: 1831591 - DNA, 18 bp, Homo sapiens
ctccactcccccacctga

SEQ ID NO: 1831592 - DNA, 22 bp, Homo sapiens
ctccactctccttcgtgtctct

SEQ ID NO: 1831593 - DNA, 19 bp, Homo sapiens
ctccagaatctgctgttgc

SEQ ID NO: 1831594 - DNA, 21 bp, Homo sapiens
ctccagaatctgctgttgcca

SEQ ID NO: 1831595 - DNA, 18 bp, Homo sapiens
ctccagagaagtttcgag

SEQ ID NO: 1831596 - DNA, 13 bp, Homo sapiens
ctccagagccagc

SEQ ID NO: 1831597 - DNA, 16 bp, Homo sapiens
ctccagagccagcctg

SEQ ID NO: 1831598 - DNA, 17 bp, Homo sapiens
ctccagagtctgagccc

SEQ ID NO: 1831599 - DNA, 20 bp, Homo sapiens
ctccagagtctgagcccccg

SEQ ID NO: 1831600 - DNA, 23 bp, Homo sapiens
ctccagcctcccctcccctgggg

SEQ ID NO: 1831601 - DNA, 14 bp, Homo sapiens
ctccagcctctccc

SEQ ID NO: 1831602 - DNA, 20 bp, Homo sapiens
ctccagcctctcccggctgc

SEQ ID NO: 1831603 - DNA, 17 bp, Homo sapiens
ctccagggcccccaccg

SEQ ID NO: 1831604 - DNA, 20 bp, Homo sapiens
ctccagggtcttgggctact

SEQ ID NO: 1831605 - DNA, 22 bp, Homo sapiens
ctccagggtcttgggctactgg

SEQ ID NO: 1831606 - DNA, 13 bp, Homo sapiens
ctccatcccctcc

SEQ ID NO: 1831607 - DNA, 14 bp, Homo sapiens
ctccatcccctccc

SEQ ID NO: 1831608 - DNA, 15 bp, Homo sapiens
ctccatcccctccct

SEQ ID NO: 1831609 - DNA, 17 bp, Homo sapiens
ctccatcccctccctgc

SEQ ID NO: 1831610 - DNA, 18 bp, Homo sapiens
ctccatcccctccctgcc

SEQ ID NO: 1831611 - DNA, 21 bp, Homo sapiens
ctccatgtagaataaatgaag

SEQ ID NO: 1831612 - DNA, 18 bp, Homo sapiens
ctcccaataaagctggac

SEQ ID NO: 1831613 - DNA, 15 bp, Homo sapiens
ctcccacagcttcct

SEQ ID NO: 1831614 - DNA, 19 bp, Homo sapiens
ctcccacagcttcctgagg

SEQ ID NO: 1831615 - DNA, 22 bp, Homo sapiens
ctcccaccagaacgcaccccac

SEQ ID NO: 1831616 - DNA, 18 bp, Homo sapiens
ctcccaccccggcctcca

SEQ ID NO: 1831617 - DNA, 15 bp, Homo sapiens
ctcccagacaggccc

SEQ ID NO: 1831618 - DNA, 22 bp, Homo sapiens
ctcccagacaggccctccctgt

SEQ ID NO: 1831619 - DNA, 23 bp, Homo sapiens
ctcccagacaggccctccctgtc

SEQ ID NO: 1831620 - DNA, 17 bp, Homo sapiens
ctcccagtgtcttcctg

SEQ ID NO: 1831621 - DNA, 19 bp, Homo sapiens
ctcccagtgtcttcctgtg

SEQ ID NO: 1831622 - DNA, 21 bp, Homo sapiens
ctcccagtgtcttcctgtggg

SEQ ID NO: 1831623 - DNA, 14 bp, Homo sapiens
ctcccatggccttc

SEQ ID NO: 1831624 - DNA, 14 bp, Homo sapiens
ctccccacagtcct

SEQ ID NO: 1831625 - DNA, 15 bp, Homo sapiens
ctcctggctgccagg

SEQ ID NO: 1831626 - DNA, 16 bp, Homo sapiens
ctcctggctgccaggc

SEQ ID NO: 1831627 - DNA, 18 bp, Homo sapiens
ctccttactctgagccca

SEQ ID NO: 1831628 - DNA, 15 bp, Homo sapiens
ctccttcgtgtctct

SEQ ID NO: 1831629 - DNA, 19 bp, Homo sapiens
ctccttcgtgtctctccca

SEQ ID NO: 1831630 - DNA, 18 bp, Homo sapiens
ctccttggcacccccatg

SEQ ID NO: 1831631 - DNA, 16 bp, Homo sapiens
ctccttgggctcctgg

SEQ ID NO: 1831632 - DNA, 17 bp, Homo sapiens
ctccttgggctcctggc

SEQ ID NO: 1831633 - DNA, 21 bp, Homo sapiens
ctccttgggctcctggctgcc

SEQ ID NO: 1831634 - DNA, 15 bp, Homo sapiens
ctccttgggtcctgc

SEQ ID NO: 1831635 - DNA, 15 bp, Homo sapiens
ctcgaaccaaggcag

SEQ ID NO: 1831636 - DNA, 23 bp, Homo sapiens
ctcgaaccaaggcagcctccaga

SEQ ID NO: 1831637 - DNA, 19 bp, Homo sapiens
ctcgaggcaccggcgctgc

SEQ ID NO: 1831638 - DNA, 20 bp, Homo sapiens
ctcgaggcaccggcgctgca

SEQ ID NO: 1831639 - DNA, 18 bp, Homo sapiens
ctcgcccaccgcatgccc

SEQ ID NO: 1831640 - DNA, 23 bp, Homo sapiens
ctcgcccaccgcatgccccctcg

SEQ ID NO: 1831641 - DNA, 13 bp, Homo sapiens
ctcgccccatccc

SEQ ID NO: 1831642 - DNA, 15 bp, Homo sapiens
ctcgccccatccctg

SEQ ID NO: 1831643 - DNA, 17 bp, Homo sapiens
ctcgccccatccctgct

SEQ ID NO: 1831644 - DNA, 16 bp, Homo sapiens
ctcgctgatgctgggc

SEQ ID NO: 1831645 - DNA, 17 bp, Homo sapiens
ctcgctgatgctgggct

SEQ ID NO: 1831646 - DNA, 20 bp, Homo sapiens
ctcgctgatgctgggctggg

SEQ ID NO: 1831647 - DNA, 23 bp, Homo sapiens
ctcgctgatgctgggctgggtgc

SEQ ID NO: 1831648 - DNA, 18 bp, Homo sapiens
ctcggaagccgtctgact

SEQ ID NO: 1831649 - DNA, 13 bp, Homo sapiens
ctcggacccacca

SEQ ID NO: 1831650 - DNA, 14 bp, Homo sapiens
ctcggctcctgctg

SEQ ID NO: 1831651 - DNA, 15 bp, Homo sapiens
ctcggctcctgctgc

SEQ ID NO: 1831652 - DNA, 23 bp, Homo sapiens
ctcgggcccaggccatcttccag

SEQ ID NO: 1831653 - DNA, 24 bp, Homo sapiens
ctcgggcccaggccatcttccagg

SEQ ID NO: 1831654 - DNA, 17 bp, Homo sapiens
ctcgggctcctgtgccc

SEQ ID NO: 1831655 - DNA, 11 bp, Homo sapiens
ctcggtggtac

SEQ ID NO: 1831656 - DNA, 15 bp, Homo sapiens
ctcgtccacaggggc

SEQ ID NO: 1831657 - DNA, 19 bp, Homo sapiens
ctcgtccacaggggcaggc

SEQ ID NO: 1831658 - DNA, 12 bp, Homo sapiens
ctcgtggacacc

SEQ ID NO: 1831659 - DNA, 17 bp, Homo sapiens
ctcgtggacacctgccc

SEQ ID NO: 1831660 - DNA, 20 bp, Homo sapiens
ctcgtggacacctgccctgc

SEQ ID NO: 1831661 - DNA, 21 bp, Homo sapiens
ctcgtggacacctgccctgcc

SEQ ID NO: 1831662 - DNA, 17 bp, Homo sapiens
ctcgtttctctcaattt

SEQ ID NO: 1831663 - DNA, 16 bp, Homo sapiens
ctctaattcttttcaa

SEQ ID NO: 1831664 - DNA, 17 bp, Homo sapiens
ctctaattcttttcaaa

SEQ ID NO: 1831665 - DNA, 21 bp, Homo sapiens
ctctaattcttttcaaaattg

SEQ ID NO: 1831666 - DNA, 21 bp, Homo sapiens
ctctagccaggagtctgtgct

SEQ ID NO: 1831667 - DNA, 23 bp, Homo sapiens
ctctagccaggagtctgtgctct

SEQ ID NO: 1831668 - DNA, 13 bp, Homo sapiens
ctctagctggcag

SEQ ID NO: 1831669 - DNA, 19 bp, Homo sapiens
ctctagctggcaggacaca

SEQ ID NO: 1831670 - DNA, 19 bp, Homo sapiens
ctctcaagtgaaagacttg

SEQ ID NO: 1831671 - DNA, 18 bp, Homo sapiens
ctctcaatattcaataaa

SEQ ID NO: 1831672 - DNA, 19 bp, Homo sapiens
ctctcaatattcaataaag

SEQ ID NO: 1831673 - DNA, 18 bp, Homo sapiens
ctctccaaaggggctgct

SEQ ID NO: 1831674 - DNA, 19 bp, Homo sapiens
ctctccaaaggggctgctg

SEQ ID NO: 1831675 - DNA, 14 bp, Homo sapiens
ctctccacctagtg

SEQ ID NO: 1831676 - DNA, 22 bp, Homo sapiens
ctctccacctagtggctgtcca

SEQ ID NO: 1831677 - DNA, 13 bp, Homo sapiens
ctctcccaccccg

SEQ ID NO: 1831678 - DNA, 21 bp, Homo sapiens
ctctcccaccccggcctccac

SEQ ID NO: 1831679 - DNA, 22 bp, Homo sapiens
ctctcccaccccggcctccact

SEQ ID NO: 1831680 - DNA, 15 bp, Homo sapiens
ctctcccggctgcct

SEQ ID NO: 1831681 - DNA, 17 bp, Homo sapiens
ctctccttcgtgtctct

SEQ ID NO: 1831682 - DNA, 22 bp, Homo sapiens
ctctccttcgtgtctctcccac

SEQ ID NO: 1831683 - DNA, 15 bp, Homo sapiens
ctctccttgggctcc

SEQ ID NO: 1831684 - DNA, 16 bp, Homo sapiens
ctctccttgggctcct

SEQ ID NO: 1831685 - DNA, 22 bp, Homo sapiens
ctctccttgggctcctggctgc

SEQ ID NO: 1831686 - DNA, 21 bp, Homo sapiens
ctctcggggcccttggggcct

SEQ ID NO: 1831687 - DNA, 12 bp, Homo sapiens
ctctctgctcta

SEQ ID NO: 1831688 - DNA, 14 bp, Homo sapiens
ctctgagcccaggc

SEQ ID NO: 1831689 - DNA, 13 bp, Homo sapiens
ctctgatttcaag

SEQ ID NO: 1831690 - DNA, 14 bp, Homo sapiens
ctctgccccaagca

SEQ ID NO: 1831691 - DNA, 17 bp, Homo sapiens
ctgcacacacagctcct

SEQ ID NO: 1831692 - DNA, 16 bp, Homo sapiens
ctgcacagtttagaac

SEQ ID NO: 1831693 - DNA, 13 bp, Homo sapiens
ctgcaccaggaga

SEQ ID NO: 1831694 - DNA, 13 bp, Homo sapiens
ctgcaccccctcc

SEQ ID NO: 1831695 - DNA, 17 bp, Homo sapiens
ctgcaccccctcctgct

SEQ ID NO: 1831696 - DNA, 15 bp, Homo sapiens
ctgcaccctggaaag

SEQ ID NO: 1831697 - DNA, 11 bp, Homo sapiens
ctgcacctcct

SEQ ID NO: 1831698 - DNA, 21 bp, Homo sapiens
ctgcacctcctaccctcccac

SEQ ID NO: 1831699 - DNA, 13 bp, Homo sapiens
ctgcactctgtgc

SEQ ID NO: 1831700 - DNA, 18 bp, Homo sapiens
ctgcactctgtgcccatg

SEQ ID NO: 1831701 - DNA, 20 bp, Homo sapiens
ctgcactctgtgcccatggg

SEQ ID NO: 1831702 - DNA, 15 bp, Homo sapiens
ctgcactgtcctgct

SEQ ID NO: 1831703 - DNA, 21 bp, Homo sapiens
ctgcactgtcctgctccacag

SEQ ID NO: 1831704 - DNA, 16 bp, Homo sapiens
ctgcagaggaccacag

SEQ ID NO: 1831705 - DNA, 14 bp, Homo sapiens
ctgcagctgggccc

SEQ ID NO: 1831706 - DNA, 15 bp, Homo sapiens
ctgcagctgggcccc

SEQ ID NO: 1831707 - DNA, 15 bp, Homo sapiens
ctgcaggaacgagca

SEQ ID NO: 1831708 - DNA, 19 bp, Homo sapiens
ctgcaggaacgagcactgg

SEQ ID NO: 1831709 - DNA, 21 bp, Homo sapiens
ctgcaggaacgagcactggcc

SEQ ID NO: 1831710 - DNA, 23 bp, Homo sapiens
ctgcaggaacgagcactggccag

SEQ ID NO: 1831711 - DNA, 15 bp, Homo sapiens
ctgcaggtacttcct

SEQ ID NO: 1831712 - DNA, 19 bp, Homo sapiens
ctgcaggtacttcctcctg

SEQ ID NO: 1831713 - DNA, 22 bp, Homo sapiens
ctgcagtgatggcgcgggaggc

SEQ ID NO: 1831714 - DNA, 23 bp, Homo sapiens
ctgccaccacgtctgccaggccc

SEQ ID NO: 1831715 - DNA, 11 bp, Homo sapiens
ctgccacctgt

SEQ ID NO: 1831716 - DNA, 13 bp, Homo sapiens
ctgccacctgtct

SEQ ID NO: 1831717 - DNA, 19 bp, Homo sapiens
ctgccagctgccttcctca

SEQ ID NO: 1831718 - DNA, 13 bp, Homo sapiens
ctgccaggcacct

SEQ ID NO: 1831719 - DNA, 15 bp, Homo sapiens
ctgccaggcacctgg

SEQ ID NO: 1831720 - DNA, 21 bp, Homo sapiens
ctgccaggcacctggcctgct

SEQ ID NO: 1831721 - DNA, 23 bp, Homo sapiens
ctgccaggcacctggcctgctgg

SEQ ID NO: 1831722 - DNA, 13 bp, Homo sapiens
ctgccaggcccat

SEQ ID NO: 1831723 - DNA, 22 bp, Homo sapiens
ctgccaggcccatctcaggtgc

SEQ ID NO: 1831724 - DNA, 14 bp, Homo sapiens
ctgccaggcgttgg

SEQ ID NO: 1831725 - DNA, 19 bp, Homo sapiens
ctgccaggcgttggtgcca

SEQ ID NO: 1831726 - DNA, 23 bp, Homo sapiens
ctgccatcatgtttacagaggac

SEQ ID NO: 1831727 - DNA, 18 bp, Homo sapiens
ctgccatgccactgccag

SEQ ID NO: 1831728 - DNA, 19 bp, Homo sapiens
ctgccatgccactgccagg

SEQ ID NO: 1831729 - DNA, 21 bp, Homo sapiens
ctgcccaatgctttgggaggc

SEQ ID NO: 1831730 - DNA, 22 bp, Homo sapiens
ctgcccaatgctttgggaggcc

SEQ ID NO: 1831731 - DNA, 24 bp, Homo sapiens
ctgcccacttagccgtccatggca

SEQ ID NO: 1831732 - DNA, 20 bp, Homo sapiens
ctgcccaggacggggccggc

SEQ ID NO: 1831733 - DNA, 15 bp, Homo sapiens
ctgccccaagcagcc

SEQ ID NO: 1831734 - DNA, 20 bp, Homo sapiens
ctgccccaagcagccagcca

SEQ ID NO: 1831735 - DNA, 21 bp, Homo sapiens
ctgccccaagcagccagccag

SEQ ID NO: 1831736 - DNA, 14 bp, Homo sapiens
ctgccccaagcccc

SEQ ID NO: 1831737 - DNA, 16 bp, Homo sapiens
ctgccccaagccccca

SEQ ID NO: 1831738 - DNA, 21 bp, Homo sapiens
ctgcccccagaaagcctcctg

SEQ ID NO: 1831739 - DNA, 22 bp, Homo sapiens
ctgcccccagaaagcctcctgc

SEQ ID NO: 1831740 - DNA, 20 bp, Homo sapiens
ctgcccccatctccccaggc

SEQ ID NO: 1831741 - DNA, 22 bp, Homo sapiens
ctgcccccatctccccaggcct

SEQ ID NO: 1831742 - DNA, 23 bp, Homo sapiens
ctgcccccatctccccaggcctc

SEQ ID NO: 1831743 - DNA, 12 bp, Homo sapiens
ctgccccctgcc

SEQ ID NO: 1831744 - DNA, 23 bp, Homo sapiens
ctgccccgttccctgtcagaggc

SEQ ID NO: 1831745 - DNA, 23 bp, Homo sapiens
ctggccctcaaggcctcccacag

SEQ ID NO: 1831746 - DNA, 14 bp, Homo sapiens
ctggcctcactggc

SEQ ID NO: 1831747 - DNA, 15 bp, Homo sapiens
ctggcctcactggct

SEQ ID NO: 1831748 - DNA, 20 bp, Homo sapiens
ctggcctcgcctggcctgag

SEQ ID NO: 1831749 - DNA, 15 bp, Homo sapiens
ctggcctgagctggg

SEQ ID NO: 1831750 - DNA, 17 bp, Homo sapiens
ctggcctgagctggggc

SEQ ID NO: 1831751 - DNA, 24 bp, Homo sapiens
ctggcctgaggtctcgctgatgct

SEQ ID NO: 1831752 - DNA, 15 bp, Homo sapiens
ctggcctgctgggaa

SEQ ID NO: 1831753 - DNA, 14 bp, Homo sapiens
ctggcctggctccc

SEQ ID NO: 1831754 - DNA, 17 bp, Homo sapiens
ctggcctggctccccac

SEQ ID NO: 1831755 - DNA, 18 bp, Homo sapiens
ctggcggcttcctgtcca

SEQ ID NO: 1831756 - DNA, 23 bp, Homo sapiens
ctggctccccacgagtcacctgc

SEQ ID NO: 1831757 - DNA, 23 bp, Homo sapiens
ctggctgagtggaatgcagggaa

SEQ ID NO: 1831758 - DNA, 13 bp, Homo sapiens
ctggctgccaggc

SEQ ID NO: 1831759 - DNA, 15 bp, Homo sapiens
ctggctgccaggcgt

SEQ ID NO: 1831760 - DNA, 17 bp, Homo sapiens
ctggctgccaggcgttg

SEQ ID NO: 1831761 - DNA, 15 bp, Homo sapiens
ctggctgcctccact

SEQ ID NO: 1831762 - DNA, 20 bp, Homo sapiens
ctggctgcctccactcccac

SEQ ID NO: 1831763 - DNA, 21 bp, Homo sapiens
ctggctgcctccactcccact

SEQ ID NO: 1831764 - DNA, 13 bp, Homo sapiens
ctggctggggcag

SEQ ID NO: 1831765 - DNA, 14 bp, Homo sapiens
ctggctggggcaga

SEQ ID NO: 1831766 - DNA, 18 bp, Homo sapiens
ctggctggggcagagggg

SEQ ID NO: 1831767 - DNA, 23 bp, Homo sapiens
ctggctggggcagaggggcagcc

SEQ ID NO: 1831768 - DNA, 16 bp, Homo sapiens
ctggctgtggaggcct

SEQ ID NO: 1831769 - DNA, 17 bp, Homo sapiens
ctggctgtggaggcctg

SEQ ID NO: 1831770 - DNA, 20 bp, Homo sapiens
ctggctgtggaggcctgatg

SEQ ID NO: 1831771 - DNA, 22 bp, Homo sapiens
ctggctgtggaggcctgatgct

SEQ ID NO: 1831772 - DNA, 23 bp, Homo sapiens
ctggctgtggaggcctgatgctg

SEQ ID NO: 1831773 - DNA, 19 bp, Homo sapiens
ctggcttgctccagggtct

SEQ ID NO: 1831774 - DNA, 13 bp, Homo sapiens
ctggctttttgaa

SEQ ID NO: 1831775 - DNA, 21 bp, Homo sapiens
ctgggaaccccgcagcccgtg

SEQ ID NO: 1831776 - DNA, 20 bp, Homo sapiens
ctgggaagctgtactcagag

SEQ ID NO: 1831777 - DNA, 23 bp, Homo sapiens
ctgggaagctgtactcagagcag

SEQ ID NO: 1831778 - DNA, 14 bp, Homo sapiens
ctgggacccagcta

SEQ ID NO: 1831779 - DNA, 13 bp, Homo sapiens
ctgggagggggct

SEQ ID NO: 1831780 - DNA, 23 bp, Homo sapiens
ctgggatttcttcgctgctctag

SEQ ID NO: 1831781 - DNA, 20 bp, Homo sapiens
ctgggccccatgctctgccc

SEQ ID NO: 1831782 - DNA, 20 bp, Homo sapiens
ctgggcctgcttttccagga

SEQ ID NO: 1831783 - DNA, 21 bp, Homo sapiens
ctgggcctgcttttccaggat

SEQ ID NO: 1831784 - DNA, 15 bp, Homo sapiens
ctgggcctgtgcagc

SEQ ID NO: 1831785 - DNA, 17 bp, Homo sapiens
ctgggcctgtgcagcag

SEQ ID NO: 1831786 - DNA, 21 bp, Homo sapiens
ctgggctcagggctggagtgc

SEQ ID NO: 1831787 - DNA, 18 bp, Homo sapiens
ctgggctctgtgggctgc

SEQ ID NO: 1831788 - DNA, 15 bp, Homo sapiens
ctgggctgactggga

SEQ ID NO: 1831789 - DNA, 15 bp, Homo sapiens
ctggggacctggttt

SEQ ID NO: 1831790 - DNA, 17 bp, Homo sapiens
ctggggatgtctctcat

SEQ ID NO: 1831791 - DNA, 15 bp, Homo sapiens
ctggggcagaggggc

SEQ ID NO: 1831792 - DNA, 20 bp, Homo sapiens
ctggggcagaggggcagccg

SEQ ID NO: 1831793 - DNA, 21 bp, Homo sapiens
ctggggcagaggggcagccgc

SEQ ID NO: 1831794 - DNA, 18 bp, Homo sapiens
ctggggcatgtgtgcctg

SEQ ID NO: 1831795 - DNA, 23 bp, Homo sapiens
ctggggcatgtgtgcctgtggca

SEQ ID NO: 1831796 - DNA, 21 bp, Homo sapiens
ctggggcctatcagtgtgccc

SEQ ID NO: 1831797 - DNA, 12 bp, Homo sapiens
ctgggggcagtg

SEQ ID NO: 1831798 - DNA, 21 bp, Homo sapiens
ctgggggcagtgactggcagg

SEQ ID NO: 1831799 - DNA, 14 bp, Homo sapiens
ctgggtctgggttt

SEQ ID NO: 1831800 - DNA, 19 bp, Homo sapiens
ctgggtgccattcccagcg

SEQ ID NO: 1831801 - DNA, 21 bp, Homo sapiens
ctgggtgcgaccccatctgcc

SEQ ID NO: 1831802 - DNA, 23 bp, Homo sapiens
ctgggtgcgaccccatctgccca

SEQ ID NO: 1831803 - DNA, 16 bp, Homo sapiens
ctgggtggcccatccc

SEQ ID NO: 1831804 - DNA, 16 bp, Homo sapiens
ctgggttggcgcaccc

SEQ ID NO: 1831805 - DNA, 20 bp, Homo sapiens
ctgggttggcgcaccctccc

SEQ ID NO: 1831806 - DNA, 22 bp, Homo sapiens
ctggtaagaggcaaagaatcaa

SEQ ID NO: 1831807 - DNA, 18 bp, Homo sapiens
ctggtatgaacttgagga

SEQ ID NO: 1831808 - DNA, 23 bp, Homo sapiens
ctggtccctcgtccacaggggca

SEQ ID NO: 1831809 - DNA, 23 bp, Homo sapiens
ctggtgaccccttttcagcttct

SEQ ID NO: 1831810 - DNA, 20 bp, Homo sapiens
ctggtggcatcgtagaagag

SEQ ID NO: 1831811 - DNA, 16 bp, Homo sapiens
ctggtggcccctgcct

SEQ ID NO: 1831812 - DNA, 17 bp, Homo sapiens
ctgtaactgctgagcca

SEQ ID NO: 1831813 - DNA, 18 bp, Homo sapiens
ctgtaactgctgagccac

SEQ ID NO: 1831814 - DNA, 17 bp, Homo sapiens
ctgtaatgggatctatt

SEQ ID NO: 1831815 - DNA, 14 bp, Homo sapiens
ctgtacccagctcc

SEQ ID NO: 1831816 - DNA, 23 bp, Homo sapiens
ctgtacccagctccttttgtccc

SEQ ID NO: 1831817 - DNA, 16 bp, Homo sapiens
ctgtacccttccacct

SEQ ID NO: 1831818 - DNA, 16 bp, Homo sapiens
ctgtactgaaagcaaa

SEQ ID NO: 1831819 - DNA, 15 bp, Homo sapiens
ctgtagccatggctc

SEQ ID NO: 1831820 - DNA, 19 bp, Homo sapiens
ctgtagccatggctcaggc

SEQ ID NO: 1831821 - DNA, 20 bp, Homo sapiens
ctgtagccatggctcaggca

SEQ ID NO: 1831822 - DNA, 14 bp, Homo sapiens
ctgtaggttgctta

SEQ ID NO: 1831823 - DNA, 13 bp, Homo sapiens
ctgtatattccct

SEQ ID NO: 1831824 - DNA, 14 bp, Homo sapiens
ctgtatttcattat

SEQ ID NO: 1831825 - DNA, 15 bp, Homo sapiens
ctgtcatcactccct

SEQ ID NO: 1831826 - DNA, 16 bp, Homo sapiens
ctgtcatcactccctg

SEQ ID NO: 1831827 - DNA, 17 bp, Homo sapiens
ctgtcatcactccctgg

SEQ ID NO: 1831828 - DNA, 15 bp, Homo sapiens
ctgtccaggccactg

SEQ ID NO: 1831829 - DNA, 16 bp, Homo sapiens
ctgtccaggccactgt

SEQ ID NO: 1831830 - DNA, 19 bp, Homo sapiens
ctgtccaggccactgtggc

SEQ ID NO: 1831831 - DNA, 21 bp, Homo sapiens
ctgtccaggccactgtggcca

SEQ ID NO: 1831832 - DNA, 15 bp, Homo sapiens
ctgtccagtgcccat

SEQ ID NO: 1831833 - DNA, 18 bp, Homo sapiens
ctgtccagtgcccattcc

SEQ ID NO: 1831834 - DNA, 16 bp, Homo sapiens
ctgtccagtttccaaa

SEQ ID NO: 1831835 - DNA, 13 bp, Homo sapiens
ctgtccataaagt

SEQ ID NO: 1831836 - DNA, 14 bp, Homo sapiens
ctgtccataaagta

SEQ ID NO: 1831837 - DNA, 18 bp, Homo sapiens
ctgtcccctctgtcatca

SEQ ID NO: 1831838 - DNA, 15 bp, Homo sapiens
ctgtcccctcttgcc

SEQ ID NO: 1831839 - DNA, 14 bp, Homo sapiens
ctgtcccgccttcc

SEQ ID NO: 1831840 - DNA, 14 bp, Homo sapiens
ctgtcctgctccac

SEQ ID NO: 1831841 - DNA, 18 bp, Homo sapiens
ctgtcctgctccacagtg

SEQ ID NO: 1831842 - DNA, 19 bp, Homo sapiens
ctgtcctgctccacagtgt

SEQ ID NO: 1831843 - DNA, 22 bp, Homo sapiens
ctgtctgtaatgggatctattt

SEQ ID NO: 1831844 - DNA, 14 bp, Homo sapiens
ctgtctgtctgtcc

SEQ ID NO: 1831845 - DNA, 14 bp, Homo sapiens
ctgtctgtctgtct

SEQ ID NO: 1831846 - DNA, 15 bp, Homo sapiens
ctgtctgtctgtctg

SEQ ID NO: 1831847 - DNA, 13 bp, Homo sapiens
ctgtcttgagaga

SEQ ID NO: 1831848 - DNA, 21 bp, Homo sapiens
ctgtcttgagagaaaagaaaa

SEQ ID NO: 1831849 - DNA, 17 bp, Homo sapiens
ctgtgaactattttgaa

SEQ ID NO: 1831850 - DNA, 21 bp, Homo sapiens
ctgtgaatatgagaaatacag

SEQ ID NO: 1831851 - DNA, 17 bp, Homo sapiens
ctgtgacacagctgagc

SEQ ID NO: 1831852 - DNA, 18 bp, Homo sapiens
ctgtgcagcagcccagct

SEQ ID NO: 1831853 - DNA, 19 bp, Homo sapiens
ctgtgcagcagcccagctt

SEQ ID NO: 1831854 - DNA, 20 bp, Homo sapiens
ctgtgcagcagcccagcttc

SEQ ID NO: 1831855 - DNA, 11 bp, Homo sapiens
ctgtgccaccc

SEQ ID NO: 1831856 - DNA, 16 bp, Homo sapiens
ctgtgccaccctgggc

SEQ ID NO: 1831857 - DNA, 18 bp, Homo sapiens
ctgtgccaccctgggctc

SEQ ID NO: 1831858 - DNA, 20 bp, Homo sapiens
ctgtgccaccctgggctctg

SEQ ID NO: 1831859 - DNA, 17 bp, Homo sapiens
ctgtgccatgttattca

SEQ ID NO: 1831860 - DNA, 13 bp, Homo sapiens
ctgtgcccatggg

SEQ ID NO: 1831861 - DNA, 11 bp, Homo sapiens
ctgtgcctgct

SEQ ID NO: 1831862 - DNA, 16 bp, Homo sapiens
ctgtgcctgctagagc

SEQ ID NO: 1831863 - DNA, 19 bp, Homo sapiens
ctgctgtcccctcttgccc

SEQ ID NO: 1831864 - DNA, 20 bp, Homo sapiens
ctgctgtcccctcttgcccc

SEQ ID NO: 1831865 - DNA, 21 bp, Homo sapiens
ctgctgtcccctcttgcccca

SEQ ID NO: 1831866 - DNA, 23 bp, Homo sapiens
ctgctgtcccctcttgccccaac

SEQ ID NO: 1831867 - DNA, 14 bp, Homo sapiens
ctgctgtggcatca

SEQ ID NO: 1831868 - DNA, 23 bp, Homo sapiens
ctgctgttaattgattaaaatct

SEQ ID NO: 1831869 - DNA, 16 bp, Homo sapiens
ctgctgttgccatagc

SEQ ID NO: 1831870 - DNA, 18 bp, Homo sapiens
ctgcttgcccgctcccac

SEQ ID NO: 1831871 - DNA, 17 bp, Homo sapiens
ctgcttttccaggatcc

SEQ ID NO: 1831872 - DNA, 23 bp, Homo sapiens
ctgcttttccaggatcctgcagg

SEQ ID NO: 1831873 - DNA, 16 bp, Homo sapiens
ctgcttttgcatcttt

SEQ ID NO: 1831874 - DNA, 17 bp, Homo sapiens
ctgctttttggcacagt

SEQ ID NO: 1831875 - DNA, 17 bp, Homo sapiens
ctggaaccagggaggag

SEQ ID NO: 1831876 - DNA, 16 bp, Homo sapiens
ctggaaggcagggcag

SEQ ID NO: 1831877 - DNA, 12 bp, Homo sapiens
ctggaaggctgg

SEQ ID NO: 1831878 - DNA, 16 bp, Homo sapiens
ctggaaggctggctga

SEQ ID NO: 1831879 - DNA, 19 bp, Homo sapiens
ctggaaggctggctgagtg

SEQ ID NO: 1831880 - DNA, 19 bp, Homo sapiens
ctggaattcagcaccctgg

SEQ ID NO: 1831881 - DNA, 21 bp, Homo sapiens
ctggaattcagcaccctgggt

SEQ ID NO: 1831882 - DNA, 14 bp, Homo sapiens
ctggacaagaagct

SEQ ID NO: 1831883 - DNA, 18 bp, Homo sapiens
ctggacaagaagctgcta

SEQ ID NO: 1831884 - DNA, 12 bp, Homo sapiens
ctggacctgagt

SEQ ID NO: 1831885 - DNA, 13 bp, Homo sapiens
ctggacctgagtc

SEQ ID NO: 1831886 - DNA, 22 bp, Homo sapiens
ctggagaccgcttcacccctgc

SEQ ID NO: 1831887 - DNA, 23 bp, Homo sapiens
ctggagaccgcttcacccctgca

SEQ ID NO: 1831888 - DNA, 18 bp, Homo sapiens
ctggagacttcctctggt

SEQ ID NO: 1831889 - DNA, 13 bp, Homo sapiens
ctggagtgaggct

SEQ ID NO: 1831890 - DNA, 19 bp, Homo sapiens
ctggagtgaggcttccagg

SEQ ID NO: 1831891 - DNA, 21 bp, Homo sapiens
ctggagtgaggcttccaggct

SEQ ID NO: 1831892 - DNA, 24 bp, Homo sapiens
ctggagtgaggcttccaggctctt

SEQ ID NO: 1831893 - DNA, 18 bp, Homo sapiens
ctggagtgcgctcttggt

SEQ ID NO: 1831894 - DNA, 18 bp, Homo sapiens
ctggatacagaatgaatc

SEQ ID NO: 1831895 - DNA, 14 bp, Homo sapiens
ctggatctgtgagg

SEQ ID NO: 1831896 - DNA, 15 bp, Homo sapiens
ctggatgggcattgg

SEQ ID NO: 1831897 - DNA, 17 bp, Homo sapiens
ctggatgggcattgggc

SEQ ID NO: 1831898 - DNA, 21 bp, Homo sapiens
ctggatgggcattgggctgac

SEQ ID NO: 1831899 - DNA, 13 bp, Homo sapiens
ctggcaagcaggg

SEQ ID NO: 1831900 - DNA, 14 bp, Homo sapiens
ctggcaagcaggga

SEQ ID NO: 1831901 - DNA, 22 bp, Homo sapiens
ctggcaagcagggaaagctcca

SEQ ID NO: 1831902 - DNA, 14 bp, Homo sapiens
ctggcaatgagtgt

SEQ ID NO: 1831903 - DNA, 19 bp, Homo sapiens
ctggcaatgagtgtgccag

SEQ ID NO: 1831904 - DNA, 15 bp, Homo sapiens
ctggcacagtgtctg

SEQ ID NO: 1831905 - DNA, 21 bp, Homo sapiens
ctggcacagtgtctgggctga

SEQ ID NO: 1831906 - DNA, 18 bp, Homo sapiens
ctggcagctcctctcctt

SEQ ID NO: 1831907 - DNA, 22 bp, Homo sapiens
ctggcagctcctctccttgggc

SEQ ID NO: 1831908 - DNA, 23 bp, Homo sapiens
ctggcaggtgcagatgggctgtt

SEQ ID NO: 1831909 - DNA, 15 bp, Homo sapiens
ctggccagagagggc

SEQ ID NO: 1831910 - DNA, 19 bp, Homo sapiens
ctggccagagagggcccag

SEQ ID NO: 1831911 - DNA, 22 bp, Homo sapiens
ctggccagagagggcccagctg

SEQ ID NO: 1831912 - DNA, 16 bp, Homo sapiens
ctggccagccccacag

SEQ ID NO: 1831913 - DNA, 18 bp, Homo sapiens
ctggccagccccacagcc

SEQ ID NO: 1831914 - DNA, 19 bp, Homo sapiens
ctggccagccccacagccc

SEQ ID NO: 1831915 - DNA, 20 bp, Homo sapiens
ctggccagccccacagccca

SEQ ID NO: 1831916 - DNA, 13 bp, Homo sapiens
ctggcccagctcc

SEQ ID NO: 1831917 - DNA, 16 bp, Homo sapiens
ctggcccatcagtgta

SEQ ID NO: 1831918 - DNA, 13 bp, Homo sapiens
ctggcccccctcc

SEQ ID NO: 1831919 - DNA, 16 bp, Homo sapiens
ctggcccccctccagg

SEQ ID NO: 1831920 - DNA, 18 bp, Homo sapiens
ctggcccccctccaggca

SEQ ID NO: 1831921 - DNA, 17 bp, Homo sapiens
cttcaatcactagtcaa

SEQ ID NO: 1831922 - DNA, 22 bp, Homo sapiens
cttcaatcactagtcaagaaaa

SEQ ID NO: 1831923 - DNA, 11 bp, Homo sapiens
cttcagagctc

SEQ ID NO: 1831924 - DNA, 13 bp, Homo sapiens
cttcagagctctt

SEQ ID NO: 1831925 - DNA, 21 bp, Homo sapiens
cttcagagctcttcaagctgt

SEQ ID NO: 1831926 - DNA, 13 bp, Homo sapiens
cttcagatttcaa

SEQ ID NO: 1831927 - DNA, 15 bp, Homo sapiens
cttcaggggctgccc

SEQ ID NO: 1831928 - DNA, 16 bp, Homo sapiens
cttcaggggctgcccg

SEQ ID NO: 1831929 - DNA, 21 bp, Homo sapiens
cttcaggtggagagcactaga

SEQ ID NO: 1831930 - DNA, 15 bp, Homo sapiens
cttccaaggtggtct

SEQ ID NO: 1831931 - DNA, 21 bp, Homo sapiens
cttccacccattcccccatgt

SEQ ID NO: 1831932 - DNA, 16 bp, Homo sapiens
cttccacctcctagag

SEQ ID NO: 1831933 - DNA, 17 bp, Homo sapiens
cttccacctcctagagg

SEQ ID NO: 1831934 - DNA, 10 bp, Homo sapiens
cttccaggct

SEQ ID NO: 1831935 - DNA, 14 bp, Homo sapiens
cttccaggctcttc

SEQ ID NO: 1831936 - DNA, 21 bp, Homo sapiens
cttccaggctcttcctggacc

SEQ ID NO: 1831937 - DNA, 22 bp, Homo sapiens
cttccaggctcttcctggacct

SEQ ID NO: 1831938 - DNA, 13 bp, Homo sapiens
cttcccctccctg

SEQ ID NO: 1831939 - DNA, 14 bp, Homo sapiens
cttcctcatcccct

SEQ ID NO: 1831940 - DNA, 16 bp, Homo sapiens
cttcctccgtccaccc

SEQ ID NO: 1831941 - DNA, 13 bp, Homo sapiens
cttcctcctccac

SEQ ID NO: 1831942 - DNA, 16 bp, Homo sapiens
cttcctcctccacagt

SEQ ID NO: 1831943 - DNA, 19 bp, Homo sapiens
cttcctcctccacagtgct

SEQ ID NO: 1831944 - DNA, 12 bp, Homo sapiens
cttcctggacct

SEQ ID NO: 1831945 - DNA, 21 bp, Homo sapiens
cttcctggggccccgctggga

SEQ ID NO: 1831946 - DNA, 20 bp, Homo sapiens
cttccttcagcatctcactt

SEQ ID NO: 1831947 - DNA, 13 bp, Homo sapiens
cttcgctgctcta

SEQ ID NO: 1831948 - DNA, 15 bp, Homo sapiens
cttcgctgctctagc

SEQ ID NO: 1831949 - DNA, 20 bp, Homo sapiens
cttcgctgctctagctggca

SEQ ID NO: 1831950 - DNA, 21 bp, Homo sapiens
cttcgctgctctagctggcag

SEQ ID NO: 1831951 - DNA, 17 bp, Homo sapiens
cttcgtgtctctcccac

SEQ ID NO: 1831952 - DNA, 23 bp, Homo sapiens
cttctaaaggtttcactgttcat

SEQ ID NO: 1831953 - DNA, 15 bp, Homo sapiens
cttctaaatgcccag

SEQ ID NO: 1831954 - DNA, 17 bp, Homo sapiens
cttctagaatccccaca

SEQ ID NO: 1831955 - DNA, 19 bp, Homo sapiens
cttctccaacaagttgcct

SEQ ID NO: 1831956 - DNA, 21 bp, Homo sapiens
cttctccaacaagttgcctcc

SEQ ID NO: 1831957 - DNA, 15 bp, Homo sapiens
cttctccaacactga

SEQ ID NO: 1831958 - DNA, 18 bp, Homo sapiens
cttctcccccccggggct

SEQ ID NO: 1831959 - DNA, 20 bp, Homo sapiens
cttctcccccccggggctgg

SEQ ID NO: 1831960 - DNA, 11 bp, Homo sapiens
cttctgccact

SEQ ID NO: 1831961 - DNA, 12 bp, Homo sapiens
cttctgccactt

SEQ ID NO: 1831962 - DNA, 20 bp, Homo sapiens
cttctgccacttcccaggta

SEQ ID NO: 1831963 - DNA, 11 bp, Homo sapiens
cttctgctggg

SEQ ID NO: 1831964 - DNA, 13 bp, Homo sapiens
cttctgctgggct

SEQ ID NO: 1831965 - DNA, 15 bp, Homo sapiens
cttctgctgggctgg

SEQ ID NO: 1831966 - DNA, 19 bp, Homo sapiens
cttctgctgggctggggcc

SEQ ID NO: 1831967 - DNA, 17 bp, Homo sapiens
cttctggaaggctggct

SEQ ID NO: 1831968 - DNA, 19 bp, Homo sapiens
cttctggaaggctggctga

SEQ ID NO: 1831969 - DNA, 21 bp, Homo sapiens
cttcttccactttttccagaa

SEQ ID NO: 1831970 - DNA, 13 bp, Homo sapiens
cttcttgcttctc

SEQ ID NO: 1831971 - DNA, 22 bp, Homo sapiens
cttgaaaacctcatttaccata

SEQ ID NO: 1831972 - DNA, 20 bp, Homo sapiens
cttgaaaacttgctgaaaaa

SEQ ID NO: 1831973 - DNA, 20 bp, Homo sapiens
cttgaattttcccactgcac

SEQ ID NO: 1831974 - DNA, 22 bp, Homo sapiens
cttgagagaaaaagtgcccctt

SEQ ID NO: 1831975 - DNA, 12 bp, Homo sapiens
cttgagcccagg

SEQ ID NO: 1831976 - DNA, 15 bp, Homo sapiens
cttgagcccaggagt

SEQ ID NO: 1831977 - DNA, 20 bp, Homo sapiens
cttgagcccaggagtttgag

SEQ ID NO: 1831978 - DNA, 13 bp, Homo sapiens
cttgaggacacat

SEQ ID NO: 1831979 - DNA, 17 bp, Homo sapiens
cttgaggacacatgtcc

SEQ ID NO: 1831980 - DNA, 17 bp, Homo sapiens
cttgcagatcatctggg

SEQ ID NO: 1831981 - DNA, 22 bp, Homo sapiens
cttgcagatcatctggggacct

SEQ ID NO: 1831982 - DNA, 14 bp, Homo sapiens
cttgccccaacccc

SEQ ID NO: 1831983 - DNA, 18 bp, Homo sapiens
cttgccccaacccccagc

SEQ ID NO: 1831984 - DNA, 20 bp, Homo sapiens
cttgccccaacccccagcac

SEQ ID NO: 1831985 - DNA, 15 bp, Homo sapiens
cttgcccgctcccac

SEQ ID NO: 1831986 - DNA, 17 bp, Homo sapiens
cttgcccgctcccacag

SEQ ID NO: 1831987 - DNA, 19 bp, Homo sapiens
cttgcccgctcccacagct

SEQ ID NO: 1831988 - DNA, 16 bp, Homo sapiens
cttgcctcggctcctg

SEQ ID NO: 1831989 - DNA, 23 bp, Homo sapiens
gacttcaggggctgcccgctccc

SEQ ID NO: 1831990 - DNA, 13 bp, Homo sapiens
gacttcctggggc

SEQ ID NO: 1831991 - DNA, 15 bp, Homo sapiens
gacttcctggggccc

SEQ ID NO: 1831992 - DNA, 14 bp, Homo sapiens
gacttctggaaggc

SEQ ID NO: 1831993 - DNA, 20 bp, Homo sapiens
gacttgaattttcccactgc

SEQ ID NO: 1831994 - DNA, 23 bp, Homo sapiens
gagaaaagaaaaatatgagagaa

SEQ ID NO: 1831995 - DNA, 17 bp, Homo sapiens
gagaaatacagaagaaa

SEQ ID NO: 1831996 - DNA, 17 bp, Homo sapiens
gagaaatcacaggggcg

SEQ ID NO: 1831997 - DNA, 21 bp, Homo sapiens
gagaaattttactgacagaaa

SEQ ID NO: 1831998 - DNA, 16 bp, Homo sapiens
gagaacaagtcacagc

SEQ ID NO: 1831999 - DNA, 20 bp, Homo sapiens
gagaacaagtcacagctgca

SEQ ID NO: 1832000 - DNA, 22 bp, Homo sapiens
gagaacaagtcacagctgcagc

SEQ ID NO: 1832001 - DNA, 23 bp, Homo sapiens
gagaatgatagtaataggataca

SEQ ID NO: 1832002 - DNA, 13 bp, Homo sapiens
gagacaagccctg

SEQ ID NO: 1832003 - DNA, 17 bp, Homo sapiens
gagacaagccctggcaa

SEQ ID NO: 1832004 - DNA, 20 bp, Homo sapiens
gagacagacagagaaggcag

SEQ ID NO: 1832005 - DNA, 12 bp, Homo sapiens
gagaccacctct

SEQ ID NO: 1832006 - DNA, 22 bp, Homo sapiens
gagaccctggaattcagcaccc

SEQ ID NO: 1832007 - DNA, 19 bp, Homo sapiens
gagaccgcttcacccctgc

SEQ ID NO: 1832008 - DNA, 21 bp, Homo sapiens
gagaccgcttcacccctgcac

SEQ ID NO: 1832009 - DNA, 18 bp, Homo sapiens
gagactatgcgtttttat

SEQ ID NO: 1832010 - DNA, 20 bp, Homo sapiens
gagactatgcgtttttataa

SEQ ID NO: 1832011 - DNA, 17 bp, Homo sapiens
gagactccagaatctgc

SEQ ID NO: 1832012 - DNA, 18 bp, Homo sapiens
gagagaaaaagtgcccct

SEQ ID NO: 1832013 - DNA, 16 bp, Homo sapiens
gagagactgaaagcag

SEQ ID NO: 1832014 - DNA, 19 bp, Homo sapiens
gagagactgaaagcagcag

SEQ ID NO: 1832015 - DNA, 19 bp, Homo sapiens
gagagagcagcttctgcca

SEQ ID NO: 1832016 - DNA, 18 bp, Homo sapiens
gagaggagcacctgaacc

SEQ ID NO: 1832017 - DNA, 14 bp, Homo sapiens
gagagggcccagct

SEQ ID NO: 1832018 - DNA, 15 bp, Homo sapiens
gagagggcccagctg

SEQ ID NO: 1832019 - DNA, 16 bp, Homo sapiens
gagagggcccagctgt

SEQ ID NO: 1832020 - DNA, 16 bp, Homo sapiens
gagagggggctctcca

SEQ ID NO: 1832021 - DNA, 23 bp, Homo sapiens
gagatggtcagtgtggagagggg

SEQ ID NO: 1832022 - DNA, 15 bp, Homo sapiens
gagatttgccagcac

SEQ ID NO: 1832023 - DNA, 22 bp, Homo sapiens
gagatttgccagcacaggggcc

SEQ ID NO: 1832024 - DNA, 14 bp, Homo sapiens
gagcaacccctgta

SEQ ID NO: 1832025 - DNA, 14 bp, Homo sapiens
gagcacagccctgg

SEQ ID NO: 1832026 - DNA, 15 bp, Homo sapiens
gagcacagccctggg

SEQ ID NO: 1832027 - DNA, 19 bp, Homo sapiens
gagcacagccctgggaggg

SEQ ID NO: 1832028 - DNA, 17 bp, Homo sapiens
gagcactggccagagag

SEQ ID NO: 1832029 - DNA, 19 bp, Homo sapiens
gagtctacctgagcattca

SEQ ID NO: 1832030 - DNA, 18 bp, Homo sapiens
gagtgaaagggctatggc

SEQ ID NO: 1832031 - DNA, 12 bp, Homo sapiens
gagtggcagcca

SEQ ID NO: 1832032 - DNA, 15 bp, Homo sapiens
gagtggcagccatgc

SEQ ID NO: 1832033 - DNA, 23 bp, Homo sapiens
gagtggcattggcagcaggtgct

SEQ ID NO: 1832034 - DNA, 15 bp, Homo sapiens
gagtggttgttgcca

SEQ ID NO: 1832035 - DNA, 15 bp, Homo sapiens
gagtgtgactttttg

SEQ ID NO: 1832036 - DNA, 12 bp, Homo sapiens
gagtgtgccaga

SEQ ID NO: 1832037 - DNA, 15 bp, Homo sapiens
gagttatattaaaga

SEQ ID NO: 1832038 - DNA, 16 bp, Homo sapiens
gagttattcaaatgaa

SEQ ID NO: 1832039 - DNA, 16 bp, Homo sapiens
gagttctttgctgccc

SEQ ID NO: 1832040 - DNA, 23 bp, Homo sapiens
gagttctttgctgcccctgtctg

SEQ ID NO: 1832041 - DNA, 11 bp, Homo sapiens
gagtttcagaa

SEQ ID NO: 1832042 - DNA, 13 bp, Homo sapiens
gataaattacatt

SEQ ID NO: 1832043 - DNA, 15 bp, Homo sapiens
gatacagaatgaatc

SEQ ID NO: 1832044 - DNA, 16 bp, Homo sapiens
gatattcatattcaag

SEQ ID NO: 1832045 - DNA, 18 bp, Homo sapiens
gatattgttataaataaa

SEQ ID NO: 1832046 - DNA, 20 bp, Homo sapiens
gatattgttataaataaaat

SEQ ID NO: 1832047 - DNA, 14 bp, Homo sapiens
gatcaaaatcaaaa

SEQ ID NO: 1832048 - DNA, 22 bp, Homo sapiens
gatcatttaggatactcttaat

SEQ ID NO: 1832049 - DNA, 16 bp, Homo sapiens
gatccgctgccaccac

SEQ ID NO: 1832050 - DNA, 21 bp, Homo sapiens
gatcctgcaggaacgagcact

SEQ ID NO: 1832051 - DNA, 15 bp, Homo sapiens
gatcgcttgagccca

SEQ ID NO: 1832052 - DNA, 23 bp, Homo sapiens
gatctcatgacattatatttgag

SEQ ID NO: 1832053 - DNA, 22 bp, Homo sapiens
gatctgatggtgagctgggaag

SEQ ID NO: 1832054 - DNA, 11 bp, Homo sapiens
gatctgcctgg

SEQ ID NO: 1832055 - DNA, 23 bp, Homo sapiens
gatctgcctgggcctgtgcagca

SEQ ID NO: 1832056 - DNA, 15 bp, Homo sapiens
gatgatgccacacca

SEQ ID NO: 1832057 - DNA, 16 bp, Homo sapiens
gatgccacaccaagct

SEQ ID NO: 1832058 - DNA, 19 bp, Homo sapiens
gatgccacaccaagctgtg

SEQ ID NO: 1832059 - DNA, 13 bp, Homo sapiens
gatgctgggctgg

SEQ ID NO: 1832060 - DNA, 13 bp, Homo sapiens
gatggaatgatgg

SEQ ID NO: 1832061 - DNA, 15 bp, Homo sapiens
gatggaccgggtggg

SEQ ID NO: 1832062 - DNA, 18 bp, Homo sapiens
gatggaccgggtgggcct

SEQ ID NO: 1832063 - DNA, 19 bp, Homo sapiens
gatggaccgggtgggcctg

SEQ ID NO: 1832064 - DNA, 22 bp, Homo sapiens
gatggaccgggtgggcctggcc

SEQ ID NO: 1832065 - DNA, 14 bp, Homo sapiens
gatggccatgctca

SEQ ID NO: 1832066 - DNA, 15 bp, Homo sapiens
gatgggtcagttgta

SEQ ID NO: 1832067 - DNA, 17 bp, Homo sapiens
gcatgtgtgcctgtggc

SEQ ID NO: 1832068 - DNA, 20 bp, Homo sapiens
gcatgtgtgcctgtggcaga

SEQ ID NO: 1832069 - DNA, 18 bp, Homo sapiens
gcattcaggcagcactga

SEQ ID NO: 1832070 - DNA, 21 bp, Homo sapiens
gcattggcagcaggtgctgct

SEQ ID NO: 1832071 - DNA, 15 bp, Homo sapiens
gcattgggctgacac

SEQ ID NO: 1832072 - DNA, 20 bp, Homo sapiens
gcattgggctgacacctacc

SEQ ID NO: 1832073 - DNA, 16 bp, Homo sapiens
gcatttagtaccttca

SEQ ID NO: 1832074 - DNA, 20 bp, Homo sapiens
gcatttagtaccttcaaata

SEQ ID NO: 1832075 - DNA, 23 bp, Homo sapiens
gccaacagtgttaggcctggcac

SEQ ID NO: 1832076 - DNA, 15 bp, Homo sapiens
gccaaggcaggtaga

SEQ ID NO: 1832077 - DNA, 17 bp, Homo sapiens
gccaaggctctcccctc

SEQ ID NO: 1832078 - DNA, 14 bp, Homo sapiens
gccacaccaagctg

SEQ ID NO: 1832079 - DNA, 18 bp, Homo sapiens
gccacaccaagctgtgcc

SEQ ID NO: 1832080 - DNA, 22 bp, Homo sapiens
gccacaccaagctgtgccaccc

SEQ ID NO: 1832081 - DNA, 17 bp, Homo sapiens
gccacacccaggaaggg

SEQ ID NO: 1832082 - DNA, 22 bp, Homo sapiens
gccaccacgtctgccaggccca

SEQ ID NO: 1832083 - DNA, 21 bp, Homo sapiens
gccaccccaaaccccagcccc

SEQ ID NO: 1832084 - DNA, 12 bp, Homo sapiens
gccaccctgggc

SEQ ID NO: 1832085 - DNA, 14 bp, Homo sapiens
gccaccctgggctc

SEQ ID NO: 1832086 - DNA, 17 bp, Homo sapiens
gccaccctgggctctgt

SEQ ID NO: 1832087 - DNA, 19 bp, Homo sapiens
gccaccctgggctctgtgg

SEQ ID NO: 1832088 - DNA, 10 bp, Homo sapiens
gccacctgtc

SEQ ID NO: 1832089 - DNA, 15 bp, Homo sapiens
gccacctgtctgtct

SEQ ID NO: 1832090 - DNA, 15 bp, Homo sapiens
gccacgattgcagga

SEQ ID NO: 1832091 - DNA, 22 bp, Homo sapiens
gccactacctttgtccaggcct

SEQ ID NO: 1832092 - DNA, 19 bp, Homo sapiens
gccactccctgagctttgg

SEQ ID NO: 1832093 - DNA, 14 bp, Homo sapiens
gccactcctgtccc

SEQ ID NO: 1832094 - DNA, 19 bp, Homo sapiens
gccactcgcagtcgcagga

SEQ ID NO: 1832095 - DNA, 16 bp, Homo sapiens
gccactgtggccagag

SEQ ID NO: 1832096 - DNA, 12 bp, Homo sapiens
gcccgctcccac

SEQ ID NO: 1832097 - DNA, 14 bp, Homo sapiens
gcccgctcccacag

SEQ ID NO: 1832098 - DNA, 19 bp, Homo sapiens
gcccgcttgcctcggctcc

SEQ ID NO: 1832099 - DNA, 21 bp, Homo sapiens
gcccgcttgcctcggctcctg

SEQ ID NO: 1832100 - DNA, 20 bp, Homo sapiens
gcccggcgccctctgtcctg

SEQ ID NO: 1832101 - DNA, 21 bp, Homo sapiens
gcccgtgaagcagtgcctcga

SEQ ID NO: 1832102 - DNA, 16 bp, Homo sapiens
gcccgttgtctccctg

SEQ ID NO: 1832103 - DNA, 21 bp, Homo sapiens
gcccgttgtctccctggccct

SEQ ID NO: 1832104 - DNA, 22 bp, Homo sapiens
gcccgttgtctccctggccctc

SEQ ID NO: 1832105 - DNA, 15 bp, Homo sapiens
gccctcaaggcctcc

SEQ ID NO: 1832106 - DNA, 17 bp, Homo sapiens
gccctcaaggcctccca

SEQ ID NO: 1832107 - DNA, 19 bp, Homo sapiens
gccctcaaggcctcccaca

SEQ ID NO: 1832108 - DNA, 20 bp, Homo sapiens
gccctcaaggcctcccacag

SEQ ID NO: 1832109 - DNA, 23 bp, Homo sapiens
gccctcagtcagttcccggagca

SEQ ID NO: 1832110 - DNA, 19 bp, Homo sapiens
gccctccctgtctccaggg

SEQ ID NO: 1832111 - DNA, 20 bp, Homo sapiens
gccctccctgtctccagggc

SEQ ID NO: 1832112 - DNA, 22 bp, Homo sapiens
gccctccctgtctccagggccc

SEQ ID NO: 1832113 - DNA, 20 bp, Homo sapiens
gccctcgaaccaaggcagcc

SEQ ID NO: 1832114 - DNA, 23 bp, Homo sapiens
gccctcgaaccaaggcagcctcc

SEQ ID NO: 1832115 - DNA, 15 bp, Homo sapiens
gccctgcactgtcct

SEQ ID NO: 1832116 - DNA, 23 bp, Homo sapiens
gccctgcactgtcctgctccaca

SEQ ID NO: 1832117 - DNA, 14 bp, Homo sapiens
gccctgccacctgt

SEQ ID NO: 1832118 - DNA, 15 bp, Homo sapiens
gccctgcctgcccac

SEQ ID NO: 1832119 - DNA, 17 bp, Homo sapiens
gccctgcgttggagcca

SEQ ID NO: 1832120 - DNA, 21 bp, Homo sapiens
gccctgcgttggagccactcc

SEQ ID NO: 1832121 - DNA, 15 bp, Homo sapiens
gcccttggggcctgg

SEQ ID NO: 1832122 - DNA, 14 bp, Homo sapiens
gcccttgtcctgcc

SEQ ID NO: 1832123 - DNA, 16 bp, Homo sapiens
gcccttgtcctgccag

SEQ ID NO: 1832124 - DNA, 19 bp, Homo sapiens
gcccttgtcctgccagctg

SEQ ID NO: 1832125 - DNA, 21 bp, Homo sapiens
gcccttgtcctgccagctgcc

SEQ ID NO: 1832126 - DNA, 13 bp, Homo sapiens
gccgccgcctcgc

SEQ ID NO: 1832127 - DNA, 13 bp, Homo sapiens
gccgcctcgccca

SEQ ID NO: 1832128 - DNA, 13 bp, Homo sapiens
gccgctaggagag

SEQ ID NO: 1832129 - DNA, 22 bp, Homo sapiens
gccgctaggagagactgaaagc

SEQ ID NO: 1832130 - DNA, 22 bp, Homo sapiens
gccgtccatggcaccagccccc

SEQ ID NO: 1832131 - DNA, 17 bp, Homo sapiens
gccgtctgactccagag

SEQ ID NO: 1832132 - DNA, 18 bp, Homo sapiens
gccgtctgactccagagt

SEQ ID NO: 1832133 - DNA, 19 bp, Homo sapiens
gccgtctgactccagagtc

SEQ ID NO: 1832134 - DNA, 12 bp, Homo sapiens
gcctaataaaga

SEQ ID NO: 1832135 - DNA, 21 bp, Homo sapiens
gcctaggagttgagtacagtg

SEQ ID NO: 1832136 - DNA, 13 bp, Homo sapiens
gcctatcagtgtg

SEQ ID NO: 1832137 - DNA, 23 bp, Homo sapiens
gcctatcagtgtgccccccatcc

SEQ ID NO: 1832138 - DNA, 16 bp, Homo sapiens
gcctcagtttctccat

SEQ ID NO: 1832139 - DNA, 22 bp, Homo sapiens
gcctcagtttctccatcagctt

SEQ ID NO: 1832140 - DNA, 16 bp, Homo sapiens
gcctcatgccacacct

SEQ ID NO: 1832141 - DNA, 16 bp, Homo sapiens
gcctccactcccactt

SEQ ID NO: 1832142 - DNA, 21 bp, Homo sapiens
gcctccactcccacttccctg

SEQ ID NO: 1832143 - DNA, 15 bp, Homo sapiens
gcctccactccccca

SEQ ID NO: 1832144 - DNA, 21 bp, Homo sapiens
gcctccactcccccacctgac

SEQ ID NO: 1832145 - DNA, 22 bp, Homo sapiens
gcctccactcccccacctgaca

SEQ ID NO: 1832146 - DNA, 23 bp, Homo sapiens
gcctccactcccccacctgacaa

SEQ ID NO: 1832147 - DNA, 12 bp, Homo sapiens
gcctccagagcc

SEQ ID NO: 1832148 - DNA, 13 bp, Homo sapiens
gcctccagcctct

SEQ ID NO: 1832149 - DNA, 15 bp, Homo sapiens
gcctcccaataaagc

SEQ ID NO: 1832150 - DNA, 14 bp, Homo sapiens
gcctcccacagtga

SEQ ID NO: 1832151 - DNA, 12 bp, Homo sapiens
gcctcccctccc

SEQ ID NO: 1832152 - DNA, 14 bp, Homo sapiens
gcctcccctcccct

SEQ ID NO: 1832153 - DNA, 18 bp, Homo sapiens
gcctccgtttatgggcct

SEQ ID NO: 1832154 - DNA, 15 bp, Homo sapiens
gcctcctgccccctg

SEQ ID NO: 1832155 - DNA, 16 bp, Homo sapiens
gcctcgaggcaccggc

SEQ ID NO: 1832156 - DNA, 21 bp, Homo sapiens
gcctcgaggcaccggcgctgc

SEQ ID NO: 1832157 - DNA, 22 bp, Homo sapiens
gcctcgaggcaccggcgctgca

SEQ ID NO: 1832158 - DNA, 14 bp, Homo sapiens
gcctcgcccaccgc

SEQ ID NO: 1832159 - DNA, 15 bp, Homo sapiens
gcctcgcctggcctg

SEQ ID NO: 1832160 - DNA, 16 bp, Homo sapiens
gcctcggctcctgctg

SEQ ID NO: 1832161 - DNA, 18 bp, Homo sapiens
gcctcggctcctgctgca

SEQ ID NO: 1832162 - DNA, 19 bp, Homo sapiens
gcctctcattccagaggaa

SEQ ID NO: 1832163 - DNA, 14 bp, Homo sapiens
gcctctcccggctg

SEQ ID NO: 1832164 - DNA, 16 bp, Homo sapiens
gcctctcccggctgcc

SEQ ID NO: 1832165 - DNA, 23 bp, Homo sapiens
gcctctcccggctgcctgccgcc

SEQ ID NO: 1832166 - DNA, 12 bp, Homo sapiens
gcctctgtgtca

SEQ ID NO: 1832167 - DNA, 14 bp, Homo sapiens
gcctcttgtgctca

SEQ ID NO: 1832168 - DNA, 17 bp, Homo sapiens
gcctcttgtgctcacgc

SEQ ID NO: 1832169 - DNA, 21 bp, Homo sapiens
gcctgaggtctcgctgatgct

SEQ ID NO: 1832170 - DNA, 20 bp, Homo sapiens
gcctgattcggctgtctcag

SEQ ID NO: 1832171 - DNA, 21 bp, Homo sapiens
gcctgcaccaggagacagaca

SEQ ID NO: 1832172 - DNA, 17 bp, Homo sapiens
gcctgcccaatgctttg

SEQ ID NO: 1832173 - DNA, 18 bp, Homo sapiens
gcctgcccaatgctttgg

SEQ ID NO: 1832174 - DNA, 16 bp, Homo sapiens
gcctgctagagcaacc

SEQ ID NO: 1832175 - DNA, 21 bp, Homo sapiens
gcctgctgggaaccccgcagc

SEQ ID NO: 1832176 - DNA, 22 bp, Homo sapiens
gcctgctgggaaccccgcagcc

SEQ ID NO: 1832177 - DNA, 15 bp, Homo sapiens
gcctgcttttccagg

SEQ ID NO: 1832178 - DNA, 17 bp, Homo sapiens
gcctgcttttccaggat

SEQ ID NO: 1832179 - DNA, 22 bp, Homo sapiens
gcctgcttttccaggatcctgc

SEQ ID NO: 1832180 - DNA, 23 bp, Homo sapiens
gcctgcttttccaggatcctgca

SEQ ID NO: 1832181 - DNA, 21 bp, Homo sapiens
gcctggaaccagggaggagag

SEQ ID NO: 1832182 - DNA, 21 bp, Homo sapiens
gcctggcacagtgtctgggct

SEQ ID NO: 1832183 - DNA, 22 bp, Homo sapiens
gcctggcacagtgtctgggctg

SEQ ID NO: 1832184 - DNA, 23 bp, Homo sapiens
gcctggcacagtgtctgggctga

SEQ ID NO: 1832185 - DNA, 14 bp, Homo sapiens
gcctggcccagctc

SEQ ID NO: 1832186 - DNA, 11 bp, Homo sapiens
gcctggcctga

SEQ ID NO: 1832187 - DNA, 15 bp, Homo sapiens
gcctggcctgagctg

SEQ ID NO: 1832188 - DNA, 15 bp, Homo sapiens
gcctgtgtccagcag

SEQ ID NO: 1832189 - DNA, 14 bp, Homo sapiens
gcctgtgtgttctg

SEQ ID NO: 1832190 - DNA, 18 bp, Homo sapiens
gccttccccttttgcctg

SEQ ID NO: 1832191 - DNA, 19 bp, Homo sapiens
gccttccctccccacagtc

SEQ ID NO: 1832192 - DNA, 15 bp, Homo sapiens
gccttcctcctccac

SEQ ID NO: 1832193 - DNA, 20 bp, Homo sapiens
gccttcctcctccacagtgc

SEQ ID NO: 1832194 - DNA, 23 bp, Homo sapiens
gccttctcccccccggggctggg

SEQ ID NO: 1832195 - DNA, 13 bp, Homo sapiens
gccttctcccctc

SEQ ID NO: 1832196 - DNA, 14 bp, Homo sapiens
gccttctcccctcc

SEQ ID NO: 1832197 - DNA, 14 bp, Homo sapiens
gccttgagcacaaa

SEQ ID NO: 1832198 - DNA, 22 bp, Homo sapiens
gccttgctttgggctttgcagg

SEQ ID NO: 1832199 - DNA, 12 bp, Homo sapiens
gccttgtgccct

SEQ ID NO: 1832200 - DNA, 19 bp, Homo sapiens
gccttgtgccctgccccca

SEQ ID NO: 1832201 - DNA, 14 bp, Homo sapiens
gcgaccccatctgc

SEQ ID NO: 1832202 - DNA, 18 bp, Homo sapiens
gcgaccccatctgcccag

SEQ ID NO: 1832203 - DNA, 20 bp, Homo sapiens
gcgaccccatctgcccagga

SEQ ID NO: 1832204 - DNA, 13 bp, Homo sapiens
gcgagaattttca

SEQ ID NO: 1832205 - DNA, 22 bp, Homo sapiens
gcgattattgatcaaaatcaaa

SEQ ID NO: 1832206 - DNA, 15 bp, Homo sapiens
gcgccctctgtcctg

SEQ ID NO: 1832207 - DNA, 22 bp, Homo sapiens
gcgcgggaggcaccagctctgt

SEQ ID NO: 1832208 - DNA, 15 bp, Homo sapiens
gcgctaacccccagc

SEQ ID NO: 1832209 - DNA, 19 bp, Homo sapiens
gcgctaacccccagcccac

SEQ ID NO: 1832210 - DNA, 18 bp, Homo sapiens
gcgctcaggacccaggcc

SEQ ID NO: 1832211 - DNA, 18 bp, Homo sapiens
gcgctcttggtccctggt

SEQ ID NO: 1832212 - DNA, 11 bp, Homo sapiens
gcgctgcaggt

SEQ ID NO: 1832213 - DNA, 22 bp, Homo sapiens
gcgctgcaggtacttcctcctg

SEQ ID NO: 1832214 - DNA, 21 bp, Homo sapiens
gcggcctgttgggcagagctg

SEQ ID NO: 1832215 - DNA, 15 bp, Homo sapiens
gcggcttcctgtcca

SEQ ID NO: 1832216 - DNA, 13 bp, Homo sapiens
gcgggaggcacca

SEQ ID NO: 1832217 - DNA, 10 bp, Homo sapiens
gcgggcagcc

SEQ ID NO: 1832218 - DNA, 14 bp, Homo sapiens
gcgggtctgaagga

SEQ ID NO: 1832219 - DNA, 18 bp, Homo sapiens
gcgtcctgacgccctgcg

SEQ ID NO: 1832220 - DNA, 15 bp, Homo sapiens
gcgtcctgcagagga

SEQ ID NO: 1832221 - DNA, 14 bp, Homo sapiens
gcgtgctacctgca

SEQ ID NO: 1832222 - DNA, 12 bp, Homo sapiens
gcgtggctgtgg

SEQ ID NO: 1832223 - DNA, 15 bp, Homo sapiens
gcgtggctgtggcac

SEQ ID NO: 1832224 - DNA, 14 bp, Homo sapiens
gcgttggtgccact

SEQ ID NO: 1832225 - DNA, 15 bp, Homo sapiens
gcgttggtgccactt

SEQ ID NO: 1832226 - DNA, 22 bp, Homo sapiens
gctaagatgagatttgccagca

SEQ ID NO: 1832227 - DNA, 16 bp, Homo sapiens
gctaagcctgatgatg

SEQ ID NO: 1832228 - DNA, 15 bp, Homo sapiens
gctaattctgggaag

SEQ ID NO: 1832229 - DNA, 23 bp, Homo sapiens
gctaccctccctgctgtcccctc

SEQ ID NO: 1832230 - DNA, 13 bp, Homo sapiens
gctactctgtcca

SEQ ID NO: 1832231 - DNA, 15 bp, Homo sapiens
gctactctgtccagg

SEQ ID NO: 1832232 - DNA, 17 bp, Homo sapiens
gctactctgtccaggcc

SEQ ID NO: 1832233 - DNA, 19 bp, Homo sapiens
gctactctgtccaggccac

SEQ ID NO: 1832234 - DNA, 21 bp, Homo sapiens
gctagagcaacccctgtaccc

SEQ ID NO: 1832235 - DNA, 11 bp, Homo sapiens
gctaggactga

SEQ ID NO: 1832236 - DNA, 14 bp, Homo sapiens
gctaggactgagga

SEQ ID NO: 1832237 - DNA, 19 bp, Homo sapiens
gctaggactgaggagtggg

SEQ ID NO: 1832238 - DNA, 19 bp, Homo sapiens
gctaggagagactgaaagc

SEQ ID NO: 1832239 - DNA, 19 bp, Homo sapiens
gctagtgtgagtggcagcc

SEQ ID NO: 1832240 - DNA, 21 bp, Homo sapiens
gctagtgtgagtggcagccat

SEQ ID NO: 1832241 - DNA, 23 bp, Homo sapiens
gctagtgtgagtggcagccatgc

SEQ ID NO: 1832242 - DNA, 15 bp, Homo sapiens
gctatggcaaggggg

SEQ ID NO: 1832243 - DNA, 15 bp, Homo sapiens
gctattgttgtgggc

SEQ ID NO: 1832244 - DNA, 15 bp, Homo sapiens
gctcaacccccctcc

SEQ ID NO: 1832245 - DNA, 16 bp, Homo sapiens
gctcaacccccctccc

SEQ ID NO: 1832246 - DNA, 22 bp, Homo sapiens
gctcacgctcccccgcagtccc

SEQ ID NO: 1832247 - DNA, 19 bp, Homo sapiens
gctcagcaaggggctctgc

SEQ ID NO: 1832248 - DNA, 12 bp, Homo sapiens
gctcaggaccca

SEQ ID NO: 1832249 - DNA, 13 bp, Homo sapiens
gctcagggctgga

SEQ ID NO: 1832250 - DNA, 14 bp, Homo sapiens
gctcagggctggag

SEQ ID NO: 1832251 - DNA, 15 bp, Homo sapiens
gctcagggctggagt

SEQ ID NO: 1832252 - DNA, 20 bp, Homo sapiens
gctcatggcgtaatgggcct

SEQ ID NO: 1832253 - DNA, 21 bp, Homo sapiens
gctcatggcgtaatgggcctg

SEQ ID NO: 1832254 - DNA, 23 bp, Homo sapiens
gctcatggcgtaatgggcctgcc

SEQ ID NO: 1832255 - DNA, 21 bp, Homo sapiens
gctccacggtgcgtggctgtg

SEQ ID NO: 1832256 - DNA, 21 bp, Homo sapiens
gctccagcatccagcctgtgt

SEQ ID NO: 1832257 - DNA, 18 bp, Homo sapiens
gctccagggtcttgggct

SEQ ID NO: 1832258 - DNA, 20 bp, Homo sapiens
gctccagggtcttgggctac

SEQ ID NO: 1832259 - DNA, 24 bp, Homo sapiens
gctccagggtcttgggctactggc

SEQ ID NO: 1832260 - DNA, 19 bp, Homo sapiens
gctcccagtgtcttcctgt

SEQ ID NO: 1832261 - DNA, 16 bp, Homo sapiens
gctcccccgcagtccc

SEQ ID NO: 1832262 - DNA, 15 bp, Homo sapiens
gctcccccgggaggg

SEQ ID NO: 1832263 - DNA, 13 bp, Homo sapiens
gctcctggctgcc

SEQ ID NO: 1832264 - DNA, 22 bp, Homo sapiens
gctccttggcacccccatgctg

SEQ ID NO: 1832265 - DNA, 21 bp, Homo sapiens
gctccttttgtccccagggcc

SEQ ID NO: 1832266 - DNA, 12 bp, Homo sapiens
gctcgggcccag

SEQ ID NO: 1832267 - DNA, 22 bp, Homo sapiens
gctcgtggccttccccttttgc

SEQ ID NO: 1832268 - DNA, 14 bp, Homo sapiens
gctcgtttctctca

SEQ ID NO: 1832269 - DNA, 20 bp, Homo sapiens
gctctaattcttttcaaaat

SEQ ID NO: 1832270 - DNA, 15 bp, Homo sapiens
gctctagccaggagt

SEQ ID NO: 1832271 - DNA, 16 bp, Homo sapiens
gctctagccaggagtc

SEQ ID NO: 1832272 - DNA, 19 bp, Homo sapiens
gctctagccaggagtctgt

SEQ ID NO: 1832273 - DNA, 13 bp, Homo sapiens
gctctagctggca

SEQ ID NO: 1832274 - DNA, 15 bp, Homo sapiens
gctctagctggcagg

SEQ ID NO: 1832275 - DNA, 20 bp, Homo sapiens
gctctagctggcaggacaca

SEQ ID NO: 1832276 - DNA, 20 bp, Homo sapiens
gctctccaaaggggctgctg

SEQ ID NO: 1832277 - DNA, 22 bp, Homo sapiens
gctctccaaaggggctgctggg

SEQ ID NO: 1832278 - DNA, 18 bp, Homo sapiens
gctctcccctctcgcccc

SEQ ID NO: 1832279 - DNA, 17 bp, Homo sapiens
gctctcctaccccacct

SEQ ID NO: 1832280 - DNA, 16 bp, Homo sapiens
gctctgccccaagccc

SEQ ID NO: 1832281 - DNA, 19 bp, Homo sapiens
gctctgccccaagccccca

SEQ ID NO: 1832282 - DNA, 23 bp, Homo sapiens
gctctggcggcttcctgtccact

SEQ ID NO: 1832283 - DNA, 21 bp, Homo sapiens
gctctgggctcagggctggag

SEQ ID NO: 1832284 - DNA, 12 bp, Homo sapiens
ggcctgctggga

SEQ ID NO: 1832285 - DNA, 21 bp, Homo sapiens
ggcctgctgggaaccccgcag

SEQ ID NO: 1832286 - DNA, 20 bp, Homo sapiens
ggcctgcttttccaggatcc

SEQ ID NO: 1832287 - DNA, 12 bp, Homo sapiens
ggcctggcctga

SEQ ID NO: 1832288 - DNA, 23 bp, Homo sapiens
ggcctggctccccacgagtcacc

SEQ ID NO: 1832289 - DNA, 18 bp, Homo sapiens
ggcctggcttgctccagg

SEQ ID NO: 1832290 - DNA, 22 bp, Homo sapiens
ggcctgggacccagctactctg

SEQ ID NO: 1832291 - DNA, 12 bp, Homo sapiens
ggcctgggcctg

SEQ ID NO: 1832292 - DNA, 15 bp, Homo sapiens
ggcctgggggcagtg

SEQ ID NO: 1832293 - DNA, 17 bp, Homo sapiens
ggcctgggggcagtgac

SEQ ID NO: 1832294 - DNA, 17 bp, Homo sapiens
ggcctgtcccccaaggt

SEQ ID NO: 1832295 - DNA, 20 bp, Homo sapiens
ggcctgtgcagcagcccagc

SEQ ID NO: 1832296 - DNA, 15 bp, Homo sapiens
ggcctgtgtccagca

SEQ ID NO: 1832297 - DNA, 19 bp, Homo sapiens
ggcctgtgtccagcagctg

SEQ ID NO: 1832298 - DNA, 19 bp, Homo sapiens
ggcctgttgggcagagctg

SEQ ID NO: 1832299 - DNA, 15 bp, Homo sapiens
ggcgagaggaggggc

SEQ ID NO: 1832300 - DNA, 13 bp, Homo sapiens
ggcgccctctgtc

SEQ ID NO: 1832301 - DNA, 14 bp, Homo sapiens
ggcgctcaggaccc

SEQ ID NO: 1832302 - DNA, 21 bp, Homo sapiens
ggcgctcaggacccaggccct

SEQ ID NO: 1832303 - DNA, 12 bp, Homo sapiens
ggcgctgcaggt

SEQ ID NO: 1832304 - DNA, 21 bp, Homo sapiens
ggcggcttcctgtccactctc

SEQ ID NO: 1832305 - DNA, 18 bp, Homo sapiens
ggcgtaatgggcctgccc

SEQ ID NO: 1832306 - DNA, 15 bp, Homo sapiens
ggcgtgctacctgca

SEQ ID NO: 1832307 - DNA, 12 bp, Homo sapiens
ggctaaatgaag

SEQ ID NO: 1832308 - DNA, 20 bp, Homo sapiens
ggctagtgtgagtggcagcc

SEQ ID NO: 1832309 - DNA, 21 bp, Homo sapiens
ggctagtgtgagtggcagcca

SEQ ID NO: 1832310 - DNA, 21 bp, Homo sapiens
ggctatggggatagatgtgtg

SEQ ID NO: 1832311 - DNA, 19 bp, Homo sapiens
ggctcaggcaagcccctca

SEQ ID NO: 1832312 - DNA, 20 bp, Homo sapiens
ggctcaggcaagcccctcag

SEQ ID NO: 1832313 - DNA, 15 bp, Homo sapiens
ggctccagcatccag

SEQ ID NO: 1832314 - DNA, 21 bp, Homo sapiens
ggctccccacgagtcacctgc

SEQ ID NO: 1832315 - DNA, 15 bp, Homo sapiens
ggctcctgctgcacc

SEQ ID NO: 1832316 - DNA, 21 bp, Homo sapiens
ggctcctgctgcaccaaccca

SEQ ID NO: 1832317 - DNA, 22 bp, Homo sapiens
ggctcctgctgcaccaacccag

SEQ ID NO: 1832318 - DNA, 12 bp, Homo sapiens
ggctcctggctg

SEQ ID NO: 1832319 - DNA, 14 bp, Homo sapiens
ggctcctggctgcc

SEQ ID NO: 1832320 - DNA, 15 bp, Homo sapiens
ggctcctggctgcca

SEQ ID NO: 1832321 - DNA, 16 bp, Homo sapiens
ggctcctggctgccag

SEQ ID NO: 1832322 - DNA, 20 bp, Homo sapiens
ggctcctggctgccaggcgt

SEQ ID NO: 1832323 - DNA, 13 bp, Homo sapiens
ggctcctgtgccc

SEQ ID NO: 1832324 - DNA, 13 bp, Homo sapiens
ggctctcaagtga

SEQ ID NO: 1832325 - DNA, 20 bp, Homo sapiens
ggctctccaaaggggctgct

SEQ ID NO: 1832326 - DNA, 22 bp, Homo sapiens
ggctctccaaaggggctgctgg

SEQ ID NO: 1832327 - DNA, 13 bp, Homo sapiens
ggctctcccctct

SEQ ID NO: 1832328 - DNA, 12 bp, Homo sapiens
ggctctgggctc

SEQ ID NO: 1832329 - DNA, 16 bp, Homo sapiens
ggctctgggctcaggg

SEQ ID NO: 1832330 - DNA, 15 bp, Homo sapiens
ggctctgtgggctgc

SEQ ID NO: 1832331 - DNA, 19 bp, Homo sapiens
ggctcttcctggacctgag

SEQ ID NO: 1832332 - DNA, 16 bp, Homo sapiens
ggctgacacctaccat

SEQ ID NO: 1832333 - DNA, 19 bp, Homo sapiens
ggctgacacctaccatgct

SEQ ID NO: 1832334 - DNA, 16 bp, Homo sapiens
ggctgaggggatacca

SEQ ID NO: 1832335 - DNA, 19 bp, Homo sapiens
ggctgagtggaatgcaggg

SEQ ID NO: 1832336 - DNA, 22 bp, Homo sapiens
ggctgcacctcctaccctccca

SEQ ID NO: 1832337 - DNA, 15 bp, Homo sapiens
ggctgcactctgtgc

SEQ ID NO: 1832338 - DNA, 18 bp, Homo sapiens
ggctgcactctgtgccca

SEQ ID NO: 1832339 - DNA, 12 bp, Homo sapiens
ggctgcactgca

SEQ ID NO: 1832340 - DNA, 13 bp, Homo sapiens
ggctgcactgcag

SEQ ID NO: 1832341 - DNA, 10 bp, Homo sapiens
ggctgccagg

SEQ ID NO: 1832342 - DNA, 23 bp, Homo sapiens
ggctgccaggcgttggtgccact

SEQ ID NO: 1832343 - DNA, 14 bp, Homo sapiens
ggctgcccgctccc

SEQ ID NO: 1832344 - DNA, 16 bp, Homo sapiens
ggctgcccgctcccag

SEQ ID NO: 1832345 - DNA, 17 bp, Homo sapiens
ggctgcccgctcccagt

SEQ ID NO: 1832346 - DNA, 18 bp, Homo sapiens
ggctgcccgctcccagtg

SEQ ID NO: 1832347 - DNA, 17 bp, Homo sapiens
ggctgcctccactccca

SEQ ID NO: 1832348 - DNA, 13 bp, Homo sapiens
ggctgcctgccgc

SEQ ID NO: 1832349 - DNA, 13 bp, Homo sapiens
ggctgctggggca

SEQ ID NO: 1832350 - DNA, 24 bp, Homo sapiens
ggctgctggggcatgtgtgcctgt

SEQ ID NO: 1832351 - DNA, 16 bp, Homo sapiens
ggctggcaagcaggga

SEQ ID NO: 1832352 - DNA, 17 bp, Homo sapiens
ggctggcaagcagggaa

SEQ ID NO: 1832353 - DNA, 17 bp, Homo sapiens
ggctggccagccccaca

SEQ ID NO: 1832354 - DNA, 20 bp, Homo sapiens
ggctggccagccccacagcc

SEQ ID NO: 1832355 - DNA, 13 bp, Homo sapiens
ggctggctgagtg

SEQ ID NO: 1832356 - DNA, 13 bp, Homo sapiens
ggctggctggggc

SEQ ID NO: 1832357 - DNA, 12 bp, Homo sapiens
ggctggggcaga

SEQ ID NO: 1832358 - DNA, 14 bp, Homo sapiens
ggctggggcagagg

SEQ ID NO: 1832359 - DNA, 20 bp, Homo sapiens
ggctggggcctatcagtgtg

SEQ ID NO: 1832360 - DNA, 22 bp, Homo sapiens
ggctggggcctatcagtgtgcc

SEQ ID NO: 1832361 - DNA, 13 bp, Homo sapiens
ggctgtggaggcc

SEQ ID NO: 1832362 - DNA, 16 bp, Homo sapiens
ggctgtggaggcctga

SEQ ID NO: 1832363 - DNA, 14 bp, Homo sapiens
ggcttccaaggtgg

SEQ ID NO: 1832364 - DNA, 13 bp, Homo sapiens
ggcttccaggctc

SEQ ID NO: 1832365 - DNA, 18 bp, Homo sapiens
ggcttccaggctcttcct

SEQ ID NO: 1832366 - DNA, 21 bp, Homo sapiens
ggcttcctccgtccacccagg

SEQ ID NO: 1832367 - DNA, 23 bp, Homo sapiens
ggcttcctccgtccacccaggct

SEQ ID NO: 1832368 - DNA, 14 bp, Homo sapiens
ggcttcctgtccac

SEQ ID NO: 1832369 - DNA, 17 bp, Homo sapiens
ggcttcctgtccactct

SEQ ID NO: 1832370 - DNA, 13 bp, Homo sapiens
ggcttgctccagg

SEQ ID NO: 1832371 - DNA, 22 bp, Homo sapiens
ggcttgctccagggtcttgggc

SEQ ID NO: 1832372 - DNA, 17 bp, Homo sapiens
ggctttgcaggctctgg

SEQ ID NO: 1832373 - DNA, 16 bp, Homo sapiens
gggaaagcgggcagcc

SEQ ID NO: 1832374 - DNA, 14 bp, Homo sapiens
gggaactccactct

SEQ ID NO: 1832375 - DNA, 14 bp, Homo sapiens
gggaagagcacagc

SEQ ID NO: 1832376 - DNA, 15 bp, Homo sapiens
gggaagagcacagcc

SEQ ID NO: 1832377 - DNA, 15 bp, Homo sapiens
gggaagagggcagta

SEQ ID NO: 1832378 - DNA, 22 bp, Homo sapiens
gggaagctgtactcagagcaga

SEQ ID NO: 1832379 - DNA, 15 bp, Homo sapiens
gggaatgttccctgc

SEQ ID NO: 1832380 - DNA, 17 bp, Homo sapiens
gggaatgttccctgcac

SEQ ID NO: 1832381 - DNA, 22 bp, Homo sapiens
gggaatgttccctgcaccctgg

SEQ ID NO: 1832382 - DNA, 23 bp, Homo sapiens
gggaatgttccctgcaccctgga

SEQ ID NO: 1832383 - DNA, 15 bp, Homo sapiens
gggacagttggcaga

SEQ ID NO: 1832384 - DNA, 19 bp, Homo sapiens
gggacagttggcagagaag

SEQ ID NO: 1832385 - DNA, 20 bp, Homo sapiens
gggacagttggcagagaagg

SEQ ID NO: 1832386 - DNA, 24 bp, Homo sapiens
gggacccagctactctgtccaggc

SEQ ID NO: 1832387 - DNA, 15 bp, Homo sapiens
gggactgtgcctttg

SEQ ID NO: 1832388 - DNA, 14 bp, Homo sapiens
gggaggcaccagct

SEQ ID NO: 1832389 - DNA, 15 bp, Homo sapiens
gggaggcaccagctc

SEQ ID NO: 1832390 - DNA, 13 bp, Homo sapiens
gggaggggcccgc

SEQ ID NO: 1832391 - DNA, 18 bp, Homo sapiens
gggaggtgagaccacctc

SEQ ID NO: 1832392 - DNA, 18 bp, Homo sapiens
gggagtgcagagaaagaa

SEQ ID NO: 1832393 - DNA, 12 bp, Homo sapiens
gggatgtcctct

SEQ ID NO: 1832394 - DNA, 18 bp, Homo sapiens
gggatttcttcgctgctc

SEQ ID NO: 1832395 - DNA, 12 bp, Homo sapiens
gggcagagggaa

SEQ ID NO: 1832396 - DNA, 12 bp, Homo sapiens
gggcagcacagc

SEQ ID NO: 1832397 - DNA, 18 bp, Homo sapiens
gggcagccgctaggagag

SEQ ID NO: 1832398 - DNA, 13 bp, Homo sapiens
gggcagctgggcc

SEQ ID NO: 1832399 - DNA, 13 bp, Homo sapiens
gggcaggcctggg

SEQ ID NO: 1832400 - DNA, 14 bp, Homo sapiens
gggcagtacctggg

SEQ ID NO: 1832401 - DNA, 15 bp, Homo sapiens
gggcagtgactggca

SEQ ID NO: 1832402 - DNA, 17 bp, Homo sapiens
gggcagtgactggcagg

SEQ ID NO: 1832403 - DNA, 18 bp, Homo sapiens
gggcagtgactggcaggt

SEQ ID NO: 1832404 - DNA, 13 bp, Homo sapiens
gggcatcaggcac

SEQ ID NO: 1832405 - DNA, 14 bp, Homo sapiens
gggcatcaggcact

SEQ ID NO: 1832406 - DNA, 17 bp, Homo sapiens
gggcatccacccagtgc

SEQ ID NO: 1832407 - DNA, 15 bp, Homo sapiens
gggcatgtgtgcctg

SEQ ID NO: 1832408 - DNA, 20 bp, Homo sapiens
gggcatgtgtgcctgtggca

SEQ ID NO: 1832409 - DNA, 22 bp, Homo sapiens
gggcatgtgtgcctgtggcaga

SEQ ID NO: 1832410 - DNA, 22 bp, Homo sapiens
gggccagaaggagggcagagcc

SEQ ID NO: 1832411 - DNA, 17 bp, Homo sapiens
gggccatactggcctcg

SEQ ID NO: 1832412 - DNA, 14 bp, Homo sapiens
gggccccagatctg

SEQ ID NO: 1832413 - DNA, 14 bp, Homo sapiens
gggccccggggctg

SEQ ID NO: 1832414 - DNA, 15 bp, Homo sapiens
gggccccggggctgg

SEQ ID NO: 1832415 - DNA, 16 bp, Homo sapiens
gggccccggggctggc

SEQ ID NO: 1832416 - DNA, 18 bp, Homo sapiens
gggccccggggctggcaa

SEQ ID NO: 1832417 - DNA, 19 bp, Homo sapiens
gggccccggggctggcaag

SEQ ID NO: 1832418 - DNA, 20 bp, Homo sapiens
gggcccgcttgcctcggctc

SEQ ID NO: 1832419 - DNA, 21 bp, Homo sapiens
gggcccgcttgcctcggctcc

SEQ ID NO: 1832420 - DNA, 21 bp, Homo sapiens
gggcccgttgtctccctggcc

SEQ ID NO: 1832421 - DNA, 16 bp, Homo sapiens
gggcctgatggggagg

SEQ ID NO: 1832422 - DNA, 12 bp, Homo sapiens
gggcctgcccaa

SEQ ID NO: 1832423 - DNA, 14 bp, Homo sapiens
gggcctggcctgag

SEQ ID NO: 1832424 - DNA, 15 bp, Homo sapiens
gggcctggcctgagc

SEQ ID NO: 1832425 - DNA, 18 bp, Homo sapiens
gggcctggcctgagctgg

SEQ ID NO: 1832426 - DNA, 22 bp, Homo sapiens
gggcctggcctgagctggggcc

SEQ ID NO: 1832427 - DNA, 21 bp, Homo sapiens
gggcctggcttgctccagggt

SEQ ID NO: 1832428 - DNA, 22 bp, Homo sapiens
gggcctggcttgctccagggtc

SEQ ID NO: 1832429 - DNA, 12 bp, Homo sapiens
gggcctgggcct

SEQ ID NO: 1832430 - DNA, 16 bp, Homo sapiens
gggcctgtgcagcagc

SEQ ID NO: 1832431 - DNA, 20 bp, Homo sapiens
gggcctgtgcagcagcccag

SEQ ID NO: 1832432 - DNA, 21 bp, Homo sapiens
gggcgctcaggacccaggccc

SEQ ID NO: 1832433 - DNA, 15 bp, Homo sapiens
gggcgggcagcacag

SEQ ID NO: 1832434 - DNA, 20 bp, Homo sapiens
gggcgggcagcacagcaagg

SEQ ID NO: 1832435 - DNA, 15 bp, Homo sapiens
gggctactggcagct

SEQ ID NO: 1832436 - DNA, 16 bp, Homo sapiens
gggctactggcagctc

SEQ ID NO: 1832437 - DNA, 18 bp, Homo sapiens
gggctactggcagctcct

SEQ ID NO: 1832438 - DNA, 15 bp, Homo sapiens
gggctatggcaaggg

SEQ ID NO: 1832439 - DNA, 17 bp, Homo sapiens
gggctatttctctcccc

SEQ ID NO: 1832440 - DNA, 12 bp, Homo sapiens
gggctcagggct

SEQ ID NO: 1832441 - DNA, 23 bp, Homo sapiens
gggctctccaaaggggctgctgg

SEQ ID NO: 1832442 - DNA, 20 bp, Homo sapiens
gggctgacacctaccatgct

SEQ ID NO: 1832443 - DNA, 22 bp, Homo sapiens
gggctgacacctaccatgctgc

SEQ ID NO: 1832444 - DNA, 18 bp, Homo sapiens
gggctgcccgctcccagt

SEQ ID NO: 1832445 - DNA, 22 bp, Homo sapiens
gggctgcccgctcccagtgtct

SEQ ID NO: 1832446 - DNA, 11 bp, Homo sapiens
gggctgctggg

SEQ ID NO: 1832447 - DNA, 23 bp, Homo sapiens
gggctggagtgcgctcttggtcc

SEQ ID NO: 1832448 - DNA, 17 bp, Homo sapiens
gggctggcaagcaggga

SEQ ID NO: 1832449 - DNA, 16 bp, Homo sapiens
gggctgggttggcgca

SEQ ID NO: 1832450 - DNA, 22 bp, Homo sapiens
gggctgggttggcgcaccctcc

SEQ ID NO: 1832451 - DNA, 15 bp, Homo sapiens
gggcttggggctgca

SEQ ID NO: 1832452 - DNA, 14 bp, Homo sapiens
gggctttgcaggct

SEQ ID NO: 1832453 - DNA, 16 bp, Homo sapiens
gggctttgcaggctct

SEQ ID NO: 1832454 - DNA, 18 bp, Homo sapiens
ggggaagagcacagccct

SEQ ID NO: 1832455 - DNA, 17 bp, Homo sapiens
ggggcaggcacagcaca

SEQ ID NO: 1832456 - DNA, 16 bp, Homo sapiens
ggggcaggccctgcac

SEQ ID NO: 1832457 - DNA, 21 bp, Homo sapiens
ggggcaggccctgcactgtcc

SEQ ID NO: 1832458 - DNA, 22 bp, Homo sapiens
ggggcaggccctgcactgtcct

SEQ ID NO: 1832459 - DNA, 23 bp, Homo sapiens
ggggcaggccctgcactgtcctg

SEQ ID NO: 1832460 - DNA, 13 bp, Homo sapiens
ggggcaggcctgg

SEQ ID NO: 1832461 - DNA, 18 bp, Homo sapiens
ggggcagtgactggcagg

SEQ ID NO: 1832462 - DNA, 18 bp, Homo sapiens
ggggcatggttccttccc

SEQ ID NO: 1832463 - DNA, 21 bp, Homo sapiens
ggggcatggttccttccctgg

SEQ ID NO: 1832464 - DNA, 20 bp, Homo sapiens
ggggcatgtgtgcctgtggc

SEQ ID NO: 1832465 - DNA, 14 bp, Homo sapiens
ggggccccagatct

SEQ ID NO: 1832466 - DNA, 22 bp, Homo sapiens
ggggccccagatctgcctgggc

SEQ ID NO: 1832467 - DNA, 23 bp, Homo sapiens
ggggccccagatctgcctgggcc

SEQ ID NO: 1832468 - DNA, 21 bp, Homo sapiens
ggggcccgttgtctccctggc

SEQ ID NO: 1832469 - DNA, 19 bp, Homo sapiens
ggggcccttggggcctggc

SEQ ID NO: 1832470 - DNA, 21 bp, Homo sapiens
ggggcctggcttgctccaggg

SEQ ID NO: 1832471 - DNA, 14 bp, Homo sapiens
ggggcggggcagga

SEQ ID NO: 1832472 - DNA, 18 bp, Homo sapiens
ggggctctccaaaggggc

SEQ ID NO: 1832473 - DNA, 15 bp, Homo sapiens
ggggctgcccgctcc

SEQ ID NO: 1832474 - DNA, 23 bp, Homo sapiens
ggggctgcccgctcccagtgtct

SEQ ID NO: 1832475 - DNA, 19 bp, Homo sapiens
ggggctgggttggcgcacc

SEQ ID NO: 1832476 - DNA, 22 bp, Homo sapiens
ggggctgggttggcgcaccctc

SEQ ID NO: 1832477 - DNA, 17 bp, Homo sapiens
gggggaagagcacagcc

SEQ ID NO: 1832478 - DNA, 19 bp, Homo sapiens
gggggaagagcacagccct

SEQ ID NO: 1832479 - DNA, 15 bp, Homo sapiens
gggggaggccacccc

SEQ ID NO: 1832480 - DNA, 12 bp, Homo sapiens
gggggcgctcag

SEQ ID NO: 1832481 - DNA, 23 bp, Homo sapiens
gggggcgctcaggacccaggccc

SEQ ID NO: 1832482 - DNA, 20 bp, Homo sapiens
gggtcacaagtctaaacaat

SEQ ID NO: 1832483 - DNA, 11 bp, Homo sapiens
gggtccaggaa

SEQ ID NO: 1832484 - DNA, 17 bp, Homo sapiens
gggtcccacttcccctc

SEQ ID NO: 1832485 - DNA, 17 bp, Homo sapiens
gggtccgcaccagctgc

SEQ ID NO: 1832486 - DNA, 19 bp, Homo sapiens
gggtccgcaccagctgctc

SEQ ID NO: 1832487 - DNA, 14 bp, Homo sapiens
gggtgcacccactc

SEQ ID NO: 1832488 - DNA, 19 bp, Homo sapiens
gggtgcacccactcaccag

SEQ ID NO: 1832489 - DNA, 23 bp, Homo sapiens
gggtgcacccactcaccagggtc

SEQ ID NO: 1832490 - DNA, 23 bp, Homo sapiens
gggttttattgtccttcagagct

SEQ ID NO: 1832491 - DNA, 18 bp, Homo sapiens
ggtaatgcacatcctcat

SEQ ID NO: 1832492 - DNA, 16 bp, Homo sapiens
ggtagatcgcttgagc

SEQ ID NO: 1832493 - DNA, 21 bp, Homo sapiens
ggtaggcccttgtcctgccag

SEQ ID NO: 1832494 - DNA, 15 bp, Homo sapiens
ggtcagtgtggagag

SEQ ID NO: 1832495 - DNA, 14 bp, Homo sapiens
ggtccaagggccat

SEQ ID NO: 1832496 - DNA, 22 bp, Homo sapiens
ggtcccaagtagtagtgtcttc

SEQ ID NO: 1832497 - DNA, 13 bp, Homo sapiens
ggtcccacttccc

SEQ ID NO: 1832498 - DNA, 17 bp, Homo sapiens
ggtcccacttcccctcc

SEQ ID NO: 1832499 - DNA, 14 bp, Homo sapiens
ggtccgcaccagct

SEQ ID NO: 1832500 - DNA, 17 bp, Homo sapiens
ggtccgcaccagctgct

SEQ ID NO: 1832501 - DNA, 22 bp, Homo sapiens
ggtccgcaccagctgctctgcc

SEQ ID NO: 1832502 - DNA, 13 bp, Homo sapiens
ggtcctagcccag

SEQ ID NO: 1832503 - DNA, 22 bp, Homo sapiens
ggtctccttactctgagcccag

SEQ ID NO: 1832504 - DNA, 23 bp, Homo sapiens
ggtctccttactctgagcccagg

SEQ ID NO: 1832505 - DNA, 20 bp, Homo sapiens
ggtctcgctgatgctgggct

SEQ ID NO: 1832506 - DNA, 18 bp, Homo sapiens
ggtctgctcgggcccagg

SEQ ID NO: 1832507 - DNA, 16 bp, Homo sapiens
ggtctgtgctgtgcct

SEQ ID NO: 1832508 - DNA, 20 bp, Homo sapiens
ggtcttgggctactggcagc

SEQ ID NO: 1832509 - DNA, 21 bp, Homo sapiens
ggtgaccccttttcagcttct

SEQ ID NO: 1832510 - DNA, 16 bp, Homo sapiens
ggtgcagatgggctgt

SEQ ID NO: 1832511 - DNA, 22 bp, Homo sapiens
ggtgccacttcttaaaggcctg

SEQ ID NO: 1832512 - DNA, 15 bp, Homo sapiens
ggtgccattcccagc

SEQ ID NO: 1832513 - DNA, 14 bp, Homo sapiens
ggtgcgaccccatc

SEQ ID NO: 1832514 - DNA, 19 bp, Homo sapiens
ggtgcgaccccatctgccc

SEQ ID NO: 1832515 - DNA, 21 bp, Homo sapiens
ggtgcgaccccatctgcccag

SEQ ID NO: 1832516 - DNA, 12 bp, Homo sapiens
ggtgcgtggctg

SEQ ID NO: 1832517 - DNA, 21 bp, Homo sapiens
ggtgcgtggctgtggcacaga

SEQ ID NO: 1832518 - DNA, 14 bp, Homo sapiens
ggtgctctggcggc

SEQ ID NO: 1832519 - DNA, 13 bp, Homo sapiens
ggtgctgctaccc

SEQ ID NO: 1832520 - DNA, 12 bp, Homo sapiens
ggtgggcagctg

SEQ ID NO: 1832521 - DNA, 18 bp, Homo sapiens
ggtgggcagctgggcccc

SEQ ID NO: 1832522 - DNA, 12 bp, Homo sapiens
ggtgggcctggc

SEQ ID NO: 1832523 - DNA, 14 bp, Homo sapiens
ggtgggcctggcct

SEQ ID NO: 1832524 - DNA, 16 bp, Homo sapiens
ggtgggcctggcctga

SEQ ID NO: 1832525 - DNA, 17 bp, Homo sapiens
ggtgggcctggcctgag

SEQ ID NO: 1832526 - DNA, 20 bp, Homo sapiens
ggtggtctgctcgggcccag

SEQ ID NO: 1832527 - DNA, 22 bp, Homo sapiens
ggtggtctgctcgggcccaggc

SEQ ID NO: 1832528 - DNA, 15 bp, Homo sapiens
ggtgtcatctgagga

SEQ ID NO: 1832529 - DNA, 17 bp, Homo sapiens
ggtgtcgcgccttctcc

SEQ ID NO: 1832530 - DNA, 15 bp, Homo sapiens
ggtgtggtggctcat

SEQ ID NO: 1832531 - DNA, 19 bp, Homo sapiens
ggttactcagcagcagaga

SEQ ID NO: 1832532 - DNA, 21 bp, Homo sapiens
ggttgaaggcagtctgaaccc

SEQ ID NO: 1832533 - DNA, 19 bp, Homo sapiens
ggttgcttaaaagggacag

SEQ ID NO: 1832534 - DNA, 15 bp, Homo sapiens
ggttggcgcaccctc

SEQ ID NO: 1832535 - DNA, 19 bp, Homo sapiens
ggttgggcgtgctacctgc

SEQ ID NO: 1832536 - DNA, 14 bp, Homo sapiens
ggttttggagtcag

SEQ ID NO: 1832537 - DNA, 17 bp, Homo sapiens
ggttttggagtcagtag

SEQ ID NO: 1832538 - DNA, 17 bp, Homo sapiens
gtaaaaagattatatat

SEQ ID NO: 1832539 - DNA, 19 bp, Homo sapiens
gtaaaaatactgtttcact

SEQ ID NO: 1832540 - DNA, 18 bp, Homo sapiens
gtaaaaatgaaggaatta

SEQ ID NO: 1832541 - DNA, 13 bp, Homo sapiens
gtaaaagctaatt

SEQ ID NO: 1832542 - DNA, 15 bp, Homo sapiens
gtaaagaataaatga

SEQ ID NO: 1832543 - DNA, 23 bp, Homo sapiens
gtaaagaggaactagactttcct

SEQ ID NO: 1832544 - DNA, 15 bp, Homo sapiens
gtaaaggcctttaat

SEQ ID NO: 1832545 - DNA, 15 bp, Homo sapiens
gtaactgctgagcca

SEQ ID NO: 1832546 - DNA, 16 bp, Homo sapiens
gtaactgctgagccac

SEQ ID NO: 1832547 - DNA, 17 bp, Homo sapiens
gtaagacttcagatttc

SEQ ID NO: 1832548 - DNA, 16 bp, Homo sapiens
gtaagaggcttcaaaa

SEQ ID NO: 1832549 - DNA, 19 bp, Homo sapiens
gtaagatggcttatttgta

SEQ ID NO: 1832550 - DNA, 13 bp, Homo sapiens
gtaataatgtaat

SEQ ID NO: 1832551 - DNA, 21 bp, Homo sapiens
gtaatatctattattataaaa

SEQ ID NO: 1832552 - DNA, 17 bp, Homo sapiens
gtaatcattgactaaag

SEQ ID NO: 1832553 - DNA, 16 bp, Homo sapiens
gtaatgaaggcatatt

SEQ ID NO: 1832554 - DNA, 12 bp, Homo sapiens
gtaatgggcctg

SEQ ID NO: 1832555 - DNA, 17 bp, Homo sapiens
gtacactgcatctcaag

SEQ ID NO: 1832556 - DNA, 13 bp, Homo sapiens
gtacacttcctgt

SEQ ID NO: 1832557 - DNA, 21 bp, Homo sapiens
gtacaggcaaaacacgcaagg

SEQ ID NO: 1832558 - DNA, 24 bp, Homo sapiens
gtacaggcaaaacacgcaagggca

SEQ ID NO: 1832559 - DNA, 14 bp, Homo sapiens
gtacagtgaggagg

SEQ ID NO: 1832560 - DNA, 18 bp, Homo sapiens
gtacagtgaggagggtgg

SEQ ID NO: 1832561 - DNA, 18 bp, Homo sapiens
gtaccaggtctcctccac

SEQ ID NO: 1832562 - DNA, 13 bp, Homo sapiens
gtacccccgccca

SEQ ID NO: 1832563 - DNA, 23 bp, Homo sapiens
gtacccccgcccaggctggccag

SEQ ID NO: 1832564 - DNA, 18 bp, Homo sapiens
gtaccctatagagagggg

SEQ ID NO: 1832565 - DNA, 22 bp, Homo sapiens
gtacctgggaaaggacccaccc

SEQ ID NO: 1832566 - DNA, 16 bp, Homo sapiens
gtactaaggagcatga

SEQ ID NO: 1832567 - DNA, 16 bp, Homo sapiens
gtactcagagcagagc

SEQ ID NO: 1832568 - DNA, 15 bp, Homo sapiens
gtactctctgctcta

SEQ ID NO: 1832569 - DNA, 21 bp, Homo sapiens
gtactctctgctctagccagg

SEQ ID NO: 1832570 - DNA, 21 bp, Homo sapiens
gtactgatactattcaatgca

SEQ ID NO: 1832571 - DNA, 14 bp, Homo sapiens
gtacttcctcctga

SEQ ID NO: 1832572 - DNA, 20 bp, Homo sapiens
gtacttcctcctgatggcca

SEQ ID NO: 1832573 - DNA, 21 bp, Homo sapiens
gtacttcctcctgatggccaa

SEQ ID NO: 1832574 - DNA, 21 bp, Homo sapiens
gtagaattcgcagtgatatac

SEQ ID NO: 1832575 - DNA, 13 bp, Homo sapiens
gtagcatatataa

SEQ ID NO: 1832576 - DNA, 16 bp, Homo sapiens
gtagccatggctcagg

SEQ ID NO: 1832577 - DNA, 18 bp, Homo sapiens
gtagccatggctcaggca

SEQ ID NO: 1832578 - DNA, 23 bp, Homo sapiens
gtagccatggctcaggcaagccc

SEQ ID NO: 1832579 - DNA, 21 bp, Homo sapiens
gtagcctccgtttatgggcct

SEQ ID NO: 1832580 - DNA, 22 bp, Homo sapiens
gtagccttgccttttaaaagaa

SEQ ID NO: 1832581 - DNA, 22 bp, Homo sapiens
gtaggaactcttaagcaatggt

SEQ ID NO: 1832582 - DNA, 22 bp, Homo sapiens
gtaggcccttgtcctgccagct

SEQ ID NO: 1832583 - DNA, 21 bp, Homo sapiens
gtagtaataaaaagtaacaca

SEQ ID NO: 1832584 - DNA, 14 bp, Homo sapiens
gtagtagtgtcttc

SEQ ID NO: 1832585 - DNA, 11 bp, Homo sapiens
gtagtgtcttc

SEQ ID NO: 1832586 - DNA, 22 bp, Homo sapiens
gtagtgtcttcctagtatatta

SEQ ID NO: 1832587 - DNA, 20 bp, Homo sapiens
gtataggataaattacatta

SEQ ID NO: 1832588 - DNA, 15 bp, Homo sapiens
gtatatgtatatcta

SEQ ID NO: 1832589 - DNA, 18 bp, Homo sapiens
gtatatgtatatctatat

SEQ ID NO: 1832590 - DNA, 14 bp, Homo sapiens
gtatattagtttga

SEQ ID NO: 1832591 - DNA, 18 bp, Homo sapiens
gtatcttcaaaaatacag

SEQ ID NO: 1832592 - DNA, 17 bp, Homo sapiens
gtatggctctcaagtga

SEQ ID NO: 1832593 - DNA, 14 bp, Homo sapiens
gtatgtcaataact

SEQ ID NO: 1832594 - DNA, 22 bp, Homo sapiens
gtatgttttaattgcatttaaa

SEQ ID NO: 1832595 - DNA, 22 bp, Homo sapiens
gtattaaaatgcatatttctat

SEQ ID NO: 1832596 - DNA, 23 bp, Homo sapiens
gtattaaaatgcatatttctatg

SEQ ID NO: 1832597 - DNA, 20 bp, Homo sapiens
gtattatttctccatcccct

SEQ ID NO: 1832598 - DNA, 15 bp, Homo sapiens
gtattcaggcactga

SEQ ID NO: 1832599 - DNA, 20 bp, Homo sapiens
gtatttttcaggtaggccct

SEQ ID NO: 1832600 - DNA, 23 bp, Homo sapiens
gtcaagaaaaatataaaaacaac

SEQ ID NO: 1832601 - DNA, 13 bp, Homo sapiens
gtcacagctgcag

SEQ ID NO: 1832602 - DNA, 15 bp, Homo sapiens
gtcacagctgcagct

SEQ ID NO: 1832603 - DNA, 20 bp, Homo sapiens
gtcacagctgcagctgggcc

SEQ ID NO: 1832604 - DNA, 18 bp, Homo sapiens
gtcacctgcaagccccag

SEQ ID NO: 1832605 - DNA, 19 bp, Homo sapiens
gtcactggctgcctccact

SEQ ID NO: 1832606 - DNA, 21 bp, Homo sapiens
gtcactggctgcctccactcc

SEQ ID NO: 1832607 - DNA, 18 bp, Homo sapiens
gtcaggatctcatgacat

SEQ ID NO: 1832608 - DNA, 19 bp, Homo sapiens
gtcagtaggtccaagggcc

SEQ ID NO: 1832609 - DNA, 20 bp, Homo sapiens
gtcagtaggtccaagggcca

SEQ ID NO: 1832610 - DNA, 21 bp, Homo sapiens
gtcagtaggtccaagggccat

SEQ ID NO: 1832611 - DNA, 15 bp, Homo sapiens
gtcagtgtggagagg

SEQ ID NO: 1832612 - DNA, 16 bp, Homo sapiens
gtcagtgtggagaggg

SEQ ID NO: 1832613 - DNA, 20 bp, Homo sapiens
gtcagttcccggagcacagc

SEQ ID NO: 1832614 - DNA, 21 bp, Homo sapiens
gtcagttcccggagcacagcc

SEQ ID NO: 1832615 - DNA, 19 bp, Homo sapiens
gtcatgactagtgcctaga

SEQ ID NO: 1832616 - DNA, 19 bp, Homo sapiens
gtcatgctcacttttgtga

SEQ ID NO: 1832617 - DNA, 13 bp, Homo sapiens
gtccacaggggca

SEQ ID NO: 1832618 - DNA, 16 bp, Homo sapiens
gtccacaggggcaggc

SEQ ID NO: 1832619 - DNA, 17 bp, Homo sapiens
gtccacaggggcaggcc

SEQ ID NO: 1832620 - DNA, 22 bp, Homo sapiens
gtccacaggggcaggcctggga

SEQ ID NO: 1832621 - DNA, 23 bp, Homo sapiens
gtccacaggggcaggcctgggac

SEQ ID NO: 1832622 - DNA, 19 bp, Homo sapiens
gtccacccaggctgcactg

SEQ ID NO: 1832623 - DNA, 21 bp, Homo sapiens
gtccacccaggctgcactgca

SEQ ID NO: 1832624 - DNA, 12 bp, Homo sapiens
gtgccctgcccc

SEQ ID NO: 1832625 - DNA, 22 bp, Homo sapiens
gtgccctgcccccatctcccca

SEQ ID NO: 1832626 - DNA, 14 bp, Homo sapiens
gtgcctagaaagca

SEQ ID NO: 1832627 - DNA, 16 bp, Homo sapiens
gtgcctcgaggcaccg

SEQ ID NO: 1832628 - DNA, 21 bp, Homo sapiens
gtgcctgattcggctgtctca

SEQ ID NO: 1832629 - DNA, 14 bp, Homo sapiens
gtgcctgcaccagg

SEQ ID NO: 1832630 - DNA, 15 bp, Homo sapiens
gtgcctgcaccagga

SEQ ID NO: 1832631 - DNA, 17 bp, Homo sapiens
gtgcctgcaccaggaga

SEQ ID NO: 1832632 - DNA, 18 bp, Homo sapiens
gtgcctgcaccaggagac

SEQ ID NO: 1832633 - DNA, 14 bp, Homo sapiens
gtgcctgctagagc

SEQ ID NO: 1832634 - DNA, 18 bp, Homo sapiens
gtgcctgctagagcaacc

SEQ ID NO: 1832635 - DNA, 14 bp, Homo sapiens
gtgccttttgccat

SEQ ID NO: 1832636 - DNA, 18 bp, Homo sapiens
gtgcgctcttggtccctg

SEQ ID NO: 1832637 - DNA, 19 bp, Homo sapiens
gtgcgctcttggtccctgg

SEQ ID NO: 1832638 - DNA, 17 bp, Homo sapiens
gtgctcacgctcccccg

SEQ ID NO: 1832639 - DNA, 21 bp, Homo sapiens
gtgctcacgctcccccgcagt

SEQ ID NO: 1832640 - DNA, 22 bp, Homo sapiens
gtgctctggcggcttcctgtcc

SEQ ID NO: 1832641 - DNA, 20 bp, Homo sapiens
gtgctgacaatactgctgcc

SEQ ID NO: 1832642 - DNA, 11 bp, Homo sapiens
gtgctgagctt

SEQ ID NO: 1832643 - DNA, 18 bp, Homo sapiens
gtgctgagcttagccttg

SEQ ID NO: 1832644 - DNA, 14 bp, Homo sapiens
gtgctgccatgcca

SEQ ID NO: 1832645 - DNA, 18 bp, Homo sapiens
gtgctgctaccctccctg

SEQ ID NO: 1832646 - DNA, 21 bp, Homo sapiens
gtgctgctaccctccctgctg

SEQ ID NO: 1832647 - DNA, 16 bp, Homo sapiens
gtgctgtacccttcca

SEQ ID NO: 1832648 - DNA, 18 bp, Homo sapiens
gtgctgtacccttccacc

SEQ ID NO: 1832649 - DNA, 20 bp, Homo sapiens
gtgctgtacccttccacctc

SEQ ID NO: 1832650 - DNA, 15 bp, Homo sapiens
gtgctgtgcctgcta

SEQ ID NO: 1832651 - DNA, 16 bp, Homo sapiens
gtgctgtgcctgctag

SEQ ID NO: 1832652 - DNA, 18 bp, Homo sapiens
gtgctgtgcctgctagag

SEQ ID NO: 1832653 - DNA, 12 bp, Homo sapiens
gtggacacctgc

SEQ ID NO: 1832654 - DNA, 16 bp, Homo sapiens
gtggacacctgccctg

SEQ ID NO: 1832655 - DNA, 16 bp, Homo sapiens
gtggaggaaggtgctg

SEQ ID NO: 1832656 - DNA, 12 bp, Homo sapiens
gtggaggcctga

SEQ ID NO: 1832657 - DNA, 18 bp, Homo sapiens
gtggcaaagtgctgtacc

SEQ ID NO: 1832658 - DNA, 15 bp, Homo sapiens
gtggcacctcctgag

SEQ ID NO: 1832659 - DNA, 18 bp, Homo sapiens
gtggcagaaaagaggaga

SEQ ID NO: 1832660 - DNA, 19 bp, Homo sapiens
gtggcagaaaagaggagac

SEQ ID NO: 1832661 - DNA, 20 bp, Homo sapiens
gtggcagccatgcctcatgc

SEQ ID NO: 1832662 - DNA, 22 bp, Homo sapiens
gtggcagccatgcctcatgcca

SEQ ID NO: 1832663 - DNA, 22 bp, Homo sapiens
gtggcatcgtagaagagatgtg

SEQ ID NO: 1832664 - DNA, 13 bp, Homo sapiens
gtggccagagctg

SEQ ID NO: 1832665 - DNA, 22 bp, Homo sapiens
gtggccagagctggaaggcagg

SEQ ID NO: 1832666 - DNA, 17 bp, Homo sapiens
gtggcccatcccccctc

SEQ ID NO: 1832667 - DNA, 20 bp, Homo sapiens
gtggcccatcccccctcacc

SEQ ID NO: 1832668 - DNA, 12 bp, Homo sapiens
gtggccccagcc

SEQ ID NO: 1832669 - DNA, 20 bp, Homo sapiens
gtggccccagcctggcccag

SEQ ID NO: 1832670 - DNA, 22 bp, Homo sapiens
gtggcctgtgtccagcagctgc

SEQ ID NO: 1832671 - DNA, 15 bp, Homo sapiens
gtggctgtccagtgc

SEQ ID NO: 1832672 - DNA, 17 bp, Homo sapiens
gtggctgtccagtgccc

SEQ ID NO: 1832673 - DNA, 18 bp, Homo sapiens
gtggctgtccagtgccca

SEQ ID NO: 1832674 - DNA, 15 bp, Homo sapiens
gtggctgtggcacag

SEQ ID NO: 1832675 - DNA, 16 bp, Homo sapiens
gtggctgtggcacaga

SEQ ID NO: 1832676 - DNA, 17 bp, Homo sapiens
gtgggcagctgggcccc

SEQ ID NO: 1832677 - DNA, 14 bp, Homo sapiens
gtgggcctggcctg

SEQ ID NO: 1832678 - DNA, 18 bp, Homo sapiens
gtgggcctggcctgagct

SEQ ID NO: 1832679 - DNA, 20 bp, Homo sapiens
gtgggcctggcctgagctgg

SEQ ID NO: 1832680 - DNA, 18 bp, Homo sapiens
gtggggctcgtggccttc

SEQ ID NO: 1832681 - DNA, 19 bp, Homo sapiens
gtggggtaggttgggagaa

SEQ ID NO: 1832682 - DNA, 13 bp, Homo sapiens
gtgggtctgtgtg

SEQ ID NO: 1832683 - DNA, 18 bp, Homo sapiens
gtgggtggcacctcctga

SEQ ID NO: 1832684 - DNA, 22 bp, Homo sapiens
gtggtctgctcgggcccaggcc

SEQ ID NO: 1832685 - DNA, 22 bp, Homo sapiens
gtggttgttgccaactaagccc

SEQ ID NO: 1832686 - DNA, 20 bp, Homo sapiens
gtgtaagacttcagatttca

SEQ ID NO: 1832687 - DNA, 20 bp, Homo sapiens
gtgtaatttaaaattgtgat

SEQ ID NO: 1832688 - DNA, 23 bp, Homo sapiens
gtgtaatttaaaattgtgatgtg

SEQ ID NO: 1832689 - DNA, 19 bp, Homo sapiens
gtgtagtggaagagcagcc

SEQ ID NO: 1832690 - DNA, 21 bp, Homo sapiens
gtgtatgtgggggtctgtgtg

SEQ ID NO: 1832691 - DNA, 14 bp, Homo sapiens
gtgtattatttctg

SEQ ID NO: 1832692 - DNA, 22 bp, Homo sapiens
gtgtatttttcaggtaggccct

SEQ ID NO: 1832693 - DNA, 14 bp, Homo sapiens
gtgtcactggctgc

SEQ ID NO: 1832694 - DNA, 18 bp, Homo sapiens
gtgtcactggctgcctcc

SEQ ID NO: 1832695 - DNA, 18 bp, Homo sapiens
gtgtcccaaggagctgat

SEQ ID NO: 1832696 - DNA, 12 bp, Homo sapiens
gtgtctctccca

SEQ ID NO: 1832697 - DNA, 14 bp, Homo sapiens
gtgtctctcccacc

SEQ ID NO: 1832698 - DNA, 12 bp, Homo sapiens
gtgtctgggctg

SEQ ID NO: 1832699 - DNA, 18 bp, Homo sapiens
gtgtgagtggcagccatg

SEQ ID NO: 1832700 - DNA, 20 bp, Homo sapiens
gtgtgagtggcagccatgcc

SEQ ID NO: 1832701 - DNA, 21 bp, Homo sapiens
gtgtgccccccatcctggccc

SEQ ID NO: 1832702 - DNA, 22 bp, Homo sapiens
gtgtgccccccatcctggccca

SEQ ID NO: 1832703 - DNA, 23 bp, Homo sapiens
gtgtgccccccatcctggcccat

SEQ ID NO: 1832704 - DNA, 14 bp, Homo sapiens
gtgtgcctgtggca

SEQ ID NO: 1832705 - DNA, 16 bp, Homo sapiens
gtgtgcctgtggcaga

SEQ ID NO: 1832706 - DNA, 14 bp, Homo sapiens
gtgtgtaatttaaa

SEQ ID NO: 1832707 - DNA, 15 bp, Homo sapiens
gtgtgtatgtggggg

SEQ ID NO: 1832708 - DNA, 14 bp, Homo sapiens
gtgtgttgtgtgtg

SEQ ID NO: 1832709 - DNA, 14 bp, Homo sapiens
gtgttaggcctggc

SEQ ID NO: 1832710 - DNA, 15 bp, Homo sapiens
gtgttaggcctggca

SEQ ID NO: 1832711 - DNA, 18 bp, Homo sapiens
gtgttaggcctggcacag

SEQ ID NO: 1832712 - DNA, 19 bp, Homo sapiens
gtgttaggcctggcacagt

SEQ ID NO: 1832713 - DNA, 19 bp, Homo sapiens
gtgttgaccactccagaga

SEQ ID NO: 1832714 - DNA, 12 bp, Homo sapiens
gtgtttatgtgt

SEQ ID NO: 1832715 - DNA, 16 bp, Homo sapiens
gtgtttatgtgtgtgt

SEQ ID NO: 1832716 - DNA, 17 bp, Homo sapiens
gttaaatcattttcatt

SEQ ID NO: 1832717 - DNA, 20 bp, Homo sapiens
gttaactgtcttgagagaaa

SEQ ID NO: 1832718 - DNA, 19 bp, Homo sapiens
gttaattgattaaaatctg

SEQ ID NO: 1832719 - DNA, 13 bp, Homo sapiens
gttagccctcagt

SEQ ID NO: 1832720 - DNA, 20 bp, Homo sapiens
gttagccctcagtcagttcc

SEQ ID NO: 1832721 - DNA, 19 bp, Homo sapiens
gttaggattaggtttagaa

SEQ ID NO: 1832722 - DNA, 12 bp, Homo sapiens
gttataaataaa

SEQ ID NO: 1832723 - DNA, 15 bp, Homo sapiens
gttatacatcttcat

SEQ ID NO: 1832724 - DNA, 15 bp, Homo sapiens
gttatctgcctggcc

SEQ ID NO: 1832725 - DNA, 20 bp, Homo sapiens
gttatctgcctggcctggct

SEQ ID NO: 1832726 - DNA, 18 bp, Homo sapiens
gttcaagtgatctttcaa

SEQ ID NO: 1832727 - DNA, 21 bp, Homo sapiens
gttcccggagcacagccctgg

SEQ ID NO: 1832728 - DNA, 17 bp, Homo sapiens
gttccctgcaccctgga

SEQ ID NO: 1832729 - DNA, 17 bp, Homo sapiens
gttccctgtcagaggct

SEQ ID NO: 1832730 - DNA, 22 bp, Homo sapiens
gttctatcagtgacttctgaat

SEQ ID NO: 1832731 - DNA, 22 bp, Homo sapiens
gttcttagctgaacaatgaatg

SEQ ID NO: 1832732 - DNA, 22 bp, Homo sapiens
gttcttgggggaggccacccca

SEQ ID NO: 1832733 - DNA, 19 bp, Homo sapiens
gttgagtacagtgaggagg

SEQ ID NO: 1832734 - DNA, 20 bp, Homo sapiens
gttgatgtgggaagaagtaa

SEQ ID NO: 1832735 - DNA, 18 bp, Homo sapiens
gttgattgcgagaatttt

SEQ ID NO: 1832736 - DNA, 13 bp, Homo sapiens
gttgcacatcatt

SEQ ID NO: 1832737 - DNA, 16 bp, Homo sapiens
gttgcacatcattcat

SEQ ID NO: 1832738 - DNA, 19 bp, Homo sapiens
gttgcacatcattcattca

SEQ ID NO: 1832739 - DNA, 16 bp, Homo sapiens
gttgtattttgacaaa

SEQ ID NO: 1832740 - DNA, 18 bp, Homo sapiens
gttgtctattctgagcct

SEQ ID NO: 1832741 - DNA, 13 bp, Homo sapiens
gttgtctccctgg

SEQ ID NO: 1832742 - DNA, 14 bp, Homo sapiens
gttgtgtgtgggag

SEQ ID NO: 1832743 - DNA, 16 bp, Homo sapiens
gttgtgtgtgggagtg

SEQ ID NO: 1832744 - DNA, 17 bp, Homo sapiens
gtttagaactactgata

SEQ ID NO: 1832745 - DNA, 21 bp, Homo sapiens
gtttagaatcaagtctgtgaa

SEQ ID NO: 1832746 - DNA, 19 bp, Homo sapiens
gtttatacgtggaaacaca

SEQ ID NO: 1832747 - DNA, 15 bp, Homo sapiens
gtttattacaagttt

SEQ ID NO: 1832748 - DNA, 15 bp, Homo sapiens
gtttcactgttcatg

SEQ ID NO: 1832749 - DNA, 21 bp, Homo sapiens
gtttccaaagggcagtaaagt

SEQ ID NO: 1832750 - DNA, 19 bp, Homo sapiens
gtttccagctaagcctgat

SEQ ID NO: 1832751 - DNA, 15 bp, Homo sapiens
gtttctagaggcctc

SEQ ID NO: 1832752 - DNA, 17 bp, Homo sapiens
gtttctagaggcctcag

SEQ ID NO: 1832753 - DNA, 11 bp, Homo sapiens
gtttctatttc

SEQ ID NO: 1832754 - DNA, 17 bp, Homo sapiens
gtttgaactcacacttt

SEQ ID NO: 1832755 - DNA, 20 bp, Homo sapiens
gtttgagacaagccctggca

SEQ ID NO: 1832756 - DNA, 21 bp, Homo sapiens
gtttgagacaagccctggcaa

SEQ ID NO: 1832757 - DNA, 22 bp, Homo sapiens
gtttgagacaagccctggcaac

SEQ ID NO: 1832758 - DNA, 13 bp, Homo sapiens
gtttgcttctaaa

SEQ ID NO: 1832759 - DNA, 17 bp, Homo sapiens
gtttgtcccccggggca

SEQ ID NO: 1832760 - DNA, 17 bp, Homo sapiens
gttttctcagaacagct

SEQ ID NO: 1832761 - DNA, 16 bp, Homo sapiens
gttttcttaacttaaa

SEQ ID NO: 1832762 - DNA, 18 bp, Homo sapiens
gtttttataaaaaatggt

SEQ ID NO: 1832763 - DNA, 14 bp, Homo sapiens
taaaaaaagtatat

SEQ ID NO: 1832764 - DNA, 11 bp, Homo sapiens
taaaaaatcaa

SEQ ID NO: 1832765 - DNA, 22 bp, Homo sapiens
taaaaacaacaaatacttccat

SEQ ID NO: 1832766 - DNA, 14 bp, Homo sapiens
taaaaagattatat

SEQ ID NO: 1832767 - DNA, 12 bp, Homo sapiens
taaaagaaaaag

SEQ ID NO: 1832768 - DNA, 15 bp, Homo sapiens
taaaatgcatatttc

SEQ ID NO: 1832769 - DNA, 18 bp, Homo sapiens
taaaatgcccatttcgaa

SEQ ID NO: 1832770 - DNA, 15 bp, Homo sapiens
taaaccctatctgtg

SEQ ID NO: 1832771 - DNA, 17 bp, Homo sapiens
taaacctaattgtggta

SEQ ID NO: 1832772 - DNA, 18 bp, Homo sapiens
taaacctctaatttattt

SEQ ID NO: 1832773 - DNA, 13 bp, Homo sapiens
taaagaataaatg

SEQ ID NO: 1832774 - DNA, 15 bp, Homo sapiens
taaagagttattcaa

SEQ ID NO: 1832775 - DNA, 16 bp, Homo sapiens
taaagctggacaagaa

SEQ ID NO: 1832776 - DNA, 19 bp, Homo sapiens
taaagctggacaagaagct

SEQ ID NO: 1832777 - DNA, 20 bp, Homo sapiens
taaagctggacaagaagctg

SEQ ID NO: 1832778 - DNA, 14 bp, Homo sapiens
taaagctgtgacag

SEQ ID NO: 1832779 - DNA, 11 bp, Homo sapiens
taaaggcctgg

SEQ ID NO: 1832780 - DNA, 22 bp, Homo sapiens
taaaggcctttaataagtcatt

SEQ ID NO: 1832781 - DNA, 21 bp, Homo sapiens
taaaggtttcactgttcatga

SEQ ID NO: 1832782 - DNA, 18 bp, Homo sapiens
taaataacacagatattg

SEQ ID NO: 1832783 - DNA, 23 bp, Homo sapiens
taaatcattttcattaaaaggaa

SEQ ID NO: 1832784 - DNA, 21 bp, Homo sapiens
taaatctgacagtctcaaatt

SEQ ID NO: 1832785 - DNA, 15 bp, Homo sapiens
taaatgatattcata

SEQ ID NO: 1832786 - DNA, 14 bp, Homo sapiens
taaatgcccagttc

SEQ ID NO: 1832787 - DNA, 17 bp, Homo sapiens
taaatgcccagttcact

SEQ ID NO: 1832788 - DNA, 21 bp, Homo sapiens
taaatgttgcacatcattcat

SEQ ID NO: 1832789 - DNA, 23 bp, Homo sapiens
taaatttacagaatattatataa

SEQ ID NO: 1832790 - DNA, 14 bp, Homo sapiens
taacaactgtgaat

SEQ ID NO: 1832791 - DNA, 23 bp, Homo sapiens
taacaactgtgaatatgagaaat

SEQ ID NO: 1832792 - DNA, 18 bp, Homo sapiens
taacaggccttgagcaca

SEQ ID NO: 1832793 - DNA, 13 bp, Homo sapiens
taacatgcaacaa

SEQ ID NO: 1832794 - DNA, 15 bp, Homo sapiens
taacatgcaacaaaa

SEQ ID NO: 1832795 - DNA, 19 bp, Homo sapiens
taacatgcaacaaaaatgt

SEQ ID NO: 1832796 - DNA, 20 bp, Homo sapiens
taacatgcaacaaaaatgtg

SEQ ID NO: 1832797 - DNA, 13 bp, Homo sapiens
taactgctgagcc

SEQ ID NO: 1832798 - DNA, 17 bp, Homo sapiens
taactgctgagccactc

SEQ ID NO: 1832799 - DNA, 21 bp, Homo sapiens
taactgtcttgagagaaaaga

SEQ ID NO: 1832800 - DNA, 12 bp, Homo sapiens
taacttcttcca

SEQ ID NO: 1832801 - DNA, 22 bp, Homo sapiens
taagaatgcagattcctgggcc

SEQ ID NO: 1832802 - DNA, 16 bp, Homo sapiens
taagacttcagatttc

SEQ ID NO: 1832803 - DNA, 17 bp, Homo sapiens
taagacttcagatttca

SEQ ID NO: 1832804 - DNA, 20 bp, Homo sapiens
taagacttcagatttcaaat

SEQ ID NO: 1832805 - DNA, 20 bp, Homo sapiens
taagatgagatttgccagca

SEQ ID NO: 1832806 - DNA, 21 bp, Homo sapiens
taagatgagatttgccagcac

SEQ ID NO: 1832807 - DNA, 18 bp, Homo sapiens
taagcaggaggaggtgcc

SEQ ID NO: 1832808 - DNA, 19 bp, Homo sapiens
taagccctcgaaccaaggc

SEQ ID NO: 1832809 - DNA, 22 bp, Homo sapiens
taagccctcgaaccaaggcagc

SEQ ID NO: 1832810 - DNA, 20 bp, Homo sapiens
taaggaagaggggtctttta

SEQ ID NO: 1832811 - DNA, 15 bp, Homo sapiens
taaggagcatgattt

SEQ ID NO: 1832812 - DNA, 23 bp, Homo sapiens
taagtaatgaaggcatatttcca

SEQ ID NO: 1832813 - DNA, 12 bp, Homo sapiens
taagtatttcca

SEQ ID NO: 1832814 - DNA, 16 bp, Homo sapiens
taagtcttgtctcatt

SEQ ID NO: 1832815 - DNA, 22 bp, Homo sapiens
taagtgccaggatggaatgatg

SEQ ID NO: 1832816 - DNA, 15 bp, Homo sapiens
taagttaaatcattt

SEQ ID NO: 1832817 - DNA, 22 bp, Homo sapiens
taagttaaatcattttcattaa

SEQ ID NO: 1832818 - DNA, 23 bp, Homo sapiens
taagttaaatcattttcattaaa

SEQ ID NO: 1832819 - DNA, 23 bp, Homo sapiens
taagttctatcagtgacttctga

SEQ ID NO: 1832820 - DNA, 18 bp, Homo sapiens
taataaaaagtaacacac

SEQ ID NO: 1832821 - DNA, 20 bp, Homo sapiens
taataaaaagtaacacacca

SEQ ID NO: 1832822 - DNA, 12 bp, Homo sapiens
taataatgtaat

SEQ ID NO: 1832823 - DNA, 16 bp, Homo sapiens
taataatttttgctga

SEQ ID NO: 1832824 - DNA, 18 bp, Homo sapiens
taataatttttgctgaat

SEQ ID NO: 1832825 - DNA, 19 bp, Homo sapiens
taatatctgagaagtgtat

SEQ ID NO: 1832826 - DNA, 21 bp, Homo sapiens
taatatctgagaagtgtatat

SEQ ID NO: 1832827 - DNA, 15 bp, Homo sapiens
taatatttttcaaaa

SEQ ID NO: 1832828 - DNA, 24 bp, Homo sapiens
taatcattgactaaagccatttgt

SEQ ID NO: 1832829 - DNA, 22 bp, Homo sapiens
taatccatgtgctgctgtggca

SEQ ID NO: 1832830 - DNA, 13 bp, Homo sapiens
taatctagaaaat

SEQ ID NO: 1832831 - DNA, 14 bp, Homo sapiens
taatctagaaaatg

SEQ ID NO: 1832832 - DNA, 23 bp, Homo sapiens
taatctcacttcatcaatcaaat

SEQ ID NO: 1832833 - DNA, 14 bp, Homo sapiens
taatctttctatat

SEQ ID NO: 1832834 - DNA, 22 bp, Homo sapiens
taatgaaggcatatttccaata

SEQ ID NO: 1832835 - DNA, 16 bp, Homo sapiens
taatgagtcacaaaat

SEQ ID NO: 1832836 - DNA, 19 bp, Homo sapiens
taatgcacatcctcattca

SEQ ID NO: 1832837 - DNA, 22 bp, Homo sapiens
taatgcacatcctcattcacta

SEQ ID NO: 1832838 - DNA, 19 bp, Homo sapiens
taatggaactgaccccctc

SEQ ID NO: 1832839 - DNA, 22 bp, Homo sapiens
taatgggatctatttttgcact

SEQ ID NO: 1832840 - DNA, 19 bp, Homo sapiens
taatgtaatactgtagaaa

SEQ ID NO: 1832841 - DNA, 22 bp, Homo sapiens
taattaaaccagactctgttgc

SEQ ID NO: 1832842 - DNA, 14 bp, Homo sapiens
taattcttcattat

SEQ ID NO: 1832843 - DNA, 12 bp, Homo sapiens
taattgcaacaa

SEQ ID NO: 1832844 - DNA, 16 bp, Homo sapiens
taattgcaacaatgca

SEQ ID NO: 1832845 - DNA, 17 bp, Homo sapiens
taattgcaacaatgcaa

SEQ ID NO: 1832846 - DNA, 17 bp, Homo sapiens
taattggctttgcagat

SEQ ID NO: 1832847 - DNA, 22 bp, Homo sapiens
tacaggcaaaacacgcaagggc

SEQ ID NO: 1832848 - DNA, 15 bp, Homo sapiens
tacagtatcttcaaa

SEQ ID NO: 1832849 - DNA, 17 bp, Homo sapiens
tacagtatcttcaaaaa

SEQ ID NO: 1832850 - DNA, 14 bp, Homo sapiens
tacatcttcattaa

SEQ ID NO: 1832851 - DNA, 22 bp, Homo sapiens
tacattatattcctctaaaact

SEQ ID NO: 1832852 - DNA, 18 bp, Homo sapiens
tacattttattacactaa

SEQ ID NO: 1832853 - DNA, 16 bp, Homo sapiens
taccacgccttgacct

SEQ ID NO: 1832854 - DNA, 17 bp, Homo sapiens
taccacgccttgacctt

SEQ ID NO: 1832855 - DNA, 16 bp, Homo sapiens
taccaggtctcctcca

SEQ ID NO: 1832856 - DNA, 20 bp, Homo sapiens
taccaggtctcctccaccgc

SEQ ID NO: 1832857 - DNA, 22 bp, Homo sapiens
taccatgctgctttttggcaca

SEQ ID NO: 1832858 - DNA, 13 bp, Homo sapiens
tacccagctcctt

SEQ ID NO: 1832859 - DNA, 17 bp, Homo sapiens
taccccacctcatgcct

SEQ ID NO: 1832860 - DNA, 20 bp, Homo sapiens
taccccacctcatgcctggc

SEQ ID NO: 1832861 - DNA, 16 bp, Homo sapiens
tacccccgcccaggct

SEQ ID NO: 1832862 - DNA, 15 bp, Homo sapiens
tacccctcccagctg

SEQ ID NO: 1832863 - DNA, 19 bp, Homo sapiens
tacccctcccagctgacag

SEQ ID NO: 1832864 - DNA, 17 bp, Homo sapiens
taccctcccaccagaac

SEQ ID NO: 1832865 - DNA, 11 bp, Homo sapiens
taccctccctg

SEQ ID NO: 1832866 - DNA, 12 bp, Homo sapiens
taccctccctgc

SEQ ID NO: 1832867 - DNA, 19 bp, Homo sapiens
tacccttccacctcctaga

SEQ ID NO: 1832868 - DNA, 20 bp, Homo sapiens
tacctatgtgagtttcagaa

SEQ ID NO: 1832869 - DNA, 17 bp, Homo sapiens
tacctggcaattcacaa

SEQ ID NO: 1832870 - DNA, 22 bp, Homo sapiens
tacctgggaaaggacccaccca

SEQ ID NO: 1832871 - DNA, 17 bp, Homo sapiens
taccttttaaaatagta

SEQ ID NO: 1832872 - DNA, 18 bp, Homo sapiens
tacctttttttctctcct

SEQ ID NO: 1832873 - DNA, 13 bp, Homo sapiens
tacgctgtctgta

SEQ ID NO: 1832874 - DNA, 16 bp, Homo sapiens
tacgtgttcaaaaatt

SEQ ID NO: 1832875 - DNA, 21 bp, Homo sapiens
tacgtgttcaaaaatttctgc

SEQ ID NO: 1832876 - DNA, 11 bp, Homo sapiens
tactaaaagaa

SEQ ID NO: 1832877 - DNA, 13 bp, Homo sapiens
tactagtaataat

SEQ ID NO: 1832878 - DNA, 14 bp, Homo sapiens
tactatggctgttt

SEQ ID NO: 1832879 - DNA, 15 bp, Homo sapiens
tactattcaatgcaa

SEQ ID NO: 1832880 - DNA, 16 bp, Homo sapiens
tactcagcagcagaga

SEQ ID NO: 1832881 - DNA, 19 bp, Homo sapiens
tactcagcagcagagagcc

SEQ ID NO: 1832882 - DNA, 18 bp, Homo sapiens
tactcattccccggggcg

SEQ ID NO: 1832883 - DNA, 16 bp, Homo sapiens
tactcccttcctggcc

SEQ ID NO: 1832884 - DNA, 17 bp, Homo sapiens
tactcccttcctggcct

SEQ ID NO: 1832885 - DNA, 14 bp, Homo sapiens
tactctgagcccag

SEQ ID NO: 1832886 - DNA, 14 bp, Homo sapiens
tactctgtccaggc

SEQ ID NO: 1832887 - DNA, 15 bp, Homo sapiens
tactctgtccaggcc

SEQ ID NO: 1832888 - DNA, 12 bp, Homo sapiens
tactgaaagcaa

SEQ ID NO: 1832889 - DNA, 15 bp, Homo sapiens
tactgatactattca

SEQ ID NO: 1832890 - DNA, 15 bp, Homo sapiens
tactgcacattttgt

SEQ ID NO: 1832891 - DNA, 12 bp, Homo sapiens
tactggcagctc

SEQ ID NO: 1832892 - DNA, 21 bp, Homo sapiens
tactggcctcgcctggcctga

SEQ ID NO: 1832893 - DNA, 21 bp, Homo sapiens
tactgtgttaccttttaaaat

SEQ ID NO: 1832894 - DNA, 17 bp, Homo sapiens
tacttcctcctgatggc

SEQ ID NO: 1832895 - DNA, 18 bp, Homo sapiens
tacttcctcctgatggcc

SEQ ID NO: 1832896 - DNA, 16 bp, Homo sapiens
tacttggcattgagta

SEQ ID NO: 1832897 - DNA, 15 bp, Homo sapiens
tacttgtctgaggcc

SEQ ID NO: 1832898 - DNA, 17 bp, Homo sapiens
tacttgtgactgaaggg

SEQ ID NO: 1832899 - DNA, 20 bp, Homo sapiens
tagaaagaaaagaccctgag

SEQ ID NO: 1832900 - DNA, 16 bp, Homo sapiens
tagaagttaaagtcaa

SEQ ID NO: 1832901 - DNA, 14 bp, Homo sapiens
tagaataaatgaag

SEQ ID NO: 1832902 - DNA, 16 bp, Homo sapiens
tagaataatttctcct

SEQ ID NO: 1832903 - DNA, 17 bp, Homo sapiens
tagaatcaagtctgtga

SEQ ID NO: 1832904 - DNA, 21 bp, Homo sapiens
tagaatggcctctttgtagaa

SEQ ID NO: 1832905 - DNA, 17 bp, Homo sapiens
tagactggagtgaggct

SEQ ID NO: 1832906 - DNA, 21 bp, Homo sapiens
tagactggagtgaggcttcca

SEQ ID NO: 1832907 - DNA, 22 bp, Homo sapiens
tagactggagtgaggcttccag

SEQ ID NO: 1832908 - DNA, 13 bp, Homo sapiens
tagagagggggct

SEQ ID NO: 1832909 - DNA, 16 bp, Homo sapiens
tagagcacttttaaca

SEQ ID NO: 1832910 - DNA, 14 bp, Homo sapiens
tagaggtgggcagc

SEQ ID NO: 1832911 - DNA, 18 bp, Homo sapiens
tagatcgcttgagcccag

SEQ ID NO: 1832912 - DNA, 19 bp, Homo sapiens
tagatcgcttgagcccagg

SEQ ID NO: 1832913 - DNA, 17 bp, Homo sapiens
tagcacatgattttctt

SEQ ID NO: 1832914 - DNA, 18 bp, Homo sapiens
tagcatatataattttat

SEQ ID NO: 1832915 - DNA, 18 bp, Homo sapiens
tagccagagaggagcacc

SEQ ID NO: 1832916 - DNA, 19 bp, Homo sapiens
tagccagagaggagcacct

SEQ ID NO: 1832917 - DNA, 20 bp, Homo sapiens
tagccagagaggagcacctg

SEQ ID NO: 1832918 - DNA, 20 bp, Homo sapiens
tagccaggagtctgtgctct

SEQ ID NO: 1832919 - DNA, 17 bp, Homo sapiens
tagccttgtgccctgcc

SEQ ID NO: 1832920 - DNA, 22 bp, Homo sapiens
tagccttgtgccctgcccccat

SEQ ID NO: 1832921 - DNA, 18 bp, Homo sapiens
taggaactgctgggcttg

SEQ ID NO: 1832922 - DNA, 13 bp, Homo sapiens
taggaagaaaaat

SEQ ID NO: 1832923 - DNA, 13 bp, Homo sapiens
taggactgaggag

SEQ ID NO: 1832924 - DNA, 17 bp, Homo sapiens
taggagcccactgtaac

SEQ ID NO: 1832925 - DNA, 21 bp, Homo sapiens
taggagcccactgtaacaata

SEQ ID NO: 1832926 - DNA, 23 bp, Homo sapiens
taggcccttgtcctgccagctgc

SEQ ID NO: 1832927 - DNA, 17 bp, Homo sapiens
taggcctggcacagtgt

SEQ ID NO: 1832928 - DNA, 17 bp, Homo sapiens
tagggtcctggccctct

SEQ ID NO: 1832929 - DNA, 21 bp, Homo sapiens
taggtttagaatcaagtctgt

SEQ ID NO: 1832930 - DNA, 23 bp, Homo sapiens
taggtttagaatcaagtctgtga

SEQ ID NO: 1832931 - DNA, 21 bp, Homo sapiens
tagtaataatgtaatactgta

SEQ ID NO: 1832932 - DNA, 16 bp, Homo sapiens
tagtaatcattgacta

SEQ ID NO: 1832933 - DNA, 19 bp, Homo sapiens
tagtaatcattgactaaag

SEQ ID NO: 1832934 - DNA, 19 bp, Homo sapiens
tagtaccctatagagaggg

SEQ ID NO: 1832935 - DNA, 15 bp, Homo sapiens
tagtaccttcaaata

SEQ ID NO: 1832936 - DNA, 13 bp, Homo sapiens
tagtcaagaaaaa

SEQ ID NO: 1832937 - DNA, 21 bp, Homo sapiens
tagtcagtaaacatttgtaaa

SEQ ID NO: 1832938 - DNA, 22 bp, Homo sapiens
tagtgccaagtttttcagaaag

SEQ ID NO: 1832939 - DNA, 17 bp, Homo sapiens
tagtgtgagtggcagcc

SEQ ID NO: 1832940 - DNA, 19 bp, Homo sapiens
tagtgtgagtggcagccat

SEQ ID NO: 1832941 - DNA, 22 bp, Homo sapiens
tagtgtgagtggcagccatgcc

SEQ ID NO: 1832942 - DNA, 23 bp, Homo sapiens
tagttcttgggggaggccacccc

SEQ ID NO: 1832943 - DNA, 21 bp, Homo sapiens
tagttgattgcgagaattttc

SEQ ID NO: 1832944 - DNA, 16 bp, Homo sapiens
tagtttctagaggcct

SEQ ID NO: 1832945 - DNA, 20 bp, Homo sapiens
tagtttgatttaatatctga

SEQ ID NO: 1832946 - DNA, 13 bp, Homo sapiens
tataaaaaatggt

SEQ ID NO: 1832947 - DNA, 19 bp, Homo sapiens
tataaaaacaacaaatact

SEQ ID NO: 1832948 - DNA, 22 bp, Homo sapiens
tataaacctctaatttattttg

SEQ ID NO: 1832949 - DNA, 22 bp, Homo sapiens
tataaatacacttcctgcttaa

SEQ ID NO: 1832950 - DNA, 19 bp, Homo sapiens
tataaatgtaaaaatgaag

SEQ ID NO: 1832951 - DNA, 17 bp, Homo sapiens
tataagacactttgcca

SEQ ID NO: 1832952 - DNA, 22 bp, Homo sapiens
tccagcctctcccggctgcctg

SEQ ID NO: 1832953 - DNA, 19 bp, Homo sapiens
tccagctaagcctgatgat

SEQ ID NO: 1832954 - DNA, 14 bp, Homo sapiens
tccaggaaggcagc

SEQ ID NO: 1832955 - DNA, 16 bp, Homo sapiens
tccaggaaggcagctg

SEQ ID NO: 1832956 - DNA, 20 bp, Homo sapiens
tccaggaaggcagctgctct

SEQ ID NO: 1832957 - DNA, 14 bp, Homo sapiens
tccaggcatgctgg

SEQ ID NO: 1832958 - DNA, 18 bp, Homo sapiens
tccaggccactgtggcca

SEQ ID NO: 1832959 - DNA, 20 bp, Homo sapiens
tccaggccactgtggccaga

SEQ ID NO: 1832960 - DNA, 15 bp, Homo sapiens
tccaggctcttcctg

SEQ ID NO: 1832961 - DNA, 14 bp, Homo sapiens
tccagggctgcccc

SEQ ID NO: 1832962 - DNA, 12 bp, Homo sapiens
tccaggggcacc

SEQ ID NO: 1832963 - DNA, 21 bp, Homo sapiens
tccaggtggggtgaggcagtg

SEQ ID NO: 1832964 - DNA, 20 bp, Homo sapiens
tccagtgcccattcctcacc

SEQ ID NO: 1832965 - DNA, 23 bp, Homo sapiens
tccagttcacaggccagaaaaca

SEQ ID NO: 1832966 - DNA, 14 bp, Homo sapiens
tccagttctgatga

SEQ ID NO: 1832967 - DNA, 16 bp, Homo sapiens
tccatatggagcattt

SEQ ID NO: 1832968 - DNA, 22 bp, Homo sapiens
tccatatggagcatttttcaga

SEQ ID NO: 1832969 - DNA, 23 bp, Homo sapiens
tccatatggagcatttttcagag

SEQ ID NO: 1832970 - DNA, 12 bp, Homo sapiens
tccatcccctcc

SEQ ID NO: 1832971 - DNA, 23 bp, Homo sapiens
tccatcccctccctgcctgctcc

SEQ ID NO: 1832972 - DNA, 16 bp, Homo sapiens
tccatgaccagaaaca

SEQ ID NO: 1832973 - DNA, 13 bp, Homo sapiens
tcctggcccatca

SEQ ID NO: 1832974 - DNA, 13 bp, Homo sapiens
tcctggctgccag

SEQ ID NO: 1832975 - DNA, 15 bp, Homo sapiens
tcctgggcctgtccc

SEQ ID NO: 1832976 - DNA, 21 bp, Homo sapiens
tcctggggccccgctgggatt

SEQ ID NO: 1832977 - DNA, 22 bp, Homo sapiens
tcctgtccactctcggggccct

SEQ ID NO: 1832978 - DNA, 19 bp, Homo sapiens
tcctgtccctcatccatag

SEQ ID NO: 1832979 - DNA, 15 bp, Homo sapiens
tccttactctgagcc

SEQ ID NO: 1832980 - DNA, 16 bp, Homo sapiens
tccttactctgagccc

SEQ ID NO: 1832981 - DNA, 20 bp, Homo sapiens
tccttactctgagcccaggc

SEQ ID NO: 1832982 - DNA, 22 bp, Homo sapiens
tccttatgagactcttaaatat

SEQ ID NO: 1832983 - DNA, 17 bp, Homo sapiens
tccttcagtgagcccct

SEQ ID NO: 1832984 - DNA, 18 bp, Homo sapiens
tccttcagtgagcccctc

SEQ ID NO: 1832985 - DNA, 14 bp, Homo sapiens
tccttccctgggaa

SEQ ID NO: 1832986 - DNA, 16 bp, Homo sapiens
tccttcctgtgccctg

SEQ ID NO: 1832987 - DNA, 16 bp, Homo sapiens
tccttcgtgtctctcc

SEQ ID NO: 1832988 - DNA, 19 bp, Homo sapiens
tccttcgtgtctctcccac

SEQ ID NO: 1832989 - DNA, 13 bp, Homo sapiens
tccttggcacccc

SEQ ID NO: 1832990 - DNA, 19 bp, Homo sapiens
tccttggcacccccatgct

SEQ ID NO: 1832991 - DNA, 23 bp, Homo sapiens
tccttggcacccccatgctgcct

SEQ ID NO: 1832992 - DNA, 21 bp, Homo sapiens
tccttgggctcctggctgcca

SEQ ID NO: 1832993 - DNA, 23 bp, Homo sapiens
tcctttacaactaaataacacag

SEQ ID NO: 1832994 - DNA, 14 bp, Homo sapiens
tccttttgtcccca

SEQ ID NO: 1832995 - DNA, 18 bp, Homo sapiens
tccttttgtccccagggc

SEQ ID NO: 1832996 - DNA, 17 bp, Homo sapiens
tcgaaccaaggcagcct

SEQ ID NO: 1832997 - DNA, 19 bp, Homo sapiens
tcgaaccaaggcagcctcc

SEQ ID NO: 1832998 - DNA, 20 bp, Homo sapiens
tcgaaccaaggcagcctcca

SEQ ID NO: 1832999 - DNA, 18 bp, Homo sapiens
tcgacgccccgaacctca

SEQ ID NO: 1833000 - DNA, 23 bp, Homo sapiens
tcgagatgttcgctcgtgcagta

SEQ ID NO: 1833001 - DNA, 20 bp, Homo sapiens
tcgaggcaccggcgctgcag

SEQ ID NO: 1833002 - DNA, 20 bp, Homo sapiens
tcgatgaatgtgttgatttg

SEQ ID NO: 1833003 - DNA, 20 bp, Homo sapiens
tcgcaggatccgctgccacc

SEQ ID NO: 1833004 - DNA, 21 bp, Homo sapiens
tcgcaggatccgctgccacca

SEQ ID NO: 1833005 - DNA, 22 bp, Homo sapiens
tcgcaggatccgctgccaccac

SEQ ID NO: 1833006 - DNA, 14 bp, Homo sapiens
tcgcagtcgcagga

SEQ ID NO: 1833007 - DNA, 16 bp, Homo sapiens
tcgcccaccgcatgcc

SEQ ID NO: 1833008 - DNA, 15 bp, Homo sapiens
tcgcctggcctgagg

SEQ ID NO: 1833009 - DNA, 12 bp, Homo sapiens
tcgcgctgcctg

SEQ ID NO: 1833010 - DNA, 17 bp, Homo sapiens
tcgctgctctagctggc

SEQ ID NO: 1833011 - DNA, 18 bp, Homo sapiens
tcgctgctctagctggca

SEQ ID NO: 1833012 - DNA, 19 bp, Homo sapiens
tcgctgctctagctggcag

SEQ ID NO: 1833013 - DNA, 21 bp, Homo sapiens
tcgctgctctagctggcagga

SEQ ID NO: 1833014 - DNA, 17 bp, Homo sapiens
tcgcttgagcccaggag

SEQ ID NO: 1833015 - DNA, 20 bp, Homo sapiens
tcggaagccgtctgactcca

SEQ ID NO: 1833016 - DNA, 15 bp, Homo sapiens
tcggctcctgctgca

SEQ ID NO: 1833017 - DNA, 18 bp, Homo sapiens
tcggctcctgctgcacca

SEQ ID NO: 1833018 - DNA, 17 bp, Homo sapiens
tcgggcccaggccatct

SEQ ID NO: 1833019 - DNA, 14 bp, Homo sapiens
tcgggctcctgtgc

SEQ ID NO: 1833020 - DNA, 19 bp, Homo sapiens
tcggttcctctgatttcaa

SEQ ID NO: 1833021 - DNA, 18 bp, Homo sapiens
tcgtattctaattcttca

SEQ ID NO: 1833022 - DNA, 21 bp, Homo sapiens
tcgtattctaattcttcatta

SEQ ID NO: 1833023 - DNA, 21 bp, Homo sapiens
tcgtccacaggggcaggcctg

SEQ ID NO: 1833024 - DNA, 14 bp, Homo sapiens
tcgtcctgtcccag

SEQ ID NO: 1833025 - DNA, 16 bp, Homo sapiens
tcgtcctgtcccagag

SEQ ID NO: 1833026 - DNA, 12 bp, Homo sapiens
tcgtggacacct

SEQ ID NO: 1833027 - DNA, 18 bp, Homo sapiens
tcgtggacacctgccctg

SEQ ID NO: 1833028 - DNA, 18 bp, Homo sapiens
tcgttagaggagcaacag

SEQ ID NO: 1833029 - DNA, 20 bp, Homo sapiens
tctaaacaatgaattcttca

SEQ ID NO: 1833030 - DNA, 22 bp, Homo sapiens
tctaaaggtttcactgttcatg

SEQ ID NO: 1833031 - DNA, 13 bp, Homo sapiens
tctaaatgcccag

SEQ ID NO: 1833032 - DNA, 14 bp, Homo sapiens
tctaaatgcccagt

SEQ ID NO: 1833033 - DNA, 16 bp, Homo sapiens
tctaaatgcccagttc

SEQ ID NO: 1833034 - DNA, 15 bp, Homo sapiens
tctaacccagtctta

SEQ ID NO: 1833035 - DNA, 18 bp, Homo sapiens
tctaattcttttcaaaat

SEQ ID NO: 1833036 - DNA, 14 bp, Homo sapiens
tctacattttatta

SEQ ID NO: 1833037 - DNA, 15 bp, Homo sapiens
tctacctcttggctg

SEQ ID NO: 1833038 - DNA, 17 bp, Homo sapiens
tctactgagacatgact

SEQ ID NO: 1833039 - DNA, 12 bp, Homo sapiens
tctagaggcctc

SEQ ID NO: 1833040 - DNA, 14 bp, Homo sapiens
tctagaggcctcag

SEQ ID NO: 1833041 - DNA, 20 bp, Homo sapiens
tctagccaggagtctgtgct

SEQ ID NO: 1833042 - DNA, 21 bp, Homo sapiens
tctagccaggagtctgtgctc

SEQ ID NO: 1833043 - DNA, 14 bp, Homo sapiens
tctagctggcagga

SEQ ID NO: 1833044 - DNA, 20 bp, Homo sapiens
tctaggagtcaactggctgg

SEQ ID NO: 1833045 - DNA, 21 bp, Homo sapiens
tctagttgattgcgagaattt

SEQ ID NO: 1833046 - DNA, 21 bp, Homo sapiens
tctatagttatacatcttcat

SEQ ID NO: 1833047 - DNA, 22 bp, Homo sapiens
tctatattccgggtgccattcc

SEQ ID NO: 1833048 - DNA, 20 bp, Homo sapiens
tctatcagtgacttctgaat

SEQ ID NO: 1833049 - DNA, 13 bp, Homo sapiens
tctatgttgtaat

SEQ ID NO: 1833050 - DNA, 13 bp, Homo sapiens
tctattctgagcc

SEQ ID NO: 1833051 - DNA, 17 bp, Homo sapiens
tctattctgagccttga

SEQ ID NO: 1833052 - DNA, 19 bp, Homo sapiens
tctatttttgcactggaat

SEQ ID NO: 1833053 - DNA, 22 bp, Homo sapiens
tctcaaaatacgtgttcaaaaa

SEQ ID NO: 1833054 - DNA, 21 bp, Homo sapiens
tctcaaatttttcatctcttc

SEQ ID NO: 1833055 - DNA, 23 bp, Homo sapiens
tctcaaatttttcatctcttcaa

SEQ ID NO: 1833056 - DNA, 17 bp, Homo sapiens
tctcaatttgaaacaca

SEQ ID NO: 1833057 - DNA, 15 bp, Homo sapiens
tctcagaacagctga

SEQ ID NO: 1833058 - DNA, 14 bp, Homo sapiens
tctcaggtgccact

SEQ ID NO: 1833059 - DNA, 16 bp, Homo sapiens
tctcaggtgccactcc

SEQ ID NO: 1833060 - DNA, 18 bp, Homo sapiens
tctcaggtgccactccct

SEQ ID NO: 1833061 - DNA, 21 bp, Homo sapiens
tctcaggtgccactccctgag

SEQ ID NO: 1833062 - DNA, 21 bp, Homo sapiens
tctcattcaggtgttctcttc

SEQ ID NO: 1833063 - DNA, 15 bp, Homo sapiens
tctttcatacattat

SEQ ID NO: 1833064 - DNA, 16 bp, Homo sapiens
tctttcatacattata

SEQ ID NO: 1833065 - DNA, 22 bp, Homo sapiens
tctttctatattttttaaattt

SEQ ID NO: 1833066 - DNA, 12 bp, Homo sapiens
tctttgctgccc

SEQ ID NO: 1833067 - DNA, 18 bp, Homo sapiens
tctttgctgcccctgtct

SEQ ID NO: 1833068 - DNA, 22 bp, Homo sapiens
tcttttcaaaattgttgcatcc

SEQ ID NO: 1833069 - DNA, 22 bp, Homo sapiens
tgaaaaaagtataggataaatt

SEQ ID NO: 1833070 - DNA, 13 bp, Homo sapiens
tgaaaaagaaaaa

SEQ ID NO: 1833071 - DNA, 14 bp, Homo sapiens
tgaaaaagaaaaaa

SEQ ID NO: 1833072 - DNA, 20 bp, Homo sapiens
tgaaaaatagtgtgtccatg

SEQ ID NO: 1833073 - DNA, 22 bp, Homo sapiens
tgaaaacaaaattccattacag

SEQ ID NO: 1833074 - DNA, 19 bp, Homo sapiens
tgaaaacttgctgaaaaac

SEQ ID NO: 1833075 - DNA, 23 bp, Homo sapiens
tgaaaacttgctgaaaaacacaa

SEQ ID NO: 1833076 - DNA, 18 bp, Homo sapiens
tgaaacattccgaagagg

SEQ ID NO: 1833077 - DNA, 20 bp, Homo sapiens
tgaaacattccgaagaggga

SEQ ID NO: 1833078 - DNA, 15 bp, Homo sapiens
tgaaactctattatg

SEQ ID NO: 1833079 - DNA, 14 bp, Homo sapiens
tgaaagaaggagca

SEQ ID NO: 1833080 - DNA, 19 bp, Homo sapiens
tgaaagacttgaatttagt

SEQ ID NO: 1833081 - DNA, 20 bp, Homo sapiens
tgaaagacttgaatttagtt

SEQ ID NO: 1833082 - DNA, 21 bp, Homo sapiens
tgaaagcagcagctaggactg

SEQ ID NO: 1833083 - DNA, 21 bp, Homo sapiens
tgaaaggacctcttctgaagc

SEQ ID NO: 1833084 - DNA, 15 bp, Homo sapiens
tgaaatgggagatgg

SEQ ID NO: 1833085 - DNA, 19 bp, Homo sapiens
tgaacaggttctttaaaat

SEQ ID NO: 1833086 - DNA, 22 bp, Homo sapiens
tgaaccgacttttctaaagctc

SEQ ID NO: 1833087 - DNA, 17 bp, Homo sapiens
tgaactattttgaagaa

SEQ ID NO: 1833088 - DNA, 22 bp, Homo sapiens
tgaactattttgaagaaaacac

SEQ ID NO: 1833089 - DNA, 19 bp, Homo sapiens
tgaacttgaggacacatgt

SEQ ID NO: 1833090 - DNA, 12 bp, Homo sapiens
tgaagaaaacac

SEQ ID NO: 1833091 - DNA, 19 bp, Homo sapiens
tgaagcagtgcctcgaggc

SEQ ID NO: 1833092 - DNA, 21 bp, Homo sapiens
tgaagcagtgcctcgaggcac

SEQ ID NO: 1833093 - DNA, 23 bp, Homo sapiens
tgaagcagtgcctcgaggcaccg

SEQ ID NO: 1833094 - DNA, 18 bp, Homo sapiens
tgagttacttgtctgagg

SEQ ID NO: 1833095 - DNA, 22 bp, Homo sapiens
tgagttacttgtctgaggcctc

SEQ ID NO: 1833096 - DNA, 18 bp, Homo sapiens
tgagttcataaatttatg

SEQ ID NO: 1833097 - DNA, 16 bp, Homo sapiens
tgagtttctttcagat

SEQ ID NO: 1833098 - DNA, 17 bp, Homo sapiens
tgagtttctttcagatc

SEQ ID NO: 1833099 - DNA, 16 bp, Homo sapiens
tgataaactaaaagca

SEQ ID NO: 1833100 - DNA, 17 bp, Homo sapiens
tgataacgtattttgat

SEQ ID NO: 1833101 - DNA, 24 bp, Homo sapiens
tgataagcagtcatcctcagatca

SEQ ID NO: 1833102 - DNA, 15 bp, Homo sapiens
tgatactattcaatg

SEQ ID NO: 1833103 - DNA, 18 bp, Homo sapiens
tgatactattcaatgcaa

SEQ ID NO: 1833104 - DNA, 13 bp, Homo sapiens
tgatactgatgcc

SEQ ID NO: 1833105 - DNA, 15 bp, Homo sapiens
tgatatctgtttgct

SEQ ID NO: 1833106 - DNA, 16 bp, Homo sapiens
tgatattcatattcaa

SEQ ID NO: 1833107 - DNA, 13 bp, Homo sapiens
tgatcaaaatcaa

SEQ ID NO: 1833108 - DNA, 17 bp, Homo sapiens
tgatctttcaatatcat

SEQ ID NO: 1833109 - DNA, 18 bp, Homo sapiens
tgatctttcaatatcatt

SEQ ID NO: 1833110 - DNA, 23 bp, Homo sapiens
tgatgaaaatgaatagagagtat

SEQ ID NO: 1833111 - DNA, 18 bp, Homo sapiens
tgatgccacaccaagctg

SEQ ID NO: 1833112 - DNA, 20 bp, Homo sapiens
tgatgccacaccaagctgtg

SEQ ID NO: 1833113 - DNA, 13 bp, Homo sapiens
tgatgctgggctg

SEQ ID NO: 1833114 - DNA, 18 bp, Homo sapiens
tgatgctgggctgggtgc

SEQ ID NO: 1833115 - DNA, 19 bp, Homo sapiens
tgatggaccgggtgggcct

SEQ ID NO: 1833116 - DNA, 21 bp, Homo sapiens
tgatggcgcgggaggcaccag

SEQ ID NO: 1833117 - DNA, 16 bp, Homo sapiens
tgatgtgggaagaagt

SEQ ID NO: 1833118 - DNA, 16 bp, Homo sapiens
tgatgtttaaaagtcc

SEQ ID NO: 1833119 - DNA, 16 bp, Homo sapiens
tgattgcgagaatttt

SEQ ID NO: 1833120 - DNA, 13 bp, Homo sapiens
tgattgttttaga

SEQ ID NO: 1833121 - DNA, 12 bp, Homo sapiens
tgatttccaggc

SEQ ID NO: 1833122 - DNA, 13 bp, Homo sapiens
tgatttccaggcc

SEQ ID NO: 1833123 - DNA, 20 bp, Homo sapiens
tgatttccaggcccctgagg

SEQ ID NO: 1833124 - DNA, 22 bp, Homo sapiens
tgatttcccgtggccccagcct

SEQ ID NO: 1833125 - DNA, 13 bp, Homo sapiens
tgattttaaatat

SEQ ID NO: 1833126 - DNA, 20 bp, Homo sapiens
tgcaacaataattcatcaag

SEQ ID NO: 1833127 - DNA, 11 bp, Homo sapiens
tgcaacaatgc

SEQ ID NO: 1833128 - DNA, 13 bp, Homo sapiens
tgcaacaatgcaa

SEQ ID NO: 1833129 - DNA, 11 bp, Homo sapiens
tgcctgctcct

SEQ ID NO: 1833130 - DNA, 19 bp, Homo sapiens
tgcctggcccccctccagg

SEQ ID NO: 1833131 - DNA, 15 bp, Homo sapiens
tgcctggcctggctc

SEQ ID NO: 1833132 - DNA, 16 bp, Homo sapiens
tgcctggcctggctcc

SEQ ID NO: 1833133 - DNA, 19 bp, Homo sapiens
tgcctggcctggctcccca

SEQ ID NO: 1833134 - DNA, 11 bp, Homo sapiens
tgcctggctgt

SEQ ID NO: 1833135 - DNA, 12 bp, Homo sapiens
tgcctggctgtg

SEQ ID NO: 1833136 - DNA, 20 bp, Homo sapiens
tgcctgggcctgtgcagcag

SEQ ID NO: 1833137 - DNA, 23 bp, Homo sapiens
tgcctgggcctgtgcagcagccc

SEQ ID NO: 1833138 - DNA, 16 bp, Homo sapiens
tgccttcctgtttaaa

SEQ ID NO: 1833139 - DNA, 19 bp, Homo sapiens
tgcgaccccatctgcccag

SEQ ID NO: 1833140 - DNA, 20 bp, Homo sapiens
tgcgaccccatctgcccagg

SEQ ID NO: 1833141 - DNA, 19 bp, Homo sapiens
tgcgtcctgacgccctgcg

SEQ ID NO: 1833142 - DNA, 15 bp, Homo sapiens
tgcgtggctgtggca

SEQ ID NO: 1833143 - DNA, 14 bp, Homo sapiens
tgctaccctccctg

SEQ ID NO: 1833144 - DNA, 15 bp, Homo sapiens
tgctaccctccctgc

SEQ ID NO: 1833145 - DNA, 17 bp, Homo sapiens
tgctaccctccctgctg

SEQ ID NO: 1833146 - DNA, 18 bp, Homo sapiens
tgctaccctccctgctgt

SEQ ID NO: 1833147 - DNA, 20 bp, Homo sapiens
tgctaccctccctgctgtcc

SEQ ID NO: 1833148 - DNA, 21 bp, Homo sapiens
tgctaccctccctgctgtccc

SEQ ID NO: 1833149 - DNA, 22 bp, Homo sapiens
tgctagagcaacccctgtaccc

SEQ ID NO: 1833150 - DNA, 16 bp, Homo sapiens
tgctatgagctgggga

SEQ ID NO: 1833151 - DNA, 16 bp, Homo sapiens
tgctcaacccccctcc

SEQ ID NO: 1833152 - DNA, 18 bp, Homo sapiens
tgctcaacccccctccca

SEQ ID NO: 1833153 - DNA, 16 bp, Homo sapiens
tgctcacgctcccccg

SEQ ID NO: 1833154 - DNA, 17 bp, Homo sapiens
tgctcagagtctatcaa

SEQ ID NO: 1833155 - DNA, 14 bp, Homo sapiens
tgctcgaagaacaa

SEQ ID NO: 1833156 - DNA, 20 bp, Homo sapiens
tgctctaattcttttcaaaa

SEQ ID NO: 1833157 - DNA, 16 bp, Homo sapiens
tgctctagccaggagt

SEQ ID NO: 1833158 - DNA, 22 bp, Homo sapiens
tgctctagccaggagtctgtgc

SEQ ID NO: 1833159 - DNA, 23 bp, Homo sapiens
tgctctagccaggagtctgtgct

SEQ ID NO: 1833160 - DNA, 15 bp, Homo sapiens
tgctctagctggcag

SEQ ID NO: 1833161 - DNA, 22 bp, Homo sapiens
tgctctcctaccccacctcatg

SEQ ID NO: 1833162 - DNA, 17 bp, Homo sapiens
tgctctgccccaagccc

SEQ ID NO: 1833163 - DNA, 18 bp, Homo sapiens
tgctctgccccaagcccc

SEQ ID NO: 1833164 - DNA, 13 bp, Homo sapiens
tgctctgcccctt

SEQ ID NO: 1833165 - DNA, 18 bp, Homo sapiens
tgctctggcggcttcctg

SEQ ID NO: 1833166 - DNA, 22 bp, Homo sapiens
tgctctggcggcttcctgtcca

SEQ ID NO: 1833167 - DNA, 13 bp, Homo sapiens
tgctcttctgtat

SEQ ID NO: 1833168 - DNA, 15 bp, Homo sapiens
tgctgaaaaacacaa

SEQ ID NO: 1833169 - DNA, 16 bp, Homo sapiens
tgctgaaaaacacaac

SEQ ID NO: 1833170 - DNA, 18 bp, Homo sapiens
tgctgaaaaagaaaaaaa

SEQ ID NO: 1833171 - DNA, 19 bp, Homo sapiens
tgctgaaaaagaaaaaaat

SEQ ID NO: 1833172 - DNA, 13 bp, Homo sapiens
tgctgagccactc

SEQ ID NO: 1833173 - DNA, 10 bp, Homo sapiens
tgctgagctt

SEQ ID NO: 1833174 - DNA, 16 bp, Homo sapiens
tgctgagcttagcctt

SEQ ID NO: 1833175 - DNA, 21 bp, Homo sapiens
tgctgagcttagccttgtgcc

SEQ ID NO: 1833176 - DNA, 13 bp, Homo sapiens
tgctgcaccagag

SEQ ID NO: 1833177 - DNA, 14 bp, Homo sapiens
tgctgcaccagagt

SEQ ID NO: 1833178 - DNA, 21 bp, Homo sapiens
tgctgcagaggggcaggccct

SEQ ID NO: 1833179 - DNA, 23 bp, Homo sapiens
tgctgcagaggggcaggccctgc

SEQ ID NO: 1833180 - DNA, 23 bp, Homo sapiens
tgctgccatgccactgccaggca

SEQ ID NO: 1833181 - DNA, 19 bp, Homo sapiens
tgctgccccgttccctgtc

SEQ ID NO: 1833182 - DNA, 21 bp, Homo sapiens
tgctgccccgttccctgtcag

SEQ ID NO: 1833183 - DNA, 12 bp, Homo sapiens
tgctgccttcag

SEQ ID NO: 1833184 - DNA, 14 bp, Homo sapiens
tgctgccttcaggg

SEQ ID NO: 1833185 - DNA, 15 bp, Homo sapiens
tgctgctaccctccc

SEQ ID NO: 1833186 - DNA, 19 bp, Homo sapiens
tgctgctaccctccctgct

SEQ ID NO: 1833187 - DNA, 21 bp, Homo sapiens
tgctgctaccctccctgctgt

SEQ ID NO: 1833188 - DNA, 22 bp, Homo sapiens
tgctgctaccctccctgctgtc

SEQ ID NO: 1833189 - DNA, 19 bp, Homo sapiens
tgctgctgtaactgctgag

SEQ ID NO: 1833190 - DNA, 13 bp, Homo sapiens
tgctgctgtggca

SEQ ID NO: 1833191 - DNA, 14 bp, Homo sapiens
tgctgcttctcttg

SEQ ID NO: 1833192 - DNA, 22 bp, Homo sapiens
tgctggcaatgagtgtgccaga

SEQ ID NO: 1833193 - DNA, 13 bp, Homo sapiens
tgctgggctgggg

SEQ ID NO: 1833194 - DNA, 15 bp, Homo sapiens
tgctgggctgggtgc

SEQ ID NO: 1833195 - DNA, 19 bp, Homo sapiens
tgctggggcatgtgtgcct

SEQ ID NO: 1833196 - DNA, 22 bp, Homo sapiens
tgctggggcatgtgtgcctgtg

SEQ ID NO: 1833197 - DNA, 14 bp, Homo sapiens
tgctgggtggccca

SEQ ID NO: 1833198 - DNA, 22 bp, Homo sapiens
tgctgggtggcccatcccccct

SEQ ID NO: 1833199 - DNA, 20 bp, Homo sapiens
tgctgtaactgctgagccac

SEQ ID NO: 1833200 - DNA, 17 bp, Homo sapiens
tgctgtcccctcttgcc

SEQ ID NO: 1833201 - DNA, 20 bp, Homo sapiens
tgctgtcccctcttgcccca

SEQ ID NO: 1833202 - DNA, 18 bp, Homo sapiens
tgctgtgcctgctagagc

SEQ ID NO: 1833203 - DNA, 12 bp, Homo sapiens
tgcttcacataa

SEQ ID NO: 1833204 - DNA, 18 bp, Homo sapiens
tgcttctaaatgcccagt

SEQ ID NO: 1833205 - DNA, 23 bp, Homo sapiens
tgggaacctagtactctctgctc

SEQ ID NO: 1833206 - DNA, 23 bp, Homo sapiens
tgggaataagtgccaggatggaa

SEQ ID NO: 1833207 - DNA, 17 bp, Homo sapiens
tgggacacctcagaaaa

SEQ ID NO: 1833208 - DNA, 23 bp, Homo sapiens
tgggacccagctactctgtccag

SEQ ID NO: 1833209 - DNA, 22 bp, Homo sapiens
tgggagaatgtcagtatgtgga

SEQ ID NO: 1833210 - DNA, 18 bp, Homo sapiens
tgggagagctggtggtgc

SEQ ID NO: 1833211 - DNA, 13 bp, Homo sapiens
tgggaggccaagg

SEQ ID NO: 1833212 - DNA, 14 bp, Homo sapiens
tgggaggccaaggc

SEQ ID NO: 1833213 - DNA, 19 bp, Homo sapiens
tgggaggtgagaccacctc

SEQ ID NO: 1833214 - DNA, 22 bp, Homo sapiens
tgggagtgaggatgtctgggcc

SEQ ID NO: 1833215 - DNA, 16 bp, Homo sapiens
tgggagtgcagagaaa

SEQ ID NO: 1833216 - DNA, 11 bp, Homo sapiens
tgggagtgtgt

SEQ ID NO: 1833217 - DNA, 13 bp, Homo sapiens
tgggagtgtgtaa

SEQ ID NO: 1833218 - DNA, 21 bp, Homo sapiens
tgggcactgctgggtggccca

SEQ ID NO: 1833219 - DNA, 15 bp, Homo sapiens
tgggcagctgggccc

SEQ ID NO: 1833220 - DNA, 16 bp, Homo sapiens
tgggcatccacccagt

SEQ ID NO: 1833221 - DNA, 21 bp, Homo sapiens
tgggcatccacccagtgctgc

SEQ ID NO: 1833222 - DNA, 14 bp, Homo sapiens
tgggcattgggctg

SEQ ID NO: 1833223 - DNA, 15 bp, Homo sapiens
tgggccatactggcc

SEQ ID NO: 1833224 - DNA, 18 bp, Homo sapiens
tgggccatactggcctcg

SEQ ID NO: 1833225 - DNA, 22 bp, Homo sapiens
tgggcccataatagttagccct

SEQ ID NO: 1833226 - DNA, 13 bp, Homo sapiens
tgggccccatgct

SEQ ID NO: 1833227 - DNA, 16 bp, Homo sapiens
tgggccccatgctctg

SEQ ID NO: 1833228 - DNA, 17 bp, Homo sapiens
tgggccccatgctctgc

SEQ ID NO: 1833229 - DNA, 20 bp, Homo sapiens
tgggcctgcccaatgctttg

SEQ ID NO: 1833230 - DNA, 20 bp, Homo sapiens
tgggcctgcttttccaggat

SEQ ID NO: 1833231 - DNA, 15 bp, Homo sapiens
tgggcctggcctgag

SEQ ID NO: 1833232 - DNA, 15 bp, Homo sapiens
tgggcctgggcctgc

SEQ ID NO: 1833233 - DNA, 13 bp, Homo sapiens
tgggcctgtcccc

SEQ ID NO: 1833234 - DNA, 15 bp, Homo sapiens
tgggcctgtgcagca

SEQ ID NO: 1833235 - DNA, 18 bp, Homo sapiens
tgggccttgctttgggct

SEQ ID NO: 1833236 - DNA, 14 bp, Homo sapiens
tgggctactggcag

SEQ ID NO: 1833237 - DNA, 20 bp, Homo sapiens
tgggctcagggctggagtgc

SEQ ID NO: 1833238 - DNA, 15 bp, Homo sapiens
tgggctcctggctgc

SEQ ID NO: 1833239 - DNA, 21 bp, Homo sapiens
tgggctgacacctaccatgct

SEQ ID NO: 1833240 - DNA, 17 bp, Homo sapiens
tgggctgcactctgtgc

SEQ ID NO: 1833241 - DNA, 20 bp, Homo sapiens
tgggctgggtgcgaccccat

SEQ ID NO: 1833242 - DNA, 21 bp, Homo sapiens
tgggctttgcaggctctgggc

SEQ ID NO: 1833243 - DNA, 17 bp, Homo sapiens
tggggacgccaaggagg

SEQ ID NO: 1833244 - DNA, 22 bp, Homo sapiens
tggggagggatttggggctcag

SEQ ID NO: 1833245 - DNA, 18 bp, Homo sapiens
tggggatagatgtgtgga

SEQ ID NO: 1833246 - DNA, 17 bp, Homo sapiens
tggggcagaggggcagc

SEQ ID NO: 1833247 - DNA, 17 bp, Homo sapiens
tggggcatgtgtgcctg

SEQ ID NO: 1833248 - DNA, 20 bp, Homo sapiens
tggggcctatcagtgtgccc

SEQ ID NO: 1833249 - DNA, 19 bp, Homo sapiens
tggggcctgatggggaggg

SEQ ID NO: 1833250 - DNA, 23 bp, Homo sapiens
tggggcctggcttgctccagggt

SEQ ID NO: 1833251 - DNA, 15 bp, Homo sapiens
tggggctcgtggcct

SEQ ID NO: 1833252 - DNA, 15 bp, Homo sapiens
ttactcagcagcaga

SEQ ID NO: 1833253 - DNA, 16 bp, Homo sapiens
ttactcccttcctggc

SEQ ID NO: 1833254 - DNA, 16 bp, Homo sapiens
ttacttgtctgaggcc

SEQ ID NO: 1833255 - DNA, 14 bp, Homo sapiens
ttagaagaagtgtg

SEQ ID NO: 1833256 - DNA, 16 bp, Homo sapiens
ttagaagaagtgtgtc

SEQ ID NO: 1833257 - DNA, 20 bp, Homo sapiens
ttagaatcaagtctgtgaaa

SEQ ID NO: 1833258 - DNA, 19 bp, Homo sapiens
ttagaatgtttctatttcc

SEQ ID NO: 1833259 - DNA, 18 bp, Homo sapiens
ttaggcctggcacagtgt

SEQ ID NO: 1833260 - DNA, 17 bp, Homo sapiens
ttagtaccttcaaataa

SEQ ID NO: 1833261 - DNA, 20 bp, Homo sapiens
ttagtattcaggcactgaga

SEQ ID NO: 1833262 - DNA, 17 bp, Homo sapiens
ttagttcttgggggagg

SEQ ID NO: 1833263 - DNA, 19 bp, Homo sapiens
ttagtttgatttaatatct

SEQ ID NO: 1833264 - DNA, 19 bp, Homo sapiens
ttataaaaaatggtgcctg

SEQ ID NO: 1833265 - DNA, 16 bp, Homo sapiens
ttataaacctctaatt

SEQ ID NO: 1833266 - DNA, 23 bp, Homo sapiens
ttataaacctctaatttattttg

SEQ ID NO: 1833267 - DNA, 22 bp, Homo sapiens
ttatataacccactgctgaaaa

SEQ ID NO: 1833268 - DNA, 14 bp, Homo sapiens
ttatatatcataaa

SEQ ID NO: 1833269 - DNA, 22 bp, Homo sapiens
ttatatgaagtattaaaatgca

SEQ ID NO: 1833270 - DNA, 17 bp, Homo sapiens
ttatatttgagtttctt

SEQ ID NO: 1833271 - DNA, 19 bp, Homo sapiens
ttatctgcctggcctggct

SEQ ID NO: 1833272 - DNA, 15 bp, Homo sapiens
ttatggcatttagta

SEQ ID NO: 1833273 - DNA, 17 bp, Homo sapiens
ttatgtaagtttgcata

SEQ ID NO: 1833274 - DNA, 12 bp, Homo sapiens
ttatgtgtgtgt

SEQ ID NO: 1833275 - DNA, 16 bp, Homo sapiens
ttatgttattggaatt

SEQ ID NO: 1833276 - DNA, 13 bp, Homo sapiens
ttattcaaatgaa

SEQ ID NO: 1833277 - DNA, 14 bp, Homo sapiens
ttattcaaatgaag

SEQ ID NO: 1833278 - DNA, 21 bp, Homo sapiens
ttattcaggaaaagcctctgt

SEQ ID NO: 1833279 - DNA, 23 bp, Homo sapiens
ttattcaggaaaagcctctgtgt

SEQ ID NO: 1833280 - DNA, 15 bp, Homo sapiens
ttattgatcaaaatc

SEQ ID NO: 1833281 - DNA, 22 bp, Homo sapiens
ttatttcaaccgcttgccatat

SEQ ID NO: 1833282 - DNA, 17 bp, Homo sapiens
ttatttccacataaagg

SEQ ID NO: 1833283 - DNA, 16 bp, Homo sapiens
ttattttcttatgtaa

SEQ ID NO: 1833284 - DNA, 15 bp, Homo sapiens
ttattttgtaattat

SEQ ID NO: 1833285 - DNA, 21 bp, Homo sapiens
ttattttgtaattattgtgat

SEQ ID NO: 1833286 - DNA, 13 bp, Homo sapiens
ttcaaaatcaaag

SEQ ID NO: 1833287 - DNA, 18 bp, Homo sapiens
ttcaaaattgttgcatcc

SEQ ID NO: 1833288 - DNA, 22 bp, Homo sapiens
ttcaaattaatctttctatatt

SEQ ID NO: 1833289 - DNA, 12 bp, Homo sapiens
ttcaataaagct

SEQ ID NO: 1833290 - DNA, 17 bp, Homo sapiens
ttcaatatcattactaa

SEQ ID NO: 1833291 - DNA, 20 bp, Homo sapiens
ttcaatcactagtcaagaaa

SEQ ID NO: 1833292 - DNA, 10 bp, Homo sapiens
ttcaatgcaa

SEQ ID NO: 1833293 - DNA, 14 bp, Homo sapiens
ttcaatgcaatgaa

SEQ ID NO: 1833294 - DNA, 15 bp, Homo sapiens
ttcaatgcaatgaaa

SEQ ID NO: 1833295 - DNA, 16 bp, Homo sapiens
ttcaatgcaatgaaaa

SEQ ID NO: 1833296 - DNA, 19 bp, Homo sapiens
ttcaatgcaatgaaaacaa

SEQ ID NO: 1833297 - DNA, 22 bp, Homo sapiens
ttcaatgcaatgaaaacaaaat

SEQ ID NO: 1833298 - DNA, 13 bp, Homo sapiens
ttcacccctgcac

SEQ ID NO: 1833299 - DNA, 14 bp, Homo sapiens
ttcacccctgcact

SEQ ID NO: 1833300 - DNA, 20 bp, Homo sapiens
ttcacttctttgcagagcct

SEQ ID NO: 1833301 - DNA, 13 bp, Homo sapiens
ttcagatttcaaa

SEQ ID NO: 1833302 - DNA, 22 bp, Homo sapiens
ttcagcaccctgggtgccattc

SEQ ID NO: 1833303 - DNA, 18 bp, Homo sapiens
ttcagctattagcaactg

SEQ ID NO: 1833304 - DNA, 17 bp, Homo sapiens
ttcagcttctgctgggc

SEQ ID NO: 1833305 - DNA, 15 bp, Homo sapiens
ttcaggcagcactga

SEQ ID NO: 1833306 - DNA, 13 bp, Homo sapiens
ttcagggccagaa

SEQ ID NO: 1833307 - DNA, 20 bp, Homo sapiens
ttcaggtaggcccttgtcct

SEQ ID NO: 1833308 - DNA, 20 bp, Homo sapiens
ttcaggtggagagcactaga

SEQ ID NO: 1833309 - DNA, 21 bp, Homo sapiens
ttcaggtggagagcactagaa

SEQ ID NO: 1833310 - DNA, 19 bp, Homo sapiens
ttcagtgagcccctcccca

SEQ ID NO: 1833311 - DNA, 22 bp, Homo sapiens
ttcagtgagcccctccccagcc

SEQ ID NO: 1833312 - DNA, 23 bp, Homo sapiens
ttcagtgagcccctccccagcca

SEQ ID NO: 1833313 - DNA, 23 bp, Homo sapiens
ttcatacggggtggctgaaagta

SEQ ID NO: 1833314 - DNA, 15 bp, Homo sapiens
ttcatctcttcaatc

SEQ ID NO: 1833315 - DNA, 16 bp, Homo sapiens
ttcatgctttctcctt

SEQ ID NO: 1833316 - DNA, 15 bp, Homo sapiens
ttcattaatactgtg

SEQ ID NO: 1833317 - DNA, 17 bp, Homo sapiens
ttccaggcccctgagga

SEQ ID NO: 1833318 - DNA, 11 bp, Homo sapiens
ttccaggctct

SEQ ID NO: 1833319 - DNA, 21 bp, Homo sapiens
ttccaggctcttcctggacct

SEQ ID NO: 1833320 - DNA, 13 bp, Homo sapiens
ttccatatggagc

SEQ ID NO: 1833321 - DNA, 11 bp, Homo sapiens
ttcccactgca

SEQ ID NO: 1833322 - DNA, 13 bp, Homo sapiens
ttcccactgcacc

SEQ ID NO: 1833323 - DNA, 24 bp, Homo sapiens
ttcccactgcaccccctcctgctg

SEQ ID NO: 1833324 - DNA, 16 bp, Homo sapiens
ttcccaggagaccatt

SEQ ID NO: 1833325 - DNA, 20 bp, Homo sapiens
ttcccatggtagactgtgac

SEQ ID NO: 1833326 - DNA, 18 bp, Homo sapiens
ttcccccatgtggctgaa

SEQ ID NO: 1833327 - DNA, 16 bp, Homo sapiens
ttccccgagggatgat

SEQ ID NO: 1833328 - DNA, 23 bp, Homo sapiens
ttccccgagggatgatgccacac

SEQ ID NO: 1833329 - DNA, 13 bp, Homo sapiens
ttcccctcctacc

SEQ ID NO: 1833330 - DNA, 17 bp, Homo sapiens
ttcccctcctacccctc

SEQ ID NO: 1833331 - DNA, 20 bp, Homo sapiens
ttcccctcctacccctccca

SEQ ID NO: 1833332 - DNA, 21 bp, Homo sapiens
ttcccctcctacccctcccag

SEQ ID NO: 1833333 - DNA, 22 bp, Homo sapiens
ttcccctcctacccctcccagc

SEQ ID NO: 1833334 - DNA, 14 bp, Homo sapiens
ttccccttggcttc

SEQ ID NO: 1833335 - DNA, 17 bp, Homo sapiens
ttccccttttgcctggc

SEQ ID NO: 1833336 - DNA, 18 bp, Homo sapiens
ttccccttttgcctggct

SEQ ID NO: 1833337 - DNA, 15 bp, Homo sapiens
ttcccgtggccccag

SEQ ID NO: 1833338 - DNA, 16 bp, Homo sapiens
ttcccgtggccccagc

SEQ ID NO: 1833339 - DNA, 17 bp, Homo sapiens
ttcccgtggccccagcc

SEQ ID NO: 1833340 - DNA, 19 bp, Homo sapiens
ttcccgtggccccagcctg

SEQ ID NO: 1833341 - DNA, 17 bp, Homo sapiens
ttccctgacactgcggg

SEQ ID NO: 1833342 - DNA, 11 bp, Homo sapiens
ttccctgcacc

SEQ ID NO: 1833343 - DNA, 16 bp, Homo sapiens
ttccctgtcagaggct

SEQ ID NO: 1833344 - DNA, 14 bp, Homo sapiens
ttcccttgaccatt

SEQ ID NO: 1833345 - DNA, 20 bp, Homo sapiens
ttcccttgaccattggctgc

SEQ ID NO: 1833346 - DNA, 15 bp, Homo sapiens
ttcctccagcctccc

SEQ ID NO: 1833347 - DNA, 16 bp, Homo sapiens
ttcctccagcctcccc

SEQ ID NO: 1833348 - DNA, 20 bp, Homo sapiens
ttcctccgtccacccaggct

SEQ ID NO: 1833349 - DNA, 21 bp, Homo sapiens
ttcctcctccacagtgctgct

SEQ ID NO: 1833350 - DNA, 15 bp, Homo sapiens
ttcctctgatttcaa

SEQ ID NO: 1833351 - DNA, 21 bp, Homo sapiens
ttcctgaggaagagggactgt

SEQ ID NO: 1833352 - DNA, 17 bp, Homo sapiens
ttcctggacctgagtcg

SEQ ID NO: 1833353 - DNA, 12 bp, Homo sapiens
ttcctgggcctg

SEQ ID NO: 1833354 - DNA, 14 bp, Homo sapiens
ttcctgggcctgtc

SEQ ID NO: 1833355 - DNA, 16 bp, Homo sapiens
ttcctggggccccgct

SEQ ID NO: 1833356 - DNA, 18 bp, Homo sapiens
ttcctgtgccatgttatt

SEQ ID NO: 1833357 - DNA, 11 bp, Homo sapiens
ttcctgtgtat

SEQ ID NO: 1833358 - DNA, 22 bp, Homo sapiens
ttccttaaaatgtgagtgacct

SEQ ID NO: 1833359 - DNA, 13 bp, Homo sapiens
ttccttccctggg

SEQ ID NO: 1833360 - DNA, 16 bp, Homo sapiens
ttcctttacaactaaa

SEQ ID NO: 1833361 - DNA, 22 bp, Homo sapiens
ttcgaaacctgtccataaagta

SEQ ID NO: 1833362 - DNA, 20 bp, Homo sapiens
ttcgtgtagtggaagagcag

SEQ ID NO: 1833363 - DNA, 23 bp, Homo sapiens
ttcgtgtagtggaagagcagcct

SEQ ID NO: 1833364 - DNA, 17 bp, Homo sapiens
ttctacacatatatgta

SEQ ID NO: 1833365 - DNA, 21 bp, Homo sapiens
ttctaggagtcaactggctgg

SEQ ID NO: 1833366 - DNA, 22 bp, Homo sapiens
ttctagttgattgcgagaattt

SEQ ID NO: 1833367 - DNA, 15 bp, Homo sapiens
ttctatcagtgactt

SEQ ID NO: 1833368 - DNA, 14 bp, Homo sapiens
tgcaacaatgcaaa

SEQ ID NO: 1833369 - DNA, 17 bp, Homo sapiens
tgcaagccccagggcct

SEQ ID NO: 1833370 - DNA, 21 bp, Homo sapiens
tgcaagccccagggcctgggg

SEQ ID NO: 1833371 - DNA, 23 bp, Homo sapiens
tgcaagccccagggcctgggggc

SEQ ID NO: 1833372 - DNA, 17 bp, Homo sapiens
tgcaagctgctgaagcc

SEQ ID NO: 1833373 - DNA, 15 bp, Homo sapiens
tgcaatgaaaacaaa

SEQ ID NO: 1833374 - DNA, 16 bp, Homo sapiens
tgcaatgcaattcaat

SEQ ID NO: 1833375 - DNA, 13 bp, Homo sapiens
tgcaattcaatgc

SEQ ID NO: 1833376 - DNA, 14 bp, Homo sapiens
tgcaattcaatgca

SEQ ID NO: 1833377 - DNA, 15 bp, Homo sapiens
tgcacacacagctcc

SEQ ID NO: 1833378 - DNA, 17 bp, Homo sapiens
tgcacacacagctcctc

SEQ ID NO: 1833379 - DNA, 16 bp, Homo sapiens
tgcacactatttccct

SEQ ID NO: 1833380 - DNA, 17 bp, Homo sapiens
tgcacatcattcattca

SEQ ID NO: 1833381 - DNA, 18 bp, Homo sapiens
tgcacatcattcattcac

SEQ ID NO: 1833382 - DNA, 22 bp, Homo sapiens
tgcacatcattcattcactgta

SEQ ID NO: 1833383 - DNA, 19 bp, Homo sapiens
tgcaccaacccagccgctg

SEQ ID NO: 1833384 - DNA, 22 bp, Homo sapiens
tgcaccaacccagccgctgccc

SEQ ID NO: 1833385 - DNA, 21 bp, Homo sapiens
tgcaccagagtgaaagggcta

SEQ ID NO: 1833386 - DNA, 15 bp, Homo sapiens
tgcaccaggagacag

SEQ ID NO: 1833387 - DNA, 15 bp, Homo sapiens
tgcacccactcacca

SEQ ID NO: 1833388 - DNA, 17 bp, Homo sapiens
tgcacccactcaccagg

SEQ ID NO: 1833389 - DNA, 12 bp, Homo sapiens
tgcaccccctcc

SEQ ID NO: 1833390 - DNA, 18 bp, Homo sapiens
tgcaccccctcctgctgc

SEQ ID NO: 1833391 - DNA, 20 bp, Homo sapiens
tgcacctcctaccctcccac

SEQ ID NO: 1833392 - DNA, 15 bp, Homo sapiens
tgcactctgtgccca

SEQ ID NO: 1833393 - DNA, 16 bp, Homo sapiens
tgcactggccccaccc

SEQ ID NO: 1833394 - DNA, 15 bp, Homo sapiens
tgcactgtcctgctc

SEQ ID NO: 1833395 - DNA, 18 bp, Homo sapiens
tgcactgtcctgctccac

SEQ ID NO: 1833396 - DNA, 22 bp, Homo sapiens
tgcactgtcctgctccacagtg

SEQ ID NO: 1833397 - DNA, 23 bp, Homo sapiens
tgcactgtcctgctccacagtgt

SEQ ID NO: 1833398 - DNA, 10 bp, Homo sapiens
tgcagagcct

SEQ ID NO: 1833399 - DNA, 15 bp, Homo sapiens
tgcagaggggcaggc

SEQ ID NO: 1833400 - DNA, 17 bp, Homo sapiens
tgcagaggggcaggccc

SEQ ID NO: 1833401 - DNA, 16 bp, Homo sapiens
tgcagatcatctgggg

SEQ ID NO: 1833402 - DNA, 21 bp, Homo sapiens
tgcagatctttttgtgaaatt

SEQ ID NO: 1833403 - DNA, 19 bp, Homo sapiens
tgcagattcctgggcctgt

SEQ ID NO: 1833404 - DNA, 15 bp, Homo sapiens
tgcagcagcccagct

SEQ ID NO: 1833405 - DNA, 12 bp, Homo sapiens
tgcagccttccc

SEQ ID NO: 1833406 - DNA, 13 bp, Homo sapiens
tgcagccttcccc

SEQ ID NO: 1833407 - DNA, 20 bp, Homo sapiens
tgcagctgggccccatgctc

SEQ ID NO: 1833408 - DNA, 23 bp, Homo sapiens
tgcagctgggccccatgctctgc

SEQ ID NO: 1833409 - DNA, 17 bp, Homo sapiens
tgcaggctctgggctca

SEQ ID NO: 1833410 - DNA, 13 bp, Homo sapiens
tgcagggaagagg

SEQ ID NO: 1833411 - DNA, 19 bp, Homo sapiens
tgcaggtacttcctcctga

SEQ ID NO: 1833412 - DNA, 20 bp, Homo sapiens
tgcaggtacttcctcctgat

SEQ ID NO: 1833413 - DNA, 22 bp, Homo sapiens
tgcattcttaatctccactgtt

SEQ ID NO: 1833414 - DNA, 21 bp, Homo sapiens
tgcattttacagtatcttcaa

SEQ ID NO: 1833415 - DNA, 22 bp, Homo sapiens
tgcattttacagtatcttcaaa

SEQ ID NO: 1833416 - DNA, 22 bp, Homo sapiens
tgccaaagcaaaagaagtaaaa

SEQ ID NO: 1833417 - DNA, 21 bp, Homo sapiens
tgccaacagtgttaggcctgg

SEQ ID NO: 1833418 - DNA, 16 bp, Homo sapiens
tgccaactaagccctc

SEQ ID NO: 1833419 - DNA, 16 bp, Homo sapiens
tgccaagtttttcaga

SEQ ID NO: 1833420 - DNA, 19 bp, Homo sapiens
tgccacaccaagctgtgcc

SEQ ID NO: 1833421 - DNA, 19 bp, Homo sapiens
tgccaccacgtctgccagg

SEQ ID NO: 1833422 - DNA, 17 bp, Homo sapiens
tgccaccctgggctctg

SEQ ID NO: 1833423 - DNA, 19 bp, Homo sapiens
tgccaccctgggctctgtg

SEQ ID NO: 1833424 - DNA, 16 bp, Homo sapiens
tgccacttcccaggta

SEQ ID NO: 1833425 - DNA, 22 bp, Homo sapiens
tgccacttcttaaaggcctgga

SEQ ID NO: 1833426 - DNA, 14 bp, Homo sapiens
tgccagcacagggg

SEQ ID NO: 1833427 - DNA, 16 bp, Homo sapiens
tgccagcacaggggcc

SEQ ID NO: 1833428 - DNA, 15 bp, Homo sapiens
tgccagctgccttcc

SEQ ID NO: 1833429 - DNA, 17 bp, Homo sapiens
tgccagctgccttcctc

SEQ ID NO: 1833430 - DNA, 19 bp, Homo sapiens
tgccaggcacctggcctgc

SEQ ID NO: 1833431 - DNA, 20 bp, Homo sapiens
tgccaggcacctggcctgct

SEQ ID NO: 1833432 - DNA, 21 bp, Homo sapiens
tgccaggcacctggcctgctg

SEQ ID NO: 1833433 - DNA, 12 bp, Homo sapiens
tgccaggcccat

SEQ ID NO: 1833434 - DNA, 19 bp, Homo sapiens
tgccagtcgcgctgcctgt

SEQ ID NO: 1833435 - DNA, 20 bp, Homo sapiens
tgccagtcgcgctgcctgtg

SEQ ID NO: 1833436 - DNA, 23 bp, Homo sapiens
tgccagtcgcgctgcctgtgtgg

SEQ ID NO: 1833437 - DNA, 16 bp, Homo sapiens
tgccagtgaagtcctt

SEQ ID NO: 1833438 - DNA, 14 bp, Homo sapiens
tgccatgccactgc

SEQ ID NO: 1833439 - DNA, 20 bp, Homo sapiens
tgccatgccactgccaggca

SEQ ID NO: 1833440 - DNA, 13 bp, Homo sapiens
tgccatgcccagg

SEQ ID NO: 1833441 - DNA, 19 bp, Homo sapiens
tgccatgcgtggctaacat

SEQ ID NO: 1833442 - DNA, 11 bp, Homo sapiens
tgccattccca

SEQ ID NO: 1833443 - DNA, 20 bp, Homo sapiens
tgcccaatgctttgggaggc

SEQ ID NO: 1833444 - DNA, 21 bp, Homo sapiens
tgcccaggacggggccggcca

SEQ ID NO: 1833445 - DNA, 22 bp, Homo sapiens
tgcccaggacggggccggccag

SEQ ID NO: 1833446 - DNA, 20 bp, Homo sapiens
tgcccaggctggtcttgaac

SEQ ID NO: 1833447 - DNA, 15 bp, Homo sapiens
cccagtccctggagc

SEQ ID NO: 1833448 - DNA, 11 bp, Homo sapiens
ccccctgagtg

SEQ ID NO: 1833449 - DNA, 21 bp, Homo sapiens
cccctgagtgggctgggccct

SEQ ID NO: 1833450 - DNA, 18 bp, Homo sapiens
ccctgagtgggctgggcc

SEQ ID NO: 1833451 - DNA, 12 bp, Homo sapiens
ccctggagctgt

SEQ ID NO: 1833452 - DNA, 13 bp, Homo sapiens
ccgactcaggtcc

SEQ ID NO: 1833453 - DNA, 14 bp, Homo sapiens
cctcccctcttgag

SEQ ID NO: 1833454 - DNA, 15 bp, Homo sapiens
cctccctggggacca

SEQ ID NO: 1833455 - DNA, 24 bp, Homo sapiens
cctccctggggaccaggagctagc

SEQ ID NO: 1833456 - DNA, 18 bp, Homo sapiens
cctccggccagcgagtgg

SEQ ID NO: 1833457 - DNA, 16 bp, Homo sapiens
cctcttgcctctctca

SEQ ID NO: 1833458 - DNA, 17 bp, Homo sapiens
cctcttgcctctctcag

SEQ ID NO: 1833459 - DNA, 18 bp, Homo sapiens
cctcttgcctctctcagg

SEQ ID NO: 1833460 - DNA, 18 bp, Homo sapiens
cctcttgctcagagctag

SEQ ID NO: 1833461 - DNA, 22 bp, Homo sapiens
cctcttgctcagagctaggccc

SEQ ID NO: 1833462 - DNA, 16 bp, Homo sapiens
cctcttttccctctct

SEQ ID NO: 1833463 - DNA, 13 bp, Homo sapiens
cctgagtgggctg

SEQ ID NO: 1833464 - DNA, 17 bp, Homo sapiens
cctgagtgggctgggcc

SEQ ID NO: 1833465 - DNA, 18 bp, Homo sapiens
cctgagtgggctgggccc

SEQ ID NO: 1833466 - DNA, 13 bp, Homo sapiens
cctggagctgtcc

SEQ ID NO: 1833467 - DNA, 18 bp, Homo sapiens
cctggagctgtccttcat

SEQ ID NO: 1833468 - DNA, 18 bp, Homo sapiens
ccttcattccgttaggaa

SEQ ID NO: 1833469 - DNA, 20 bp, Homo sapiens
cgcctcttttccctctctag

SEQ ID NO: 1833470 - DNA, 19 bp, Homo sapiens
cgttaggaataacactgca

SEQ ID NO: 1833471 - DNA, 18 bp, Homo sapiens
ctaaagtgcctaccccag

SEQ ID NO: 1833472 - DNA, 14 bp, Homo sapiens
ctactaaagtgcct

SEQ ID NO: 1833473 - DNA, 18 bp, Homo sapiens
ctactaaagtgcctaccc

SEQ ID NO: 1833474 - DNA, 13 bp, Homo sapiens
ctcccctcttgag

SEQ ID NO: 1833475 - DNA, 16 bp, Homo sapiens
ctctcaggagtatctt

SEQ ID NO: 1833476 - DNA, 11 bp, Homo sapiens
ctctgtccaca

SEQ ID NO: 1833477 - DNA, 13 bp, Homo sapiens
ctcttgcctctct

SEQ ID NO: 1833478 - DNA, 14 bp, Homo sapiens
ctcttgcctctctc

SEQ ID NO: 1833479 - DNA, 23 bp, Homo sapiens
ctgccacccgcttcctgtttctt

SEQ ID NO: 1833480 - DNA, 13 bp, Homo sapiens
ctgcctccctggg

SEQ ID NO: 1833481 - DNA, 21 bp, Homo sapiens
ctgcctccctggggaccagga

SEQ ID NO: 1833482 - DNA, 14 bp, Homo sapiens
ctgctgctgcctcc

SEQ ID NO: 1833483 - DNA, 16 bp, Homo sapiens
ctggagctgtccttca

SEQ ID NO: 1833484 - DNA, 19 bp, Homo sapiens
ctggaggaagccagtgggg

SEQ ID NO: 1833485 - DNA, 16 bp, Homo sapiens
ctggggaccaggagct

SEQ ID NO: 1833486 - DNA, 22 bp, Homo sapiens
cttcagccctaacatagtgtct

SEQ ID NO: 1833487 - DNA, 16 bp, Homo sapiens
cttcattccgttagga

SEQ ID NO: 1833488 - DNA, 15 bp, Homo sapiens
ctttcccttccagtt

SEQ ID NO: 1833489 - DNA, 15 bp, Homo sapiens
gaccaggagctagcc

SEQ ID NO: 1833490 - DNA, 17 bp, Homo sapiens
gaggtggtgccttctca

SEQ ID NO: 1833491 - DNA, 22 bp, Homo sapiens
gagtgggctgggccctctgtcc

SEQ ID NO: 1833492 - DNA, 20 bp, Homo sapiens
gattcctcttgcctctctca

SEQ ID NO: 1833493 - DNA, 24 bp, Homo sapiens
gcccagtccctggagctgtccttc

SEQ ID NO: 1833494 - DNA, 23 bp, Homo sapiens
gcccccaaattgccttcagccct

SEQ ID NO: 1833495 - DNA, 14 bp, Homo sapiens
gccctctgtccaca

SEQ ID NO: 1833496 - DNA, 21 bp, Homo sapiens
gcctccctggggaccaggagc

SEQ ID NO: 1833497 - DNA, 14 bp, Homo sapiens
gcctctctcaggag

SEQ ID NO: 1833498 - DNA, 14 bp, Homo sapiens
gcgagtggtcaagg

SEQ ID NO: 1833499 - DNA, 15 bp, Homo sapiens
gctcagagctaggcc

SEQ ID NO: 1833500 - DNA, 16 bp, Homo sapiens
gctcctcccctcttga

SEQ ID NO: 1833501 - DNA, 23 bp, Homo sapiens
gctgcctccctggggaccaggag

SEQ ID NO: 1833502 - DNA, 16 bp, Homo sapiens
gctgctcccagcctct

SEQ ID NO: 1833503 - DNA, 15 bp, Homo sapiens
gctgctgcctccctg

SEQ ID NO: 1833504 - DNA, 17 bp, Homo sapiens
gctgctgcctccctggg

SEQ ID NO: 1833505 - DNA, 13 bp, Homo sapiens
gctgggccctctg

SEQ ID NO: 1833506 - DNA, 14 bp, Homo sapiens
ggaataacactgca

SEQ ID NO: 1833507 - DNA, 21 bp, Homo sapiens
ggcccccaaattgccttcagc

SEQ ID NO: 1833508 - DNA, 15 bp, Homo sapiens
ggccctctgtccaca

SEQ ID NO: 1833509 - DNA, 18 bp, Homo sapiens
gggtcccccctgagtggg

SEQ ID NO: 1833510 - DNA, 14 bp, Homo sapiens
ggtcccccctgagt

SEQ ID NO: 1833511 - DNA, 16 bp, Homo sapiens
ggtcccccctgagtgg

SEQ ID NO: 1833512 - DNA, 19 bp, Homo sapiens
ggtgtggctgctcccagcc

SEQ ID NO: 1833513 - DNA, 14 bp, Homo sapiens
gtccagaggctgca

SEQ ID NO: 1833514 - DNA, 12 bp, Homo sapiens
gtcccccctgag

SEQ ID NO: 1833515 - DNA, 19 bp, Homo sapiens
gtccgccttaatctggaag

SEQ ID NO: 1833516 - DNA, 21 bp, Homo sapiens
gtctgctgctgcctccctggg

SEQ ID NO: 1833517 - DNA, 23 bp, Homo sapiens
gttagattcctcttgcctctctc

SEQ ID NO: 1833518 - DNA, 12 bp, Homo sapiens
taagggactgtg

SEQ ID NO: 1833519 - DNA, 19 bp, Homo sapiens
taatctggaaggcccctcc

SEQ ID NO: 1833520 - DNA, 23 bp, Homo sapiens
tagattcctcttgcctctctcag

SEQ ID NO: 1833521 - DNA, 19 bp, Homo sapiens
tagcccagtccctggagct

SEQ ID NO: 1833522 - DNA, 21 bp, Homo sapiens
taggcccccaaattgccttca

SEQ ID NO: 1833523 - DNA, 21 bp, Homo sapiens
tccacatgtggggacagggct

SEQ ID NO: 1833524 - DNA, 22 bp, Homo sapiens
tcccagcctcttgctcagagct

SEQ ID NO: 1833525 - DNA, 13 bp, Homo sapiens
tccctggagctgt

SEQ ID NO: 1833526 - DNA, 19 bp, Homo sapiens
tccctggagctgtccttca

SEQ ID NO: 1833527 - DNA, 21 bp, Homo sapiens
tccctggggaccaggagctag

SEQ ID NO: 1833528 - DNA, 21 bp, Homo sapiens
tccgttaggaataacactgca

SEQ ID NO: 1833529 - DNA, 17 bp, Homo sapiens
tctaaatcaagtattta

SEQ ID NO: 1833530 - DNA, 17 bp, Homo sapiens
tctctcaggagtatctt

SEQ ID NO: 1833531 - DNA, 13 bp, Homo sapiens
tcttgcctctctc

SEQ ID NO: 1833532 - DNA, 14 bp, Homo sapiens
tcttgctcagagct

SEQ ID NO: 1833533 - DNA, 13 bp, Homo sapiens
tcttttccctctc

SEQ ID NO: 1833534 - DNA, 23 bp, Homo sapiens
tgcagccctctccaccctccggc

SEQ ID NO: 1833535 - DNA, 22 bp, Homo sapiens
tgcctccctggggaccaggagc

SEQ ID NO: 1833536 - DNA, 23 bp, Homo sapiens
tgcctccctggggaccaggagct

SEQ ID NO: 1833537 - DNA, 15 bp, Homo sapiens
tgctgcctccctggg

SEQ ID NO: 1833538 - DNA, 13 bp, Homo sapiens
tgctgctgcctcc

SEQ ID NO: 1833539 - DNA, 22 bp, Homo sapiens
tgggtccgccttaatctggaag

SEQ ID NO: 1833540 - DNA, 16 bp, Homo sapiens
tggtgtggctgctccc

SEQ ID NO: 1833541 - DNA, 22 bp, Homo sapiens
tgtccttcattccgttaggaat

SEQ ID NO: 1833542 - DNA, 20 bp, Homo sapiens
tgtggctgctcccagcctct

SEQ ID NO: 1833543 - DNA, 17 bp, Homo sapiens
ttaggaataacactgca

SEQ ID NO: 1833544 - DNA, 19 bp, Homo sapiens
ttcagcattattcctccag

SEQ ID NO: 1833545 - DNA, 12 bp, Homo sapiens
ttcattccgtta

SEQ ID NO: 1833546 - DNA, 11 bp, Homo sapiens
ttccctctcta

SEQ ID NO: 1833547 - DNA, 19 bp, Homo sapiens
ttcctcttgcctctctcag

SEQ ID NO: 1833548 - DNA, 11 bp, Homo sapiens
ttgccttcagc

SEQ ID NO: 1833549 - DNA, 23 bp, Homo sapiens
caggagtatcttacctgtaaagt

SEQ ID NO: 1833550 - DNA, 23 bp, Homo sapiens
cagggcctactgccacccgcttc

SEQ ID NO: 1833551 - DNA, 20 bp, Homo sapiens
cagggctggtgtggctgctc

SEQ ID NO: 1833552 - DNA, 14 bp, Homo sapiens
cagtccctggagct

SEQ ID NO: 1833553 - DNA, 20 bp, Homo sapiens
ccagcctcttgctcagagct

SEQ ID NO: 1833554 - DNA, 15 bp, Homo sapiens
ccagcgagtggtcaa

SEQ ID NO: 1833555 - DNA, 12 bp, Homo sapiens
ccaggagctagc

SEQ ID NO: 1833556 - DNA, 16 bp, Homo sapiens
ccaggagctagcccag

SEQ ID NO: 1833557 - DNA, 19 bp, Homo sapiens
ccaggagctagcccagtcc

SEQ ID NO: 1833558 - DNA, 21 bp, Homo sapiens
ccaggagctagcccagtccct

SEQ ID NO: 1833559 - DNA, 17 bp, Homo sapiens
ccagggcctactgccac

SEQ ID NO: 1833560 - DNA, 17 bp, Homo sapiens
ccagtccctggagctgt

SEQ ID NO: 1833561 - DNA, 20 bp, Homo sapiens
ccagtggggtcccccctgag

SEQ ID NO: 1833562 - DNA, 15 bp, Homo sapiens
ccataagggactgtg

SEQ ID NO: 1833563 - DNA, 16 bp, Homo sapiens
cccaaattgccttcag

SEQ ID NO: 1833564 - DNA, 21 bp, Homo sapiens
cccagcctcttgctcagagct

SEQ ID NO: 1833565 - DNA, 14 bp, Homo sapiens
cccagtccctggag

SEQ ID NO: 1833566 - DNA, 18 bp, Homo sapiens
ccccaaattgccttcagc

SEQ ID NO: 1833567 - DNA, 20 bp, Homo sapiens
cccccaaattgccttcagcc

SEQ ID NO: 1833568 - DNA, 16 bp, Homo sapiens
ccctaacatagtgtct

SEQ ID NO: 1833569 - DNA, 19 bp, Homo sapiens
ccctggagctgtccttcat

SEQ ID NO: 1833570 - DNA, 20 bp, Homo sapiens
ccctggagctgtccttcatt

SEQ ID NO: 1833571 - DNA, 19 bp, Homo sapiens
ccgctcctcccctcttgag

SEQ ID NO: 1833572 - DNA, 13 bp, Homo sapiens
ccgcttcctgttt

SEQ ID NO: 1833573 - DNA, 16 bp, Homo sapiens
cctctgtccacatgtg

SEQ ID NO: 1833574 - DNA, 20 bp, Homo sapiens
cctggctttcccttccagtt

SEQ ID NO: 1833575 - DNA, 16 bp, Homo sapiens
cctggggaccaggagc

SEQ ID NO: 1833576 - DNA, 17 bp, Homo sapiens
cctggggaccaggagct

SEQ ID NO: 1833577 - DNA, 19 bp, Homo sapiens
cctggggaccaggagctag

SEQ ID NO: 1833578 - DNA, 16 bp, Homo sapiens
cgcctcttttccctct

SEQ ID NO: 1833579 - DNA, 21 bp, Homo sapiens
cgttaggaataacactgcagc

SEQ ID NO: 1833580 - DNA, 20 bp, Homo sapiens
ctaacatagtgtctgctgct

SEQ ID NO: 1833581 - DNA, 13 bp, Homo sapiens
ctagcccagtccc

SEQ ID NO: 1833582 - DNA, 22 bp, Homo sapiens
ctaggcccccaaattgccttca

SEQ ID NO: 1833583 - DNA, 22 bp, Homo sapiens
ctccaccctccggccagcgagt

SEQ ID NO: 1833584 - DNA, 19 bp, Homo sapiens
ctccctggggaccaggagc

SEQ ID NO: 1833585 - DNA, 22 bp, Homo sapiens
ctccctggggaccaggagctag

SEQ ID NO: 1833586 - DNA, 20 bp, Homo sapiens
ctccggccagcgagtggtca

SEQ ID NO: 1833587 - DNA, 15 bp, Homo sapiens
ctcttgctcagagct

SEQ ID NO: 1833588 - DNA, 16 bp, Homo sapiens
ctcttttccctctcta

SEQ ID NO: 1833589 - DNA, 22 bp, Homo sapiens
ctgcctccctggggaccaggag

SEQ ID NO: 1833590 - DNA, 18 bp, Homo sapiens
ctgctcccagcctcttgc

SEQ ID NO: 1833591 - DNA, 19 bp, Homo sapiens
ctgctcccagcctcttgct

SEQ ID NO: 1833592 - DNA, 23 bp, Homo sapiens
ctgctgcctccctggggaccagg

SEQ ID NO: 1833593 - DNA, 18 bp, Homo sapiens
ctgctgctgcctccctgg

SEQ ID NO: 1833594 - DNA, 15 bp, Homo sapiens
ctggggaccaggagc

SEQ ID NO: 1833595 - DNA, 22 bp, Homo sapiens
ctgtccttcattccgttaggaa

SEQ ID NO: 1833596 - DNA, 14 bp, Homo sapiens
cttgcctctctcag

SEQ ID NO: 1833597 - DNA, 16 bp, Homo sapiens
cttgctcagagctagg

SEQ ID NO: 1833598 - DNA, 14 bp, Homo sapiens
ctttcccttccagt

SEQ ID NO: 1833599 - DNA, 16 bp, Homo sapiens
gaataacactgcagcc

SEQ ID NO: 1833600 - DNA, 22 bp, Homo sapiens
gaccaggagctagcccagtccc

SEQ ID NO: 1833601 - DNA, 12 bp, Homo sapiens
gaccaggatcag

SEQ ID NO: 1833602 - DNA, 17 bp, Homo sapiens
gatcagccccgctcctc

SEQ ID NO: 1833603 - DNA, 12 bp, Homo sapiens
gcagccctctcc

SEQ ID NO: 1833604 - DNA, 16 bp, Homo sapiens
gcattattcctccagg

SEQ ID NO: 1833605 - DNA, 14 bp, Homo sapiens
gcccagtccctgga

SEQ ID NO: 1833606 - DNA, 16 bp, Homo sapiens
gcccagtccctggagc

SEQ ID NO: 1833607 - DNA, 17 bp, Homo sapiens
gcccagtccctggagct

SEQ ID NO: 1833608 - DNA, 19 bp, Homo sapiens
gcccagtccctggagctgt

SEQ ID NO: 1833609 - DNA, 20 bp, Homo sapiens
gcctccctggggaccaggag

SEQ ID NO: 1833610 - DNA, 18 bp, Homo sapiens
gcctcttttccctctcta

SEQ ID NO: 1833611 - DNA, 11 bp, Homo sapiens
gcggtacccca

SEQ ID NO: 1833612 - DNA, 14 bp, Homo sapiens
gctgcctccctggg

SEQ ID NO: 1833613 - DNA, 17 bp, Homo sapiens
gctttcccttccagttc

SEQ ID NO: 1833614 - DNA, 17 bp, Homo sapiens
ggagctagcccagtccc

SEQ ID NO: 1833615 - DNA, 20 bp, Homo sapiens
ggcccccaaattgccttcag

SEQ ID NO: 1833616 - DNA, 18 bp, Homo sapiens
ggctgggccctctgtcca

SEQ ID NO: 1833617 - DNA, 12 bp, Homo sapiens
gggaccaggagc

SEQ ID NO: 1833618 - DNA, 13 bp, Homo sapiens
gggaccaggagct

SEQ ID NO: 1833619 - DNA, 14 bp, Homo sapiens
gggccctctgtcca

SEQ ID NO: 1833620 - DNA, 18 bp, Homo sapiens
gggctgggccctctgtcc

SEQ ID NO: 1833621 - DNA, 20 bp, Homo sapiens
gtatcttacctgtaaagtct

SEQ ID NO: 1833622 - DNA, 22 bp, Homo sapiens
gtccacatgtggggacagggct

SEQ ID NO: 1833623 - DNA, 15 bp, Homo sapiens
gtcccccctgagtgg

SEQ ID NO: 1833624 - DNA, 20 bp, Homo sapiens
gtcccccctgagtgggctgg

SEQ ID NO: 1833625 - DNA, 13 bp, Homo sapiens
gtccctggagctg

SEQ ID NO: 1833626 - DNA, 23 bp, Homo sapiens
gtggggtcccccctgagtgggct

SEQ ID NO: 1833627 - DNA, 17 bp, Homo sapiens
gttaggaataacactgc

SEQ ID NO: 1833628 - DNA, 18 bp, Homo sapiens
gttaggaataacactgca

SEQ ID NO: 1833629 - DNA, 19 bp, Homo sapiens
taacactgcagccctctcc

SEQ ID NO: 1833630 - DNA, 17 bp, Homo sapiens
taccataagggactgtg

SEQ ID NO: 1833631 - DNA, 21 bp, Homo sapiens
tagattcctcttgcctctctc

SEQ ID NO: 1833632 - DNA, 22 bp, Homo sapiens
tagattcctcttgcctctctca

SEQ ID NO: 1833633 - DNA, 20 bp, Homo sapiens
tagcccagtccctggagctg

SEQ ID NO: 1833634 - DNA, 13 bp, Homo sapiens
tcagagctaggcc

SEQ ID NO: 1833635 - DNA, 18 bp, Homo sapiens
tcagcattattcctccag

SEQ ID NO: 1833636 - DNA, 17 bp, Homo sapiens
tcattccgttaggaata

SEQ ID NO: 1833637 - DNA, 19 bp, Homo sapiens
tccctggggaccaggagct

SEQ ID NO: 1833638 - DNA, 20 bp, Homo sapiens
tccctggggaccaggagcta

SEQ ID NO: 1833639 - DNA, 19 bp, Homo sapiens
tccgggagagcggctgccc

SEQ ID NO: 1833640 - DNA, 18 bp, Homo sapiens
tctctaaatcaagtattt

SEQ ID NO: 1833641 - DNA, 20 bp, Homo sapiens
tctggaaggcccctcccagc

SEQ ID NO: 1833642 - DNA, 15 bp, Homo sapiens
tcttttccctctcta

SEQ ID NO: 1833643 - DNA, 13 bp, Homo sapiens
tgccttcagccct

SEQ ID NO: 1833644 - DNA, 15 bp, Homo sapiens
tgccttcagccctaa

SEQ ID NO: 1833645 - DNA, 20 bp, Homo sapiens
tggctgctcccagcctcttg

SEQ ID NO: 1833646 - DNA, 21 bp, Homo sapiens
tggctgctcccagcctcttgc

SEQ ID NO: 1833647 - DNA, 13 bp, Homo sapiens
tggggacagggct

SEQ ID NO: 1833648 - DNA, 16 bp, Homo sapiens
tggggtcccccctgag

SEQ ID NO: 1833649 - DNA, 15 bp, Homo sapiens
tgtctgctgctgcct

SEQ ID NO: 1833650 - DNA, 18 bp, Homo sapiens
tgtctgctgctgcctccc

SEQ ID NO: 1833651 - DNA, 14 bp, Homo sapiens
ttgcctctctcagg

SEQ ID NO: 1833652 - DNA, 12 bp, Homo sapiens
ttgctcagagct

SEQ ID NO: 1833653 - DNA, 13 bp, Homo sapiens
tttccctctctag

SEQ ID NO: 1833654 - DNA, 14 bp, Homo sapiens
tttcccttccagtt

SEQ ID NO: 1833655 - DNA, 18 bp, Homo sapiens
tttcttagtcgaatgtta

SEQ ID NO: 1833656 - DNA, 12 bp, Homo sapiens
aacactgcagcc

SEQ ID NO: 1833657 - DNA, 12 bp, Homo sapiens
aaggcccctccc

SEQ ID NO: 1833658 - DNA, 19 bp, Homo sapiens
aataacactgcagccctct

SEQ ID NO: 1833659 - DNA, 16 bp, Homo sapiens
acactgcagccctctc

SEQ ID NO: 1833660 - DNA, 15 bp, Homo sapiens
accaggagctagccc

SEQ ID NO: 1833661 - DNA, 18 bp, Homo sapiens
accaggagctagcccagt

SEQ ID NO: 1833662 - DNA, 21 bp, Homo sapiens
accaggagctagcccagtccc

SEQ ID NO: 1833663 - DNA, 22 bp, Homo sapiens
tcaagtatttattattgaagat

SEQ ID NO: 1833664 - DNA, 12 bp, Homo sapiens
tcccccctgagt

SEQ ID NO: 1833665 - DNA, 17 bp, Homo sapiens
tccctggggaccaggag

SEQ ID NO: 1833666 - DNA, 12 bp, Homo sapiens
tccgttaggaat

SEQ ID NO: 1833667 - DNA, 15 bp, Homo sapiens
tcctcccctcttgag

SEQ ID NO: 1833668 - DNA, 18 bp, Homo sapiens
tcctcttgcctctctcag

SEQ ID NO: 1833669 - DNA, 19 bp, Homo sapiens
tccttcattccgttaggaa

SEQ ID NO: 1833670 - DNA, 15 bp, Homo sapiens
tctcaggagtatctt

SEQ ID NO: 1833671 - DNA, 23 bp, Homo sapiens
tctccaccctccggccagcgagt

SEQ ID NO: 1833672 - DNA, 19 bp, Homo sapiens
tctgtccagaggctgcaag

SEQ ID NO: 1833673 - DNA, 23 bp, Homo sapiens
tcttagtcgaatgttagattcct

SEQ ID NO: 1833674 - DNA, 15 bp, Homo sapiens
tgagtgggctgggcc

SEQ ID NO: 1833675 - DNA, 14 bp, Homo sapiens
tgcagccctctcca

SEQ ID NO: 1833676 - DNA, 22 bp, Homo sapiens
tgcagccctctccaccctccgg

SEQ ID NO: 1833677 - DNA, 17 bp, Homo sapiens
tgggccctctgtccaca

SEQ ID NO: 1833678 - DNA, 14 bp, Homo sapiens
tggggaccaggagc

SEQ ID NO: 1833679 - DNA, 17 bp, Homo sapiens
tggggaccaggagctag

SEQ ID NO: 1833680 - DNA, 21 bp, Homo sapiens
tggggtcccccctgagtgggc

SEQ ID NO: 1833681 - DNA, 19 bp, Homo sapiens
ttattgaagatttaccata

SEQ ID NO: 1833682 - DNA, 12 bp, Homo sapiens
ttccctctctag

SEQ ID NO: 1833683 - DNA, 17 bp, Homo sapiens
ttcctcttgcctctctc

SEQ ID NO: 1833684 - DNA, 18 bp, Homo sapiens
ttctcacatctgtccaga

SEQ ID NO: 1833685 - DNA, 15 bp, Homo sapiens
cagtccctggagctg

SEQ ID NO: 1833686 - DNA, 20 bp, Homo sapiens
cagtggggtcccccctgagt

SEQ ID NO: 1833687 - DNA, 21 bp, Homo sapiens
cagtggggtcccccctgagtg

SEQ ID NO: 1833688 - DNA, 19 bp, Homo sapiens
catgtggggacagggctgg

SEQ ID NO: 1833689 - DNA, 14 bp, Homo sapiens
cattattcctccag

SEQ ID NO: 1833690 - DNA, 16 bp, Homo sapiens
ccaaattgccttcagc

SEQ ID NO: 1833691 - DNA, 20 bp, Homo sapiens
ccaggagctagcccagtccc

SEQ ID NO: 1833692 - DNA, 22 bp, Homo sapiens
ccagggcctactgccacccgct

SEQ ID NO: 1833693 - DNA, 19 bp, Homo sapiens
ccccaaattgccttcagcc

SEQ ID NO: 1833694 - DNA, 20 bp, Homo sapiens
cccgctcctcccctcttgag

SEQ ID NO: 1833695 - DNA, 23 bp, Homo sapiens
ccctcttgaggtggtgccttctc

SEQ ID NO: 1833696 - DNA, 14 bp, Homo sapiens
ccctggagctgtcc

SEQ ID NO: 1833697 - DNA, 18 bp, Homo sapiens
ccctggagctgtccttca

SEQ ID NO: 1833698 - DNA, 17 bp, Homo sapiens
ccctggggaccaggagc

SEQ ID NO: 1833699 - DNA, 20 bp, Homo sapiens
ccgttaggaataacactgca

SEQ ID NO: 1833700 - DNA, 19 bp, Homo sapiens
cctaacatagtgtctgctg

SEQ ID NO: 1833701 - DNA, 18 bp, Homo sapiens
cctccctggggaccagga

SEQ ID NO: 1833702 - DNA, 21 bp, Homo sapiens
cctccctggggaccaggagct

SEQ ID NO: 1833703 - DNA, 12 bp, Homo sapiens
cctctgtccaca

SEQ ID NO: 1833704 - DNA, 17 bp, Homo sapiens
cctcttttccctctcta

SEQ ID NO: 1833705 - DNA, 18 bp, Homo sapiens
cctcttttccctctctag

SEQ ID NO: 1833706 - DNA, 18 bp, Homo sapiens
ctagcccagtccctggag

SEQ ID NO: 1833707 - DNA, 22 bp, Homo sapiens
ctagcccagtccctggagctgt

SEQ ID NO: 1833708 - DNA, 15 bp, Homo sapiens
ctaggcccccaaatt

SEQ ID NO: 1833709 - DNA, 21 bp, Homo sapiens
ctccaccctccggccagcgag

SEQ ID NO: 1833710 - DNA, 20 bp, Homo sapiens
ctccctggggaccaggagct

SEQ ID NO: 1833711 - DNA, 19 bp, Homo sapiens
ctccggccagcgagtggtc

SEQ ID NO: 1833712 - DNA, 16 bp, Homo sapiens
ctctccaccctccggc

SEQ ID NO: 1833713 - DNA, 15 bp, Homo sapiens
ctcttgcctctctca

SEQ ID NO: 1833714 - DNA, 13 bp, Homo sapiens
ctgagtgggctgg

SEQ ID NO: 1833715 - DNA, 19 bp, Homo sapiens
ctgcagccctctccaccct

SEQ ID NO: 1833716 - DNA, 15 bp, Homo sapiens
ctgctcccagcctct

SEQ ID NO: 1833717 - DNA, 18 bp, Homo sapiens
ctgctgcctccctgggga

SEQ ID NO: 1833718 - DNA, 21 bp, Homo sapiens
ctgctgcctccctggggacca

SEQ ID NO: 1833719 - DNA, 23 bp, Homo sapiens
ctggagctgtccttcattccgtt

SEQ ID NO: 1833720 - DNA, 23 bp, Homo sapiens
cttagtcgaatgttagattcctc

SEQ ID NO: 1833721 - DNA, 17 bp, Homo sapiens
cttgcctctctcaggag

SEQ ID NO: 1833722 - DNA, 17 bp, Homo sapiens
ctttcccttccagttcc

SEQ ID NO: 1833723 - DNA, 14 bp, Homo sapiens
cttttccctctcta

SEQ ID NO: 1833724 - DNA, 12 bp, Homo sapiens
gaataacactgc

SEQ ID NO: 1833725 - DNA, 10 bp, Homo sapiens
gaccaggagc

SEQ ID NO: 1833726 - DNA, 22 bp, Homo sapiens
gccagtggggtcccccctgagt

SEQ ID NO: 1833727 - DNA, 18 bp, Homo sapiens
gcccagtccctggagctg

SEQ ID NO: 1833728 - DNA, 20 bp, Homo sapiens
gcctctctcaggagtatctt

SEQ ID NO: 1833729 - DNA, 19 bp, Homo sapiens
gctagcccagtccctggag

SEQ ID NO: 1833730 - DNA, 22 bp, Homo sapiens
gctagcccagtccctggagctg

SEQ ID NO: 1833731 - DNA, 17 bp, Homo sapiens
gctcctcccctcttgag

SEQ ID NO: 1833732 - DNA, 18 bp, Homo sapiens
gctgctgcctccctgggg

SEQ ID NO: 1833733 - DNA, 17 bp, Homo sapiens
ggaataacactgcagcc

SEQ ID NO: 1833734 - DNA, 11 bp, Homo sapiens
ggaccaggagc

SEQ ID NO: 1833735 - DNA, 12 bp, Homo sapiens
ggaccaggagct

SEQ ID NO: 1833736 - DNA, 15 bp, Homo sapiens
ggagagcggctgccc

SEQ ID NO: 1833737 - DNA, 15 bp, Homo sapiens
ggagctagcccagtc

SEQ ID NO: 1833738 - DNA, 19 bp, Homo sapiens
ggccagcgagtggtcaagg

SEQ ID NO: 1833739 - DNA, 20 bp, Homo sapiens
ggccagcgagtggtcaagga

SEQ ID NO: 1833740 - DNA, 16 bp, Homo sapiens
ggccctctgtccacat

SEQ ID NO: 1833741 - DNA, 19 bp, Homo sapiens
gggtcccccctgagtgggc

SEQ ID NO: 1833742 - DNA, 20 bp, Homo sapiens
ggtccgccttaatctggaag

SEQ ID NO: 1833743 - DNA, 13 bp, Homo sapiens
gtcccccctgagt

SEQ ID NO: 1833744 - DNA, 19 bp, Homo sapiens
gtcccccctgagtgggctg

SEQ ID NO: 1833745 - DNA, 14 bp, Homo sapiens
gtccgccttaatct

SEQ ID NO: 1833746 - DNA, 21 bp, Homo sapiens
gtccttcattccgttaggaat

SEQ ID NO: 1833747 - DNA, 16 bp, Homo sapiens
gtctgctgctgcctcc

SEQ ID NO: 1833748 - DNA, 19 bp, Homo sapiens
gtggctgctcccagcctct

SEQ ID NO: 1833749 - DNA, 20 bp, Homo sapiens
gtgggctgggccctctgtcc

SEQ ID NO: 1833750 - DNA, 14 bp, Homo sapiens
gtggggacagggct

SEQ ID NO: 1833751 - DNA, 18 bp, Homo sapiens
gtgtctgctgctgcctcc

SEQ ID NO: 1833752 - DNA, 19 bp, Homo sapiens
gttaggaataacactgcag

SEQ ID NO: 1833753 - DNA, 19 bp, Homo sapiens
taacatagtgtctgctgct

SEQ ID NO: 1833754 - DNA, 21 bp, Homo sapiens
taatctctaaatcaagtattt

SEQ ID NO: 1833755 - DNA, 20 bp, Homo sapiens
taccccagggcctactgcca

SEQ ID NO: 1833756 - DNA, 16 bp, Homo sapiens
taggaataacactgca

SEQ ID NO: 1833757 - DNA, 23 bp, Homo sapiens
taggcccccaaattgccttcagc

SEQ ID NO: 1833758 - DNA, 14 bp, Homo sapiens
tattattgaagatt

SEQ ID NO: 1833759 - DNA, 23 bp, Homo sapiens
accctccggccagcgagtggtca

SEQ ID NO: 1833760 - DNA, 14 bp, Homo sapiens
actgcagccctctc

SEQ ID NO: 1833761 - DNA, 16 bp, Homo sapiens
actgcagccctctcca

SEQ ID NO: 1833762 - DNA, 23 bp, Homo sapiens
actgcagccctctccaccctccg

SEQ ID NO: 1833763 - DNA, 21 bp, Homo sapiens
agattcctcttgcctctctca

SEQ ID NO: 1833764 - DNA, 23 bp, Homo sapiens
agcagcggtaccccagggcctac

SEQ ID NO: 1833765 - DNA, 17 bp, Homo sapiens
agcccagtccctggagc

SEQ ID NO: 1833766 - DNA, 20 bp, Homo sapiens
agcccagtccctggagctgt

SEQ ID NO: 1833767 - DNA, 21 bp, Homo sapiens
agcccagtccctggagctgtc

SEQ ID NO: 1833768 - DNA, 21 bp, Homo sapiens
agccccgctcctcccctcttg

SEQ ID NO: 1833769 - DNA, 23 bp, Homo sapiens
agctagcccagtccctggagctg

SEQ ID NO: 1833770 - DNA, 17 bp, Homo sapiens
aggaataacactgcagc

SEQ ID NO: 1833771 - DNA, 22 bp, Homo sapiens
aggcccccaaattgccttcagc

SEQ ID NO: 1833772 - DNA, 16 bp, Homo sapiens
agggcctactgccacc

SEQ ID NO: 1833773 - DNA, 21 bp, Homo sapiens
agggctggtgtggctgctccc

SEQ ID NO: 1833774 - DNA, 15 bp, Homo sapiens
aggtggtgccttctc

SEQ ID NO: 1833775 - DNA, 19 bp, Homo sapiens
agtatcttacctgtaaagt

SEQ ID NO: 1833776 - DNA, 17 bp, Homo sapiens
agtccctggagctgtcc

SEQ ID NO: 1833777 - DNA, 18 bp, Homo sapiens
agtctaatctctaaatca

SEQ ID NO: 1833778 - DNA, 18 bp, Homo sapiens
agtgggctgggccctctg

SEQ ID NO: 1833779 - DNA, 23 bp, Homo sapiens
agtggggtcccccctgagtgggc

SEQ ID NO: 1833780 - DNA, 20 bp, Homo sapiens
ataacactgcagccctctcc

SEQ ID NO: 1833781 - DNA, 15 bp, Homo sapiens
attgccttcagccct

SEQ ID NO: 1833782 - DNA, 12 bp, Homo sapiens
atttattattga

SEQ ID NO: 1833783 - DNA, 14 bp, Homo sapiens
caaattgccttcag

SEQ ID NO: 1833784 - DNA, 17 bp, Homo sapiens
cagcctcttgctcagag

SEQ ID NO: 1833785 - DNA, 14 bp, Homo sapiens
cagcgagtggtcaa

SEQ ID NO: 1833786 - DNA, 21 bp, Homo sapiens
caggagctagcccagtccctg

SEQ ID NO: 1833787 - DNA, 16 bp, Homo sapiens
cagtccctggagctgt

SEQ ID NO: 1833788 - DNA, 23 bp, Homo sapiens
cagttccgggagagcggctgccc

SEQ ID NO: 1833789 - DNA, 22 bp, Homo sapiens
catagtgtctgctgctgcctcc

SEQ ID NO: 1833790 - DNA, 13 bp, Homo sapiens
cattccgttagga

SEQ ID NO: 1833791 - DNA, 20 bp, Homo sapiens
ccacatgtggggacagggct

SEQ ID NO: 1833792 - DNA, 12 bp, Homo sapiens
ccagtccctgga

SEQ ID NO: 1833793 - DNA, 15 bp, Homo sapiens
ccagtccctggagct

SEQ ID NO: 1833794 - DNA, 16 bp, Homo sapiens
ccagtccctggagctg

SEQ ID NO: 1833795 - DNA, 14 bp, Homo sapiens
ccagtggggtcccc

SEQ ID NO: 1833796 - DNA, 15 bp, Homo sapiens
cccaaattgccttca

SEQ ID NO: 1833797 - DNA, 17 bp, Homo sapiens
cccaaattgccttcagc

SEQ ID NO: 1833798 - DNA, 13 bp, Homo sapiens
aaaacgcctcttt

SEQ ID NO: 1833799 - DNA, 22 bp, Homo sapiens
aaacgcctcttttccctctcta

SEQ ID NO: 1833800 - DNA, 19 bp, Homo sapiens
aaattgccttcagccctaa

SEQ ID NO: 1833801 - DNA, 18 bp, Homo sapiens
aacactgcagccctctcc

SEQ ID NO: 1833802 - DNA, 18 bp, Homo sapiens
aactactaaagtgcctac

SEQ ID NO: 1833803 - DNA, 23 bp, Homo sapiens
aagccagtggggtcccccctgag

SEQ ID NO: 1833804 - DNA, 11 bp, Homo sapiens
aataacactgc

SEQ ID NO: 1833805 - DNA, 12 bp, Homo sapiens
aataacactgca

SEQ ID NO: 1833806 - DNA, 13 bp, Homo sapiens
aatcaagtattta

SEQ ID NO: 1833807 - DNA, 18 bp, Homo sapiens
aatctctaaatcaagtat

SEQ ID NO: 1833808 - DNA, 17 bp, Homo sapiens
acactgcagccctctcc

SEQ ID NO: 1833809 - DNA, 20 bp, Homo sapiens
acatgtggggacagggctgg

SEQ ID NO: 1833810 - DNA, 21 bp, Homo sapiens
accataagggactgtgccaga

SEQ ID NO: 1833811 - DNA, 19 bp, Homo sapiens
acgcctcttttccctctct

SEQ ID NO: 1833812 - DNA, 20 bp, Homo sapiens
acgcctcttttccctctcta

SEQ ID NO: 1833813 - DNA, 19 bp, Homo sapiens
agattcctcttgcctctct

SEQ ID NO: 1833814 - DNA, 18 bp, Homo sapiens
agcctcttgctcagagct

SEQ ID NO: 1833815 - DNA, 20 bp, Homo sapiens
aggagcaaaacgcctctttt

SEQ ID NO: 1833816 - DNA, 18 bp, Homo sapiens
aggagctagcccagtccc

SEQ ID NO: 1833817 - DNA, 19 bp, Homo sapiens
aggagctagcccagtccct

SEQ ID NO: 1833818 - DNA, 24 bp, Homo sapiens
aggagctagcccagtccctggagc

SEQ ID NO: 1833819 - DNA, 20 bp, Homo sapiens
aggcccccaaattgccttca

SEQ ID NO: 1833820 - DNA, 21 bp, Homo sapiens
aggcccccaaattgccttcag

SEQ ID NO: 1833821 - DNA, 22 bp, Homo sapiens
agtccctggagctgtccttcat

SEQ ID NO: 1833822 - DNA, 20 bp, Homo sapiens
agtggggtcccccctgagtg

SEQ ID NO: 1833823 - DNA, 20 bp, Homo sapiens
agtgtctgctgctgcctccc

SEQ ID NO: 1833824 - DNA, 21 bp, Homo sapiens
agtgtctgctgctgcctccct

SEQ ID NO: 1833825 - DNA, 14 bp, Homo sapiens
ataacactgcagcc

SEQ ID NO: 1833826 - DNA, 17 bp, Homo sapiens
atcagccccgctcctcc

SEQ ID NO: 1833827 - DNA, 23 bp, Homo sapiens
atcagccccgctcctcccctctt

SEQ ID NO: 1833828 - DNA, 18 bp, Homo sapiens
atcttacctgtaaagtct

SEQ ID NO: 1833829 - DNA, 16 bp, Homo sapiens
atgtggggacagggct

SEQ ID NO: 1833830 - DNA, 13 bp, Homo sapiens
attccgttaggaa

SEQ ID NO: 1833831 - DNA, 22 bp, Homo sapiens
attccgttaggaataacactgc

SEQ ID NO: 1833832 - DNA, 18 bp, Homo sapiens
attcctcttgcctctctc

SEQ ID NO: 1833833 - DNA, 19 bp, Homo sapiens
attcctcttgcctctctca

SEQ ID NO: 1833834 - DNA, 12 bp, Homo sapiens
attgccttcagc

SEQ ID NO: 1833835 - DNA, 15 bp, Homo sapiens
caaattgccttcagc

SEQ ID NO: 1833836 - DNA, 20 bp, Homo sapiens
caagtatttattattgaaga

SEQ ID NO: 1833837 - DNA, 15 bp, Homo sapiens
cacccgcttcctgtt

SEQ ID NO: 1833838 - DNA, 17 bp, Homo sapiens
cacccgcttcctgtttc

SEQ ID NO: 1833839 - DNA, 19 bp, Homo sapiens
caccctccggccagcgagt

SEQ ID NO: 1833840 - DNA, 15 bp, Homo sapiens
cactgcagccctctc

SEQ ID NO: 1833841 - DNA, 14 bp, Homo sapiens
cagagctaggcccc

SEQ ID NO: 1833842 - DNA, 17 bp, Homo sapiens
caggatcagccccgctc

SEQ ID NO: 1833843 - DNA, 12 bp, Homo sapiens
cagtccctggag

SEQ ID NO: 1833844 - DNA, 13 bp, Homo sapiens
cagtccctggagc

SEQ ID NO: 1833845 - DNA, 13 bp, Homo sapiens
gtgtggctgctcc

SEQ ID NO: 1833846 - DNA, 20 bp, Homo sapiens
taccataagggactgtgcca

SEQ ID NO: 1833847 - DNA, 12 bp, Homo sapiens
tagcccagtccc

SEQ ID NO: 1833848 - DNA, 15 bp, Homo sapiens
taggaataacactgc

SEQ ID NO: 1833849 - DNA, 20 bp, Homo sapiens
tatcttacctgtaaagtcta

SEQ ID NO: 1833850 - DNA, 14 bp, Homo sapiens
tcattccgttagga

SEQ ID NO: 1833851 - DNA, 15 bp, Homo sapiens
tcattccgttaggaa

SEQ ID NO: 1833852 - DNA, 13 bp, Homo sapiens
tcccccctgagtg

SEQ ID NO: 1833853 - DNA, 20 bp, Homo sapiens
tccctggagctgtccttcat

SEQ ID NO: 1833854 - DNA, 18 bp, Homo sapiens
tccctggggaccaggagc

SEQ ID NO: 1833855 - DNA, 12 bp, Homo sapiens
tcccttccagtt

SEQ ID NO: 1833856 - DNA, 16 bp, Homo sapiens
tctctcaggagtatct

SEQ ID NO: 1833857 - DNA, 14 bp, Homo sapiens
tcttgcctctctca

SEQ ID NO: 1833858 - DNA, 16 bp, Homo sapiens
tcttgcctctctcagg

SEQ ID NO: 1833859 - DNA, 16 bp, Homo sapiens
tcttgctcagagctag

SEQ ID NO: 1833860 - DNA, 14 bp, Homo sapiens
tggctttcccttcc

SEQ ID NO: 1833861 - DNA, 15 bp, Homo sapiens
tggggaccaggagct

SEQ ID NO: 1833862 - DNA, 22 bp, Homo sapiens
ttcattccgttaggaataacac

SEQ ID NO: 1833863 - DNA, 18 bp, Homo sapiens
ttcctcttgcctctctca

SEQ ID NO: 1833864 - DNA, 19 bp, Homo sapiens
ttgaggtggtgccttctca

SEQ ID NO: 1833865 - DNA, 14 bp, Homo sapiens
ttgctcagagctag

SEQ ID NO: 1833866 - DNA, 14 bp, Homo sapiens
tttattattgaaga

SEQ ID NO: 1833867 - DNA, 23 bp, Homo sapiens
aaaacgcctcttttccctctcta

SEQ ID NO: 1833868 - DNA, 12 bp, Homo sapiens
aaattgccttca

SEQ ID NO: 1833869 - DNA, 22 bp, Homo sapiens
aacgcctcttttccctctctag

SEQ ID NO: 1833870 - DNA, 21 bp, Homo sapiens
aataacactgcagccctctcc

SEQ ID NO: 1833871 - DNA, 21 bp, Homo sapiens
aatctggaaggcccctcccag

SEQ ID NO: 1833872 - DNA, 18 bp, Homo sapiens
accctccggccagcgagt

SEQ ID NO: 1833873 - DNA, 13 bp, Homo sapiens
actactaaagtgc

SEQ ID NO: 1833874 - DNA, 16 bp, Homo sapiens
agaactactaaagtgc

SEQ ID NO: 1833875 - DNA, 13 bp, Homo sapiens
agagcggctgccc

SEQ ID NO: 1833876 - DNA, 23 bp, Homo sapiens
agagctaggcccccaaattgcct

SEQ ID NO: 1833877 - DNA, 23 bp, Homo sapiens
agattcctcttgcctctctcagg

SEQ ID NO: 1833878 - DNA, 23 bp, Homo sapiens
agccagtggggtcccccctgagt

SEQ ID NO: 1833879 - DNA, 18 bp, Homo sapiens
agcccagtccctggagct

SEQ ID NO: 1833880 - DNA, 18 bp, Homo sapiens
agccctaacatagtgtct

SEQ ID NO: 1833881 - DNA, 14 bp, Homo sapiens
aggaataacactgc

SEQ ID NO: 1833882 - DNA, 22 bp, Homo sapiens
atcagccccgctcctcccctct

SEQ ID NO: 1833883 - DNA, 16 bp, Homo sapiens
atcttacctgtaaagt

SEQ ID NO: 1833884 - DNA, 16 bp, Homo sapiens
atgttaggagaactac

SEQ ID NO: 1833885 - DNA, 14 bp, Homo sapiens
attccgttaggaat

SEQ ID NO: 1833886 - DNA, 17 bp, Homo sapiens
attcctcttgcctctct

SEQ ID NO: 1833887 - DNA, 13 bp, Homo sapiens
caaattgccttca

SEQ ID NO: 1833888 - DNA, 13 bp, Homo sapiens
cagagctaggccc

SEQ ID NO: 1833889 - DNA, 17 bp, Homo sapiens
cagcattattcctccag

SEQ ID NO: 1833890 - DNA, 20 bp, Homo sapiens
cagccccgctcctcccctct

SEQ ID NO: 1833891 - DNA, 19 bp, Homo sapiens
caggagctagcccagtccc

SEQ ID NO: 1833892 - DNA, 23 bp, Homo sapiens
caggagctagcccagtccctgga

SEQ ID NO: 1833893 - DNA, 21 bp, Homo sapiens
cagggcctactgccacccgct

SEQ ID NO: 1833894 - DNA, 22 bp, Homo sapiens
cagtggggtcccccctgagtgg

SEQ ID NO: 1833895 - DNA, 17 bp, Homo sapiens
catgtggggacagggct

SEQ ID NO: 1833896 - DNA, 23 bp, Homo sapiens
cattccgttaggaataacactgc

SEQ ID NO: 1833897 - DNA, 19 bp, Homo sapiens
ccagcagcggtaccccagg

SEQ ID NO: 1833898 - DNA, 13 bp, Homo sapiens
ccagtccctggag

SEQ ID NO: 1833899 - DNA, 14 bp, Homo sapiens
ccagtccctggagc

SEQ ID NO: 1833900 - DNA, 13 bp, Homo sapiens
ccagtggggtccc

SEQ ID NO: 1833901 - DNA, 23 bp, Homo sapiens
ccagtggggtcccccctgagtgg

SEQ ID NO: 1833902 - DNA, 16 bp, Homo sapiens
cccagtccctggagct

SEQ ID NO: 1833903 - DNA, 17 bp, Homo sapiens
cccagtccctggagctg

SEQ ID NO: 1833904 - DNA, 16 bp, Homo sapiens
ccccaaattgccttca

SEQ ID NO: 1833905 - DNA, 17 bp, Homo sapiens
ccccaaattgccttcag

SEQ ID NO: 1833906 - DNA, 19 bp, Homo sapiens
cccccaaattgccttcagc

SEQ ID NO: 1833907 - DNA, 12 bp, Homo sapiens
cccccctgagtg

SEQ ID NO: 1833908 - DNA, 16 bp, Homo sapiens
ccccctgagtgggctg

SEQ ID NO: 1833909 - DNA, 11 bp, Homo sapiens
cccctcccagc

SEQ ID NO: 1833910 - DNA, 13 bp, Homo sapiens
ccctctgtccaca

SEQ ID NO: 1833911 - DNA, 23 bp, Homo sapiens
ccctgagtgggctgggccctctg

SEQ ID NO: 1833912 - DNA, 13 bp, Homo sapiens
ccctggagctgtc

SEQ ID NO: 1833913 - DNA, 15 bp, Homo sapiens
ccctggagctgtcct

SEQ ID NO: 1833914 - DNA, 15 bp, Homo sapiens
ccctggggaccagga

SEQ ID NO: 1833915 - DNA, 18 bp, Homo sapiens
ccctggggaccaggagct

SEQ ID NO: 1833916 - DNA, 20 bp, Homo sapiens
ccctggggaccaggagctag

SEQ ID NO: 1833917 - DNA, 13 bp, Homo sapiens
ccgcccgaccagg

SEQ ID NO: 1833918 - DNA, 22 bp, Homo sapiens
ccgccttaatctggaaggcccc

SEQ ID NO: 1833919 - DNA, 19 bp, Homo sapiens
ccgttaggaataacactgc

SEQ ID NO: 1833920 - DNA, 15 bp, Homo sapiens
cctaacatagtgtct

SEQ ID NO: 1833921 - DNA, 23 bp, Homo sapiens
cctactgccacccgcttcctgtt

SEQ ID NO: 1833922 - DNA, 23 bp, Homo sapiens
cctccctggggaccaggagctag

SEQ ID NO: 1833923 - DNA, 17 bp, Homo sapiens
cctctccaccctccggc

SEQ ID NO: 1833924 - DNA, 19 bp, Homo sapiens
cctctctcaggagtatctt

SEQ ID NO: 1833925 - DNA, 14 bp, Homo sapiens
cctcttgcctctct

SEQ ID NO: 1833926 - DNA, 15 bp, Homo sapiens
cctcttgcctctctc

SEQ ID NO: 1833927 - DNA, 17 bp, Homo sapiens
cctcttgctcagagcta

SEQ ID NO: 1833928 - DNA, 14 bp, Homo sapiens
cctgagtgggctgg

SEQ ID NO: 1833929 - DNA, 11 bp, Homo sapiens
cctggagctgt

SEQ ID NO: 1833930 - DNA, 17 bp, Homo sapiens
ccttcattccgttagga

SEQ ID NO: 1833931 - DNA, 17 bp, Homo sapiens
cgctcctcccctcttga

SEQ ID NO: 1833932 - DNA, 12 bp, Homo sapiens
ctactaaagtgc

SEQ ID NO: 1833933 - DNA, 23 bp, Homo sapiens
ctagcccagtccctggagctgtc

SEQ ID NO: 1833934 - DNA, 15 bp, Homo sapiens
ctcccagcctcttgc

SEQ ID NO: 1833935 - DNA, 22 bp, Homo sapiens
ctcccagcctcttgctcagagc

SEQ ID NO: 1833936 - DNA, 18 bp, Homo sapiens
ctccctggggaccaggag

SEQ ID NO: 1833937 - DNA, 21 bp, Homo sapiens
ctccctggggaccaggagcta

SEQ ID NO: 1833938 - DNA, 15 bp, Homo sapiens
ctcttttccctctct

SEQ ID NO: 1833939 - DNA, 17 bp, Homo sapiens
ctcttttccctctctag

SEQ ID NO: 1833940 - DNA, 18 bp, Homo sapiens
ctgagtgggctgggccct

SEQ ID NO: 1833941 - DNA, 19 bp, Homo sapiens
ctgccacccgcttcctgtt

SEQ ID NO: 1833942 - DNA, 17 bp, Homo sapiens
ctgcccgactcaggtcc

SEQ ID NO: 1833943 - DNA, 15 bp, Homo sapiens
ctgcctccctgggga

SEQ ID NO: 1833944 - DNA, 23 bp, Homo sapiens
ctgcctccctggggaccaggagc

SEQ ID NO: 1833945 - DNA, 13 bp, Homo sapiens
ctgctcccagcct

SEQ ID NO: 1833946 - DNA, 17 bp, Homo sapiens
ctgctgcctccctgggg

SEQ ID NO: 1833947 - DNA, 18 bp, Homo sapiens
ctgggccctctgtccaca

SEQ ID NO: 1833948 - DNA, 14 bp, Homo sapiens
ctggggaccaggag

SEQ ID NO: 1833949 - DNA, 17 bp, Homo sapiens
ctggggaccaggagcta

SEQ ID NO: 1833950 - DNA, 18 bp, Homo sapiens
ctggggaccaggagctag

SEQ ID NO: 1833951 - DNA, 19 bp, Homo sapiens
cttcattccgttaggaata

SEQ ID NO: 1833952 - DNA, 13 bp, Homo sapiens
cttgcctctctca

SEQ ID NO: 1833953 - DNA, 13 bp, Homo sapiens
gaataacactgca

SEQ ID NO: 1833954 - DNA, 19 bp, Homo sapiens
gattcctcttgcctctctc

SEQ ID NO: 1833955 - DNA, 15 bp, Homo sapiens
gcccagtccctggag

SEQ ID NO: 1833956 - DNA, 17 bp, Homo sapiens
gcccccaaattgccttc

SEQ ID NO: 1833957 - DNA, 18 bp, Homo sapiens
gcccccaaattgccttca

SEQ ID NO: 1833958 - DNA, 19 bp, Homo sapiens
gcccccaaattgccttcag

SEQ ID NO: 1833959 - DNA, 21 bp, Homo sapiens
gcccccaaattgccttcagcc

SEQ ID NO: 1833960 - DNA, 22 bp, Homo sapiens
gcctccctggggaccaggagct

SEQ ID NO: 1833961 - DNA, 20 bp, Homo sapiens
gccttaatctggaaggcccc

SEQ ID NO: 1833962 - DNA, 12 bp, Homo sapiens
gccttcagccct

SEQ ID NO: 1833963 - DNA, 15 bp, Homo sapiens
gctcctcccctcttg

SEQ ID NO: 1833964 - DNA, 19 bp, Homo sapiens
gctgctcccagcctcttgc

SEQ ID NO: 1833965 - DNA, 15 bp, Homo sapiens
gctgggccctctgtc

SEQ ID NO: 1833966 - DNA, 13 bp, Homo sapiens
ggaataacactgc

SEQ ID NO: 1833967 - DNA, 22 bp, Homo sapiens
ggagctagcccagtccctggag

SEQ ID NO: 1833968 - DNA, 16 bp, Homo sapiens
ggctggtgtggctgct

SEQ ID NO: 1833969 - DNA, 13 bp, Homo sapiens
ggggaccaggagc

SEQ ID NO: 1833970 - DNA, 17 bp, Homo sapiens
gggtcccccctgagtgg

SEQ ID NO: 1833971 - DNA, 13 bp, Homo sapiens
ggtcccccctgag

SEQ ID NO: 1833972 - DNA, 14 bp, Homo sapiens
gtccctggagctgt

SEQ ID NO: 1833973 - DNA, 17 bp, Homo sapiens
gtccctggagctgtcct

SEQ ID NO: 1833974 - DNA, 15 bp, Homo sapiens
gtgggctgggccctc

SEQ ID NO: 1833975 - DNA, 20 bp, Homo sapiens
aaacgcctcttttccctctc

SEQ ID NO: 1833976 - DNA, 13 bp, Homo sapiens
aaattgccttcag

SEQ ID NO: 1833977 - DNA, 14 bp, Homo sapiens
aaattgccttcagc

SEQ ID NO: 1833978 - DNA, 15 bp, Homo sapiens
aaattgccttcagcc

SEQ ID NO: 1833979 - DNA, 11 bp, Homo sapiens
acactgcagcc

SEQ ID NO: 1833980 - DNA, 18 bp, Homo sapiens
acatgtggggacagggct

SEQ ID NO: 1833981 - DNA, 21 bp, Homo sapiens
acgcctcttttccctctctag

SEQ ID NO: 1833982 - DNA, 21 bp, Homo sapiens
actgcagccctctccaccctc

SEQ ID NO: 1833983 - DNA, 20 bp, Homo sapiens
agattcctcttgcctctctc

SEQ ID NO: 1833984 - DNA, 22 bp, Homo sapiens
agccagtggggtcccccctgag

SEQ ID NO: 1833985 - DNA, 20 bp, Homo sapiens
agccccgctcctcccctctt

SEQ ID NO: 1833986 - DNA, 16 bp, Homo sapiens
agccctctccaccctc

SEQ ID NO: 1833987 - DNA, 15 bp, Homo sapiens
aggaataacactgca

SEQ ID NO: 1833988 - DNA, 17 bp, Homo sapiens
aggatcagccccgctcc

SEQ ID NO: 1833989 - DNA, 21 bp, Homo sapiens
agtatcttacctgtaaagtct

SEQ ID NO: 1833990 - DNA, 13 bp, Homo sapiens
agtccctggagct

SEQ ID NO: 1833991 - DNA, 21 bp, Homo sapiens
agtggggtcccccctgagtgg

SEQ ID NO: 1833992 - DNA, 12 bp, Homo sapiens
agtggtcaagga

SEQ ID NO: 1833993 - DNA, 16 bp, Homo sapiens
atctggaaggcccctc

SEQ ID NO: 1833994 - DNA, 13 bp, Homo sapiens
attattcctccag

SEQ ID NO: 1833995 - DNA, 23 bp, Homo sapiens
attccgttaggaataacactgca

SEQ ID NO: 1833996 - DNA, 20 bp, Homo sapiens
attcctcttgcctctctcag

SEQ ID NO: 1833997 - DNA, 16 bp, Homo sapiens
caaattgccttcagcc

SEQ ID NO: 1833998 - DNA, 17 bp, Homo sapiens
cagcagcggtaccccag

SEQ ID NO: 1833999 - DNA, 18 bp, Homo sapiens
cagcattattcctccagg

SEQ ID NO: 1834000 - DNA, 15 bp, Homo sapiens
accactgctctgatg

SEQ ID NO: 1834001 - DNA, 23 bp, Homo sapiens
accactgctctgatgaagaggag

SEQ ID NO: 1834002 - DNA, 21 bp, Homo sapiens
accagaaccaattattttcat

SEQ ID NO: 1834003 - DNA, 19 bp, Homo sapiens
accagtttaacctgatgca

SEQ ID NO: 1834004 - DNA, 21 bp, Homo sapiens
accagtttaacctgatgcagt

SEQ ID NO: 1834005 - DNA, 19 bp, Homo sapiens
accataaccccggaagcca

SEQ ID NO: 1834006 - DNA, 20 bp, Homo sapiens
accatcagaaacaccctcac

SEQ ID NO: 1834007 - DNA, 23 bp, Homo sapiens
accatgattaaccacttcagctg

SEQ ID NO: 1834008 - DNA, 16 bp, Homo sapiens
accattctccacctgc

SEQ ID NO: 1834009 - DNA, 21 bp, Homo sapiens
accattctccacctgccaggg

SEQ ID NO: 1834010 - DNA, 18 bp, Homo sapiens
acccaaggtaccatccta

SEQ ID NO: 1834011 - DNA, 17 bp, Homo sapiens
acccacccccacccaag

SEQ ID NO: 1834012 - DNA, 16 bp, Homo sapiens
acccacctgttttctg

SEQ ID NO: 1834013 - DNA, 19 bp, Homo sapiens
acccacctgttttctgaaa

SEQ ID NO: 1834014 - DNA, 14 bp, Homo sapiens
acccaggctgggca

SEQ ID NO: 1834015 - DNA, 23 bp, Homo sapiens
acccaggtgctaggaacactcct

SEQ ID NO: 1834016 - DNA, 16 bp, Homo sapiens
acccatgcagctgctc

SEQ ID NO: 1834017 - DNA, 18 bp, Homo sapiens
acccatgcagctgctccc

SEQ ID NO: 1834018 - DNA, 16 bp, Homo sapiens
acccatgctgccctgt

SEQ ID NO: 1834019 - DNA, 22 bp, Homo sapiens
acccattgttgtcaaggaagaa

SEQ ID NO: 1834020 - DNA, 23 bp, Homo sapiens
acccattgttgtcaaggaagaag

SEQ ID NO: 1834021 - DNA, 18 bp, Homo sapiens
accccagacgatgtcttc

SEQ ID NO: 1834022 - DNA, 18 bp, Homo sapiens
accccatctctacaaaaa

SEQ ID NO: 1834023 - DNA, 12 bp, Homo sapiens
acccccacccaa

SEQ ID NO: 1834024 - DNA, 23 bp, Homo sapiens
accccgctgatggagccccacct

SEQ ID NO: 1834025 - DNA, 20 bp, Homo sapiens
acccctcaacacctctgcac

SEQ ID NO: 1834026 - DNA, 19 bp, Homo sapiens
acccgggaagggggctggg

SEQ ID NO: 1834027 - DNA, 13 bp, Homo sapiens
accctattgctgc

SEQ ID NO: 1834028 - DNA, 19 bp, Homo sapiens
accctattgctgcttgagg

SEQ ID NO: 1834029 - DNA, 15 bp, Homo sapiens
accctcacactggga

SEQ ID NO: 1834030 - DNA, 18 bp, Homo sapiens
accctcatacacagaaac

SEQ ID NO: 1834031 - DNA, 21 bp, Homo sapiens
accctccccacagtgccaccc

SEQ ID NO: 1834032 - DNA, 18 bp, Homo sapiens
accctgaaagccctgagc

SEQ ID NO: 1834033 - DNA, 16 bp, Homo sapiens
accctgaggcccagag

SEQ ID NO: 1834034 - DNA, 21 bp, Homo sapiens
accctgaggcccagagggcct

SEQ ID NO: 1834035 - DNA, 11 bp, Homo sapiens
accctgccctg

SEQ ID NO: 1834036 - DNA, 17 bp, Homo sapiens
accctgccctgtgggcc

SEQ ID NO: 1834037 - DNA, 16 bp, Homo sapiens
accctgtgatggggcc

SEQ ID NO: 1834038 - DNA, 17 bp, Homo sapiens
acccttgtggtcccacc

SEQ ID NO: 1834039 - DNA, 16 bp, Homo sapiens
accctttggccccact

SEQ ID NO: 1834040 - DNA, 17 bp, Homo sapiens
accgctgattctcaggg

SEQ ID NO: 1834041 - DNA, 14 bp, Homo sapiens
accggctggcctgg

SEQ ID NO: 1834042 - DNA, 12 bp, Homo sapiens
acctaccacatg

SEQ ID NO: 1834043 - DNA, 19 bp, Homo sapiens
acctagcatcttacaaaaa

SEQ ID NO: 1834044 - DNA, 18 bp, Homo sapiens
acctagctgaatgttttt

SEQ ID NO: 1834045 - DNA, 19 bp, Homo sapiens
acctagctgaatgtttttc

SEQ ID NO: 1834046 - DNA, 20 bp, Homo sapiens
acctagctgaatgtttttct

SEQ ID NO: 1834047 - DNA, 18 bp, Homo sapiens
acctcagagtatggagct

SEQ ID NO: 1834048 - DNA, 18 bp, Homo sapiens
acctcaggtgagaagcag

SEQ ID NO: 1834049 - DNA, 15 bp, Homo sapiens
acctcatgcccagct

SEQ ID NO: 1834050 - DNA, 22 bp, Homo sapiens
acctcatgcccagctctctgac

SEQ ID NO: 1834051 - DNA, 16 bp, Homo sapiens
acctcctgtctctggc

SEQ ID NO: 1834052 - DNA, 17 bp, Homo sapiens
acctcggtgccttcctc

SEQ ID NO: 1834053 - DNA, 19 bp, Homo sapiens
acctcggtgccttcctctt

SEQ ID NO: 1834054 - DNA, 14 bp, Homo sapiens
acctctcccttgga

SEQ ID NO: 1834055 - DNA, 19 bp, Homo sapiens
acctctctcactccttgaa

SEQ ID NO: 1834056 - DNA, 16 bp, Homo sapiens
acctctgcacaagctg

SEQ ID NO: 1834057 - DNA, 17 bp, Homo sapiens
acctgagatttattaaa

SEQ ID NO: 1834058 - DNA, 14 bp, Homo sapiens
acctgaggcccttc

SEQ ID NO: 1834059 - DNA, 16 bp, Homo sapiens
acctgaggcccttctc

SEQ ID NO: 1834060 - DNA, 21 bp, Homo sapiens
acctgaggcccttctctccag

SEQ ID NO: 1834061 - DNA, 17 bp, Homo sapiens
acctgattgtgtctctt

SEQ ID NO: 1834062 - DNA, 13 bp, Homo sapiens
acctgcacacagg

SEQ ID NO: 1834063 - DNA, 14 bp, Homo sapiens
acctgcacacagga

SEQ ID NO: 1834064 - DNA, 15 bp, Homo sapiens
acctgcacacaggac

SEQ ID NO: 1834065 - DNA, 21 bp, Homo sapiens
acctgcacacaggacagcggg

SEQ ID NO: 1834066 - DNA, 13 bp, Homo sapiens
acctgccagggac

SEQ ID NO: 1834067 - DNA, 18 bp, Homo sapiens
acctgccagggacagagg

SEQ ID NO: 1834068 - DNA, 21 bp, Homo sapiens
acctgcctcccttcatgcatg

SEQ ID NO: 1834069 - DNA, 13 bp, Homo sapiens
acctgcctgggtt

SEQ ID NO: 1834070 - DNA, 19 bp, Homo sapiens
acctgcggtgctatctccc

SEQ ID NO: 1834071 - DNA, 23 bp, Homo sapiens
acctgcggtgctatctcccccag

SEQ ID NO: 1834072 - DNA, 16 bp, Homo sapiens
acctggcctcatttaa

SEQ ID NO: 1834073 - DNA, 20 bp, Homo sapiens
acctggggctgctggcctga

SEQ ID NO: 1834074 - DNA, 23 bp, Homo sapiens
acctgtcacgattgtcatcagga

SEQ ID NO: 1834075 - DNA, 12 bp, Homo sapiens
acctgtccccct

SEQ ID NO: 1834076 - DNA, 18 bp, Homo sapiens
accttagacagtccctgc

SEQ ID NO: 1834077 - DNA, 20 bp, Homo sapiens
accttagacagtccctgcca

SEQ ID NO: 1834078 - DNA, 14 bp, Homo sapiens
accttccaaagagt

SEQ ID NO: 1834079 - DNA, 13 bp, Homo sapiens
accttctccttca

SEQ ID NO: 1834080 - DNA, 22 bp, Homo sapiens
accttctccttcacctttgtcc

SEQ ID NO: 1834081 - DNA, 21 bp, Homo sapiens
accttgtctgctaaataaaca

SEQ ID NO: 1834082 - DNA, 12 bp, Homo sapiens
acctttattctg

SEQ ID NO: 1834083 - DNA, 20 bp, Homo sapiens
acgagagagtcttccaggta

SEQ ID NO: 1834084 - DNA, 18 bp, Homo sapiens
acgcaaaaatagctcttg

SEQ ID NO: 1834085 - DNA, 16 bp, Homo sapiens
acgcaggcccctctcc

SEQ ID NO: 1834086 - DNA, 19 bp, Homo sapiens
acgcaggcccctctcctcc

SEQ ID NO: 1834087 - DNA, 21 bp, Homo sapiens
acgcaggcccctctcctccgt

SEQ ID NO: 1834088 - DNA, 22 bp, Homo sapiens
acgccagattctttcctgaggc

SEQ ID NO: 1834089 - DNA, 23 bp, Homo sapiens
acgccagattctttcctgaggct

SEQ ID NO: 1834090 - DNA, 17 bp, Homo sapiens
acgccatcccagcccca

SEQ ID NO: 1834091 - DNA, 14 bp, Homo sapiens
acgcccccactggt

SEQ ID NO: 1834092 - DNA, 13 bp, Homo sapiens
acgctacccggga

SEQ ID NO: 1834093 - DNA, 15 bp, Homo sapiens
acgctgtgctgccct

SEQ ID NO: 1834094 - DNA, 18 bp, Homo sapiens
acgctgtgctgccctgcc

SEQ ID NO: 1834095 - DNA, 22 bp, Homo sapiens
acgctgtgctgccctgcccacc

SEQ ID NO: 1834096 - DNA, 19 bp, Homo sapiens
acggctctgtccccagcct

SEQ ID NO: 1834097 - DNA, 14 bp, Homo sapiens
acggtaagtgttct

SEQ ID NO: 1834098 - DNA, 17 bp, Homo sapiens
acggttttactgcagct

SEQ ID NO: 1834099 - DNA, 13 bp, Homo sapiens
acgtctgtgccat

SEQ ID NO: 1834100 - DNA, 18 bp, Homo sapiens
acgtgactggcctgctgg

SEQ ID NO: 1834101 - DNA, 21 bp, Homo sapiens
acgttttataagcatcattat

SEQ ID NO: 1834102 - DNA, 15 bp, Homo sapiens
actacagagaaggct

SEQ ID NO: 1834103 - DNA, 17 bp, Homo sapiens
actactcccccaggtgg

SEQ ID NO: 1834104 - DNA, 17 bp, Homo sapiens
actacttgggagcaccg

SEQ ID NO: 1834105 - DNA, 22 bp, Homo sapiens
actaggaagtaaagtgaagaat

SEQ ID NO: 1834106 - DNA, 20 bp, Homo sapiens
actatatttttctcaatgtt

SEQ ID NO: 1834107 - DNA, 23 bp, Homo sapiens
actatatttttctcaatgtttag

SEQ ID NO: 1834108 - DNA, 23 bp, Homo sapiens
actatttgcttatttaataaaga

SEQ ID NO: 1834109 - DNA, 13 bp, Homo sapiens
actattttatatg

SEQ ID NO: 1834110 - DNA, 20 bp, Homo sapiens
actcaaaccaaatcactgaa

SEQ ID NO: 1834111 - DNA, 19 bp, Homo sapiens
actcaacccattgttgtca

SEQ ID NO: 1834112 - DNA, 16 bp, Homo sapiens
actcaccccagcccca

SEQ ID NO: 1834113 - DNA, 14 bp, Homo sapiens
actcacctggggct

SEQ ID NO: 1834114 - DNA, 20 bp, Homo sapiens
actcacctggggctgctggc

SEQ ID NO: 1834115 - DNA, 15 bp, Homo sapiens
actcagccttgcaaa

SEQ ID NO: 1834116 - DNA, 19 bp, Homo sapiens
actcagccttgcaaatagc

SEQ ID NO: 1834117 - DNA, 12 bp, Homo sapiens
actcagcctttt

SEQ ID NO: 1834118 - DNA, 22 bp, Homo sapiens
actcagccttttgggaataata

SEQ ID NO: 1834119 - DNA, 23 bp, Homo sapiens
actcatacactcgtatgatactt

SEQ ID NO: 1834120 - DNA, 14 bp, Homo sapiens
actcattgacctga

SEQ ID NO: 1834121 - DNA, 16 bp, Homo sapiens
actcattgacctgagg

SEQ ID NO: 1834122 - DNA, 17 bp, Homo sapiens
actccaattaaggattt

SEQ ID NO: 1834123 - DNA, 12 bp, Homo sapiens
actccagcctgg

SEQ ID NO: 1834124 - DNA, 13 bp, Homo sapiens
agactcctgcagg

SEQ ID NO: 1834125 - DNA, 16 bp, Homo sapiens
agactcctgcaggcag

SEQ ID NO: 1834126 - DNA, 17 bp, Homo sapiens
agactcctgcaggcagc

SEQ ID NO: 1834127 - DNA, 18 bp, Homo sapiens
agactcctgcaggcagcc

SEQ ID NO: 1834128 - DNA, 20 bp, Homo sapiens
agactcctgcaggcagccag

SEQ ID NO: 1834129 - DNA, 20 bp, Homo sapiens
agactccttgagagaccagg

SEQ ID NO: 1834130 - DNA, 16 bp, Homo sapiens
agactctttggacact

SEQ ID NO: 1834131 - DNA, 18 bp, Homo sapiens
agactgtgattcttagca

SEQ ID NO: 1834132 - DNA, 19 bp, Homo sapiens
agactgttcctgagccttc

SEQ ID NO: 1834133 - DNA, 23 bp, Homo sapiens
agacttaatagaaacattgaaga

SEQ ID NO: 1834134 - DNA, 20 bp, Homo sapiens
agacttgggatggggaggga

SEQ ID NO: 1834135 - DNA, 14 bp, Homo sapiens
agactttggaaaga

SEQ ID NO: 1834136 - DNA, 19 bp, Homo sapiens
agactttggaaagagtagg

SEQ ID NO: 1834137 - DNA, 15 bp, Homo sapiens
agacttttccaaccc

SEQ ID NO: 1834138 - DNA, 15 bp, Homo sapiens
agagaccatccctga

SEQ ID NO: 1834139 - DNA, 19 bp, Homo sapiens
agagaccatccctgaaggc

SEQ ID NO: 1834140 - DNA, 21 bp, Homo sapiens
agagaccatccctgaaggccc

SEQ ID NO: 1834141 - DNA, 11 bp, Homo sapiens
agagactcctg

SEQ ID NO: 1834142 - DNA, 13 bp, Homo sapiens
agagactcctgca

SEQ ID NO: 1834143 - DNA, 18 bp, Homo sapiens
agagactcctgcaggcag

SEQ ID NO: 1834144 - DNA, 21 bp, Homo sapiens
agagactcctgcaggcagcca

SEQ ID NO: 1834145 - DNA, 13 bp, Homo sapiens
agagagaaaaaca

SEQ ID NO: 1834146 - DNA, 11 bp, Homo sapiens
agagagcaaga

SEQ ID NO: 1834147 - DNA, 19 bp, Homo sapiens
agagagcaagacgctgtgc

SEQ ID NO: 1834148 - DNA, 22 bp, Homo sapiens
agagattggaatgggcagctca

SEQ ID NO: 1834149 - DNA, 21 bp, Homo sapiens
agagcaccttagacagtccct

SEQ ID NO: 1834150 - DNA, 22 bp, Homo sapiens
agagcaccttagacagtccctg

SEQ ID NO: 1834151 - DNA, 12 bp, Homo sapiens
agagcagagacc

SEQ ID NO: 1834152 - DNA, 22 bp, Homo sapiens
agagcagtttctgtcctgctgg

SEQ ID NO: 1834153 - DNA, 20 bp, Homo sapiens
agagccatgtagaagctgca

SEQ ID NO: 1834154 - DNA, 16 bp, Homo sapiens
agagcccacgccccca

SEQ ID NO: 1834155 - DNA, 17 bp, Homo sapiens
agagccttccaggggtg

SEQ ID NO: 1834156 - DNA, 18 bp, Homo sapiens
agagcgtgagctgagcag

SEQ ID NO: 1834157 - DNA, 20 bp, Homo sapiens
agagcgtgagctgagcaggc

SEQ ID NO: 1834158 - DNA, 20 bp, Homo sapiens
agagctgacacaaacctgcc

SEQ ID NO: 1834159 - DNA, 23 bp, Homo sapiens
agagctgacacaggatgaaggca

SEQ ID NO: 1834160 - DNA, 12 bp, Homo sapiens
agagctggagcc

SEQ ID NO: 1834161 - DNA, 13 bp, Homo sapiens
agagcttggactg

SEQ ID NO: 1834162 - DNA, 20 bp, Homo sapiens
agaggaaatattgctggggt

SEQ ID NO: 1834163 - DNA, 20 bp, Homo sapiens
agaggatgctgacatcattt

SEQ ID NO: 1834164 - DNA, 22 bp, Homo sapiens
agagggagggagggctccagac

SEQ ID NO: 1834165 - DNA, 16 bp, Homo sapiens
agagggcctgcaaggg

SEQ ID NO: 1834166 - DNA, 16 bp, Homo sapiens
agaggggacgcaggcc

SEQ ID NO: 1834167 - DNA, 14 bp, Homo sapiens
agaggtggatgtta

SEQ ID NO: 1834168 - DNA, 22 bp, Homo sapiens
agaggtggatgttatgaacagc

SEQ ID NO: 1834169 - DNA, 18 bp, Homo sapiens
agaggtggccccatatta

SEQ ID NO: 1834170 - DNA, 15 bp, Homo sapiens
agaggtttgcagtcc

SEQ ID NO: 1834171 - DNA, 23 bp, Homo sapiens
agagtattggtctcctctcagcc

SEQ ID NO: 1834172 - DNA, 15 bp, Homo sapiens
agataaacacaagat

SEQ ID NO: 1834173 - DNA, 20 bp, Homo sapiens
agataactgttatttataat

SEQ ID NO: 1834174 - DNA, 22 bp, Homo sapiens
agataatattaaggaagacaat

SEQ ID NO: 1834175 - DNA, 17 bp, Homo sapiens
agatgaaacacaaacaa

SEQ ID NO: 1834176 - DNA, 22 bp, Homo sapiens
agatgcattcttggttggctgg

SEQ ID NO: 1834177 - DNA, 18 bp, Homo sapiens
agatgcttctcactgcca

SEQ ID NO: 1834178 - DNA, 13 bp, Homo sapiens
agattcacactgt

SEQ ID NO: 1834179 - DNA, 18 bp, Homo sapiens
agattctatgttaatatt

SEQ ID NO: 1834180 - DNA, 15 bp, Homo sapiens
agattctttcctgag

SEQ ID NO: 1834181 - DNA, 18 bp, Homo sapiens
agattctttcctgaggct

SEQ ID NO: 1834182 - DNA, 16 bp, Homo sapiens
agattgcaccactgca

SEQ ID NO: 1834183 - DNA, 14 bp, Homo sapiens
agatttattaaaga

SEQ ID NO: 1834184 - DNA, 13 bp, Homo sapiens
agatttgggctgg

SEQ ID NO: 1834185 - DNA, 22 bp, Homo sapiens
agcaaatcatctgcattcctga

SEQ ID NO: 1834186 - DNA, 20 bp, Homo sapiens
agcaaatgtcttcctggatt

SEQ ID NO: 1834187 - DNA, 15 bp, Homo sapiens
agcaagctcccaagg

SEQ ID NO: 1834188 - DNA, 20 bp, Homo sapiens
agcaagctcccaagggatgg

SEQ ID NO: 1834189 - DNA, 14 bp, Homo sapiens
agcacaacataatt

SEQ ID NO: 1834190 - DNA, 19 bp, Homo sapiens
agcacaacataatttttat

SEQ ID NO: 1834191 - DNA, 14 bp, Homo sapiens
agcacacacttttg

SEQ ID NO: 1834192 - DNA, 12 bp, Homo sapiens
agcacagaccct

SEQ ID NO: 1834193 - DNA, 19 bp, Homo sapiens
agcacagaccctgccctgt

SEQ ID NO: 1834194 - DNA, 20 bp, Homo sapiens
agcacagaccctgccctgtg

SEQ ID NO: 1834195 - DNA, 21 bp, Homo sapiens
agcacagaccctgccctgtgg

SEQ ID NO: 1834196 - DNA, 15 bp, Homo sapiens
agcacatgatttggg

SEQ ID NO: 1834197 - DNA, 17 bp, Homo sapiens
agcaccaagctcaaagc

SEQ ID NO: 1834198 - DNA, 13 bp, Homo sapiens
agcaccacactgg

SEQ ID NO: 1834199 - DNA, 22 bp, Homo sapiens
agcaccaccaaacacagtgtat

SEQ ID NO: 1834200 - DNA, 16 bp, Homo sapiens
agcacccttctgctgt

SEQ ID NO: 1834201 - DNA, 22 bp, Homo sapiens
agcaccttagacagtccctgcc

SEQ ID NO: 1834202 - DNA, 20 bp, Homo sapiens
agcactaacctatgagggtg

SEQ ID NO: 1834203 - DNA, 15 bp, Homo sapiens
agcactgcctgctcc

SEQ ID NO: 1834204 - DNA, 19 bp, Homo sapiens
agcactgtgctcagggcta

SEQ ID NO: 1834205 - DNA, 18 bp, Homo sapiens
agcactttaacacagtgt

SEQ ID NO: 1834206 - DNA, 23 bp, Homo sapiens
agcactttgggaggccaaggtgg

SEQ ID NO: 1834207 - DNA, 19 bp, Homo sapiens
agcagaacctgcacacagg

SEQ ID NO: 1834208 - DNA, 20 bp, Homo sapiens
agcagaacctgcacacagga

SEQ ID NO: 1834209 - DNA, 15 bp, Homo sapiens
agcagagaccatccc

SEQ ID NO: 1834210 - DNA, 20 bp, Homo sapiens
agcagagcaccttagacagt

SEQ ID NO: 1834211 - DNA, 20 bp, Homo sapiens
agcagccaagggatgaaaga

SEQ ID NO: 1834212 - DNA, 21 bp, Homo sapiens
agcagccacattcctgatgct

SEQ ID NO: 1834213 - DNA, 20 bp, Homo sapiens
agcagcctcagaacaaagtg

SEQ ID NO: 1834214 - DNA, 21 bp, Homo sapiens
agcagctgccaggagcacggc

SEQ ID NO: 1834215 - DNA, 13 bp, Homo sapiens
agcaggccacact

SEQ ID NO: 1834216 - DNA, 24 bp, Homo sapiens
agcaggccacacttcaaactactt

SEQ ID NO: 1834217 - DNA, 16 bp, Homo sapiens
agcagggtctgggcag

SEQ ID NO: 1834218 - DNA, 18 bp, Homo sapiens
agcagtccccttccctcc

SEQ ID NO: 1834219 - DNA, 13 bp, Homo sapiens
agcagtgcaggca

SEQ ID NO: 1834220 - DNA, 18 bp, Homo sapiens
agcagtttctgtcctgct

SEQ ID NO: 1834221 - DNA, 14 bp, Homo sapiens
agcatattcaggaa

SEQ ID NO: 1834222 - DNA, 19 bp, Homo sapiens
agcatattcaggaagctca

SEQ ID NO: 1834223 - DNA, 21 bp, Homo sapiens
agcatattcaggaagctcagg

SEQ ID NO: 1834224 - DNA, 20 bp, Homo sapiens
agcatcaggccaggccctct

SEQ ID NO: 1834225 - DNA, 21 bp, Homo sapiens
agcatcaggccaggccctctg

SEQ ID NO: 1834226 - DNA, 22 bp, Homo sapiens
agcatcaggccaggccctctgc

SEQ ID NO: 1834227 - DNA, 19 bp, Homo sapiens
agcatcattatttatgtat

SEQ ID NO: 1834228 - DNA, 21 bp, Homo sapiens
agcatcccttgaccaggcctg

SEQ ID NO: 1834229 - DNA, 23 bp, Homo sapiens
agcatcccttgaccaggcctggg

SEQ ID NO: 1834230 - DNA, 20 bp, Homo sapiens
agcatgcctggatggggctg

SEQ ID NO: 1834231 - DNA, 13 bp, Homo sapiens
agcatgtttagac

SEQ ID NO: 1834232 - DNA, 24 bp, Homo sapiens
agcatgtttagactttaacataag

SEQ ID NO: 1834233 - DNA, 15 bp, Homo sapiens
agcattgtagtgctt

SEQ ID NO: 1834234 - DNA, 20 bp, Homo sapiens
agcattgtagtgctttgaga

SEQ ID NO: 1834235 - DNA, 13 bp, Homo sapiens
agcattttataaa

SEQ ID NO: 1834236 - DNA, 20 bp, Homo sapiens
agcattttataaatcgcttt

SEQ ID NO: 1834237 - DNA, 22 bp, Homo sapiens
agcattttgctaaatgtgaatg

SEQ ID NO: 1834238 - DNA, 20 bp, Homo sapiens
agccaatatcccttacttta

SEQ ID NO: 1834239 - DNA, 12 bp, Homo sapiens
agccaggccaca

SEQ ID NO: 1834240 - DNA, 23 bp, Homo sapiens
agcccacccctcaacacctctgc

SEQ ID NO: 1834241 - DNA, 19 bp, Homo sapiens
agcccacgcccccactggt

SEQ ID NO: 1834242 - DNA, 20 bp, Homo sapiens
agcccacgcccccactggtg

SEQ ID NO: 1834243 - DNA, 14 bp, Homo sapiens
agcccagccccgcc

SEQ ID NO: 1834244 - DNA, 14 bp, Homo sapiens
agcccaggaaaggc

SEQ ID NO: 1834245 - DNA, 18 bp, Homo sapiens
agcccaggaaaggctcca

SEQ ID NO: 1834246 - DNA, 19 bp, Homo sapiens
agcccaggaaaggctccag

SEQ ID NO: 1834247 - DNA, 16 bp, Homo sapiens
agccccaaaactctcc

SEQ ID NO: 1834248 - DNA, 17 bp, Homo sapiens
agccccaaaactctcct

SEQ ID NO: 1834249 - DNA, 21 bp, Homo sapiens
agccccaaaactctcctctgc

SEQ ID NO: 1834250 - DNA, 11 bp, Homo sapiens
agccccatcct

SEQ ID NO: 1834251 - DNA, 20 bp, Homo sapiens
agcccctgatcctgtgaagt

SEQ ID NO: 1834252 - DNA, 17 bp, Homo sapiens
agcccctggatgcagcc

SEQ ID NO: 1834253 - DNA, 19 bp, Homo sapiens
agccccttctgacccatgc

SEQ ID NO: 1834254 - DNA, 15 bp, Homo sapiens
agcccgggctctgcc

SEQ ID NO: 1834255 - DNA, 15 bp, Homo sapiens
agccctggctgaagg

SEQ ID NO: 1834256 - DNA, 16 bp, Homo sapiens
agccctggctgaagga

SEQ ID NO: 1834257 - DNA, 18 bp, Homo sapiens
agccctggctgaaggact

SEQ ID NO: 1834258 - DNA, 19 bp, Homo sapiens
agccgagattgcaccactg

SEQ ID NO: 1834259 - DNA, 13 bp, Homo sapiens
agccgctggggcc

SEQ ID NO: 1834260 - DNA, 22 bp, Homo sapiens
agccgctggggccagttggtcc

SEQ ID NO: 1834261 - DNA, 19 bp, Homo sapiens
agccgtttgttccccaaga

SEQ ID NO: 1834262 - DNA, 23 bp, Homo sapiens
agcctctgaaaaccaatgttctc

SEQ ID NO: 1834263 - DNA, 12 bp, Homo sapiens
agcctgccctcc

SEQ ID NO: 1834264 - DNA, 15 bp, Homo sapiens
agcctgctccagctg

SEQ ID NO: 1834265 - DNA, 14 bp, Homo sapiens
agcctggaccctgt

SEQ ID NO: 1834266 - DNA, 13 bp, Homo sapiens
agcctggctccaa

SEQ ID NO: 1834267 - DNA, 17 bp, Homo sapiens
agcctgggaaagcccct

SEQ ID NO: 1834268 - DNA, 20 bp, Homo sapiens
agcctgggaggtcaaggctg

SEQ ID NO: 1834269 - DNA, 11 bp, Homo sapiens
agccttccagg

SEQ ID NO: 1834270 - DNA, 14 bp, Homo sapiens
agcggtgtctctcc

SEQ ID NO: 1834271 - DNA, 15 bp, Homo sapiens
agcgtggacaggtgt

SEQ ID NO: 1834272 - DNA, 16 bp, Homo sapiens
agctaacacacagctc

SEQ ID NO: 1834273 - DNA, 15 bp, Homo sapiens
agctatcctggctct

SEQ ID NO: 1834274 - DNA, 14 bp, Homo sapiens
agctatttttctaa

SEQ ID NO: 1834275 - DNA, 14 bp, Homo sapiens
agctcaatgagcat

SEQ ID NO: 1834276 - DNA, 16 bp, Homo sapiens
agctcagagagggcag

SEQ ID NO: 1834277 - DNA, 17 bp, Homo sapiens
agctcagagagggcagg

SEQ ID NO: 1834278 - DNA, 21 bp, Homo sapiens
agctcagagagggcaggcatg

SEQ ID NO: 1834279 - DNA, 20 bp, Homo sapiens
agctcagcactgcctgctcc

SEQ ID NO: 1834280 - DNA, 14 bp, Homo sapiens
agctcaggaccagg

SEQ ID NO: 1834281 - DNA, 18 bp, Homo sapiens
agctcaggaccaggcaat

SEQ ID NO: 1834282 - DNA, 13 bp, Homo sapiens
agctcagggcctg

SEQ ID NO: 1834283 - DNA, 17 bp, Homo sapiens
agctcagggcctggctc

SEQ ID NO: 1834284 - DNA, 19 bp, Homo sapiens
agctcagggcctggctcag

SEQ ID NO: 1834285 - DNA, 15 bp, Homo sapiens
agctcatttcacttt

SEQ ID NO: 1834286 - DNA, 18 bp, Homo sapiens
agctcccaagggatggtg

SEQ ID NO: 1834287 - DNA, 20 bp, Homo sapiens
agctccccgcttctgcctgc

SEQ ID NO: 1834288 - DNA, 21 bp, Homo sapiens
agctccccgcttctgcctgca

SEQ ID NO: 1834289 - DNA, 18 bp, Homo sapiens
agctcctcatccagggct

SEQ ID NO: 1834290 - DNA, 16 bp, Homo sapiens
agctctctcctccctt

SEQ ID NO: 1834291 - DNA, 11 bp, Homo sapiens
agctctctgac

SEQ ID NO: 1834292 - DNA, 13 bp, Homo sapiens
agctctctgacgc

SEQ ID NO: 1834293 - DNA, 13 bp, Homo sapiens
agctcttgctttg

SEQ ID NO: 1834294 - DNA, 12 bp, Homo sapiens
agctgaagaaaa

SEQ ID NO: 1834295 - DNA, 20 bp, Homo sapiens
agctgaatgtttttctaaag

SEQ ID NO: 1834296 - DNA, 22 bp, Homo sapiens
agctgacacaaacctgcctggg

SEQ ID NO: 1834297 - DNA, 20 bp, Homo sapiens
agctgagatgaaccctggca

SEQ ID NO: 1834298 - DNA, 21 bp, Homo sapiens
agctgatacaaattgcagact

SEQ ID NO: 1834299 - DNA, 19 bp, Homo sapiens
agctgcaccctcaggcagg

SEQ ID NO: 1834300 - DNA, 20 bp, Homo sapiens
agctgcaccctcaggcaggt

SEQ ID NO: 1834301 - DNA, 23 bp, Homo sapiens
agctgccaggagcacggctctgt

SEQ ID NO: 1834302 - DNA, 17 bp, Homo sapiens
agctgccgcaccagccc

SEQ ID NO: 1834303 - DNA, 22 bp, Homo sapiens
agctgccgcaccagcccgaaca

SEQ ID NO: 1834304 - DNA, 21 bp, Homo sapiens
agctggatagacttgggatgg

SEQ ID NO: 1834305 - DNA, 17 bp, Homo sapiens
agctggccgtgggcctg

SEQ ID NO: 1834306 - DNA, 19 bp, Homo sapiens
agctggccgtgggcctggg

SEQ ID NO: 1834307 - DNA, 22 bp, Homo sapiens
agctggcggctggggtcccagc

SEQ ID NO: 1834308 - DNA, 20 bp, Homo sapiens
agctgggagaccctccccac

SEQ ID NO: 1834309 - DNA, 21 bp, Homo sapiens
agctgggagaccctccccaca

SEQ ID NO: 1834310 - DNA, 14 bp, Homo sapiens
agctgtgtctgcca

SEQ ID NO: 1834311 - DNA, 21 bp, Homo sapiens
agctgtgtctgccaaacacat

SEQ ID NO: 1834312 - DNA, 13 bp, Homo sapiens
agctgttcagctg

SEQ ID NO: 1834313 - DNA, 21 bp, Homo sapiens
agcttaaaataaagttaaact

SEQ ID NO: 1834314 - DNA, 19 bp, Homo sapiens
agcttgaaatagtgtctga

SEQ ID NO: 1834315 - DNA, 17 bp, Homo sapiens
agcttgctcacatcttg

SEQ ID NO: 1834316 - DNA, 20 bp, Homo sapiens
agcttgctccagattctgat

SEQ ID NO: 1834317 - DNA, 22 bp, Homo sapiens
agcttgctccagattctgatgc

SEQ ID NO: 1834318 - DNA, 20 bp, Homo sapiens
agctttctgggatgtcacag

SEQ ID NO: 1834319 - DNA, 22 bp, Homo sapiens
agctttgtttgttgtcagctga

SEQ ID NO: 1834320 - DNA, 23 bp, Homo sapiens
agctttgtttgttgtcagctgaa

SEQ ID NO: 1834321 - DNA, 20 bp, Homo sapiens
aggaaaccacagctgctgga

SEQ ID NO: 1834322 - DNA, 15 bp, Homo sapiens
aggaaacccagctct

SEQ ID NO: 1834323 - DNA, 16 bp, Homo sapiens
aggaaacccagctctg

SEQ ID NO: 1834324 - DNA, 18 bp, Homo sapiens
aggaaacccagctctggt

SEQ ID NO: 1834325 - DNA, 19 bp, Homo sapiens
aggaaactgggttcctgca

SEQ ID NO: 1834326 - DNA, 14 bp, Homo sapiens
aggaaaggctccag

SEQ ID NO: 1834327 - DNA, 23 bp, Homo sapiens
aggaaaggctccaggagcagcca

SEQ ID NO: 1834328 - DNA, 14 bp, Homo sapiens
aggaagactttgga

SEQ ID NO: 1834329 - DNA, 15 bp, Homo sapiens
aggaagactttggaa

SEQ ID NO: 1834330 - DNA, 19 bp, Homo sapiens
aggaagagcccgcagggcc

SEQ ID NO: 1834331 - DNA, 14 bp, Homo sapiens
aggaagctcagggc

SEQ ID NO: 1834332 - DNA, 20 bp, Homo sapiens
aggaaggctcttctccccag

SEQ ID NO: 1834333 - DNA, 21 bp, Homo sapiens
aggaaggctcttctccccaga

SEQ ID NO: 1834334 - DNA, 16 bp, Homo sapiens
aggaaggttctggtgt

SEQ ID NO: 1834335 - DNA, 14 bp, Homo sapiens
aggaagtgaagaat

SEQ ID NO: 1834336 - DNA, 23 bp, Homo sapiens
aggaataatgggcttagagcagt

SEQ ID NO: 1834337 - DNA, 15 bp, Homo sapiens
aggaatacctgtccc

SEQ ID NO: 1834338 - DNA, 18 bp, Homo sapiens
aggaatacctgtccccct

SEQ ID NO: 1834339 - DNA, 22 bp, Homo sapiens
aggaatcagcaagaagatccta

SEQ ID NO: 1834340 - DNA, 23 bp, Homo sapiens
aggaatcatctcctttgcagaat

SEQ ID NO: 1834341 - DNA, 17 bp, Homo sapiens
aggaatccactcccagg

SEQ ID NO: 1834342 - DNA, 21 bp, Homo sapiens
aggaatccactcccaggcagc

SEQ ID NO: 1834343 - DNA, 23 bp, Homo sapiens
aggacacgggcctgtccacaggc

SEQ ID NO: 1834344 - DNA, 13 bp, Homo sapiens
aggacctcaggtg

SEQ ID NO: 1834345 - DNA, 20 bp, Homo sapiens
aggacctcaggtgagaagca

SEQ ID NO: 1834346 - DNA, 22 bp, Homo sapiens
aggactagagcacaacataatt

SEQ ID NO: 1834347 - DNA, 17 bp, Homo sapiens
aggactcagctccccag

SEQ ID NO: 1834348 - DNA, 20 bp, Homo sapiens
aggactcagctccccagagt

SEQ ID NO: 1834349 - DNA, 14 bp, Homo sapiens
aggactcctgaaaa

SEQ ID NO: 1834350 - DNA, 16 bp, Homo sapiens
aggactgcagtgtgga

SEQ ID NO: 1834351 - DNA, 16 bp, Homo sapiens
aggactgtgacaggca

SEQ ID NO: 1834352 - DNA, 18 bp, Homo sapiens
aggactgtgacaggcagc

SEQ ID NO: 1834353 - DNA, 20 bp, Homo sapiens
aggactgtgacaggcagcag

SEQ ID NO: 1834354 - DNA, 23 bp, Homo sapiens
aggacttgggcgggacacaggct

SEQ ID NO: 1834355 - DNA, 17 bp, Homo sapiens
aggagataagaaagcag

SEQ ID NO: 1834356 - DNA, 22 bp, Homo sapiens
aggagatccagggcaaggccat

SEQ ID NO: 1834357 - DNA, 15 bp, Homo sapiens
aggagcaaaggctga

SEQ ID NO: 1834358 - DNA, 14 bp, Homo sapiens
aggagcagccacat

SEQ ID NO: 1834359 - DNA, 14 bp, Homo sapiens
aggaggtggagaaa

SEQ ID NO: 1834360 - DNA, 23 bp, Homo sapiens
aggagtttatgttccattaaacg

SEQ ID NO: 1834361 - DNA, 19 bp, Homo sapiens
aggatccctctctggattg

SEQ ID NO: 1834362 - DNA, 17 bp, Homo sapiens
aggatctcttgagcctg

SEQ ID NO: 1834363 - DNA, 13 bp, Homo sapiens
aggatctgctgag

SEQ ID NO: 1834364 - DNA, 15 bp, Homo sapiens
aggatctgctgaggc

SEQ ID NO: 1834365 - DNA, 21 bp, Homo sapiens
aggatctgctgaggcccagtg

SEQ ID NO: 1834366 - DNA, 20 bp, Homo sapiens
aggatgatctaggaagactt

SEQ ID NO: 1834367 - DNA, 22 bp, Homo sapiens
aggatgatctaggaagactttg

SEQ ID NO: 1834368 - DNA, 23 bp, Homo sapiens
aggatgatctaggaagactttgg

SEQ ID NO: 1834369 - DNA, 13 bp, Homo sapiens
aggatggcctggc

SEQ ID NO: 1834370 - DNA, 16 bp, Homo sapiens
aggattttatgcttta

SEQ ID NO: 1834371 - DNA, 20 bp, Homo sapiens
actcctaggcaggacatgct

SEQ ID NO: 1834372 - DNA, 21 bp, Homo sapiens
actcctaggcaggacatgctg

SEQ ID NO: 1834373 - DNA, 15 bp, Homo sapiens
actcctgcaggcagc

SEQ ID NO: 1834374 - DNA, 17 bp, Homo sapiens
actcctgcaggcagcca

SEQ ID NO: 1834375 - DNA, 23 bp, Homo sapiens
actccttgaaaacactgttctct

SEQ ID NO: 1834376 - DNA, 24 bp, Homo sapiens
actccttgaaaacactgttctctg

SEQ ID NO: 1834377 - DNA, 23 bp, Homo sapiens
actccttgagagaccaggcaaag

SEQ ID NO: 1834378 - DNA, 16 bp, Homo sapiens
actcgtgtgcaacaga

SEQ ID NO: 1834379 - DNA, 18 bp, Homo sapiens
actctaccctcttagaaa

SEQ ID NO: 1834380 - DNA, 16 bp, Homo sapiens
actctcctctgctgct

SEQ ID NO: 1834381 - DNA, 18 bp, Homo sapiens
actctcctctgctgctgg

SEQ ID NO: 1834382 - DNA, 21 bp, Homo sapiens
actctcctctgctgctggctg

SEQ ID NO: 1834383 - DNA, 18 bp, Homo sapiens
actctgacaacagacttc

SEQ ID NO: 1834384 - DNA, 20 bp, Homo sapiens
actctggcagctcagagagg

SEQ ID NO: 1834385 - DNA, 14 bp, Homo sapiens
actctttggtcgtt

SEQ ID NO: 1834386 - DNA, 16 bp, Homo sapiens
actgaactttgctgag

SEQ ID NO: 1834387 - DNA, 19 bp, Homo sapiens
actgaactttgctgagcct

SEQ ID NO: 1834388 - DNA, 15 bp, Homo sapiens
actgagacagcccgg

SEQ ID NO: 1834389 - DNA, 18 bp, Homo sapiens
actgagacagcccgggct

SEQ ID NO: 1834390 - DNA, 23 bp, Homo sapiens
actgagacagcccgggctctgcc

SEQ ID NO: 1834391 - DNA, 17 bp, Homo sapiens
actgcactccagcctgg

SEQ ID NO: 1834392 - DNA, 14 bp, Homo sapiens
actgccatgccagc

SEQ ID NO: 1834393 - DNA, 15 bp, Homo sapiens
actgcccggcagggt

SEQ ID NO: 1834394 - DNA, 17 bp, Homo sapiens
actgcctgatggacctg

SEQ ID NO: 1834395 - DNA, 18 bp, Homo sapiens
actggaaggtggggacag

SEQ ID NO: 1834396 - DNA, 22 bp, Homo sapiens
actggagcttgaaatagtgtct

SEQ ID NO: 1834397 - DNA, 16 bp, Homo sapiens
actggcctctgctgat

SEQ ID NO: 1834398 - DNA, 19 bp, Homo sapiens
actggcttaacttagtata

SEQ ID NO: 1834399 - DNA, 16 bp, Homo sapiens
actgggtgcgtctcca

SEQ ID NO: 1834400 - DNA, 14 bp, Homo sapiens
actgggttcctgca

SEQ ID NO: 1834401 - DNA, 18 bp, Homo sapiens
actggtattcctgcctcc

SEQ ID NO: 1834402 - DNA, 15 bp, Homo sapiens
actgtatctgtgtag

SEQ ID NO: 1834403 - DNA, 16 bp, Homo sapiens
actgtcctattatatt

SEQ ID NO: 1834404 - DNA, 14 bp, Homo sapiens
actgtgacaggcag

SEQ ID NO: 1834405 - DNA, 17 bp, Homo sapiens
actgtgacaggcagcag

SEQ ID NO: 1834406 - DNA, 22 bp, Homo sapiens
actgtgctgagtctgaaggctg

SEQ ID NO: 1834407 - DNA, 17 bp, Homo sapiens
actgttatttataatca

SEQ ID NO: 1834408 - DNA, 18 bp, Homo sapiens
actgttcctgagccttca

SEQ ID NO: 1834409 - DNA, 15 bp, Homo sapiens
actgttctctgccct

SEQ ID NO: 1834410 - DNA, 20 bp, Homo sapiens
actgttcttagctcaatgag

SEQ ID NO: 1834411 - DNA, 21 bp, Homo sapiens
actgttcttagctcaatgagc

SEQ ID NO: 1834412 - DNA, 21 bp, Homo sapiens
acttcgacactgttcttagct

SEQ ID NO: 1834413 - DNA, 23 bp, Homo sapiens
acttcgacactgttcttagctca

SEQ ID NO: 1834414 - DNA, 20 bp, Homo sapiens
acttcgggaggtcgaggcag

SEQ ID NO: 1834415 - DNA, 16 bp, Homo sapiens
acttcttcagagctga

SEQ ID NO: 1834416 - DNA, 18 bp, Homo sapiens
acttctttgctttgccca

SEQ ID NO: 1834417 - DNA, 19 bp, Homo sapiens
acttgagaattaccctttt

SEQ ID NO: 1834418 - DNA, 23 bp, Homo sapiens
acttgcaaaaagggtcagtatgg

SEQ ID NO: 1834419 - DNA, 15 bp, Homo sapiens
acttggattcaattt

SEQ ID NO: 1834420 - DNA, 18 bp, Homo sapiens
acttggcatcagctggcg

SEQ ID NO: 1834421 - DNA, 14 bp, Homo sapiens
acttgtaaatataa

SEQ ID NO: 1834422 - DNA, 17 bp, Homo sapiens
acttgtaaatataaaga

SEQ ID NO: 1834423 - DNA, 16 bp, Homo sapiens
acttgttttctgggaa

SEQ ID NO: 1834424 - DNA, 18 bp, Homo sapiens
actttaacacagtgtctg

SEQ ID NO: 1834425 - DNA, 14 bp, Homo sapiens
actttaacataagc

SEQ ID NO: 1834426 - DNA, 16 bp, Homo sapiens
actttaacataagcta

SEQ ID NO: 1834427 - DNA, 19 bp, Homo sapiens
actttaacataagctattt

SEQ ID NO: 1834428 - DNA, 14 bp, Homo sapiens
actttggaaagact

SEQ ID NO: 1834429 - DNA, 14 bp, Homo sapiens
actttggaaagagt

SEQ ID NO: 1834430 - DNA, 22 bp, Homo sapiens
acttttggttaagtctgtttta

SEQ ID NO: 1834431 - DNA, 16 bp, Homo sapiens
agaaaaaaatgtattt

SEQ ID NO: 1834432 - DNA, 18 bp, Homo sapiens
agaaaaaaatgtatttta

SEQ ID NO: 1834433 - DNA, 17 bp, Homo sapiens
agaaaaaatattttcct

SEQ ID NO: 1834434 - DNA, 13 bp, Homo sapiens
agaaaaataaaga

SEQ ID NO: 1834435 - DNA, 20 bp, Homo sapiens
agaaaaataaagaaaagatg

SEQ ID NO: 1834436 - DNA, 18 bp, Homo sapiens
agaaaaatgagcctggca

SEQ ID NO: 1834437 - DNA, 16 bp, Homo sapiens
agaaaaccagctcagc

SEQ ID NO: 1834438 - DNA, 21 bp, Homo sapiens
agaaaaccagctcagcactgc

SEQ ID NO: 1834439 - DNA, 15 bp, Homo sapiens
agaaacacccctctg

SEQ ID NO: 1834440 - DNA, 22 bp, Homo sapiens
agaaactttattcaagtaaaaa

SEQ ID NO: 1834441 - DNA, 21 bp, Homo sapiens
agaaagttgcacggctgctga

SEQ ID NO: 1834442 - DNA, 20 bp, Homo sapiens
agaaatagcttatgaaaaga

SEQ ID NO: 1834443 - DNA, 16 bp, Homo sapiens
agaaatctttctccct

SEQ ID NO: 1834444 - DNA, 18 bp, Homo sapiens
agaaatggcgtctgctct

SEQ ID NO: 1834445 - DNA, 17 bp, Homo sapiens
agaaattaagtatctga

SEQ ID NO: 1834446 - DNA, 14 bp, Homo sapiens
agaacactgtgaaa

SEQ ID NO: 1834447 - DNA, 17 bp, Homo sapiens
agaacactgtgaaaaca

SEQ ID NO: 1834448 - DNA, 20 bp, Homo sapiens
agaacctgcacacaggacag

SEQ ID NO: 1834449 - DNA, 17 bp, Homo sapiens
agaactaaaatgttcta

SEQ ID NO: 1834450 - DNA, 16 bp, Homo sapiens
agaagcagaggaagga

SEQ ID NO: 1834451 - DNA, 16 bp, Homo sapiens
agaagcccaggaaagg

SEQ ID NO: 1834452 - DNA, 23 bp, Homo sapiens
agaagcccaggaaaggctccagg

SEQ ID NO: 1834453 - DNA, 13 bp, Homo sapiens
agaaggactgcag

SEQ ID NO: 1834454 - DNA, 14 bp, Homo sapiens
agaagtaacttact

SEQ ID NO: 1834455 - DNA, 18 bp, Homo sapiens
agaagtcttctatttatt

SEQ ID NO: 1834456 - DNA, 18 bp, Homo sapiens
agaagttgatatagaaca

SEQ ID NO: 1834457 - DNA, 14 bp, Homo sapiens
agaatatttttccc

SEQ ID NO: 1834458 - DNA, 19 bp, Homo sapiens
agaatctgtttcccagcag

SEQ ID NO: 1834459 - DNA, 20 bp, Homo sapiens
agaattataattagttcctc

SEQ ID NO: 1834460 - DNA, 21 bp, Homo sapiens
agaattccagtcccctttctc

SEQ ID NO: 1834461 - DNA, 21 bp, Homo sapiens
agaattggctgaactcatgag

SEQ ID NO: 1834462 - DNA, 22 bp, Homo sapiens
agaattggctgaactcatgaga

SEQ ID NO: 1834463 - DNA, 16 bp, Homo sapiens
agacaaatcaaagcag

SEQ ID NO: 1834464 - DNA, 16 bp, Homo sapiens
agacaacgtgctcttt

SEQ ID NO: 1834465 - DNA, 23 bp, Homo sapiens
agacaacgtgctctttgttttgt

SEQ ID NO: 1834466 - DNA, 19 bp, Homo sapiens
agacacaacaactcctagg

SEQ ID NO: 1834467 - DNA, 21 bp, Homo sapiens
agacacatgtccaagaagccc

SEQ ID NO: 1834468 - DNA, 21 bp, Homo sapiens
agacagagacctcctgcctcc

SEQ ID NO: 1834469 - DNA, 14 bp, Homo sapiens
agacagcccgggct

SEQ ID NO: 1834470 - DNA, 13 bp, Homo sapiens
agacagctgcctg

SEQ ID NO: 1834471 - DNA, 15 bp, Homo sapiens
agacagtccagcctg

SEQ ID NO: 1834472 - DNA, 17 bp, Homo sapiens
agacagtccagcctgga

SEQ ID NO: 1834473 - DNA, 12 bp, Homo sapiens
agacagtccctg

SEQ ID NO: 1834474 - DNA, 14 bp, Homo sapiens
agacagtccctgcc

SEQ ID NO: 1834475 - DNA, 15 bp, Homo sapiens
agacagtccctgcca

SEQ ID NO: 1834476 - DNA, 18 bp, Homo sapiens
agacagttaaactggctt

SEQ ID NO: 1834477 - DNA, 20 bp, Homo sapiens
agacatgagtgcgtgctcag

SEQ ID NO: 1834478 - DNA, 14 bp, Homo sapiens
agaccatccctgaa

SEQ ID NO: 1834479 - DNA, 23 bp, Homo sapiens
agaccatccctgaaggccccgcc

SEQ ID NO: 1834480 - DNA, 12 bp, Homo sapiens
agaccctgccct

SEQ ID NO: 1834481 - DNA, 14 bp, Homo sapiens
agaccctgccctgt

SEQ ID NO: 1834482 - DNA, 13 bp, Homo sapiens
agacccttgtggt

SEQ ID NO: 1834483 - DNA, 15 bp, Homo sapiens
agacccttgtggtcc

SEQ ID NO: 1834484 - DNA, 20 bp, Homo sapiens
agacccttgtggtcccaccc

SEQ ID NO: 1834485 - DNA, 13 bp, Homo sapiens
agacctcatgccc

SEQ ID NO: 1834486 - DNA, 18 bp, Homo sapiens
agacctctgtgcacttat

SEQ ID NO: 1834487 - DNA, 11 bp, Homo sapiens
agaccttctcc

SEQ ID NO: 1834488 - DNA, 15 bp, Homo sapiens
agaccttctccttca

SEQ ID NO: 1834489 - DNA, 18 bp, Homo sapiens
agaccttctccttcacct

SEQ ID NO: 1834490 - DNA, 21 bp, Homo sapiens
agaccttctccttcacctttg

SEQ ID NO: 1834491 - DNA, 21 bp, Homo sapiens
agacgacaaggaaaggcaaat

SEQ ID NO: 1834492 - DNA, 16 bp, Homo sapiens
agacgatgtcttcata

SEQ ID NO: 1834493 - DNA, 17 bp, Homo sapiens
agacgctgtgctgccct

SEQ ID NO: 1834494 - DNA, 14 bp, Homo sapiens
agactatttgctta

SEQ ID NO: 1834495 - DNA, 21 bp, Homo sapiens
ccccaaatggaaatgggcaga

SEQ ID NO: 1834496 - DNA, 15 bp, Homo sapiens
ccccaccgcagacag

SEQ ID NO: 1834497 - DNA, 17 bp, Homo sapiens
ccccagaggctgggtga

SEQ ID NO: 1834498 - DNA, 12 bp, Homo sapiens
ccccaggaggcc

SEQ ID NO: 1834499 - DNA, 21 bp, Homo sapiens
ccccaggaggccagccttgac

SEQ ID NO: 1834500 - DNA, 17 bp, Homo sapiens
ccccatcctctgtacag

SEQ ID NO: 1834501 - DNA, 24 bp, Homo sapiens
cccccacccaagggcctggcctga

SEQ ID NO: 1834502 - DNA, 13 bp, Homo sapiens
cccccactggtga

SEQ ID NO: 1834503 - DNA, 17 bp, Homo sapiens
ccccctgacaacactca

SEQ ID NO: 1834504 - DNA, 14 bp, Homo sapiens
cccccttccatgga

SEQ ID NO: 1834505 - DNA, 13 bp, Homo sapiens
ccccggccacctg

SEQ ID NO: 1834506 - DNA, 21 bp, Homo sapiens
ccccgtctctggttcctcccc

SEQ ID NO: 1834507 - DNA, 22 bp, Homo sapiens
cccctcagggtccctggtggca

SEQ ID NO: 1834508 - DNA, 11 bp, Homo sapiens
cccctctcaga

SEQ ID NO: 1834509 - DNA, 22 bp, Homo sapiens
cccctctcagaacatactgatt

SEQ ID NO: 1834510 - DNA, 11 bp, Homo sapiens
cccctctcctc

SEQ ID NO: 1834511 - DNA, 15 bp, Homo sapiens
cccctgacaacactc

SEQ ID NO: 1834512 - DNA, 19 bp, Homo sapiens
cccctggatgcagcctcac

SEQ ID NO: 1834513 - DNA, 13 bp, Homo sapiens
ccccttccatgga

SEQ ID NO: 1834514 - DNA, 13 bp, Homo sapiens
ccccttctgaccc

SEQ ID NO: 1834515 - DNA, 14 bp, Homo sapiens
ccccttctgaccca

SEQ ID NO: 1834516 - DNA, 16 bp, Homo sapiens
ccccttctgacccatg

SEQ ID NO: 1834517 - DNA, 20 bp, Homo sapiens
ccccttgaggattgtggaaa

SEQ ID NO: 1834518 - DNA, 20 bp, Homo sapiens
cccgaatacaaacacctgga

SEQ ID NO: 1834519 - DNA, 13 bp, Homo sapiens
cccgagcctggct

SEQ ID NO: 1834520 - DNA, 23 bp, Homo sapiens
cccgctaagagggagggagggct

SEQ ID NO: 1834521 - DNA, 16 bp, Homo sapiens
cccgctgatggagccc

SEQ ID NO: 1834522 - DNA, 22 bp, Homo sapiens
cccgctgatggagccccacctt

SEQ ID NO: 1834523 - DNA, 13 bp, Homo sapiens
cccggccacctgc

SEQ ID NO: 1834524 - DNA, 14 bp, Homo sapiens
cccggccacctgcg

SEQ ID NO: 1834525 - DNA, 17 bp, Homo sapiens
cccggccacctgcggtg

SEQ ID NO: 1834526 - DNA, 18 bp, Homo sapiens
cccgggaagggggctggg

SEQ ID NO: 1834527 - DNA, 22 bp, Homo sapiens
cccgtctctggttcctcccctc

SEQ ID NO: 1834528 - DNA, 20 bp, Homo sapiens
ccctacagttgaaaaacagc

SEQ ID NO: 1834529 - DNA, 20 bp, Homo sapiens
ccctattttttttctgttat

SEQ ID NO: 1834530 - DNA, 14 bp, Homo sapiens
ccctcacactggga

SEQ ID NO: 1834531 - DNA, 18 bp, Homo sapiens
ccctcacagtattgctca

SEQ ID NO: 1834532 - DNA, 23 bp, Homo sapiens
ccctcagcctctcccctgcctgc

SEQ ID NO: 1834533 - DNA, 17 bp, Homo sapiens
ccctcagggtccctggt

SEQ ID NO: 1834534 - DNA, 19 bp, Homo sapiens
ccctcagggtccctggtgg

SEQ ID NO: 1834535 - DNA, 19 bp, Homo sapiens
ccctcatcaaggacacggg

SEQ ID NO: 1834536 - DNA, 12 bp, Homo sapiens
ccctcatgctgt

SEQ ID NO: 1834537 - DNA, 12 bp, Homo sapiens
ccctcccacagc

SEQ ID NO: 1834538 - DNA, 18 bp, Homo sapiens
cctcttgtagtcttggct

SEQ ID NO: 1834539 - DNA, 13 bp, Homo sapiens
cctgaaggccccg

SEQ ID NO: 1834540 - DNA, 14 bp, Homo sapiens
cctgaaggccccgc

SEQ ID NO: 1834541 - DNA, 18 bp, Homo sapiens
cctgaaggccccgcccag

SEQ ID NO: 1834542 - DNA, 23 bp, Homo sapiens
cctgacaacactcattgacctga

SEQ ID NO: 1834543 - DNA, 22 bp, Homo sapiens
cctgagaccagccaacctgggg

SEQ ID NO: 1834544 - DNA, 21 bp, Homo sapiens
cctgagatttattaaagaaaa

SEQ ID NO: 1834545 - DNA, 12 bp, Homo sapiens
cctgaggcccag

SEQ ID NO: 1834546 - DNA, 16 bp, Homo sapiens
cctgaggcccagaggg

SEQ ID NO: 1834547 - DNA, 21 bp, Homo sapiens
cctgaggcccagagggcctgc

SEQ ID NO: 1834548 - DNA, 19 bp, Homo sapiens
cctgaggcccttctctcca

SEQ ID NO: 1834549 - DNA, 21 bp, Homo sapiens
cctgaggcccttctctccagc

SEQ ID NO: 1834550 - DNA, 14 bp, Homo sapiens
cctgaggctgggct

SEQ ID NO: 1834551 - DNA, 15 bp, Homo sapiens
cctgaggctgggctc

SEQ ID NO: 1834552 - DNA, 16 bp, Homo sapiens
cctgaggctgggctcc

SEQ ID NO: 1834553 - DNA, 19 bp, Homo sapiens
cctgaggctgggctccctt

SEQ ID NO: 1834554 - DNA, 21 bp, Homo sapiens
cctgaggctgggctcccttcc

SEQ ID NO: 1834555 - DNA, 16 bp, Homo sapiens
cctgaggggcctctta

SEQ ID NO: 1834556 - DNA, 21 bp, Homo sapiens
cctgatatttccctcccctgg

SEQ ID NO: 1834557 - DNA, 20 bp, Homo sapiens
cctgatggcaggatggcctg

SEQ ID NO: 1834558 - DNA, 19 bp, Homo sapiens
cctgattgtgtctcttggt

SEQ ID NO: 1834559 - DNA, 19 bp, Homo sapiens
cctgcaatgaagtctctga

SEQ ID NO: 1834560 - DNA, 20 bp, Homo sapiens
cctgcaatgaagtctctgaa

SEQ ID NO: 1834561 - DNA, 21 bp, Homo sapiens
cctgcaatgaagtctctgaag

SEQ ID NO: 1834562 - DNA, 14 bp, Homo sapiens
cctgcacacaggac

SEQ ID NO: 1834563 - DNA, 16 bp, Homo sapiens
cctgcacacaggacag

SEQ ID NO: 1834564 - DNA, 19 bp, Homo sapiens
cctgcacacaggacagcgg

SEQ ID NO: 1834565 - DNA, 17 bp, Homo sapiens
cctgcagccaagcaaat

SEQ ID NO: 1834566 - DNA, 13 bp, Homo sapiens
cctgcaggcagcc

SEQ ID NO: 1834567 - DNA, 15 bp, Homo sapiens
cctgcaggcagccag

SEQ ID NO: 1834568 - DNA, 16 bp, Homo sapiens
cctgccagcccctgcc

SEQ ID NO: 1834569 - DNA, 12 bp, Homo sapiens
cctgccaggcat

SEQ ID NO: 1834570 - DNA, 15 bp, Homo sapiens
cctgccaggcatggt

SEQ ID NO: 1834571 - DNA, 16 bp, Homo sapiens
cctgccaggcatggtg

SEQ ID NO: 1834572 - DNA, 13 bp, Homo sapiens
cctgccagggaca

SEQ ID NO: 1834573 - DNA, 14 bp, Homo sapiens
cctgccagggacag

SEQ ID NO: 1834574 - DNA, 13 bp, Homo sapiens
cctgcccacctgg

SEQ ID NO: 1834575 - DNA, 18 bp, Homo sapiens
cctgcccacctggcctct

SEQ ID NO: 1834576 - DNA, 15 bp, Homo sapiens
cctgcctcttctcta

SEQ ID NO: 1834577 - DNA, 23 bp, Homo sapiens
cctgcgtctcatactcacctcac

SEQ ID NO: 1834578 - DNA, 12 bp, Homo sapiens
cctgctccagct

SEQ ID NO: 1834579 - DNA, 16 bp, Homo sapiens
cctgctgcagttgcca

SEQ ID NO: 1834580 - DNA, 17 bp, Homo sapiens
cctgctgcagttgccag

SEQ ID NO: 1834581 - DNA, 12 bp, Homo sapiens
cctggaagacag

SEQ ID NO: 1834582 - DNA, 14 bp, Homo sapiens
cctggaagacagag

SEQ ID NO: 1834583 - DNA, 14 bp, Homo sapiens
cctggactcctgca

SEQ ID NO: 1834584 - DNA, 13 bp, Homo sapiens
cctggatgcagcc

SEQ ID NO: 1834585 - DNA, 14 bp, Homo sapiens
cctggatgcagcct

SEQ ID NO: 1834586 - DNA, 17 bp, Homo sapiens
cctggatgcagcctcac

SEQ ID NO: 1834587 - DNA, 13 bp, Homo sapiens
cctggcactgctt

SEQ ID NO: 1834588 - DNA, 20 bp, Homo sapiens
cctggcactgcttccagtga

SEQ ID NO: 1834589 - DNA, 17 bp, Homo sapiens
cctggcatttggcctct

SEQ ID NO: 1834590 - DNA, 21 bp, Homo sapiens
cctggcatttggcctcttgta

SEQ ID NO: 1834591 - DNA, 20 bp, Homo sapiens
cctggccagggcctggaaga

SEQ ID NO: 1834592 - DNA, 23 bp, Homo sapiens
cctggccagggcctggaagacag

SEQ ID NO: 1834593 - DNA, 18 bp, Homo sapiens
cctggcccctcagggtcc

SEQ ID NO: 1834594 - DNA, 20 bp, Homo sapiens
cctggcccctcagggtccct

SEQ ID NO: 1834595 - DNA, 14 bp, Homo sapiens
cctggcctctgcac

SEQ ID NO: 1834596 - DNA, 21 bp, Homo sapiens
cctggcctctgcactcccctg

SEQ ID NO: 1834597 - DNA, 14 bp, Homo sapiens
cctggcctgagctg

SEQ ID NO: 1834598 - DNA, 19 bp, Homo sapiens
cctggctgaaggactgtga

SEQ ID NO: 1834599 - DNA, 18 bp, Homo sapiens
cctgggaaagcccctgcc

SEQ ID NO: 1834600 - DNA, 14 bp, Homo sapiens
cctggggctgctgg

SEQ ID NO: 1834601 - DNA, 20 bp, Homo sapiens
cctgggtaaatgcagcgtga

SEQ ID NO: 1834602 - DNA, 13 bp, Homo sapiens
cctggtgctgctg

SEQ ID NO: 1834603 - DNA, 18 bp, Homo sapiens
cctggtggcagctcacct

SEQ ID NO: 1834604 - DNA, 19 bp, Homo sapiens
cctggtggcagctcacctc

SEQ ID NO: 1834605 - DNA, 21 bp, Homo sapiens
cctggtggcagctcacctctc

SEQ ID NO: 1834606 - DNA, 15 bp, Homo sapiens
cctggttctgatgat

SEQ ID NO: 1834607 - DNA, 15 bp, Homo sapiens
cctgtagagtgggag

SEQ ID NO: 1834608 - DNA, 16 bp, Homo sapiens
cctgtagagtgggagc

SEQ ID NO: 1834609 - DNA, 23 bp, Homo sapiens
cctgtagagtgggagctgagtgg

SEQ ID NO: 1834610 - DNA, 20 bp, Homo sapiens
cctgtgagtactacagtcct

SEQ ID NO: 1834611 - DNA, 20 bp, Homo sapiens
cctgtgatggggccctgcct

SEQ ID NO: 1834612 - DNA, 21 bp, Homo sapiens
cctgtgatggggccctgcctc

SEQ ID NO: 1834613 - DNA, 19 bp, Homo sapiens
cctgttttctgaaacacac

SEQ ID NO: 1834614 - DNA, 18 bp, Homo sapiens
ccttaataaacgtccaca

SEQ ID NO: 1834615 - DNA, 16 bp, Homo sapiens
ccttaccagcagagca

SEQ ID NO: 1834616 - DNA, 20 bp, Homo sapiens
ccttaccagcagagcacctt

SEQ ID NO: 1834617 - DNA, 20 bp, Homo sapiens
ccttacctcggtgccttcct

SEQ ID NO: 1834618 - DNA, 19 bp, Homo sapiens
ccttactttaaccctttct

SEQ ID NO: 1834619 - DNA, 20 bp, Homo sapiens
ccttactttaaccctttctg

SEQ ID NO: 1834620 - DNA, 14 bp, Homo sapiens
ccttagacagtccc

SEQ ID NO: 1834621 - DNA, 19 bp, Homo sapiens
ccttagacagtccctgcca

SEQ ID NO: 1834622 - DNA, 15 bp, Homo sapiens
ccttcaaagcaaatg

SEQ ID NO: 1834623 - DNA, 17 bp, Homo sapiens
ccttcacagatgggtgc

SEQ ID NO: 1834624 - DNA, 13 bp, Homo sapiens
agtacctgggcaa

SEQ ID NO: 1834625 - DNA, 18 bp, Homo sapiens
agtacctgggcaagctgg

SEQ ID NO: 1834626 - DNA, 16 bp, Homo sapiens
agtaggaagactttgg

SEQ ID NO: 1834627 - DNA, 22 bp, Homo sapiens
agtaggaagactttggaaagac

SEQ ID NO: 1834628 - DNA, 15 bp, Homo sapiens
agtatattattatta

SEQ ID NO: 1834629 - DNA, 16 bp, Homo sapiens
agtatcagctacaatt

SEQ ID NO: 1834630 - DNA, 19 bp, Homo sapiens
agtatcagctacaattgta

SEQ ID NO: 1834631 - DNA, 17 bp, Homo sapiens
agtatgggactggcctc

SEQ ID NO: 1834632 - DNA, 16 bp, Homo sapiens
agtatgtgcatttaat

SEQ ID NO: 1834633 - DNA, 14 bp, Homo sapiens
agtattgaagcatt

SEQ ID NO: 1834634 - DNA, 16 bp, Homo sapiens
agtcaagtgaaaaagg

SEQ ID NO: 1834635 - DNA, 20 bp, Homo sapiens
agtcaagtgaaaaaggagga

SEQ ID NO: 1834636 - DNA, 16 bp, Homo sapiens
agtcacacgggggcag

SEQ ID NO: 1834637 - DNA, 19 bp, Homo sapiens
agtcacacgggggcagctg

SEQ ID NO: 1834638 - DNA, 18 bp, Homo sapiens
agtcacgtggaggagcag

SEQ ID NO: 1834639 - DNA, 21 bp, Homo sapiens
agtcacgtggaggagcagtgc

SEQ ID NO: 1834640 - DNA, 19 bp, Homo sapiens
agtcaggggttcccttttt

SEQ ID NO: 1834641 - DNA, 21 bp, Homo sapiens
agtcatctgtaagagcttgct

SEQ ID NO: 1834642 - DNA, 12 bp, Homo sapiens
agtcattatgtt

SEQ ID NO: 1834643 - DNA, 12 bp, Homo sapiens
agtcccctttct

SEQ ID NO: 1834644 - DNA, 12 bp, Homo sapiens
agtccctgccaa

SEQ ID NO: 1834645 - DNA, 14 bp, Homo sapiens
agtccctgccaatg

SEQ ID NO: 1834646 - DNA, 14 bp, Homo sapiens
agtcctcccatctc

SEQ ID NO: 1834647 - DNA, 22 bp, Homo sapiens
agtctattgaataatgtagttt

SEQ ID NO: 1834648 - DNA, 12 bp, Homo sapiens
agtctgaaggct

SEQ ID NO: 1834649 - DNA, 19 bp, Homo sapiens
agtctgatgatttcttgaa

SEQ ID NO: 1834650 - DNA, 17 bp, Homo sapiens
agtctgttttatgactt

SEQ ID NO: 1834651 - DNA, 18 bp, Homo sapiens
agtctgttttatgacttc

SEQ ID NO: 1834652 - DNA, 15 bp, Homo sapiens
agtcttatcaagcag

SEQ ID NO: 1834653 - DNA, 11 bp, Homo sapiens
agtgaaaaagg

SEQ ID NO: 1834654 - DNA, 20 bp, Homo sapiens
agtgaaaaaggaggaagaga

SEQ ID NO: 1834655 - DNA, 13 bp, Homo sapiens
agtgaaactgctt

SEQ ID NO: 1834656 - DNA, 13 bp, Homo sapiens
agtgaagaattta

SEQ ID NO: 1834657 - DNA, 18 bp, Homo sapiens
agtgacctcagctttgat

SEQ ID NO: 1834658 - DNA, 20 bp, Homo sapiens
agtgactgtatctgtgtaga

SEQ ID NO: 1834659 - DNA, 17 bp, Homo sapiens
agtgactgttcaagagc

SEQ ID NO: 1834660 - DNA, 19 bp, Homo sapiens
agtgactgttcaagagcac

SEQ ID NO: 1834661 - DNA, 21 bp, Homo sapiens
agtgagacagtccagcctgga

SEQ ID NO: 1834662 - DNA, 12 bp, Homo sapiens
agtgagatgcat

SEQ ID NO: 1834663 - DNA, 16 bp, Homo sapiens
agtgagatgcattctt

SEQ ID NO: 1834664 - DNA, 12 bp, Homo sapiens
agtgagcagaac

SEQ ID NO: 1834665 - DNA, 15 bp, Homo sapiens
agtgagcagaacagg

SEQ ID NO: 1834666 - DNA, 17 bp, Homo sapiens
agtgagcagaacaggta

SEQ ID NO: 1834667 - DNA, 13 bp, Homo sapiens
agtgaggctctgc

SEQ ID NO: 1834668 - DNA, 14 bp, Homo sapiens
agtgaggctctgcc

SEQ ID NO: 1834669 - DNA, 15 bp, Homo sapiens
agtgaggctctgccc

SEQ ID NO: 1834670 - DNA, 19 bp, Homo sapiens
agtgaggctctgcccttgg

SEQ ID NO: 1834671 - DNA, 20 bp, Homo sapiens
agtgaggctctgcccttggt

SEQ ID NO: 1834672 - DNA, 21 bp, Homo sapiens
agtgaggctctgcccttggtt

SEQ ID NO: 1834673 - DNA, 22 bp, Homo sapiens
agtgccacccatgcagctgctc

SEQ ID NO: 1834674 - DNA, 15 bp, Homo sapiens
agtgccctctcccct

SEQ ID NO: 1834675 - DNA, 14 bp, Homo sapiens
agtgcctcttccag

SEQ ID NO: 1834676 - DNA, 17 bp, Homo sapiens
agtgctaagcattagct

SEQ ID NO: 1834677 - DNA, 17 bp, Homo sapiens
agtgctcatttcaggat

SEQ ID NO: 1834678 - DNA, 18 bp, Homo sapiens
agtggcgcgcgccaccac

SEQ ID NO: 1834679 - DNA, 12 bp, Homo sapiens
agtggctgctgc

SEQ ID NO: 1834680 - DNA, 14 bp, Homo sapiens
agtggctgctgccc

SEQ ID NO: 1834681 - DNA, 20 bp, Homo sapiens
agtgtccaaagcagggtctg

SEQ ID NO: 1834682 - DNA, 17 bp, Homo sapiens
agtgtgcggctgtgtgt

SEQ ID NO: 1834683 - DNA, 20 bp, Homo sapiens
agtgtggtgtttcctggcac

SEQ ID NO: 1834684 - DNA, 23 bp, Homo sapiens
agtgttctcatgaagcaggaggc

SEQ ID NO: 1834685 - DNA, 13 bp, Homo sapiens
agttaagcctttg

SEQ ID NO: 1834686 - DNA, 21 bp, Homo sapiens
agttactcttcagttaagcct

SEQ ID NO: 1834687 - DNA, 18 bp, Homo sapiens
agttaggggagaggaaaa

SEQ ID NO: 1834688 - DNA, 16 bp, Homo sapiens
agttagtttttaatct

SEQ ID NO: 1834689 - DNA, 18 bp, Homo sapiens
agttatcatgcatgttat

SEQ ID NO: 1834690 - DNA, 24 bp, Homo sapiens
agttcaatctggattcatatttaa

SEQ ID NO: 1834691 - DNA, 16 bp, Homo sapiens
agttcctgagaccagc

SEQ ID NO: 1834692 - DNA, 21 bp, Homo sapiens
agttctgacccaaccacagag

SEQ ID NO: 1834693 - DNA, 22 bp, Homo sapiens
agttgatagcacagaccctgcc

SEQ ID NO: 1834694 - DNA, 17 bp, Homo sapiens
agttgatatagaacagt

SEQ ID NO: 1834695 - DNA, 14 bp, Homo sapiens
agttgattcagctc

SEQ ID NO: 1834696 - DNA, 15 bp, Homo sapiens
agttgattcagctct

SEQ ID NO: 1834697 - DNA, 18 bp, Homo sapiens
agttgattcagctctgca

SEQ ID NO: 1834698 - DNA, 23 bp, Homo sapiens
agttgattcagctctgcaagaat

SEQ ID NO: 1834699 - DNA, 17 bp, Homo sapiens
agttgcacggctgctga

SEQ ID NO: 1834700 - DNA, 20 bp, Homo sapiens
agttgcacggctgctgaggc

SEQ ID NO: 1834701 - DNA, 20 bp, Homo sapiens
agttgccagtcaccccggcc

SEQ ID NO: 1834702 - DNA, 23 bp, Homo sapiens
agttgccagtcaccccggccacc

SEQ ID NO: 1834703 - DNA, 15 bp, Homo sapiens
agttggaaggatctg

SEQ ID NO: 1834704 - DNA, 13 bp, Homo sapiens
agttggtccccct

SEQ ID NO: 1834705 - DNA, 20 bp, Homo sapiens
agttgtttgattcagacagc

SEQ ID NO: 1834706 - DNA, 16 bp, Homo sapiens
agtttatactcacctt

SEQ ID NO: 1834707 - DNA, 20 bp, Homo sapiens
agtttcacagcacttacaat

SEQ ID NO: 1834708 - DNA, 22 bp, Homo sapiens
agtttcacagcacttacaattt

SEQ ID NO: 1834709 - DNA, 19 bp, Homo sapiens
agtttccttggctggtgca

SEQ ID NO: 1834710 - DNA, 21 bp, Homo sapiens
agtttctccaagcaggacatg

SEQ ID NO: 1834711 - DNA, 20 bp, Homo sapiens
agtttgagatcagcctgggc

SEQ ID NO: 1834712 - DNA, 17 bp, Homo sapiens
agttttgaagattctat

SEQ ID NO: 1834713 - DNA, 21 bp, Homo sapiens
agttttggttgctttaatatc

SEQ ID NO: 1834714 - DNA, 12 bp, Homo sapiens
agttttgtctgt

SEQ ID NO: 1834715 - DNA, 16 bp, Homo sapiens
ataaacaagaaaaata

SEQ ID NO: 1834716 - DNA, 13 bp, Homo sapiens
ataaagaaaagat

SEQ ID NO: 1834717 - DNA, 19 bp, Homo sapiens
ataaagaaaagatgcactt

SEQ ID NO: 1834718 - DNA, 21 bp, Homo sapiens
ataaagacgttttataagcat

SEQ ID NO: 1834719 - DNA, 15 bp, Homo sapiens
ataaagagagaaaaa

SEQ ID NO: 1834720 - DNA, 15 bp, Homo sapiens
ataaagttaaactga

SEQ ID NO: 1834721 - DNA, 14 bp, Homo sapiens
ataaatatattatt

SEQ ID NO: 1834722 - DNA, 19 bp, Homo sapiens
ataaatcgcttttgataat

SEQ ID NO: 1834723 - DNA, 13 bp, Homo sapiens
ataaatgcaaata

SEQ ID NO: 1834724 - DNA, 16 bp, Homo sapiens
ataaatggttaaaaga

SEQ ID NO: 1834725 - DNA, 22 bp, Homo sapiens
ataaattccctggcctttcata

SEQ ID NO: 1834726 - DNA, 16 bp, Homo sapiens
ataaccacatttctaa

SEQ ID NO: 1834727 - DNA, 20 bp, Homo sapiens
ataactgttatttataatca

SEQ ID NO: 1834728 - DNA, 23 bp, Homo sapiens
ataagagtaacagtcatcattta

SEQ ID NO: 1834729 - DNA, 23 bp, Homo sapiens
ataagcccaacaagttgaagaag

SEQ ID NO: 1834730 - DNA, 15 bp, Homo sapiens
ataagggcagagtca

SEQ ID NO: 1834731 - DNA, 18 bp, Homo sapiens
ataagggtatctggtgac

SEQ ID NO: 1834732 - DNA, 20 bp, Homo sapiens
ataattcaggaagcagcttt

SEQ ID NO: 1834733 - DNA, 23 bp, Homo sapiens
cagctttccccatgtctcgactc

SEQ ID NO: 1834734 - DNA, 21 bp, Homo sapiens
cagctttctgggatgtcacag

SEQ ID NO: 1834735 - DNA, 14 bp, Homo sapiens
cagctttgatattt

SEQ ID NO: 1834736 - DNA, 23 bp, Homo sapiens
cagctttgtttgttgtcagctga

SEQ ID NO: 1834737 - DNA, 14 bp, Homo sapiens
caggaaaggctcca

SEQ ID NO: 1834738 - DNA, 15 bp, Homo sapiens
caggaaaggctccag

SEQ ID NO: 1834739 - DNA, 13 bp, Homo sapiens
caggaagctcagg

SEQ ID NO: 1834740 - DNA, 23 bp, Homo sapiens
caggaagctcagggcctggctca

SEQ ID NO: 1834741 - DNA, 17 bp, Homo sapiens
caggacagcgggaaaaa

SEQ ID NO: 1834742 - DNA, 13 bp, Homo sapiens
caggacatgctga

SEQ ID NO: 1834743 - DNA, 21 bp, Homo sapiens
caggaccagggatttccatga

SEQ ID NO: 1834744 - DNA, 16 bp, Homo sapiens
caggacctcaggtgag

SEQ ID NO: 1834745 - DNA, 23 bp, Homo sapiens
caggacctcaggtgagaagcaga

SEQ ID NO: 1834746 - DNA, 21 bp, Homo sapiens
caggactcagctccccagagt

SEQ ID NO: 1834747 - DNA, 17 bp, Homo sapiens
caggagcacggctctgt

SEQ ID NO: 1834748 - DNA, 15 bp, Homo sapiens
caggagcagcctcag

SEQ ID NO: 1834749 - DNA, 14 bp, Homo sapiens
caggaggccagcct

SEQ ID NO: 1834750 - DNA, 17 bp, Homo sapiens
caggaggccagccttga

SEQ ID NO: 1834751 - DNA, 23 bp, Homo sapiens
caggagtttgagaccaacctggg

SEQ ID NO: 1834752 - DNA, 23 bp, Homo sapiens
caggatcgcaagagccatgtaga

SEQ ID NO: 1834753 - DNA, 17 bp, Homo sapiens
caggatggcctggccag

SEQ ID NO: 1834754 - DNA, 17 bp, Homo sapiens
caggattcttcctccct

SEQ ID NO: 1834755 - DNA, 13 bp, Homo sapiens
caggatttaagtt

SEQ ID NO: 1834756 - DNA, 14 bp, Homo sapiens
caggcagccaggcc

SEQ ID NO: 1834757 - DNA, 23 bp, Homo sapiens
caggcaggctaaggcgtggagct

SEQ ID NO: 1834758 - DNA, 14 bp, Homo sapiens
caggcatcacagct

SEQ ID NO: 1834759 - DNA, 15 bp, Homo sapiens
caggcattccccagg

SEQ ID NO: 1834760 - DNA, 16 bp, Homo sapiens
caggcattccccagga

SEQ ID NO: 1834761 - DNA, 19 bp, Homo sapiens
caggcattccccaggaggc

SEQ ID NO: 1834762 - DNA, 24 bp, Homo sapiens
caggcattccccaggaggccagcc

SEQ ID NO: 1834763 - DNA, 18 bp, Homo sapiens
caggccacacttcaaact

SEQ ID NO: 1834764 - DNA, 21 bp, Homo sapiens
caggccacacttcaaactact

SEQ ID NO: 1834765 - DNA, 14 bp, Homo sapiens
caggccaggccctc

SEQ ID NO: 1834766 - DNA, 16 bp, Homo sapiens
caggccaggccctctg

SEQ ID NO: 1834767 - DNA, 21 bp, Homo sapiens
caggccatcatcagtggagcc

SEQ ID NO: 1834768 - DNA, 18 bp, Homo sapiens
caggccattccccgtctc

SEQ ID NO: 1834769 - DNA, 15 bp, Homo sapiens
caggccctctgccca

SEQ ID NO: 1834770 - DNA, 17 bp, Homo sapiens
caggccctctgcccact

SEQ ID NO: 1834771 - DNA, 22 bp, Homo sapiens
caggccctctgcccactccctg

SEQ ID NO: 1834772 - DNA, 13 bp, Homo sapiens
caggcgttcagct

SEQ ID NO: 1834773 - DNA, 14 bp, Homo sapiens
caggctgggagagc

SEQ ID NO: 1834774 - DNA, 21 bp, Homo sapiens
caggctgggagagccttccag

SEQ ID NO: 1834775 - DNA, 24 bp, Homo sapiens
caggctggtctcgaactgctggat

SEQ ID NO: 1834776 - DNA, 22 bp, Homo sapiens
caggcttagtcactgagacagc

SEQ ID NO: 1834777 - DNA, 16 bp, Homo sapiens
caggcttctgagcagc

SEQ ID NO: 1834778 - DNA, 21 bp, Homo sapiens
caggcttctgagcagcgagcc

SEQ ID NO: 1834779 - DNA, 20 bp, Homo sapiens
caggcttggggaaaatggcc

SEQ ID NO: 1834780 - DNA, 13 bp, Homo sapiens
cagggacagaggg

SEQ ID NO: 1834781 - DNA, 16 bp, Homo sapiens
cagggatgagcatgga

SEQ ID NO: 1834782 - DNA, 19 bp, Homo sapiens
cagggatgagcatggagct

SEQ ID NO: 1834783 - DNA, 20 bp, Homo sapiens
cagggatgagcatggagctg

SEQ ID NO: 1834784 - DNA, 18 bp, Homo sapiens
cagggccatgcagacctc

SEQ ID NO: 1834785 - DNA, 22 bp, Homo sapiens
cagggccatgcagacctcatgc

SEQ ID NO: 1834786 - DNA, 19 bp, Homo sapiens
cagggcctggctcaggtgg

SEQ ID NO: 1834787 - DNA, 14 bp, Homo sapiens
cagggctgctagac

SEQ ID NO: 1834788 - DNA, 20 bp, Homo sapiens
caggggaaaatcagcctgct

SEQ ID NO: 1834789 - DNA, 21 bp, Homo sapiens
caggggtgggacaccctgtga

SEQ ID NO: 1834790 - DNA, 19 bp, Homo sapiens
cagggtccctggtggcagc

SEQ ID NO: 1834791 - DNA, 23 bp, Homo sapiens
cagggtccctggtggcagctcac

SEQ ID NO: 1834792 - DNA, 20 bp, Homo sapiens
caggtagtattacaccaccg

SEQ ID NO: 1834793 - DNA, 20 bp, Homo sapiens
caggtgagcccatggccctc

SEQ ID NO: 1834794 - DNA, 17 bp, Homo sapiens
caggtgcacaagctcca

SEQ ID NO: 1834795 - DNA, 18 bp, Homo sapiens
caggtgcacaagctccaa

SEQ ID NO: 1834796 - DNA, 19 bp, Homo sapiens
caggtgcacaagctccaag

SEQ ID NO: 1834797 - DNA, 20 bp, Homo sapiens
caggtgcacaagctccaagc

SEQ ID NO: 1834798 - DNA, 22 bp, Homo sapiens
caggtgcacaagctccaagctc

SEQ ID NO: 1834799 - DNA, 19 bp, Homo sapiens
caggtgggcttcccagtgg

SEQ ID NO: 1834800 - DNA, 14 bp, Homo sapiens
catgaaactccacc

SEQ ID NO: 1834801 - DNA, 15 bp, Homo sapiens
catgaagcaggaggc

SEQ ID NO: 1834802 - DNA, 18 bp, Homo sapiens
catgaagtttccttggct

SEQ ID NO: 1834803 - DNA, 22 bp, Homo sapiens
catgaagtttccttggctggtg

SEQ ID NO: 1834804 - DNA, 15 bp, Homo sapiens
catgaatctgcaatg

SEQ ID NO: 1834805 - DNA, 16 bp, Homo sapiens
catgacccaggctggg

SEQ ID NO: 1834806 - DNA, 17 bp, Homo sapiens
catgacccaggctgggc

SEQ ID NO: 1834807 - DNA, 19 bp, Homo sapiens
catgacccaggctgggcaa

SEQ ID NO: 1834808 - DNA, 22 bp, Homo sapiens
catgagaagttgatatagaaca

SEQ ID NO: 1834809 - DNA, 13 bp, Homo sapiens
catgagcatcagg

SEQ ID NO: 1834810 - DNA, 18 bp, Homo sapiens
catgagcatcaggccagg

SEQ ID NO: 1834811 - DNA, 20 bp, Homo sapiens
catgagcatcaggccaggcc

SEQ ID NO: 1834812 - DNA, 23 bp, Homo sapiens
catgagcatcaggccaggccctc

SEQ ID NO: 1834813 - DNA, 13 bp, Homo sapiens
catgagtcccctg

SEQ ID NO: 1834814 - DNA, 15 bp, Homo sapiens
catgagtcccctgtt

SEQ ID NO: 1834815 - DNA, 15 bp, Homo sapiens
catgatgctgggatt

SEQ ID NO: 1834816 - DNA, 16 bp, Homo sapiens
catgatgctgggattt

SEQ ID NO: 1834817 - DNA, 16 bp, Homo sapiens
catgcaccctcataca

SEQ ID NO: 1834818 - DNA, 20 bp, Homo sapiens
catgcaccctcatacacaga

SEQ ID NO: 1834819 - DNA, 22 bp, Homo sapiens
catgcagctgctccccaggcca

SEQ ID NO: 1834820 - DNA, 11 bp, Homo sapiens
catgcaggagg

SEQ ID NO: 1834821 - DNA, 20 bp, Homo sapiens
catgccagcttatctcaggg

SEQ ID NO: 1834822 - DNA, 19 bp, Homo sapiens
catgcccagctctctgacg

SEQ ID NO: 1834823 - DNA, 14 bp, Homo sapiens
catgccccgatgtc

SEQ ID NO: 1834824 - DNA, 13 bp, Homo sapiens
catgctcctggcc

SEQ ID NO: 1834825 - DNA, 17 bp, Homo sapiens
catgctcctggcccact

SEQ ID NO: 1834826 - DNA, 15 bp, Homo sapiens
catgctgccctgtga

SEQ ID NO: 1834827 - DNA, 22 bp, Homo sapiens
catgctgtgtgactcaaaccaa

SEQ ID NO: 1834828 - DNA, 21 bp, Homo sapiens
catggaaattcccttcatctg

SEQ ID NO: 1834829 - DNA, 16 bp, Homo sapiens
catggagagctggagc

SEQ ID NO: 1834830 - DNA, 13 bp, Homo sapiens
catggagctggcc

SEQ ID NO: 1834831 - DNA, 14 bp, Homo sapiens
catggccctcccag

SEQ ID NO: 1834832 - DNA, 18 bp, Homo sapiens
catgggaaaggggaagtt

SEQ ID NO: 1834833 - DNA, 19 bp, Homo sapiens
catgggtcgggagagggga

SEQ ID NO: 1834834 - DNA, 12 bp, Homo sapiens
catggtgtctgg

SEQ ID NO: 1834835 - DNA, 13 bp, Homo sapiens
catgtagaagctg

SEQ ID NO: 1834836 - DNA, 17 bp, Homo sapiens
catgtatgtaaatagct

SEQ ID NO: 1834837 - DNA, 22 bp, Homo sapiens
catgtatgtaaatagctaagat

SEQ ID NO: 1834838 - DNA, 14 bp, Homo sapiens
catgtctcgactca

SEQ ID NO: 1834839 - DNA, 14 bp, Homo sapiens
catgtcttttcttg

SEQ ID NO: 1834840 - DNA, 19 bp, Homo sapiens
catgtcttttcttgcatga

SEQ ID NO: 1834841 - DNA, 19 bp, Homo sapiens
catgtgagaatatttttcc

SEQ ID NO: 1834842 - DNA, 16 bp, Homo sapiens
catgtgccttttctga

SEQ ID NO: 1834843 - DNA, 18 bp, Homo sapiens
catgtgttggcagcctct

SEQ ID NO: 1834844 - DNA, 20 bp, Homo sapiens
catgttgagacctcagcttg

SEQ ID NO: 1834845 - DNA, 18 bp, Homo sapiens
catgttttaaagcttgct

SEQ ID NO: 1834846 - DNA, 15 bp, Homo sapiens
catgttttgtttacg

SEQ ID NO: 1834847 - DNA, 17 bp, Homo sapiens
cattaaacgtcattcag

SEQ ID NO: 1834848 - DNA, 12 bp, Homo sapiens
cattagagcagg

SEQ ID NO: 1834849 - DNA, 23 bp, Homo sapiens
cattagagcaggcgttcagctca

SEQ ID NO: 1834850 - DNA, 13 bp, Homo sapiens
cattagttttgaa

SEQ ID NO: 1834851 - DNA, 15 bp, Homo sapiens
cattagttttgaaga

SEQ ID NO: 1834852 - DNA, 13 bp, Homo sapiens
cattatgatgtgt

SEQ ID NO: 1834853 - DNA, 17 bp, Homo sapiens
cattatgttaatatttc

SEQ ID NO: 1834854 - DNA, 22 bp, Homo sapiens
cattatttatgtattgtgcaat

SEQ ID NO: 1834855 - DNA, 13 bp, Homo sapiens
cattcagtactta

SEQ ID NO: 1834856 - DNA, 16 bp, Homo sapiens
cattcatgcctggctt

SEQ ID NO: 1834857 - DNA, 17 bp, Homo sapiens
cattcattccattctgg

SEQ ID NO: 1834858 - DNA, 15 bp, Homo sapiens
cattccattctggaa

SEQ ID NO: 1834859 - DNA, 14 bp, Homo sapiens
cattcccagcccag

SEQ ID NO: 1834860 - DNA, 14 bp, Homo sapiens
cattcctgatgctt

SEQ ID NO: 1834861 - DNA, 13 bp, Homo sapiens
cattccttgcctg

SEQ ID NO: 1834862 - DNA, 17 bp, Homo sapiens
cattctcattggaaatt

SEQ ID NO: 1834863 - DNA, 13 bp, Homo sapiens
aggcactgcctga

SEQ ID NO: 1834864 - DNA, 14 bp, Homo sapiens
aggcactgcctgat

SEQ ID NO: 1834865 - DNA, 13 bp, Homo sapiens
aggcagcaccaca

SEQ ID NO: 1834866 - DNA, 19 bp, Homo sapiens
aggcagcaccacactgggt

SEQ ID NO: 1834867 - DNA, 21 bp, Homo sapiens
aggcagcaccacactgggtgc

SEQ ID NO: 1834868 - DNA, 14 bp, Homo sapiens
aggcagccaggcca

SEQ ID NO: 1834869 - DNA, 16 bp, Homo sapiens
aggcagccaggccaca

SEQ ID NO: 1834870 - DNA, 19 bp, Homo sapiens
aggcaggacatgctgaagc

SEQ ID NO: 1834871 - DNA, 16 bp, Homo sapiens
aggcaggggaatgtat

SEQ ID NO: 1834872 - DNA, 14 bp, Homo sapiens
aggcatcacagcta

SEQ ID NO: 1834873 - DNA, 23 bp, Homo sapiens
aggcattccccaggaggccagcc

SEQ ID NO: 1834874 - DNA, 20 bp, Homo sapiens
aggcatttgctgaatacaga

SEQ ID NO: 1834875 - DNA, 15 bp, Homo sapiens
aggccacaagaccct

SEQ ID NO: 1834876 - DNA, 17 bp, Homo sapiens
aggccacaagacccttg

SEQ ID NO: 1834877 - DNA, 19 bp, Homo sapiens
aggccacaagacccttgtg

SEQ ID NO: 1834878 - DNA, 20 bp, Homo sapiens
aggccacaagacccttgtgg

SEQ ID NO: 1834879 - DNA, 21 bp, Homo sapiens
aggccacacttcaaactactt

SEQ ID NO: 1834880 - DNA, 13 bp, Homo sapiens
aggccaggccctc

SEQ ID NO: 1834881 - DNA, 14 bp, Homo sapiens
aggccaggccctct

SEQ ID NO: 1834882 - DNA, 16 bp, Homo sapiens
aggccaggccctctgc

SEQ ID NO: 1834883 - DNA, 17 bp, Homo sapiens
aggccaggccctctgcc

SEQ ID NO: 1834884 - DNA, 18 bp, Homo sapiens
aggccaggccctctgccc

SEQ ID NO: 1834885 - DNA, 16 bp, Homo sapiens
aggccatggagagctg

SEQ ID NO: 1834886 - DNA, 22 bp, Homo sapiens
aggccatggagagctggagcct

SEQ ID NO: 1834887 - DNA, 19 bp, Homo sapiens
aggcccagtgcatatgcaa

SEQ ID NO: 1834888 - DNA, 11 bp, Homo sapiens
aggcccctctc

SEQ ID NO: 1834889 - DNA, 13 bp, Homo sapiens
aggcccctctcct

SEQ ID NO: 1834890 - DNA, 14 bp, Homo sapiens
aggcccctctcctc

SEQ ID NO: 1834891 - DNA, 15 bp, Homo sapiens
aggcccggcctctca

SEQ ID NO: 1834892 - DNA, 21 bp, Homo sapiens
aggccctctgcccactccctg

SEQ ID NO: 1834893 - DNA, 23 bp, Homo sapiens
aggccctctgcccactccctgca

SEQ ID NO: 1834894 - DNA, 23 bp, Homo sapiens
aggcccttctctccagcccctgg

SEQ ID NO: 1834895 - DNA, 15 bp, Homo sapiens
aggcgtggagctgcc

SEQ ID NO: 1834896 - DNA, 13 bp, Homo sapiens
aggctacactgac

SEQ ID NO: 1834897 - DNA, 19 bp, Homo sapiens
aggctacactgacactggt

SEQ ID NO: 1834898 - DNA, 17 bp, Homo sapiens
aggctccaggagcagcc

SEQ ID NO: 1834899 - DNA, 15 bp, Homo sapiens
aggctcgagcatgcc

SEQ ID NO: 1834900 - DNA, 16 bp, Homo sapiens
aggctctgcccttggt

SEQ ID NO: 1834901 - DNA, 18 bp, Homo sapiens
aggctcttctccccagag

SEQ ID NO: 1834902 - DNA, 19 bp, Homo sapiens
aggctcttctccccagagt

SEQ ID NO: 1834903 - DNA, 21 bp, Homo sapiens
aggctgacacctaactcttct

SEQ ID NO: 1834904 - DNA, 16 bp, Homo sapiens
aggctgagaacactgt

SEQ ID NO: 1834905 - DNA, 19 bp, Homo sapiens
aggctgagaacactgtgaa

SEQ ID NO: 1834906 - DNA, 18 bp, Homo sapiens
aggctggagtgcagtggc

SEQ ID NO: 1834907 - DNA, 20 bp, Homo sapiens
aggctgggagagccttccag

SEQ ID NO: 1834908 - DNA, 22 bp, Homo sapiens
aggctgggagagccttccaggg

SEQ ID NO: 1834909 - DNA, 14 bp, Homo sapiens
aggctgggctccct

SEQ ID NO: 1834910 - DNA, 16 bp, Homo sapiens
aggctggggaagtcct

SEQ ID NO: 1834911 - DNA, 22 bp, Homo sapiens
aggctggggaagtcctctgggt

SEQ ID NO: 1834912 - DNA, 17 bp, Homo sapiens
aggctgggggaagaagc

SEQ ID NO: 1834913 - DNA, 22 bp, Homo sapiens
aggctgggggaagaagctctct

SEQ ID NO: 1834914 - DNA, 14 bp, Homo sapiens
aggctgtgctccct

SEQ ID NO: 1834915 - DNA, 20 bp, Homo sapiens
aggcttagctttgctctgcc

SEQ ID NO: 1834916 - DNA, 17 bp, Homo sapiens
aggcttagtcactgaga

SEQ ID NO: 1834917 - DNA, 21 bp, Homo sapiens
aggcttagtcactgagacagc

SEQ ID NO: 1834918 - DNA, 15 bp, Homo sapiens
aggcttctgagcagc

SEQ ID NO: 1834919 - DNA, 14 bp, Homo sapiens
agggaatgcctgag

SEQ ID NO: 1834920 - DNA, 13 bp, Homo sapiens
agggacagagggg

SEQ ID NO: 1834921 - DNA, 17 bp, Homo sapiens
agggacgctacccggga

SEQ ID NO: 1834922 - DNA, 21 bp, Homo sapiens
agggacgctacccgggaaggg

SEQ ID NO: 1834923 - DNA, 12 bp, Homo sapiens
agggagggagtt

SEQ ID NO: 1834924 - DNA, 13 bp, Homo sapiens
agggagggctcca

SEQ ID NO: 1834925 - DNA, 16 bp, Homo sapiens
agggagggctccagac

SEQ ID NO: 1834926 - DNA, 17 bp, Homo sapiens
agggagggctccagaca

SEQ ID NO: 1834927 - DNA, 19 bp, Homo sapiens
agggagttttgtctgtctc

SEQ ID NO: 1834928 - DNA, 20 bp, Homo sapiens
agggagttttgtctgtctcc

SEQ ID NO: 1834929 - DNA, 17 bp, Homo sapiens
agggatgaaagagaagg

SEQ ID NO: 1834930 - DNA, 13 bp, Homo sapiens
agggcaagaaatg

SEQ ID NO: 1834931 - DNA, 11 bp, Homo sapiens
agggcaggcat

SEQ ID NO: 1834932 - DNA, 14 bp, Homo sapiens
agggcaggcttggg

SEQ ID NO: 1834933 - DNA, 15 bp, Homo sapiens
agggcaggcttgggg

SEQ ID NO: 1834934 - DNA, 17 bp, Homo sapiens
agggcaggcttggggaa

SEQ ID NO: 1834935 - DNA, 16 bp, Homo sapiens
agggccatgcagacct

SEQ ID NO: 1834936 - DNA, 14 bp, Homo sapiens
agggccccggggcc

SEQ ID NO: 1834937 - DNA, 13 bp, Homo sapiens
agggcctggcctg

SEQ ID NO: 1834938 - DNA, 14 bp, Homo sapiens
agggcctggcctga

SEQ ID NO: 1834939 - DNA, 18 bp, Homo sapiens
agggcctggcctgagctg

SEQ ID NO: 1834940 - DNA, 13 bp, Homo sapiens
agggcctggctca

SEQ ID NO: 1834941 - DNA, 15 bp, Homo sapiens
agggctccagacaca

SEQ ID NO: 1834942 - DNA, 20 bp, Homo sapiens
agggctccagacacatgtcc

SEQ ID NO: 1834943 - DNA, 13 bp, Homo sapiens
agggctccagagt

SEQ ID NO: 1834944 - DNA, 14 bp, Homo sapiens
agggctctgaccag

SEQ ID NO: 1834945 - DNA, 15 bp, Homo sapiens
agggctctgaccagt

SEQ ID NO: 1834946 - DNA, 18 bp, Homo sapiens
aggggaaaatcagcctgc

SEQ ID NO: 1834947 - DNA, 21 bp, Homo sapiens
aggggaataaactgttgagtc

SEQ ID NO: 1834948 - DNA, 19 bp, Homo sapiens
aggggacgcaggcccctct

SEQ ID NO: 1834949 - DNA, 24 bp, Homo sapiens
aggggacgcaggcccctctcctcc

SEQ ID NO: 1834950 - DNA, 17 bp, Homo sapiens
aggggagggcaggcttg

SEQ ID NO: 1834951 - DNA, 20 bp, Homo sapiens
aggggcctcttatgggctgg

SEQ ID NO: 1834952 - DNA, 13 bp, Homo sapiens
agggggctgggac

SEQ ID NO: 1834953 - DNA, 22 bp, Homo sapiens
aggggtgggacaccctgtgatg

SEQ ID NO: 1834954 - DNA, 21 bp, Homo sapiens
agggtatctggtgactttcct

SEQ ID NO: 1834955 - DNA, 13 bp, Homo sapiens
agggtattccaga

SEQ ID NO: 1834956 - DNA, 12 bp, Homo sapiens
agggtccctggt

SEQ ID NO: 1834957 - DNA, 20 bp, Homo sapiens
agggtccctggtggcagctc

SEQ ID NO: 1834958 - DNA, 17 bp, Homo sapiens
agggtggtggagccagt

SEQ ID NO: 1834959 - DNA, 21 bp, Homo sapiens
aggtactgatcctgtttcttg

SEQ ID NO: 1834960 - DNA, 21 bp, Homo sapiens
aggtcaaggctgcagtgagcc

SEQ ID NO: 1834961 - DNA, 17 bp, Homo sapiens
aggtccagccctggctg

SEQ ID NO: 1834962 - DNA, 22 bp, Homo sapiens
aggtccagccctggctgaagga

SEQ ID NO: 1834963 - DNA, 15 bp, Homo sapiens
aggtgcacaagctcc

SEQ ID NO: 1834964 - DNA, 20 bp, Homo sapiens
aggtgccgccagctgccgca

SEQ ID NO: 1834965 - DNA, 20 bp, Homo sapiens
aggtgcgtgttcagcagaac

SEQ ID NO: 1834966 - DNA, 19 bp, Homo sapiens
aggtgctaggaacactcct

SEQ ID NO: 1834967 - DNA, 23 bp, Homo sapiens
aggtgctaggaacactccttcac

SEQ ID NO: 1834968 - DNA, 17 bp, Homo sapiens
aggtggagaaaattgga

SEQ ID NO: 1834969 - DNA, 20 bp, Homo sapiens
aggtggatgttatgaacagc

SEQ ID NO: 1834970 - DNA, 22 bp, Homo sapiens
aggtggatgttatgaacagctg

SEQ ID NO: 1834971 - DNA, 15 bp, Homo sapiens
aggtggcaaggctgt

SEQ ID NO: 1834972 - DNA, 23 bp, Homo sapiens
aggtggccccatattaacaaatt

SEQ ID NO: 1834973 - DNA, 18 bp, Homo sapiens
aggtgggatcctccaggt

SEQ ID NO: 1834974 - DNA, 14 bp, Homo sapiens
aggtggggacaggg

SEQ ID NO: 1834975 - DNA, 23 bp, Homo sapiens
aggtggggtcactctggcagctc

SEQ ID NO: 1834976 - DNA, 23 bp, Homo sapiens
aggtgggttttcatcaagactgg

SEQ ID NO: 1834977 - DNA, 17 bp, Homo sapiens
aggttatctgtcccagg

SEQ ID NO: 1834978 - DNA, 18 bp, Homo sapiens
atagcctgcctcttctct

SEQ ID NO: 1834979 - DNA, 13 bp, Homo sapiens
atagctcttgctt

SEQ ID NO: 1834980 - DNA, 13 bp, Homo sapiens
ataggtggcctct

SEQ ID NO: 1834981 - DNA, 16 bp, Homo sapiens
atagtaacctgggtaa

SEQ ID NO: 1834982 - DNA, 14 bp, Homo sapiens
atagtaattctcag

SEQ ID NO: 1834983 - DNA, 22 bp, Homo sapiens
atagttccctagtctattcatt

SEQ ID NO: 1834984 - DNA, 16 bp, Homo sapiens
atataaatatattatt

SEQ ID NO: 1834985 - DNA, 12 bp, Homo sapiens
atataaatgcaa

SEQ ID NO: 1834986 - DNA, 15 bp, Homo sapiens
atataaatgcaaata

SEQ ID NO: 1834987 - DNA, 17 bp, Homo sapiens
atataaatggttaaaag

SEQ ID NO: 1834988 - DNA, 16 bp, Homo sapiens
atataaccacatttct

SEQ ID NO: 1834989 - DNA, 18 bp, Homo sapiens
atataaccacatttctaa

SEQ ID NO: 1834990 - DNA, 19 bp, Homo sapiens
atatagaaggactgcagcc

SEQ ID NO: 1834991 - DNA, 14 bp, Homo sapiens
atatatgtgatgat

SEQ ID NO: 1834992 - DNA, 19 bp, Homo sapiens
atatcccttggacatttta

SEQ ID NO: 1834993 - DNA, 22 bp, Homo sapiens
atatcccttggacattttatgt

SEQ ID NO: 1834994 - DNA, 23 bp, Homo sapiens
atatcccttggacattttatgtc

SEQ ID NO: 1834995 - DNA, 22 bp, Homo sapiens
atatcttaattctttgttctgt

SEQ ID NO: 1834996 - DNA, 19 bp, Homo sapiens
atatgacattcatgcctgg

SEQ ID NO: 1834997 - DNA, 20 bp, Homo sapiens
atatgatttaaatcagccgt

SEQ ID NO: 1834998 - DNA, 15 bp, Homo sapiens
atatggactcagcct

SEQ ID NO: 1834999 - DNA, 12 bp, Homo sapiens
atattattactt

SEQ ID NO: 1835000 - DNA, 14 bp, Homo sapiens
atattcaggaagct

SEQ ID NO: 1835001 - DNA, 16 bp, Homo sapiens
atattcaggaagctca

SEQ ID NO: 1835002 - DNA, 19 bp, Homo sapiens
atcaaagaggttttaaaaa

SEQ ID NO: 1835003 - DNA, 15 bp, Homo sapiens
atcaagactggaagg

SEQ ID NO: 1835004 - DNA, 13 bp, Homo sapiens
atcaaggcactgc

SEQ ID NO: 1835005 - DNA, 14 bp, Homo sapiens
atcacagcagcttc

SEQ ID NO: 1835006 - DNA, 13 bp, Homo sapiens
atcacagcctctg

SEQ ID NO: 1835007 - DNA, 18 bp, Homo sapiens
atcacagtggccacggcc

SEQ ID NO: 1835008 - DNA, 17 bp, Homo sapiens
atcacattaatctcaaa

SEQ ID NO: 1835009 - DNA, 14 bp, Homo sapiens
atcaggccaggccc

SEQ ID NO: 1835010 - DNA, 20 bp, Homo sapiens
atcaggccaggccctctgcc

SEQ ID NO: 1835011 - DNA, 21 bp, Homo sapiens
atcaggccaggccctctgccc

SEQ ID NO: 1835012 - DNA, 23 bp, Homo sapiens
atcaggccaggccctctgcccac

SEQ ID NO: 1835013 - DNA, 14 bp, Homo sapiens
atcaggtttttccc

SEQ ID NO: 1835014 - DNA, 13 bp, Homo sapiens
atcagtggagcca

SEQ ID NO: 1835015 - DNA, 15 bp, Homo sapiens
atcagttagagctga

SEQ ID NO: 1835016 - DNA, 19 bp, Homo sapiens
atcatacttaactttacta

SEQ ID NO: 1835017 - DNA, 15 bp, Homo sapiens
atcatcagtattgaa

SEQ ID NO: 1835018 - DNA, 21 bp, Homo sapiens
atcatctcctttgcagaatga

SEQ ID NO: 1835019 - DNA, 18 bp, Homo sapiens
atcatctgcattcctgat

SEQ ID NO: 1835020 - DNA, 20 bp, Homo sapiens
atccaattttaaaatgaaat

SEQ ID NO: 1835021 - DNA, 22 bp, Homo sapiens
atccaattttaaaatgaaatgc

SEQ ID NO: 1835022 - DNA, 22 bp, Homo sapiens
atcccacatatttcaaaaacat

SEQ ID NO: 1835023 - DNA, 11 bp, Homo sapiens
atcccagcccc

SEQ ID NO: 1835024 - DNA, 14 bp, Homo sapiens
atcccatttaaaaa

SEQ ID NO: 1835025 - DNA, 21 bp, Homo sapiens
atccctcatcctcatacccac

SEQ ID NO: 1835026 - DNA, 23 bp, Homo sapiens
atccctcatcctcatacccaccc

SEQ ID NO: 1835027 - DNA, 22 bp, Homo sapiens
atcccttactttaaccctttct

SEQ ID NO: 1835028 - DNA, 22 bp, Homo sapiens
atcccttgaccaggcctgggcc

SEQ ID NO: 1835029 - DNA, 14 bp, Homo sapiens
atcctaggctgaca

SEQ ID NO: 1835030 - DNA, 16 bp, Homo sapiens
atcctaggctgacacc

SEQ ID NO: 1835031 - DNA, 19 bp, Homo sapiens
atcctagttccaccatcaa

SEQ ID NO: 1835032 - DNA, 20 bp, Homo sapiens
atcctctcaaccacctttca

SEQ ID NO: 1835033 - DNA, 13 bp, Homo sapiens
atcctgctaagtt

SEQ ID NO: 1835034 - DNA, 16 bp, Homo sapiens
atcctgtgaagtaagg

SEQ ID NO: 1835035 - DNA, 19 bp, Homo sapiens
atcctgtgtgttaagctct

SEQ ID NO: 1835036 - DNA, 19 bp, Homo sapiens
atcgaaaagttattttgta

SEQ ID NO: 1835037 - DNA, 17 bp, Homo sapiens
atctaggaagactttgg

SEQ ID NO: 1835038 - DNA, 19 bp, Homo sapiens
atctaggaagactttggaa

SEQ ID NO: 1835039 - DNA, 15 bp, Homo sapiens
atctcacacatgagc

SEQ ID NO: 1835040 - DNA, 18 bp, Homo sapiens
atctcacttgtgccaaca

SEQ ID NO: 1835041 - DNA, 14 bp, Homo sapiens
atctcagggcctgg

SEQ ID NO: 1835042 - DNA, 15 bp, Homo sapiens
atctcccccagcccc

SEQ ID NO: 1835043 - DNA, 16 bp, Homo sapiens
atctcccccagcccca

SEQ ID NO: 1835044 - DNA, 19 bp, Homo sapiens
atctccgtctcccaaagtg

SEQ ID NO: 1835045 - DNA, 14 bp, Homo sapiens
atctcctttgcaga

SEQ ID NO: 1835046 - DNA, 18 bp, Homo sapiens
atctgggcatagatgcag

SEQ ID NO: 1835047 - DNA, 17 bp, Homo sapiens
atctggtgactttcctc

SEQ ID NO: 1835048 - DNA, 21 bp, Homo sapiens
atctgtaagagcttgctccag

SEQ ID NO: 1835049 - DNA, 18 bp, Homo sapiens
atcttaattctttgttct

SEQ ID NO: 1835050 - DNA, 19 bp, Homo sapiens
atctttctccctcaactga

SEQ ID NO: 1835051 - DNA, 23 bp, Homo sapiens
atctttctccctcaactgaaggg

SEQ ID NO: 1835052 - DNA, 14 bp, Homo sapiens
atctttgccaccct

SEQ ID NO: 1835053 - DNA, 23 bp, Homo sapiens
atctttggacagaagcagctctt

SEQ ID NO: 1835054 - DNA, 12 bp, Homo sapiens
atgaaatgcatt

SEQ ID NO: 1835055 - DNA, 15 bp, Homo sapiens
atgaaatgcattttg

SEQ ID NO: 1835056 - DNA, 18 bp, Homo sapiens
atgaacaagagaagcatt

SEQ ID NO: 1835057 - DNA, 15 bp, Homo sapiens
atgaacagctgtgtc

SEQ ID NO: 1835058 - DNA, 21 bp, Homo sapiens
atgaacagctgtgtctgccaa

SEQ ID NO: 1835059 - DNA, 17 bp, Homo sapiens
atgaaccctggcatttg

SEQ ID NO: 1835060 - DNA, 15 bp, Homo sapiens
atgaagcaggaggcc

SEQ ID NO: 1835061 - DNA, 14 bp, Homo sapiens
atgaagtctctgaa

SEQ ID NO: 1835062 - DNA, 19 bp, Homo sapiens
atgaagtttccttggctgg

SEQ ID NO: 1835063 - DNA, 16 bp, Homo sapiens
atgacattcatgcctg

SEQ ID NO: 1835064 - DNA, 15 bp, Homo sapiens
atgaccacactccag

SEQ ID NO: 1835065 - DNA, 18 bp, Homo sapiens
atgaccacactccagctg

SEQ ID NO: 1835066 - DNA, 14 bp, Homo sapiens
atgacccaggctgg

SEQ ID NO: 1835067 - DNA, 15 bp, Homo sapiens
atgacccaggctggg

SEQ ID NO: 1835068 - DNA, 18 bp, Homo sapiens
atgacggtaagtgttctc

SEQ ID NO: 1835069 - DNA, 20 bp, Homo sapiens
atgacggtaagtgttctcat

SEQ ID NO: 1835070 - DNA, 17 bp, Homo sapiens
atgagcatcaggccagg

SEQ ID NO: 1835071 - DNA, 14 bp, Homo sapiens
atgagcatcccagg

SEQ ID NO: 1835072 - DNA, 15 bp, Homo sapiens
atgagcatggagctg

SEQ ID NO: 1835073 - DNA, 14 bp, Homo sapiens
atgagcatgtttag

SEQ ID NO: 1835074 - DNA, 21 bp, Homo sapiens
atgagcatgtttagactttaa

SEQ ID NO: 1835075 - DNA, 13 bp, Homo sapiens
atgagtcccctgt

SEQ ID NO: 1835076 - DNA, 23 bp, Homo sapiens
atgagtcccctgtttgtttctga

SEQ ID NO: 1835077 - DNA, 22 bp, Homo sapiens
attctcagggtctctgctgccg

SEQ ID NO: 1835078 - DNA, 11 bp, Homo sapiens
attctcattgg

SEQ ID NO: 1835079 - DNA, 19 bp, Homo sapiens
attctccacctgccaggga

SEQ ID NO: 1835080 - DNA, 14 bp, Homo sapiens
attcttagcaaaaa

SEQ ID NO: 1835081 - DNA, 22 bp, Homo sapiens
attcttcctccctccctctttc

SEQ ID NO: 1835082 - DNA, 15 bp, Homo sapiens
attctttgttctgtt

SEQ ID NO: 1835083 - DNA, 22 bp, Homo sapiens
attgaagcattttataaatcgc

SEQ ID NO: 1835084 - DNA, 13 bp, Homo sapiens
attgacctgaggc

SEQ ID NO: 1835085 - DNA, 13 bp, Homo sapiens
attgatgttttca

SEQ ID NO: 1835086 - DNA, 21 bp, Homo sapiens
attgcaacctccaccttctgg

SEQ ID NO: 1835087 - DNA, 12 bp, Homo sapiens
attgcaccactg

SEQ ID NO: 1835088 - DNA, 23 bp, Homo sapiens
attgcctttagtgatcacagcag

SEQ ID NO: 1835089 - DNA, 23 bp, Homo sapiens
attggaactctactcaacccatt

SEQ ID NO: 1835090 - DNA, 18 bp, Homo sapiens
attggaatgggcagctca

SEQ ID NO: 1835091 - DNA, 17 bp, Homo sapiens
attggtctcctctcagc

SEQ ID NO: 1835092 - DNA, 15 bp, Homo sapiens
attggttcttgtatt

SEQ ID NO: 1835093 - DNA, 23 bp, Homo sapiens
attgtagtgctttgagagagaaa

SEQ ID NO: 1835094 - DNA, 19 bp, Homo sapiens
attgtccccgacccttgcc

SEQ ID NO: 1835095 - DNA, 21 bp, Homo sapiens
attgtgcaatgtgtataaaca

SEQ ID NO: 1835096 - DNA, 22 bp, Homo sapiens
attgtgcaatgtgtataaacaa

SEQ ID NO: 1835097 - DNA, 12 bp, Homo sapiens
attgtggtgcca

SEQ ID NO: 1835098 - DNA, 21 bp, Homo sapiens
attgtgtctcttggtcctgct

SEQ ID NO: 1835099 - DNA, 13 bp, Homo sapiens
atttaatttgaag

SEQ ID NO: 1835100 - DNA, 22 bp, Homo sapiens
atttaatttgaaggtagaatgt

SEQ ID NO: 1835101 - DNA, 13 bp, Homo sapiens
atttataatcact

SEQ ID NO: 1835102 - DNA, 17 bp, Homo sapiens
atttatgtattgtgcaa

SEQ ID NO: 1835103 - DNA, 18 bp, Homo sapiens
atttatgtattgtgcaat

SEQ ID NO: 1835104 - DNA, 15 bp, Homo sapiens
atttattaaagaaaa

SEQ ID NO: 1835105 - DNA, 22 bp, Homo sapiens
atttattaaagaaaaaaatgta

SEQ ID NO: 1835106 - DNA, 22 bp, Homo sapiens
atttattaaatgcccagcccct

SEQ ID NO: 1835107 - DNA, 13 bp, Homo sapiens
atttattgaaatg

SEQ ID NO: 1835108 - DNA, 21 bp, Homo sapiens
atttatttttctcatgaatct

SEQ ID NO: 1835109 - DNA, 18 bp, Homo sapiens
atttcaaaaacatgcttt

SEQ ID NO: 1835110 - DNA, 17 bp, Homo sapiens
atttcacagtgtgtggt

SEQ ID NO: 1835111 - DNA, 17 bp, Homo sapiens
atttccagccagggctg

SEQ ID NO: 1835112 - DNA, 18 bp, Homo sapiens
atttccagccagggctgc

SEQ ID NO: 1835113 - DNA, 21 bp, Homo sapiens
atttcctcatgtgatcacaat

SEQ ID NO: 1835114 - DNA, 23 bp, Homo sapiens
atttgaaggtagaatgttttcaa

SEQ ID NO: 1835115 - DNA, 17 bp, Homo sapiens
atttgcaaggctgattt

SEQ ID NO: 1835116 - DNA, 21 bp, Homo sapiens
atttgccaagtctcccaatat

SEQ ID NO: 1835117 - DNA, 18 bp, Homo sapiens
atttgcttatttaataaa

SEQ ID NO: 1835118 - DNA, 14 bp, Homo sapiens
atttggtctcaggc

SEQ ID NO: 1835119 - DNA, 21 bp, Homo sapiens
atttggtgcacttttctgtgt

SEQ ID NO: 1835120 - DNA, 22 bp, Homo sapiens
atttggtttggccatctctgga

SEQ ID NO: 1835121 - DNA, 22 bp, Homo sapiens
attttaaaatgaaatgcatttt

SEQ ID NO: 1835122 - DNA, 20 bp, Homo sapiens
attttagatttaccttgtta

SEQ ID NO: 1835123 - DNA, 23 bp, Homo sapiens
attttagtcacacgtggtctttc

SEQ ID NO: 1835124 - DNA, 15 bp, Homo sapiens
attttataaatcgct

SEQ ID NO: 1835125 - DNA, 17 bp, Homo sapiens
attttataaatcgcttt

SEQ ID NO: 1835126 - DNA, 21 bp, Homo sapiens
attttataaatcgcttttgat

SEQ ID NO: 1835127 - DNA, 12 bp, Homo sapiens
attttatgcttt

SEQ ID NO: 1835128 - DNA, 19 bp, Homo sapiens
attttatgctttaaacatt

SEQ ID NO: 1835129 - DNA, 12 bp, Homo sapiens
attttatgttat

SEQ ID NO: 1835130 - DNA, 17 bp, Homo sapiens
attttcatccttgtctt

SEQ ID NO: 1835131 - DNA, 22 bp, Homo sapiens
attttgcacctgcagccaagca

SEQ ID NO: 1835132 - DNA, 20 bp, Homo sapiens
attttgctaaatgtgaatga

SEQ ID NO: 1835133 - DNA, 21 bp, Homo sapiens
attttgctagacagttaaact

SEQ ID NO: 1835134 - DNA, 21 bp, Homo sapiens
attttgtttttgtcttaaaaa

SEQ ID NO: 1835135 - DNA, 22 bp, Homo sapiens
atttttatgtaattatatatac

SEQ ID NO: 1835136 - DNA, 19 bp, Homo sapiens
atttttctaactacaaagg

SEQ ID NO: 1835137 - DNA, 17 bp, Homo sapiens
atttttggcaaagccag

SEQ ID NO: 1835138 - DNA, 19 bp, Homo sapiens
atttttggcaaagccagaa

SEQ ID NO: 1835139 - DNA, 13 bp, Homo sapiens
caaaaaggcagga

SEQ ID NO: 1835140 - DNA, 14 bp, Homo sapiens
caaaaatagctctt

SEQ ID NO: 1835141 - DNA, 17 bp, Homo sapiens
caaaaatagctcttgct

SEQ ID NO: 1835142 - DNA, 15 bp, Homo sapiens
caaaactctcctctg

SEQ ID NO: 1835143 - DNA, 20 bp, Homo sapiens
caaaactctcctctgctgct

SEQ ID NO: 1835144 - DNA, 22 bp, Homo sapiens
caaaagcccattcattccattc

SEQ ID NO: 1835145 - DNA, 24 bp, Homo sapiens
caaacaatagtaattctcaggcca

SEQ ID NO: 1835146 - DNA, 20 bp, Homo sapiens
caaacactgcaggcatcaca

SEQ ID NO: 1835147 - DNA, 14 bp, Homo sapiens
caaacctgcctggg

SEQ ID NO: 1835148 - DNA, 14 bp, Homo sapiens
caaactctttggtc

SEQ ID NO: 1835149 - DNA, 19 bp, Homo sapiens
caaagagattcgaatgacg

SEQ ID NO: 1835150 - DNA, 21 bp, Homo sapiens
caaaggaataacctttctgga

SEQ ID NO: 1835151 - DNA, 21 bp, Homo sapiens
caaaggccatggagagctgga

SEQ ID NO: 1835152 - DNA, 23 bp, Homo sapiens
caaaggccatggagagctggagc

SEQ ID NO: 1835153 - DNA, 23 bp, Homo sapiens
caaaggtttaaatgaacaagaga

SEQ ID NO: 1835154 - DNA, 10 bp, Homo sapiens
caaataaaat

SEQ ID NO: 1835155 - DNA, 12 bp, Homo sapiens
caaataaagtct

SEQ ID NO: 1835156 - DNA, 14 bp, Homo sapiens
caaataaagtctct

SEQ ID NO: 1835157 - DNA, 17 bp, Homo sapiens
caaatagccagtgctag

SEQ ID NO: 1835158 - DNA, 13 bp, Homo sapiens
caaatcaaagcag

SEQ ID NO: 1835159 - DNA, 20 bp, Homo sapiens
caaatcatctgcattcctga

SEQ ID NO: 1835160 - DNA, 13 bp, Homo sapiens
caaatgcagcttt

SEQ ID NO: 1835161 - DNA, 21 bp, Homo sapiens
caaatgccaaattaaaaaaga

SEQ ID NO: 1835162 - DNA, 15 bp, Homo sapiens
caaatgcctgccaaa

SEQ ID NO: 1835163 - DNA, 16 bp, Homo sapiens
caaatgcctgccaaat

SEQ ID NO: 1835164 - DNA, 23 bp, Homo sapiens
caaatggaaatgggcagagcaga

SEQ ID NO: 1835165 - DNA, 21 bp, Homo sapiens
caaatggctacatctccaaat

SEQ ID NO: 1835166 - DNA, 22 bp, Homo sapiens
caaatggctacatctccaaata

SEQ ID NO: 1835167 - DNA, 13 bp, Homo sapiens
caaattgcatttg

SEQ ID NO: 1835168 - DNA, 15 bp, Homo sapiens
caacatactcccatc

SEQ ID NO: 1835169 - DNA, 17 bp, Homo sapiens
caacatactcccatctg

SEQ ID NO: 1835170 - DNA, 22 bp, Homo sapiens
caacatttctcatgttgaaact

SEQ ID NO: 1835171 - DNA, 18 bp, Homo sapiens
caaccagaaacacccctc

SEQ ID NO: 1835172 - DNA, 23 bp, Homo sapiens
caaccagggccccggggcctgtt

SEQ ID NO: 1835173 - DNA, 18 bp, Homo sapiens
caacgtgctctttgtttt

SEQ ID NO: 1835174 - DNA, 20 bp, Homo sapiens
caacgtgctctttgttttgt

SEQ ID NO: 1835175 - DNA, 19 bp, Homo sapiens
caactcctagggccactga

SEQ ID NO: 1835176 - DNA, 23 bp, Homo sapiens
caagaaaaataaagaaaagatgc

SEQ ID NO: 1835177 - DNA, 18 bp, Homo sapiens
caagaaatggcgtctgct

SEQ ID NO: 1835178 - DNA, 21 bp, Homo sapiens
caagaaatggcgtctgctctg

SEQ ID NO: 1835179 - DNA, 13 bp, Homo sapiens
caagaagcccagg

SEQ ID NO: 1835180 - DNA, 14 bp, Homo sapiens
caagaagcccagga

SEQ ID NO: 1835181 - DNA, 18 bp, Homo sapiens
caagaagcccaggaaagg

SEQ ID NO: 1835182 - DNA, 18 bp, Homo sapiens
caagacccttgtggtccc

SEQ ID NO: 1835183 - DNA, 19 bp, Homo sapiens
caagacccttgtggtccca

SEQ ID NO: 1835184 - DNA, 18 bp, Homo sapiens
caagaccttctccttcac

SEQ ID NO: 1835185 - DNA, 21 bp, Homo sapiens
caagaccttctccttcacctt

SEQ ID NO: 1835186 - DNA, 19 bp, Homo sapiens
caagacgctgtgctgccct

SEQ ID NO: 1835187 - DNA, 16 bp, Homo sapiens
caagagcacacttggc

SEQ ID NO: 1835188 - DNA, 20 bp, Homo sapiens
caagattggtgtttttttct

SEQ ID NO: 1835189 - DNA, 19 bp, Homo sapiens
caagcaaatgcctgccaaa

SEQ ID NO: 1835190 - DNA, 22 bp, Homo sapiens
caagcaccaccaaacacagtgt

SEQ ID NO: 1835191 - DNA, 12 bp, Homo sapiens
caagcactgtgc

SEQ ID NO: 1835192 - DNA, 17 bp, Homo sapiens
caagcactgtgctcagg

SEQ ID NO: 1835193 - DNA, 18 bp, Homo sapiens
caagcaggacatggacaa

SEQ ID NO: 1835194 - DNA, 21 bp, Homo sapiens
caagccaccaacatactccca

SEQ ID NO: 1835195 - DNA, 18 bp, Homo sapiens
caagctcaggaccaggca

SEQ ID NO: 1835196 - DNA, 17 bp, Homo sapiens
caagctccaagctccca

SEQ ID NO: 1835197 - DNA, 20 bp, Homo sapiens
ttcctggcactgcttccagt

SEQ ID NO: 1835198 - DNA, 20 bp, Homo sapiens
ttccttcaaagcaaatgtct

SEQ ID NO: 1835199 - DNA, 19 bp, Homo sapiens
ttccttcattcaacccacc

SEQ ID NO: 1835200 - DNA, 20 bp, Homo sapiens
ttccttgagttgattcagct

SEQ ID NO: 1835201 - DNA, 19 bp, Homo sapiens
ttccttgcctgcacaaact

SEQ ID NO: 1835202 - DNA, 13 bp, Homo sapiens
ttccttggctggt

SEQ ID NO: 1835203 - DNA, 15 bp, Homo sapiens
ttcgacactgttctt

SEQ ID NO: 1835204 - DNA, 14 bp, Homo sapiens
ttcgctctttgaga

SEQ ID NO: 1835205 - DNA, 23 bp, Homo sapiens
ttctaaaggagtttatgttccat

SEQ ID NO: 1835206 - DNA, 22 bp, Homo sapiens
ttctaactacaaaggtttaaat

SEQ ID NO: 1835207 - DNA, 13 bp, Homo sapiens
ttctacgccaggg

SEQ ID NO: 1835208 - DNA, 23 bp, Homo sapiens
ttctaggtggcaaggctgtgctc

SEQ ID NO: 1835209 - DNA, 18 bp, Homo sapiens
ttctatgggtgttatcac

SEQ ID NO: 1835210 - DNA, 21 bp, Homo sapiens
ttctatttatttatttattca

SEQ ID NO: 1835211 - DNA, 18 bp, Homo sapiens
ttctcagaaggcaaatga

SEQ ID NO: 1835212 - DNA, 19 bp, Homo sapiens
ttctcagaaggcaaatgac

SEQ ID NO: 1835213 - DNA, 13 bp, Homo sapiens
tttaatataaatg

SEQ ID NO: 1835214 - DNA, 20 bp, Homo sapiens
tttaatataaatgcaaataa

SEQ ID NO: 1835215 - DNA, 22 bp, Homo sapiens
tttaccctttggccccactttg

SEQ ID NO: 1835216 - DNA, 18 bp, Homo sapiens
tttagatgaatgtcagtt

SEQ ID NO: 1835217 - DNA, 12 bp, Homo sapiens
tttagcattgta

SEQ ID NO: 1835218 - DNA, 12 bp, Homo sapiens
tttataagcatc

SEQ ID NO: 1835219 - DNA, 21 bp, Homo sapiens
tttatgttatatataaatata

SEQ ID NO: 1835220 - DNA, 22 bp, Homo sapiens
tttatgttatatataaatatat

SEQ ID NO: 1835221 - DNA, 11 bp, Homo sapiens
tttattaaaga

SEQ ID NO: 1835222 - DNA, 13 bp, Homo sapiens
tttattaaagaaa

SEQ ID NO: 1835223 - DNA, 16 bp, Homo sapiens
tttattaaagaaaaaa

SEQ ID NO: 1835224 - DNA, 15 bp, Homo sapiens
tttcaaaaacatgct

SEQ ID NO: 1835225 - DNA, 14 bp, Homo sapiens
tttcaaatgttctc

SEQ ID NO: 1835226 - DNA, 21 bp, Homo sapiens
tttcatattttagctactata

SEQ ID NO: 1835227 - DNA, 16 bp, Homo sapiens
tttcatttcttctaca

SEQ ID NO: 1835228 - DNA, 23 bp, Homo sapiens
tttcatttcttctacaactcata

SEQ ID NO: 1835229 - DNA, 20 bp, Homo sapiens
tttccaaaacaatttctttt

SEQ ID NO: 1835230 - DNA, 19 bp, Homo sapiens
tttccaggtttaagctgtt

SEQ ID NO: 1835231 - DNA, 18 bp, Homo sapiens
tttccatgagtcccctgt

SEQ ID NO: 1835232 - DNA, 22 bp, Homo sapiens
tttcccccttgaggattgtgga

SEQ ID NO: 1835233 - DNA, 19 bp, Homo sapiens
tttcccggacttagaaaac

SEQ ID NO: 1835234 - DNA, 16 bp, Homo sapiens
tttccctcccagtttt

SEQ ID NO: 1835235 - DNA, 21 bp, Homo sapiens
tttctaaaggagtttatgttc

SEQ ID NO: 1835236 - DNA, 18 bp, Homo sapiens
tttctcatgaatctgcaa

SEQ ID NO: 1835237 - DNA, 15 bp, Homo sapiens
tttctcatgttgaaa

SEQ ID NO: 1835238 - DNA, 19 bp, Homo sapiens
tttctgggatgtcacagtc

SEQ ID NO: 1835239 - DNA, 12 bp, Homo sapiens
tttcttaaataa

SEQ ID NO: 1835240 - DNA, 13 bp, Homo sapiens
tttcttctccctc

SEQ ID NO: 1835241 - DNA, 22 bp, Homo sapiens
tttgaacatgtgccttttctga

SEQ ID NO: 1835242 - DNA, 14 bp, Homo sapiens
tttgacgccatccc

SEQ ID NO: 1835243 - DNA, 16 bp, Homo sapiens
tttgagaaattaagta

SEQ ID NO: 1835244 - DNA, 12 bp, Homo sapiens
tttggaagaagg

SEQ ID NO: 1835245 - DNA, 15 bp, Homo sapiens
tttggaccctgaggc

SEQ ID NO: 1835246 - DNA, 13 bp, Homo sapiens
tttggccccactt

SEQ ID NO: 1835247 - DNA, 13 bp, Homo sapiens
tttgtaaattgtc

SEQ ID NO: 1835248 - DNA, 23 bp, Homo sapiens
tttgtaactgtttagatgaatgt

SEQ ID NO: 1835249 - DNA, 18 bp, Homo sapiens
tttgtagcgtacatcaat

SEQ ID NO: 1835250 - DNA, 13 bp, Homo sapiens
tttgtccccaccg

SEQ ID NO: 1835251 - DNA, 21 bp, Homo sapiens
tttgtccccaccgcagacagg

SEQ ID NO: 1835252 - DNA, 16 bp, Homo sapiens
tttgtgatgcatttta

SEQ ID NO: 1835253 - DNA, 16 bp, Homo sapiens
tttgtgctccattttt

SEQ ID NO: 1835254 - DNA, 20 bp, Homo sapiens
tttgtgtctcttatggatgt

SEQ ID NO: 1835255 - DNA, 14 bp, Homo sapiens
tttgttttgtgtct

SEQ ID NO: 1835256 - DNA, 21 bp, Homo sapiens
ttttatgacttcattaataat

SEQ ID NO: 1835257 - DNA, 19 bp, Homo sapiens
ttttccatgagtcccctgt

SEQ ID NO: 1835258 - DNA, 18 bp, Homo sapiens
ttttccctattagagaag

SEQ ID NO: 1835259 - DNA, 16 bp, Homo sapiens
ttttcctcctgagtgc

SEQ ID NO: 1835260 - DNA, 14 bp, Homo sapiens
ttttcttaaataat

SEQ ID NO: 1835261 - DNA, 17 bp, Homo sapiens
ttttcttgcatgaggct

SEQ ID NO: 1835262 - DNA, 13 bp, Homo sapiens
ttttgaaatgtca

SEQ ID NO: 1835263 - DNA, 21 bp, Homo sapiens
ttttgaagattctatgttaat

SEQ ID NO: 1835264 - DNA, 20 bp, Homo sapiens
ttttgcacctgcagccaagc

SEQ ID NO: 1835265 - DNA, 16 bp, Homo sapiens
ttttggttgctttaat

SEQ ID NO: 1835266 - DNA, 21 bp, Homo sapiens
ttttgtgtctcttatggatgt

SEQ ID NO: 1835267 - DNA, 21 bp, Homo sapiens
tttttccacataaggaaactg

SEQ ID NO: 1835268 - DNA, 14 bp, Homo sapiens
tttttctaaaggag

SEQ ID NO: 1835269 - DNA, 15 bp, Homo sapiens
tttttctaactacaa

SEQ ID NO: 1835270 - DNA, 19 bp, Homo sapiens
tttttctcatgaatctgca

SEQ ID NO: 1835271 - DNA, 13 bp, Homo sapiens
tttttcttccctt

SEQ ID NO: 1835272 - DNA, 13 bp, Homo sapiens
tgcccagctctct

SEQ ID NO: 1835273 - DNA, 14 bp, Homo sapiens
tgcccagctctctg

SEQ ID NO: 1835274 - DNA, 16 bp, Homo sapiens
tgcccagctctctgac

SEQ ID NO: 1835275 - DNA, 18 bp, Homo sapiens
tgcccagctctctgacgc

SEQ ID NO: 1835276 - DNA, 23 bp, Homo sapiens
tgccctgtgagtactacagtcct

SEQ ID NO: 1835277 - DNA, 15 bp, Homo sapiens
tgccctgtgggcccc

SEQ ID NO: 1835278 - DNA, 12 bp, Homo sapiens
tgccgcaccagc

SEQ ID NO: 1835279 - DNA, 19 bp, Homo sapiens
tgcctaaggctgaacttgt

SEQ ID NO: 1835280 - DNA, 21 bp, Homo sapiens
tgcctcattttagaaccacca

SEQ ID NO: 1835281 - DNA, 13 bp, Homo sapiens
tgcctcccatcac

SEQ ID NO: 1835282 - DNA, 14 bp, Homo sapiens
tgcctcccatcacc

SEQ ID NO: 1835283 - DNA, 22 bp, Homo sapiens
tgcctcccatcacccgctaaga

SEQ ID NO: 1835284 - DNA, 16 bp, Homo sapiens
tgcctcccttcatgca

SEQ ID NO: 1835285 - DNA, 19 bp, Homo sapiens
tgcctccgcctcagtaaga

SEQ ID NO: 1835286 - DNA, 16 bp, Homo sapiens
tgcctcctttgtgagg

SEQ ID NO: 1835287 - DNA, 16 bp, Homo sapiens
tgcctcttccagtgaa

SEQ ID NO: 1835288 - DNA, 18 bp, Homo sapiens
tgcctcttccagtgaaca

SEQ ID NO: 1835289 - DNA, 21 bp, Homo sapiens
tgcctcttctctactctaggg

SEQ ID NO: 1835290 - DNA, 16 bp, Homo sapiens
tgcctgagtgcctggc

SEQ ID NO: 1835291 - DNA, 15 bp, Homo sapiens
tgcctgattgccaag

SEQ ID NO: 1835292 - DNA, 17 bp, Homo sapiens
tgcctgcacaaactcac

SEQ ID NO: 1835293 - DNA, 15 bp, Homo sapiens
tgcctgccctggtga

SEQ ID NO: 1835294 - DNA, 18 bp, Homo sapiens
tgcctgtgaactgaactc

SEQ ID NO: 1835295 - DNA, 18 bp, Homo sapiens
tgccttggaagttgcatg

SEQ ID NO: 1835296 - DNA, 13 bp, Homo sapiens
tgcctttgacctg

SEQ ID NO: 1835297 - DNA, 13 bp, Homo sapiens
tgcgaaaggatga

SEQ ID NO: 1835298 - DNA, 19 bp, Homo sapiens
tgcgaaaggatgaaagtga

SEQ ID NO: 1835299 - DNA, 17 bp, Homo sapiens
tgcgcgcacaatagtaa

SEQ ID NO: 1835300 - DNA, 13 bp, Homo sapiens
tgcggagaacaaa

SEQ ID NO: 1835301 - DNA, 19 bp, Homo sapiens
tgcggcctttggcttcacg

SEQ ID NO: 1835302 - DNA, 17 bp, Homo sapiens
tgcggtgctatctcccc

SEQ ID NO: 1835303 - DNA, 13 bp, Homo sapiens
tgcgtctccagtc

SEQ ID NO: 1835304 - DNA, 15 bp, Homo sapiens
tgcgtctccagtcat

SEQ ID NO: 1835305 - DNA, 14 bp, Homo sapiens
tgcgtgttcagcag

SEQ ID NO: 1835306 - DNA, 16 bp, Homo sapiens
tgcgtgttcagcagaa

SEQ ID NO: 1835307 - DNA, 18 bp, Homo sapiens
tgcgtgttcagcagaacc

SEQ ID NO: 1835308 - DNA, 17 bp, Homo sapiens
tgcgttccatgatgctg

SEQ ID NO: 1835309 - DNA, 15 bp, Homo sapiens
tgctaaatgtgaatg

SEQ ID NO: 1835310 - DNA, 16 bp, Homo sapiens
tgctaagcattagctt

SEQ ID NO: 1835311 - DNA, 18 bp, Homo sapiens
tgctaatattttcctcct

SEQ ID NO: 1835312 - DNA, 21 bp, Homo sapiens
tgctaattttattatagtaat

SEQ ID NO: 1835313 - DNA, 16 bp, Homo sapiens
tgctaggaacactcct

SEQ ID NO: 1835314 - DNA, 20 bp, Homo sapiens
tgctaggaacactccttcac

SEQ ID NO: 1835315 - DNA, 21 bp, Homo sapiens
tgctaggaacactccttcaca

SEQ ID NO: 1835316 - DNA, 22 bp, Homo sapiens
tgctaggaacactccttcacag

SEQ ID NO: 1835317 - DNA, 14 bp, Homo sapiens
tgctatctccccca

SEQ ID NO: 1835318 - DNA, 17 bp, Homo sapiens
tgctatctcccccagcc

SEQ ID NO: 1835319 - DNA, 19 bp, Homo sapiens
tgctatctcccccagcccc

SEQ ID NO: 1835320 - DNA, 16 bp, Homo sapiens
tgctccagattctgat

SEQ ID NO: 1835321 - DNA, 18 bp, Homo sapiens
tgctccagattctgatgc

SEQ ID NO: 1835322 - DNA, 21 bp, Homo sapiens
tgctccagctgttcagctggt

SEQ ID NO: 1835323 - DNA, 15 bp, Homo sapiens
tgctccccaggccac

SEQ ID NO: 1835324 - DNA, 18 bp, Homo sapiens
tgctccccaggccacccc

SEQ ID NO: 1835325 - DNA, 21 bp, Homo sapiens
tgctcctggatctccctgaga

SEQ ID NO: 1835326 - DNA, 18 bp, Homo sapiens
tgctctgatgaagaggag

SEQ ID NO: 1835327 - DNA, 14 bp, Homo sapiens
tgctctttgttttg

SEQ ID NO: 1835328 - DNA, 22 bp, Homo sapiens
tgctctttgttttgtgtctctt

SEQ ID NO: 1835329 - DNA, 12 bp, Homo sapiens
tgctgaaggctc

SEQ ID NO: 1835330 - DNA, 13 bp, Homo sapiens
tgctgaaggctcg

SEQ ID NO: 1835331 - DNA, 21 bp, Homo sapiens
tgctgaaggctcgagcatgcc

SEQ ID NO: 1835332 - DNA, 18 bp, Homo sapiens
tgctgaatacagaggcaa

SEQ ID NO: 1835333 - DNA, 14 bp, Homo sapiens
tgctgacatcattt

SEQ ID NO: 1835334 - DNA, 15 bp, Homo sapiens
tgctgacatcatttg

SEQ ID NO: 1835335 - DNA, 17 bp, Homo sapiens
tgctgacatcatttgta

SEQ ID NO: 1835336 - DNA, 16 bp, Homo sapiens
tgctgactgttttctc

SEQ ID NO: 1835337 - DNA, 21 bp, Homo sapiens
tgctgactgttttctcttgag

SEQ ID NO: 1835338 - DNA, 24 bp, Homo sapiens
tgctgactgttttctcttgagagg

SEQ ID NO: 1835339 - DNA, 14 bp, Homo sapiens
tgctgagtctgaag

SEQ ID NO: 1835340 - DNA, 23 bp, Homo sapiens
tgctgagtctgaaggctgggttc

SEQ ID NO: 1835341 - DNA, 16 bp, Homo sapiens
tgctgcagttgccagt

SEQ ID NO: 1835342 - DNA, 18 bp, Homo sapiens
tgcttccagtgaggctct

SEQ ID NO: 1835343 - DNA, 20 bp, Homo sapiens
tgcttccagtgaggctctgc

SEQ ID NO: 1835344 - DNA, 23 bp, Homo sapiens
tgcttccagtgaggctctgccct

SEQ ID NO: 1835345 - DNA, 12 bp, Homo sapiens
tgcttctcactg

SEQ ID NO: 1835346 - DNA, 15 bp, Homo sapiens
tgcttgagctcagga

SEQ ID NO: 1835347 - DNA, 17 bp, Homo sapiens
tgcttgccacagagcgg

SEQ ID NO: 1835348 - DNA, 14 bp, Homo sapiens
tgcttggaggaagg

SEQ ID NO: 1835349 - DNA, 14 bp, Homo sapiens
tgcttgttaactga

SEQ ID NO: 1835350 - DNA, 21 bp, Homo sapiens
tgctttaatataaatgcaaat

SEQ ID NO: 1835351 - DNA, 22 bp, Homo sapiens
tgctttaatataaatgcaaata

SEQ ID NO: 1835352 - DNA, 13 bp, Homo sapiens
tgctttaatatca

SEQ ID NO: 1835353 - DNA, 20 bp, Homo sapiens
tgctttaatatcatcagtat

SEQ ID NO: 1835354 - DNA, 13 bp, Homo sapiens
tgctttgcccagc

SEQ ID NO: 1835355 - DNA, 20 bp, Homo sapiens
tggaaaaatagcctgcctct

SEQ ID NO: 1835356 - DNA, 22 bp, Homo sapiens
tggaaacagctcgactttaaaa

SEQ ID NO: 1835357 - DNA, 14 bp, Homo sapiens
tggaaatacacagt

SEQ ID NO: 1835358 - DNA, 15 bp, Homo sapiens
tggaaatacacagtg

SEQ ID NO: 1835359 - DNA, 22 bp, Homo sapiens
tggaaattcccttcatctggaa

SEQ ID NO: 1835360 - DNA, 17 bp, Homo sapiens
tggaaatttagcattgt

SEQ ID NO: 1835361 - DNA, 21 bp, Homo sapiens
tggaacatcatcaaggcactg

SEQ ID NO: 1835362 - DNA, 11 bp, Homo sapiens
tggaagacaca

SEQ ID NO: 1835363 - DNA, 13 bp, Homo sapiens
tggaagacagaga

SEQ ID NO: 1835364 - DNA, 19 bp, Homo sapiens
tggaaggatctgctgaggc

SEQ ID NO: 1835365 - DNA, 21 bp, Homo sapiens
tggaaggatctgctgaggccc

SEQ ID NO: 1835366 - DNA, 23 bp, Homo sapiens
tggaaggatctgctgaggcccag

SEQ ID NO: 1835367 - DNA, 15 bp, Homo sapiens
tggaagtgactttgg

SEQ ID NO: 1835368 - DNA, 23 bp, Homo sapiens
tggaagtgactttggctgcatgc

SEQ ID NO: 1835369 - DNA, 18 bp, Homo sapiens
tggacagaagcagctctt

SEQ ID NO: 1835370 - DNA, 12 bp, Homo sapiens
tggacatggccc

SEQ ID NO: 1835371 - DNA, 17 bp, Homo sapiens
tggacatggcccctgtg

SEQ ID NO: 1835372 - DNA, 13 bp, Homo sapiens
tggacattttatg

SEQ ID NO: 1835373 - DNA, 16 bp, Homo sapiens
tggacattttatgtct

SEQ ID NO: 1835374 - DNA, 13 bp, Homo sapiens
tggaccctgaggc

SEQ ID NO: 1835375 - DNA, 15 bp, Homo sapiens
tggaccctgaggccc

SEQ ID NO: 1835376 - DNA, 18 bp, Homo sapiens
tggaccctgaggcccaga

SEQ ID NO: 1835377 - DNA, 20 bp, Homo sapiens
tggaccctgaggcccagagg

SEQ ID NO: 1835378 - DNA, 14 bp, Homo sapiens
tggacggtgctcca

SEQ ID NO: 1835379 - DNA, 16 bp, Homo sapiens
tggacggtgctccagg

SEQ ID NO: 1835380 - DNA, 18 bp, Homo sapiens
tggacggtgctccaggca

SEQ ID NO: 1835381 - DNA, 20 bp, Homo sapiens
tggacggtgctccaggcagg

SEQ ID NO: 1835382 - DNA, 13 bp, Homo sapiens
tggagaagcggct

SEQ ID NO: 1835383 - DNA, 18 bp, Homo sapiens
tggagacaccaccaccct

SEQ ID NO: 1835384 - DNA, 19 bp, Homo sapiens
tggagactcctaggcagga

SEQ ID NO: 1835385 - DNA, 13 bp, Homo sapiens
tggagagctggag

SEQ ID NO: 1835386 - DNA, 15 bp, Homo sapiens
tggagagctggagcc

SEQ ID NO: 1835387 - DNA, 20 bp, Homo sapiens
tggagagctggagcctggtg

SEQ ID NO: 1835388 - DNA, 20 bp, Homo sapiens
tggagaggcccggcctctca

SEQ ID NO: 1835389 - DNA, 14 bp, Homo sapiens
tggagccccacctt

SEQ ID NO: 1835390 - DNA, 19 bp, Homo sapiens
tggagccccaccttgtctg

SEQ ID NO: 1835391 - DNA, 22 bp, Homo sapiens
tggagccccaccttgtctgcta

SEQ ID NO: 1835392 - DNA, 13 bp, Homo sapiens
tggagcctggtgc

SEQ ID NO: 1835393 - DNA, 12 bp, Homo sapiens
tggaggaaggaa

SEQ ID NO: 1835394 - DNA, 18 bp, Homo sapiens
tggaggaaggaaacccag

SEQ ID NO: 1835395 - DNA, 16 bp, Homo sapiens
tggaggagcaaaggct

SEQ ID NO: 1835396 - DNA, 21 bp, Homo sapiens
tggaggagcagtgcaggcaca

SEQ ID NO: 1835397 - DNA, 16 bp, Homo sapiens
tgagttgattcagctc

SEQ ID NO: 1835398 - DNA, 23 bp, Homo sapiens
tgagtttgggccccagaggctgg

SEQ ID NO: 1835399 - DNA, 20 bp, Homo sapiens
tgatacaaattgcagactgt

SEQ ID NO: 1835400 - DNA, 20 bp, Homo sapiens
tgatacttcgacactgttct

SEQ ID NO: 1835401 - DNA, 13 bp, Homo sapiens
tgatagcacagac

SEQ ID NO: 1835402 - DNA, 14 bp, Homo sapiens
tgatagcacagacc

SEQ ID NO: 1835403 - DNA, 15 bp, Homo sapiens
tgatagcacagaccc

SEQ ID NO: 1835404 - DNA, 23 bp, Homo sapiens
tgatagcacagaccctgccctgt

SEQ ID NO: 1835405 - DNA, 23 bp, Homo sapiens
tgatatttccctcccctggggac

SEQ ID NO: 1835406 - DNA, 16 bp, Homo sapiens
tgatcctagttccacc

SEQ ID NO: 1835407 - DNA, 19 bp, Homo sapiens
tgatctaggaagactttgg

SEQ ID NO: 1835408 - DNA, 22 bp, Homo sapiens
tgatctcatttaatcctctcaa

SEQ ID NO: 1835409 - DNA, 14 bp, Homo sapiens
tgatgaccaatggg

SEQ ID NO: 1835410 - DNA, 16 bp, Homo sapiens
tgatgatgtgcctggg

SEQ ID NO: 1835411 - DNA, 11 bp, Homo sapiens
tgatgcatttt

SEQ ID NO: 1835412 - DNA, 14 bp, Homo sapiens
tgatgcattttata

SEQ ID NO: 1835413 - DNA, 21 bp, Homo sapiens
tgatgccaagttgtttgagaa

SEQ ID NO: 1835414 - DNA, 21 bp, Homo sapiens
tgatgcctgtgaactgaactc

SEQ ID NO: 1835415 - DNA, 16 bp, Homo sapiens
tgatgcttcttcagag

SEQ ID NO: 1835416 - DNA, 23 bp, Homo sapiens
tgatgcttcttcagagactcctg

SEQ ID NO: 1835417 - DNA, 16 bp, Homo sapiens
tgatggagccccacct

SEQ ID NO: 1835418 - DNA, 23 bp, Homo sapiens
tgatgttttccatgagtcccctg

SEQ ID NO: 1835419 - DNA, 22 bp, Homo sapiens
tgattcacccccaaacagtgac

SEQ ID NO: 1835420 - DNA, 12 bp, Homo sapiens
tgattctcaggg

SEQ ID NO: 1835421 - DNA, 21 bp, Homo sapiens
tgattcttagcaaaaaatgaa

SEQ ID NO: 1835422 - DNA, 22 bp, Homo sapiens
tgattcttagcaaaaaatgaac

SEQ ID NO: 1835423 - DNA, 21 bp, Homo sapiens
tgattggaggggggaggtggg

SEQ ID NO: 1835424 - DNA, 19 bp, Homo sapiens
tgatttaggtcagtagact

SEQ ID NO: 1835425 - DNA, 18 bp, Homo sapiens
tgatttgggctctagaat

SEQ ID NO: 1835426 - DNA, 13 bp, Homo sapiens
tgattttcattgc

SEQ ID NO: 1835427 - DNA, 14 bp, Homo sapiens
tgatttttaaatta

SEQ ID NO: 1835428 - DNA, 13 bp, Homo sapiens
tgcaaaggctggg

SEQ ID NO: 1835429 - DNA, 14 bp, Homo sapiens
tgcaaaggctggga

SEQ ID NO: 1835430 - DNA, 22 bp, Homo sapiens
tgcaaagtcatgcaaaggctgg

SEQ ID NO: 1835431 - DNA, 19 bp, Homo sapiens
tgcaacactcaagtctatt

SEQ ID NO: 1835432 - DNA, 21 bp, Homo sapiens
tgcaacctccaccttctgggt

SEQ ID NO: 1835433 - DNA, 22 bp, Homo sapiens
tgcaatatttcctcatgtgatc

SEQ ID NO: 1835434 - DNA, 15 bp, Homo sapiens
tgcaatgaagtctct

SEQ ID NO: 1835435 - DNA, 16 bp, Homo sapiens
tgcaatgtgtataaac

SEQ ID NO: 1835436 - DNA, 20 bp, Homo sapiens
tgcaatgtgtataaacaaga

SEQ ID NO: 1835437 - DNA, 21 bp, Homo sapiens
tgcaatgtgtataaacaagaa

SEQ ID NO: 1835438 - DNA, 16 bp, Homo sapiens
tgcacaagctccaagc

SEQ ID NO: 1835439 - DNA, 22 bp, Homo sapiens
tgcacaagctccaagctcccag

SEQ ID NO: 1835440 - DNA, 23 bp, Homo sapiens
tgcacaagctccaagctcccagg

SEQ ID NO: 1835441 - DNA, 15 bp, Homo sapiens
tgcacaagctgcacc

SEQ ID NO: 1835442 - DNA, 18 bp, Homo sapiens
tgcacaagctgcaccctc

SEQ ID NO: 1835443 - DNA, 12 bp, Homo sapiens
tgcacacaggac

SEQ ID NO: 1835444 - DNA, 16 bp, Homo sapiens
tgcacacaggacagcg

SEQ ID NO: 1835445 - DNA, 17 bp, Homo sapiens
tgcacaggaagctgaga

SEQ ID NO: 1835446 - DNA, 17 bp, Homo sapiens
tgcacatctgttttgta

SEQ ID NO: 1835447 - DNA, 17 bp, Homo sapiens
tgcacccacccaggagt

SEQ ID NO: 1835448 - DNA, 18 bp, Homo sapiens
tgcacccacccaggagtg

SEQ ID NO: 1835449 - DNA, 21 bp, Homo sapiens
tgcacccacctgttttctgaa

SEQ ID NO: 1835450 - DNA, 17 bp, Homo sapiens
tgcaccctcaggcaggt

SEQ ID NO: 1835451 - DNA, 13 bp, Homo sapiens
tgcacctgcagcc

SEQ ID NO: 1835452 - DNA, 17 bp, Homo sapiens
tgcacctgcagccaagc

SEQ ID NO: 1835453 - DNA, 15 bp, Homo sapiens
tgcacggctgctgag

SEQ ID NO: 1835454 - DNA, 22 bp, Homo sapiens
tgcacttatttatgaacctgcc

SEQ ID NO: 1835455 - DNA, 20 bp, Homo sapiens
tgcactttgctttaatataa

SEQ ID NO: 1835456 - DNA, 14 bp, Homo sapiens
tgcactttgttctg

SEQ ID NO: 1835457 - DNA, 19 bp, Homo sapiens
tgcactttgttctggctct

SEQ ID NO: 1835458 - DNA, 20 bp, Homo sapiens
tgcactttgttctggctctt

SEQ ID NO: 1835459 - DNA, 15 bp, Homo sapiens
tgcacttttctgtgt

SEQ ID NO: 1835460 - DNA, 14 bp, Homo sapiens
tgcagacctcatgc

SEQ ID NO: 1835461 - DNA, 15 bp, Homo sapiens
tgcagacctcatgcc

SEQ ID NO: 1835462 - DNA, 23 bp, Homo sapiens
tgcagagggctccagagtggaga

SEQ ID NO: 1835463 - DNA, 16 bp, Homo sapiens
tgcagatttgggctgg

SEQ ID NO: 1835464 - DNA, 17 bp, Homo sapiens
tgcagatttgggctgga

SEQ ID NO: 1835465 - DNA, 13 bp, Homo sapiens
tgcagctgctccc

SEQ ID NO: 1835466 - DNA, 14 bp, Homo sapiens
tgcaggacctcagg

SEQ ID NO: 1835467 - DNA, 13 bp, Homo sapiens
tgcaggaggtgga

SEQ ID NO: 1835468 - DNA, 14 bp, Homo sapiens
tgcaggaggtggag

SEQ ID NO: 1835469 - DNA, 13 bp, Homo sapiens
tgcaggcagccag

SEQ ID NO: 1835470 - DNA, 14 bp, Homo sapiens
tgcaggcagccagg

SEQ ID NO: 1835471 - DNA, 15 bp, Homo sapiens
tgcaggcagccaggc

SEQ ID NO: 1835472 - DNA, 16 bp, Homo sapiens
tgcaggcatcacagct

SEQ ID NO: 1835473 - DNA, 13 bp, Homo sapiens
tgcagtcccaagc

SEQ ID NO: 1835474 - DNA, 20 bp, Homo sapiens
tgcagtgtggagttcacctt

SEQ ID NO: 1835475 - DNA, 13 bp, Homo sapiens
tgcagttgccagt

SEQ ID NO: 1835476 - DNA, 19 bp, Homo sapiens
tgcagtttgagacaggaga

SEQ ID NO: 1835477 - DNA, 20 bp, Homo sapiens
tgcataggtgatctcattta

SEQ ID NO: 1835478 - DNA, 14 bp, Homo sapiens
tgcatatgcaatgt

SEQ ID NO: 1835479 - DNA, 15 bp, Homo sapiens
tgcatcgtttcatct

SEQ ID NO: 1835480 - DNA, 17 bp, Homo sapiens
tgcatcgtttcatcttc

SEQ ID NO: 1835481 - DNA, 23 bp, Homo sapiens
tgcatggaaattcccttcatctg

SEQ ID NO: 1835482 - DNA, 20 bp, Homo sapiens
tgcattcttggttggctggc

SEQ ID NO: 1835483 - DNA, 20 bp, Homo sapiens
tgccaacactcaagaagcag

SEQ ID NO: 1835484 - DNA, 21 bp, Homo sapiens
tgccaacactcaagaagcagg

SEQ ID NO: 1835485 - DNA, 21 bp, Homo sapiens
tgccaacttcttcagagctga

SEQ ID NO: 1835486 - DNA, 14 bp, Homo sapiens
tgccaagctcagga

SEQ ID NO: 1835487 - DNA, 22 bp, Homo sapiens
tgccaagctcaggaccaggcaa

SEQ ID NO: 1835488 - DNA, 15 bp, Homo sapiens
tgccaagttgtttga

SEQ ID NO: 1835489 - DNA, 20 bp, Homo sapiens
tgccaagttgtttgagaaat

SEQ ID NO: 1835490 - DNA, 17 bp, Homo sapiens
tgccaccctcatgctgt

SEQ ID NO: 1835491 - DNA, 20 bp, Homo sapiens
tgccaggagcacggctctgt

SEQ ID NO: 1835492 - DNA, 14 bp, Homo sapiens
tgccaggcatggtg

SEQ ID NO: 1835493 - DNA, 18 bp, Homo sapiens
tgccagtcaccccggcca

SEQ ID NO: 1835494 - DNA, 22 bp, Homo sapiens
tgccagtcaccccggccacctg

SEQ ID NO: 1835495 - DNA, 19 bp, Homo sapiens
tgccatcctcaaacactgc

SEQ ID NO: 1835496 - DNA, 14 bp, Homo sapiens
tgcccacctggcct

SEQ ID NO: 1835497 - DNA, 13 bp, Homo sapiens
tgcccactccctg

SEQ ID NO: 1835498 - DNA, 15 bp, Homo sapiens
tgcccactccctgca

SEQ ID NO: 1835499 - DNA, 21 bp, Homo sapiens
tgcccactccctgcaacctga

SEQ ID NO: 1835500 - DNA, 13 bp, Homo sapiens
tgcccagcccctt

SEQ ID NO: 1835501 - DNA, 16 bp, Homo sapiens
tgcccagccccttctg

SEQ ID NO: 1835502 - DNA, 18 bp, Homo sapiens
cctttgacgccatcccag

SEQ ID NO: 1835503 - DNA, 21 bp, Homo sapiens
cctttgacgccatcccagccc

SEQ ID NO: 1835504 - DNA, 18 bp, Homo sapiens
cctttggcaggtgcagcc

SEQ ID NO: 1835505 - DNA, 20 bp, Homo sapiens
cctttggcaggtgcagcccc

SEQ ID NO: 1835506 - DNA, 14 bp, Homo sapiens
cctttgtccccacc

SEQ ID NO: 1835507 - DNA, 16 bp, Homo sapiens
cctttgtccccaccgc

SEQ ID NO: 1835508 - DNA, 22 bp, Homo sapiens
cctttgtccccaccgcagacag

SEQ ID NO: 1835509 - DNA, 23 bp, Homo sapiens
cctttgtccccaccgcagacagg

SEQ ID NO: 1835510 - DNA, 17 bp, Homo sapiens
cctttgtgaggaagccg

SEQ ID NO: 1835511 - DNA, 20 bp, Homo sapiens
ccttttcgcaggattcttcc

SEQ ID NO: 1835512 - DNA, 17 bp, Homo sapiens
cctttttcactttgaaa

SEQ ID NO: 1835513 - DNA, 22 bp, Homo sapiens
ccttttttggctgctgaaggct

SEQ ID NO: 1835514 - DNA, 14 bp, Homo sapiens
cgaatgggttttct

SEQ ID NO: 1835515 - DNA, 20 bp, Homo sapiens
cgagattgcaccactgcact

SEQ ID NO: 1835516 - DNA, 15 bp, Homo sapiens
cgagtgctcatttca

SEQ ID NO: 1835517 - DNA, 22 bp, Homo sapiens
cgcacaatagtaacctgggtaa

SEQ ID NO: 1835518 - DNA, 14 bp, Homo sapiens
cgcagacaggacca

SEQ ID NO: 1835519 - DNA, 14 bp, Homo sapiens
cgcaggcccctctc

SEQ ID NO: 1835520 - DNA, 19 bp, Homo sapiens
cgcaggcccctctcctccg

SEQ ID NO: 1835521 - DNA, 16 bp, Homo sapiens
cgcagggccatgcaga

SEQ ID NO: 1835522 - DNA, 18 bp, Homo sapiens
cgcagggccatgcagacc

SEQ ID NO: 1835523 - DNA, 23 bp, Homo sapiens
cgccaaggctgggggaagaagct

SEQ ID NO: 1835524 - DNA, 16 bp, Homo sapiens
cgccatcccagcccca

SEQ ID NO: 1835525 - DNA, 20 bp, Homo sapiens
cgccatcccagccccaatga

SEQ ID NO: 1835526 - DNA, 17 bp, Homo sapiens
cgccatgctcctggccc

SEQ ID NO: 1835527 - DNA, 21 bp, Homo sapiens
cgctacccgggaagggggctg

SEQ ID NO: 1835528 - DNA, 24 bp, Homo sapiens
cgctacccgggaagggggctggga

SEQ ID NO: 1835529 - DNA, 20 bp, Homo sapiens
cgctgatggagccccacctt

SEQ ID NO: 1835530 - DNA, 23 bp, Homo sapiens
cgctggccgggaccccgagcctg

SEQ ID NO: 1835531 - DNA, 20 bp, Homo sapiens
cgctggggccagttggtccc

SEQ ID NO: 1835532 - DNA, 11 bp, Homo sapiens
cgctgtgctgc

SEQ ID NO: 1835533 - DNA, 15 bp, Homo sapiens
cgctgtgctgccctg

SEQ ID NO: 1835534 - DNA, 17 bp, Homo sapiens
cgcttgtgacagtgcct

SEQ ID NO: 1835535 - DNA, 19 bp, Homo sapiens
cgcttgtgacagtgcctct

SEQ ID NO: 1835536 - DNA, 11 bp, Homo sapiens
cggccacctgc

SEQ ID NO: 1835537 - DNA, 16 bp, Homo sapiens
cggccacctgcggtgc

SEQ ID NO: 1835538 - DNA, 15 bp, Homo sapiens
cggcctttggcttca

SEQ ID NO: 1835539 - DNA, 14 bp, Homo sapiens
cggctggcagccca

SEQ ID NO: 1835540 - DNA, 13 bp, Homo sapiens
cggctggcctggc

SEQ ID NO: 1835541 - DNA, 16 bp, Homo sapiens
cggctggcctggcccc

SEQ ID NO: 1835542 - DNA, 18 bp, Homo sapiens
cggctggcctggcccctc

SEQ ID NO: 1835543 - DNA, 22 bp, Homo sapiens
cggctggcctggcccctcaggg

SEQ ID NO: 1835544 - DNA, 16 bp, Homo sapiens
cggctggggtcccagc

SEQ ID NO: 1835545 - DNA, 19 bp, Homo sapiens
cgggaagggggctgggaca

SEQ ID NO: 1835546 - DNA, 21 bp, Homo sapiens
cgggagaggggacgcaggccc

SEQ ID NO: 1835547 - DNA, 15 bp, Homo sapiens
cgggcctgtccacag

SEQ ID NO: 1835548 - DNA, 16 bp, Homo sapiens
cgggcctgtccacagg

SEQ ID NO: 1835549 - DNA, 17 bp, Homo sapiens
cgggcctgtccacaggc

SEQ ID NO: 1835550 - DNA, 12 bp, Homo sapiens
cgggctctgcct

SEQ ID NO: 1835551 - DNA, 13 bp, Homo sapiens
cggggcagccccc

SEQ ID NO: 1835552 - DNA, 14 bp, Homo sapiens
cggggtcaggttct

SEQ ID NO: 1835553 - DNA, 23 bp, Homo sapiens
cggtgctatctcccccagcccca

SEQ ID NO: 1835554 - DNA, 13 bp, Homo sapiens
cggtgctccaggc

SEQ ID NO: 1835555 - DNA, 20 bp, Homo sapiens
cggtggctcacgcctgtaat

SEQ ID NO: 1835556 - DNA, 18 bp, Homo sapiens
cggtgtggagaagcggct

SEQ ID NO: 1835557 - DNA, 16 bp, Homo sapiens
cggttttactgcagct

SEQ ID NO: 1835558 - DNA, 19 bp, Homo sapiens
cgtccacagagtataaata

SEQ ID NO: 1835559 - DNA, 14 bp, Homo sapiens
cgtctacctgaggg

SEQ ID NO: 1835560 - DNA, 16 bp, Homo sapiens
cgtctacctgaggggc

SEQ ID NO: 1835561 - DNA, 16 bp, Homo sapiens
cgtctcatactcacct

SEQ ID NO: 1835562 - DNA, 12 bp, Homo sapiens
cgtctgctctgg

SEQ ID NO: 1835563 - DNA, 19 bp, Homo sapiens
cgtgactggcctgctggat

SEQ ID NO: 1835564 - DNA, 20 bp, Homo sapiens
cgtgagctgagcaggccaca

SEQ ID NO: 1835565 - DNA, 22 bp, Homo sapiens
cgtggaggagcagtgcaggcac

SEQ ID NO: 1835566 - DNA, 17 bp, Homo sapiens
cgtggcacctcttccga

SEQ ID NO: 1835567 - DNA, 18 bp, Homo sapiens
cgtgggatggcatttggt

SEQ ID NO: 1835568 - DNA, 17 bp, Homo sapiens
cgtgttcagcagaacct

SEQ ID NO: 1835569 - DNA, 18 bp, Homo sapiens
cgttctaggtaggaagag

SEQ ID NO: 1835570 - DNA, 20 bp, Homo sapiens
cgttctaggtaggaagagcc

SEQ ID NO: 1835571 - DNA, 12 bp, Homo sapiens
cgttgtgagctg

SEQ ID NO: 1835572 - DNA, 14 bp, Homo sapiens
cgttgtgagctgga

SEQ ID NO: 1835573 - DNA, 11 bp, Homo sapiens
cgtttgtgttc

SEQ ID NO: 1835574 - DNA, 20 bp, Homo sapiens
cgtttgtgttctgttttgtt

SEQ ID NO: 1835575 - DNA, 14 bp, Homo sapiens
ctaaactttcacac

SEQ ID NO: 1835576 - DNA, 13 bp, Homo sapiens
ctaaaggagttta

SEQ ID NO: 1835577 - DNA, 16 bp, Homo sapiens
ctaacacacagctccc

SEQ ID NO: 1835578 - DNA, 19 bp, Homo sapiens
ctaactacaaaggtttaaa

SEQ ID NO: 1835579 - DNA, 23 bp, Homo sapiens
ctaactacaaaggtttaaatgaa

SEQ ID NO: 1835580 - DNA, 15 bp, Homo sapiens
ctaagagggagggag

SEQ ID NO: 1835581 - DNA, 22 bp, Homo sapiens
ctaagagggagggagggctcca

SEQ ID NO: 1835582 - DNA, 17 bp, Homo sapiens
ctaagatataatttaaa

SEQ ID NO: 1835583 - DNA, 20 bp, Homo sapiens
ctaagatataatttaaacgt

SEQ ID NO: 1835584 - DNA, 23 bp, Homo sapiens
ctaagcattagctttaattaagc

SEQ ID NO: 1835585 - DNA, 17 bp, Homo sapiens
ctaaggcgtggagctgc

SEQ ID NO: 1835586 - DNA, 14 bp, Homo sapiens
ctaaggctgaactt

SEQ ID NO: 1835587 - DNA, 13 bp, Homo sapiens
ctaagtctctgtg

SEQ ID NO: 1835588 - DNA, 18 bp, Homo sapiens
ctacaaaggtttaaatga

SEQ ID NO: 1835589 - DNA, 14 bp, Homo sapiens
ctacacagggatgt

SEQ ID NO: 1835590 - DNA, 21 bp, Homo sapiens
ctacacagggatgtacaaggc

SEQ ID NO: 1835591 - DNA, 15 bp, Homo sapiens
ctacactgacactgg

SEQ ID NO: 1835592 - DNA, 13 bp, Homo sapiens
ctacactgtgctg

SEQ ID NO: 1835593 - DNA, 14 bp, Homo sapiens
ctacactgtgctga

SEQ ID NO: 1835594 - DNA, 18 bp, Homo sapiens
ctacactgtgctgagtct

SEQ ID NO: 1835595 - DNA, 18 bp, Homo sapiens
ctacagtcctcccatctc

SEQ ID NO: 1835596 - DNA, 21 bp, Homo sapiens
ctacagttgaaaaacagctga

SEQ ID NO: 1835597 - DNA, 18 bp, Homo sapiens
ctaccatcccctgtagag

SEQ ID NO: 1835598 - DNA, 13 bp, Homo sapiens
ctacccaggtgct

SEQ ID NO: 1835599 - DNA, 14 bp, Homo sapiens
ctacctgaggggcc

SEQ ID NO: 1835600 - DNA, 19 bp, Homo sapiens
ctacctgaggggcctctta

SEQ ID NO: 1835601 - DNA, 16 bp, Homo sapiens
aaaatgaaatgcattt

SEQ ID NO: 1835602 - DNA, 19 bp, Homo sapiens
aaaatttttatgtaattat

SEQ ID NO: 1835603 - DNA, 17 bp, Homo sapiens
aaacaagaaaaataaag

SEQ ID NO: 1835604 - DNA, 20 bp, Homo sapiens
aaacaagaaaaataaagaaa

SEQ ID NO: 1835605 - DNA, 14 bp, Homo sapiens
aaacacacgagcaa

SEQ ID NO: 1835606 - DNA, 16 bp, Homo sapiens
aaacacccctctgtct

SEQ ID NO: 1835607 - DNA, 14 bp, Homo sapiens
aaacactgcaggca

SEQ ID NO: 1835608 - DNA, 16 bp, Homo sapiens
aaacactgttctctgc

SEQ ID NO: 1835609 - DNA, 18 bp, Homo sapiens
aaacactgttctctgccc

SEQ ID NO: 1835610 - DNA, 19 bp, Homo sapiens
aaacactgttctctgccct

SEQ ID NO: 1835611 - DNA, 17 bp, Homo sapiens
aaacatgcttttccaaa

SEQ ID NO: 1835612 - DNA, 17 bp, Homo sapiens
aaacatgtatgtaaata

SEQ ID NO: 1835613 - DNA, 12 bp, Homo sapiens
aaacattgaaga

SEQ ID NO: 1835614 - DNA, 17 bp, Homo sapiens
aaacattggttcttgta

SEQ ID NO: 1835615 - DNA, 23 bp, Homo sapiens
aaaccaagtcaagtgaaaaagga

SEQ ID NO: 1835616 - DNA, 14 bp, Homo sapiens
aaaccacagctgct

SEQ ID NO: 1835617 - DNA, 12 bp, Homo sapiens
aaacccagctct

SEQ ID NO: 1835618 - DNA, 16 bp, Homo sapiens
aaaccgccaaggctgg

SEQ ID NO: 1835619 - DNA, 15 bp, Homo sapiens
aaacgggctcagcaa

SEQ ID NO: 1835620 - DNA, 17 bp, Homo sapiens
aaactacaaagctgaag

SEQ ID NO: 1835621 - DNA, 12 bp, Homo sapiens
aaactcttaaaa

SEQ ID NO: 1835622 - DNA, 22 bp, Homo sapiens
aaactgcttgtttcctagcaca

SEQ ID NO: 1835623 - DNA, 15 bp, Homo sapiens
aaactgggttcctgc

SEQ ID NO: 1835624 - DNA, 14 bp, Homo sapiens
aaagaaaagatgca

SEQ ID NO: 1835625 - DNA, 20 bp, Homo sapiens
aaagaattgttgggggtttt

SEQ ID NO: 1835626 - DNA, 18 bp, Homo sapiens
aaagagagaaaaacaaat

SEQ ID NO: 1835627 - DNA, 19 bp, Homo sapiens
aaagaggtttttcttaaat

SEQ ID NO: 1835628 - DNA, 18 bp, Homo sapiens
aaagataaacacaagatt

SEQ ID NO: 1835629 - DNA, 15 bp, Homo sapiens
aaagatcatgtaaaa

SEQ ID NO: 1835630 - DNA, 20 bp, Homo sapiens
aaagatctttcattttgcac

SEQ ID NO: 1835631 - DNA, 17 bp, Homo sapiens
aaagatgcactttgctt

SEQ ID NO: 1835632 - DNA, 14 bp, Homo sapiens
aaagatgcttctca

SEQ ID NO: 1835633 - DNA, 19 bp, Homo sapiens
aaagatgcttctcactgcc

SEQ ID NO: 1835634 - DNA, 22 bp, Homo sapiens
aaagcaagtgattgggacagag

SEQ ID NO: 1835635 - DNA, 16 bp, Homo sapiens
aaagcctcctccagcc

SEQ ID NO: 1835636 - DNA, 20 bp, Homo sapiens
aaaggaaggttctggtgtga

SEQ ID NO: 1835637 - DNA, 21 bp, Homo sapiens
aaaggaatccactcccaggca

SEQ ID NO: 1835638 - DNA, 21 bp, Homo sapiens
aaaggagagctagcagcaggg

SEQ ID NO: 1835639 - DNA, 11 bp, Homo sapiens
aaaggagttta

SEQ ID NO: 1835640 - DNA, 21 bp, Homo sapiens
aaaggagtttatgttccatta

SEQ ID NO: 1835641 - DNA, 19 bp, Homo sapiens
aaaggccatggagagctgg

SEQ ID NO: 1835642 - DNA, 13 bp, Homo sapiens
aaaggtttaaatg

SEQ ID NO: 1835643 - DNA, 21 bp, Homo sapiens
aaagtgaagaatttatctctt

SEQ ID NO: 1835644 - DNA, 13 bp, Homo sapiens
aaagttattttgt

SEQ ID NO: 1835645 - DNA, 20 bp, Homo sapiens
aaagttggaaggatctgctg

SEQ ID NO: 1835646 - DNA, 13 bp, Homo sapiens
aaataaagtctct

SEQ ID NO: 1835647 - DNA, 20 bp, Homo sapiens
aaataacaaatgccaaatta

SEQ ID NO: 1835648 - DNA, 20 bp, Homo sapiens
aaatacagtttgtcacatga

SEQ ID NO: 1835649 - DNA, 18 bp, Homo sapiens
aaatacctaattgtggat

SEQ ID NO: 1835650 - DNA, 17 bp, Homo sapiens
aaatagccagtgctagt

SEQ ID NO: 1835651 - DNA, 20 bp, Homo sapiens
aaatagctaagatataattt

SEQ ID NO: 1835652 - DNA, 15 bp, Homo sapiens
aaatagcttatgaaa

SEQ ID NO: 1835653 - DNA, 12 bp, Homo sapiens
aaatataaagac

SEQ ID NO: 1835654 - DNA, 13 bp, Homo sapiens
aaatataaagacg

SEQ ID NO: 1835655 - DNA, 12 bp, Homo sapiens
aaatatattatt

SEQ ID NO: 1835656 - DNA, 21 bp, Homo sapiens
aaatatattattacttgtaaa

SEQ ID NO: 1835657 - DNA, 16 bp, Homo sapiens
aaatctcaattcttcc

SEQ ID NO: 1835658 - DNA, 12 bp, Homo sapiens
aaatgaaatgca

SEQ ID NO: 1835659 - DNA, 13 bp, Homo sapiens
aaatgaacaagag

SEQ ID NO: 1835660 - DNA, 21 bp, Homo sapiens
aaatgaacaagagaagcattc

SEQ ID NO: 1835661 - DNA, 13 bp, Homo sapiens
aaatgagcctggc

SEQ ID NO: 1835662 - DNA, 14 bp, Homo sapiens
aaatgcaaataaca

SEQ ID NO: 1835663 - DNA, 17 bp, Homo sapiens
aaatgcattttgctaga

SEQ ID NO: 1835664 - DNA, 22 bp, Homo sapiens
aaatgccaaattaaaaaagata

SEQ ID NO: 1835665 - DNA, 13 bp, Homo sapiens
aaatgcccagctt

SEQ ID NO: 1835666 - DNA, 18 bp, Homo sapiens
aaatggccatgcaggagg

SEQ ID NO: 1835667 - DNA, 14 bp, Homo sapiens
aaatggcgtctgct

SEQ ID NO: 1835668 - DNA, 17 bp, Homo sapiens
aaatggcgtctgctctg

SEQ ID NO: 1835669 - DNA, 21 bp, Homo sapiens
aaatggctacatctccaaata

SEQ ID NO: 1835670 - DNA, 19 bp, Homo sapiens
aaatggttaaaagaggttt

SEQ ID NO: 1835671 - DNA, 19 bp, Homo sapiens
aaatgtctagttgtaacac

SEQ ID NO: 1835672 - DNA, 24 bp, Homo sapiens
aaatgtctagttgtaacaccatga

SEQ ID NO: 1835673 - DNA, 16 bp, Homo sapiens
aaatgtcttctgtatt

SEQ ID NO: 1835674 - DNA, 18 bp, Homo sapiens
aaatgtcttctgtattca

SEQ ID NO: 1835675 - DNA, 18 bp, Homo sapiens
aaattaaataaaattttt

SEQ ID NO: 1835676 - DNA, 22 bp, Homo sapiens
aggaatacctgtccccctgaca

SEQ ID NO: 1835677 - DNA, 18 bp, Homo sapiens
aggacatgaaactccacc

SEQ ID NO: 1835678 - DNA, 17 bp, Homo sapiens
aggacatgctgaagcca

SEQ ID NO: 1835679 - DNA, 23 bp, Homo sapiens
aggactagagcacaacataattt

SEQ ID NO: 1835680 - DNA, 17 bp, Homo sapiens
aggactgcagagggctc

SEQ ID NO: 1835681 - DNA, 23 bp, Homo sapiens
aggactgcagagggctccagagt

SEQ ID NO: 1835682 - DNA, 23 bp, Homo sapiens
aggactgcagccactgattctct

SEQ ID NO: 1835683 - DNA, 19 bp, Homo sapiens
aggactgtgacaggcagca

SEQ ID NO: 1835684 - DNA, 21 bp, Homo sapiens
aggactgtgacaggcagcaga

SEQ ID NO: 1835685 - DNA, 22 bp, Homo sapiens
aggagaagtcttctatttattt

SEQ ID NO: 1835686 - DNA, 19 bp, Homo sapiens
aggagacacaacaactcct

SEQ ID NO: 1835687 - DNA, 22 bp, Homo sapiens
aggagcaaaggctgagaacact

SEQ ID NO: 1835688 - DNA, 23 bp, Homo sapiens
aggagcacggctctgtccccagc

SEQ ID NO: 1835689 - DNA, 12 bp, Homo sapiens
aggagcagccac

SEQ ID NO: 1835690 - DNA, 16 bp, Homo sapiens
aggagcagcctcagaa

SEQ ID NO: 1835691 - DNA, 19 bp, Homo sapiens
aggagcagtgcaggcacag

SEQ ID NO: 1835692 - DNA, 19 bp, Homo sapiens
aggaggccacgtgatgtgg

SEQ ID NO: 1835693 - DNA, 15 bp, Homo sapiens
aggaggccagccttg

SEQ ID NO: 1835694 - DNA, 13 bp, Homo sapiens
aggaggtggagaa

SEQ ID NO: 1835695 - DNA, 16 bp, Homo sapiens
aggatccctctctgga

SEQ ID NO: 1835696 - DNA, 14 bp, Homo sapiens
aggatctagagggg

SEQ ID NO: 1835697 - DNA, 18 bp, Homo sapiens
aggatctcttgagcctgg

SEQ ID NO: 1835698 - DNA, 22 bp, Homo sapiens
aggatctcttgagcctgggagg

SEQ ID NO: 1835699 - DNA, 22 bp, Homo sapiens
aggatctgctgaggcccagtgc

SEQ ID NO: 1835700 - DNA, 17 bp, Homo sapiens
aggatgatctaggaaga

SEQ ID NO: 1835701 - DNA, 16 bp, Homo sapiens
aggatgctgacatcat

SEQ ID NO: 1835702 - DNA, 22 bp, Homo sapiens
aggatgctgacatcatttgtat

SEQ ID NO: 1835703 - DNA, 23 bp, Homo sapiens
aggatggcctggccagggcctgg

SEQ ID NO: 1835704 - DNA, 21 bp, Homo sapiens
aggatgtgggggaagacctgg

SEQ ID NO: 1835705 - DNA, 16 bp, Homo sapiens
aggattcttcctccct

SEQ ID NO: 1835706 - DNA, 19 bp, Homo sapiens
aggattcttcctccctccc

SEQ ID NO: 1835707 - DNA, 14 bp, Homo sapiens
aggattttatgctt

SEQ ID NO: 1835708 - DNA, 19 bp, Homo sapiens
aggcaactgcattggcttt

SEQ ID NO: 1835709 - DNA, 18 bp, Homo sapiens
aggcaggctaaggcgtgg

SEQ ID NO: 1835710 - DNA, 23 bp, Homo sapiens
aggcaggctaaggcgtggagctg

SEQ ID NO: 1835711 - DNA, 14 bp, Homo sapiens
aggcaggggaatgt

SEQ ID NO: 1835712 - DNA, 17 bp, Homo sapiens
aggcaggtgggatggat

SEQ ID NO: 1835713 - DNA, 15 bp, Homo sapiens
aggcataaagtcagg

SEQ ID NO: 1835714 - DNA, 20 bp, Homo sapiens
aggcatatttaacaaaattt

SEQ ID NO: 1835715 - DNA, 15 bp, Homo sapiens
aggcatggtggccca

SEQ ID NO: 1835716 - DNA, 20 bp, Homo sapiens
aggcattccccaggaggcca

SEQ ID NO: 1835717 - DNA, 18 bp, Homo sapiens
aggcattgtgggaagggg

SEQ ID NO: 1835718 - DNA, 16 bp, Homo sapiens
aggccaaggtgggagg

SEQ ID NO: 1835719 - DNA, 15 bp, Homo sapiens
atagcacatgatttg

SEQ ID NO: 1835720 - DNA, 16 bp, Homo sapiens
atagcacatgatttgg

SEQ ID NO: 1835721 - DNA, 15 bp, Homo sapiens
atagccctatttatc

SEQ ID NO: 1835722 - DNA, 22 bp, Homo sapiens
atagctaagatataatttaaac

SEQ ID NO: 1835723 - DNA, 18 bp, Homo sapiens
atagcttatgaaaagaat

SEQ ID NO: 1835724 - DNA, 20 bp, Homo sapiens
atagtgtctattatcacatt

SEQ ID NO: 1835725 - DNA, 16 bp, Homo sapiens
atataaagacgtttta

SEQ ID NO: 1835726 - DNA, 14 bp, Homo sapiens
atataaatgcaaat

SEQ ID NO: 1835727 - DNA, 17 bp, Homo sapiens
atataaatgcaaataac

SEQ ID NO: 1835728 - DNA, 18 bp, Homo sapiens
atataaatgcaaataaca

SEQ ID NO: 1835729 - DNA, 20 bp, Homo sapiens
atataaccacatttctaagc

SEQ ID NO: 1835730 - DNA, 16 bp, Homo sapiens
atataatttaaacgtg

SEQ ID NO: 1835731 - DNA, 13 bp, Homo sapiens
atatacatcatac

SEQ ID NO: 1835732 - DNA, 13 bp, Homo sapiens
atatactatattt

SEQ ID NO: 1835733 - DNA, 10 bp, Homo sapiens
atatataaat

SEQ ID NO: 1835734 - DNA, 11 bp, Homo sapiens
atatataaata

SEQ ID NO: 1835735 - DNA, 13 bp, Homo sapiens
atatataaatata

SEQ ID NO: 1835736 - DNA, 14 bp, Homo sapiens
atatataaatatat

SEQ ID NO: 1835737 - DNA, 18 bp, Homo sapiens
atatataaatatattatt

SEQ ID NO: 1835738 - DNA, 19 bp, Homo sapiens
atatataaatatattatta

SEQ ID NO: 1835739 - DNA, 14 bp, Homo sapiens
atatatacatcata

SEQ ID NO: 1835740 - DNA, 18 bp, Homo sapiens
atatattattacttgtaa

SEQ ID NO: 1835741 - DNA, 22 bp, Homo sapiens
atatcagtgggctctcttacca

SEQ ID NO: 1835742 - DNA, 17 bp, Homo sapiens
atatcatcagtattgaa

SEQ ID NO: 1835743 - DNA, 22 bp, Homo sapiens
atatcatcagtattgaagcatt

SEQ ID NO: 1835744 - DNA, 18 bp, Homo sapiens
atatccaattttaaaatg

SEQ ID NO: 1835745 - DNA, 20 bp, Homo sapiens
atatccaattttaaaatgaa

SEQ ID NO: 1835746 - DNA, 21 bp, Homo sapiens
atatccaattttaaaatgaaa

SEQ ID NO: 1835747 - DNA, 22 bp, Homo sapiens
atatccaattttaaaatgaaat

SEQ ID NO: 1835748 - DNA, 14 bp, Homo sapiens
atatcccttacttt

SEQ ID NO: 1835749 - DNA, 20 bp, Homo sapiens
atatcttaattctttgttct

SEQ ID NO: 1835750 - DNA, 14 bp, Homo sapiens
atatggactcagcc

SEQ ID NO: 1835751 - DNA, 20 bp, Homo sapiens
atatgtctagggtgtgattt

SEQ ID NO: 1835752 - DNA, 16 bp, Homo sapiens
atattaacaaattgca

SEQ ID NO: 1835753 - DNA, 15 bp, Homo sapiens
atattattacttgta

SEQ ID NO: 1835754 - DNA, 17 bp, Homo sapiens
atattattacttgtaaa

SEQ ID NO: 1835755 - DNA, 17 bp, Homo sapiens
atattcaggaagctcag

SEQ ID NO: 1835756 - DNA, 17 bp, Homo sapiens
atattggtttatgtagt

SEQ ID NO: 1835757 - DNA, 15 bp, Homo sapiens
atatttttcccagga

SEQ ID NO: 1835758 - DNA, 19 bp, Homo sapiens
atatttttctcaatgttta

SEQ ID NO: 1835759 - DNA, 23 bp, Homo sapiens
atcaaagaggttttaaaaaaatc

SEQ ID NO: 1835760 - DNA, 16 bp, Homo sapiens
atcaaggcactgcctg

SEQ ID NO: 1835761 - DNA, 21 bp, Homo sapiens
atcacattaatctcaaagaga

SEQ ID NO: 1835762 - DNA, 20 bp, Homo sapiens
atcaccaacgtctgtgccat

SEQ ID NO: 1835763 - DNA, 13 bp, Homo sapiens
atcaccagacagg

SEQ ID NO: 1835764 - DNA, 16 bp, Homo sapiens
atcacctagctgaatg

SEQ ID NO: 1835765 - DNA, 20 bp, Homo sapiens
atcacctagctgaatgtttt

SEQ ID NO: 1835766 - DNA, 23 bp, Homo sapiens
atcacctagctgaatgtttttct

SEQ ID NO: 1835767 - DNA, 14 bp, Homo sapiens
atcactgaactttg

SEQ ID NO: 1835768 - DNA, 14 bp, Homo sapiens
atcacttttttcca

SEQ ID NO: 1835769 - DNA, 16 bp, Homo sapiens
atcagaaacaccctca

SEQ ID NO: 1835770 - DNA, 22 bp, Homo sapiens
atcagaggtttgcttcctcagt

SEQ ID NO: 1835771 - DNA, 22 bp, Homo sapiens
atcaggagaaaaagcctccagt

SEQ ID NO: 1835772 - DNA, 18 bp, Homo sapiens
atcaggccaggccctctg

SEQ ID NO: 1835773 - DNA, 15 bp, Homo sapiens
atcagtgccctccag

SEQ ID NO: 1835774 - DNA, 17 bp, Homo sapiens
atcagtgccctccagga

SEQ ID NO: 1835775 - DNA, 13 bp, Homo sapiens
atcatacttaact

SEQ ID NO: 1835776 - DNA, 13 bp, Homo sapiens
atcatcaaggcac

SEQ ID NO: 1835777 - DNA, 18 bp, Homo sapiens
atcatcaaggcactgcct

SEQ ID NO: 1835778 - DNA, 19 bp, Homo sapiens
atcatcaaggcactgcctg

SEQ ID NO: 1835779 - DNA, 16 bp, Homo sapiens
atcatcacaaatggct

SEQ ID NO: 1835780 - DNA, 18 bp, Homo sapiens
atcatcagtggagccatg

SEQ ID NO: 1835781 - DNA, 15 bp, Homo sapiens
atcatctcctttgca

SEQ ID NO: 1835782 - DNA, 18 bp, Homo sapiens
atcatctcctttgcagaa

SEQ ID NO: 1835783 - DNA, 14 bp, Homo sapiens
atcattatttatgt

SEQ ID NO: 1835784 - DNA, 17 bp, Homo sapiens
atcattatttatgtatt

SEQ ID NO: 1835785 - DNA, 16 bp, Homo sapiens
atcatttcacttgtca

SEQ ID NO: 1835786 - DNA, 21 bp, Homo sapiens
atccaagcaccaccaaacaca

SEQ ID NO: 1835787 - DNA, 17 bp, Homo sapiens
atccaattttaaaatga

SEQ ID NO: 1835788 - DNA, 16 bp, Homo sapiens
atccactcccaggcag

SEQ ID NO: 1835789 - DNA, 23 bp, Homo sapiens
atccatttgcgttccatgatgct

SEQ ID NO: 1835790 - DNA, 17 bp, Homo sapiens
atcccacatatttcaaa

SEQ ID NO: 1835791 - DNA, 14 bp, Homo sapiens
atccctctctggat

SEQ ID NO: 1835792 - DNA, 22 bp, Homo sapiens
atccctgaaggccccgcccagg

SEQ ID NO: 1835793 - DNA, 20 bp, Homo sapiens
atcccttactttaacccttt

SEQ ID NO: 1835794 - DNA, 18 bp, Homo sapiens
atcccttgaccaggcctg

SEQ ID NO: 1835795 - DNA, 19 bp, Homo sapiens
atcctaaaacaaaagctca

SEQ ID NO: 1835796 - DNA, 15 bp, Homo sapiens
atcctagttccacca

SEQ ID NO: 1835797 - DNA, 18 bp, Homo sapiens
atcctcatacccaccccc

SEQ ID NO: 1835798 - DNA, 13 bp, Homo sapiens
atcctccaggtgc

SEQ ID NO: 1835799 - DNA, 24 bp, Homo sapiens
atcctggctctttggagatcaagg

SEQ ID NO: 1835800 - DNA, 13 bp, Homo sapiens
atcctgtgtgtta

SEQ ID NO: 1835801 - DNA, 16 bp, Homo sapiens
atccttgagtcaaaaa

SEQ ID NO: 1835802 - DNA, 18 bp, Homo sapiens
atcgatgagcgccacctc

SEQ ID NO: 1835803 - DNA, 23 bp, Homo sapiens
atctaggaagactttggaaagag

SEQ ID NO: 1835804 - DNA, 15 bp, Homo sapiens
atctagtgaccagat

SEQ ID NO: 1835805 - DNA, 19 bp, Homo sapiens
atctatatttttgtactga

SEQ ID NO: 1835806 - DNA, 17 bp, Homo sapiens
aataaagaaaagatgca

SEQ ID NO: 1835807 - DNA, 19 bp, Homo sapiens
aataaagatcatgtaaaag

SEQ ID NO: 1835808 - DNA, 15 bp, Homo sapiens
aataacacacagcta

SEQ ID NO: 1835809 - DNA, 20 bp, Homo sapiens
aataaccaattcctcatttg

SEQ ID NO: 1835810 - DNA, 13 bp, Homo sapiens
aataataaagatc

SEQ ID NO: 1835811 - DNA, 18 bp, Homo sapiens
aatagacccacaagaggc

SEQ ID NO: 1835812 - DNA, 11 bp, Homo sapiens
aatagctcttg

SEQ ID NO: 1835813 - DNA, 17 bp, Homo sapiens
aatagcttatgaaaaga

SEQ ID NO: 1835814 - DNA, 12 bp, Homo sapiens
aatataaagacg

SEQ ID NO: 1835815 - DNA, 11 bp, Homo sapiens
aatataaatgc

SEQ ID NO: 1835816 - DNA, 12 bp, Homo sapiens
aatataaatgca

SEQ ID NO: 1835817 - DNA, 15 bp, Homo sapiens
aatataaatgcaaat

SEQ ID NO: 1835818 - DNA, 18 bp, Homo sapiens
aatataaatgcaaataac

SEQ ID NO: 1835819 - DNA, 19 bp, Homo sapiens
aatataaatgcaaataaca

SEQ ID NO: 1835820 - DNA, 20 bp, Homo sapiens
aatataaatgcaaataacaa

SEQ ID NO: 1835821 - DNA, 22 bp, Homo sapiens
aatataaatgcaaataacaaat

SEQ ID NO: 1835822 - DNA, 20 bp, Homo sapiens
aatatagctttcataacatc

SEQ ID NO: 1835823 - DNA, 18 bp, Homo sapiens
aatatattattacttgta

SEQ ID NO: 1835824 - DNA, 21 bp, Homo sapiens
aatatattattacttgtaaat

SEQ ID NO: 1835825 - DNA, 21 bp, Homo sapiens
aatatggactcagccttgcaa

SEQ ID NO: 1835826 - DNA, 20 bp, Homo sapiens
aatattttcctcctgagtgc

SEQ ID NO: 1835827 - DNA, 14 bp, Homo sapiens
aatcaactgggctg

SEQ ID NO: 1835828 - DNA, 20 bp, Homo sapiens
aatcaactttatcatatgct

SEQ ID NO: 1835829 - DNA, 14 bp, Homo sapiens
aatcagaatggaat

SEQ ID NO: 1835830 - DNA, 13 bp, Homo sapiens
aatcagcctgctc

SEQ ID NO: 1835831 - DNA, 19 bp, Homo sapiens
aatcagcctgctccagctg

SEQ ID NO: 1835832 - DNA, 18 bp, Homo sapiens
aatccactcccaggcagc

SEQ ID NO: 1835833 - DNA, 17 bp, Homo sapiens
aatcccatttaaaaaaa

SEQ ID NO: 1835834 - DNA, 15 bp, Homo sapiens
aatctcacagcattt

SEQ ID NO: 1835835 - DNA, 15 bp, Homo sapiens
aatctctccaccttc

SEQ ID NO: 1835836 - DNA, 18 bp, Homo sapiens
aatctctccaccttccaa

SEQ ID NO: 1835837 - DNA, 19 bp, Homo sapiens
aatctggattcatatttaa

SEQ ID NO: 1835838 - DNA, 18 bp, Homo sapiens
aatctgggccagaatttc

SEQ ID NO: 1835839 - DNA, 14 bp, Homo sapiens
aatcttacagctgg

SEQ ID NO: 1835840 - DNA, 18 bp, Homo sapiens
aatcttacagctgggtgg

SEQ ID NO: 1835841 - DNA, 23 bp, Homo sapiens
aatcttacagctgggtggcactg

SEQ ID NO: 1835842 - DNA, 13 bp, Homo sapiens
aatgaacaagaga

SEQ ID NO: 1835843 - DNA, 12 bp, Homo sapiens
aatgagcatgtt

SEQ ID NO: 1835844 - DNA, 16 bp, Homo sapiens
aatgagcatgtttaga

SEQ ID NO: 1835845 - DNA, 11 bp, Homo sapiens
aatgagcctgg

SEQ ID NO: 1835846 - DNA, 20 bp, Homo sapiens
aatgataatattgtggtgcc

SEQ ID NO: 1835847 - DNA, 13 bp, Homo sapiens
aatgcactttgtt

SEQ ID NO: 1835848 - DNA, 13 bp, Homo sapiens
aatgcccagcccc

SEQ ID NO: 1835849 - DNA, 22 bp, Homo sapiens
aatgcccagccccttctgaccc

SEQ ID NO: 1835850 - DNA, 23 bp, Homo sapiens
aatgcccagccccttctgaccca

SEQ ID NO: 1835851 - DNA, 24 bp, Homo sapiens
aatgcccagccccttctgacccat

SEQ ID NO: 1835852 - DNA, 12 bp, Homo sapiens
aatgcctgccaa

SEQ ID NO: 1835853 - DNA, 20 bp, Homo sapiens
aatgctgcagatttgggctg

SEQ ID NO: 1835854 - DNA, 21 bp, Homo sapiens
aatggaaatgggcagagcaga

SEQ ID NO: 1835855 - DNA, 13 bp, Homo sapiens
aatggaagacaca

SEQ ID NO: 1835856 - DNA, 12 bp, Homo sapiens
aatggccatgca

SEQ ID NO: 1835857 - DNA, 19 bp, Homo sapiens
aatggcgtctgctctggtg

SEQ ID NO: 1835858 - DNA, 22 bp, Homo sapiens
aatggcttatccagctggtgag

SEQ ID NO: 1835859 - DNA, 14 bp, Homo sapiens
aatggtagttttac

SEQ ID NO: 1835860 - DNA, 22 bp, Homo sapiens
aatgtagttttgtgatgcattt

SEQ ID NO: 1835861 - DNA, 18 bp, Homo sapiens
aatgtattttatgttata

SEQ ID NO: 1835862 - DNA, 20 bp, Homo sapiens
aatgtcagttgttatttatt

SEQ ID NO: 1835863 - DNA, 22 bp, Homo sapiens
aatgtcagttgttatttattga

SEQ ID NO: 1835864 - DNA, 19 bp, Homo sapiens
aatgtgaaaagaaaaatga

SEQ ID NO: 1835865 - DNA, 21 bp, Homo sapiens
aatgttctctcttctccacct

SEQ ID NO: 1835866 - DNA, 20 bp, Homo sapiens
aatgtttagcagatttaaga

SEQ ID NO: 1835867 - DNA, 16 bp, Homo sapiens
aattaaaaaagataaa

SEQ ID NO: 1835868 - DNA, 17 bp, Homo sapiens
aattaaaaaagataaac

SEQ ID NO: 1835869 - DNA, 19 bp, Homo sapiens
aattaaaaaagataaacac

SEQ ID NO: 1835870 - DNA, 14 bp, Homo sapiens
aattaaataaaatt

SEQ ID NO: 1835871 - DNA, 16 bp, Homo sapiens
aattaaggattttatg

SEQ ID NO: 1835872 - DNA, 19 bp, Homo sapiens
actttgaaaagttggaagg

SEQ ID NO: 1835873 - DNA, 15 bp, Homo sapiens
actttgctttaatat

SEQ ID NO: 1835874 - DNA, 16 bp, Homo sapiens
actttgctttaatata

SEQ ID NO: 1835875 - DNA, 17 bp, Homo sapiens
actttgctttaatataa

SEQ ID NO: 1835876 - DNA, 19 bp, Homo sapiens
actttgctttaatataaat

SEQ ID NO: 1835877 - DNA, 23 bp, Homo sapiens
actttggaaagacttttccaacc

SEQ ID NO: 1835878 - DNA, 14 bp, Homo sapiens
actttggctgcatg

SEQ ID NO: 1835879 - DNA, 20 bp, Homo sapiens
actttgttagtttctccaag

SEQ ID NO: 1835880 - DNA, 14 bp, Homo sapiens
actttgttctggct

SEQ ID NO: 1835881 - DNA, 16 bp, Homo sapiens
actttgttctggctct

SEQ ID NO: 1835882 - DNA, 17 bp, Homo sapiens
actttgttctggctctt

SEQ ID NO: 1835883 - DNA, 19 bp, Homo sapiens
actttgttctggctcttcc

SEQ ID NO: 1835884 - DNA, 23 bp, Homo sapiens
acttttatttccagtgaaatcag

SEQ ID NO: 1835885 - DNA, 16 bp, Homo sapiens
acttttggttaagtct

SEQ ID NO: 1835886 - DNA, 20 bp, Homo sapiens
acttttggttaagtctgttt

SEQ ID NO: 1835887 - DNA, 17 bp, Homo sapiens
actttttttttttttcc

SEQ ID NO: 1835888 - DNA, 23 bp, Homo sapiens
agaaaaaaatgtattttatgtta

SEQ ID NO: 1835889 - DNA, 13 bp, Homo sapiens
agaaaaagaaaaa

SEQ ID NO: 1835890 - DNA, 19 bp, Homo sapiens
agaaaaatatgaccacact

SEQ ID NO: 1835891 - DNA, 17 bp, Homo sapiens
agaaaaatgagcctggc

SEQ ID NO: 1835892 - DNA, 13 bp, Homo sapiens
agaaaagatgcac

SEQ ID NO: 1835893 - DNA, 16 bp, Homo sapiens
agaaaagatgcacttt

SEQ ID NO: 1835894 - DNA, 19 bp, Homo sapiens
agaaaagatgcactttgct

SEQ ID NO: 1835895 - DNA, 11 bp, Homo sapiens
agaaaatgaag

SEQ ID NO: 1835896 - DNA, 16 bp, Homo sapiens
agaaaatgaagcccta

SEQ ID NO: 1835897 - DNA, 21 bp, Homo sapiens
agaaaattggaactctactca

SEQ ID NO: 1835898 - DNA, 18 bp, Homo sapiens
agaaacacccctctgtct

SEQ ID NO: 1835899 - DNA, 21 bp, Homo sapiens
agaaacacccctctgtctagg

SEQ ID NO: 1835900 - DNA, 16 bp, Homo sapiens
agaaatggcgtctgct

SEQ ID NO: 1835901 - DNA, 23 bp, Homo sapiens
agaaatggcgtctgctctggtgg

SEQ ID NO: 1835902 - DNA, 21 bp, Homo sapiens
agaacagtgcttgccacagag

SEQ ID NO: 1835903 - DNA, 17 bp, Homo sapiens
agaacctgcacacagga

SEQ ID NO: 1835904 - DNA, 21 bp, Homo sapiens
agaacctgcacacaggacagc

SEQ ID NO: 1835905 - DNA, 21 bp, Homo sapiens
agaagaggtggccccatatta

SEQ ID NO: 1835906 - DNA, 23 bp, Homo sapiens
agaagaggtggccccatattaac

SEQ ID NO: 1835907 - DNA, 20 bp, Homo sapiens
agaagcccaggaaaggctcc

SEQ ID NO: 1835908 - DNA, 22 bp, Homo sapiens
agaagcccaggaaaggctccag

SEQ ID NO: 1835909 - DNA, 15 bp, Homo sapiens
agaagcggctggcag

SEQ ID NO: 1835910 - DNA, 16 bp, Homo sapiens
agaagcggctggcagc

SEQ ID NO: 1835911 - DNA, 20 bp, Homo sapiens
agaaggcaaatgactttgga

SEQ ID NO: 1835912 - DNA, 22 bp, Homo sapiens
agaagtttgagatcagcctggg

SEQ ID NO: 1835913 - DNA, 22 bp, Homo sapiens
agaatcacttctgagaactcat

SEQ ID NO: 1835914 - DNA, 21 bp, Homo sapiens
agaatgtgtttaaacttggtt

SEQ ID NO: 1835915 - DNA, 12 bp, Homo sapiens
agaatgttttca

SEQ ID NO: 1835916 - DNA, 21 bp, Homo sapiens
agaatgttttcaaatgttctc

SEQ ID NO: 1835917 - DNA, 20 bp, Homo sapiens
agacaagtgactgtatctgt

SEQ ID NO: 1835918 - DNA, 23 bp, Homo sapiens
agacaagtgactgtatctgtgta

SEQ ID NO: 1835919 - DNA, 20 bp, Homo sapiens
agacaatgtgaaaagaaaaa

SEQ ID NO: 1835920 - DNA, 18 bp, Homo sapiens
agacacaacaactcctag

SEQ ID NO: 1835921 - DNA, 20 bp, Homo sapiens
agacacatgtccaagaagcc

SEQ ID NO: 1835922 - DNA, 18 bp, Homo sapiens
agacacccaagtccaggc

SEQ ID NO: 1835923 - DNA, 19 bp, Homo sapiens
agacaccgttcattcaggc

SEQ ID NO: 1835924 - DNA, 16 bp, Homo sapiens
agacagagacctcctg

SEQ ID NO: 1835925 - DNA, 17 bp, Homo sapiens
agacagcccgggctctg

SEQ ID NO: 1835926 - DNA, 22 bp, Homo sapiens
agacagcccgggctctgcctcc

SEQ ID NO: 1835927 - DNA, 23 bp, Homo sapiens
agacagcccgggctctgcctccc

SEQ ID NO: 1835928 - DNA, 17 bp, Homo sapiens
agacaggactgcagagg

SEQ ID NO: 1835929 - DNA, 16 bp, Homo sapiens
agaccaggcaaagcaa

SEQ ID NO: 1835930 - DNA, 17 bp, Homo sapiens
agaccatccctgaaggc

SEQ ID NO: 1835931 - DNA, 14 bp, Homo sapiens
agaccctccccaca

SEQ ID NO: 1835932 - DNA, 19 bp, Homo sapiens
agaccctgccctgtgggcc

SEQ ID NO: 1835933 - DNA, 16 bp, Homo sapiens
agacctcagcttggca

SEQ ID NO: 1835934 - DNA, 19 bp, Homo sapiens
agacctcatgcccagctct

SEQ ID NO: 1835935 - DNA, 20 bp, Homo sapiens
agacctcatgcccagctctc

SEQ ID NO: 1835936 - DNA, 22 bp, Homo sapiens
agacctcatgcccagctctctg

SEQ ID NO: 1835937 - DNA, 18 bp, Homo sapiens
agaccttctaggacgcca

SEQ ID NO: 1835938 - DNA, 18 bp, Homo sapiens
agacgctgtgctgccctg

SEQ ID NO: 1835939 - DNA, 19 bp, Homo sapiens
agacgctgtgctgccctgc

SEQ ID NO: 1835940 - DNA, 22 bp, Homo sapiens
agacgctgtgctgccctgccca

SEQ ID NO: 1835941 - DNA, 21 bp, Homo sapiens
agacggaggcctactcttcca

SEQ ID NO: 1835942 - DNA, 23 bp, Homo sapiens
agacggggtttgccatgctggcc

SEQ ID NO: 1835943 - DNA, 22 bp, Homo sapiens
agacgttttataagcatcatta

SEQ ID NO: 1835944 - DNA, 15 bp, Homo sapiens
agactcctgcaggca

SEQ ID NO: 1835945 - DNA, 18 bp, Homo sapiens
agactctttttttgagtg

SEQ ID NO: 1835946 - DNA, 11 bp, Homo sapiens
agactggaagg

SEQ ID NO: 1835947 - DNA, 20 bp, Homo sapiens
agactgtgattcttagcaaa

SEQ ID NO: 1835948 - DNA, 16 bp, Homo sapiens
agactgttcctgagcc

SEQ ID NO: 1835949 - DNA, 14 bp, Homo sapiens
agacttcagattcc

SEQ ID NO: 1835950 - DNA, 16 bp, Homo sapiens
agacttcagattcccc

SEQ ID NO: 1835951 - DNA, 12 bp, Homo sapiens
agactttaacat

SEQ ID NO: 1835952 - DNA, 21 bp, Homo sapiens
agactttaacataagctattt

SEQ ID NO: 1835953 - DNA, 15 bp, Homo sapiens
agactttggaaagac

SEQ ID NO: 1835954 - DNA, 13 bp, Homo sapiens
agagaaaaacaaa

SEQ ID NO: 1835955 - DNA, 10 bp, Homo sapiens
agagaagaga

SEQ ID NO: 1835956 - DNA, 12 bp, Homo sapiens
agagacagtcac

SEQ ID NO: 1835957 - DNA, 18 bp, Homo sapiens
agagaccatccctgaagg

SEQ ID NO: 1835958 - DNA, 15 bp, Homo sapiens
agagacctcctgcct

SEQ ID NO: 1835959 - DNA, 20 bp, Homo sapiens
agagactcctgcaggcagcc

SEQ ID NO: 1835960 - DNA, 21 bp, Homo sapiens
agagactccttgagagaccag

SEQ ID NO: 1835961 - DNA, 22 bp, Homo sapiens
agagactccttgagagaccagg

SEQ ID NO: 1835962 - DNA, 15 bp, Homo sapiens
agagagaaaggactc

SEQ ID NO: 1835963 - DNA, 18 bp, Homo sapiens
agagagcttaatgataat

SEQ ID NO: 1835964 - DNA, 15 bp, Homo sapiens
agagagggcaggcat

SEQ ID NO: 1835965 - DNA, 22 bp, Homo sapiens
agagaggtttgcagtcccaagc

SEQ ID NO: 1835966 - DNA, 21 bp, Homo sapiens
agagattggaatgggcagctc

SEQ ID NO: 1835967 - DNA, 16 bp, Homo sapiens
agagattgtggtttca

SEQ ID NO: 1835968 - DNA, 20 bp, Homo sapiens
agagcacacttggcccaagt

SEQ ID NO: 1835969 - DNA, 23 bp, Homo sapiens
agagcaccttagacagtccctgc

SEQ ID NO: 1835970 - DNA, 20 bp, Homo sapiens
agagcagagaccatccctga

SEQ ID NO: 1835971 - DNA, 23 bp, Homo sapiens
agagcagtttctgtcctgctggt

SEQ ID NO: 1835972 - DNA, 13 bp, Homo sapiens
agagcccacgccc

SEQ ID NO: 1835973 - DNA, 14 bp, Homo sapiens
agagccttaataaa

SEQ ID NO: 1835974 - DNA, 15 bp, Homo sapiens
agagccttccagggg

SEQ ID NO: 1835975 - DNA, 11 bp, Homo sapiens
agagccttgcg

SEQ ID NO: 1835976 - DNA, 21 bp, Homo sapiens
agagccttgcggaaggttcta

SEQ ID NO: 1835977 - DNA, 18 bp, Homo sapiens
agagctgacacaaacctg

SEQ ID NO: 1835978 - DNA, 22 bp, Homo sapiens
agagctgacacaaacctgcctg

SEQ ID NO: 1835979 - DNA, 23 bp, Homo sapiens
agagctgacacaaacctgcctgg

SEQ ID NO: 1835980 - DNA, 19 bp, Homo sapiens
agagctggagcctggtgcc

SEQ ID NO: 1835981 - DNA, 13 bp, Homo sapiens
agagcttgctcca

SEQ ID NO: 1835982 - DNA, 15 bp, Homo sapiens
agagcttgctccaga

SEQ ID NO: 1835983 - DNA, 16 bp, Homo sapiens
agagcttgctccagat

SEQ ID NO: 1835984 - DNA, 22 bp, Homo sapiens
agagcttgctccagattctgat

SEQ ID NO: 1835985 - DNA, 19 bp, Homo sapiens
agaggaaatattgctgggg

SEQ ID NO: 1835986 - DNA, 20 bp, Homo sapiens
agaggagtacaggtgaagca

SEQ ID NO: 1835987 - DNA, 18 bp, Homo sapiens
agaggcaactgcattggc

SEQ ID NO: 1835988 - DNA, 13 bp, Homo sapiens
agaggcagtacct

SEQ ID NO: 1835989 - DNA, 20 bp, Homo sapiens
agagggagggagggctccag

SEQ ID NO: 1835990 - DNA, 15 bp, Homo sapiens
agagggaggtaagga

SEQ ID NO: 1835991 - DNA, 20 bp, Homo sapiens
agaggggacgcaggcccctc

SEQ ID NO: 1835992 - DNA, 14 bp, Homo sapiens
agcctttgagactg

SEQ ID NO: 1835993 - DNA, 15 bp, Homo sapiens
agcctttggaaacag

SEQ ID NO: 1835994 - DNA, 14 bp, Homo sapiens
agcggcagatgggg

SEQ ID NO: 1835995 - DNA, 13 bp, Homo sapiens
agcggctggcagc

SEQ ID NO: 1835996 - DNA, 15 bp, Homo sapiens
agcgtgagctgagca

SEQ ID NO: 1835997 - DNA, 18 bp, Homo sapiens
agctaacacacagctccc

SEQ ID NO: 1835998 - DNA, 19 bp, Homo sapiens
agctaacacacagctccca

SEQ ID NO: 1835999 - DNA, 22 bp, Homo sapiens
agctaataattcttcacctaag

SEQ ID NO: 1836000 - DNA, 16 bp, Homo sapiens
agctatcctggctctt

SEQ ID NO: 1836001 - DNA, 13 bp, Homo sapiens
agctatttttcta

SEQ ID NO: 1836002 - DNA, 15 bp, Homo sapiens
agctatttttctaac

SEQ ID NO: 1836003 - DNA, 20 bp, Homo sapiens
agctatttttctaactacaa

SEQ ID NO: 1836004 - DNA, 23 bp, Homo sapiens
agctcaatgagcatgtttagact

SEQ ID NO: 1836005 - DNA, 12 bp, Homo sapiens
agctcacctctc

SEQ ID NO: 1836006 - DNA, 15 bp, Homo sapiens
agctcacctctccct

SEQ ID NO: 1836007 - DNA, 18 bp, Homo sapiens
agctcacctctcccttgg

SEQ ID NO: 1836008 - DNA, 12 bp, Homo sapiens
agctcagagagg

SEQ ID NO: 1836009 - DNA, 14 bp, Homo sapiens
agctcagagagggc

SEQ ID NO: 1836010 - DNA, 14 bp, Homo sapiens
agctcagagagggt

SEQ ID NO: 1836011 - DNA, 16 bp, Homo sapiens
agctcagggcctggct

SEQ ID NO: 1836012 - DNA, 18 bp, Homo sapiens
agctcagggcctggctca

SEQ ID NO: 1836013 - DNA, 20 bp, Homo sapiens
agctcagggcctggctcagg

SEQ ID NO: 1836014 - DNA, 12 bp, Homo sapiens
agctcatttcac

SEQ ID NO: 1836015 - DNA, 15 bp, Homo sapiens
agctccaagctccca

SEQ ID NO: 1836016 - DNA, 17 bp, Homo sapiens
agctccaagctcccagg

SEQ ID NO: 1836017 - DNA, 18 bp, Homo sapiens
agctccaagctcccaggc

SEQ ID NO: 1836018 - DNA, 19 bp, Homo sapiens
agctccaagctcccaggca

SEQ ID NO: 1836019 - DNA, 23 bp, Homo sapiens
agctcccaagggatggtgccctg

SEQ ID NO: 1836020 - DNA, 15 bp, Homo sapiens
agctcctcatccagg

SEQ ID NO: 1836021 - DNA, 19 bp, Homo sapiens
agctcctcatccagggctc

SEQ ID NO: 1836022 - DNA, 21 bp, Homo sapiens
agctcctcatccagggctctg

SEQ ID NO: 1836023 - DNA, 22 bp, Homo sapiens
agctctctgacgcttgtgacag

SEQ ID NO: 1836024 - DNA, 23 bp, Homo sapiens
agctctctgacgcttgtgacagt

SEQ ID NO: 1836025 - DNA, 17 bp, Homo sapiens
agctctggtccatagag

SEQ ID NO: 1836026 - DNA, 20 bp, Homo sapiens
agctctggtccatagagagc

SEQ ID NO: 1836027 - DNA, 15 bp, Homo sapiens
agctgaacctgggta

SEQ ID NO: 1836028 - DNA, 15 bp, Homo sapiens
agctgaatgtttttc

SEQ ID NO: 1836029 - DNA, 16 bp, Homo sapiens
agctgaatgtttttct

SEQ ID NO: 1836030 - DNA, 18 bp, Homo sapiens
agctgaatgtttttctaa

SEQ ID NO: 1836031 - DNA, 21 bp, Homo sapiens
agctgacacaaacctgcctgg

SEQ ID NO: 1836032 - DNA, 15 bp, Homo sapiens
agctgagcaggccac

SEQ ID NO: 1836033 - DNA, 19 bp, Homo sapiens
agctgcctgggatccctca

SEQ ID NO: 1836034 - DNA, 14 bp, Homo sapiens
agctgctggagact

SEQ ID NO: 1836035 - DNA, 14 bp, Homo sapiens
agctggagcctggt

SEQ ID NO: 1836036 - DNA, 19 bp, Homo sapiens
agctggagcctggtgccct

SEQ ID NO: 1836037 - DNA, 20 bp, Homo sapiens
agctggatagacttgggatg

SEQ ID NO: 1836038 - DNA, 23 bp, Homo sapiens
agctgggatgattggagggggga

SEQ ID NO: 1836039 - DNA, 14 bp, Homo sapiens
agctgggcaggttg

SEQ ID NO: 1836040 - DNA, 18 bp, Homo sapiens
agctgggtggcactgcca

SEQ ID NO: 1836041 - DNA, 15 bp, Homo sapiens
agctgtgtctgccaa

SEQ ID NO: 1836042 - DNA, 18 bp, Homo sapiens
agctgttactgtcttcag

SEQ ID NO: 1836043 - DNA, 20 bp, Homo sapiens
agcttaaaggggctagagtg

SEQ ID NO: 1836044 - DNA, 23 bp, Homo sapiens
agcttgctccagattctgatgca

SEQ ID NO: 1836045 - DNA, 16 bp, Homo sapiens
agctttaattaagctc

SEQ ID NO: 1836046 - DNA, 16 bp, Homo sapiens
agctttgaaaattcag

SEQ ID NO: 1836047 - DNA, 19 bp, Homo sapiens
agctttgaaaattcagtgg

SEQ ID NO: 1836048 - DNA, 17 bp, Homo sapiens
aggaaaccacagctgct

SEQ ID NO: 1836049 - DNA, 16 bp, Homo sapiens
aggaaaggctccagga

SEQ ID NO: 1836050 - DNA, 20 bp, Homo sapiens
aggaaaggctccaggagcag

SEQ ID NO: 1836051 - DNA, 16 bp, Homo sapiens
aggaaatattgctggg

SEQ ID NO: 1836052 - DNA, 15 bp, Homo sapiens
aggaacactccttca

SEQ ID NO: 1836053 - DNA, 14 bp, Homo sapiens
aggaagagaaaaaa

SEQ ID NO: 1836054 - DNA, 18 bp, Homo sapiens
aggaagcagctttcccca

SEQ ID NO: 1836055 - DNA, 18 bp, Homo sapiens
aggaagccgctggggcca

SEQ ID NO: 1836056 - DNA, 20 bp, Homo sapiens
aggaagccgctggggccagt

SEQ ID NO: 1836057 - DNA, 12 bp, Homo sapiens
aggaagctcagg

SEQ ID NO: 1836058 - DNA, 15 bp, Homo sapiens
aggaagctcagggcc

SEQ ID NO: 1836059 - DNA, 18 bp, Homo sapiens
aggaagctcagggcctgg

SEQ ID NO: 1836060 - DNA, 22 bp, Homo sapiens
aggaagctcagggcctggctca

SEQ ID NO: 1836061 - DNA, 16 bp, Homo sapiens
aggaagctgagatgaa

SEQ ID NO: 1836062 - DNA, 20 bp, Homo sapiens
aggaaggaaacccagctctg

SEQ ID NO: 1836063 - DNA, 23 bp, Homo sapiens
aggaaggaaacccagctctggtc

SEQ ID NO: 1836064 - DNA, 14 bp, Homo sapiens
aggaaggttctggt

SEQ ID NO: 1836065 - DNA, 21 bp, Homo sapiens
aggaaggttctggtgtgaact

SEQ ID NO: 1836066 - DNA, 22 bp, Homo sapiens
aggaagttagtttttaatctct

SEQ ID NO: 1836067 - DNA, 15 bp, Homo sapiens
aggaataatgggctt

SEQ ID NO: 1836068 - DNA, 16 bp, Homo sapiens
cttttttggctgctga

SEQ ID NO: 1836069 - DNA, 22 bp, Homo sapiens
cttttttggctgctgaaggctc

SEQ ID NO: 1836070 - DNA, 15 bp, Homo sapiens
gaaaaaaatgtattt

SEQ ID NO: 1836071 - DNA, 19 bp, Homo sapiens
gaaaaacaaattcatcaaa

SEQ ID NO: 1836072 - DNA, 11 bp, Homo sapiens
gaaaaagaaaa

SEQ ID NO: 1836073 - DNA, 12 bp, Homo sapiens
gaaaaaggagga

SEQ ID NO: 1836074 - DNA, 19 bp, Homo sapiens
gaaaaataaagaaaagatg

SEQ ID NO: 1836075 - DNA, 16 bp, Homo sapiens
gaaaagttggaaggat

SEQ ID NO: 1836076 - DNA, 20 bp, Homo sapiens
gaaaatcagcctgctccagc

SEQ ID NO: 1836077 - DNA, 22 bp, Homo sapiens
gaaaatcagcctgctccagctg

SEQ ID NO: 1836078 - DNA, 21 bp, Homo sapiens
gaaacacccctctgtctagga

SEQ ID NO: 1836079 - DNA, 22 bp, Homo sapiens
gaaacacccctctgtctaggac

SEQ ID NO: 1836080 - DNA, 19 bp, Homo sapiens
gaaacaccctcacactggg

SEQ ID NO: 1836081 - DNA, 15 bp, Homo sapiens
gaaacagctcgactt

SEQ ID NO: 1836082 - DNA, 20 bp, Homo sapiens
gaaacagctcgactttaaaa

SEQ ID NO: 1836083 - DNA, 20 bp, Homo sapiens
gaaaccacagctgctggaga

SEQ ID NO: 1836084 - DNA, 14 bp, Homo sapiens
gaaacccagctctg

SEQ ID NO: 1836085 - DNA, 16 bp, Homo sapiens
gaaacccagctctggt

SEQ ID NO: 1836086 - DNA, 21 bp, Homo sapiens
gaaactgcttgtttcctagca

SEQ ID NO: 1836087 - DNA, 17 bp, Homo sapiens
gaaactgggttcctgca

SEQ ID NO: 1836088 - DNA, 23 bp, Homo sapiens
gaaagaaagttgcacggctgctg

SEQ ID NO: 1836089 - DNA, 16 bp, Homo sapiens
gaaagagtaggaagac

SEQ ID NO: 1836090 - DNA, 23 bp, Homo sapiens
gaaagcacaggtgggcttcccag

SEQ ID NO: 1836091 - DNA, 23 bp, Homo sapiens
gaaagcccctgcccctcctctcc

SEQ ID NO: 1836092 - DNA, 13 bp, Homo sapiens
gaaaggctccagg

SEQ ID NO: 1836093 - DNA, 16 bp, Homo sapiens
gaaaggctccaggagc

SEQ ID NO: 1836094 - DNA, 22 bp, Homo sapiens
gaaaggctccaggagcagccac

SEQ ID NO: 1836095 - DNA, 19 bp, Homo sapiens
gaaagttgcacggctgctg

SEQ ID NO: 1836096 - DNA, 16 bp, Homo sapiens
gaaagtttacaggaaa

SEQ ID NO: 1836097 - DNA, 15 bp, Homo sapiens
gaaatactgtttgag

SEQ ID NO: 1836098 - DNA, 19 bp, Homo sapiens
gaaatagcttatgaaaaga

SEQ ID NO: 1836099 - DNA, 14 bp, Homo sapiens
gaaatgggcagagc

SEQ ID NO: 1836100 - DNA, 20 bp, Homo sapiens
gaaatgggcagagcagagac

SEQ ID NO: 1836101 - DNA, 16 bp, Homo sapiens
gaaattggaagagcac

SEQ ID NO: 1836102 - DNA, 16 bp, Homo sapiens
gaaatttagcattgta

SEQ ID NO: 1836103 - DNA, 17 bp, Homo sapiens
gaacacataattcagga

SEQ ID NO: 1836104 - DNA, 20 bp, Homo sapiens
gaacacataattcaggaagc

SEQ ID NO: 1836105 - DNA, 12 bp, Homo sapiens
gaacagctgtgt

SEQ ID NO: 1836106 - DNA, 18 bp, Homo sapiens
gaacagtgcttgccacag

SEQ ID NO: 1836107 - DNA, 17 bp, Homo sapiens
gaacatactgattggga

SEQ ID NO: 1836108 - DNA, 15 bp, Homo sapiens
gaacctgcacacagg

SEQ ID NO: 1836109 - DNA, 16 bp, Homo sapiens
gaacctgcacacagga

SEQ ID NO: 1836110 - DNA, 16 bp, Homo sapiens
gaactaaactttcaca

SEQ ID NO: 1836111 - DNA, 17 bp, Homo sapiens
gaactaaactttcacac

SEQ ID NO: 1836112 - DNA, 16 bp, Homo sapiens
gaactcacctggggct

SEQ ID NO: 1836113 - DNA, 21 bp, Homo sapiens
gaactcacctggggctgctgg

SEQ ID NO: 1836114 - DNA, 20 bp, Homo sapiens
gaactctgacaacagacttc

SEQ ID NO: 1836115 - DNA, 15 bp, Homo sapiens
gaacttggaggcacc

SEQ ID NO: 1836116 - DNA, 15 bp, Homo sapiens
gaacttgttttctgg

SEQ ID NO: 1836117 - DNA, 19 bp, Homo sapiens
gaactttgctgagcctgta

SEQ ID NO: 1836118 - DNA, 13 bp, Homo sapiens
gaagaagaaatct

SEQ ID NO: 1836119 - DNA, 17 bp, Homo sapiens
gaagaagaaatctttct

SEQ ID NO: 1836120 - DNA, 14 bp, Homo sapiens
gaagaagctctctc

SEQ ID NO: 1836121 - DNA, 18 bp, Homo sapiens
gaagacagagacctcctg

SEQ ID NO: 1836122 - DNA, 22 bp, Homo sapiens
gaagacctggcaaggacacaga

SEQ ID NO: 1836123 - DNA, 14 bp, Homo sapiens
gaagactttggaaa

SEQ ID NO: 1836124 - DNA, 12 bp, Homo sapiens
gaagcaggaggc

SEQ ID NO: 1836125 - DNA, 16 bp, Homo sapiens
gaagcattctcattgg

SEQ ID NO: 1836126 - DNA, 15 bp, Homo sapiens
gaagcattttataaa

SEQ ID NO: 1836127 - DNA, 16 bp, Homo sapiens
gaagcccaggaaaggc

SEQ ID NO: 1836128 - DNA, 14 bp, Homo sapiens
gaagccgctggggc

SEQ ID NO: 1836129 - DNA, 11 bp, Homo sapiens
gaagcctttgt

SEQ ID NO: 1836130 - DNA, 17 bp, Homo sapiens
gaagctcagggcctggc

SEQ ID NO: 1836131 - DNA, 22 bp, Homo sapiens
gaagctgagatgaaccctggca

SEQ ID NO: 1836132 - DNA, 14 bp, Homo sapiens
gaaggaaacccagc

SEQ ID NO: 1836133 - DNA, 18 bp, Homo sapiens
gaaggaaacccagctctg

SEQ ID NO: 1836134 - DNA, 19 bp, Homo sapiens
gaaggaaacccagctctgg

SEQ ID NO: 1836135 - DNA, 20 bp, Homo sapiens
gaaggactgcagccactgat

SEQ ID NO: 1836136 - DNA, 15 bp, Homo sapiens
gaaggatctgctgag

SEQ ID NO: 1836137 - DNA, 16 bp, Homo sapiens
gaaggcaaatgacttt

SEQ ID NO: 1836138 - DNA, 16 bp, Homo sapiens
gaaggccccgcccagg

SEQ ID NO: 1836139 - DNA, 19 bp, Homo sapiens
gaaggccccgcccaggctt

SEQ ID NO: 1836140 - DNA, 16 bp, Homo sapiens
gaaggctcgagcatgc

SEQ ID NO: 1836141 - DNA, 21 bp, Homo sapiens
gaaggctcgagcatgcctgga

SEQ ID NO: 1836142 - DNA, 23 bp, Homo sapiens
gaaggctcttctccccagagttc

SEQ ID NO: 1836143 - DNA, 20 bp, Homo sapiens
gaagggattttagtcacacg

SEQ ID NO: 1836144 - DNA, 14 bp, Homo sapiens
gaagggcaagaaat

SEQ ID NO: 1836145 - DNA, 19 bp, Homo sapiens
gaaggggaagcactcgtgt

SEQ ID NO: 1836146 - DNA, 19 bp, Homo sapiens
gaagggggctgggacatgg

SEQ ID NO: 1836147 - DNA, 20 bp, Homo sapiens
gagcaccttagacagtccct

SEQ ID NO: 1836148 - DNA, 16 bp, Homo sapiens
gagcagaacaggtagt

SEQ ID NO: 1836149 - DNA, 16 bp, Homo sapiens
gagcagagaccatccc

SEQ ID NO: 1836150 - DNA, 17 bp, Homo sapiens
gagcagcgagcctgcta

SEQ ID NO: 1836151 - DNA, 16 bp, Homo sapiens
gagcatcaggccaggc

SEQ ID NO: 1836152 - DNA, 13 bp, Homo sapiens
gagcatgcctgga

SEQ ID NO: 1836153 - DNA, 11 bp, Homo sapiens
gagcccacgcc

SEQ ID NO: 1836154 - DNA, 22 bp, Homo sapiens
gagcccgcagggccatgcagac

SEQ ID NO: 1836155 - DNA, 21 bp, Homo sapiens
gagcctgggaggtcaaggctg

SEQ ID NO: 1836156 - DNA, 17 bp, Homo sapiens
gagcctggtgctgctgc

SEQ ID NO: 1836157 - DNA, 16 bp, Homo sapiens
gagccttccaggggtg

SEQ ID NO: 1836158 - DNA, 17 bp, Homo sapiens
gagccttccaggggtgg

SEQ ID NO: 1836159 - DNA, 18 bp, Homo sapiens
gagctgacacaaacctgc

SEQ ID NO: 1836160 - DNA, 12 bp, Homo sapiens
gagctggagcct

SEQ ID NO: 1836161 - DNA, 14 bp, Homo sapiens
gagctggagcctgg

SEQ ID NO: 1836162 - DNA, 19 bp, Homo sapiens
gagctggatagacttggga

SEQ ID NO: 1836163 - DNA, 17 bp, Homo sapiens
gagctggccgtgggcct

SEQ ID NO: 1836164 - DNA, 20 bp, Homo sapiens
gagcttgaaatagtgtctga

SEQ ID NO: 1836165 - DNA, 18 bp, Homo sapiens
gagcttgctccagattct

SEQ ID NO: 1836166 - DNA, 14 bp, Homo sapiens
gaggaagccgctgg

SEQ ID NO: 1836167 - DNA, 13 bp, Homo sapiens
gaggaaggaaacc

SEQ ID NO: 1836168 - DNA, 16 bp, Homo sapiens
gaggagcaaaggctga

SEQ ID NO: 1836169 - DNA, 17 bp, Homo sapiens
gaggagcagtgcaggca

SEQ ID NO: 1836170 - DNA, 15 bp, Homo sapiens
gaggagtacaggtga

SEQ ID NO: 1836171 - DNA, 22 bp, Homo sapiens
gaggatctcttgagcctgggag

SEQ ID NO: 1836172 - DNA, 22 bp, Homo sapiens
gaggatgctgacatcatttgta

SEQ ID NO: 1836173 - DNA, 23 bp, Homo sapiens
gaggattgtggaaaaccaggaaa

SEQ ID NO: 1836174 - DNA, 20 bp, Homo sapiens
gaggccccttctaggtggca

SEQ ID NO: 1836175 - DNA, 24 bp, Homo sapiens
gaggcccttctctccagcccctgg

SEQ ID NO: 1836176 - DNA, 12 bp, Homo sapiens
gaggcccttgtc

SEQ ID NO: 1836177 - DNA, 19 bp, Homo sapiens
gaggcggatctttggacag

SEQ ID NO: 1836178 - DNA, 22 bp, Homo sapiens
gaggctagtgtggtgtttcctg

SEQ ID NO: 1836179 - DNA, 14 bp, Homo sapiens
gagggaggtaagga

SEQ ID NO: 1836180 - DNA, 12 bp, Homo sapiens
gagggctccaga

SEQ ID NO: 1836181 - DNA, 14 bp, Homo sapiens
gagggctccagaca

SEQ ID NO: 1836182 - DNA, 14 bp, Homo sapiens
gaggggacgcaggc

SEQ ID NO: 1836183 - DNA, 22 bp, Homo sapiens
gaggggacgcaggcccctctcc

SEQ ID NO: 1836184 - DNA, 22 bp, Homo sapiens
gaggggcctcttatgggctggg

SEQ ID NO: 1836185 - DNA, 15 bp, Homo sapiens
gaggggggaggtggg

SEQ ID NO: 1836186 - DNA, 17 bp, Homo sapiens
gaggtccagccctggct

SEQ ID NO: 1836187 - DNA, 19 bp, Homo sapiens
gaggtccagccctggctga

SEQ ID NO: 1836188 - DNA, 22 bp, Homo sapiens
gaggtccagccctggctgaagg

SEQ ID NO: 1836189 - DNA, 23 bp, Homo sapiens
gaggtccagccctggctgaagga

SEQ ID NO: 1836190 - DNA, 15 bp, Homo sapiens
gaggtgggatcctcc

SEQ ID NO: 1836191 - DNA, 18 bp, Homo sapiens
gaggtgggatcctccagg

SEQ ID NO: 1836192 - DNA, 22 bp, Homo sapiens
gaggtgggatcctccaggtgca

SEQ ID NO: 1836193 - DNA, 16 bp, Homo sapiens
gaggtttgcagtccca

SEQ ID NO: 1836194 - DNA, 19 bp, Homo sapiens
gaggtttgcagtcccaagc

SEQ ID NO: 1836195 - DNA, 22 bp, Homo sapiens
gaggtttgcagtcccaagcggt

SEQ ID NO: 1836196 - DNA, 13 bp, Homo sapiens
ctgaggctgggct

SEQ ID NO: 1836197 - DNA, 17 bp, Homo sapiens
ctgaggctgggctccct

SEQ ID NO: 1836198 - DNA, 22 bp, Homo sapiens
ctgaggctgggctcccttccca

SEQ ID NO: 1836199 - DNA, 12 bp, Homo sapiens
ctgaggtgggag

SEQ ID NO: 1836200 - DNA, 13 bp, Homo sapiens
ctgaggtgggagg

SEQ ID NO: 1836201 - DNA, 14 bp, Homo sapiens
ctgagtctgaaggc

SEQ ID NO: 1836202 - DNA, 16 bp, Homo sapiens
ctgagtgcctggccaa

SEQ ID NO: 1836203 - DNA, 14 bp, Homo sapiens
ctgagtgccttttg

SEQ ID NO: 1836204 - DNA, 16 bp, Homo sapiens
ctgagtgccttttggt

SEQ ID NO: 1836205 - DNA, 20 bp, Homo sapiens
ctgatcctgtgaagtaagga

SEQ ID NO: 1836206 - DNA, 15 bp, Homo sapiens
ctgatggacctgtca

SEQ ID NO: 1836207 - DNA, 12 bp, Homo sapiens
ctgatggagccc

SEQ ID NO: 1836208 - DNA, 15 bp, Homo sapiens
ctgatggagccccac

SEQ ID NO: 1836209 - DNA, 17 bp, Homo sapiens
ctgatggagccccacct

SEQ ID NO: 1836210 - DNA, 17 bp, Homo sapiens
ctgatggcaggatggcc

SEQ ID NO: 1836211 - DNA, 15 bp, Homo sapiens
ctgatgtcctcacca

SEQ ID NO: 1836212 - DNA, 19 bp, Homo sapiens
ctgattgggaggtgcgtgt

SEQ ID NO: 1836213 - DNA, 17 bp, Homo sapiens
ctgattgtgtctcttgg

SEQ ID NO: 1836214 - DNA, 14 bp, Homo sapiens
ctgcaacctgattg

SEQ ID NO: 1836215 - DNA, 22 bp, Homo sapiens
ctgcaatcttctcagaaggcaa

SEQ ID NO: 1836216 - DNA, 18 bp, Homo sapiens
ctgcacaagctgcaccct

SEQ ID NO: 1836217 - DNA, 11 bp, Homo sapiens
ctgcacacagg

SEQ ID NO: 1836218 - DNA, 12 bp, Homo sapiens
ctgcacacagga

SEQ ID NO: 1836219 - DNA, 14 bp, Homo sapiens
ctgcacacaggaca

SEQ ID NO: 1836220 - DNA, 13 bp, Homo sapiens
ctgcaccctcagg

SEQ ID NO: 1836221 - DNA, 17 bp, Homo sapiens
ctgcaccctcaggcagg

SEQ ID NO: 1836222 - DNA, 18 bp, Homo sapiens
ctgcaccctcaggcaggt

SEQ ID NO: 1836223 - DNA, 15 bp, Homo sapiens
ctgcaccggctggcc

SEQ ID NO: 1836224 - DNA, 19 bp, Homo sapiens
ctgcaccggctggcctggc

SEQ ID NO: 1836225 - DNA, 16 bp, Homo sapiens
ctgcactccagcctgg

SEQ ID NO: 1836226 - DNA, 19 bp, Homo sapiens
ctgcactccagcctgggtg

SEQ ID NO: 1836227 - DNA, 20 bp, Homo sapiens
ctgcactccagcctgggtga

SEQ ID NO: 1836228 - DNA, 18 bp, Homo sapiens
ctgcactcccctgctggg

SEQ ID NO: 1836229 - DNA, 17 bp, Homo sapiens
ctgcagatttgggctgg

SEQ ID NO: 1836230 - DNA, 18 bp, Homo sapiens
ctgcagatttgggctgga

SEQ ID NO: 1836231 - DNA, 19 bp, Homo sapiens
ctgcagccaagcaaatgcc

SEQ ID NO: 1836232 - DNA, 12 bp, Homo sapiens
ctgcagctttgt

SEQ ID NO: 1836233 - DNA, 14 bp, Homo sapiens
ctgcaggcagccag

SEQ ID NO: 1836234 - DNA, 16 bp, Homo sapiens
ctgcaggcagccaggc

SEQ ID NO: 1836235 - DNA, 21 bp, Homo sapiens
ctgcagttgccagtcaccccg

SEQ ID NO: 1836236 - DNA, 19 bp, Homo sapiens
ctgcagtttgagacaggag

SEQ ID NO: 1836237 - DNA, 21 bp, Homo sapiens
ctgcagtttgagacaggagac

SEQ ID NO: 1836238 - DNA, 23 bp, Homo sapiens
ctgcatgcgagtgctcatttcag

SEQ ID NO: 1836239 - DNA, 13 bp, Homo sapiens
ctgccaaacacat

SEQ ID NO: 1836240 - DNA, 21 bp, Homo sapiens
ctgccaacttcttcagagctg

SEQ ID NO: 1836241 - DNA, 12 bp, Homo sapiens
ctgccagcccct

SEQ ID NO: 1836242 - DNA, 11 bp, Homo sapiens
ctgccaggcat

SEQ ID NO: 1836243 - DNA, 23 bp, Homo sapiens
ctgccagggacagagggggtggc

SEQ ID NO: 1836244 - DNA, 14 bp, Homo sapiens
ctgccatgccagct

SEQ ID NO: 1836245 - DNA, 19 bp, Homo sapiens
ctgccatgccagcttatct

SEQ ID NO: 1836246 - DNA, 16 bp, Homo sapiens
ctgccatttctgagat

SEQ ID NO: 1836247 - DNA, 12 bp, Homo sapiens
ctgcccacctgg

SEQ ID NO: 1836248 - DNA, 14 bp, Homo sapiens
ctgcccacctggcc

SEQ ID NO: 1836249 - DNA, 15 bp, Homo sapiens
ctgcccacctggcct

SEQ ID NO: 1836250 - DNA, 16 bp, Homo sapiens
ctgccctgcccacctg

SEQ ID NO: 1836251 - DNA, 21 bp, Homo sapiens
ctgccctgcccacctggcctc

SEQ ID NO: 1836252 - DNA, 24 bp, Homo sapiens
ctgccctgtgagtactacagtcct

SEQ ID NO: 1836253 - DNA, 12 bp, Homo sapiens
ctgccctgtggg

SEQ ID NO: 1836254 - DNA, 18 bp, Homo sapiens
ctgccctgtgggccccca

SEQ ID NO: 1836255 - DNA, 19 bp, Homo sapiens
ctgccggggcagccccctc

SEQ ID NO: 1836256 - DNA, 23 bp, Homo sapiens
ctgccggggcagccccctcacag

SEQ ID NO: 1836257 - DNA, 11 bp, Homo sapiens
ctgcctcccat

SEQ ID NO: 1836258 - DNA, 16 bp, Homo sapiens
ctgcctcccatcaccc

SEQ ID NO: 1836259 - DNA, 18 bp, Homo sapiens
ctgcctcccttcatgcat

SEQ ID NO: 1836260 - DNA, 21 bp, Homo sapiens
ctgcctcccttcatgcatgga

SEQ ID NO: 1836261 - DNA, 14 bp, Homo sapiens
ctgcctcctttgtg

SEQ ID NO: 1836262 - DNA, 17 bp, Homo sapiens
ctgcctcctttgtgagg

SEQ ID NO: 1836263 - DNA, 16 bp, Homo sapiens
ctgcctgatggacctg

SEQ ID NO: 1836264 - DNA, 23 bp, Homo sapiens
ctgcctgggatccctcatcctca

SEQ ID NO: 1836265 - DNA, 19 bp, Homo sapiens
ctgcggtgctatctccccc

SEQ ID NO: 1836266 - DNA, 21 bp, Homo sapiens
ctgcggtgctatctcccccag

SEQ ID NO: 1836267 - DNA, 15 bp, Homo sapiens
ctgctaaataaacat

SEQ ID NO: 1836268 - DNA, 23 bp, Homo sapiens
ctgctaatattttcctcctgagt

SEQ ID NO: 1836269 - DNA, 19 bp, Homo sapiens
ctgctatgtatttgcaagg

SEQ ID NO: 1836270 - DNA, 14 bp, Homo sapiens
ctgctccagctgtt

SEQ ID NO: 1836271 - DNA, 17 bp, Homo sapiens
ctgctccccaggccacc

SEQ ID NO: 1836272 - DNA, 18 bp, Homo sapiens
ctgctccccaggccaccc

SEQ ID NO: 1836273 - DNA, 12 bp, Homo sapiens
ctgctgaaggct

SEQ ID NO: 1836274 - DNA, 14 bp, Homo sapiens
ctgctgaaggctcg

SEQ ID NO: 1836275 - DNA, 15 bp, Homo sapiens
ctgctgaaggctcga

SEQ ID NO: 1836276 - DNA, 21 bp, Homo sapiens
ctgctgactgttttctcttga

SEQ ID NO: 1836277 - DNA, 14 bp, Homo sapiens
ctgctgaggcccag

SEQ ID NO: 1836278 - DNA, 10 bp, Homo sapiens
ctgctgcagt

SEQ ID NO: 1836279 - DNA, 13 bp, Homo sapiens
ctgctgcagttgc

SEQ ID NO: 1836280 - DNA, 14 bp, Homo sapiens
ctgctgcagttgcc

SEQ ID NO: 1836281 - DNA, 12 bp, Homo sapiens
ctgctgcccagg

SEQ ID NO: 1836282 - DNA, 19 bp, Homo sapiens
ctgctgccgccccacccag

SEQ ID NO: 1836283 - DNA, 12 bp, Homo sapiens
ctgctgctggct

SEQ ID NO: 1836284 - DNA, 13 bp, Homo sapiens
ctgctgctggctg

SEQ ID NO: 1836285 - DNA, 15 bp, Homo sapiens
ctgctgctggctggt

SEQ ID NO: 1836286 - DNA, 15 bp, Homo sapiens
ctgctgggtgtggcg

SEQ ID NO: 1836287 - DNA, 19 bp, Homo sapiens
ctgcttagcttgcaccttg

SEQ ID NO: 1836288 - DNA, 13 bp, Homo sapiens
ctgcttgaggcaa

SEQ ID NO: 1836289 - DNA, 21 bp, Homo sapiens
ctgcttgaggcaactcatctt

SEQ ID NO: 1836290 - DNA, 18 bp, Homo sapiens
ctggcgtcatgcaaagtc

SEQ ID NO: 1836291 - DNA, 20 bp, Homo sapiens
ctggctccaaaccctcgagg

SEQ ID NO: 1836292 - DNA, 24 bp, Homo sapiens
ctggctcttccaggctgggagagc

SEQ ID NO: 1836293 - DNA, 16 bp, Homo sapiens
ctggctgaaggactgt

SEQ ID NO: 1836294 - DNA, 16 bp, Homo sapiens
ctggcttaacttagta

SEQ ID NO: 1836295 - DNA, 16 bp, Homo sapiens
ctggcttcgcaaaatg

SEQ ID NO: 1836296 - DNA, 16 bp, Homo sapiens
ctgggaaagcccctgc

SEQ ID NO: 1836297 - DNA, 20 bp, Homo sapiens
ctgggaactcacctggggct

SEQ ID NO: 1836298 - DNA, 12 bp, Homo sapiens
ctgggagaccct

SEQ ID NO: 1836299 - DNA, 18 bp, Homo sapiens
ctgggagaccctccccac

SEQ ID NO: 1836300 - DNA, 19 bp, Homo sapiens
ctgggaggtcaaggctgca

SEQ ID NO: 1836301 - DNA, 18 bp, Homo sapiens
ctgggatgattggagggg

SEQ ID NO: 1836302 - DNA, 17 bp, Homo sapiens
ctgggatgtcacagtcc

SEQ ID NO: 1836303 - DNA, 17 bp, Homo sapiens
ctgggatttacacttga

SEQ ID NO: 1836304 - DNA, 20 bp, Homo sapiens
ctgggcctcctcacaacatg

SEQ ID NO: 1836305 - DNA, 20 bp, Homo sapiens
ctgggctcccttcccacctc

SEQ ID NO: 1836306 - DNA, 21 bp, Homo sapiens
ctgggctcctaaccttcctgt

SEQ ID NO: 1836307 - DNA, 15 bp, Homo sapiens
ctgggggaagaagct

SEQ ID NO: 1836308 - DNA, 21 bp, Homo sapiens
ctggggtaccaagagactcct

SEQ ID NO: 1836309 - DNA, 18 bp, Homo sapiens
ctggggtcccagcagctg

SEQ ID NO: 1836310 - DNA, 20 bp, Homo sapiens
ctgggtggcaccagcagcct

SEQ ID NO: 1836311 - DNA, 21 bp, Homo sapiens
ctgggtggcactgccatgcag

SEQ ID NO: 1836312 - DNA, 16 bp, Homo sapiens
ctgggtgtggcgcagc

SEQ ID NO: 1836313 - DNA, 15 bp, Homo sapiens
ctggtattcctgcct

SEQ ID NO: 1836314 - DNA, 18 bp, Homo sapiens
ctggtccatagagagcaa

SEQ ID NO: 1836315 - DNA, 21 bp, Homo sapiens
ctggtccatagagagcaagac

SEQ ID NO: 1836316 - DNA, 21 bp, Homo sapiens
ctggtctatataaccacattt

SEQ ID NO: 1836317 - DNA, 19 bp, Homo sapiens
ctggtctcgaactgctgga

SEQ ID NO: 1836318 - DNA, 16 bp, Homo sapiens
ctggtctctaggctgg

SEQ ID NO: 1836319 - DNA, 12 bp, Homo sapiens
ctggtgctgctg

SEQ ID NO: 1836320 - DNA, 13 bp, Homo sapiens
ctggtggcagctc

SEQ ID NO: 1836321 - DNA, 16 bp, Homo sapiens
ctggtggcagctcacc

SEQ ID NO: 1836322 - DNA, 21 bp, Homo sapiens
ctggtggcagctcacctctcc

SEQ ID NO: 1836323 - DNA, 17 bp, Homo sapiens
ctggtggcttaagtgag

SEQ ID NO: 1836324 - DNA, 21 bp, Homo sapiens
ctggtggcttaagtgagcaga

SEQ ID NO: 1836325 - DNA, 21 bp, Homo sapiens
ctggttagaggttccctttga

SEQ ID NO: 1836326 - DNA, 12 bp, Homo sapiens
ctggttcctccc

SEQ ID NO: 1836327 - DNA, 22 bp, Homo sapiens
ctgtaaaatggagacaccacca

SEQ ID NO: 1836328 - DNA, 17 bp, Homo sapiens
ctgtaagagcttgctcc

SEQ ID NO: 1836329 - DNA, 20 bp, Homo sapiens
ctgtaatcctagcactttgg

SEQ ID NO: 1836330 - DNA, 15 bp, Homo sapiens
ctgtagagtgggagc

SEQ ID NO: 1836331 - DNA, 14 bp, Homo sapiens
ctgtatctgtgtag

SEQ ID NO: 1836332 - DNA, 12 bp, Homo sapiens
ctgtccccagcc

SEQ ID NO: 1836333 - DNA, 14 bp, Homo sapiens
ctgtccccagcctg

SEQ ID NO: 1836334 - DNA, 15 bp, Homo sapiens
ctgtccgagctttga

SEQ ID NO: 1836335 - DNA, 12 bp, Homo sapiens
ctgtcctgccta

SEQ ID NO: 1836336 - DNA, 13 bp, Homo sapiens
ctgtctaggactg

SEQ ID NO: 1836337 - DNA, 18 bp, Homo sapiens
ctgtctcaaaaaaagaaa

SEQ ID NO: 1836338 - DNA, 22 bp, Homo sapiens
ctgtctcaaaaaaagaaaaaga

SEQ ID NO: 1836339 - DNA, 18 bp, Homo sapiens
ctgtcttcagtaagccgt

SEQ ID NO: 1836340 - DNA, 16 bp, Homo sapiens
ctgtgaaaggaaagag

SEQ ID NO: 1836341 - DNA, 22 bp, Homo sapiens
ctgtgaaaggaaagagggaggt

SEQ ID NO: 1836342 - DNA, 15 bp, Homo sapiens
ctgtgaactgaactc

SEQ ID NO: 1836343 - DNA, 16 bp, Homo sapiens
ctgtgaactgaactct

SEQ ID NO: 1836344 - DNA, 15 bp, Homo sapiens
ctgtgacaggcagca

SEQ ID NO: 1836345 - DNA, 18 bp, Homo sapiens
ctgtgacaggcagcagag

SEQ ID NO: 1836346 - DNA, 20 bp, Homo sapiens
ctgtgagtactacagtcctc

SEQ ID NO: 1836347 - DNA, 18 bp, Homo sapiens
ctgtgatggggccctgcc

SEQ ID NO: 1836348 - DNA, 21 bp, Homo sapiens
ctgtgatggggccctgcctcc

SEQ ID NO: 1836349 - DNA, 23 bp, Homo sapiens
ctgtgatggggccctgcctcctt

SEQ ID NO: 1836350 - DNA, 22 bp, Homo sapiens
ctgtgctccctggttctgatga

SEQ ID NO: 1836351 - DNA, 12 bp, Homo sapiens
ctgtgctgagtc

SEQ ID NO: 1836352 - DNA, 22 bp, Homo sapiens
ctgtgctgagtctgaaggctgg

SEQ ID NO: 1836353 - DNA, 11 bp, Homo sapiens
ctgtgctgccc

SEQ ID NO: 1836354 - DNA, 17 bp, Homo sapiens
ctgtgctgccctgccca

SEQ ID NO: 1836355 - DNA, 21 bp, Homo sapiens
ctgtgctgccctgcccacctg

SEQ ID NO: 1836356 - DNA, 14 bp, Homo sapiens
ctgtgggcccccaa

SEQ ID NO: 1836357 - DNA, 19 bp, Homo sapiens
ctgtgtgttaagctctgct

SEQ ID NO: 1836358 - DNA, 12 bp, Homo sapiens
ctgttcagctgg

SEQ ID NO: 1836359 - DNA, 19 bp, Homo sapiens
ctgttcagctggttgaggt

SEQ ID NO: 1836360 - DNA, 16 bp, Homo sapiens
ctgttctcatttgatc

SEQ ID NO: 1836361 - DNA, 17 bp, Homo sapiens
ctgttctctgccctcca

SEQ ID NO: 1836362 - DNA, 21 bp, Homo sapiens
ctgttcttagctcaatgagca

SEQ ID NO: 1836363 - DNA, 21 bp, Homo sapiens
ctgtttcccagcagtggactc

SEQ ID NO: 1836364 - DNA, 21 bp, Homo sapiens
ctgtttgtttctgaaagggac

SEQ ID NO: 1836365 - DNA, 13 bp, Homo sapiens
ctgttttatgact

SEQ ID NO: 1836366 - DNA, 15 bp, Homo sapiens
ctgttttctgaaaca

SEQ ID NO: 1836367 - DNA, 20 bp, Homo sapiens
ctgttttctgaaacacacga

SEQ ID NO: 1836368 - DNA, 13 bp, Homo sapiens
cttaaaataaagt

SEQ ID NO: 1836369 - DNA, 20 bp, Homo sapiens
cttaagtgagcagaacaggt

SEQ ID NO: 1836370 - DNA, 22 bp, Homo sapiens
cttaagtgagcagaacaggtag

SEQ ID NO: 1836371 - DNA, 16 bp, Homo sapiens
cttaagtttatactct

SEQ ID NO: 1836372 - DNA, 16 bp, Homo sapiens
cttaattattgatgtt

SEQ ID NO: 1836373 - DNA, 17 bp, Homo sapiens
cttaattctttgttctg

SEQ ID NO: 1836374 - DNA, 22 bp, Homo sapiens
cttacagctgggtggcactgcc

SEQ ID NO: 1836375 - DNA, 15 bp, Homo sapiens
gcccaggaaaggctc

SEQ ID NO: 1836376 - DNA, 20 bp, Homo sapiens
gcccaggaaaggctccagga

SEQ ID NO: 1836377 - DNA, 24 bp, Homo sapiens
gcccaggaaaggctccaggagcag

SEQ ID NO: 1836378 - DNA, 21 bp, Homo sapiens
gcccaggcttagtcactgaga

SEQ ID NO: 1836379 - DNA, 17 bp, Homo sapiens
gcccaggtttctggtct

SEQ ID NO: 1836380 - DNA, 20 bp, Homo sapiens
gcccagtgcatatgcaatgt

SEQ ID NO: 1836381 - DNA, 16 bp, Homo sapiens
gcccattcattccatt

SEQ ID NO: 1836382 - DNA, 23 bp, Homo sapiens
gcccattcattccattctggaag

SEQ ID NO: 1836383 - DNA, 19 bp, Homo sapiens
gccccaaaactctcctctg

SEQ ID NO: 1836384 - DNA, 16 bp, Homo sapiens
gccccactttgaaggg

SEQ ID NO: 1836385 - DNA, 13 bp, Homo sapiens
gccccatcctctg

SEQ ID NO: 1836386 - DNA, 14 bp, Homo sapiens
gccccatcctctgt

SEQ ID NO: 1836387 - DNA, 12 bp, Homo sapiens
gcccccactggt

SEQ ID NO: 1836388 - DNA, 15 bp, Homo sapiens
gccccggggcctgtt

SEQ ID NO: 1836389 - DNA, 21 bp, Homo sapiens
gccccgttgtgagctggatag

SEQ ID NO: 1836390 - DNA, 18 bp, Homo sapiens
gcccctcagggtccctgg

SEQ ID NO: 1836391 - DNA, 19 bp, Homo sapiens
gcccctcagggtccctggt

SEQ ID NO: 1836392 - DNA, 18 bp, Homo sapiens
gcccctcccacagcgctg

SEQ ID NO: 1836393 - DNA, 11 bp, Homo sapiens
gcccctctcct

SEQ ID NO: 1836394 - DNA, 14 bp, Homo sapiens
gcccctctcctccg

SEQ ID NO: 1836395 - DNA, 21 bp, Homo sapiens
gcccctgccattgtagcgtct

SEQ ID NO: 1836396 - DNA, 15 bp, Homo sapiens
gccccttggacacgc

SEQ ID NO: 1836397 - DNA, 13 bp, Homo sapiens
gcccgaatacaaa

SEQ ID NO: 1836398 - DNA, 13 bp, Homo sapiens
gcccgcagggcca

SEQ ID NO: 1836399 - DNA, 19 bp, Homo sapiens
gcccgcagggccatgcaga

SEQ ID NO: 1836400 - DNA, 21 bp, Homo sapiens
gccctacttctttgctttgcc

SEQ ID NO: 1836401 - DNA, 23 bp, Homo sapiens
gccctccaagaccttctccttca

SEQ ID NO: 1836402 - DNA, 13 bp, Homo sapiens
gccctctgcccac

SEQ ID NO: 1836403 - DNA, 16 bp, Homo sapiens
gccctgagctttctgc

SEQ ID NO: 1836404 - DNA, 21 bp, Homo sapiens
gccctgcccacctggcctctg

SEQ ID NO: 1836405 - DNA, 13 bp, Homo sapiens
gccctgcctcctt

SEQ ID NO: 1836406 - DNA, 14 bp, Homo sapiens
gccctgcctccttt

SEQ ID NO: 1836407 - DNA, 18 bp, Homo sapiens
gccctggctgaaggactg

SEQ ID NO: 1836408 - DNA, 22 bp, Homo sapiens
gccctgtcctgcctaaggctga

SEQ ID NO: 1836409 - DNA, 22 bp, Homo sapiens
gccctgttctctaccaagctat

SEQ ID NO: 1836410 - DNA, 14 bp, Homo sapiens
gcccttctctccag

SEQ ID NO: 1836411 - DNA, 16 bp, Homo sapiens
gcccttctctccagcc

SEQ ID NO: 1836412 - DNA, 17 bp, Homo sapiens
gcccttctctccagccc

SEQ ID NO: 1836413 - DNA, 18 bp, Homo sapiens
gcccttgtcgtgggatgg

SEQ ID NO: 1836414 - DNA, 18 bp, Homo sapiens
gccgagattgcaccactg

SEQ ID NO: 1836415 - DNA, 11 bp, Homo sapiens
gccgccagctg

SEQ ID NO: 1836416 - DNA, 17 bp, Homo sapiens
gccgccagctgccgcac

SEQ ID NO: 1836417 - DNA, 15 bp, Homo sapiens
gccgccatgctcctg

SEQ ID NO: 1836418 - DNA, 15 bp, Homo sapiens
gccgccccacccaga

SEQ ID NO: 1836419 - DNA, 18 bp, Homo sapiens
gccgtctacctgaggggc

SEQ ID NO: 1836420 - DNA, 23 bp, Homo sapiens
gccgtctacctgaggggcctctt

SEQ ID NO: 1836421 - DNA, 20 bp, Homo sapiens
gccgtgtaaccatggaccca

SEQ ID NO: 1836422 - DNA, 20 bp, Homo sapiens
gccgttgatgttggctggga

SEQ ID NO: 1836423 - DNA, 23 bp, Homo sapiens
gcctcacacggtttgaagcctgg

SEQ ID NO: 1836424 - DNA, 17 bp, Homo sapiens
gcctcacagtccttacc

SEQ ID NO: 1836425 - DNA, 21 bp, Homo sapiens
gcctcccaactcaccccagcc

SEQ ID NO: 1836426 - DNA, 14 bp, Homo sapiens
gcctcccacgactg

SEQ ID NO: 1836427 - DNA, 15 bp, Homo sapiens
gcctcccttcatgca

SEQ ID NO: 1836428 - DNA, 20 bp, Homo sapiens
gcctcctttgtgaggaagcc

SEQ ID NO: 1836429 - DNA, 21 bp, Homo sapiens
gcctcctttgtgaggaagccg

SEQ ID NO: 1836430 - DNA, 17 bp, Homo sapiens
gcctctcccctgcctgc

SEQ ID NO: 1836431 - DNA, 20 bp, Homo sapiens
gcctctccttgtggcctggg

SEQ ID NO: 1836432 - DNA, 21 bp, Homo sapiens
gcctctccttgtggcctgggc

SEQ ID NO: 1836433 - DNA, 16 bp, Homo sapiens
gcctctgcactcccct

SEQ ID NO: 1836434 - DNA, 18 bp, Homo sapiens
gctgctgaaggctcgagc

SEQ ID NO: 1836435 - DNA, 12 bp, Homo sapiens
gctgctgcccag

SEQ ID NO: 1836436 - DNA, 21 bp, Homo sapiens
gctggagactcctaggcagga

SEQ ID NO: 1836437 - DNA, 12 bp, Homo sapiens
gctggccaggct

SEQ ID NO: 1836438 - DNA, 18 bp, Homo sapiens
gctggccgtgggcctggg

SEQ ID NO: 1836439 - DNA, 20 bp, Homo sapiens
gctggcctggcccctcaggg

SEQ ID NO: 1836440 - DNA, 23 bp, Homo sapiens
gctgggaactcacctggggctgc

SEQ ID NO: 1836441 - DNA, 13 bp, Homo sapiens
gctgggagaccct

SEQ ID NO: 1836442 - DNA, 18 bp, Homo sapiens
gctgggagagccttccag

SEQ ID NO: 1836443 - DNA, 19 bp, Homo sapiens
gctgggagagccttccagg

SEQ ID NO: 1836444 - DNA, 22 bp, Homo sapiens
gctgggagagccttccaggggt

SEQ ID NO: 1836445 - DNA, 21 bp, Homo sapiens
gctgggatgattggagggggg

SEQ ID NO: 1836446 - DNA, 16 bp, Homo sapiens
gctggggtcccagcag

SEQ ID NO: 1836447 - DNA, 21 bp, Homo sapiens
gctgggtggcaccagcagcct

SEQ ID NO: 1836448 - DNA, 23 bp, Homo sapiens
gctgggtggcaccagcagcctgg

SEQ ID NO: 1836449 - DNA, 15 bp, Homo sapiens
gctgggtgtggcgca

SEQ ID NO: 1836450 - DNA, 17 bp, Homo sapiens
gctgggttctacccagg

SEQ ID NO: 1836451 - DNA, 18 bp, Homo sapiens
gctgggttctacccaggt

SEQ ID NO: 1836452 - DNA, 21 bp, Homo sapiens
gctgggttctacccaggtgct

SEQ ID NO: 1836453 - DNA, 20 bp, Homo sapiens
gctggtgagtgatgcggcag

SEQ ID NO: 1836454 - DNA, 15 bp, Homo sapiens
gctgtgctgccctgc

SEQ ID NO: 1836455 - DNA, 22 bp, Homo sapiens
gctgtgctgccctgcccacctg

SEQ ID NO: 1836456 - DNA, 13 bp, Homo sapiens
gctgtgtctgcca

SEQ ID NO: 1836457 - DNA, 19 bp, Homo sapiens
gctgtgtctgccaaacaca

SEQ ID NO: 1836458 - DNA, 18 bp, Homo sapiens
gcttaagtgagcagaaca

SEQ ID NO: 1836459 - DNA, 22 bp, Homo sapiens
gcttaattattgatgttttcat

SEQ ID NO: 1836460 - DNA, 12 bp, Homo sapiens
gcttagagcagt

SEQ ID NO: 1836461 - DNA, 17 bp, Homo sapiens
gcttagctttgctctgc

SEQ ID NO: 1836462 - DNA, 21 bp, Homo sapiens
gcttaggagaagtcttctatt

SEQ ID NO: 1836463 - DNA, 15 bp, Homo sapiens
gcttataggtggcct

SEQ ID NO: 1836464 - DNA, 17 bp, Homo sapiens
gcttataggtggcctct

SEQ ID NO: 1836465 - DNA, 13 bp, Homo sapiens
gcttatctcaggg

SEQ ID NO: 1836466 - DNA, 15 bp, Homo sapiens
gcttcattagagcag

SEQ ID NO: 1836467 - DNA, 15 bp, Homo sapiens
gcttccagtgaggct

SEQ ID NO: 1836468 - DNA, 16 bp, Homo sapiens
gcttccagtgaggctc

SEQ ID NO: 1836469 - DNA, 20 bp, Homo sapiens
gcttccagtgaggctctgcc

SEQ ID NO: 1836470 - DNA, 22 bp, Homo sapiens
gcttcccagtggctgctgccca

SEQ ID NO: 1836471 - DNA, 22 bp, Homo sapiens
gcttctcactgccatgccagct

SEQ ID NO: 1836472 - DNA, 13 bp, Homo sapiens
gcttctgcctgca

SEQ ID NO: 1836473 - DNA, 16 bp, Homo sapiens
gcttcttcagagactc

SEQ ID NO: 1836474 - DNA, 19 bp, Homo sapiens
gcttcttcagagactcctg

SEQ ID NO: 1836475 - DNA, 21 bp, Homo sapiens
gcttcttcagagactcctgca

SEQ ID NO: 1836476 - DNA, 14 bp, Homo sapiens
gcttgccacagagc

SEQ ID NO: 1836477 - DNA, 12 bp, Homo sapiens
gcttgctccaga

SEQ ID NO: 1836478 - DNA, 20 bp, Homo sapiens
gcttgctccagattctgatg

SEQ ID NO: 1836479 - DNA, 12 bp, Homo sapiens
gcttggggaaaa

SEQ ID NO: 1836480 - DNA, 12 bp, Homo sapiens
gcttgtgacagt

SEQ ID NO: 1836481 - DNA, 14 bp, Homo sapiens
gcttgtgacagtgc

SEQ ID NO: 1836482 - DNA, 15 bp, Homo sapiens
gcttgtttcctagca

SEQ ID NO: 1836483 - DNA, 12 bp, Homo sapiens
gctttaatataa

SEQ ID NO: 1836484 - DNA, 14 bp, Homo sapiens
gctttaatataaat

SEQ ID NO: 1836485 - DNA, 19 bp, Homo sapiens
gctttaatataaatgcaaa

SEQ ID NO: 1836486 - DNA, 22 bp, Homo sapiens
gctttccccatgtctcgactca

SEQ ID NO: 1836487 - DNA, 11 bp, Homo sapiens
gctttctgtct

SEQ ID NO: 1836488 - DNA, 20 bp, Homo sapiens
gcttttccaaacccaggcta

SEQ ID NO: 1836489 - DNA, 16 bp, Homo sapiens
ggaaaatggccatgca

SEQ ID NO: 1836490 - DNA, 21 bp, Homo sapiens
ggaaaatggccatgcaggagg

SEQ ID NO: 1836491 - DNA, 16 bp, Homo sapiens
ggaaaccacagctgct

SEQ ID NO: 1836492 - DNA, 18 bp, Homo sapiens
ggaaaccacagctgctgg

SEQ ID NO: 1836493 - DNA, 16 bp, Homo sapiens
ggaaagagtaggaaga

SEQ ID NO: 1836494 - DNA, 17 bp, Homo sapiens
ggaaaggctccaggagc

SEQ ID NO: 1836495 - DNA, 21 bp, Homo sapiens
ggaaaggctccaggagcagcc

SEQ ID NO: 1836496 - DNA, 14 bp, Homo sapiens
ggaaatgggcagag

SEQ ID NO: 1836497 - DNA, 16 bp, Homo sapiens
ggaaatgggcagagca

SEQ ID NO: 1836498 - DNA, 18 bp, Homo sapiens
ggaaatgggcagagcaga

SEQ ID NO: 1836499 - DNA, 22 bp, Homo sapiens
ggaaattcccttcatctggaac

SEQ ID NO: 1836500 - DNA, 17 bp, Homo sapiens
ggaaattggaagagcac

SEQ ID NO: 1836501 - DNA, 17 bp, Homo sapiens
ggaaatttagcattgta

SEQ ID NO: 1836502 - DNA, 17 bp, Homo sapiens
ggaacaccataggtcac

SEQ ID NO: 1836503 - DNA, 15 bp, Homo sapiens
ggaacactccttcac

SEQ ID NO: 1836504 - DNA, 22 bp, Homo sapiens
ggaacatcatcaaggcactgcc

SEQ ID NO: 1836505 - DNA, 12 bp, Homo sapiens
ggaagaagaaat

SEQ ID NO: 1836506 - DNA, 14 bp, Homo sapiens
ggaagacaatgtga

SEQ ID NO: 1836507 - DNA, 13 bp, Homo sapiens
ggaagactttgga

SEQ ID NO: 1836508 - DNA, 17 bp, Homo sapiens
ggaagactttggaaaga

SEQ ID NO: 1836509 - DNA, 15 bp, Homo sapiens
ggaagagaaaaaata

SEQ ID NO: 1836510 - DNA, 18 bp, Homo sapiens
ggaagagcccgcagggcc

SEQ ID NO: 1836511 - DNA, 13 bp, Homo sapiens
ggaagcagctttc

SEQ ID NO: 1836512 - DNA, 15 bp, Homo sapiens
ggaagctcagggcct

SEQ ID NO: 1836513 - DNA, 22 bp, Homo sapiens
ggaagctcagggcctggctcag

SEQ ID NO: 1836514 - DNA, 16 bp, Homo sapiens
ggaaggaaacccagct

SEQ ID NO: 1836515 - DNA, 13 bp, Homo sapiens
ggaaggatctgct

SEQ ID NO: 1836516 - DNA, 18 bp, Homo sapiens
ggaaggatctgctgaggc

SEQ ID NO: 1836517 - DNA, 23 bp, Homo sapiens
ggaaggggagataagggtatctg

SEQ ID NO: 1836518 - DNA, 13 bp, Homo sapiens
ggaagtcctctgg

SEQ ID NO: 1836519 - DNA, 16 bp, Homo sapiens
ggaatcagcaagaaga

SEQ ID NO: 1836520 - DNA, 21 bp, Homo sapiens
ggaatcatctcctttgcagaa

SEQ ID NO: 1836521 - DNA, 14 bp, Homo sapiens
ggaatccactccca

SEQ ID NO: 1836522 - DNA, 14 bp, Homo sapiens
ggaatgcctgagtg

SEQ ID NO: 1836523 - DNA, 18 bp, Homo sapiens
ggaatgcctgagtgcctg

SEQ ID NO: 1836524 - DNA, 13 bp, Homo sapiens
ggacaccctgtga

SEQ ID NO: 1836525 - DNA, 22 bp, Homo sapiens
ggacacgctcagtggggcagag

SEQ ID NO: 1836526 - DNA, 16 bp, Homo sapiens
ggacagaagcagctct

SEQ ID NO: 1836527 - DNA, 16 bp, Homo sapiens
ggacagagggggtggc

SEQ ID NO: 1836528 - DNA, 20 bp, Homo sapiens
ggacaggtgtgccgacagaa

SEQ ID NO: 1836529 - DNA, 15 bp, Homo sapiens
ggacattttatgtct

SEQ ID NO: 1836530 - DNA, 17 bp, Homo sapiens
ggaccagcttttcccaa

SEQ ID NO: 1836531 - DNA, 21 bp, Homo sapiens
ggaccccgagcctggctccaa

SEQ ID NO: 1836532 - DNA, 13 bp, Homo sapiens
ggaccctgaggcc

SEQ ID NO: 1836533 - DNA, 14 bp, Homo sapiens
ggaccctgaggccc

SEQ ID NO: 1836534 - DNA, 19 bp, Homo sapiens
ggacctcaggtgagaagca

SEQ ID NO: 1836535 - DNA, 17 bp, Homo sapiens
ggacgcaggcccctctc

SEQ ID NO: 1836536 - DNA, 17 bp, Homo sapiens
ggacgctacccgggaag

SEQ ID NO: 1836537 - DNA, 20 bp, Homo sapiens
ggacgctacccgggaagggg

SEQ ID NO: 1836538 - DNA, 14 bp, Homo sapiens
ggacggtgctccag

SEQ ID NO: 1836539 - DNA, 17 bp, Homo sapiens
ggacggtgctccaggca

SEQ ID NO: 1836540 - DNA, 18 bp, Homo sapiens
ggacggtgctccaggcag

SEQ ID NO: 1836541 - DNA, 21 bp, Homo sapiens
ggactgcagagggctccagag

SEQ ID NO: 1836542 - DNA, 12 bp, Homo sapiens
ggactgcagtgt

SEQ ID NO: 1836543 - DNA, 20 bp, Homo sapiens
ggactgtgacaggcagcaga

SEQ ID NO: 1836544 - DNA, 17 bp, Homo sapiens
ggagaagcggctggcag

SEQ ID NO: 1836545 - DNA, 17 bp, Homo sapiens
ggagagccttccagggg

SEQ ID NO: 1836546 - DNA, 17 bp, Homo sapiens
ggagagctagcagcagg

SEQ ID NO: 1836547 - DNA, 17 bp, Homo sapiens
ggagagctggagcctgg

SEQ ID NO: 1836548 - DNA, 14 bp, Homo sapiens
ggagaggggacgca

SEQ ID NO: 1836549 - DNA, 15 bp, Homo sapiens
ggagaggggcacagg

SEQ ID NO: 1836550 - DNA, 15 bp, Homo sapiens
ggagatcccacatat

SEQ ID NO: 1836551 - DNA, 19 bp, Homo sapiens
ggagatttgctcaatacct

SEQ ID NO: 1836552 - DNA, 23 bp, Homo sapiens
ggagcacggctctgtccccagcc

SEQ ID NO: 1836553 - DNA, 13 bp, Homo sapiens
ggagcagccacat

SEQ ID NO: 1836554 - DNA, 13 bp, Homo sapiens
ggagcagcctcag

SEQ ID NO: 1836555 - DNA, 18 bp, Homo sapiens
ggagcagtgcaggcacag

SEQ ID NO: 1836556 - DNA, 14 bp, Homo sapiens
ggagctcagagagg

SEQ ID NO: 1836557 - DNA, 16 bp, Homo sapiens
tgaaggccccgcccag

SEQ ID NO: 1836558 - DNA, 18 bp, Homo sapiens
tgaaggccccgcccaggc

SEQ ID NO: 1836559 - DNA, 16 bp, Homo sapiens
tgaaggctgggttctg

SEQ ID NO: 1836560 - DNA, 19 bp, Homo sapiens
tgaagggcaagaaatggcg

SEQ ID NO: 1836561 - DNA, 21 bp, Homo sapiens
tgaaggggtgcacccacctgt

SEQ ID NO: 1836562 - DNA, 22 bp, Homo sapiens
tgaaggggtgcacccacctgtt

SEQ ID NO: 1836563 - DNA, 20 bp, Homo sapiens
tgaagggtaatatggactca

SEQ ID NO: 1836564 - DNA, 18 bp, Homo sapiens
tgaaggtagaatgttttc

SEQ ID NO: 1836565 - DNA, 19 bp, Homo sapiens
tgaaggtagaatgttttca

SEQ ID NO: 1836566 - DNA, 22 bp, Homo sapiens
tgaagtaaccttataggttact

SEQ ID NO: 1836567 - DNA, 21 bp, Homo sapiens
tgaagtcgtcttaactcacca

SEQ ID NO: 1836568 - DNA, 12 bp, Homo sapiens
tgaataatacag

SEQ ID NO: 1836569 - DNA, 20 bp, Homo sapiens
tcactttttttttttttccc

SEQ ID NO: 1836570 - DNA, 15 bp, Homo sapiens
tcagaatttccctct

SEQ ID NO: 1836571 - DNA, 19 bp, Homo sapiens
tcagacagctgcctgggat

SEQ ID NO: 1836572 - DNA, 20 bp, Homo sapiens
tcagacagctgcctgggatc

SEQ ID NO: 1836573 - DNA, 22 bp, Homo sapiens
tcagagactcctgcaggcagcc

SEQ ID NO: 1836574 - DNA, 14 bp, Homo sapiens
tcagagctgacaca

SEQ ID NO: 1836575 - DNA, 18 bp, Homo sapiens
tcagagctgacacaggat

SEQ ID NO: 1836576 - DNA, 19 bp, Homo sapiens
tcagaggtttgcttcctca

SEQ ID NO: 1836577 - DNA, 22 bp, Homo sapiens
tcagataactgttatttataat

SEQ ID NO: 1836578 - DNA, 21 bp, Homo sapiens
tcagattccccactcagcctt

SEQ ID NO: 1836579 - DNA, 22 bp, Homo sapiens
tcagattccccactcagccttt

SEQ ID NO: 1836580 - DNA, 15 bp, Homo sapiens
tcagcaaaagatgct

SEQ ID NO: 1836581 - DNA, 15 bp, Homo sapiens
tcagcactgcctgct

SEQ ID NO: 1836582 - DNA, 17 bp, Homo sapiens
tcagcagaacctgcaca

SEQ ID NO: 1836583 - DNA, 21 bp, Homo sapiens
tcagcagaacctgcacacagg

SEQ ID NO: 1836584 - DNA, 22 bp, Homo sapiens
tcagcagaacctgcacacagga

SEQ ID NO: 1836585 - DNA, 22 bp, Homo sapiens
tcagcccctgatcctgtgaagt

SEQ ID NO: 1836586 - DNA, 23 bp, Homo sapiens
tcagccgtgtaaccatggaccca

SEQ ID NO: 1836587 - DNA, 10 bp, Homo sapiens
tcagcctggg

SEQ ID NO: 1836588 - DNA, 15 bp, Homo sapiens
tcagccttttgggaa

SEQ ID NO: 1836589 - DNA, 14 bp, Homo sapiens
tcagctcactgttc

SEQ ID NO: 1836590 - DNA, 17 bp, Homo sapiens
tcagctccccagagtcc

SEQ ID NO: 1836591 - DNA, 16 bp, Homo sapiens
tcagctgaacctgggt

SEQ ID NO: 1836592 - DNA, 23 bp, Homo sapiens
tcagcttggcactcaggtgctga

SEQ ID NO: 1836593 - DNA, 14 bp, Homo sapiens
tcaggaagctcagg

SEQ ID NO: 1836594 - DNA, 16 bp, Homo sapiens
tcaggaagctcagggc

SEQ ID NO: 1836595 - DNA, 17 bp, Homo sapiens
tcaggaagctcagggcc

SEQ ID NO: 1836596 - DNA, 14 bp, Homo sapiens
tctgacccatgctg

SEQ ID NO: 1836597 - DNA, 19 bp, Homo sapiens
tctgacccatgctgccctg

SEQ ID NO: 1836598 - DNA, 20 bp, Homo sapiens
tctgacccatgctgccctgt

SEQ ID NO: 1836599 - DNA, 18 bp, Homo sapiens
tctgacgcttgtgacagt

SEQ ID NO: 1836600 - DNA, 20 bp, Homo sapiens
tctgacgcttgtgacagtgc

SEQ ID NO: 1836601 - DNA, 13 bp, Homo sapiens
tctgagaactcat

SEQ ID NO: 1836602 - DNA, 23 bp, Homo sapiens
tctgaggctgaaattcagaatat

SEQ ID NO: 1836603 - DNA, 16 bp, Homo sapiens
tctgatgatgtgcctg

SEQ ID NO: 1836604 - DNA, 15 bp, Homo sapiens
tctgatggcttctcc

SEQ ID NO: 1836605 - DNA, 17 bp, Homo sapiens
tctgcaatcttctcaga

SEQ ID NO: 1836606 - DNA, 19 bp, Homo sapiens
tctgcacaagctgcaccct

SEQ ID NO: 1836607 - DNA, 17 bp, Homo sapiens
tctgcactcccctgctg

SEQ ID NO: 1836608 - DNA, 15 bp, Homo sapiens
tctgcctcccatcac

SEQ ID NO: 1836609 - DNA, 16 bp, Homo sapiens
tctgcctcccatcacc

SEQ ID NO: 1836610 - DNA, 20 bp, Homo sapiens
tctgcctcccatcacccgct

SEQ ID NO: 1836611 - DNA, 15 bp, Homo sapiens
tctgctaaataaaca

SEQ ID NO: 1836612 - DNA, 17 bp, Homo sapiens
tctgctctggtggctta

SEQ ID NO: 1836613 - DNA, 22 bp, Homo sapiens
tctgctgccgccccacccagat

SEQ ID NO: 1836614 - DNA, 14 bp, Homo sapiens
tctgctgctggctg

SEQ ID NO: 1836615 - DNA, 15 bp, Homo sapiens
tctgctgctggctgg

SEQ ID NO: 1836616 - DNA, 13 bp, Homo sapiens
tctggaaagggca

SEQ ID NO: 1836617 - DNA, 18 bp, Homo sapiens
tctggaagtgactttggc

SEQ ID NO: 1836618 - DNA, 13 bp, Homo sapiens
tctggattcccag

SEQ ID NO: 1836619 - DNA, 17 bp, Homo sapiens
tctggattcccaggatg

SEQ ID NO: 1836620 - DNA, 23 bp, Homo sapiens
tctggctcttccaggctgggaga

SEQ ID NO: 1836621 - DNA, 15 bp, Homo sapiens
tctgggatgtcacag

SEQ ID NO: 1836622 - DNA, 19 bp, Homo sapiens
tctgggatgtcacagtcca

SEQ ID NO: 1836623 - DNA, 21 bp, Homo sapiens
tctgggcaggactcagctccc

SEQ ID NO: 1836624 - DNA, 13 bp, Homo sapiens
tctggtctatata

SEQ ID NO: 1836625 - DNA, 18 bp, Homo sapiens
tctggtctctaggctggg

SEQ ID NO: 1836626 - DNA, 23 bp, Homo sapiens
tctggtgactttcctctttggtc

SEQ ID NO: 1836627 - DNA, 12 bp, Homo sapiens
tctggtggctta

SEQ ID NO: 1836628 - DNA, 16 bp, Homo sapiens
tctgtaagagcttgct

SEQ ID NO: 1836629 - DNA, 12 bp, Homo sapiens
tctgtcctgctg

SEQ ID NO: 1836630 - DNA, 22 bp, Homo sapiens
tctgtctccttaacactgagct

SEQ ID NO: 1836631 - DNA, 15 bp, Homo sapiens
tctgtgaaaggaaag

SEQ ID NO: 1836632 - DNA, 21 bp, Homo sapiens
tctgtgaaaggaaagagggag

SEQ ID NO: 1836633 - DNA, 22 bp, Homo sapiens
tctgtgaaaggaaagagggagg

SEQ ID NO: 1836634 - DNA, 15 bp, Homo sapiens
tctgttttatgactt

SEQ ID NO: 1836635 - DNA, 18 bp, Homo sapiens
tcttaaaaagtggaaaaa

SEQ ID NO: 1836636 - DNA, 15 bp, Homo sapiens
tcttaattctttgtt

SEQ ID NO: 1836637 - DNA, 18 bp, Homo sapiens
tcttaattctttgttctg

SEQ ID NO: 1836638 - DNA, 19 bp, Homo sapiens
tcttaattctttgttctgt

SEQ ID NO: 1836639 - DNA, 20 bp, Homo sapiens
tcttaattctttgttctgtt

SEQ ID NO: 1836640 - DNA, 22 bp, Homo sapiens
tcttagctcaatgagcatgttt

SEQ ID NO: 1836641 - DNA, 23 bp, Homo sapiens
tcttaggttggcaaaaaggcagg

SEQ ID NO: 1836642 - DNA, 21 bp, Homo sapiens
tcttagtatgtgcatttaatt

SEQ ID NO: 1836643 - DNA, 12 bp, Homo sapiens
tcttatggatgt

SEQ ID NO: 1836644 - DNA, 13 bp, Homo sapiens
tcttatgggctgg

SEQ ID NO: 1836645 - DNA, 20 bp, Homo sapiens
tcttattcccttcctgccag

SEQ ID NO: 1836646 - DNA, 12 bp, Homo sapiens
tcttcagagctg

SEQ ID NO: 1836647 - DNA, 13 bp, Homo sapiens
tcttcagagctga

SEQ ID NO: 1836648 - DNA, 20 bp, Homo sapiens
tcttcagttaagcctttgga

SEQ ID NO: 1836649 - DNA, 14 bp, Homo sapiens
tcttcctccctccc

SEQ ID NO: 1836650 - DNA, 15 bp, Homo sapiens
tcttcctccctccct

SEQ ID NO: 1836651 - DNA, 12 bp, Homo sapiens
tcttctatttat

SEQ ID NO: 1836652 - DNA, 23 bp, Homo sapiens
tcttctcagaaggcaaatgactt

SEQ ID NO: 1836653 - DNA, 13 bp, Homo sapiens
tcttctcggggac

SEQ ID NO: 1836654 - DNA, 13 bp, Homo sapiens
tcttgagcctggg

SEQ ID NO: 1836655 - DNA, 16 bp, Homo sapiens
tcttgagcctgggagg

SEQ ID NO: 1836656 - DNA, 14 bp, Homo sapiens
tcttgataagacca

SEQ ID NO: 1836657 - DNA, 14 bp, Homo sapiens
tcttgtagtcttgg

SEQ ID NO: 1836658 - DNA, 17 bp, Homo sapiens
tcttgtagtcttggcta

SEQ ID NO: 1836659 - DNA, 14 bp, Homo sapiens
tcttgtattaagaa

SEQ ID NO: 1836660 - DNA, 20 bp, Homo sapiens
tcttgtttatacctttgcct

SEQ ID NO: 1836661 - DNA, 18 bp, Homo sapiens
tctttaaaaactcactta

SEQ ID NO: 1836662 - DNA, 15 bp, Homo sapiens
tctttcctgaggctg

SEQ ID NO: 1836663 - DNA, 17 bp, Homo sapiens
tctttcctgaggctggg

SEQ ID NO: 1836664 - DNA, 13 bp, Homo sapiens
tctttctccctca

SEQ ID NO: 1836665 - DNA, 20 bp, Homo sapiens
tctttcttacaaggaaggtg

SEQ ID NO: 1836666 - DNA, 14 bp, Homo sapiens
tctttgccaccctc

SEQ ID NO: 1836667 - DNA, 16 bp, Homo sapiens
tctttgccaccctcat

SEQ ID NO: 1836668 - DNA, 18 bp, Homo sapiens
tctttgccaccctcatgc

SEQ ID NO: 1836669 - DNA, 13 bp, Homo sapiens
tctttgctttgcc

SEQ ID NO: 1836670 - DNA, 17 bp, Homo sapiens
tctttggacactcacac

SEQ ID NO: 1836671 - DNA, 17 bp, Homo sapiens
tctttggaccctgaggc

SEQ ID NO: 1836672 - DNA, 19 bp, Homo sapiens
tctttttttgagtgacagc

SEQ ID NO: 1836673 - DNA, 21 bp, Homo sapiens
tgaaaaaaaacctgagattta

SEQ ID NO: 1836674 - DNA, 23 bp, Homo sapiens
tgaaaacactgttctctgccctc

SEQ ID NO: 1836675 - DNA, 15 bp, Homo sapiens
tgaaaagaaaaatga

SEQ ID NO: 1836676 - DNA, 13 bp, Homo sapiens
tgaaacacaaaca

SEQ ID NO: 1836677 - DNA, 21 bp, Homo sapiens
tgaaactccaccttgcgggga

SEQ ID NO: 1836678 - DNA, 19 bp, Homo sapiens
tgaaactgcttgtttccta

SEQ ID NO: 1836679 - DNA, 20 bp, Homo sapiens
tgaaactgcttgtttcctag

SEQ ID NO: 1836680 - DNA, 14 bp, Homo sapiens
tgaaatactgtttg

SEQ ID NO: 1836681 - DNA, 16 bp, Homo sapiens
tgaaatcagttactct

SEQ ID NO: 1836682 - DNA, 17 bp, Homo sapiens
tgaaatcagttactctt

SEQ ID NO: 1836683 - DNA, 19 bp, Homo sapiens
tgaaatcttacagctgggt

SEQ ID NO: 1836684 - DNA, 15 bp, Homo sapiens
tgaaatgcattttgc

SEQ ID NO: 1836685 - DNA, 21 bp, Homo sapiens
tgaaatgcattttgctagaca

SEQ ID NO: 1836686 - DNA, 14 bp, Homo sapiens
tgaacaagagaagc

SEQ ID NO: 1836687 - DNA, 16 bp, Homo sapiens
tgaacaagagaagcat

SEQ ID NO: 1836688 - DNA, 17 bp, Homo sapiens
tgaacaagagaagcatt

SEQ ID NO: 1836689 - DNA, 23 bp, Homo sapiens
tgaacaagagaagcattctcatt

SEQ ID NO: 1836690 - DNA, 13 bp, Homo sapiens
tgaacagctgtgt

SEQ ID NO: 1836691 - DNA, 15 bp, Homo sapiens
tgaacagctgtgtct

SEQ ID NO: 1836692 - DNA, 17 bp, Homo sapiens
tgaacagctgtgtctgc

SEQ ID NO: 1836693 - DNA, 20 bp, Homo sapiens
tgaacagctgtgtctgccaa

SEQ ID NO: 1836694 - DNA, 20 bp, Homo sapiens
tgaacatgtgccttttctga

SEQ ID NO: 1836695 - DNA, 12 bp, Homo sapiens
tgaacctgccct

SEQ ID NO: 1836696 - DNA, 21 bp, Homo sapiens
tgaactatggacggtgctcca

SEQ ID NO: 1836697 - DNA, 19 bp, Homo sapiens
tgaactgaactctgacaac

SEQ ID NO: 1836698 - DNA, 15 bp, Homo sapiens
tgaactttgctgagc

SEQ ID NO: 1836699 - DNA, 12 bp, Homo sapiens
tgaagatgaaca

SEQ ID NO: 1836700 - DNA, 21 bp, Homo sapiens
tgaagattctatgttaatatt

SEQ ID NO: 1836701 - DNA, 12 bp, Homo sapiens
tgaagcaggagg

SEQ ID NO: 1836702 - DNA, 15 bp, Homo sapiens
tgaagccaaagccaa

SEQ ID NO: 1836703 - DNA, 23 bp, Homo sapiens
tgaaggactgtgacaggcagcag

SEQ ID NO: 1836704 - DNA, 23 bp, Homo sapiens
ggcccttctctccagcccctgga

SEQ ID NO: 1836705 - DNA, 23 bp, Homo sapiens
ggccgggaccccgagcctggctc

SEQ ID NO: 1836706 - DNA, 19 bp, Homo sapiens
ggcctcactaggcttctgg

SEQ ID NO: 1836707 - DNA, 22 bp, Homo sapiens
ggcctcccaactcaccccagcc

SEQ ID NO: 1836708 - DNA, 16 bp, Homo sapiens
ggcctgcaagggagtg

SEQ ID NO: 1836709 - DNA, 17 bp, Homo sapiens
ggcctggccagggcctg

SEQ ID NO: 1836710 - DNA, 18 bp, Homo sapiens
ggcctggccagggcctgg

SEQ ID NO: 1836711 - DNA, 14 bp, Homo sapiens
ggcctggcccctca

SEQ ID NO: 1836712 - DNA, 17 bp, Homo sapiens
ggcctggcccctcaggg

SEQ ID NO: 1836713 - DNA, 14 bp, Homo sapiens
ggcctgggccagag

SEQ ID NO: 1836714 - DNA, 18 bp, Homo sapiens
ggcctggggtaccaagag

SEQ ID NO: 1836715 - DNA, 15 bp, Homo sapiens
ggcctgtccacaggc

SEQ ID NO: 1836716 - DNA, 21 bp, Homo sapiens
ggcctgtgtctagttgtttga

SEQ ID NO: 1836717 - DNA, 21 bp, Homo sapiens
ggcctgttttagaaggttctc

SEQ ID NO: 1836718 - DNA, 23 bp, Homo sapiens
ggcgcagcatattcaggaagctc

SEQ ID NO: 1836719 - DNA, 20 bp, Homo sapiens
ggcggctggggtcccagcag

SEQ ID NO: 1836720 - DNA, 13 bp, Homo sapiens
ggcgtctgctctg

SEQ ID NO: 1836721 - DNA, 18 bp, Homo sapiens
ggcgtgagccaccaaacc

SEQ ID NO: 1836722 - DNA, 12 bp, Homo sapiens
ggcgtggagctg

SEQ ID NO: 1836723 - DNA, 12 bp, Homo sapiens
ggctacacaggg

SEQ ID NO: 1836724 - DNA, 17 bp, Homo sapiens
ggctacatctccaaata

SEQ ID NO: 1836725 - DNA, 15 bp, Homo sapiens
ggctaggggctgggg

SEQ ID NO: 1836726 - DNA, 19 bp, Homo sapiens
ggctcaggtggggtcactc

SEQ ID NO: 1836727 - DNA, 9 bp, Homo sapiens
ggctccaga

SEQ ID NO: 1836728 - DNA, 13 bp, Homo sapiens
ggctccaggagca

SEQ ID NO: 1836729 - DNA, 16 bp, Homo sapiens
ggctcccttcccacct

SEQ ID NO: 1836730 - DNA, 18 bp, Homo sapiens
ggctcccttcccacctct

SEQ ID NO: 1836731 - DNA, 15 bp, Homo sapiens
ggctctgcctcccat

SEQ ID NO: 1836732 - DNA, 18 bp, Homo sapiens
ggctctgtccccagcctg

SEQ ID NO: 1836733 - DNA, 23 bp, Homo sapiens
ggctctgtccccagcctgggaaa

SEQ ID NO: 1836734 - DNA, 12 bp, Homo sapiens
ggctcttccagg

SEQ ID NO: 1836735 - DNA, 18 bp, Homo sapiens
ggctcttccaggctggga

SEQ ID NO: 1836736 - DNA, 24 bp, Homo sapiens
ggctcttccaggctgggagagcct

SEQ ID NO: 1836737 - DNA, 13 bp, Homo sapiens
ggctgaaggactg

SEQ ID NO: 1836738 - DNA, 14 bp, Homo sapiens
ggctgaaggactgt

SEQ ID NO: 1836739 - DNA, 15 bp, Homo sapiens
ggctgaggtgggagg

SEQ ID NO: 1836740 - DNA, 22 bp, Homo sapiens
ggctgatgccaagttgtttgag

SEQ ID NO: 1836741 - DNA, 15 bp, Homo sapiens
ggctgccggggcagc

SEQ ID NO: 1836742 - DNA, 15 bp, Homo sapiens
ggctgctgaaggctc

SEQ ID NO: 1836743 - DNA, 12 bp, Homo sapiens
ggctgctgccca

SEQ ID NO: 1836744 - DNA, 14 bp, Homo sapiens
ggctgctgcccagg

SEQ ID NO: 1836745 - DNA, 22 bp, Homo sapiens
ggctggaacagattcacactgt

SEQ ID NO: 1836746 - DNA, 13 bp, Homo sapiens
ggctgggagagcc

SEQ ID NO: 1836747 - DNA, 18 bp, Homo sapiens
ggctggggaagtcctctg

SEQ ID NO: 1836748 - DNA, 16 bp, Homo sapiens
ggctggggtcccagca

SEQ ID NO: 1836749 - DNA, 17 bp, Homo sapiens
ggctggggtcccagcag

SEQ ID NO: 1836750 - DNA, 18 bp, Homo sapiens
ggctggggtcccagcagc

SEQ ID NO: 1836751 - DNA, 21 bp, Homo sapiens
ggctggggtcccagcagctgc

SEQ ID NO: 1836752 - DNA, 21 bp, Homo sapiens
ggctgggttctacccaggtgc

SEQ ID NO: 1836753 - DNA, 21 bp, Homo sapiens
ggctgtcgggggctgtggatg

SEQ ID NO: 1836754 - DNA, 18 bp, Homo sapiens
gtggccgaaccagaacca

SEQ ID NO: 1836755 - DNA, 12 bp, Homo sapiens
gtggcctgggcc

SEQ ID NO: 1836756 - DNA, 13 bp, Homo sapiens
gtggctgctgccc

SEQ ID NO: 1836757 - DNA, 13 bp, Homo sapiens
gtgggatcctcca

SEQ ID NO: 1836758 - DNA, 15 bp, Homo sapiens
gtgggatcctccagg

SEQ ID NO: 1836759 - DNA, 17 bp, Homo sapiens
gtgggcccaatgcactt

SEQ ID NO: 1836760 - DNA, 23 bp, Homo sapiens
gtgggcttcccagtggctgctgc

SEQ ID NO: 1836761 - DNA, 23 bp, Homo sapiens
gtgggggtgcagatgaggttgct

SEQ ID NO: 1836762 - DNA, 15 bp, Homo sapiens
gtggggtcactctgg

SEQ ID NO: 1836763 - DNA, 22 bp, Homo sapiens
gtggggtcactctggcagctca

SEQ ID NO: 1836764 - DNA, 21 bp, Homo sapiens
gtgggttttcatcaagactgg

SEQ ID NO: 1836765 - DNA, 14 bp, Homo sapiens
gtggtcccacccca

SEQ ID NO: 1836766 - DNA, 12 bp, Homo sapiens
gtggtggagcca

SEQ ID NO: 1836767 - DNA, 22 bp, Homo sapiens
gtggtggagccagtaaacagag

SEQ ID NO: 1836768 - DNA, 16 bp, Homo sapiens
gtggtgtttcctggca

SEQ ID NO: 1836769 - DNA, 12 bp, Homo sapiens
gtgtataaacaa

SEQ ID NO: 1836770 - DNA, 19 bp, Homo sapiens
gtgtataaacaagaaaaat

SEQ ID NO: 1836771 - DNA, 13 bp, Homo sapiens
gtgtccaaagcag

SEQ ID NO: 1836772 - DNA, 20 bp, Homo sapiens
gtgtctcttggtcctgctgc

SEQ ID NO: 1836773 - DNA, 22 bp, Homo sapiens
gtgtctcttggtcctgctgcag

SEQ ID NO: 1836774 - DNA, 14 bp, Homo sapiens
gtgttaagctctgc

SEQ ID NO: 1836775 - DNA, 20 bp, Homo sapiens
gtgttcacactgtaaacatt

SEQ ID NO: 1836776 - DNA, 16 bp, Homo sapiens
gtgttcagcagaacct

SEQ ID NO: 1836777 - DNA, 16 bp, Homo sapiens
gtgttctcatgaagca

SEQ ID NO: 1836778 - DNA, 14 bp, Homo sapiens
gtgtttaagacatt

SEQ ID NO: 1836779 - DNA, 22 bp, Homo sapiens
gtgtttaagacatttttggaag

SEQ ID NO: 1836780 - DNA, 12 bp, Homo sapiens
gttaagcctttg

SEQ ID NO: 1836781 - DNA, 13 bp, Homo sapiens
gttaagtctgttt

SEQ ID NO: 1836782 - DNA, 15 bp, Homo sapiens
gttaagtctgtttta

SEQ ID NO: 1836783 - DNA, 19 bp, Homo sapiens
gttaatatttataggtcac

SEQ ID NO: 1836784 - DNA, 19 bp, Homo sapiens
gttagaagaggtggcccca

SEQ ID NO: 1836785 - DNA, 19 bp, Homo sapiens
gttagaggttccctttgac

SEQ ID NO: 1836786 - DNA, 19 bp, Homo sapiens
gttagtttctccaagcagg

SEQ ID NO: 1836787 - DNA, 22 bp, Homo sapiens
gttatatataaatatattatta

SEQ ID NO: 1836788 - DNA, 20 bp, Homo sapiens
gttatcacctagctgaatgt

SEQ ID NO: 1836789 - DNA, 23 bp, Homo sapiens
gttatgaacagctgtgtctgcca

SEQ ID NO: 1836790 - DNA, 20 bp, Homo sapiens
gttatttataatcacttttt

SEQ ID NO: 1836791 - DNA, 15 bp, Homo sapiens
gttcagcagaacctg

SEQ ID NO: 1836792 - DNA, 18 bp, Homo sapiens
gttcattaaacgtcattc

SEQ ID NO: 1836793 - DNA, 17 bp, Homo sapiens
gttccaccatcaagcca

SEQ ID NO: 1836794 - DNA, 15 bp, Homo sapiens
gttccccaagacatt

SEQ ID NO: 1836795 - DNA, 21 bp, Homo sapiens
gttccctttgacgccatccca

SEQ ID NO: 1836796 - DNA, 22 bp, Homo sapiens
gttcccttttttggctgctgaa

SEQ ID NO: 1836797 - DNA, 23 bp, Homo sapiens
gttcctcccctcctcctggactc

SEQ ID NO: 1836798 - DNA, 14 bp, Homo sapiens
gttctcatgaagca

SEQ ID NO: 1836799 - DNA, 16 bp, Homo sapiens
gttctggctcttccag

SEQ ID NO: 1836800 - DNA, 20 bp, Homo sapiens
gttctggctcttccaggctg

SEQ ID NO: 1836801 - DNA, 15 bp, Homo sapiens
gttctggtgtgaact

SEQ ID NO: 1836802 - DNA, 18 bp, Homo sapiens
gttctggtgtgaactaaa

SEQ ID NO: 1836803 - DNA, 18 bp, Homo sapiens
gttcttgtattaagaatg

SEQ ID NO: 1836804 - DNA, 14 bp, Homo sapiens
gttgaagcctttgt

SEQ ID NO: 1836805 - DNA, 24 bp, Homo sapiens
gttgagacctcagcttggcactca

SEQ ID NO: 1836806 - DNA, 23 bp, Homo sapiens
gttgatagcacagaccctgccct

SEQ ID NO: 1836807 - DNA, 14 bp, Homo sapiens
gttggaaggatctg

SEQ ID NO: 1836808 - DNA, 17 bp, Homo sapiens
gttggaaggatctgctg

SEQ ID NO: 1836809 - DNA, 19 bp, Homo sapiens
gttggaaggatctgctgag

SEQ ID NO: 1836810 - DNA, 18 bp, Homo sapiens
gttggtcccccttccatg

SEQ ID NO: 1836811 - DNA, 15 bp, Homo sapiens
gttggttttcttctt

SEQ ID NO: 1836812 - DNA, 16 bp, Homo sapiens
gttgtcaaggaagaag

SEQ ID NO: 1836813 - DNA, 20 bp, Homo sapiens
gttgtcaaggaagaagaaat

SEQ ID NO: 1836814 - DNA, 18 bp, Homo sapiens
gttgtttgagaaattaag

SEQ ID NO: 1836815 - DNA, 20 bp, Homo sapiens
gttgtttgattcagacagct

SEQ ID NO: 1836816 - DNA, 19 bp, Homo sapiens
gtttaaatgaacaagagaa

SEQ ID NO: 1836817 - DNA, 23 bp, Homo sapiens
gtttaaatgaacaagagaagcat

SEQ ID NO: 1836818 - DNA, 12 bp, Homo sapiens
gtttaatggtag

SEQ ID NO: 1836819 - DNA, 17 bp, Homo sapiens
gtttagatgaatgtcag

SEQ ID NO: 1836820 - DNA, 21 bp, Homo sapiens
gtttcacagcacttacaattt

SEQ ID NO: 1836821 - DNA, 16 bp, Homo sapiens
gtttcctggcactgct

SEQ ID NO: 1836822 - DNA, 21 bp, Homo sapiens
gtttcctggcactgcttccag

SEQ ID NO: 1836823 - DNA, 18 bp, Homo sapiens
gtttctgaaagggacgct

SEQ ID NO: 1836824 - DNA, 14 bp, Homo sapiens
gtttgaagcctgga

SEQ ID NO: 1836825 - DNA, 19 bp, Homo sapiens
gtttgaggtttttaagcct

SEQ ID NO: 1836826 - DNA, 16 bp, Homo sapiens
gtttgattcagacagc

SEQ ID NO: 1836827 - DNA, 20 bp, Homo sapiens
gtttgggccccagaggctgg

SEQ ID NO: 1836828 - DNA, 17 bp, Homo sapiens
gtttgtcacatgaaaca

SEQ ID NO: 1836829 - DNA, 20 bp, Homo sapiens
gtttgtcctttttcactttg

SEQ ID NO: 1836830 - DNA, 15 bp, Homo sapiens
gtttgtgttctgttt

SEQ ID NO: 1836831 - DNA, 22 bp, Homo sapiens
gtttgttggttggttttcttct

SEQ ID NO: 1836832 - DNA, 16 bp, Homo sapiens
gttttactgcagcttt

SEQ ID NO: 1836833 - DNA, 20 bp, Homo sapiens
gttttataagcatcattatt

SEQ ID NO: 1836834 - DNA, 19 bp, Homo sapiens
gttttctcttgagagggtg

SEQ ID NO: 1836835 - DNA, 18 bp, Homo sapiens
gtttttctaggcctgggg

SEQ ID NO: 1836836 - DNA, 23 bp, Homo sapiens
taaaaaactgctgactgttttct

SEQ ID NO: 1836837 - DNA, 17 bp, Homo sapiens
taaaaaagataaacaca

SEQ ID NO: 1836838 - DNA, 16 bp, Homo sapiens
taaaatgaaatgcatt

SEQ ID NO: 1836839 - DNA, 22 bp, Homo sapiens
taaaatttttatgtaattatat

SEQ ID NO: 1836840 - DNA, 21 bp, Homo sapiens
taaacaagaaaaataaagaaa

SEQ ID NO: 1836841 - DNA, 21 bp, Homo sapiens
taaacattggttcttgtatta

SEQ ID NO: 1836842 - DNA, 17 bp, Homo sapiens
taaacgatttttaaaat

SEQ ID NO: 1836843 - DNA, 21 bp, Homo sapiens
taaacgatttttaaaatgtac

SEQ ID NO: 1836844 - DNA, 16 bp, Homo sapiens
taaactggcttaactt

SEQ ID NO: 1836845 - DNA, 12 bp, Homo sapiens
taaactttcaca

SEQ ID NO: 1836846 - DNA, 14 bp, Homo sapiens
taaagaaaagatgc

SEQ ID NO: 1836847 - DNA, 13 bp, Homo sapiens
taaagtcaggggt

SEQ ID NO: 1836848 - DNA, 22 bp, Homo sapiens
taaagtgaagaatttatctctt

SEQ ID NO: 1836849 - DNA, 23 bp, Homo sapiens
taaataaccaattcctcatttgt

SEQ ID NO: 1836850 - DNA, 13 bp, Homo sapiens
taaatatattatt

SEQ ID NO: 1836851 - DNA, 20 bp, Homo sapiens
taaatatattattacttgta

SEQ ID NO: 1836852 - DNA, 22 bp, Homo sapiens
taaatatattattacttgtaaa

SEQ ID NO: 1836853 - DNA, 13 bp, Homo sapiens
taaatgaacaaga

SEQ ID NO: 1836854 - DNA, 15 bp, Homo sapiens
taaatgaacaagaga

SEQ ID NO: 1836855 - DNA, 13 bp, Homo sapiens
taaatgcccagcc

SEQ ID NO: 1836856 - DNA, 14 bp, Homo sapiens
taaatgcccagccc

SEQ ID NO: 1836857 - DNA, 20 bp, Homo sapiens
taaatgtctagttgtaacac

SEQ ID NO: 1836858 - DNA, 16 bp, Homo sapiens
taaattatttattatt

SEQ ID NO: 1836859 - DNA, 15 bp, Homo sapiens
taacaaaatttgaat

SEQ ID NO: 1836860 - DNA, 14 bp, Homo sapiens
taacaacaattatt

SEQ ID NO: 1836861 - DNA, 18 bp, Homo sapiens
taacaacaattatttgaa

SEQ ID NO: 1836862 - DNA, 15 bp, Homo sapiens
taacacacagctccc

SEQ ID NO: 1836863 - DNA, 17 bp, Homo sapiens
taacacacagctcccat

SEQ ID NO: 1836864 - DNA, 15 bp, Homo sapiens
taacagtcatcattt

SEQ ID NO: 1836865 - DNA, 18 bp, Homo sapiens
taacagtcatcatttatc

SEQ ID NO: 1836866 - DNA, 16 bp, Homo sapiens
taacatttctgttctc

SEQ ID NO: 1836867 - DNA, 17 bp, Homo sapiens
taacatttctgttctca

SEQ ID NO: 1836868 - DNA, 19 bp, Homo sapiens
taaccaattcctcatttgt

SEQ ID NO: 1836869 - DNA, 23 bp, Homo sapiens
taaccacctacaaggagataaga

SEQ ID NO: 1836870 - DNA, 12 bp, Homo sapiens
taacctttctgg

SEQ ID NO: 1836871 - DNA, 21 bp, Homo sapiens
taactacaaaggtttaaatga

SEQ ID NO: 1836872 - DNA, 17 bp, Homo sapiens
taactattgcccaggtt

SEQ ID NO: 1836873 - DNA, 17 bp, Homo sapiens
taactgagtgccttttg

SEQ ID NO: 1836874 - DNA, 17 bp, Homo sapiens
taactgttatttataat

SEQ ID NO: 1836875 - DNA, 16 bp, Homo sapiens
taagaactaaaatgtt

SEQ ID NO: 1836876 - DNA, 21 bp, Homo sapiens
taagaatgaaatactgtttga

SEQ ID NO: 1836877 - DNA, 16 bp, Homo sapiens
taagagcttgctccag

SEQ ID NO: 1836878 - DNA, 20 bp, Homo sapiens
taagagtaacagtcatcatt

SEQ ID NO: 1836879 - DNA, 23 bp, Homo sapiens
taagatataatttaaacgtgatt

SEQ ID NO: 1836880 - DNA, 20 bp, Homo sapiens
taagcatcattatttatgta

SEQ ID NO: 1836881 - DNA, 13 bp, Homo sapiens
taagcattagctt

SEQ ID NO: 1836882 - DNA, 15 bp, Homo sapiens
taagcattagcttta

SEQ ID NO: 1836883 - DNA, 21 bp, Homo sapiens
taagcattagctttaattaag

SEQ ID NO: 1836884 - DNA, 21 bp, Homo sapiens
taagcctttggaaacagctcg

SEQ ID NO: 1836885 - DNA, 16 bp, Homo sapiens
taagctatttttctaa

SEQ ID NO: 1836886 - DNA, 17 bp, Homo sapiens
taagctatttttctaac

SEQ ID NO: 1836887 - DNA, 22 bp, Homo sapiens
taagctgttactgtcttcagta

SEQ ID NO: 1836888 - DNA, 14 bp, Homo sapiens
taaggaaactgggt

SEQ ID NO: 1836889 - DNA, 12 bp, Homo sapiens
taaggattttat

SEQ ID NO: 1836890 - DNA, 17 bp, Homo sapiens
taaggattttatgcttt

SEQ ID NO: 1836891 - DNA, 20 bp, Homo sapiens
taaggattttatgctttaaa

SEQ ID NO: 1836892 - DNA, 16 bp, Homo sapiens
taaggcgtggagctgc

SEQ ID NO: 1836893 - DNA, 20 bp, Homo sapiens
taaggcgtggagctgcctga

SEQ ID NO: 1836894 - DNA, 14 bp, Homo sapiens
taagggcagagtca

SEQ ID NO: 1836895 - DNA, 12 bp, Homo sapiens
taagtctctgtg

SEQ ID NO: 1836896 - DNA, 21 bp, Homo sapiens
taagtctgttttatgacttca

SEQ ID NO: 1836897 - DNA, 16 bp, Homo sapiens
taataaattatttatt

SEQ ID NO: 1836898 - DNA, 16 bp, Homo sapiens
taatataaatgcaaat

SEQ ID NO: 1836899 - DNA, 22 bp, Homo sapiens
taatatggactcagccttgcaa

SEQ ID NO: 1836900 - DNA, 23 bp, Homo sapiens
taatatggactcagccttgcaaa

SEQ ID NO: 1836901 - DNA, 22 bp, Homo sapiens
taatattttcctcctgagtgct

SEQ ID NO: 1836902 - DNA, 19 bp, Homo sapiens
taatcacttttttccacat

SEQ ID NO: 1836903 - DNA, 16 bp, Homo sapiens
taatctcacagcattt

SEQ ID NO: 1836904 - DNA, 21 bp, Homo sapiens
taatctcacagcatttgccaa

SEQ ID NO: 1836905 - DNA, 20 bp, Homo sapiens
taatctgatggcttctccag

SEQ ID NO: 1836906 - DNA, 16 bp, Homo sapiens
taatggtagttttaca

SEQ ID NO: 1836907 - DNA, 22 bp, Homo sapiens
taatgtagttttgtgatgcatt

SEQ ID NO: 1836908 - DNA, 21 bp, Homo sapiens
taatgttgggtagaaagagat

SEQ ID NO: 1836909 - DNA, 12 bp, Homo sapiens
taattctcaggc

SEQ ID NO: 1836910 - DNA, 15 bp, Homo sapiens
taattctttgttctg

SEQ ID NO: 1836911 - DNA, 19 bp, Homo sapiens
taattctttgttctgtttt

SEQ ID NO: 1836912 - DNA, 23 bp, Homo sapiens
taatttttatttttggcaaagcc

SEQ ID NO: 1836913 - DNA, 17 bp, Homo sapiens
tacaaacacctggactt

SEQ ID NO: 1836914 - DNA, 16 bp, Homo sapiens
tacaaaggtttaaatg

SEQ ID NO: 1836915 - DNA, 17 bp, Homo sapiens
tacaaaggtttaaatga

SEQ ID NO: 1836916 - DNA, 18 bp, Homo sapiens
tacaaaggtttaaatgaa

SEQ ID NO: 1836917 - DNA, 17 bp, Homo sapiens
tacaaggaaggtggtgg

SEQ ID NO: 1836918 - DNA, 21 bp, Homo sapiens
tacaattttccctcttcactt

SEQ ID NO: 1836919 - DNA, 20 bp, Homo sapiens
tacacagggatgtacaaggc

SEQ ID NO: 1836920 - DNA, 19 bp, Homo sapiens
tacactcgtatgatacttc

SEQ ID NO: 1836921 - DNA, 22 bp, Homo sapiens
tacactgtgctgagtctgaagg

SEQ ID NO: 1836922 - DNA, 19 bp, Homo sapiens
tacagagcccacgccccca

SEQ ID NO: 1836923 - DNA, 22 bp, Homo sapiens
tacagagcccacgcccccactg

SEQ ID NO: 1836924 - DNA, 21 bp, Homo sapiens
tacagctgggtggcactgcca

SEQ ID NO: 1836925 - DNA, 16 bp, Homo sapiens
tacaggcgtgagccac

SEQ ID NO: 1836926 - DNA, 20 bp, Homo sapiens
tacagggaatgcctgagtgc

SEQ ID NO: 1836927 - DNA, 15 bp, Homo sapiens
tacagtatctcaggg

SEQ ID NO: 1836928 - DNA, 18 bp, Homo sapiens
tacagtcctcccatctca

SEQ ID NO: 1836929 - DNA, 17 bp, Homo sapiens
tacagtcttgcagcagg

SEQ ID NO: 1836930 - DNA, 18 bp, Homo sapiens
tacatcaatgataatgct

SEQ ID NO: 1836931 - DNA, 20 bp, Homo sapiens
tacatcaatgataatgctaa

SEQ ID NO: 1836932 - DNA, 15 bp, Homo sapiens
taccacccaatgctg

SEQ ID NO: 1836933 - DNA, 13 bp, Homo sapiens
taccagcagagca

SEQ ID NO: 1836934 - DNA, 20 bp, Homo sapiens
tacccgggaagggggctggg

SEQ ID NO: 1836935 - DNA, 23 bp, Homo sapiens
tacccgggaagggggctgggaca

SEQ ID NO: 1836936 - DNA, 15 bp, Homo sapiens
tacctaattgtggat

SEQ ID NO: 1836937 - DNA, 18 bp, Homo sapiens
tacctcggtgccttcctc

SEQ ID NO: 1836938 - DNA, 13 bp, Homo sapiens
tacctgtccccct

SEQ ID NO: 1836939 - DNA, 22 bp, Homo sapiens
tacgccaggggaaaatcagcct

SEQ ID NO: 1836940 - DNA, 21 bp, Homo sapiens
tactaagtaatctcacagcat

SEQ ID NO: 1836941 - DNA, 22 bp, Homo sapiens
tactaagtaatctcacagcatt

SEQ ID NO: 1836942 - DNA, 13 bp, Homo sapiens
tactacagagaag

SEQ ID NO: 1836943 - DNA, 12 bp, Homo sapiens
tactacagtcct

SEQ ID NO: 1836944 - DNA, 17 bp, Homo sapiens
tactacagtcctcccat

SEQ ID NO: 1836945 - DNA, 20 bp, Homo sapiens
tactacagtcctcccatctc

SEQ ID NO: 1836946 - DNA, 22 bp, Homo sapiens
tactcataaggcatatacaaat

SEQ ID NO: 1836947 - DNA, 14 bp, Homo sapiens
tactcccatctgtg

SEQ ID NO: 1836948 - DNA, 16 bp, Homo sapiens
tactcccatctgtgaa

SEQ ID NO: 1836949 - DNA, 21 bp, Homo sapiens
tactgtcttcagtaagccgtg

SEQ ID NO: 1836950 - DNA, 16 bp, Homo sapiens
tacttgtaaatataaa

SEQ ID NO: 1836951 - DNA, 19 bp, Homo sapiens
tacttgtaaatataaagac

SEQ ID NO: 1836952 - DNA, 17 bp, Homo sapiens
tactttaaccctttctg

SEQ ID NO: 1836953 - DNA, 16 bp, Homo sapiens
tagaagcttaaaataa

SEQ ID NO: 1836954 - DNA, 19 bp, Homo sapiens
tagaaggttctctcctccc

SEQ ID NO: 1836955 - DNA, 16 bp, Homo sapiens
tagacagtccctgcca

SEQ ID NO: 1836956 - DNA, 17 bp, Homo sapiens
tagacagtccctgccaa

SEQ ID NO: 1836957 - DNA, 20 bp, Homo sapiens
tagagcaggcgttcagctca

SEQ ID NO: 1836958 - DNA, 15 bp, Homo sapiens
tgcactcccctgctg

SEQ ID NO: 1836959 - DNA, 17 bp, Homo sapiens
tgcactttgctttaata

SEQ ID NO: 1836960 - DNA, 21 bp, Homo sapiens
tgcactttgctttaatataaa

SEQ ID NO: 1836961 - DNA, 15 bp, Homo sapiens
tgcagacatgagtgc

SEQ ID NO: 1836962 - DNA, 22 bp, Homo sapiens
tgcagacctcatgcccagctct

SEQ ID NO: 1836963 - DNA, 21 bp, Homo sapiens
tgcagcaggatctagaggggg

SEQ ID NO: 1836964 - DNA, 16 bp, Homo sapiens
tgcagccactgattct

SEQ ID NO: 1836965 - DNA, 18 bp, Homo sapiens
ttcccttttttggctgct

SEQ ID NO: 1836966 - DNA, 19 bp, Homo sapiens
ttcctagcacacacttttg

SEQ ID NO: 1836967 - DNA, 13 bp, Homo sapiens
ttcctcatttgtt

SEQ ID NO: 1836968 - DNA, 20 bp, Homo sapiens
ttcctcatttgttcattaaa

SEQ ID NO: 1836969 - DNA, 12 bp, Homo sapiens
ttcctccctccc

SEQ ID NO: 1836970 - DNA, 13 bp, Homo sapiens
ttcctctttccat

SEQ ID NO: 1836971 - DNA, 17 bp, Homo sapiens
ttcctctttccatctac

SEQ ID NO: 1836972 - DNA, 20 bp, Homo sapiens
ttcctgaggctgggctccct

SEQ ID NO: 1836973 - DNA, 21 bp, Homo sapiens
ttcctgatggcaggatggcct

SEQ ID NO: 1836974 - DNA, 13 bp, Homo sapiens
ttcctgcaatgaa

SEQ ID NO: 1836975 - DNA, 22 bp, Homo sapiens
ttcctggcactgcttccagtga

SEQ ID NO: 1836976 - DNA, 21 bp, Homo sapiens
aactacaaaggtttaaatgaa

SEQ ID NO: 1836977 - DNA, 17 bp, Homo sapiens
aactagggaagataata

SEQ ID NO: 1836978 - DNA, 12 bp, Homo sapiens
aactcaccccag

SEQ ID NO: 1836979 - DNA, 18 bp, Homo sapiens
aactcaccccagccccaa

SEQ ID NO: 1836980 - DNA, 23 bp, Homo sapiens
aactcatacactcgtatgatact

SEQ ID NO: 1836981 - DNA, 22 bp, Homo sapiens
aactcatccctaatgctgcaga

SEQ ID NO: 1836982 - DNA, 21 bp, Homo sapiens
aactcctagggccactgaaga

SEQ ID NO: 1836983 - DNA, 21 bp, Homo sapiens
aactctcctctgctgctggct

SEQ ID NO: 1836984 - DNA, 16 bp, Homo sapiens
aactctgacaacagac

SEQ ID NO: 1836985 - DNA, 20 bp, Homo sapiens
aactctgacaacagacttct

SEQ ID NO: 1836986 - DNA, 16 bp, Homo sapiens
aactgaactctgacaa

SEQ ID NO: 1836987 - DNA, 23 bp, Homo sapiens
aactgaactctgacaacagactt

SEQ ID NO: 1836988 - DNA, 19 bp, Homo sapiens
aactgaaggggtgcaccca

SEQ ID NO: 1836989 - DNA, 16 bp, Homo sapiens
aactgagtgccttttg

SEQ ID NO: 1836990 - DNA, 16 bp, Homo sapiens
aactgttatttataat

SEQ ID NO: 1836991 - DNA, 22 bp, Homo sapiens
aacttgagcgtgaatctgtatc

SEQ ID NO: 1836992 - DNA, 13 bp, Homo sapiens
aacttgttttctg

SEQ ID NO: 1836993 - DNA, 15 bp, Homo sapiens
aagaaaaaaatgtat

SEQ ID NO: 1836994 - DNA, 22 bp, Homo sapiens
aagaaaaaaatgtattttatgt

SEQ ID NO: 1836995 - DNA, 13 bp, Homo sapiens
aagaaaaagaaaa

SEQ ID NO: 1836996 - DNA, 14 bp, Homo sapiens
aagaaaaataaaga

SEQ ID NO: 1836997 - DNA, 15 bp, Homo sapiens
aagaaaaataaagaa

SEQ ID NO: 1836998 - DNA, 16 bp, Homo sapiens
aagaaaaataaagaaa

SEQ ID NO: 1836999 - DNA, 11 bp, Homo sapiens
aagaaatggcg

SEQ ID NO: 1837000 - DNA, 16 bp, Homo sapiens
aagaattgaagcagga

SEQ ID NO: 1837001 - DNA, 22 bp, Homo sapiens
aagaattgttgggggttttttt

SEQ ID NO: 1837002 - DNA, 21 bp, Homo sapiens
aagacccagacaggactgcag

SEQ ID NO: 1837003 - DNA, 21 bp, Homo sapiens
aagacccttgtggtcccaccc

SEQ ID NO: 1837004 - DNA, 21 bp, Homo sapiens
aagacgctgtgctgccctgcc

SEQ ID NO: 1837005 - DNA, 21 bp, Homo sapiens
aagactggaaggtggggacag

SEQ ID NO: 1837006 - DNA, 17 bp, Homo sapiens
aagacttttccaaccct

SEQ ID NO: 1837007 - DNA, 12 bp, Homo sapiens
aagagagaaaaa

SEQ ID NO: 1837008 - DNA, 21 bp, Homo sapiens
aagagatatgtagaaggcaca

SEQ ID NO: 1837009 - DNA, 19 bp, Homo sapiens
aagagattgtggtttcatt

SEQ ID NO: 1837010 - DNA, 21 bp, Homo sapiens
aagagccatgtagaagctgca

SEQ ID NO: 1837011 - DNA, 20 bp, Homo sapiens
aagagtaacagtcatcattt

SEQ ID NO: 1837012 - DNA, 18 bp, Homo sapiens
aagagtaggaagactttg

SEQ ID NO: 1837013 - DNA, 22 bp, Homo sapiens
aagataaacacaagattggtgt

SEQ ID NO: 1837014 - DNA, 19 bp, Homo sapiens
aagataatattaaggaaga

SEQ ID NO: 1837015 - DNA, 20 bp, Homo sapiens
aagatataactattgcccag

SEQ ID NO: 1837016 - DNA, 22 bp, Homo sapiens
aagatcctaaaacaaaagctca

SEQ ID NO: 1837017 - DNA, 19 bp, Homo sapiens
aagattctatgttaatatt

SEQ ID NO: 1837018 - DNA, 19 bp, Homo sapiens
aagattggtgtttttttct

SEQ ID NO: 1837019 - DNA, 20 bp, Homo sapiens
aagattggtgtttttttcta

SEQ ID NO: 1837020 - DNA, 21 bp, Homo sapiens
aagattggtgtttttttctat

SEQ ID NO: 1837021 - DNA, 23 bp, Homo sapiens
aagattggtgtttttttctatgg

SEQ ID NO: 1837022 - DNA, 14 bp, Homo sapiens
aagcaccaagctca

SEQ ID NO: 1837023 - DNA, 12 bp, Homo sapiens
aagcactcgtgt

SEQ ID NO: 1837024 - DNA, 12 bp, Homo sapiens
aagcactgtgct

SEQ ID NO: 1837025 - DNA, 15 bp, Homo sapiens
aagcactgtgctcag

SEQ ID NO: 1837026 - DNA, 16 bp, Homo sapiens
aagcactgtgctcagg

SEQ ID NO: 1837027 - DNA, 16 bp, Homo sapiens
aagcagaaatccaagc

SEQ ID NO: 1837028 - DNA, 15 bp, Homo sapiens
aagcaggaggccctt

SEQ ID NO: 1837029 - DNA, 18 bp, Homo sapiens
aagcaggaggcccttgtc

SEQ ID NO: 1837030 - DNA, 17 bp, Homo sapiens
aagcagggtctgggcag

SEQ ID NO: 1837031 - DNA, 18 bp, Homo sapiens
aagcatcattatttatgt

SEQ ID NO: 1837032 - DNA, 15 bp, Homo sapiens
aagcattagctttaa

SEQ ID NO: 1837033 - DNA, 15 bp, Homo sapiens
aagcattctcattgg

SEQ ID NO: 1837034 - DNA, 23 bp, Homo sapiens
aagcattctcattggaaatttag

SEQ ID NO: 1837035 - DNA, 12 bp, Homo sapiens
aagcattttata

SEQ ID NO: 1837036 - DNA, 15 bp, Homo sapiens
aagcattttataaat

SEQ ID NO: 1837037 - DNA, 18 bp, Homo sapiens
aagccaataacacacagc

SEQ ID NO: 1837038 - DNA, 21 bp, Homo sapiens
aagccaccaacatactcccat

SEQ ID NO: 1837039 - DNA, 21 bp, Homo sapiens
aagcccattcattccattctg

SEQ ID NO: 1837040 - DNA, 19 bp, Homo sapiens
aagccctgagctttctgct

SEQ ID NO: 1837041 - DNA, 16 bp, Homo sapiens
aagcctcccacgactg

SEQ ID NO: 1837042 - DNA, 19 bp, Homo sapiens
aagcctcctccagccgcca

SEQ ID NO: 1837043 - DNA, 10 bp, Homo sapiens
aagcctttgt

SEQ ID NO: 1837044 - DNA, 18 bp, Homo sapiens
aagctaataattcttcac

SEQ ID NO: 1837045 - DNA, 12 bp, Homo sapiens
aagctcagggcc

SEQ ID NO: 1837046 - DNA, 13 bp, Homo sapiens
aagctcagggcct

SEQ ID NO: 1837047 - DNA, 18 bp, Homo sapiens
aagctcagggcctggctc

SEQ ID NO: 1837048 - DNA, 19 bp, Homo sapiens
aagctcagggcctggctca

SEQ ID NO: 1837049 - DNA, 18 bp, Homo sapiens
aagctccaagctcccagg

SEQ ID NO: 1837050 - DNA, 17 bp, Homo sapiens
aagctcccaagggatgg

SEQ ID NO: 1837051 - DNA, 21 bp, Homo sapiens
aagctcccaagggatggtgcc

SEQ ID NO: 1837052 - DNA, 14 bp, Homo sapiens
aagctctcatagct

SEQ ID NO: 1837053 - DNA, 13 bp, Homo sapiens
aagctgaagaaaa

SEQ ID NO: 1837054 - DNA, 20 bp, Homo sapiens
aagctgcaccctcaggcagg

SEQ ID NO: 1837055 - DNA, 23 bp, Homo sapiens
aagctggcggctggggtcccagc

SEQ ID NO: 1837056 - DNA, 15 bp, Homo sapiens
aagctgggcaggttg

SEQ ID NO: 1837057 - DNA, 14 bp, Homo sapiens
aagcttgctcacat

SEQ ID NO: 1837058 - DNA, 14 bp, Homo sapiens
aaggaaattctaac

SEQ ID NO: 1837059 - DNA, 14 bp, Homo sapiens
aaggaagaagaaat

SEQ ID NO: 1837060 - DNA, 18 bp, Homo sapiens
aaggaatacctgtccccc

SEQ ID NO: 1837061 - DNA, 20 bp, Homo sapiens
aaggaatccactcccaggca

SEQ ID NO: 1837062 - DNA, 23 bp, Homo sapiens
aaggaatccactcccaggcagcc

SEQ ID NO: 1837063 - DNA, 12 bp, Homo sapiens
aaggagacacaa

SEQ ID NO: 1837064 - DNA, 18 bp, Homo sapiens
aaggaggaagagaaaaaa

SEQ ID NO: 1837065 - DNA, 17 bp, Homo sapiens
aaggagtaagtacaaat

SEQ ID NO: 1837066 - DNA, 12 bp, Homo sapiens
aaggagtttatg

SEQ ID NO: 1837067 - DNA, 13 bp, Homo sapiens
aaggagtttatgt

SEQ ID NO: 1837068 - DNA, 12 bp, Homo sapiens
aaggatctgctg

SEQ ID NO: 1837069 - DNA, 14 bp, Homo sapiens
aaggatctgctgag

SEQ ID NO: 1837070 - DNA, 15 bp, Homo sapiens
aaggatctgctgagg

SEQ ID NO: 1837071 - DNA, 16 bp, Homo sapiens
aaggatctgctgaggc

SEQ ID NO: 1837072 - DNA, 23 bp, Homo sapiens
aaggatgatctaggaagactttg

SEQ ID NO: 1837073 - DNA, 20 bp, Homo sapiens
aaggattttatgctttaaac

SEQ ID NO: 1837074 - DNA, 21 bp, Homo sapiens
aaggattttatgctttaaaca

SEQ ID NO: 1837075 - DNA, 15 bp, Homo sapiens
aaggcaaatgacttt

SEQ ID NO: 1837076 - DNA, 16 bp, Homo sapiens
aaggcaaatgactttg

SEQ ID NO: 1837077 - DNA, 16 bp, Homo sapiens
aaggcaaatgcccaag

SEQ ID NO: 1837078 - DNA, 17 bp, Homo sapiens
aaggcaaatgcccaagg

SEQ ID NO: 1837079 - DNA, 22 bp, Homo sapiens
aaggcaatgccatcctcaaaca

SEQ ID NO: 1837080 - DNA, 12 bp, Homo sapiens
aaggcactgcct

SEQ ID NO: 1837081 - DNA, 13 bp, Homo sapiens
aaggcactgcctg

SEQ ID NO: 1837082 - DNA, 18 bp, Homo sapiens
aaggcaggggaatgtatg

SEQ ID NO: 1837083 - DNA, 20 bp, Homo sapiens
aaggcaggggaatgtatgtg

SEQ ID NO: 1837084 - DNA, 15 bp, Homo sapiens
aaggcatatacaaat

SEQ ID NO: 1837085 - DNA, 18 bp, Homo sapiens
aaggccatggagagctgg

SEQ ID NO: 1837086 - DNA, 21 bp, Homo sapiens
aaggccatggagagctggagc

SEQ ID NO: 1837087 - DNA, 22 bp, Homo sapiens
aaggccatggagagctggagcc

SEQ ID NO: 1837088 - DNA, 16 bp, Homo sapiens
aaggcgtggagctgcc

SEQ ID NO: 1837089 - DNA, 19 bp, Homo sapiens
aaggcgtggagctgcctga

SEQ ID NO: 1837090 - DNA, 16 bp, Homo sapiens
aaggctccaggagcag

SEQ ID NO: 1837091 - DNA, 22 bp, Homo sapiens
aaggctcgagcatgcctggatg

SEQ ID NO: 1837092 - DNA, 19 bp, Homo sapiens
aaggctcttctccccagag

SEQ ID NO: 1837093 - DNA, 23 bp, Homo sapiens
aaggctgatgccaagttgtttga

SEQ ID NO: 1837094 - DNA, 21 bp, Homo sapiens
aaggctgcctgctatgtattt

SEQ ID NO: 1837095 - DNA, 17 bp, Homo sapiens
aagggattttagtcaca

SEQ ID NO: 1837096 - DNA, 14 bp, Homo sapiens
aagggcctggcctg

SEQ ID NO: 1837097 - DNA, 15 bp, Homo sapiens
aagggcgcaaagggc

SEQ ID NO: 1837098 - DNA, 13 bp, Homo sapiens
acccagaggtgga

SEQ ID NO: 1837099 - DNA, 22 bp, Homo sapiens
acccagatgggggaaagcacag

SEQ ID NO: 1837100 - DNA, 15 bp, Homo sapiens
acccagctctggtcc

SEQ ID NO: 1837101 - DNA, 20 bp, Homo sapiens
acccaggctgggcaaggagg

SEQ ID NO: 1837102 - DNA, 22 bp, Homo sapiens
acccaggctgggcaaggaggcc

SEQ ID NO: 1837103 - DNA, 15 bp, Homo sapiens
acccagtgccctctc

SEQ ID NO: 1837104 - DNA, 22 bp, Homo sapiens
acccagtgccctctcccctcag

SEQ ID NO: 1837105 - DNA, 17 bp, Homo sapiens
acccatgctgccctgtg

SEQ ID NO: 1837106 - DNA, 18 bp, Homo sapiens
acccatgctgccctgtga

SEQ ID NO: 1837107 - DNA, 17 bp, Homo sapiens
accccacacacgccaga

SEQ ID NO: 1837108 - DNA, 14 bp, Homo sapiens
accctcaggcaggt

SEQ ID NO: 1837109 - DNA, 15 bp, Homo sapiens
accctcaggcaggtg

SEQ ID NO: 1837110 - DNA, 23 bp, Homo sapiens
accctcatcaccaacgtctgtgc

SEQ ID NO: 1837111 - DNA, 12 bp, Homo sapiens
accctcatgctg

SEQ ID NO: 1837112 - DNA, 11 bp, Homo sapiens
accctgaggcc

SEQ ID NO: 1837113 - DNA, 13 bp, Homo sapiens
accctgaggccca

SEQ ID NO: 1837114 - DNA, 19 bp, Homo sapiens
accctgaggcccagagggc

SEQ ID NO: 1837115 - DNA, 13 bp, Homo sapiens
accctgccctgtg

SEQ ID NO: 1837116 - DNA, 19 bp, Homo sapiens
accctggcatttggcctct

SEQ ID NO: 1837117 - DNA, 17 bp, Homo sapiens
accctgtgatggggccc

SEQ ID NO: 1837118 - DNA, 19 bp, Homo sapiens
accctgtgatggggccctg

SEQ ID NO: 1837119 - DNA, 20 bp, Homo sapiens
accctgtgatggggccctgc

SEQ ID NO: 1837120 - DNA, 21 bp, Homo sapiens
accctgtgatggggccctgcc

SEQ ID NO: 1837121 - DNA, 20 bp, Homo sapiens
acccttgccgtctacctgag

SEQ ID NO: 1837122 - DNA, 15 bp, Homo sapiens
acccttgtggtccca

SEQ ID NO: 1837123 - DNA, 23 bp, Homo sapiens
acccttgtggtcccaccccacac

SEQ ID NO: 1837124 - DNA, 16 bp, Homo sapiens
accgcagacaggacca

SEQ ID NO: 1837125 - DNA, 17 bp, Homo sapiens
accgcagacaggaccag

SEQ ID NO: 1837126 - DNA, 17 bp, Homo sapiens
accgccaaggctggggg

SEQ ID NO: 1837127 - DNA, 15 bp, Homo sapiens
accggctggcctggc

SEQ ID NO: 1837128 - DNA, 17 bp, Homo sapiens
accggctggcctggccc

SEQ ID NO: 1837129 - DNA, 19 bp, Homo sapiens
accggctggcctggcccct

SEQ ID NO: 1837130 - DNA, 18 bp, Homo sapiens
acctaagtctctgtgaat

SEQ ID NO: 1837131 - DNA, 20 bp, Homo sapiens
acctactgtgtcttggaatc

SEQ ID NO: 1837132 - DNA, 23 bp, Homo sapiens
acctagctgaatgtttttctaaa

SEQ ID NO: 1837133 - DNA, 20 bp, Homo sapiens
acctcatgcccagctctctg

SEQ ID NO: 1837134 - DNA, 11 bp, Homo sapiens
acctcctgcct

SEQ ID NO: 1837135 - DNA, 15 bp, Homo sapiens
acctcctgtctctgg

SEQ ID NO: 1837136 - DNA, 13 bp, Homo sapiens
acctctcccttgg

SEQ ID NO: 1837137 - DNA, 21 bp, Homo sapiens
acctctgcacaagctgcaccc

SEQ ID NO: 1837138 - DNA, 18 bp, Homo sapiens
acctgagatttattaaag

SEQ ID NO: 1837139 - DNA, 15 bp, Homo sapiens
acctgaggcccttct

SEQ ID NO: 1837140 - DNA, 14 bp, Homo sapiens
acctgaggggcctc

SEQ ID NO: 1837141 - DNA, 20 bp, Homo sapiens
acctgcacactgtcctatta

SEQ ID NO: 1837142 - DNA, 11 bp, Homo sapiens
acctgccaggg

SEQ ID NO: 1837143 - DNA, 22 bp, Homo sapiens
acctgcctcccttcatgcatgg

SEQ ID NO: 1837144 - DNA, 16 bp, Homo sapiens
acctgcggtgctatct

SEQ ID NO: 1837145 - DNA, 22 bp, Homo sapiens
acctgcggtgctatctccccca

SEQ ID NO: 1837146 - DNA, 21 bp, Homo sapiens
acctgcgtctcatactcacct

SEQ ID NO: 1837147 - DNA, 12 bp, Homo sapiens
acctggcctctg

SEQ ID NO: 1837148 - DNA, 16 bp, Homo sapiens
acctggcctctgcact

SEQ ID NO: 1837149 - DNA, 17 bp, Homo sapiens
acctggcctctgcactc

SEQ ID NO: 1837150 - DNA, 18 bp, Homo sapiens
acctggcctctgcactcc

SEQ ID NO: 1837151 - DNA, 17 bp, Homo sapiens
acctgggcaagctggcg

SEQ ID NO: 1837152 - DNA, 14 bp, Homo sapiens
acctggggctgctg

SEQ ID NO: 1837153 - DNA, 15 bp, Homo sapiens
acctggggctgctgg

SEQ ID NO: 1837154 - DNA, 15 bp, Homo sapiens
acctgtccccctgac

SEQ ID NO: 1837155 - DNA, 14 bp, Homo sapiens
acctgttttctgaa

SEQ ID NO: 1837156 - DNA, 15 bp, Homo sapiens
acctgttttctgaaa

SEQ ID NO: 1837157 - DNA, 23 bp, Homo sapiens
accttctccctcatttcaggagc

SEQ ID NO: 1837158 - DNA, 11 bp, Homo sapiens
accttggaagg

SEQ ID NO: 1837159 - DNA, 13 bp, Homo sapiens
acctttattctgg

SEQ ID NO: 1837160 - DNA, 23 bp, Homo sapiens
acctttcagataactgttattta

SEQ ID NO: 1837161 - DNA, 14 bp, Homo sapiens
acgacaaggaaagg

SEQ ID NO: 1837162 - DNA, 13 bp, Homo sapiens
acgcaaaaatagc

SEQ ID NO: 1837163 - DNA, 18 bp, Homo sapiens
acgcaggcccctctcctc

SEQ ID NO: 1837164 - DNA, 19 bp, Homo sapiens
acgccagattctttcctga

SEQ ID NO: 1837165 - DNA, 23 bp, Homo sapiens
acgccaggggaaaatcagcctgc

SEQ ID NO: 1837166 - DNA, 15 bp, Homo sapiens
acgccatcccagccc

SEQ ID NO: 1837167 - DNA, 18 bp, Homo sapiens
acgctacccgggaagggg

SEQ ID NO: 1837168 - DNA, 11 bp, Homo sapiens
acgctgtgctg

SEQ ID NO: 1837169 - DNA, 14 bp, Homo sapiens
acgctgtgctgccc

SEQ ID NO: 1837170 - DNA, 17 bp, Homo sapiens
acgcttgtgacagtgcc

SEQ ID NO: 1837171 - DNA, 20 bp, Homo sapiens
acggctctgtccccagcctg

SEQ ID NO: 1837172 - DNA, 18 bp, Homo sapiens
acggcttttacttaaacc

SEQ ID NO: 1837173 - DNA, 22 bp, Homo sapiens
acggtgctccaggcaggctaag

SEQ ID NO: 1837174 - DNA, 11 bp, Homo sapiens
acgtcattcag

SEQ ID NO: 1837175 - DNA, 20 bp, Homo sapiens
acgtccacagagtataaata

SEQ ID NO: 1837176 - DNA, 19 bp, Homo sapiens
acgtgctctttgttttgtg

SEQ ID NO: 1837177 - DNA, 17 bp, Homo sapiens
acgtggaggagcagtgc

SEQ ID NO: 1837178 - DNA, 19 bp, Homo sapiens
acgtgggcaaacaggcagt

SEQ ID NO: 1837179 - DNA, 13 bp, Homo sapiens
actaaacatgtat

SEQ ID NO: 1837180 - DNA, 17 bp, Homo sapiens
actaaacatgtatgtaa

SEQ ID NO: 1837181 - DNA, 16 bp, Homo sapiens
actaaactttcacacc

SEQ ID NO: 1837182 - DNA, 23 bp, Homo sapiens
actaagtaatctcacagcatttg

SEQ ID NO: 1837183 - DNA, 18 bp, Homo sapiens
actacaaaggtttaaatg

SEQ ID NO: 1837184 - DNA, 16 bp, Homo sapiens
actactttgctgctaa

SEQ ID NO: 1837185 - DNA, 15 bp, Homo sapiens
actagagcacaacat

SEQ ID NO: 1837186 - DNA, 13 bp, Homo sapiens
actatatatgtga

SEQ ID NO: 1837187 - DNA, 18 bp, Homo sapiens
actcaaaagctgggcagg

SEQ ID NO: 1837188 - DNA, 16 bp, Homo sapiens
actcaaactcttaaaa

SEQ ID NO: 1837189 - DNA, 14 bp, Homo sapiens
actcaagaagcagg

SEQ ID NO: 1837190 - DNA, 13 bp, Homo sapiens
actcaccatctgt

SEQ ID NO: 1837191 - DNA, 14 bp, Homo sapiens
actcaccatctgtg

SEQ ID NO: 1837192 - DNA, 13 bp, Homo sapiens
actcaccccagcc

SEQ ID NO: 1837193 - DNA, 14 bp, Homo sapiens
actcaccccagccc

SEQ ID NO: 1837194 - DNA, 17 bp, Homo sapiens
actcaccccagccccaa

SEQ ID NO: 1837195 - DNA, 18 bp, Homo sapiens
actcacctggggctgctg

SEQ ID NO: 1837196 - DNA, 14 bp, Homo sapiens
actcatacatctgg

SEQ ID NO: 1837197 - DNA, 15 bp, Homo sapiens
actcatacatctggc

SEQ ID NO: 1837198 - DNA, 19 bp, Homo sapiens
actcatccctaatgctgca

SEQ ID NO: 1837199 - DNA, 12 bp, Homo sapiens
actcatcttagg

SEQ ID NO: 1837200 - DNA, 17 bp, Homo sapiens
actcattgacctgaggc

SEQ ID NO: 1837201 - DNA, 22 bp, Homo sapiens
actcattgacctgaggcccttc

SEQ ID NO: 1837202 - DNA, 13 bp, Homo sapiens
actccagcctggg

SEQ ID NO: 1837203 - DNA, 22 bp, Homo sapiens
actcccatctgtgaaaggaaag

SEQ ID NO: 1837204 - DNA, 17 bp, Homo sapiens
actcccctgctgggtgt

SEQ ID NO: 1837205 - DNA, 21 bp, Homo sapiens
actcccttcccatgacccagg

SEQ ID NO: 1837206 - DNA, 16 bp, Homo sapiens
actcctaggcaggaca

SEQ ID NO: 1837207 - DNA, 13 bp, Homo sapiens
actcctgaaaaaa

SEQ ID NO: 1837208 - DNA, 12 bp, Homo sapiens
actcctgcaggc

SEQ ID NO: 1837209 - DNA, 16 bp, Homo sapiens
actcctgcaggcagcc

SEQ ID NO: 1837210 - DNA, 19 bp, Homo sapiens
actcctgcaggcagccagg

SEQ ID NO: 1837211 - DNA, 22 bp, Homo sapiens
actcctgcaggcagccaggcca

SEQ ID NO: 1837212 - DNA, 17 bp, Homo sapiens
actccttgagagaccag

SEQ ID NO: 1837213 - DNA, 13 bp, Homo sapiens
actctaccctctt

SEQ ID NO: 1837214 - DNA, 16 bp, Homo sapiens
actctacctgcacact

SEQ ID NO: 1837215 - DNA, 15 bp, Homo sapiens
actctagggaaaaac

SEQ ID NO: 1837216 - DNA, 13 bp, Homo sapiens
actctcctctgct

SEQ ID NO: 1837217 - DNA, 13 bp, Homo sapiens
actctgacaacag

SEQ ID NO: 1837218 - DNA, 20 bp, Homo sapiens
actctgacaacagacttctg

SEQ ID NO: 1837219 - DNA, 13 bp, Homo sapiens
actctggcagctc

SEQ ID NO: 1837220 - DNA, 15 bp, Homo sapiens
actctggcagctcag

SEQ ID NO: 1837221 - DNA, 15 bp, Homo sapiens
agtcatctgtaagag

SEQ ID NO: 1837222 - DNA, 19 bp, Homo sapiens
agtcatctgtaagagcttg

SEQ ID NO: 1837223 - DNA, 20 bp, Homo sapiens
agtcatctgtaagagcttgc

SEQ ID NO: 1837224 - DNA, 19 bp, Homo sapiens
agtcatgcaaaggctggga

SEQ ID NO: 1837225 - DNA, 18 bp, Homo sapiens
agtccaaggaaaccacag

SEQ ID NO: 1837226 - DNA, 13 bp, Homo sapiens
agtccagcctgga

SEQ ID NO: 1837227 - DNA, 19 bp, Homo sapiens
agtcccctgtttgtttctg

SEQ ID NO: 1837228 - DNA, 13 bp, Homo sapiens
agtccctgccaat

SEQ ID NO: 1837229 - DNA, 20 bp, Homo sapiens
agtcctctgggtaggaatca

SEQ ID NO: 1837230 - DNA, 16 bp, Homo sapiens
agtccttaccagcaga

SEQ ID NO: 1837231 - DNA, 18 bp, Homo sapiens
agtccttaccagcagagc

SEQ ID NO: 1837232 - DNA, 19 bp, Homo sapiens
agtccttaccagcagagca

SEQ ID NO: 1837233 - DNA, 19 bp, Homo sapiens
agtcgcatctcagtgcagg

SEQ ID NO: 1837234 - DNA, 14 bp, Homo sapiens
agtctattcattat

SEQ ID NO: 1837235 - DNA, 15 bp, Homo sapiens
agtctattgaataat

SEQ ID NO: 1837236 - DNA, 23 bp, Homo sapiens
agtctcccaatatccaattttaa

SEQ ID NO: 1837237 - DNA, 18 bp, Homo sapiens
agtctctgaagtgaaact

SEQ ID NO: 1837238 - DNA, 12 bp, Homo sapiens
agtctctgtgaa

SEQ ID NO: 1837239 - DNA, 16 bp, Homo sapiens
agtcttatcaagcagc

SEQ ID NO: 1837240 - DNA, 16 bp, Homo sapiens
agtcttgcagcaggat

SEQ ID NO: 1837241 - DNA, 17 bp, Homo sapiens
agtgaaaaaggaggaag

SEQ ID NO: 1837242 - DNA, 23 bp, Homo sapiens
agtgaaaaaggaggaagagaaaa

SEQ ID NO: 1837243 - DNA, 21 bp, Homo sapiens
agtgaacattcccagcccagc

SEQ ID NO: 1837244 - DNA, 20 bp, Homo sapiens
agtgaacttgggccactgtg

SEQ ID NO: 1837245 - DNA, 21 bp, Homo sapiens
agtgacagctttctgggatgt

SEQ ID NO: 1837246 - DNA, 17 bp, Homo sapiens
agtgactgtatctgtgt

SEQ ID NO: 1837247 - DNA, 18 bp, Homo sapiens
agtgactgtatctgtgta

SEQ ID NO: 1837248 - DNA, 20 bp, Homo sapiens
agtgactgttcaagagcaca

SEQ ID NO: 1837249 - DNA, 18 bp, Homo sapiens
agtgactttggctgcatg

SEQ ID NO: 1837250 - DNA, 13 bp, Homo sapiens
agtgagcagaaca

SEQ ID NO: 1837251 - DNA, 16 bp, Homo sapiens
agtgagcagaacaggt

SEQ ID NO: 1837252 - DNA, 18 bp, Homo sapiens
agtgagcagaacaggtag

SEQ ID NO: 1837253 - DNA, 16 bp, Homo sapiens
agtgaggctctgccct

SEQ ID NO: 1837254 - DNA, 17 bp, Homo sapiens
agtgaggctctgccctt

SEQ ID NO: 1837255 - DNA, 23 bp, Homo sapiens
agtgagttgatagcacagaccct

SEQ ID NO: 1837256 - DNA, 15 bp, Homo sapiens
agtgatcacagcagc

SEQ ID NO: 1837257 - DNA, 16 bp, Homo sapiens
agtgatcacagcagct

SEQ ID NO: 1837258 - DNA, 15 bp, Homo sapiens
agtgattatatttca

SEQ ID NO: 1837259 - DNA, 17 bp, Homo sapiens
agtgcctcttccagtga

SEQ ID NO: 1837260 - DNA, 21 bp, Homo sapiens
agtgctgggaattacaggcgt

SEQ ID NO: 1837261 - DNA, 17 bp, Homo sapiens
agtgcttgccacagagc

SEQ ID NO: 1837262 - DNA, 18 bp, Homo sapiens
agtggaaaaatagcctgc

SEQ ID NO: 1837263 - DNA, 19 bp, Homo sapiens
agtggagatcccacatatt

SEQ ID NO: 1837264 - DNA, 16 bp, Homo sapiens
agtggcgcgcgccacc

SEQ ID NO: 1837265 - DNA, 16 bp, Homo sapiens
agtggctgctgcccag

SEQ ID NO: 1837266 - DNA, 18 bp, Homo sapiens
agtgggggatcacagcct

SEQ ID NO: 1837267 - DNA, 13 bp, Homo sapiens
agtgggtgaataa

SEQ ID NO: 1837268 - DNA, 14 bp, Homo sapiens
agtgtccaaagcag

SEQ ID NO: 1837269 - DNA, 23 bp, Homo sapiens
agttaaactggcttaacttagta

SEQ ID NO: 1837270 - DNA, 12 bp, Homo sapiens
agttagagctga

SEQ ID NO: 1837271 - DNA, 18 bp, Homo sapiens
agttagtgattatatttc

SEQ ID NO: 1837272 - DNA, 21 bp, Homo sapiens
agttccaccatcaagccacca

SEQ ID NO: 1837273 - DNA, 14 bp, Homo sapiens
agttccccatgcag

SEQ ID NO: 1837274 - DNA, 16 bp, Homo sapiens
agttccccatgcagac

SEQ ID NO: 1837275 - DNA, 17 bp, Homo sapiens
agttccccatgcagaca

SEQ ID NO: 1837276 - DNA, 18 bp, Homo sapiens
agttgaaaaacagctgag

SEQ ID NO: 1837277 - DNA, 23 bp, Homo sapiens
agttgatagcacagaccctgccc

SEQ ID NO: 1837278 - DNA, 15 bp, Homo sapiens
agttgcacggctgct

SEQ ID NO: 1837279 - DNA, 16 bp, Homo sapiens
agttgcacggctgctg

SEQ ID NO: 1837280 - DNA, 10 bp, Homo sapiens
agttggaagg

SEQ ID NO: 1837281 - DNA, 12 bp, Homo sapiens
agttggaaggat

SEQ ID NO: 1837282 - DNA, 17 bp, Homo sapiens
agttgttatttattgaa

SEQ ID NO: 1837283 - DNA, 15 bp, Homo sapiens
agtttctccaagcag

SEQ ID NO: 1837284 - DNA, 18 bp, Homo sapiens
agtttgtcacatgaaaca

SEQ ID NO: 1837285 - DNA, 15 bp, Homo sapiens
agttttacagtgttt

SEQ ID NO: 1837286 - DNA, 17 bp, Homo sapiens
agttttgtgatgcattt

SEQ ID NO: 1837287 - DNA, 13 bp, Homo sapiens
ataaaattattcc

SEQ ID NO: 1837288 - DNA, 24 bp, Homo sapiens
ataaagacgttttataagcatcat

SEQ ID NO: 1837289 - DNA, 19 bp, Homo sapiens
ataaagatcatgtaaaagt

SEQ ID NO: 1837290 - DNA, 18 bp, Homo sapiens
ataaatatattattactt

SEQ ID NO: 1837291 - DNA, 14 bp, Homo sapiens
ataaatcgcttttg

SEQ ID NO: 1837292 - DNA, 12 bp, Homo sapiens
ataaatgcaaat

SEQ ID NO: 1837293 - DNA, 22 bp, Homo sapiens
ataaatggttaaaagaggtttt

SEQ ID NO: 1837294 - DNA, 17 bp, Homo sapiens
ataacaaatgccaaatt

SEQ ID NO: 1837295 - DNA, 13 bp, Homo sapiens
ataacctttctgg

SEQ ID NO: 1837296 - DNA, 22 bp, Homo sapiens
ataactgttatttataatcact

SEQ ID NO: 1837297 - DNA, 17 bp, Homo sapiens
ataagagggcacacact

SEQ ID NO: 1837298 - DNA, 14 bp, Homo sapiens
ataagcatcattat

SEQ ID NO: 1837299 - DNA, 13 bp, Homo sapiens
ataagggcagagt

SEQ ID NO: 1837300 - DNA, 23 bp, Homo sapiens
ataataagcccaacaagttgaag

SEQ ID NO: 1837301 - DNA, 19 bp, Homo sapiens
ataatagcacatgatttgg

SEQ ID NO: 1837302 - DNA, 17 bp, Homo sapiens
ataatccagtcttcact

SEQ ID NO: 1837303 - DNA, 18 bp, Homo sapiens
ataatgggcttagagcag

SEQ ID NO: 1837304 - DNA, 16 bp, Homo sapiens
ataccacccaatgctg

SEQ ID NO: 1837305 - DNA, 12 bp, Homo sapiens
atacccaccccc

SEQ ID NO: 1837306 - DNA, 17 bp, Homo sapiens
atacctaattgtggatg

SEQ ID NO: 1837307 - DNA, 21 bp, Homo sapiens
atacctacatgtatttgtttg

SEQ ID NO: 1837308 - DNA, 17 bp, Homo sapiens
atacctggcctcattta

SEQ ID NO: 1837309 - DNA, 14 bp, Homo sapiens
atacctgtccccct

SEQ ID NO: 1837310 - DNA, 18 bp, Homo sapiens
atacctgtccccctgaca

SEQ ID NO: 1837311 - DNA, 22 bp, Homo sapiens
atactatatttttctcaatgtt

SEQ ID NO: 1837312 - DNA, 12 bp, Homo sapiens
atactgtttgag

SEQ ID NO: 1837313 - DNA, 20 bp, Homo sapiens
atactgtttgaggtttttaa

SEQ ID NO: 1837314 - DNA, 21 bp, Homo sapiens
atacttaactttactaagtaa

SEQ ID NO: 1837315 - DNA, 17 bp, Homo sapiens
atagaacagagaaagag

SEQ ID NO: 1837316 - DNA, 13 bp, Homo sapiens
atagaacagtgct

SEQ ID NO: 1837317 - DNA, 17 bp, Homo sapiens
atagaaggactgcagcc

SEQ ID NO: 1837318 - DNA, 18 bp, Homo sapiens
atagcacagaccctgccc

SEQ ID NO: 1837319 - DNA, 21 bp, Homo sapiens
atagcacatgatttgggctct

SEQ ID NO: 1837320 - DNA, 16 bp, Homo sapiens
atagctaagatataat

SEQ ID NO: 1837321 - DNA, 20 bp, Homo sapiens
atagctccccgcttctgcct

SEQ ID NO: 1837322 - DNA, 23 bp, Homo sapiens
atataaatgcaaataacaaatgc

SEQ ID NO: 1837323 - DNA, 17 bp, Homo sapiens
atataaccacatttcta

SEQ ID NO: 1837324 - DNA, 14 bp, Homo sapiens
atatacaaataaac

SEQ ID NO: 1837325 - DNA, 20 bp, Homo sapiens
atatacatcatacttaactt

SEQ ID NO: 1837326 - DNA, 22 bp, Homo sapiens
atatacatcatacttaacttta

SEQ ID NO: 1837327 - DNA, 15 bp, Homo sapiens
atatagaacagtgct

SEQ ID NO: 1837328 - DNA, 20 bp, Homo sapiens
atatagaaggactgcagcca

SEQ ID NO: 1837329 - DNA, 14 bp, Homo sapiens
atatattattactt

SEQ ID NO: 1837330 - DNA, 13 bp, Homo sapiens
atatcatcagtat

SEQ ID NO: 1837331 - DNA, 15 bp, Homo sapiens
atatccaattttaaa

SEQ ID NO: 1837332 - DNA, 20 bp, Homo sapiens
atatcccttggacattttat

SEQ ID NO: 1837333 - DNA, 21 bp, Homo sapiens
atatggactcagccttgcaaa

SEQ ID NO: 1837334 - DNA, 22 bp, Homo sapiens
atattaaggaagacaatgtgaa

SEQ ID NO: 1837335 - DNA, 21 bp, Homo sapiens
atattttctttaaaagacaaa

SEQ ID NO: 1837336 - DNA, 20 bp, Homo sapiens
atcaaagaggttttaaaaaa

SEQ ID NO: 1837337 - DNA, 17 bp, Homo sapiens
atcaaatggaagacaca

SEQ ID NO: 1837338 - DNA, 21 bp, Homo sapiens
atcaaatggaagacacattga

SEQ ID NO: 1837339 - DNA, 15 bp, Homo sapiens
atcaaggcactgcct

SEQ ID NO: 1837340 - DNA, 15 bp, Homo sapiens
atcacagttttggtt

SEQ ID NO: 1837341 - DNA, 21 bp, Homo sapiens
atcacagttttggttgcttta

SEQ ID NO: 1837342 - DNA, 18 bp, Homo sapiens
atcacattaatctcaaag

SEQ ID NO: 1837343 - DNA, 17 bp, Homo sapiens
caatattcgctgtgtca

SEQ ID NO: 1837344 - DNA, 17 bp, Homo sapiens
caatatttcctcatgtg

SEQ ID NO: 1837345 - DNA, 19 bp, Homo sapiens
caatatttcctcatgtgat

SEQ ID NO: 1837346 - DNA, 13 bp, Homo sapiens
caatgagcatgtt

SEQ ID NO: 1837347 - DNA, 20 bp, Homo sapiens
caatgatgtgagtacccagg

SEQ ID NO: 1837348 - DNA, 21 bp, Homo sapiens
caatgatgtgagtacccagga

SEQ ID NO: 1837349 - DNA, 14 bp, Homo sapiens
caatgcactttgtt

SEQ ID NO: 1837350 - DNA, 22 bp, Homo sapiens
caatgcactttgttctggctct

SEQ ID NO: 1837351 - DNA, 20 bp, Homo sapiens
caatgtattgataagagggc

SEQ ID NO: 1837352 - DNA, 22 bp, Homo sapiens
caatgtgaaaagaaaaatgagc

SEQ ID NO: 1837353 - DNA, 20 bp, Homo sapiens
caatgtgtataaacaagaaa

SEQ ID NO: 1837354 - DNA, 21 bp, Homo sapiens
caatgtgtataaacaagaaaa

SEQ ID NO: 1837355 - DNA, 23 bp, Homo sapiens
caatgtgtataaacaagaaaaat

SEQ ID NO: 1837356 - DNA, 21 bp, Homo sapiens
caattaaggattttatgcttt

SEQ ID NO: 1837357 - DNA, 20 bp, Homo sapiens
caattcttccctatctttgc

SEQ ID NO: 1837358 - DNA, 15 bp, Homo sapiens
caattgtaaactagt

SEQ ID NO: 1837359 - DNA, 17 bp, Homo sapiens
cacaaacgggctcagca

SEQ ID NO: 1837360 - DNA, 13 bp, Homo sapiens
cacaaactcacca

SEQ ID NO: 1837361 - DNA, 12 bp, Homo sapiens
cacaaataaaat

SEQ ID NO: 1837362 - DNA, 15 bp, Homo sapiens
cacaaatggctacat

SEQ ID NO: 1837363 - DNA, 20 bp, Homo sapiens
cacaagctccaagctcccag

SEQ ID NO: 1837364 - DNA, 13 bp, Homo sapiens
cacacagctccca

SEQ ID NO: 1837365 - DNA, 20 bp, Homo sapiens
cacacatgagcatcaggcca

SEQ ID NO: 1837366 - DNA, 20 bp, Homo sapiens
cacacggtttgaagcctgga

SEQ ID NO: 1837367 - DNA, 18 bp, Homo sapiens
cacactgtggcctgatca

SEQ ID NO: 1837368 - DNA, 18 bp, Homo sapiens
cacacttcaaactacttt

SEQ ID NO: 1837369 - DNA, 21 bp, Homo sapiens
cacacttggcccaagtggcag

SEQ ID NO: 1837370 - DNA, 18 bp, Homo sapiens
cacagaccctgccctgtg

SEQ ID NO: 1837371 - DNA, 13 bp, Homo sapiens
cacagagcgggga

SEQ ID NO: 1837372 - DNA, 14 bp, Homo sapiens
cacagagcggggac

SEQ ID NO: 1837373 - DNA, 16 bp, Homo sapiens
cacagcaattcctcag

SEQ ID NO: 1837374 - DNA, 20 bp, Homo sapiens
cacagctaacacacagctcc

SEQ ID NO: 1837375 - DNA, 18 bp, Homo sapiens
cacaggcttctgagcagc

SEQ ID NO: 1837376 - DNA, 22 bp, Homo sapiens
cacaggtgccgccagctgccgc

SEQ ID NO: 1837377 - DNA, 15 bp, Homo sapiens
cacagtattgctcac

SEQ ID NO: 1837378 - DNA, 18 bp, Homo sapiens
cacagtccaaccagaaac

SEQ ID NO: 1837379 - DNA, 13 bp, Homo sapiens
cacagtggccacg

SEQ ID NO: 1837380 - DNA, 13 bp, Homo sapiens
cacagtgtctggc

SEQ ID NO: 1837381 - DNA, 23 bp, Homo sapiens
cacagtgtgtggtcaacatttct

SEQ ID NO: 1837382 - DNA, 13 bp, Homo sapiens
cacatatttcaaa

SEQ ID NO: 1837383 - DNA, 17 bp, Homo sapiens
cacatcagtcacaagtt

SEQ ID NO: 1837384 - DNA, 16 bp, Homo sapiens
cacatgctaaagccag

SEQ ID NO: 1837385 - DNA, 16 bp, Homo sapiens
cacattcctgatgctt

SEQ ID NO: 1837386 - DNA, 18 bp, Homo sapiens
cacattccttgcctgcac

SEQ ID NO: 1837387 - DNA, 19 bp, Homo sapiens
cacatttaagagacagtca

SEQ ID NO: 1837388 - DNA, 14 bp, Homo sapiens
caccaacgtctgtg

SEQ ID NO: 1837389 - DNA, 16 bp, Homo sapiens
caccaacgtctgtgcc

SEQ ID NO: 1837390 - DNA, 22 bp, Homo sapiens
caccaagttggaacatccttgg

SEQ ID NO: 1837391 - DNA, 17 bp, Homo sapiens
caccaccggccccctcc

SEQ ID NO: 1837392 - DNA, 13 bp, Homo sapiens
caccacctcagag

SEQ ID NO: 1837393 - DNA, 14 bp, Homo sapiens
cacccacctgtttt

SEQ ID NO: 1837394 - DNA, 21 bp, Homo sapiens
cacccagatgggggaaagcac

SEQ ID NO: 1837395 - DNA, 16 bp, Homo sapiens
cacccagtgccctctc

SEQ ID NO: 1837396 - DNA, 12 bp, Homo sapiens
caccccagcccc

SEQ ID NO: 1837397 - DNA, 13 bp, Homo sapiens
caccccaggactc

SEQ ID NO: 1837398 - DNA, 15 bp, Homo sapiens
caccccgctgatgga

SEQ ID NO: 1837399 - DNA, 23 bp, Homo sapiens
caccccgctgatggagccccacc

SEQ ID NO: 1837400 - DNA, 16 bp, Homo sapiens
caccccggccacctgc

SEQ ID NO: 1837401 - DNA, 23 bp, Homo sapiens
cacccctctgtctaggactgcag

SEQ ID NO: 1837402 - DNA, 13 bp, Homo sapiens
caccctcatgctg

SEQ ID NO: 1837403 - DNA, 14 bp, Homo sapiens
caccggctggcctg

SEQ ID NO: 1837404 - DNA, 15 bp, Homo sapiens
caccggctggcctgg

SEQ ID NO: 1837405 - DNA, 16 bp, Homo sapiens
caccggctggcctggc

SEQ ID NO: 1837406 - DNA, 17 bp, Homo sapiens
cacctacaaggagataa

SEQ ID NO: 1837407 - DNA, 22 bp, Homo sapiens
cacctagctgaatgtttttcta

SEQ ID NO: 1837408 - DNA, 19 bp, Homo sapiens
cacctcagagtatggagct

SEQ ID NO: 1837409 - DNA, 14 bp, Homo sapiens
cacctctcccttgg

SEQ ID NO: 1837410 - DNA, 17 bp, Homo sapiens
cacctctcccttggatt

SEQ ID NO: 1837411 - DNA, 17 bp, Homo sapiens
cacctctctcactcctt

SEQ ID NO: 1837412 - DNA, 19 bp, Homo sapiens
cacctctgcacaagctgca

SEQ ID NO: 1837413 - DNA, 20 bp, Homo sapiens
cacctctttaaaaactcact

SEQ ID NO: 1837414 - DNA, 16 bp, Homo sapiens
cacctgccagggacag

SEQ ID NO: 1837415 - DNA, 13 bp, Homo sapiens
cacctggcctctg

SEQ ID NO: 1837416 - DNA, 15 bp, Homo sapiens
cacctggcctctgca

SEQ ID NO: 1837417 - DNA, 18 bp, Homo sapiens
cacctggcctctgcactc

SEQ ID NO: 1837418 - DNA, 20 bp, Homo sapiens
cacctggcctctgcactccc

SEQ ID NO: 1837419 - DNA, 14 bp, Homo sapiens
cacctgttttctga

SEQ ID NO: 1837420 - DNA, 15 bp, Homo sapiens
cacctgttttctgaa

SEQ ID NO: 1837421 - DNA, 18 bp, Homo sapiens
caccttagacagtccctg

SEQ ID NO: 1837422 - DNA, 13 bp, Homo sapiens
caccttccaaaga

SEQ ID NO: 1837423 - DNA, 21 bp, Homo sapiens
cacctttcagataactgttat

SEQ ID NO: 1837424 - DNA, 14 bp, Homo sapiens
cacctttgtcccca

SEQ ID NO: 1837425 - DNA, 20 bp, Homo sapiens
cacgagcaaacccagaggtg

SEQ ID NO: 1837426 - DNA, 17 bp, Homo sapiens
cacgcacttcgggaggt

SEQ ID NO: 1837427 - DNA, 16 bp, Homo sapiens
cacgccagattctttc

SEQ ID NO: 1837428 - DNA, 22 bp, Homo sapiens
cacgccagattctttcctgagg

SEQ ID NO: 1837429 - DNA, 23 bp, Homo sapiens
cacgccagattctttcctgaggc

SEQ ID NO: 1837430 - DNA, 16 bp, Homo sapiens
cacggaagagccttgc

SEQ ID NO: 1837431 - DNA, 18 bp, Homo sapiens
cacggctctgtccccagc

SEQ ID NO: 1837432 - DNA, 19 bp, Homo sapiens
cacggctctgtccccagcc

SEQ ID NO: 1837433 - DNA, 20 bp, Homo sapiens
cacggctctgtccccagcct

SEQ ID NO: 1837434 - DNA, 14 bp, Homo sapiens
cacgggcctgtcca

SEQ ID NO: 1837435 - DNA, 17 bp, Homo sapiens
cacgggcctgtccacag

SEQ ID NO: 1837436 - DNA, 18 bp, Homo sapiens
cacgggcctgtccacagg

SEQ ID NO: 1837437 - DNA, 24 bp, Homo sapiens
cacgggcctgtccacaggcttctg

SEQ ID NO: 1837438 - DNA, 15 bp, Homo sapiens
cacgggggcagctga

SEQ ID NO: 1837439 - DNA, 21 bp, Homo sapiens
cacgtggaggagcagtgcagg

SEQ ID NO: 1837440 - DNA, 14 bp, Homo sapiens
cactaggcttctgg

SEQ ID NO: 1837441 - DNA, 17 bp, Homo sapiens
cactcaaaagctgggca

SEQ ID NO: 1837442 - DNA, 18 bp, Homo sapiens
cactcaaaagctgggcag

SEQ ID NO: 1837443 - DNA, 20 bp, Homo sapiens
cactcaaaagctgggcaggt

SEQ ID NO: 1837444 - DNA, 14 bp, Homo sapiens
cactcaagaagcag

SEQ ID NO: 1837445 - DNA, 15 bp, Homo sapiens
cactcattgacctga

SEQ ID NO: 1837446 - DNA, 18 bp, Homo sapiens
cactcattgacctgaggc

SEQ ID NO: 1837447 - DNA, 13 bp, Homo sapiens
cactccaattaag

SEQ ID NO: 1837448 - DNA, 14 bp, Homo sapiens
cactccagcctggg

SEQ ID NO: 1837449 - DNA, 11 bp, Homo sapiens
cactccagctg

SEQ ID NO: 1837450 - DNA, 15 bp, Homo sapiens
cactcccaggcagcc

SEQ ID NO: 1837451 - DNA, 12 bp, Homo sapiens
cactcccctgct

SEQ ID NO: 1837452 - DNA, 14 bp, Homo sapiens
cactcccctgctgg

SEQ ID NO: 1837453 - DNA, 15 bp, Homo sapiens
cactctggcagctca

SEQ ID NO: 1837454 - DNA, 16 bp, Homo sapiens
cactctggcagctcag

SEQ ID NO: 1837455 - DNA, 20 bp, Homo sapiens
cactctggcagctcagagag

SEQ ID NO: 1837456 - DNA, 20 bp, Homo sapiens
cactgaactttgctgagcct

SEQ ID NO: 1837457 - DNA, 20 bp, Homo sapiens
cactgacactggtattcctg

SEQ ID NO: 1837458 - DNA, 13 bp, Homo sapiens
cactgagacagcc

SEQ ID NO: 1837459 - DNA, 20 bp, Homo sapiens
cactgcaggcatcacagcta

SEQ ID NO: 1837460 - DNA, 14 bp, Homo sapiens
cactgcttccagtg

SEQ ID NO: 1837461 - DNA, 18 bp, Homo sapiens
cactgcttccagtgaggc

SEQ ID NO: 1837462 - DNA, 18 bp, Homo sapiens
cactgggtgcgtctccag

SEQ ID NO: 1837463 - DNA, 17 bp, Homo sapiens
cactggtattcctgcct

SEQ ID NO: 1837464 - DNA, 17 bp, Homo sapiens
cactggtgacatgtctt

SEQ ID NO: 1837465 - DNA, 23 bp, Homo sapiens
ccagcagagcaccttagacagtc

SEQ ID NO: 1837466 - DNA, 12 bp, Homo sapiens
ccagcagcctgg

SEQ ID NO: 1837467 - DNA, 10 bp, Homo sapiens
ccagcagctg

SEQ ID NO: 1837468 - DNA, 20 bp, Homo sapiens
ccagcagctgccaggagcac

SEQ ID NO: 1837469 - DNA, 23 bp, Homo sapiens
ccagcagctgccaggagcacggc

SEQ ID NO: 1837470 - DNA, 18 bp, Homo sapiens
ccagccaaagcctcctcc

SEQ ID NO: 1837471 - DNA, 19 bp, Homo sapiens
ccagccaaagcctcctcca

SEQ ID NO: 1837472 - DNA, 23 bp, Homo sapiens
ccagccccatcctctgtacagag

SEQ ID NO: 1837473 - DNA, 13 bp, Homo sapiens
ccagcccctggat

SEQ ID NO: 1837474 - DNA, 10 bp, Homo sapiens
ccagcccctt

SEQ ID NO: 1837475 - DNA, 18 bp, Homo sapiens
ccagccctggctgaagga

SEQ ID NO: 1837476 - DNA, 22 bp, Homo sapiens
ccagccttgaccattctccacc

SEQ ID NO: 1837477 - DNA, 14 bp, Homo sapiens
ccagctctctgacg

SEQ ID NO: 1837478 - DNA, 16 bp, Homo sapiens
ccagctctctgacgct

SEQ ID NO: 1837479 - DNA, 17 bp, Homo sapiens
ccagctctggtccatag

SEQ ID NO: 1837480 - DNA, 21 bp, Homo sapiens
ccagctctggtccatagagag

SEQ ID NO: 1837481 - DNA, 17 bp, Homo sapiens
ccagctgttcagctggt

SEQ ID NO: 1837482 - DNA, 18 bp, Homo sapiens
ccaggaaaggctccagga

SEQ ID NO: 1837483 - DNA, 15 bp, Homo sapiens
ccaggagcagccaca

SEQ ID NO: 1837484 - DNA, 16 bp, Homo sapiens
ccaggagcagccacat

SEQ ID NO: 1837485 - DNA, 14 bp, Homo sapiens
ccaggaggccagcc

SEQ ID NO: 1837486 - DNA, 20 bp, Homo sapiens
ccaggaggccagccttgacc

SEQ ID NO: 1837487 - DNA, 22 bp, Homo sapiens
ccaggatgtacaaggacagccc

SEQ ID NO: 1837488 - DNA, 18 bp, Homo sapiens
ccaggcaggctaaggcgt

SEQ ID NO: 1837489 - DNA, 21 bp, Homo sapiens
ccaggcaggctaaggcgtgga

SEQ ID NO: 1837490 - DNA, 13 bp, Homo sapiens
ccaggcatggtgg

SEQ ID NO: 1837491 - DNA, 19 bp, Homo sapiens
ccaggcattccccaggagg

SEQ ID NO: 1837492 - DNA, 24 bp, Homo sapiens
ccaggcattccccaggaggccagc

SEQ ID NO: 1837493 - DNA, 17 bp, Homo sapiens
ccaggccctctgcccac

SEQ ID NO: 1837494 - DNA, 17 bp, Homo sapiens
ccaggcctgggccagag

SEQ ID NO: 1837495 - DNA, 22 bp, Homo sapiens
ccaggctattcggcaaggaagt

SEQ ID NO: 1837496 - DNA, 21 bp, Homo sapiens
ccaggctgggagagccttcca

SEQ ID NO: 1837497 - DNA, 21 bp, Homo sapiens
ccaggcttagtcactgagaca

SEQ ID NO: 1837498 - DNA, 23 bp, Homo sapiens
ccaggcttagtcactgagacagc

SEQ ID NO: 1837499 - DNA, 21 bp, Homo sapiens
ccagggacagagggggtggcc

SEQ ID NO: 1837500 - DNA, 22 bp, Homo sapiens
ccagggacagagggggtggcct

SEQ ID NO: 1837501 - DNA, 23 bp, Homo sapiens
ccagggacagagggggtggcctc

SEQ ID NO: 1837502 - DNA, 16 bp, Homo sapiens
ccagggctctgaccag

SEQ ID NO: 1837503 - DNA, 20 bp, Homo sapiens
ccagggctgctagacggagg

SEQ ID NO: 1837504 - DNA, 19 bp, Homo sapiens
ccaggggaaaatcagcctg

SEQ ID NO: 1837505 - DNA, 20 bp, Homo sapiens
ccaggggtgggacaccctgt

SEQ ID NO: 1837506 - DNA, 16 bp, Homo sapiens
ccaggttatctgggca

SEQ ID NO: 1837507 - DNA, 13 bp, Homo sapiens
ccagtcaccccgg

SEQ ID NO: 1837508 - DNA, 17 bp, Homo sapiens
ccagtcaccccggccac

SEQ ID NO: 1837509 - DNA, 18 bp, Homo sapiens
ccagtcaccccggccacc

SEQ ID NO: 1837510 - DNA, 20 bp, Homo sapiens
ccagtcaccccggccacctg

SEQ ID NO: 1837511 - DNA, 21 bp, Homo sapiens
ccagtcattatgttaatattt

SEQ ID NO: 1837512 - DNA, 22 bp, Homo sapiens
ccagtcattatgttaatatttc

SEQ ID NO: 1837513 - DNA, 15 bp, Homo sapiens
ccagtcccctttctc

SEQ ID NO: 1837514 - DNA, 21 bp, Homo sapiens
ccagtgaacattcccagccca

SEQ ID NO: 1837515 - DNA, 17 bp, Homo sapiens
ccagtgagatgcattct

SEQ ID NO: 1837516 - DNA, 23 bp, Homo sapiens
ccagtgccctctcccctcagcct

SEQ ID NO: 1837517 - DNA, 14 bp, Homo sapiens
ccagtggctgctgc

SEQ ID NO: 1837518 - DNA, 16 bp, Homo sapiens
ccagtggctgctgccc

SEQ ID NO: 1837519 - DNA, 18 bp, Homo sapiens
ccagtttaacctgatgca

SEQ ID NO: 1837520 - DNA, 14 bp, Homo sapiens
ccatattaacaaat

SEQ ID NO: 1837521 - DNA, 20 bp, Homo sapiens
ccatattaacaaattgcatt

SEQ ID NO: 1837522 - DNA, 12 bp, Homo sapiens
ccatcaagccac

SEQ ID NO: 1837523 - DNA, 20 bp, Homo sapiens
ccatcagaaacaccctcaca

SEQ ID NO: 1837524 - DNA, 16 bp, Homo sapiens
ccatcagttagagctg

SEQ ID NO: 1837525 - DNA, 12 bp, Homo sapiens
ccatcccagccc

SEQ ID NO: 1837526 - DNA, 15 bp, Homo sapiens
ccatcccagccccaa

SEQ ID NO: 1837527 - DNA, 15 bp, Homo sapiens
ccatccctgaaggcc

SEQ ID NO: 1837528 - DNA, 20 bp, Homo sapiens
ccatccctgaaggccccgcc

SEQ ID NO: 1837529 - DNA, 21 bp, Homo sapiens
ccatcctctgtacagagccca

SEQ ID NO: 1837530 - DNA, 13 bp, Homo sapiens
ccatcctgtgtgt

SEQ ID NO: 1837531 - DNA, 14 bp, Homo sapiens
ccatctcacacatg

SEQ ID NO: 1837532 - DNA, 15 bp, Homo sapiens
ccatctcacacatga

SEQ ID NO: 1837533 - DNA, 17 bp, Homo sapiens
ccatctcacacatgagc

SEQ ID NO: 1837534 - DNA, 18 bp, Homo sapiens
ccatctcacacatgagca

SEQ ID NO: 1837535 - DNA, 22 bp, Homo sapiens
ccatctgggctcctaaccttcc

SEQ ID NO: 1837536 - DNA, 16 bp, Homo sapiens
ccatctgtgcacgcag

SEQ ID NO: 1837537 - DNA, 14 bp, Homo sapiens
ccatgacccaggct

SEQ ID NO: 1837538 - DNA, 15 bp, Homo sapiens
ccatgacccaggctg

SEQ ID NO: 1837539 - DNA, 17 bp, Homo sapiens
ccatgacccaggctggg

SEQ ID NO: 1837540 - DNA, 13 bp, Homo sapiens
ccatgagtcccct

SEQ ID NO: 1837541 - DNA, 21 bp, Homo sapiens
ccatgcagacctcatgcccag

SEQ ID NO: 1837542 - DNA, 14 bp, Homo sapiens
ccatgcagctgctc

SEQ ID NO: 1837543 - DNA, 16 bp, Homo sapiens
ccatgcagctgctccc

SEQ ID NO: 1837544 - DNA, 12 bp, Homo sapiens
ccatgcaggagg

SEQ ID NO: 1837545 - DNA, 16 bp, Homo sapiens
ccatgcaggaggtgga

SEQ ID NO: 1837546 - DNA, 14 bp, Homo sapiens
ccatgctgccctgt

SEQ ID NO: 1837547 - DNA, 15 bp, Homo sapiens
ccatgtagaagctgc

SEQ ID NO: 1837548 - DNA, 19 bp, Homo sapiens
ccatgtagaagctgcatct

SEQ ID NO: 1837549 - DNA, 15 bp, Homo sapiens
ccatgtctcgactca

SEQ ID NO: 1837550 - DNA, 10 bp, Homo sapiens
ccattaaacg

SEQ ID NO: 1837551 - DNA, 23 bp, Homo sapiens
ccattaaacgatttttaaaatgt

SEQ ID NO: 1837552 - DNA, 13 bp, Homo sapiens
ccattcattccat

SEQ ID NO: 1837553 - DNA, 14 bp, Homo sapiens
ccattcattccatt

SEQ ID NO: 1837554 - DNA, 20 bp, Homo sapiens
ccattcattccattctggaa

SEQ ID NO: 1837555 - DNA, 22 bp, Homo sapiens
ccattctggattttgtcaagca

SEQ ID NO: 1837556 - DNA, 19 bp, Homo sapiens
ccattgtagcgtctttctt

SEQ ID NO: 1837557 - DNA, 20 bp, Homo sapiens
ccattgtagcgtctttcttt

SEQ ID NO: 1837558 - DNA, 17 bp, Homo sapiens
ccattgttgtcaaggaa

SEQ ID NO: 1837559 - DNA, 21 bp, Homo sapiens
ccattgttgtcaaggaagaag

SEQ ID NO: 1837560 - DNA, 22 bp, Homo sapiens
ccatttcatttgtgccagaatg

SEQ ID NO: 1837561 - DNA, 16 bp, Homo sapiens
cccaaaactctcctct

SEQ ID NO: 1837562 - DNA, 16 bp, Homo sapiens
cccaaccagggccccg

SEQ ID NO: 1837563 - DNA, 15 bp, Homo sapiens
cccaactcaccccag

SEQ ID NO: 1837564 - DNA, 17 bp, Homo sapiens
cccaactcaccccagcc

SEQ ID NO: 1837565 - DNA, 23 bp, Homo sapiens
cccaagcctacttttgccattga

SEQ ID NO: 1837566 - DNA, 16 bp, Homo sapiens
cccaagcggtgtctct

SEQ ID NO: 1837567 - DNA, 14 bp, Homo sapiens
cccaagggcctggc

SEQ ID NO: 1837568 - DNA, 19 bp, Homo sapiens
cccaagggcctggcctgag

SEQ ID NO: 1837569 - DNA, 16 bp, Homo sapiens
cccaagtggcagagct

SEQ ID NO: 1837570 - DNA, 20 bp, Homo sapiens
cccaatgcactttgttctgg

SEQ ID NO: 1837571 - DNA, 20 bp, Homo sapiens
cccacccaagggcctggcct

SEQ ID NO: 1837572 - DNA, 13 bp, Homo sapiens
cccacctctctca

SEQ ID NO: 1837573 - DNA, 16 bp, Homo sapiens
cccacctgttttctga

SEQ ID NO: 1837574 - DNA, 15 bp, Homo sapiens
cccagacgatgtctt

SEQ ID NO: 1837575 - DNA, 16 bp, Homo sapiens
cccagaggctgggtga

SEQ ID NO: 1837576 - DNA, 21 bp, Homo sapiens
cccagatgggggaaagcacag

SEQ ID NO: 1837577 - DNA, 15 bp, Homo sapiens
cccagcagctgccag

SEQ ID NO: 1837578 - DNA, 23 bp, Homo sapiens
cccagccccaaaactctcctctg

SEQ ID NO: 1837579 - DNA, 17 bp, Homo sapiens
cccagccccaatgaaca

SEQ ID NO: 1837580 - DNA, 11 bp, Homo sapiens
cccagccccat

SEQ ID NO: 1837581 - DNA, 12 bp, Homo sapiens
cccagccccatc

SEQ ID NO: 1837582 - DNA, 13 bp, Homo sapiens
cccagccccatcc

SEQ ID NO: 1837583 - DNA, 18 bp, Homo sapiens
cccagccccttctgaccc

SEQ ID NO: 1837584 - DNA, 12 bp, Homo sapiens
cccagctctggt

SEQ ID NO: 1837585 - DNA, 22 bp, Homo sapiens
cccaggaaaggctccaggagca

SEQ ID NO: 1837586 - DNA, 15 bp, Homo sapiens
cccaggaggccagcc

SEQ ID NO: 1837587 - DNA, 15 bp, Homo sapiens
ctgagcaggccacac

SEQ ID NO: 1837588 - DNA, 21 bp, Homo sapiens
ctgaggcccagagggcctgca

SEQ ID NO: 1837589 - DNA, 15 bp, Homo sapiens
ctgaggcccagtgca

SEQ ID NO: 1837590 - DNA, 21 bp, Homo sapiens
ctgaggccccttctaggtggc

SEQ ID NO: 1837591 - DNA, 23 bp, Homo sapiens
ctgaggcccttctctccagcccc

SEQ ID NO: 1837592 - DNA, 24 bp, Homo sapiens
ctgaggcccttctctccagcccct

SEQ ID NO: 1837593 - DNA, 14 bp, Homo sapiens
ctgaggggcctctt

SEQ ID NO: 1837594 - DNA, 13 bp, Homo sapiens
ctgagtctgaagg

SEQ ID NO: 1837595 - DNA, 17 bp, Homo sapiens
ctgagtctgaaggctgg

SEQ ID NO: 1837596 - DNA, 14 bp, Homo sapiens
ctgagtgcctggcc

SEQ ID NO: 1837597 - DNA, 22 bp, Homo sapiens
ctgatatttccctcccctgggg

SEQ ID NO: 1837598 - DNA, 18 bp, Homo sapiens
ctgatcagcaggagccaa

SEQ ID NO: 1837599 - DNA, 23 bp, Homo sapiens
ctgatcctgtgaagtaaggatgt

SEQ ID NO: 1837600 - DNA, 23 bp, Homo sapiens
ctgatgcatacggctatattggt

SEQ ID NO: 1837601 - DNA, 19 bp, Homo sapiens
ctgatgccaagttgtttga

SEQ ID NO: 1837602 - DNA, 17 bp, Homo sapiens
ctgatgcttcttcagag

SEQ ID NO: 1837603 - DNA, 18 bp, Homo sapiens
ctgatgcttcttcagaga

SEQ ID NO: 1837604 - DNA, 20 bp, Homo sapiens
ctgatgcttcttcagagact

SEQ ID NO: 1837605 - DNA, 16 bp, Homo sapiens
ctgatggcaggatggc

SEQ ID NO: 1837606 - DNA, 19 bp, Homo sapiens
ctgatggcaggatggcctg

SEQ ID NO: 1837607 - DNA, 12 bp, Homo sapiens
ctgatggcttct

SEQ ID NO: 1837608 - DNA, 14 bp, Homo sapiens
ctgattctcagggt

SEQ ID NO: 1837609 - DNA, 18 bp, Homo sapiens
ctgattctcagggtctct

SEQ ID NO: 1837610 - DNA, 21 bp, Homo sapiens
ctgattctcagggtctctgct

SEQ ID NO: 1837611 - DNA, 19 bp, Homo sapiens
ctgcaacctgattgtgtct

SEQ ID NO: 1837612 - DNA, 21 bp, Homo sapiens
ctgcaacctgattgtgtctct

SEQ ID NO: 1837613 - DNA, 18 bp, Homo sapiens
ctgcaatgaagtctctga

SEQ ID NO: 1837614 - DNA, 14 bp, Homo sapiens
ctgcacaagctgca

SEQ ID NO: 1837615 - DNA, 20 bp, Homo sapiens
ctgcacacgctccttcctct

SEQ ID NO: 1837616 - DNA, 14 bp, Homo sapiens
ctgcaccctcaggc

SEQ ID NO: 1837617 - DNA, 18 bp, Homo sapiens
ctgcaccggctggcctgg

SEQ ID NO: 1837618 - DNA, 20 bp, Homo sapiens
ctgcaccggctggcctggcc

SEQ ID NO: 1837619 - DNA, 23 bp, Homo sapiens
ctgcaccggctggcctggcccct

SEQ ID NO: 1837620 - DNA, 13 bp, Homo sapiens
ctgcactcccctg

SEQ ID NO: 1837621 - DNA, 14 bp, Homo sapiens
ctgcactcccctgc

SEQ ID NO: 1837622 - DNA, 20 bp, Homo sapiens
ctgcagatttgggctggaac

SEQ ID NO: 1837623 - DNA, 23 bp, Homo sapiens
ctgcagatttgggctggaacaga

SEQ ID NO: 1837624 - DNA, 13 bp, Homo sapiens
ctgcaggcagcca

SEQ ID NO: 1837625 - DNA, 15 bp, Homo sapiens
ctgcaggcagccagg

SEQ ID NO: 1837626 - DNA, 20 bp, Homo sapiens
ctgcaggcagccaggccaca

SEQ ID NO: 1837627 - DNA, 17 bp, Homo sapiens
ctgcaggcatcacagct

SEQ ID NO: 1837628 - DNA, 19 bp, Homo sapiens
ctgcagttgccagtcaccc

SEQ ID NO: 1837629 - DNA, 14 bp, Homo sapiens
ctgccagcccctgc

SEQ ID NO: 1837630 - DNA, 13 bp, Homo sapiens
ctgccaggcatgg

SEQ ID NO: 1837631 - DNA, 15 bp, Homo sapiens
ctgccagggacagag

SEQ ID NO: 1837632 - DNA, 15 bp, Homo sapiens
ctgccatgccagctt

SEQ ID NO: 1837633 - DNA, 19 bp, Homo sapiens
ctgcccacctggcctctgc

SEQ ID NO: 1837634 - DNA, 20 bp, Homo sapiens
ctgcccacctggcctctgca

SEQ ID NO: 1837635 - DNA, 22 bp, Homo sapiens
ctgccccttggacacgctcagt

SEQ ID NO: 1837636 - DNA, 13 bp, Homo sapiens
ctgccctgcccac

SEQ ID NO: 1837637 - DNA, 14 bp, Homo sapiens
ctgccctgcccacc

SEQ ID NO: 1837638 - DNA, 15 bp, Homo sapiens
ctgccctgcccacct

SEQ ID NO: 1837639 - DNA, 20 bp, Homo sapiens
ctgccctgcccacctggcct

SEQ ID NO: 1837640 - DNA, 12 bp, Homo sapiens
ctgccctgtgag

SEQ ID NO: 1837641 - DNA, 11 bp, Homo sapiens
ctgccctgtgg

SEQ ID NO: 1837642 - DNA, 15 bp, Homo sapiens
ctgccctgtgggccc

SEQ ID NO: 1837643 - DNA, 14 bp, Homo sapiens
ctgccgcaccagcc

SEQ ID NO: 1837644 - DNA, 17 bp, Homo sapiens
ctgccggggcagccccc

SEQ ID NO: 1837645 - DNA, 23 bp, Homo sapiens
ctgccggttcttaaatccatcct

SEQ ID NO: 1837646 - DNA, 12 bp, Homo sapiens
ctgcctcccatc

SEQ ID NO: 1837647 - DNA, 19 bp, Homo sapiens
ctgcctcccatcacccgct

SEQ ID NO: 1837648 - DNA, 14 bp, Homo sapiens
ctgcctcccttcat

SEQ ID NO: 1837649 - DNA, 17 bp, Homo sapiens
ctgcctcccttcatgca

SEQ ID NO: 1837650 - DNA, 14 bp, Homo sapiens
ctgcctcttctcta

SEQ ID NO: 1837651 - DNA, 14 bp, Homo sapiens
ctgcctgccctggt

SEQ ID NO: 1837652 - DNA, 15 bp, Homo sapiens
ctgcctgccctggtg

SEQ ID NO: 1837653 - DNA, 12 bp, Homo sapiens
ctgcctgtgctg

SEQ ID NO: 1837654 - DNA, 14 bp, Homo sapiens
ctgcctgtgctgtg

SEQ ID NO: 1837655 - DNA, 22 bp, Homo sapiens
ctgcggtgctatctcccccagc

SEQ ID NO: 1837656 - DNA, 13 bp, Homo sapiens
ctgctaaataaac

SEQ ID NO: 1837657 - DNA, 24 bp, Homo sapiens
ctgctaatattttcctcctgagtg

SEQ ID NO: 1837658 - DNA, 20 bp, Homo sapiens
ctgctctgatgaagaggagt

SEQ ID NO: 1837659 - DNA, 21 bp, Homo sapiens
ctgctctggtggcttaagtga

SEQ ID NO: 1837660 - DNA, 13 bp, Homo sapiens
ctgctgaaggctc

SEQ ID NO: 1837661 - DNA, 24 bp, Homo sapiens
ctgctgaaggctcgagcatgcctg

SEQ ID NO: 1837662 - DNA, 15 bp, Homo sapiens
ctgctgaggcccagt

SEQ ID NO: 1837663 - DNA, 17 bp, Homo sapiens
ctgctgaggcccagtgc

SEQ ID NO: 1837664 - DNA, 17 bp, Homo sapiens
ctgctgggtgtggcgca

SEQ ID NO: 1837665 - DNA, 21 bp, Homo sapiens
ctgctggttaacttgtttggc

SEQ ID NO: 1837666 - DNA, 14 bp, Homo sapiens
ctgctgtttcctag

SEQ ID NO: 1837667 - DNA, 22 bp, Homo sapiens
ctgctgtttcctagcgcagcca

SEQ ID NO: 1837668 - DNA, 14 bp, Homo sapiens
ctgcttccagtgag

SEQ ID NO: 1837669 - DNA, 15 bp, Homo sapiens
ctgcttccagtgagg

SEQ ID NO: 1837670 - DNA, 16 bp, Homo sapiens
ctgcttccagtgaggc

SEQ ID NO: 1837671 - DNA, 19 bp, Homo sapiens
ctgcttccagtgaggctct

SEQ ID NO: 1837672 - DNA, 23 bp, Homo sapiens
ctgcttccagtgaggctctgccc

SEQ ID NO: 1837673 - DNA, 14 bp, Homo sapiens
ctggaacagattca

SEQ ID NO: 1837674 - DNA, 16 bp, Homo sapiens
ctggaaccatcagaaa

SEQ ID NO: 1837675 - DNA, 17 bp, Homo sapiens
ctggaactcagtgtgac

SEQ ID NO: 1837676 - DNA, 21 bp, Homo sapiens
ctggaactcagtgtgactcct

SEQ ID NO: 1837677 - DNA, 21 bp, Homo sapiens
ctggaagacagagacctcctg

SEQ ID NO: 1837678 - DNA, 15 bp, Homo sapiens
ctggaagtgactttg

SEQ ID NO: 1837679 - DNA, 18 bp, Homo sapiens
ctggagactcctaggcag

SEQ ID NO: 1837680 - DNA, 20 bp, Homo sapiens
ctggagactcctaggcagga

SEQ ID NO: 1837681 - DNA, 22 bp, Homo sapiens
ctggagcttgaaatagtgtctg

SEQ ID NO: 1837682 - DNA, 15 bp, Homo sapiens
ctggagtgaaccaga

SEQ ID NO: 1837683 - DNA, 16 bp, Homo sapiens
ctggatagacttggga

SEQ ID NO: 1837684 - DNA, 15 bp, Homo sapiens
ctggatgcagcctca

SEQ ID NO: 1837685 - DNA, 17 bp, Homo sapiens
ctggatgcagcctcaca

SEQ ID NO: 1837686 - DNA, 17 bp, Homo sapiens
ctggcaaggacacagat

SEQ ID NO: 1837687 - DNA, 18 bp, Homo sapiens
ctggcaaggacacagatg

SEQ ID NO: 1837688 - DNA, 20 bp, Homo sapiens
ctggcactgactgggcatag

SEQ ID NO: 1837689 - DNA, 16 bp, Homo sapiens
ctggcactgcttccag

SEQ ID NO: 1837690 - DNA, 18 bp, Homo sapiens
ctggcactgcttccagtg

SEQ ID NO: 1837691 - DNA, 19 bp, Homo sapiens
ctggcactgcttccagtga

SEQ ID NO: 1837692 - DNA, 12 bp, Homo sapiens
ctggcagctcag

SEQ ID NO: 1837693 - DNA, 16 bp, Homo sapiens
ctggcatttggcctct

SEQ ID NO: 1837694 - DNA, 20 bp, Homo sapiens
ctggcatttggcctcttgta

SEQ ID NO: 1837695 - DNA, 13 bp, Homo sapiens
ctggcccactgca

SEQ ID NO: 1837696 - DNA, 13 bp, Homo sapiens
ctggcccctcagg

SEQ ID NO: 1837697 - DNA, 21 bp, Homo sapiens
ctggcccctcagggtccctgg

SEQ ID NO: 1837698 - DNA, 15 bp, Homo sapiens
ctggccgtgggcctg

SEQ ID NO: 1837699 - DNA, 12 bp, Homo sapiens
ctggcctctgca

SEQ ID NO: 1837700 - DNA, 13 bp, Homo sapiens
ctggcctctgcac

SEQ ID NO: 1837701 - DNA, 18 bp, Homo sapiens
ctggcctctgcactcccc

SEQ ID NO: 1837702 - DNA, 13 bp, Homo sapiens
ctggctcttccag

SEQ ID NO: 1837703 - DNA, 21 bp, Homo sapiens
ctggctcttccaggctgggag

SEQ ID NO: 1837704 - DNA, 22 bp, Homo sapiens
ctggctctttggagatcaagga

SEQ ID NO: 1837705 - DNA, 14 bp, Homo sapiens
ctggctgaaggact

SEQ ID NO: 1837706 - DNA, 17 bp, Homo sapiens
ctgggaactcacctggg

SEQ ID NO: 1837707 - DNA, 14 bp, Homo sapiens
ctgggacatgggaa

SEQ ID NO: 1837708 - DNA, 14 bp, Homo sapiens
ctgggaccacgtga

SEQ ID NO: 1837709 - DNA, 14 bp, Homo sapiens
gaccacactccagc

SEQ ID NO: 1837710 - DNA, 20 bp, Homo sapiens
gaccagggatttccatgatg

SEQ ID NO: 1837711 - DNA, 12 bp, Homo sapiens
gaccatccctga

SEQ ID NO: 1837712 - DNA, 13 bp, Homo sapiens
gaccatccctgaa

SEQ ID NO: 1837713 - DNA, 17 bp, Homo sapiens
gaccatccctgaaggcc

SEQ ID NO: 1837714 - DNA, 23 bp, Homo sapiens
gacccaaccacagaggatgctga

SEQ ID NO: 1837715 - DNA, 15 bp, Homo sapiens
gacccaggctgggca

SEQ ID NO: 1837716 - DNA, 20 bp, Homo sapiens
gacccatgctgccctgtgag

SEQ ID NO: 1837717 - DNA, 20 bp, Homo sapiens
gaccccgagcctggctccaa

SEQ ID NO: 1837718 - DNA, 21 bp, Homo sapiens
gaccctccccacagtgccacc

SEQ ID NO: 1837719 - DNA, 10 bp, Homo sapiens
gaccctgagg

SEQ ID NO: 1837720 - DNA, 11 bp, Homo sapiens
gaccctgaggc

SEQ ID NO: 1837721 - DNA, 12 bp, Homo sapiens
gaccctgaggcc

SEQ ID NO: 1837722 - DNA, 15 bp, Homo sapiens
gaccctgccctgtgg

SEQ ID NO: 1837723 - DNA, 17 bp, Homo sapiens
gaccctgccctgtgggc

SEQ ID NO: 1837724 - DNA, 20 bp, Homo sapiens
gacccttgccgtctacctga

SEQ ID NO: 1837725 - DNA, 15 bp, Homo sapiens
gacccttgtggtccc

SEQ ID NO: 1837726 - DNA, 20 bp, Homo sapiens
gacccttgtggtcccacccc

SEQ ID NO: 1837727 - DNA, 12 bp, Homo sapiens
gacctcatgccc

SEQ ID NO: 1837728 - DNA, 11 bp, Homo sapiens
gacctgaggcc

SEQ ID NO: 1837729 - DNA, 21 bp, Homo sapiens
gacctgaggcccttctctcca

SEQ ID NO: 1837730 - DNA, 11 bp, Homo sapiens
gacctgcctcc

SEQ ID NO: 1837731 - DNA, 15 bp, Homo sapiens
gacctgctgtttcct

SEQ ID NO: 1837732 - DNA, 16 bp, Homo sapiens
gacctggcaaggacac

SEQ ID NO: 1837733 - DNA, 18 bp, Homo sapiens
gacctggcactggatgca

SEQ ID NO: 1837734 - DNA, 12 bp, Homo sapiens
gacgcaggcccc

SEQ ID NO: 1837735 - DNA, 14 bp, Homo sapiens
gacgcaggcccctc

SEQ ID NO: 1837736 - DNA, 15 bp, Homo sapiens
gacgcaggcccctct

SEQ ID NO: 1837737 - DNA, 15 bp, Homo sapiens
gacgccatcccagcc

SEQ ID NO: 1837738 - DNA, 16 bp, Homo sapiens
gacgccatcccagccc

SEQ ID NO: 1837739 - DNA, 19 bp, Homo sapiens
gacgctacccgggaagggg

SEQ ID NO: 1837740 - DNA, 21 bp, Homo sapiens
gacgctgtgctgccctgccca

SEQ ID NO: 1837741 - DNA, 18 bp, Homo sapiens
gacgcttgtgacagtgcc

SEQ ID NO: 1837742 - DNA, 22 bp, Homo sapiens
gacgtgattcaattcaacactc

SEQ ID NO: 1837743 - DNA, 17 bp, Homo sapiens
gactactcccccaggtg

SEQ ID NO: 1837744 - DNA, 20 bp, Homo sapiens
gactagagcacaacataatt

SEQ ID NO: 1837745 - DNA, 15 bp, Homo sapiens
gactattttatatga

SEQ ID NO: 1837746 - DNA, 23 bp, Homo sapiens
gactcaaaacccatctgggctcc

SEQ ID NO: 1837747 - DNA, 14 bp, Homo sapiens
gactcaaaccaaat

SEQ ID NO: 1837748 - DNA, 17 bp, Homo sapiens
gactcagctccccagag

SEQ ID NO: 1837749 - DNA, 18 bp, Homo sapiens
gactcagctccccagagt

SEQ ID NO: 1837750 - DNA, 23 bp, Homo sapiens
gactcctgcacacgctccttcct

SEQ ID NO: 1837751 - DNA, 15 bp, Homo sapiens
gactcctgcaggcag

SEQ ID NO: 1837752 - DNA, 18 bp, Homo sapiens
gactcctgcaggcagcca

SEQ ID NO: 1837753 - DNA, 20 bp, Homo sapiens
gactcctgcaggcagccagg

SEQ ID NO: 1837754 - DNA, 20 bp, Homo sapiens
gactgcagtgtggagttcac

SEQ ID NO: 1837755 - DNA, 21 bp, Homo sapiens
gactgcagtgtggagttcacc

SEQ ID NO: 1837756 - DNA, 13 bp, Homo sapiens
gactgcccggcag

SEQ ID NO: 1837757 - DNA, 15 bp, Homo sapiens
gactgcccggcaggg

SEQ ID NO: 1837758 - DNA, 14 bp, Homo sapiens
gactgtatctgtgt

SEQ ID NO: 1837759 - DNA, 17 bp, Homo sapiens
gactgtgacaggcagca

SEQ ID NO: 1837760 - DNA, 18 bp, Homo sapiens
gactgtgacaggcagcag

SEQ ID NO: 1837761 - DNA, 20 bp, Homo sapiens
gactgtgacaggcagcagag

SEQ ID NO: 1837762 - DNA, 14 bp, Homo sapiens
gactgttcaagagc

SEQ ID NO: 1837763 - DNA, 18 bp, Homo sapiens
gactgttcaagagcacac

SEQ ID NO: 1837764 - DNA, 21 bp, Homo sapiens
gacttagaaaaccagctcagc

SEQ ID NO: 1837765 - DNA, 13 bp, Homo sapiens
gacttcagattcc

SEQ ID NO: 1837766 - DNA, 21 bp, Homo sapiens
gacttttctgtccgagctttg

SEQ ID NO: 1837767 - DNA, 23 bp, Homo sapiens
gacttttctgtccgagctttgaa

SEQ ID NO: 1837768 - DNA, 23 bp, Homo sapiens
gagaactcatccctaatgctgca

SEQ ID NO: 1837769 - DNA, 18 bp, Homo sapiens
gagaagcattctcattgg

SEQ ID NO: 1837770 - DNA, 13 bp, Homo sapiens
gagaagcggctgg

SEQ ID NO: 1837771 - DNA, 15 bp, Homo sapiens
gagaagcggctggca

SEQ ID NO: 1837772 - DNA, 16 bp, Homo sapiens
gagaagcggctggcag

SEQ ID NO: 1837773 - DNA, 23 bp, Homo sapiens
gagaaggtgggttttcatcaaga

SEQ ID NO: 1837774 - DNA, 17 bp, Homo sapiens
gagacaacgtgctcttt

SEQ ID NO: 1837775 - DNA, 20 bp, Homo sapiens
gagacacaacaactcctagg

SEQ ID NO: 1837776 - DNA, 14 bp, Homo sapiens
gagacaccaccacc

SEQ ID NO: 1837777 - DNA, 20 bp, Homo sapiens
gagacagcccgggctctgcc

SEQ ID NO: 1837778 - DNA, 21 bp, Homo sapiens
gagacagcccgggctctgcct

SEQ ID NO: 1837779 - DNA, 17 bp, Homo sapiens
gagacagtccagcctgg

SEQ ID NO: 1837780 - DNA, 18 bp, Homo sapiens
gagaccaggcaaagcaag

SEQ ID NO: 1837781 - DNA, 16 bp, Homo sapiens
gagactcctaggcagg

SEQ ID NO: 1837782 - DNA, 16 bp, Homo sapiens
gagactcctgcaggca

SEQ ID NO: 1837783 - DNA, 18 bp, Homo sapiens
gagactcctgcaggcagc

SEQ ID NO: 1837784 - DNA, 20 bp, Homo sapiens
gagactcctgcaggcagcca

SEQ ID NO: 1837785 - DNA, 21 bp, Homo sapiens
gagactcctgcaggcagccag

SEQ ID NO: 1837786 - DNA, 22 bp, Homo sapiens
gagactcctgcaggcagccagg

SEQ ID NO: 1837787 - DNA, 14 bp, Homo sapiens
gagagaccaggcaa

SEQ ID NO: 1837788 - DNA, 20 bp, Homo sapiens
gagagagtcttccaggtact

SEQ ID NO: 1837789 - DNA, 19 bp, Homo sapiens
gagagcctggtgctgctgc

SEQ ID NO: 1837790 - DNA, 15 bp, Homo sapiens
gagagccttccaggg

SEQ ID NO: 1837791 - DNA, 15 bp, Homo sapiens
gagagctagcagcag

SEQ ID NO: 1837792 - DNA, 21 bp, Homo sapiens
gagagctagcagcagggaggg

SEQ ID NO: 1837793 - DNA, 16 bp, Homo sapiens
gagagctggagcctgg

SEQ ID NO: 1837794 - DNA, 16 bp, Homo sapiens
gagagcttaatgataa

SEQ ID NO: 1837795 - DNA, 12 bp, Homo sapiens
gagaggggacgc

SEQ ID NO: 1837796 - DNA, 17 bp, Homo sapiens
gagaggggacgcaggcc

SEQ ID NO: 1837797 - DNA, 19 bp, Homo sapiens
gagaggggacgcaggcccc

SEQ ID NO: 1837798 - DNA, 14 bp, Homo sapiens
gagagggtgggagt

SEQ ID NO: 1837799 - DNA, 20 bp, Homo sapiens
gagagggtgggagtgggccc

SEQ ID NO: 1837800 - DNA, 20 bp, Homo sapiens
gagaggtttgcagtcccaag

SEQ ID NO: 1837801 - DNA, 21 bp, Homo sapiens
gagatgaaccctggcatttgg

SEQ ID NO: 1837802 - DNA, 23 bp, Homo sapiens
gagatgcattcttggttggctgg

SEQ ID NO: 1837803 - DNA, 14 bp, Homo sapiens
gagatgggcttccc

SEQ ID NO: 1837804 - DNA, 16 bp, Homo sapiens
gagatgggcttcccaa

SEQ ID NO: 1837805 - DNA, 21 bp, Homo sapiens
gagattgcaccactgcactcc

SEQ ID NO: 1837806 - DNA, 17 bp, Homo sapiens
gagatttattaaagaaa

SEQ ID NO: 1837807 - DNA, 18 bp, Homo sapiens
gagcaaacccagaggtgg

SEQ ID NO: 1837808 - DNA, 21 bp, Homo sapiens
gagcaagacgctgtgctgccc

SEQ ID NO: 1837809 - DNA, 23 bp, Homo sapiens
gagcaagacgctgtgctgccctg

SEQ ID NO: 1837810 - DNA, 16 bp, Homo sapiens
gagcacctgcaggcgt

SEQ ID NO: 1837811 - DNA, 19 bp, Homo sapiens
gagcaccttagacagtccc

SEQ ID NO: 1837812 - DNA, 22 bp, Homo sapiens
gagcaccttagacagtccctgc

SEQ ID NO: 1837813 - DNA, 18 bp, Homo sapiens
gagcagccacattcctga

SEQ ID NO: 1837814 - DNA, 22 bp, Homo sapiens
gagcagccacattcctgatgct

SEQ ID NO: 1837815 - DNA, 15 bp, Homo sapiens
gagcagcgagcctgc

SEQ ID NO: 1837816 - DNA, 14 bp, Homo sapiens
gagcagtgcaggca

SEQ ID NO: 1837817 - DNA, 16 bp, Homo sapiens
gagcagtgcaggcaca

SEQ ID NO: 1837818 - DNA, 17 bp, Homo sapiens
gagcagtttctgtcctg

SEQ ID NO: 1837819 - DNA, 20 bp, Homo sapiens
gagcagtttctgtcctgctg

SEQ ID NO: 1837820 - DNA, 21 bp, Homo sapiens
gagcagtttctgtcctgctgg

SEQ ID NO: 1837821 - DNA, 14 bp, Homo sapiens
gagcatcaggccag

SEQ ID NO: 1837822 - DNA, 15 bp, Homo sapiens
gagcatcaggccagg

SEQ ID NO: 1837823 - DNA, 21 bp, Homo sapiens
gagcatgcctggatggggctg

SEQ ID NO: 1837824 - DNA, 14 bp, Homo sapiens
gagcatggagctgg

SEQ ID NO: 1837825 - DNA, 16 bp, Homo sapiens
gagcccacgcccccac

SEQ ID NO: 1837826 - DNA, 13 bp, Homo sapiens
gagcctgggaggt

SEQ ID NO: 1837827 - DNA, 14 bp, Homo sapiens
gagcctggtgccct

SEQ ID NO: 1837828 - DNA, 20 bp, Homo sapiens
gagccttccaggggtgggac

SEQ ID NO: 1837829 - DNA, 23 bp, Homo sapiens
gagccttccaggggtgggacacc

SEQ ID NO: 1837830 - DNA, 16 bp, Homo sapiens
gagcgtgagctgagca

SEQ ID NO: 1837831 - DNA, 12 bp, Homo sapiens
gcttggactgga

SEQ ID NO: 1837832 - DNA, 23 bp, Homo sapiens
gcttgtttcctagcacacacttt

SEQ ID NO: 1837833 - DNA, 19 bp, Homo sapiens
gctttaattaagctctcat

SEQ ID NO: 1837834 - DNA, 21 bp, Homo sapiens
gctttccccatgtctcgactc

SEQ ID NO: 1837835 - DNA, 22 bp, Homo sapiens
gctttctgggatgtcacagtcc

SEQ ID NO: 1837836 - DNA, 16 bp, Homo sapiens
gctttgagagagaaag

SEQ ID NO: 1837837 - DNA, 12 bp, Homo sapiens
gctttgctctgc

SEQ ID NO: 1837838 - DNA, 21 bp, Homo sapiens
gctttgtttgttgtcagctga

SEQ ID NO: 1837839 - DNA, 14 bp, Homo sapiens
gcttttacttaaac

SEQ ID NO: 1837840 - DNA, 18 bp, Homo sapiens
gcttttcatgcaaactct

SEQ ID NO: 1837841 - DNA, 15 bp, Homo sapiens
ggaaaaatagcctgc

SEQ ID NO: 1837842 - DNA, 15 bp, Homo sapiens
ggaaaacattccatc

SEQ ID NO: 1837843 - DNA, 12 bp, Homo sapiens
ggaaaaccagac

SEQ ID NO: 1837844 - DNA, 22 bp, Homo sapiens
ggaaaaccagactacttgggag

SEQ ID NO: 1837845 - DNA, 19 bp, Homo sapiens
ggaaaatacctaattgtgg

SEQ ID NO: 1837846 - DNA, 17 bp, Homo sapiens
ggaaaatggccatgcag

SEQ ID NO: 1837847 - DNA, 16 bp, Homo sapiens
ggaaacccagctctgg

SEQ ID NO: 1837848 - DNA, 18 bp, Homo sapiens
ggaaactgggttcctgca

SEQ ID NO: 1837849 - DNA, 15 bp, Homo sapiens
ggaaagaaagttgca

SEQ ID NO: 1837850 - DNA, 16 bp, Homo sapiens
ggaaagcacaggtggg

SEQ ID NO: 1837851 - DNA, 18 bp, Homo sapiens
ggaaaggcaaatgcccaa

SEQ ID NO: 1837852 - DNA, 20 bp, Homo sapiens
ggaaaggcaaatgcccaagg

SEQ ID NO: 1837853 - DNA, 19 bp, Homo sapiens
ggaaaggctccaggagcag

SEQ ID NO: 1837854 - DNA, 17 bp, Homo sapiens
ggaaatgggcagagcag

SEQ ID NO: 1837855 - DNA, 23 bp, Homo sapiens
ggaacagaagaggaaagagagac

SEQ ID NO: 1837856 - DNA, 12 bp, Homo sapiens
ggaagacagaga

SEQ ID NO: 1837857 - DNA, 23 bp, Homo sapiens
ggaagacagagacctcctgcctc

SEQ ID NO: 1837858 - DNA, 12 bp, Homo sapiens
ggaagactttgg

SEQ ID NO: 1837859 - DNA, 13 bp, Homo sapiens
ggaagagaaaaaa

SEQ ID NO: 1837860 - DNA, 18 bp, Homo sapiens
ggaagcagaaatccaagc

SEQ ID NO: 1837861 - DNA, 18 bp, Homo sapiens
ggaagccgctggggccag

SEQ ID NO: 1837862 - DNA, 16 bp, Homo sapiens
ggaagctcagggcctg

SEQ ID NO: 1837863 - DNA, 17 bp, Homo sapiens
ggaagctcagggcctgg

SEQ ID NO: 1837864 - DNA, 23 bp, Homo sapiens
ggaagctcagggcctggctcagg

SEQ ID NO: 1837865 - DNA, 20 bp, Homo sapiens
ggaaggaaacccagctctgg

SEQ ID NO: 1837866 - DNA, 16 bp, Homo sapiens
ggaaggtggggacagg

SEQ ID NO: 1837867 - DNA, 23 bp, Homo sapiens
ggaagtaacagtaacgcagggga

SEQ ID NO: 1837868 - DNA, 15 bp, Homo sapiens
ggaataacctttctg

SEQ ID NO: 1837869 - DNA, 17 bp, Homo sapiens
ggaataacctttctgga

SEQ ID NO: 1837870 - DNA, 22 bp, Homo sapiens
ggaataatgggcttagagcagt

SEQ ID NO: 1837871 - DNA, 16 bp, Homo sapiens
ggaatccactcccagg

SEQ ID NO: 1837872 - DNA, 19 bp, Homo sapiens
ggaatccactcccaggcag

SEQ ID NO: 1837873 - DNA, 23 bp, Homo sapiens
ggacaaggatgatctaggaagac

SEQ ID NO: 1837874 - DNA, 12 bp, Homo sapiens
ggacaccctgtg

SEQ ID NO: 1837875 - DNA, 23 bp, Homo sapiens
ggacaccctgtgatggggccctg

SEQ ID NO: 1837876 - DNA, 16 bp, Homo sapiens
ggacacgctcagtggg

SEQ ID NO: 1837877 - DNA, 21 bp, Homo sapiens
ggacacgggcctgtccacagg

SEQ ID NO: 1837878 - DNA, 17 bp, Homo sapiens
ggacactcaaaagctgg

SEQ ID NO: 1837879 - DNA, 20 bp, Homo sapiens
ggacagagggggtggcctcc

SEQ ID NO: 1837880 - DNA, 16 bp, Homo sapiens
ggacagcccctcctcc

SEQ ID NO: 1837881 - DNA, 19 bp, Homo sapiens
ggacatgctgaagccaaag

SEQ ID NO: 1837882 - DNA, 13 bp, Homo sapiens
ggacatggacaag

SEQ ID NO: 1837883 - DNA, 22 bp, Homo sapiens
ggaccagcttttcccaaaagcc

SEQ ID NO: 1837884 - DNA, 13 bp, Homo sapiens
ggaccaggcaatg

SEQ ID NO: 1837885 - DNA, 15 bp, Homo sapiens
ggaccccgagcctgg

SEQ ID NO: 1837886 - DNA, 18 bp, Homo sapiens
ggaccctgaggcccagag

SEQ ID NO: 1837887 - DNA, 23 bp, Homo sapiens
ggacctcaggtgagaagcagagg

SEQ ID NO: 1837888 - DNA, 19 bp, Homo sapiens
ggacgcaggcccctctcct

SEQ ID NO: 1837889 - DNA, 15 bp, Homo sapiens
ggacgccacccagca

SEQ ID NO: 1837890 - DNA, 15 bp, Homo sapiens
ggacggtgctccagg

SEQ ID NO: 1837891 - DNA, 11 bp, Homo sapiens
ggactcctgaa

SEQ ID NO: 1837892 - DNA, 16 bp, Homo sapiens
ggactcctgaaaaaaa

SEQ ID NO: 1837893 - DNA, 19 bp, Homo sapiens
ggactgtgacaggcagcag

SEQ ID NO: 1837894 - DNA, 21 bp, Homo sapiens
ggactgtgacaggcagcagag

SEQ ID NO: 1837895 - DNA, 22 bp, Homo sapiens
ggacttagaaaaccagctcagc

SEQ ID NO: 1837896 - DNA, 18 bp, Homo sapiens
ggagaagcggctggcagc

SEQ ID NO: 1837897 - DNA, 19 bp, Homo sapiens
ggagaagtcttctatttat

SEQ ID NO: 1837898 - DNA, 21 bp, Homo sapiens
ggagacacaacaactcctagg

SEQ ID NO: 1837899 - DNA, 16 bp, Homo sapiens
ggagactcctaggcag

SEQ ID NO: 1837900 - DNA, 16 bp, Homo sapiens
ggagagccttccaggg

SEQ ID NO: 1837901 - DNA, 18 bp, Homo sapiens
ggagagccttccaggggt

SEQ ID NO: 1837902 - DNA, 15 bp, Homo sapiens
ggagagctagcagca

SEQ ID NO: 1837903 - DNA, 21 bp, Homo sapiens
ggagagctagcagcagggagg

SEQ ID NO: 1837904 - DNA, 18 bp, Homo sapiens
ggagagctggagcctggt

SEQ ID NO: 1837905 - DNA, 17 bp, Homo sapiens
ggagaggggacgcaggc

SEQ ID NO: 1837906 - DNA, 16 bp, Homo sapiens
ggagataagaaagcag

SEQ ID NO: 1837907 - DNA, 18 bp, Homo sapiens
ggagatcccacatatttc

SEQ ID NO: 1837908 - DNA, 14 bp, Homo sapiens
ggagcagtgcaggc

SEQ ID NO: 1837909 - DNA, 16 bp, Homo sapiens
ggagcatcagtgccct

SEQ ID NO: 1837910 - DNA, 18 bp, Homo sapiens
ggagccagtaaacagagg

SEQ ID NO: 1837911 - DNA, 12 bp, Homo sapiens
ggagcctggtgc

SEQ ID NO: 1837912 - DNA, 12 bp, Homo sapiens
ggaggaagagaa

SEQ ID NO: 1837913 - DNA, 20 bp, Homo sapiens
ggaggaaggaaacccagctc

SEQ ID NO: 1837914 - DNA, 17 bp, Homo sapiens
ggaggagcaaaggctga

SEQ ID NO: 1837915 - DNA, 17 bp, Homo sapiens
ggaggagcagtgcaggc

SEQ ID NO: 1837916 - DNA, 11 bp, Homo sapiens
ggaggccagcc

SEQ ID NO: 1837917 - DNA, 12 bp, Homo sapiens
ggaggccagcct

SEQ ID NO: 1837918 - DNA, 21 bp, Homo sapiens
ggaggcccttgtcgtgggatg

SEQ ID NO: 1837919 - DNA, 17 bp, Homo sapiens
ggagggagggctccaga

SEQ ID NO: 1837920 - DNA, 18 bp, Homo sapiens
ggagggcaggcttgggga

SEQ ID NO: 1837921 - DNA, 14 bp, Homo sapiens
ggagggctccagac

SEQ ID NO: 1837922 - DNA, 16 bp, Homo sapiens
ggaggggggaggtggg

SEQ ID NO: 1837923 - DNA, 22 bp, Homo sapiens
ggaggtaaggaatacctgtccc

SEQ ID NO: 1837924 - DNA, 14 bp, Homo sapiens
ggaggtcgaggcag

SEQ ID NO: 1837925 - DNA, 17 bp, Homo sapiens
ggagtacaggtgaagca

SEQ ID NO: 1837926 - DNA, 23 bp, Homo sapiens
ggagtgagttgatagcacagacc

SEQ ID NO: 1837927 - DNA, 12 bp, Homo sapiens
ggagtgggccca

SEQ ID NO: 1837928 - DNA, 15 bp, Homo sapiens
ggagttcaccttgga

SEQ ID NO: 1837929 - DNA, 21 bp, Homo sapiens
ggagttcaccttggaagggcg

SEQ ID NO: 1837930 - DNA, 21 bp, Homo sapiens
ggagtttatgttccattaaac

SEQ ID NO: 1837931 - DNA, 13 bp, Homo sapiens
ggatccctcatcc

SEQ ID NO: 1837932 - DNA, 13 bp, Homo sapiens
ggatcctccaggt

SEQ ID NO: 1837933 - DNA, 14 bp, Homo sapiens
ggatcctccaggtg

SEQ ID NO: 1837934 - DNA, 21 bp, Homo sapiens
ggatctccctgagatgggctt

SEQ ID NO: 1837935 - DNA, 14 bp, Homo sapiens
ggatctgctgaggc

SEQ ID NO: 1837936 - DNA, 15 bp, Homo sapiens
ggatctgctgaggcc

SEQ ID NO: 1837937 - DNA, 18 bp, Homo sapiens
ggatctgctgaggcccag

SEQ ID NO: 1837938 - DNA, 19 bp, Homo sapiens
ggatgagcatggagctggc

SEQ ID NO: 1837939 - DNA, 22 bp, Homo sapiens
ggatgatctaggaagactttgg

SEQ ID NO: 1837940 - DNA, 16 bp, Homo sapiens
ggatgcagcctcacag

SEQ ID NO: 1837941 - DNA, 19 bp, Homo sapiens
ggatgcagcctcacagtcc

SEQ ID NO: 1837942 - DNA, 21 bp, Homo sapiens
ggatgcatgttttccagctcc

SEQ ID NO: 1837943 - DNA, 17 bp, Homo sapiens
ggatgctgacatcattt

SEQ ID NO: 1837944 - DNA, 17 bp, Homo sapiens
ggatggcatttggtctc

SEQ ID NO: 1837945 - DNA, 20 bp, Homo sapiens
ggatggcatttggtctcagg

SEQ ID NO: 1837946 - DNA, 21 bp, Homo sapiens
ggatggcctggccagggcctg

SEQ ID NO: 1837947 - DNA, 16 bp, Homo sapiens
ggatggggctgcaccg

SEQ ID NO: 1837948 - DNA, 13 bp, Homo sapiens
ggatggtgccctg

SEQ ID NO: 1837949 - DNA, 21 bp, Homo sapiens
ggatgtacaaggacagcccct

SEQ ID NO: 1837950 - DNA, 18 bp, Homo sapiens
ggatgttatgaacagctg

SEQ ID NO: 1837951 - DNA, 19 bp, Homo sapiens
ggatgttatgaacagctgt

SEQ ID NO: 1837952 - DNA, 14 bp, Homo sapiens
ggattcaattttaa

SEQ ID NO: 1837953 - DNA, 13 bp, Homo sapiens
taaagaaaagatg

SEQ ID NO: 1837954 - DNA, 15 bp, Homo sapiens
taaagacagaggcag

SEQ ID NO: 1837955 - DNA, 20 bp, Homo sapiens
taaagggcgcaaagggcatg

SEQ ID NO: 1837956 - DNA, 18 bp, Homo sapiens
taaagtgaagaatttatc

SEQ ID NO: 1837957 - DNA, 13 bp, Homo sapiens
taaagtttctgtt

SEQ ID NO: 1837958 - DNA, 13 bp, Homo sapiens
taaataaaatttt

SEQ ID NO: 1837959 - DNA, 23 bp, Homo sapiens
taaatataaagacgttttataag

SEQ ID NO: 1837960 - DNA, 14 bp, Homo sapiens
taaatatattatta

SEQ ID NO: 1837961 - DNA, 17 bp, Homo sapiens
taaatatattattactt

SEQ ID NO: 1837962 - DNA, 18 bp, Homo sapiens
taaatatattattacttg

SEQ ID NO: 1837963 - DNA, 21 bp, Homo sapiens
taaatatattattacttgtaa

SEQ ID NO: 1837964 - DNA, 23 bp, Homo sapiens
taaatatattattacttgtaaat

SEQ ID NO: 1837965 - DNA, 19 bp, Homo sapiens
taaatcgcttttgataatc

SEQ ID NO: 1837966 - DNA, 23 bp, Homo sapiens
taaatgaacaagagaagcattct

SEQ ID NO: 1837967 - DNA, 15 bp, Homo sapiens
taaatgcccagcccc

SEQ ID NO: 1837968 - DNA, 16 bp, Homo sapiens
taaatgcccagcccct

SEQ ID NO: 1837969 - DNA, 17 bp, Homo sapiens
taaatgcccagcccctt

SEQ ID NO: 1837970 - DNA, 14 bp, Homo sapiens
taaatggttaaaag

SEQ ID NO: 1837971 - DNA, 14 bp, Homo sapiens
taacaaattgcatt

SEQ ID NO: 1837972 - DNA, 16 bp, Homo sapiens
taacaaattgcatttg

SEQ ID NO: 1837973 - DNA, 15 bp, Homo sapiens
taacaacaattattt

SEQ ID NO: 1837974 - DNA, 14 bp, Homo sapiens
taacacacagctcc

SEQ ID NO: 1837975 - DNA, 13 bp, Homo sapiens
taacacagtgtct

SEQ ID NO: 1837976 - DNA, 18 bp, Homo sapiens
taacaccatgattaacca

SEQ ID NO: 1837977 - DNA, 15 bp, Homo sapiens
taacagtaacgcagg

SEQ ID NO: 1837978 - DNA, 14 bp, Homo sapiens
taacagtcatcatt

SEQ ID NO: 1837979 - DNA, 19 bp, Homo sapiens
taacatcgaaaagttattt

SEQ ID NO: 1837980 - DNA, 12 bp, Homo sapiens
taacatttctgt

SEQ ID NO: 1837981 - DNA, 22 bp, Homo sapiens
taaccacatttctaagcctttg

SEQ ID NO: 1837982 - DNA, 11 bp, Homo sapiens
taaccctttct

SEQ ID NO: 1837983 - DNA, 22 bp, Homo sapiens
taactacaaaggtttaaatgaa

SEQ ID NO: 1837984 - DNA, 16 bp, Homo sapiens
taactgagtgcctttt

SEQ ID NO: 1837985 - DNA, 21 bp, Homo sapiens
taactgttatttataatcact

SEQ ID NO: 1837986 - DNA, 11 bp, Homo sapiens
taacttagtat

SEQ ID NO: 1837987 - DNA, 16 bp, Homo sapiens
taacttgtctttggac

SEQ ID NO: 1837988 - DNA, 13 bp, Homo sapiens
taagagacagtca

SEQ ID NO: 1837989 - DNA, 12 bp, Homo sapiens
taagagggaggg

SEQ ID NO: 1837990 - DNA, 20 bp, Homo sapiens
taagagggcacacactgtgt

SEQ ID NO: 1837991 - DNA, 18 bp, Homo sapiens
taagcactttaacacagt

SEQ ID NO: 1837992 - DNA, 21 bp, Homo sapiens
taagcatcattatttatgtat

SEQ ID NO: 1837993 - DNA, 22 bp, Homo sapiens
taagcatcattatttatgtatt

SEQ ID NO: 1837994 - DNA, 18 bp, Homo sapiens
taagcctttgagactgtt

SEQ ID NO: 1837995 - DNA, 17 bp, Homo sapiens
taagcctttggaaacag

SEQ ID NO: 1837996 - DNA, 19 bp, Homo sapiens
taaggaaactgggttcctg

SEQ ID NO: 1837997 - DNA, 22 bp, Homo sapiens
taaggattttatgctttaaaca

SEQ ID NO: 1837998 - DNA, 17 bp, Homo sapiens
taaggcatatttaacaa

SEQ ID NO: 1837999 - DNA, 22 bp, Homo sapiens
taagtaatctcacagcatttgc

SEQ ID NO: 1838000 - DNA, 16 bp, Homo sapiens
taagtatctgacatct

SEQ ID NO: 1838001 - DNA, 11 bp, Homo sapiens
taagtctctgt

SEQ ID NO: 1838002 - DNA, 13 bp, Homo sapiens
taagtctgtttta

SEQ ID NO: 1838003 - DNA, 16 bp, Homo sapiens
taagtctgttttatga

SEQ ID NO: 1838004 - DNA, 20 bp, Homo sapiens
taagtctgttttatgacttc

SEQ ID NO: 1838005 - DNA, 22 bp, Homo sapiens
taagtcttatcaagcagccaag

SEQ ID NO: 1838006 - DNA, 14 bp, Homo sapiens
taagtgcacaacat

SEQ ID NO: 1838007 - DNA, 20 bp, Homo sapiens
taagtggtactaactttcct

SEQ ID NO: 1838008 - DNA, 16 bp, Homo sapiens
taataaagatcatgta

SEQ ID NO: 1838009 - DNA, 17 bp, Homo sapiens
taataaagatcatgtaa

SEQ ID NO: 1838010 - DNA, 13 bp, Homo sapiens
taatataaatgca

SEQ ID NO: 1838011 - DNA, 14 bp, Homo sapiens
taatataaatgcaa

SEQ ID NO: 1838012 - DNA, 22 bp, Homo sapiens
taatataaatgcaaataacaaa

SEQ ID NO: 1838013 - DNA, 16 bp, Homo sapiens
taatattgtggtgcca

SEQ ID NO: 1838014 - DNA, 16 bp, Homo sapiens
taatcacttttttcca

SEQ ID NO: 1838015 - DNA, 21 bp, Homo sapiens
taatctcaaagagattcgaat

SEQ ID NO: 1838016 - DNA, 14 bp, Homo sapiens
taatctcacagcat

SEQ ID NO: 1838017 - DNA, 13 bp, Homo sapiens
taatctctccacc

SEQ ID NO: 1838018 - DNA, 18 bp, Homo sapiens
taatctctccaccttcca

SEQ ID NO: 1838019 - DNA, 19 bp, Homo sapiens
taatctctccaccttccaa

SEQ ID NO: 1838020 - DNA, 18 bp, Homo sapiens
taatggtagttttacagt

SEQ ID NO: 1838021 - DNA, 22 bp, Homo sapiens
taattaagctctcatagctcat

SEQ ID NO: 1838022 - DNA, 23 bp, Homo sapiens
taattagttcctcattagcattt

SEQ ID NO: 1838023 - DNA, 16 bp, Homo sapiens
taattattgatgtttt

SEQ ID NO: 1838024 - DNA, 20 bp, Homo sapiens
tacaaaaagcataaaaatta

SEQ ID NO: 1838025 - DNA, 14 bp, Homo sapiens
tacaaaggtttaaa

SEQ ID NO: 1838026 - DNA, 20 bp, Homo sapiens
tacaaaggtttaaatgaaca

SEQ ID NO: 1838027 - DNA, 21 bp, Homo sapiens
tacactgtgctgagtctgaag

SEQ ID NO: 1838028 - DNA, 16 bp, Homo sapiens
tacagggaatgcctga

SEQ ID NO: 1838029 - DNA, 12 bp, Homo sapiens
tacagtcctccc

SEQ ID NO: 1838030 - DNA, 17 bp, Homo sapiens
tacagttgaaaaacagc

SEQ ID NO: 1838031 - DNA, 17 bp, Homo sapiens
tacagtttgtcacatga

SEQ ID NO: 1838032 - DNA, 12 bp, Homo sapiens
tacccaccccca

SEQ ID NO: 1838033 - DNA, 19 bp, Homo sapiens
tacccacccccacccaagg

SEQ ID NO: 1838034 - DNA, 23 bp, Homo sapiens
tacctacatgtatttgtttgcat

SEQ ID NO: 1838035 - DNA, 15 bp, Homo sapiens
tacctcctgtctctg

SEQ ID NO: 1838036 - DNA, 16 bp, Homo sapiens
tacctgtccccctgac

SEQ ID NO: 1838037 - DNA, 17 bp, Homo sapiens
tacctgtccccctgaca

SEQ ID NO: 1838038 - DNA, 22 bp, Homo sapiens
taccttctccctcatttcagga

SEQ ID NO: 1838039 - DNA, 23 bp, Homo sapiens
tactaggaagtaaagtgaagaat

SEQ ID NO: 1838040 - DNA, 20 bp, Homo sapiens
tactcataaggcatatacaa

SEQ ID NO: 1838041 - DNA, 15 bp, Homo sapiens
tactctacaaaatat

SEQ ID NO: 1838042 - DNA, 17 bp, Homo sapiens
tactgattgggaggtgc

SEQ ID NO: 1838043 - DNA, 13 bp, Homo sapiens
tacttgtaaatat

SEQ ID NO: 1838044 - DNA, 14 bp, Homo sapiens
tacttgtaaatata

SEQ ID NO: 1838045 - DNA, 15 bp, Homo sapiens
tacttgtaaatataa

SEQ ID NO: 1838046 - DNA, 15 bp, Homo sapiens
tactttaaccctttc

SEQ ID NO: 1838047 - DNA, 15 bp, Homo sapiens
tagaaacattgaaga

SEQ ID NO: 1838048 - DNA, 18 bp, Homo sapiens
tagaaagagatacagagg

SEQ ID NO: 1838049 - DNA, 20 bp, Homo sapiens
tagaaccaccaacaagcaag

SEQ ID NO: 1838050 - DNA, 22 bp, Homo sapiens
tagaaccaccaacaagcaagct

SEQ ID NO: 1838051 - DNA, 16 bp, Homo sapiens
tagaaggactgcagcc

SEQ ID NO: 1838052 - DNA, 18 bp, Homo sapiens
tagaatgttttcaaatgt

SEQ ID NO: 1838053 - DNA, 21 bp, Homo sapiens
tagaattttggtataaagaaa

SEQ ID NO: 1838054 - DNA, 12 bp, Homo sapiens
tagacagtccct

SEQ ID NO: 1838055 - DNA, 14 bp, Homo sapiens
tagacagtccctgc

SEQ ID NO: 1838056 - DNA, 22 bp, Homo sapiens
tagagcaggcgttcagctcact

SEQ ID NO: 1838057 - DNA, 17 bp, Homo sapiens
tagagcagtttctgtcc

SEQ ID NO: 1838058 - DNA, 22 bp, Homo sapiens
tagagcagtttctgtcctgctg

SEQ ID NO: 1838059 - DNA, 20 bp, Homo sapiens
tagaggatccctctctggat

SEQ ID NO: 1838060 - DNA, 16 bp, Homo sapiens
tagcacagaccctgcc

SEQ ID NO: 1838061 - DNA, 18 bp, Homo sapiens
tagcacagaccctgccct

SEQ ID NO: 1838062 - DNA, 24 bp, Homo sapiens
tagcacagaccctgccctgtgggc

SEQ ID NO: 1838063 - DNA, 14 bp, Homo sapiens
tagcacatgatttg

SEQ ID NO: 1838064 - DNA, 16 bp, Homo sapiens
tagcactttgggaggc

SEQ ID NO: 1838065 - DNA, 22 bp, Homo sapiens
tagcattttgctaaatgtgaat

SEQ ID NO: 1838066 - DNA, 16 bp, Homo sapiens
tagcccgaatacaaac

SEQ ID NO: 1838067 - DNA, 15 bp, Homo sapiens
tagccgatggaaaat

SEQ ID NO: 1838068 - DNA, 19 bp, Homo sapiens
tagctaagatataatttaa

SEQ ID NO: 1838069 - DNA, 13 bp, Homo sapiens
tagctcaatgagc

SEQ ID NO: 1838070 - DNA, 15 bp, Homo sapiens
tagctcaatgagcat

SEQ ID NO: 1838071 - DNA, 18 bp, Homo sapiens
tagctcaatgagcatgtt

SEQ ID NO: 1838072 - DNA, 12 bp, Homo sapiens
tagctcttgctt

SEQ ID NO: 1838073 - DNA, 15 bp, Homo sapiens
tagctgaatgttttt

SEQ ID NO: 1838074 - DNA, 16 bp, Homo sapiens
tagcttgcaccttgtc

SEQ ID NO: 1838075 - DNA, 13 bp, Homo sapiens
tcttaaaaagtgg

SEQ ID NO: 1838076 - DNA, 15 bp, Homo sapiens
tcttaaataataaag

SEQ ID NO: 1838077 - DNA, 19 bp, Homo sapiens
tcttacaaaaacaagacac

SEQ ID NO: 1838078 - DNA, 20 bp, Homo sapiens
tcttaccagggagatttgct

SEQ ID NO: 1838079 - DNA, 18 bp, Homo sapiens
tcttagcaaaaaatgaac

SEQ ID NO: 1838080 - DNA, 15 bp, Homo sapiens
tcttagctcaatgag

SEQ ID NO: 1838081 - DNA, 19 bp, Homo sapiens
tcttatggatgtccccagc

SEQ ID NO: 1838082 - DNA, 17 bp, Homo sapiens
tcttcaaaatgagccct

SEQ ID NO: 1838083 - DNA, 23 bp, Homo sapiens
tcttcacctaagtctctgtgaat

SEQ ID NO: 1838084 - DNA, 20 bp, Homo sapiens
tcttcagagactcctgcagg

SEQ ID NO: 1838085 - DNA, 18 bp, Homo sapiens
tcttcatacctacatgta

SEQ ID NO: 1838086 - DNA, 21 bp, Homo sapiens
tcttcatacctacatgtattt

SEQ ID NO: 1838087 - DNA, 21 bp, Homo sapiens
tcttccaggctgggagagcct

SEQ ID NO: 1838088 - DNA, 21 bp, Homo sapiens
tcttccagtgaacattcccag

SEQ ID NO: 1838089 - DNA, 18 bp, Homo sapiens
tcttctacaactcataca

SEQ ID NO: 1838090 - DNA, 22 bp, Homo sapiens
tcttctatttatttatttattc

SEQ ID NO: 1838091 - DNA, 22 bp, Homo sapiens
tcttggcacatttaagagacag

SEQ ID NO: 1838092 - DNA, 17 bp, Homo sapiens
tcttggtcctgctgcag

SEQ ID NO: 1838093 - DNA, 19 bp, Homo sapiens
tcttggtcctgctgcagtt

SEQ ID NO: 1838094 - DNA, 17 bp, Homo sapiens
tcttggttggctggcct

SEQ ID NO: 1838095 - DNA, 22 bp, Homo sapiens
tcttgtattaagaatgaaatac

SEQ ID NO: 1838096 - DNA, 12 bp, Homo sapiens
tctttcctgagg

SEQ ID NO: 1838097 - DNA, 22 bp, Homo sapiens
tctttggacagaagcagctctt

SEQ ID NO: 1838098 - DNA, 16 bp, Homo sapiens
tctttggaccctgagg

SEQ ID NO: 1838099 - DNA, 22 bp, Homo sapiens
tctttggtctacactgtgctga

SEQ ID NO: 1838100 - DNA, 17 bp, Homo sapiens
tctttgttttgtgtctc

SEQ ID NO: 1838101 - DNA, 14 bp, Homo sapiens
tctttttgaaatgt

SEQ ID NO: 1838102 - DNA, 17 bp, Homo sapiens
tctttttttgagtgaca

SEQ ID NO: 1838103 - DNA, 20 bp, Homo sapiens
tctttttttgagtgacagct

SEQ ID NO: 1838104 - DNA, 16 bp, Homo sapiens
tgaaaaaggaggaaga

SEQ ID NO: 1838105 - DNA, 17 bp, Homo sapiens
tgaaaacactgttctct

SEQ ID NO: 1838106 - DNA, 20 bp, Homo sapiens
tgaaaacactgttctctgcc

SEQ ID NO: 1838107 - DNA, 13 bp, Homo sapiens
tgaaaagttggaa

SEQ ID NO: 1838108 - DNA, 16 bp, Homo sapiens
tgaaaagttggaagga

SEQ ID NO: 1838109 - DNA, 23 bp, Homo sapiens
tgaaaagttggaaggatctgctg

SEQ ID NO: 1838110 - DNA, 13 bp, Homo sapiens
tgaaacacacgag

SEQ ID NO: 1838111 - DNA, 21 bp, Homo sapiens
tgaaacacacgagcaaaccca

SEQ ID NO: 1838112 - DNA, 23 bp, Homo sapiens
tgaaatagacccacaagaggcag

SEQ ID NO: 1838113 - DNA, 14 bp, Homo sapiens
tgaaatagtgtctg

SEQ ID NO: 1838114 - DNA, 12 bp, Homo sapiens
tgaaatgcattt

SEQ ID NO: 1838115 - DNA, 14 bp, Homo sapiens
tgaaatgcattttg

SEQ ID NO: 1838116 - DNA, 19 bp, Homo sapiens
tgaacactccaattaagga

SEQ ID NO: 1838117 - DNA, 23 bp, Homo sapiens
tgaacactccaattaaggatttt

SEQ ID NO: 1838118 - DNA, 17 bp, Homo sapiens
tgaacattcccagccca

SEQ ID NO: 1838119 - DNA, 22 bp, Homo sapiens
tgaaccctggcatttggcctct

SEQ ID NO: 1838120 - DNA, 16 bp, Homo sapiens
tgaactctgacaacag

SEQ ID NO: 1838121 - DNA, 14 bp, Homo sapiens
tgaactgaactctg

SEQ ID NO: 1838122 - DNA, 16 bp, Homo sapiens
tgaactttgctgagcc

SEQ ID NO: 1838123 - DNA, 21 bp, Homo sapiens
tgaagaatctgtttcccagca

SEQ ID NO: 1838124 - DNA, 13 bp, Homo sapiens
tgaagatttaatt

SEQ ID NO: 1838125 - DNA, 13 bp, Homo sapiens
tgaagcaggaggc

SEQ ID NO: 1838126 - DNA, 15 bp, Homo sapiens
tgaagcaggaggccc

SEQ ID NO: 1838127 - DNA, 14 bp, Homo sapiens
tgaagcattttata

SEQ ID NO: 1838128 - DNA, 15 bp, Homo sapiens
tgaagcattttataa

SEQ ID NO: 1838129 - DNA, 22 bp, Homo sapiens
tgaagcattttataaatcgctt

SEQ ID NO: 1838130 - DNA, 12 bp, Homo sapiens
tgaagcctttgt

SEQ ID NO: 1838131 - DNA, 12 bp, Homo sapiens
tgaaggactgtg

SEQ ID NO: 1838132 - DNA, 14 bp, Homo sapiens
tgaaggactgtgac

SEQ ID NO: 1838133 - DNA, 14 bp, Homo sapiens
tgaaggcaatgcca

SEQ ID NO: 1838134 - DNA, 20 bp, Homo sapiens
tgaaggccccgcccaggctt

SEQ ID NO: 1838135 - DNA, 24 bp, Homo sapiens
tgaagggattttagtcacacgtgg

SEQ ID NO: 1838136 - DNA, 11 bp, Homo sapiens
tgaagtaacct

SEQ ID NO: 1838137 - DNA, 19 bp, Homo sapiens
tgaagtctctgaagtgaaa

SEQ ID NO: 1838138 - DNA, 12 bp, Homo sapiens
tgaagtgaaact

SEQ ID NO: 1838139 - DNA, 13 bp, Homo sapiens
tgaagtgaaactg

SEQ ID NO: 1838140 - DNA, 19 bp, Homo sapiens
tgaataaaattattccttt

SEQ ID NO: 1838141 - DNA, 19 bp, Homo sapiens
tgaatgcttataggtggcc

SEQ ID NO: 1838142 - DNA, 21 bp, Homo sapiens
tgaatgcttataggtggcctc

SEQ ID NO: 1838143 - DNA, 13 bp, Homo sapiens
tgaatgtttttct

SEQ ID NO: 1838144 - DNA, 17 bp, Homo sapiens
tgaatgtttttctaaag

SEQ ID NO: 1838145 - DNA, 17 bp, Homo sapiens
tgaattatgcttccaca

SEQ ID NO: 1838146 - DNA, 13 bp, Homo sapiens
tgacaacactcat

SEQ ID NO: 1838147 - DNA, 15 bp, Homo sapiens
tgacaacagacttct

SEQ ID NO: 1838148 - DNA, 18 bp, Homo sapiens
tgacaacagacttctgaa

SEQ ID NO: 1838149 - DNA, 16 bp, Homo sapiens
tgacacaggatgaagg

SEQ ID NO: 1838150 - DNA, 16 bp, Homo sapiens
tgacagctttctggga

SEQ ID NO: 1838151 - DNA, 17 bp, Homo sapiens
tgacagctttctgggat

SEQ ID NO: 1838152 - DNA, 14 bp, Homo sapiens
tgacaggcagcaga

SEQ ID NO: 1838153 - DNA, 16 bp, Homo sapiens
tgacaggcagcagaga

SEQ ID NO: 1838154 - DNA, 22 bp, Homo sapiens
tgacagtgcctcttccagtgaa

SEQ ID NO: 1838155 - DNA, 13 bp, Homo sapiens
tgacatctctgca

SEQ ID NO: 1838156 - DNA, 14 bp, Homo sapiens
tgacatctctgcaa

SEQ ID NO: 1838157 - DNA, 15 bp, Homo sapiens
tgacattcatgcctg

SEQ ID NO: 1838158 - DNA, 22 bp, Homo sapiens
tgacatttatttttctcatgaa

SEQ ID NO: 1838159 - DNA, 12 bp, Homo sapiens
tgaccacactcc

SEQ ID NO: 1838160 - DNA, 19 bp, Homo sapiens
tgaccacactccagctggg

SEQ ID NO: 1838161 - DNA, 13 bp, Homo sapiens
tgaccaggcctgg

SEQ ID NO: 1838162 - DNA, 15 bp, Homo sapiens
tgaccaggcctgggc

SEQ ID NO: 1838163 - DNA, 21 bp, Homo sapiens
tgaccagtttaacctgatgca

SEQ ID NO: 1838164 - DNA, 13 bp, Homo sapiens
tgaccattctcca

SEQ ID NO: 1838165 - DNA, 16 bp, Homo sapiens
tgaccattctccacct

SEQ ID NO: 1838166 - DNA, 14 bp, Homo sapiens
tgacccaggctggg

SEQ ID NO: 1838167 - DNA, 21 bp, Homo sapiens
tgacccatgctgccctgtgag

SEQ ID NO: 1838168 - DNA, 22 bp, Homo sapiens
tgacctcagctttgatatttca

SEQ ID NO: 1838169 - DNA, 16 bp, Homo sapiens
tgacctgacagcccaa

SEQ ID NO: 1838170 - DNA, 18 bp, Homo sapiens
tgacctgaggcccttctc

SEQ ID NO: 1838171 - DNA, 15 bp, Homo sapiens
tgacgccatcccagc

SEQ ID NO: 1838172 - DNA, 17 bp, Homo sapiens
tgacgccatcccagccc

SEQ ID NO: 1838173 - DNA, 15 bp, Homo sapiens
tgacgcttgtgacag

SEQ ID NO: 1838174 - DNA, 18 bp, Homo sapiens
tgactcgagtcacactca

SEQ ID NO: 1838175 - DNA, 15 bp, Homo sapiens
tgactgtatctgtgt

SEQ ID NO: 1838176 - DNA, 16 bp, Homo sapiens
tgactgtatctgtgta

SEQ ID NO: 1838177 - DNA, 24 bp, Homo sapiens
tgactgttcaagagcacacttggc

SEQ ID NO: 1838178 - DNA, 14 bp, Homo sapiens
tgagaaattaagta

SEQ ID NO: 1838179 - DNA, 12 bp, Homo sapiens
tgagaattaccc

SEQ ID NO: 1838180 - DNA, 17 bp, Homo sapiens
tgagacagcccgggctc

SEQ ID NO: 1838181 - DNA, 18 bp, Homo sapiens
tgagacagcccgggctct

SEQ ID NO: 1838182 - DNA, 19 bp, Homo sapiens
tgagacagcccgggctctg

SEQ ID NO: 1838183 - DNA, 22 bp, Homo sapiens
tgagacagcccgggctctgcct

SEQ ID NO: 1838184 - DNA, 16 bp, Homo sapiens
tgagacagtccagcct

SEQ ID NO: 1838185 - DNA, 18 bp, Homo sapiens
tgagacagtccagcctgg

SEQ ID NO: 1838186 - DNA, 19 bp, Homo sapiens
tgagacagtccagcctgga

SEQ ID NO: 1838187 - DNA, 14 bp, Homo sapiens
tgagaccaacctgg

SEQ ID NO: 1838188 - DNA, 12 bp, Homo sapiens
tgagaccctgtc

SEQ ID NO: 1838189 - DNA, 22 bp, Homo sapiens
tgagacctcagcttggcactca

SEQ ID NO: 1838190 - DNA, 14 bp, Homo sapiens
tgagagaccaggca

SEQ ID NO: 1838191 - DNA, 16 bp, Homo sapiens
tgagatttattaaaga

SEQ ID NO: 1838192 - DNA, 23 bp, Homo sapiens
tgagcacctgcaggcgtgacctg

SEQ ID NO: 1838193 - DNA, 14 bp, Homo sapiens
tgagcagaacaggt

SEQ ID NO: 1838194 - DNA, 15 bp, Homo sapiens
tgagcatcacagttt

SEQ ID NO: 1838195 - DNA, 18 bp, Homo sapiens
tgagcatcaggccaggcc

SEQ ID NO: 1838196 - DNA, 20 bp, Homo sapiens
tgagcatcaggccaggccct

SEQ ID NO: 1838197 - DNA, 21 bp, Homo sapiens
ttatgcttccacaggcaaaac

SEQ ID NO: 1838198 - DNA, 13 bp, Homo sapiens
ttatgggctgggt

SEQ ID NO: 1838199 - DNA, 14 bp, Homo sapiens
ttatgtaattatat

SEQ ID NO: 1838200 - DNA, 16 bp, Homo sapiens
ttatgttatatataaa

SEQ ID NO: 1838201 - DNA, 12 bp, Homo sapiens
ttattaaagaaa

SEQ ID NO: 1838202 - DNA, 13 bp, Homo sapiens
ttattaaagaaaa

SEQ ID NO: 1838203 - DNA, 21 bp, Homo sapiens
ttattaaagaaaaaaatgtat

SEQ ID NO: 1838204 - DNA, 19 bp, Homo sapiens
ttattaaatgcccagcccc

SEQ ID NO: 1838205 - DNA, 18 bp, Homo sapiens
ttattcattagttttgaa

SEQ ID NO: 1838206 - DNA, 21 bp, Homo sapiens
ttattcattagttttgaagat

SEQ ID NO: 1838207 - DNA, 19 bp, Homo sapiens
ttcaaatgggctgctgctt

SEQ ID NO: 1838208 - DNA, 20 bp, Homo sapiens
ttcaatctggattcatattt

SEQ ID NO: 1838209 - DNA, 19 bp, Homo sapiens
ttcacagcacttacaattt

SEQ ID NO: 1838210 - DNA, 14 bp, Homo sapiens
ttcaccttgaagaa

SEQ ID NO: 1838211 - DNA, 14 bp, Homo sapiens
ttcacctttgtccc

SEQ ID NO: 1838212 - DNA, 18 bp, Homo sapiens
ttcacggaagagccttgc

SEQ ID NO: 1838213 - DNA, 15 bp, Homo sapiens
ttcacttacagcacc

SEQ ID NO: 1838214 - DNA, 22 bp, Homo sapiens
ttcactttgaaaagttggaagg

SEQ ID NO: 1838215 - DNA, 23 bp, Homo sapiens
ttcactttgaaaagttggaagga

SEQ ID NO: 1838216 - DNA, 14 bp, Homo sapiens
ttcagacagctgcc

SEQ ID NO: 1838217 - DNA, 23 bp, Homo sapiens
ttcagataactgttatttataat

SEQ ID NO: 1838218 - DNA, 13 bp, Homo sapiens
ttcagcagaacct

SEQ ID NO: 1838219 - DNA, 21 bp, Homo sapiens
ttcagctggttgaggtttcaa

SEQ ID NO: 1838220 - DNA, 19 bp, Homo sapiens
ttcaggaagctcagggcct

SEQ ID NO: 1838221 - DNA, 20 bp, Homo sapiens
ttcaggaagctcagggcctg

SEQ ID NO: 1838222 - DNA, 16 bp, Homo sapiens
ttcaggagcagcctca

SEQ ID NO: 1838223 - DNA, 18 bp, Homo sapiens
ttcatagagaatataaaa

SEQ ID NO: 1838224 - DNA, 20 bp, Homo sapiens
ttcatatgacattcatgcct

SEQ ID NO: 1838225 - DNA, 12 bp, Homo sapiens
ttcatctggaac

SEQ ID NO: 1838226 - DNA, 15 bp, Homo sapiens
ttcatgcaaactctt

SEQ ID NO: 1838227 - DNA, 20 bp, Homo sapiens
ttcatgcaaactctttggtc

SEQ ID NO: 1838228 - DNA, 21 bp, Homo sapiens
ttcattaataataaattccct

SEQ ID NO: 1838229 - DNA, 13 bp, Homo sapiens
ttcattagagcag

SEQ ID NO: 1838230 - DNA, 14 bp, Homo sapiens
ttcattagttttga

SEQ ID NO: 1838231 - DNA, 16 bp, Homo sapiens
ttcattccattctgga

SEQ ID NO: 1838232 - DNA, 12 bp, Homo sapiens
ttccacttggct

SEQ ID NO: 1838233 - DNA, 13 bp, Homo sapiens
ttccagctcctca

SEQ ID NO: 1838234 - DNA, 21 bp, Homo sapiens
ttccaggggtgggacaccctg

SEQ ID NO: 1838235 - DNA, 18 bp, Homo sapiens
ttccaggtttaagctgtt

SEQ ID NO: 1838236 - DNA, 22 bp, Homo sapiens
ttccagtgaaatcagttactct

SEQ ID NO: 1838237 - DNA, 21 bp, Homo sapiens
ttccagtgaggctctgccctt

SEQ ID NO: 1838238 - DNA, 13 bp, Homo sapiens
ttccattctggaa

SEQ ID NO: 1838239 - DNA, 20 bp, Homo sapiens
ttccattctggattttgtca

SEQ ID NO: 1838240 - DNA, 22 bp, Homo sapiens
ttcccagcagtggactcaaaac

SEQ ID NO: 1838241 - DNA, 13 bp, Homo sapiens
ttcccagcccagc

SEQ ID NO: 1838242 - DNA, 17 bp, Homo sapiens
ttcccagtggctgctgc

SEQ ID NO: 1838243 - DNA, 19 bp, Homo sapiens
ttcccagtggctgctgccc

SEQ ID NO: 1838244 - DNA, 21 bp, Homo sapiens
ttcccataccacccaatgctg

SEQ ID NO: 1838245 - DNA, 19 bp, Homo sapiens
ttcccatgacccaggctgg

SEQ ID NO: 1838246 - DNA, 15 bp, Homo sapiens
ttccccaggaggcca

SEQ ID NO: 1838247 - DNA, 16 bp, Homo sapiens
ttccccaggaggccag

SEQ ID NO: 1838248 - DNA, 19 bp, Homo sapiens
ttccccaggaggccagcct

SEQ ID NO: 1838249 - DNA, 23 bp, Homo sapiens
ttcccccttgaggattgtggaaa

SEQ ID NO: 1838250 - DNA, 11 bp, Homo sapiens
ttccctccctt

SEQ ID NO: 1838251 - DNA, 17 bp, Homo sapiens
ttccctcccttcctctt

SEQ ID NO: 1838252 - DNA, 17 bp, Homo sapiens
ttccctggcctttcata

SEQ ID NO: 1838253 - DNA, 14 bp, Homo sapiens
ttcccttcatctgg

SEQ ID NO: 1838254 - DNA, 16 bp, Homo sapiens
ttcccttcatctggaa

SEQ ID NO: 1838255 - DNA, 19 bp, Homo sapiens
ttccctttgacgccatccc

SEQ ID NO: 1838256 - DNA, 17 bp, Homo sapiens
ttcctagcacacacttt

SEQ ID NO: 1838257 - DNA, 13 bp, Homo sapiens
ttcctcattagca

SEQ ID NO: 1838258 - DNA, 12 bp, Homo sapiens
ttcctcatttgt

SEQ ID NO: 1838259 - DNA, 17 bp, Homo sapiens
ttcctcatttgttcatt

SEQ ID NO: 1838260 - DNA, 19 bp, Homo sapiens
ttcctccctccctctttcc

SEQ ID NO: 1838261 - DNA, 22 bp, Homo sapiens
ttcctccctccctctttccctc

SEQ ID NO: 1838262 - DNA, 22 bp, Homo sapiens
ttcctctttccatctaccctcc

SEQ ID NO: 1838263 - DNA, 22 bp, Homo sapiens
ttcctctttttatttagttcct

SEQ ID NO: 1838264 - DNA, 15 bp, Homo sapiens
ttcctgaggctgggc

SEQ ID NO: 1838265 - DNA, 15 bp, Homo sapiens
ttcctgatgcttctt

SEQ ID NO: 1838266 - DNA, 19 bp, Homo sapiens
ttcctgatgcttcttcaga

SEQ ID NO: 1838267 - DNA, 19 bp, Homo sapiens
ttcctggcactgcttccag

SEQ ID NO: 1838268 - DNA, 13 bp, Homo sapiens
ttccttgcctgca

SEQ ID NO: 1838269 - DNA, 16 bp, Homo sapiens
ttctaaaggagtttat

SEQ ID NO: 1838270 - DNA, 20 bp, Homo sapiens
ttctaattaataaattattt

SEQ ID NO: 1838271 - DNA, 21 bp, Homo sapiens
ttctaccctccatgtgagaat

SEQ ID NO: 1838272 - DNA, 21 bp, Homo sapiens
ttctagcccgaatacaaacac

SEQ ID NO: 1838273 - DNA, 21 bp, Homo sapiens
ttctcactgccatgccagctt

SEQ ID NO: 1838274 - DNA, 13 bp, Homo sapiens
ttctcagggtctc

SEQ ID NO: 1838275 - DNA, 17 bp, Homo sapiens
ttctcagggtctctgct

SEQ ID NO: 1838276 - DNA, 21 bp, Homo sapiens
ttctcagggtctctgctgccg

SEQ ID NO: 1838277 - DNA, 16 bp, Homo sapiens
ttctccaagcaggaca

SEQ ID NO: 1838278 - DNA, 17 bp, Homo sapiens
ttctccagtcattatgt

SEQ ID NO: 1838279 - DNA, 20 bp, Homo sapiens
ttctccctcatttcaggagc

SEQ ID NO: 1838280 - DNA, 13 bp, Homo sapiens
ttctctccagccc

SEQ ID NO: 1838281 - DNA, 18 bp, Homo sapiens
ttctctccagcccctgga

SEQ ID NO: 1838282 - DNA, 15 bp, Homo sapiens
ttctcttttcctttg

SEQ ID NO: 1838283 - DNA, 20 bp, Homo sapiens
ttctgacccatgctgccctg

SEQ ID NO: 1838284 - DNA, 20 bp, Homo sapiens
ttctgagggtccactactca

SEQ ID NO: 1838285 - DNA, 15 bp, Homo sapiens
ttctggcagaggagg

SEQ ID NO: 1838286 - DNA, 15 bp, Homo sapiens
ttctggctcttccag

SEQ ID NO: 1838287 - DNA, 16 bp, Homo sapiens
ttctggctcttccagg

SEQ ID NO: 1838288 - DNA, 15 bp, Homo sapiens
ttctgggatgtcaca

SEQ ID NO: 1838289 - DNA, 22 bp, Homo sapiens
ttctggttgatgcctgtgaact

SEQ ID NO: 1838290 - DNA, 18 bp, Homo sapiens
ttctgtattttgtttttg

SEQ ID NO: 1838291 - DNA, 17 bp, Homo sapiens
ttctgttttgtttcgct

SEQ ID NO: 1838292 - DNA, 20 bp, Homo sapiens
ttctgtttttctaggcctgg

SEQ ID NO: 1838293 - DNA, 15 bp, Homo sapiens
ttcttaaataataaa

SEQ ID NO: 1838294 - DNA, 12 bp, Homo sapiens
ttcttagctcaa

SEQ ID NO: 1838295 - DNA, 22 bp, Homo sapiens
ttcttcacctaagtctctgtga

SEQ ID NO: 1838296 - DNA, 13 bp, Homo sapiens
ttcttcccttttc

SEQ ID NO: 1838297 - DNA, 18 bp, Homo sapiens
ttcttgtattaagaatga

SEQ ID NO: 1838298 - DNA, 14 bp, Homo sapiens
ttctttcatttctt

SEQ ID NO: 1838299 - DNA, 15 bp, Homo sapiens
ttctttgttctgttt

SEQ ID NO: 1838300 - DNA, 14 bp, Homo sapiens
ttctttttgaaatg

SEQ ID NO: 1838301 - DNA, 16 bp, Homo sapiens
ttgaaaagttggaagg

SEQ ID NO: 1838302 - DNA, 17 bp, Homo sapiens
ttgaaatagtgtctgat

SEQ ID NO: 1838303 - DNA, 19 bp, Homo sapiens
ttgaacatgtgccttttct

SEQ ID NO: 1838304 - DNA, 22 bp, Homo sapiens
ttgaagattctatgttaatatt

SEQ ID NO: 1838305 - DNA, 13 bp, Homo sapiens
ttgaagcatttta

SEQ ID NO: 1838306 - DNA, 14 bp, Homo sapiens
ttgaagcattttat

SEQ ID NO: 1838307 - DNA, 15 bp, Homo sapiens
ttgaagcattttata

SEQ ID NO: 1838308 - DNA, 16 bp, Homo sapiens
ttgaagggcaagaaat

SEQ ID NO: 1838309 - DNA, 12 bp, Homo sapiens
ttgacctgaggc

SEQ ID NO: 1838310 - DNA, 19 bp, Homo sapiens
ttgacctgaggcccttctc

SEQ ID NO: 1838311 - DNA, 22 bp, Homo sapiens
ttgacctgaggcccttctctcc

SEQ ID NO: 1838312 - DNA, 21 bp, Homo sapiens
ttgacctgcctcccttcatgc

SEQ ID NO: 1838313 - DNA, 23 bp, Homo sapiens
ttgacctgcctcccttcatgcat

SEQ ID NO: 1838314 - DNA, 18 bp, Homo sapiens
ttgacgccatcccagccc

SEQ ID NO: 1838315 - DNA, 20 bp, Homo sapiens
ttgacgccatcccagcccca

SEQ ID NO: 1838316 - DNA, 14 bp, Homo sapiens
ttgagacctcagct

SEQ ID NO: 1838317 - DNA, 17 bp, Homo sapiens
ttgagagaccaggcaaa

SEQ ID NO: 1838318 - DNA, 18 bp, Homo sapiens
ttgaggattgtggaaaac

SEQ ID NO: 1838319 - DNA, 23 bp, Homo sapiens
aaaaacctgagatttattaaaga

SEQ ID NO: 1838320 - DNA, 16 bp, Homo sapiens
aaaaatgtattttatg

SEQ ID NO: 1838321 - DNA, 15 bp, Homo sapiens
aaaacctgagattta

SEQ ID NO: 1838322 - DNA, 22 bp, Homo sapiens
aaaacctgagatttattaaaga

SEQ ID NO: 1838323 - DNA, 20 bp, Homo sapiens
aaaactgctgactgttttct

SEQ ID NO: 1838324 - DNA, 21 bp, Homo sapiens
aaaagaggtttttcttaaata

SEQ ID NO: 1838325 - DNA, 12 bp, Homo sapiens
aaaagataaaca

SEQ ID NO: 1838326 - DNA, 17 bp, Homo sapiens
aaaagataaacacaaga

SEQ ID NO: 1838327 - DNA, 17 bp, Homo sapiens
aaaagatctttcatttt

SEQ ID NO: 1838328 - DNA, 18 bp, Homo sapiens
aaaagatctttcattttg

SEQ ID NO: 1838329 - DNA, 22 bp, Homo sapiens
aaaaggtatttattgagcacct

SEQ ID NO: 1838330 - DNA, 21 bp, Homo sapiens
aaaataaagaaaagatgcact

SEQ ID NO: 1838331 - DNA, 17 bp, Homo sapiens
aaaatagctcttgcttt

SEQ ID NO: 1838332 - DNA, 13 bp, Homo sapiens
aaaatcagaatgg

SEQ ID NO: 1838333 - DNA, 21 bp, Homo sapiens
aaaatcagaatggaatgctct

SEQ ID NO: 1838334 - DNA, 13 bp, Homo sapiens
aaaatcagcctgc

SEQ ID NO: 1838335 - DNA, 13 bp, Homo sapiens
aaaatgaaatgca

SEQ ID NO: 1838336 - DNA, 16 bp, Homo sapiens
aaaatgtattttatgt

SEQ ID NO: 1838337 - DNA, 13 bp, Homo sapiens
aaacaagaaaaat

SEQ ID NO: 1838338 - DNA, 18 bp, Homo sapiens
aaacaagaaaaataaaga

SEQ ID NO: 1838339 - DNA, 19 bp, Homo sapiens
aaacacaaacgggctcagc

SEQ ID NO: 1838340 - DNA, 21 bp, Homo sapiens
aaacacaagattggtgttttt

SEQ ID NO: 1838341 - DNA, 14 bp, Homo sapiens
aaacacccctctgt

SEQ ID NO: 1838342 - DNA, 15 bp, Homo sapiens
aaacaccctcacact

SEQ ID NO: 1838343 - DNA, 21 bp, Homo sapiens
aaacaggcagttggccagaga

SEQ ID NO: 1838344 - DNA, 18 bp, Homo sapiens
aaacatgcttttccaaac

SEQ ID NO: 1838345 - DNA, 18 bp, Homo sapiens
aaacattggttcttgtat

SEQ ID NO: 1838346 - DNA, 18 bp, Homo sapiens
aaaccaaatcactgaact

SEQ ID NO: 1838347 - DNA, 18 bp, Homo sapiens
aaacccagctctggtcca

SEQ ID NO: 1838348 - DNA, 17 bp, Homo sapiens
aaaccccatctctacaa

SEQ ID NO: 1838349 - DNA, 24 bp, Homo sapiens
aaaccctcgaggcggatctttgga

SEQ ID NO: 1838350 - DNA, 21 bp, Homo sapiens
aaacctgagatttattaaaga

SEQ ID NO: 1838351 - DNA, 23 bp, Homo sapiens
aaacctgagatttattaaagaaa

SEQ ID NO: 1838352 - DNA, 12 bp, Homo sapiens
aaacctgcctgg

SEQ ID NO: 1838353 - DNA, 16 bp, Homo sapiens
aaacctgcctgggttt

SEQ ID NO: 1838354 - DNA, 13 bp, Homo sapiens
aaacgaaaaacat

SEQ ID NO: 1838355 - DNA, 18 bp, Homo sapiens
aaactctcctctgctgct

SEQ ID NO: 1838356 - DNA, 13 bp, Homo sapiens
aaactgcttgttt

SEQ ID NO: 1838357 - DNA, 14 bp, Homo sapiens
aaactgcttgtttc

SEQ ID NO: 1838358 - DNA, 19 bp, Homo sapiens
aaactgcttgtttcctagc

SEQ ID NO: 1838359 - DNA, 11 bp, Homo sapiens
aaagaaaaaaa

SEQ ID NO: 1838360 - DNA, 17 bp, Homo sapiens
aaagaaaaaaatgtatt

SEQ ID NO: 1838361 - DNA, 15 bp, Homo sapiens
aaagacgttttataa

SEQ ID NO: 1838362 - DNA, 14 bp, Homo sapiens
aaagagatacagag

SEQ ID NO: 1838363 - DNA, 14 bp, Homo sapiens
aaagagtaggaaga

SEQ ID NO: 1838364 - DNA, 16 bp, Homo sapiens
aaagataaacacaaga

SEQ ID NO: 1838365 - DNA, 21 bp, Homo sapiens
aaagatgcactttgctttaat

SEQ ID NO: 1838366 - DNA, 22 bp, Homo sapiens
aaagatgcactttgctttaata

SEQ ID NO: 1838367 - DNA, 17 bp, Homo sapiens
aaagatgcttctcactg

SEQ ID NO: 1838368 - DNA, 22 bp, Homo sapiens
aaagcacaggtgggcttcccag

SEQ ID NO: 1838369 - DNA, 19 bp, Homo sapiens
aaagccaataacacacagc

SEQ ID NO: 1838370 - DNA, 16 bp, Homo sapiens
aaagcccattcattcc

SEQ ID NO: 1838371 - DNA, 23 bp, Homo sapiens
aaaggaaggttctggtgtgaact

SEQ ID NO: 1838372 - DNA, 20 bp, Homo sapiens
aaaggaataacctttctgga

SEQ ID NO: 1838373 - DNA, 21 bp, Homo sapiens
aaaggactcctgaaaaaaaac

SEQ ID NO: 1838374 - DNA, 17 bp, Homo sapiens
aaaggagagctagcagc

SEQ ID NO: 1838375 - DNA, 14 bp, Homo sapiens
aaaggccatggaga

SEQ ID NO: 1838376 - DNA, 15 bp, Homo sapiens
aaaggctccaggagc

SEQ ID NO: 1838377 - DNA, 16 bp, Homo sapiens
aaaggctccaggagca

SEQ ID NO: 1838378 - DNA, 19 bp, Homo sapiens
aaaggctccaggagcagcc

SEQ ID NO: 1838379 - DNA, 21 bp, Homo sapiens
aaaggctccaggagcagccac

SEQ ID NO: 1838380 - DNA, 21 bp, Homo sapiens
aaagggcatgggtcgggagag

SEQ ID NO: 1838381 - DNA, 20 bp, Homo sapiens
aaaggtttaaatgaacaaga

SEQ ID NO: 1838382 - DNA, 21 bp, Homo sapiens
aaaggtttaaatgaacaagag

SEQ ID NO: 1838383 - DNA, 13 bp, Homo sapiens
aaagtggaaaaat

SEQ ID NO: 1838384 - DNA, 18 bp, Homo sapiens
aaagttgcacggctgctg

SEQ ID NO: 1838385 - DNA, 19 bp, Homo sapiens
aaagttggaaggatctgct

SEQ ID NO: 1838386 - DNA, 13 bp, Homo sapiens
aaataaaattttt

SEQ ID NO: 1838387 - DNA, 15 bp, Homo sapiens
aaataaagaaaagat

SEQ ID NO: 1838388 - DNA, 11 bp, Homo sapiens
aaataaagtct

SEQ ID NO: 1838389 - DNA, 18 bp, Homo sapiens
aaataagggcagagtcac

SEQ ID NO: 1838390 - DNA, 22 bp, Homo sapiens
aaatacagtttgtcacatgaaa

SEQ ID NO: 1838391 - DNA, 14 bp, Homo sapiens
aaatactgtttgag

SEQ ID NO: 1838392 - DNA, 21 bp, Homo sapiens
aaatagctcttgctttgactt

SEQ ID NO: 1838393 - DNA, 16 bp, Homo sapiens
aaatagcttatgaaaa

SEQ ID NO: 1838394 - DNA, 10 bp, Homo sapiens
aaatataaag

SEQ ID NO: 1838395 - DNA, 16 bp, Homo sapiens
aaatatattattactt

SEQ ID NO: 1838396 - DNA, 23 bp, Homo sapiens
aaatatattattacttgtaaata

SEQ ID NO: 1838397 - DNA, 19 bp, Homo sapiens
aaatcagccgtgtaaccat

SEQ ID NO: 1838398 - DNA, 12 bp, Homo sapiens
aaatcagcctgc

SEQ ID NO: 1838399 - DNA, 20 bp, Homo sapiens
aaatcatctgcattcctgat

SEQ ID NO: 1838400 - DNA, 18 bp, Homo sapiens
aaatcccttacctcggtg

SEQ ID NO: 1838401 - DNA, 14 bp, Homo sapiens
aaatcgcttttgat

SEQ ID NO: 1838402 - DNA, 17 bp, Homo sapiens
aaatgccaaattaaaaa

SEQ ID NO: 1838403 - DNA, 14 bp, Homo sapiens
aaatgcccagcccc

SEQ ID NO: 1838404 - DNA, 14 bp, Homo sapiens
aaatgcctgccaaa

SEQ ID NO: 1838405 - DNA, 15 bp, Homo sapiens
aaatggaagacacat

SEQ ID NO: 1838406 - DNA, 18 bp, Homo sapiens
aaatggaagacacattga

SEQ ID NO: 1838407 - DNA, 21 bp, Homo sapiens
aaatggcgtctgctctggtgg

SEQ ID NO: 1838408 - DNA, 18 bp, Homo sapiens
aaatgggcagagcagaga

SEQ ID NO: 1838409 - DNA, 11 bp, Homo sapiens
aaatggttaaa

SEQ ID NO: 1838410 - DNA, 16 bp, Homo sapiens
aaatgtattttatgtt

SEQ ID NO: 1838411 - DNA, 21 bp, Homo sapiens
aaatgtattttatgttatata

SEQ ID NO: 1838412 - DNA, 12 bp, Homo sapiens
aaattaaaaaag

SEQ ID NO: 1838413 - DNA, 15 bp, Homo sapiens
aaattaaaaaagata

SEQ ID NO: 1838414 - DNA, 15 bp, Homo sapiens
aaattatttattatt

SEQ ID NO: 1838415 - DNA, 16 bp, Homo sapiens
aaattcccttcatctg

SEQ ID NO: 1838416 - DNA, 14 bp, Homo sapiens
aaattgcatttgtg

SEQ ID NO: 1838417 - DNA, 13 bp, Homo sapiens
aaattggaactct

SEQ ID NO: 1838418 - DNA, 12 bp, Homo sapiens
aacaacaattat

SEQ ID NO: 1838419 - DNA, 17 bp, Homo sapiens
aacaagagaagcattct

SEQ ID NO: 1838420 - DNA, 15 bp, Homo sapiens
aacaagttgaagaag

SEQ ID NO: 1838421 - DNA, 14 bp, Homo sapiens
aacaattgtgaagt

SEQ ID NO: 1838422 - DNA, 17 bp, Homo sapiens
actacagtcctcccatc

SEQ ID NO: 1838423 - DNA, 19 bp, Homo sapiens
actagagcacaacataatt

SEQ ID NO: 1838424 - DNA, 19 bp, Homo sapiens
actatttgcttatttaata

SEQ ID NO: 1838425 - DNA, 13 bp, Homo sapiens
actcaaaagctgg

SEQ ID NO: 1838426 - DNA, 19 bp, Homo sapiens
actcaaaccaaatcactga

SEQ ID NO: 1838427 - DNA, 17 bp, Homo sapiens
actcaaactcttaaaac

SEQ ID NO: 1838428 - DNA, 13 bp, Homo sapiens
actcaagaagcag

SEQ ID NO: 1838429 - DNA, 15 bp, Homo sapiens
actcaagaagcaggc

SEQ ID NO: 1838430 - DNA, 16 bp, Homo sapiens
actcaagaagcaggct

SEQ ID NO: 1838431 - DNA, 15 bp, Homo sapiens
actcaccatctgtgc

SEQ ID NO: 1838432 - DNA, 15 bp, Homo sapiens
actcaccccagcccc

SEQ ID NO: 1838433 - DNA, 12 bp, Homo sapiens
actcacctgggg

SEQ ID NO: 1838434 - DNA, 23 bp, Homo sapiens
actcacctggggctgctggcctg

SEQ ID NO: 1838435 - DNA, 12 bp, Homo sapiens
actcagccttgc

SEQ ID NO: 1838436 - DNA, 13 bp, Homo sapiens
actcagccttgca

SEQ ID NO: 1838437 - DNA, 15 bp, Homo sapiens
actcagctccccaga

SEQ ID NO: 1838438 - DNA, 19 bp, Homo sapiens
actcagctccccagagtcc

SEQ ID NO: 1838439 - DNA, 15 bp, Homo sapiens
actcattgacctgag

SEQ ID NO: 1838440 - DNA, 23 bp, Homo sapiens
actcccttcccatgacccaggct

SEQ ID NO: 1838441 - DNA, 13 bp, Homo sapiens
actcctaggcagg

SEQ ID NO: 1838442 - DNA, 16 bp, Homo sapiens
actcctcagggttgag

SEQ ID NO: 1838443 - DNA, 16 bp, Homo sapiens
actcctgaaaaaaaac

SEQ ID NO: 1838444 - DNA, 23 bp, Homo sapiens
actcctgcacacgctccttcctc

SEQ ID NO: 1838445 - DNA, 18 bp, Homo sapiens
actcctgcaggcagccag

SEQ ID NO: 1838446 - DNA, 18 bp, Homo sapiens
actccttgagagaccagg

SEQ ID NO: 1838447 - DNA, 21 bp, Homo sapiens
actctaccctcttagaaaaac

SEQ ID NO: 1838448 - DNA, 12 bp, Homo sapiens
actctcctctgc

SEQ ID NO: 1838449 - DNA, 22 bp, Homo sapiens
actctgacaacagacttctgaa

SEQ ID NO: 1838450 - DNA, 23 bp, Homo sapiens
actctgacaacagacttctgaaa

SEQ ID NO: 1838451 - DNA, 17 bp, Homo sapiens
actctggcagctcagag

SEQ ID NO: 1838452 - DNA, 19 bp, Homo sapiens
actctggcagctcagagag

SEQ ID NO: 1838453 - DNA, 11 bp, Homo sapiens
actcttaaaac

SEQ ID NO: 1838454 - DNA, 18 bp, Homo sapiens
actcttaaaacccaagtg

SEQ ID NO: 1838455 - DNA, 22 bp, Homo sapiens
actctttttttgagtgacagct

SEQ ID NO: 1838456 - DNA, 21 bp, Homo sapiens
actgaactttgctgagcctgt

SEQ ID NO: 1838457 - DNA, 15 bp, Homo sapiens
actgaaggggtgcac

SEQ ID NO: 1838458 - DNA, 21 bp, Homo sapiens
actgaatctcataattggaat

SEQ ID NO: 1838459 - DNA, 16 bp, Homo sapiens
actgagtgccttttgg

SEQ ID NO: 1838460 - DNA, 14 bp, Homo sapiens
actgcactccagcc

SEQ ID NO: 1838461 - DNA, 18 bp, Homo sapiens
actgcactccagcctggg

SEQ ID NO: 1838462 - DNA, 19 bp, Homo sapiens
actgcactccagcctgggt

SEQ ID NO: 1838463 - DNA, 14 bp, Homo sapiens
actgcagtgtggag

SEQ ID NO: 1838464 - DNA, 11 bp, Homo sapiens
actgcctttga

SEQ ID NO: 1838465 - DNA, 13 bp, Homo sapiens
actgcctttgacc

SEQ ID NO: 1838466 - DNA, 22 bp, Homo sapiens
actgcttccagtgaggctctgc

SEQ ID NO: 1838467 - DNA, 16 bp, Homo sapiens
actggcttaacttagt

SEQ ID NO: 1838468 - DNA, 21 bp, Homo sapiens
actgggctgaacactccaatt

SEQ ID NO: 1838469 - DNA, 18 bp, Homo sapiens
actgtgacaggcagcaga

SEQ ID NO: 1838470 - DNA, 18 bp, Homo sapiens
actgtgattcttagcaaa

SEQ ID NO: 1838471 - DNA, 23 bp, Homo sapiens
actgtgtacagtaaatggcttat

SEQ ID NO: 1838472 - DNA, 13 bp, Homo sapiens
actgttatttata

SEQ ID NO: 1838473 - DNA, 14 bp, Homo sapiens
actgttatttataa

SEQ ID NO: 1838474 - DNA, 13 bp, Homo sapiens
actgttcaagagc

SEQ ID NO: 1838475 - DNA, 17 bp, Homo sapiens
actgttcctgagccttc

SEQ ID NO: 1838476 - DNA, 14 bp, Homo sapiens
actgttctctgccc

SEQ ID NO: 1838477 - DNA, 16 bp, Homo sapiens
actgttctctgccctc

SEQ ID NO: 1838478 - DNA, 18 bp, Homo sapiens
acttagtatattattatt

SEQ ID NO: 1838479 - DNA, 17 bp, Homo sapiens
acttatttatgaacctg

SEQ ID NO: 1838480 - DNA, 18 bp, Homo sapiens
acttcaaactactttgct

SEQ ID NO: 1838481 - DNA, 21 bp, Homo sapiens
acttcaaactactttgctgct

SEQ ID NO: 1838482 - DNA, 11 bp, Homo sapiens
acttcagctga

SEQ ID NO: 1838483 - DNA, 22 bp, Homo sapiens
acttcgggaggtcgaggcagga

SEQ ID NO: 1838484 - DNA, 13 bp, Homo sapiens
acttcttcagagc

SEQ ID NO: 1838485 - DNA, 16 bp, Homo sapiens
acttctttgctttgcc

SEQ ID NO: 1838486 - DNA, 17 bp, Homo sapiens
acttggctacacaggga

SEQ ID NO: 1838487 - DNA, 23 bp, Homo sapiens
acttggggggctgaggtgggagg

SEQ ID NO: 1838488 - DNA, 15 bp, Homo sapiens
acttggttcttgtac

SEQ ID NO: 1838489 - DNA, 12 bp, Homo sapiens
acttgtaaatat

SEQ ID NO: 1838490 - DNA, 19 bp, Homo sapiens
acttgtaaatataaagacg

SEQ ID NO: 1838491 - DNA, 18 bp, Homo sapiens
acttgtattaaagacaga

SEQ ID NO: 1838492 - DNA, 19 bp, Homo sapiens
acttgtcaggagtgtgtgt

SEQ ID NO: 1838493 - DNA, 16 bp, Homo sapiens
acttgtttgtaagatt

SEQ ID NO: 1838494 - DNA, 15 bp, Homo sapiens
actttaaccctttct

SEQ ID NO: 1838495 - DNA, 21 bp, Homo sapiens
actttcctctttggtctacac

SEQ ID NO: 1838496 - DNA, 14 bp, Homo sapiens
actttgaagggcaa

SEQ ID NO: 1838497 - DNA, 13 bp, Homo sapiens
actttggaaagag

SEQ ID NO: 1838498 - DNA, 20 bp, Homo sapiens
actttgttctggctcttcca

SEQ ID NO: 1838499 - DNA, 23 bp, Homo sapiens
actttgttctggctcttccaggc

SEQ ID NO: 1838500 - DNA, 14 bp, Homo sapiens
agaaaaaaatgtat

SEQ ID NO: 1838501 - DNA, 17 bp, Homo sapiens
agaaaaaatattttccc

SEQ ID NO: 1838502 - DNA, 16 bp, Homo sapiens
agaaaaagatctttca

SEQ ID NO: 1838503 - DNA, 20 bp, Homo sapiens
agaaaaccagctcagcactg

SEQ ID NO: 1838504 - DNA, 12 bp, Homo sapiens
agaaaagatgca

SEQ ID NO: 1838505 - DNA, 15 bp, Homo sapiens
agaaaagatgcactt

SEQ ID NO: 1838506 - DNA, 19 bp, Homo sapiens
agaaacacccctctgtcta

SEQ ID NO: 1838507 - DNA, 22 bp, Homo sapiens
agaaacacccctctgtctagga

SEQ ID NO: 1838508 - DNA, 17 bp, Homo sapiens
agaaacaccctcacact

SEQ ID NO: 1838509 - DNA, 14 bp, Homo sapiens
agaaacattgaaga

SEQ ID NO: 1838510 - DNA, 12 bp, Homo sapiens
agaaactttatt

SEQ ID NO: 1838511 - DNA, 19 bp, Homo sapiens
agaaaggactcctgaaaaa

SEQ ID NO: 1838512 - DNA, 17 bp, Homo sapiens
agaaagttgcacggctg

SEQ ID NO: 1838513 - DNA, 20 bp, Homo sapiens
agaaatggcgtctgctctgg

SEQ ID NO: 1838514 - DNA, 22 bp, Homo sapiens
agaaatggcgtctgctctggtg

SEQ ID NO: 1838515 - DNA, 20 bp, Homo sapiens
agaacaaaggggcttaatta

SEQ ID NO: 1838516 - DNA, 23 bp, Homo sapiens
agaactcatccctaatgctgcag

SEQ ID NO: 1838517 - DNA, 17 bp, Homo sapiens
agaagatcctaaaacaa

SEQ ID NO: 1838518 - DNA, 12 bp, Homo sapiens
agaagcagctct

SEQ ID NO: 1838519 - DNA, 22 bp, Homo sapiens
agaagcattctcattggaaatt

SEQ ID NO: 1838520 - DNA, 21 bp, Homo sapiens
agaagcttaaaataaagttaa

SEQ ID NO: 1838521 - DNA, 14 bp, Homo sapiens
agaaggcaaatgac

SEQ ID NO: 1838522 - DNA, 15 bp, Homo sapiens
agaaggggaagcact

SEQ ID NO: 1838523 - DNA, 16 bp, Homo sapiens
agaaggggaagcactc

SEQ ID NO: 1838524 - DNA, 19 bp, Homo sapiens
agaagttgatatagaacag

SEQ ID NO: 1838525 - DNA, 20 bp, Homo sapiens
agaatgaaatactgtttgag

SEQ ID NO: 1838526 - DNA, 18 bp, Homo sapiens
agaattggctgaactcat

SEQ ID NO: 1838527 - DNA, 19 bp, Homo sapiens
agacaacgtgctctttgtt

SEQ ID NO: 1838528 - DNA, 21 bp, Homo sapiens
agacaacgtgctctttgtttt

SEQ ID NO: 1838529 - DNA, 22 bp, Homo sapiens
agacaagtgactgtatctgtgt

SEQ ID NO: 1838530 - DNA, 15 bp, Homo sapiens
agacacaacaactcc

SEQ ID NO: 1838531 - DNA, 16 bp, Homo sapiens
agacacatgtccaaga

SEQ ID NO: 1838532 - DNA, 24 bp, Homo sapiens
agacacatgtccaagaagcccagg

SEQ ID NO: 1838533 - DNA, 13 bp, Homo sapiens
agacaccaccacc

SEQ ID NO: 1838534 - DNA, 15 bp, Homo sapiens
agacaccaccaccct

SEQ ID NO: 1838535 - DNA, 17 bp, Homo sapiens
agacaccgttcattcag

SEQ ID NO: 1838536 - DNA, 15 bp, Homo sapiens
agacagcccgggctc

SEQ ID NO: 1838537 - DNA, 21 bp, Homo sapiens
agacagcccgggctctgcctc

SEQ ID NO: 1838538 - DNA, 12 bp, Homo sapiens
agacagctgcct

SEQ ID NO: 1838539 - DNA, 15 bp, Homo sapiens
agacagctgcctggg

SEQ ID NO: 1838540 - DNA, 16 bp, Homo sapiens
agacagctgcctggga

SEQ ID NO: 1838541 - DNA, 15 bp, Homo sapiens
agacaggaccaggga

SEQ ID NO: 1838542 - DNA, 17 bp, Homo sapiens
agacagtcaccccagga

SEQ ID NO: 1838543 - DNA, 16 bp, Homo sapiens
agacagtccctgccaa

SEQ ID NO: 1838544 - DNA, 17 bp, Homo sapiens
agacagtccctgccaat

SEQ ID NO: 1838545 - DNA, 16 bp, Homo sapiens
agaccaccacctcaga

SEQ ID NO: 1838546 - DNA, 13 bp, Homo sapiens
agaccatccctga

SEQ ID NO: 1838547 - DNA, 18 bp, Homo sapiens
agcatgtttagactttaa

SEQ ID NO: 1838548 - DNA, 23 bp, Homo sapiens
agcatgtttagactttaacataa

SEQ ID NO: 1838549 - DNA, 18 bp, Homo sapiens
agcattagctttaattaa

SEQ ID NO: 1838550 - DNA, 23 bp, Homo sapiens
agcattagctttaattaagctct

SEQ ID NO: 1838551 - DNA, 14 bp, Homo sapiens
agcattctcattgg

SEQ ID NO: 1838552 - DNA, 18 bp, Homo sapiens
agcattgtagtgctttga

SEQ ID NO: 1838553 - DNA, 22 bp, Homo sapiens
agcattgtagtgctttgagaga

SEQ ID NO: 1838554 - DNA, 14 bp, Homo sapiens
agcattttataaat

SEQ ID NO: 1838555 - DNA, 22 bp, Homo sapiens
agccaatatcccttactttaac

SEQ ID NO: 1838556 - DNA, 14 bp, Homo sapiens
agccacattcctga

SEQ ID NO: 1838557 - DNA, 19 bp, Homo sapiens
agccaccaacatactccca

SEQ ID NO: 1838558 - DNA, 20 bp, Homo sapiens
agccaccaacatactcccat

SEQ ID NO: 1838559 - DNA, 23 bp, Homo sapiens
agccaccaacatactcccatctg

SEQ ID NO: 1838560 - DNA, 15 bp, Homo sapiens
agccagctcatttca

SEQ ID NO: 1838561 - DNA, 22 bp, Homo sapiens
agccagctgtgttcacactgta

SEQ ID NO: 1838562 - DNA, 21 bp, Homo sapiens
agccaggccacaagacccttg

SEQ ID NO: 1838563 - DNA, 11 bp, Homo sapiens
agccagggctg

SEQ ID NO: 1838564 - DNA, 16 bp, Homo sapiens
agccagtaaacagagg

SEQ ID NO: 1838565 - DNA, 22 bp, Homo sapiens
agccatgtagaagctgcatctt

SEQ ID NO: 1838566 - DNA, 14 bp, Homo sapiens
agcccacgccccca

SEQ ID NO: 1838567 - DNA, 23 bp, Homo sapiens
agcccacgcccccactggtgaca

SEQ ID NO: 1838568 - DNA, 22 bp, Homo sapiens
agcccaggaaaggctccaggag

SEQ ID NO: 1838569 - DNA, 20 bp, Homo sapiens
agccccaaaactctcctctg

SEQ ID NO: 1838570 - DNA, 14 bp, Homo sapiens
agcccctgccattg

SEQ ID NO: 1838571 - DNA, 16 bp, Homo sapiens
agcccctgcccctcct

SEQ ID NO: 1838572 - DNA, 18 bp, Homo sapiens
agcccctggatgcagcct

SEQ ID NO: 1838573 - DNA, 14 bp, Homo sapiens
agccccttctgacc

SEQ ID NO: 1838574 - DNA, 20 bp, Homo sapiens
agccccttctgacccatgct

SEQ ID NO: 1838575 - DNA, 14 bp, Homo sapiens
agcccgaacaccat

SEQ ID NO: 1838576 - DNA, 14 bp, Homo sapiens
agcccgaatacaaa

SEQ ID NO: 1838577 - DNA, 14 bp, Homo sapiens
agcccgcagggcca

SEQ ID NO: 1838578 - DNA, 19 bp, Homo sapiens
agcccgcagggccatgcag

SEQ ID NO: 1838579 - DNA, 21 bp, Homo sapiens
agcccgcagggccatgcagac

SEQ ID NO: 1838580 - DNA, 13 bp, Homo sapiens
agcccgggctctg

SEQ ID NO: 1838581 - DNA, 16 bp, Homo sapiens
agcccgggctctgcct

SEQ ID NO: 1838582 - DNA, 21 bp, Homo sapiens
agccctggctgaaggactgtg

SEQ ID NO: 1838583 - DNA, 16 bp, Homo sapiens
agcctccagtccaagg

SEQ ID NO: 1838584 - DNA, 14 bp, Homo sapiens
agcctcctccagcc

SEQ ID NO: 1838585 - DNA, 19 bp, Homo sapiens
agcctctcccctgcctgcc

SEQ ID NO: 1838586 - DNA, 14 bp, Homo sapiens
agcctgctccagct

SEQ ID NO: 1838587 - DNA, 17 bp, Homo sapiens
agcctgctccagctgtt

SEQ ID NO: 1838588 - DNA, 19 bp, Homo sapiens
agcctggaacatcatcaag

SEQ ID NO: 1838589 - DNA, 20 bp, Homo sapiens
agcctggaacatcatcaagg

SEQ ID NO: 1838590 - DNA, 22 bp, Homo sapiens
agcctggctccaaaccctcgag

SEQ ID NO: 1838591 - DNA, 19 bp, Homo sapiens
agcctgggaaagcccctgc

SEQ ID NO: 1838592 - DNA, 12 bp, Homo sapiens
agcctgggaggt

SEQ ID NO: 1838593 - DNA, 18 bp, Homo sapiens
agcctgggcaatgtgata

SEQ ID NO: 1838594 - DNA, 15 bp, Homo sapiens
agcctggtgctgctg

SEQ ID NO: 1838595 - DNA, 16 bp, Homo sapiens
agccttccaggggtgg

SEQ ID NO: 1838596 - DNA, 18 bp, Homo sapiens
agccttccaggggtggga

SEQ ID NO: 1838597 - DNA, 18 bp, Homo sapiens
agccttgaccattctcca

SEQ ID NO: 1838598 - DNA, 19 bp, Homo sapiens
agccttgaccattctccac

SEQ ID NO: 1838599 - DNA, 18 bp, Homo sapiens
agccttgcaaatagccag

SEQ ID NO: 1838600 - DNA, 16 bp, Homo sapiens
agcgctggccgggacc

SEQ ID NO: 1838601 - DNA, 23 bp, Homo sapiens
agcggctggcagcccacccctca

SEQ ID NO: 1838602 - DNA, 18 bp, Homo sapiens
agcgtctttcttttttgg

SEQ ID NO: 1838603 - DNA, 16 bp, Homo sapiens
agcgtgagctgagcag

SEQ ID NO: 1838604 - DNA, 19 bp, Homo sapiens
agctacaattgtaaactag

SEQ ID NO: 1838605 - DNA, 17 bp, Homo sapiens
agctatttttctaacta

SEQ ID NO: 1838606 - DNA, 22 bp, Homo sapiens
agctcaaagcgtggacaggtgt

SEQ ID NO: 1838607 - DNA, 12 bp, Homo sapiens
agctcaatgagc

SEQ ID NO: 1838608 - DNA, 13 bp, Homo sapiens
agctcaatgagca

SEQ ID NO: 1838609 - DNA, 15 bp, Homo sapiens
agctcaatgagcatg

SEQ ID NO: 1838610 - DNA, 17 bp, Homo sapiens
agctcaatgagcatgtt

SEQ ID NO: 1838611 - DNA, 19 bp, Homo sapiens
agctcacctctcccttgga

SEQ ID NO: 1838612 - DNA, 13 bp, Homo sapiens
agctcagcactgc

SEQ ID NO: 1838613 - DNA, 23 bp, Homo sapiens
agctcagcactgcctgctcccat

SEQ ID NO: 1838614 - DNA, 12 bp, Homo sapiens
agctcagggcct

SEQ ID NO: 1838615 - DNA, 15 bp, Homo sapiens
agctcagggcctggc

SEQ ID NO: 1838616 - DNA, 16 bp, Homo sapiens
agctccaagctcccag

SEQ ID NO: 1838617 - DNA, 20 bp, Homo sapiens
agctcccaagggatggtgcc

SEQ ID NO: 1838618 - DNA, 22 bp, Homo sapiens
agctcccaagggatggtgccct

SEQ ID NO: 1838619 - DNA, 17 bp, Homo sapiens
agctgaatgtttttcta

SEQ ID NO: 1838620 - DNA, 19 bp, Homo sapiens
agctgacacaaacctgcct

SEQ ID NO: 1838621 - DNA, 20 bp, Homo sapiens
agctgacacaaacctgcctg

SEQ ID NO: 1838622 - DNA, 23 bp, Homo sapiens
agctgacacaaacctgcctgggt

SEQ ID NO: 1838623 - DNA, 21 bp, Homo sapiens
agctgacttttctgtccgagc

SEQ ID NO: 1838624 - DNA, 23 bp, Homo sapiens
agctgagatgaaccctggcattt

SEQ ID NO: 1838625 - DNA, 13 bp, Homo sapiens
agctgcaccctca

SEQ ID NO: 1838626 - DNA, 18 bp, Homo sapiens
agctgcaccctcaggcag

SEQ ID NO: 1838627 - DNA, 13 bp, Homo sapiens
agctgcctgggat

SEQ ID NO: 1838628 - DNA, 21 bp, Homo sapiens
agctgcctgggatccctcatc

SEQ ID NO: 1838629 - DNA, 12 bp, Homo sapiens
agctgctcccca

SEQ ID NO: 1838630 - DNA, 16 bp, Homo sapiens
agctgctccccaggcc

SEQ ID NO: 1838631 - DNA, 15 bp, Homo sapiens
agctggagcctggtg

SEQ ID NO: 1838632 - DNA, 17 bp, Homo sapiens
agctggagcctggtgcc

SEQ ID NO: 1838633 - DNA, 23 bp, Homo sapiens
agctggcggctggggtcccagca

SEQ ID NO: 1838634 - DNA, 22 bp, Homo sapiens
agctgggatcacatgtggactt

SEQ ID NO: 1838635 - DNA, 19 bp, Homo sapiens
agctgggtggcactgccat

SEQ ID NO: 1838636 - DNA, 19 bp, Homo sapiens
agctggtcccctctatata

SEQ ID NO: 1838637 - DNA, 18 bp, Homo sapiens
agctggtgagtgatgcgg

SEQ ID NO: 1838638 - DNA, 16 bp, Homo sapiens
agctggttgaggtttc

SEQ ID NO: 1838639 - DNA, 22 bp, Homo sapiens
agctgtgtctgccaaacacatt

SEQ ID NO: 1838640 - DNA, 14 bp, Homo sapiens
agctgttcagctgg

SEQ ID NO: 1838641 - DNA, 15 bp, Homo sapiens
agcttatgaaaagaa

SEQ ID NO: 1838642 - DNA, 16 bp, Homo sapiens
agcttatgaaaagaat

SEQ ID NO: 1838643 - DNA, 21 bp, Homo sapiens
agcttgaaatagtgtctgatg

SEQ ID NO: 1838644 - DNA, 14 bp, Homo sapiens
agcttgctccagat

SEQ ID NO: 1838645 - DNA, 19 bp, Homo sapiens
agcttgctccagattctga

SEQ ID NO: 1838646 - DNA, 22 bp, Homo sapiens
agctttccccatgtctcgactc

SEQ ID NO: 1838647 - DNA, 18 bp, Homo sapiens
agctttgaaaattcagtg

SEQ ID NO: 1838648 - DNA, 15 bp, Homo sapiens
aggaaaagggagcta

SEQ ID NO: 1838649 - DNA, 16 bp, Homo sapiens
aggaaaagggagctat

SEQ ID NO: 1838650 - DNA, 16 bp, Homo sapiens
aggaaaccacagctgc

SEQ ID NO: 1838651 - DNA, 17 bp, Homo sapiens
aggaaacccagctctgg

SEQ ID NO: 1838652 - DNA, 21 bp, Homo sapiens
aggaaacccagctctggtcca

SEQ ID NO: 1838653 - DNA, 13 bp, Homo sapiens
aggaaaggctcca

SEQ ID NO: 1838654 - DNA, 18 bp, Homo sapiens
aggaaaggctccaggagc

SEQ ID NO: 1838655 - DNA, 22 bp, Homo sapiens
aggaaaggctccaggagcagcc

SEQ ID NO: 1838656 - DNA, 13 bp, Homo sapiens
aggaagactttgg

SEQ ID NO: 1838657 - DNA, 20 bp, Homo sapiens
aggaagaggggaagcagaaa

SEQ ID NO: 1838658 - DNA, 17 bp, Homo sapiens
aggaagctcagggcctg

SEQ ID NO: 1838659 - DNA, 19 bp, Homo sapiens
aggaaggaaacccagctct

SEQ ID NO: 1838660 - DNA, 15 bp, Homo sapiens
aggaaggagaggaga

SEQ ID NO: 1838661 - DNA, 16 bp, Homo sapiens
aggaatccactcccag

SEQ ID NO: 1838662 - DNA, 23 bp, Homo sapiens
aggacacagatgaaacacaaaca

SEQ ID NO: 1838663 - DNA, 18 bp, Homo sapiens
aggacacgggcctgtcca

SEQ ID NO: 1838664 - DNA, 17 bp, Homo sapiens
aggacagcccctcctcc

SEQ ID NO: 1838665 - DNA, 13 bp, Homo sapiens
aggacatgaaact

SEQ ID NO: 1838666 - DNA, 13 bp, Homo sapiens
aggaccaggcaat

SEQ ID NO: 1838667 - DNA, 14 bp, Homo sapiens
aggacctcaggtga

SEQ ID NO: 1838668 - DNA, 18 bp, Homo sapiens
aggactcagctccccaga

SEQ ID NO: 1838669 - DNA, 19 bp, Homo sapiens
aggactcagctccccagag

SEQ ID NO: 1838670 - DNA, 17 bp, Homo sapiens
aggactcctgaaaaaaa

SEQ ID NO: 1838671 - DNA, 16 bp, Homo sapiens
aggactgcagagggct

SEQ ID NO: 1838672 - DNA, 13 bp, Homo sapiens
aggactgcagtgt

SEQ ID NO: 1838673 - DNA, 15 bp, Homo sapiens
aggactgcagtgtgg

SEQ ID NO: 1838674 - DNA, 22 bp, Homo sapiens
aggactgtgacaggcagcagag

SEQ ID NO: 1838675 - DNA, 23 bp, Homo sapiens
aggagaagtcttctatttattta

SEQ ID NO: 1838676 - DNA, 11 bp, Homo sapiens
aggagacacaa

SEQ ID NO: 1838677 - DNA, 21 bp, Homo sapiens
aggagacctggcactggatgc

SEQ ID NO: 1838678 - DNA, 15 bp, Homo sapiens
aggagagctagcagc

SEQ ID NO: 1838679 - DNA, 14 bp, Homo sapiens
aggagaggggcaca

SEQ ID NO: 1838680 - DNA, 16 bp, Homo sapiens
aggagaggggcacagg

SEQ ID NO: 1838681 - DNA, 18 bp, Homo sapiens
aggagaggggcacagggt

SEQ ID NO: 1838682 - DNA, 14 bp, Homo sapiens
aggagataagaaag

SEQ ID NO: 1838683 - DNA, 16 bp, Homo sapiens
aggagcaaaggctgag

SEQ ID NO: 1838684 - DNA, 15 bp, Homo sapiens
aggagcacggctctg

SEQ ID NO: 1838685 - DNA, 16 bp, Homo sapiens
aggagcacggctctgt

SEQ ID NO: 1838686 - DNA, 16 bp, Homo sapiens
aggagcagtgcaggca

SEQ ID NO: 1838687 - DNA, 20 bp, Homo sapiens
aggaggcccttgtcgtggga

SEQ ID NO: 1838688 - DNA, 23 bp, Homo sapiens
aggaggcccttgtcgtgggatgg

SEQ ID NO: 1838689 - DNA, 21 bp, Homo sapiens
aggagggagcatcagtgccct

SEQ ID NO: 1838690 - DNA, 20 bp, Homo sapiens
aggaggtggagaaaattgga

SEQ ID NO: 1838691 - DNA, 16 bp, Homo sapiens
aggagtgtggccacgt

SEQ ID NO: 1838692 - DNA, 14 bp, Homo sapiens
aggagtttatgttc

SEQ ID NO: 1838693 - DNA, 15 bp, Homo sapiens
aggatccctctctgg

SEQ ID NO: 1838694 - DNA, 17 bp, Homo sapiens
aggatccctctctggat

SEQ ID NO: 1838695 - DNA, 19 bp, Homo sapiens
aggatctcttgagcctggg

SEQ ID NO: 1838696 - DNA, 12 bp, Homo sapiens
aggatctgctga

SEQ ID NO: 1838697 - DNA, 16 bp, Homo sapiens
aggatctgctgaggcc

SEQ ID NO: 1838698 - DNA, 18 bp, Homo sapiens
aggatctgctgaggccca

SEQ ID NO: 1838699 - DNA, 19 bp, Homo sapiens
aggatctgctgaggcccag

SEQ ID NO: 1838700 - DNA, 17 bp, Homo sapiens
aggatggcctggccagg

SEQ ID NO: 1838701 - DNA, 22 bp, Homo sapiens
aggatggcctggccagggcctg

SEQ ID NO: 1838702 - DNA, 22 bp, Homo sapiens
aggatgtacaaggacagcccct

SEQ ID NO: 1838703 - DNA, 12 bp, Homo sapiens
aggattcttcct

SEQ ID NO: 1838704 - DNA, 13 bp, Homo sapiens
aggattgtggaaa

SEQ ID NO: 1838705 - DNA, 19 bp, Homo sapiens
aggattgtggaaaaccagg

SEQ ID NO: 1838706 - DNA, 11 bp, Homo sapiens
aggattttatg

SEQ ID NO: 1838707 - DNA, 15 bp, Homo sapiens
aggattttatgcttt

SEQ ID NO: 1838708 - DNA, 14 bp, Homo sapiens
aggcaaatgcccaa

SEQ ID NO: 1838709 - DNA, 15 bp, Homo sapiens
aggcaaatgcccaag

SEQ ID NO: 1838710 - DNA, 16 bp, Homo sapiens
aggcagcaccacactg

SEQ ID NO: 1838711 - DNA, 15 bp, Homo sapiens
aggcagccaggccac

SEQ ID NO: 1838712 - DNA, 18 bp, Homo sapiens
aggcagccaggccacaag

SEQ ID NO: 1838713 - DNA, 22 bp, Homo sapiens
aggcataaagtcaggggttccc

SEQ ID NO: 1838714 - DNA, 19 bp, Homo sapiens
aggcattccccaggaggcc

SEQ ID NO: 1838715 - DNA, 21 bp, Homo sapiens
aggcattccccaggaggccag

SEQ ID NO: 1838716 - DNA, 22 bp, Homo sapiens
aggcattccccaggaggccagc

SEQ ID NO: 1838717 - DNA, 23 bp, Homo sapiens
aggccacgtgatgtggagggcac

SEQ ID NO: 1838718 - DNA, 15 bp, Homo sapiens
aggccagccttgacc

SEQ ID NO: 1838719 - DNA, 19 bp, Homo sapiens
aggccaggccctctgccca

SEQ ID NO: 1838720 - DNA, 23 bp, Homo sapiens
aggccaggccctctgcccactcc

SEQ ID NO: 1838721 - DNA, 18 bp, Homo sapiens
aggccatggagagctgga

SEQ ID NO: 1838722 - DNA, 16 bp, Homo sapiens
aggccccgcccaggct

SEQ ID NO: 1838723 - DNA, 17 bp, Homo sapiens
aggccccgcccaggctt

SEQ ID NO: 1838724 - DNA, 16 bp, Homo sapiens
aggcccctctcctccg

SEQ ID NO: 1838725 - DNA, 20 bp, Homo sapiens
aggccctctgcccactccct

SEQ ID NO: 1838726 - DNA, 22 bp, Homo sapiens
aggccctctgcccactccctgc

SEQ ID NO: 1838727 - DNA, 15 bp, Homo sapiens
aggcccttctctcca

SEQ ID NO: 1838728 - DNA, 19 bp, Homo sapiens
aggcccttctctccagccc

SEQ ID NO: 1838729 - DNA, 20 bp, Homo sapiens
aggcccttctctccagcccc

SEQ ID NO: 1838730 - DNA, 21 bp, Homo sapiens
aggcccttctctccagcccct

SEQ ID NO: 1838731 - DNA, 17 bp, Homo sapiens
aggcccttgtcgtggga

SEQ ID NO: 1838732 - DNA, 12 bp, Homo sapiens
aggcctggggac

SEQ ID NO: 1838733 - DNA, 16 bp, Homo sapiens
aggcgtggagctgcct

SEQ ID NO: 1838734 - DNA, 18 bp, Homo sapiens
aggctaaggcgtggagct

SEQ ID NO: 1838735 - DNA, 14 bp, Homo sapiens
aggctactacagag

SEQ ID NO: 1838736 - DNA, 21 bp, Homo sapiens
aggctactacagagaaggctg

SEQ ID NO: 1838737 - DNA, 23 bp, Homo sapiens
aggctagtgtggtgtttcctggc

SEQ ID NO: 1838738 - DNA, 14 bp, Homo sapiens
aggctccaggagca

SEQ ID NO: 1838739 - DNA, 23 bp, Homo sapiens
aggctccaggagcagccacattc

SEQ ID NO: 1838740 - DNA, 12 bp, Homo sapiens
aggctcgagcat

SEQ ID NO: 1838741 - DNA, 17 bp, Homo sapiens
aggctcgagcatgcctg

SEQ ID NO: 1838742 - DNA, 18 bp, Homo sapiens
aggctcgagcatgcctgg

SEQ ID NO: 1838743 - DNA, 11 bp, Homo sapiens
aggctctgccc

SEQ ID NO: 1838744 - DNA, 13 bp, Homo sapiens
aggctctgccctt

SEQ ID NO: 1838745 - DNA, 12 bp, Homo sapiens
aggctgatttat

SEQ ID NO: 1838746 - DNA, 22 bp, Homo sapiens
aggctgatttatggtcagaatt

SEQ ID NO: 1838747 - DNA, 17 bp, Homo sapiens
aggctgcagtgagccga

SEQ ID NO: 1838748 - DNA, 19 bp, Homo sapiens
aggctgcagtgagccgaga

SEQ ID NO: 1838749 - DNA, 16 bp, Homo sapiens
aggctgggagagcctt

SEQ ID NO: 1838750 - DNA, 19 bp, Homo sapiens
aggctgggagagccttcca

SEQ ID NO: 1838751 - DNA, 21 bp, Homo sapiens
aggctgggctcccttcccacc

SEQ ID NO: 1838752 - DNA, 17 bp, Homo sapiens
aggctgggttctgatcc

SEQ ID NO: 1838753 - DNA, 24 bp, Homo sapiens
aggctgtgctccctggttctgatg

SEQ ID NO: 1838754 - DNA, 19 bp, Homo sapiens
aggcttagctttgctctgc

SEQ ID NO: 1838755 - DNA, 18 bp, Homo sapiens
aggcttagtcactgagac

SEQ ID NO: 1838756 - DNA, 23 bp, Homo sapiens
aggcttagtcactgagacagccc

SEQ ID NO: 1838757 - DNA, 19 bp, Homo sapiens
aggcttggggaaaatggcc

SEQ ID NO: 1838758 - DNA, 22 bp, Homo sapiens
aggcttggggaaaatggccatg

SEQ ID NO: 1838759 - DNA, 18 bp, Homo sapiens
agggaaaacattccatcc

SEQ ID NO: 1838760 - DNA, 19 bp, Homo sapiens
agggaaagaaaaggaaggc

SEQ ID NO: 1838761 - DNA, 12 bp, Homo sapiens
agggacagaggg

SEQ ID NO: 1838762 - DNA, 22 bp, Homo sapiens
agggacagagggggtggcctcc

SEQ ID NO: 1838763 - DNA, 19 bp, Homo sapiens
agggacatgcttagcagtc

SEQ ID NO: 1838764 - DNA, 17 bp, Homo sapiens
agggagggagggctcca

SEQ ID NO: 1838765 - DNA, 12 bp, Homo sapiens
agggagggctcc

SEQ ID NO: 1838766 - DNA, 14 bp, Homo sapiens
agggagggctccag

SEQ ID NO: 1838767 - DNA, 19 bp, Homo sapiens
agggagggctccagacaca

SEQ ID NO: 1838768 - DNA, 22 bp, Homo sapiens
agggagggctccagacacatgt

SEQ ID NO: 1838769 - DNA, 22 bp, Homo sapiens
agggcaggcttggggaaaatgg

SEQ ID NO: 1838770 - DNA, 19 bp, Homo sapiens
agggcatgaagctgcatat

SEQ ID NO: 1838771 - DNA, 20 bp, Homo sapiens
agggcatgggtcgggagagg

SEQ ID NO: 1838772 - DNA, 16 bp, Homo sapiens
agggcattcaaatggg

SEQ ID NO: 1838773 - DNA, 14 bp, Homo sapiens
agggcctgcaaggg

SEQ ID NO: 1838774 - DNA, 19 bp, Homo sapiens
agggcctggaagacagaga

SEQ ID NO: 1838775 - DNA, 14 bp, Homo sapiens
agggcctggctcag

SEQ ID NO: 1838776 - DNA, 22 bp, Homo sapiens
agggcgttctaggtaggaagag

SEQ ID NO: 1838777 - DNA, 17 bp, Homo sapiens
agggctccagagtggag

SEQ ID NO: 1838778 - DNA, 22 bp, Homo sapiens
aggggaaaatcagcctgctcca

SEQ ID NO: 1838779 - DNA, 17 bp, Homo sapiens
aggggaagcactcgtgt

SEQ ID NO: 1838780 - DNA, 16 bp, Homo sapiens
aggggacgcaggcccc

SEQ ID NO: 1838781 - DNA, 22 bp, Homo sapiens
aggggacgcaggcccctctcct

SEQ ID NO: 1838782 - DNA, 15 bp, Homo sapiens
aggggcacagggtct

SEQ ID NO: 1838783 - DNA, 21 bp, Homo sapiens
aggggcttaattattgatgtt

SEQ ID NO: 1838784 - DNA, 15 bp, Homo sapiens
agggggtggcctccc

SEQ ID NO: 1838785 - DNA, 17 bp, Homo sapiens
agggggtggcctcccaa

SEQ ID NO: 1838786 - DNA, 20 bp, Homo sapiens
aggggtgggacaccctgtga

SEQ ID NO: 1838787 - DNA, 11 bp, Homo sapiens
agggtccctgg

SEQ ID NO: 1838788 - DNA, 14 bp, Homo sapiens
agggtccctggtgg

SEQ ID NO: 1838789 - DNA, 13 bp, Homo sapiens
agggtctctgctg

SEQ ID NO: 1838790 - DNA, 14 bp, Homo sapiens
agggtctctgctgc

SEQ ID NO: 1838791 - DNA, 15 bp, Homo sapiens
agggtctctgctgcc

SEQ ID NO: 1838792 - DNA, 15 bp, Homo sapiens
agggtgggagtgggc

SEQ ID NO: 1838793 - DNA, 22 bp, Homo sapiens
agggtgtccggtccctgtccca

SEQ ID NO: 1838794 - DNA, 23 bp, Homo sapiens
agggtgtgatttaggtcagtaga

SEQ ID NO: 1838795 - DNA, 19 bp, Homo sapiens
atgagcatcaggccaggcc

SEQ ID NO: 1838796 - DNA, 20 bp, Homo sapiens
atgagcatcaggccaggccc

SEQ ID NO: 1838797 - DNA, 21 bp, Homo sapiens
atgagcatcaggccaggccct

SEQ ID NO: 1838798 - DNA, 22 bp, Homo sapiens
atgagcatcaggccaggccctc

SEQ ID NO: 1838799 - DNA, 17 bp, Homo sapiens
atgagcatggagctggc

SEQ ID NO: 1838800 - DNA, 18 bp, Homo sapiens
atgagcatggagctggcc

SEQ ID NO: 1838801 - DNA, 12 bp, Homo sapiens
atgagcctggca

SEQ ID NO: 1838802 - DNA, 19 bp, Homo sapiens
ataatacagtatctcaggg

SEQ ID NO: 1838803 - DNA, 18 bp, Homo sapiens
ataatagcacatgatttg

SEQ ID NO: 1838804 - DNA, 19 bp, Homo sapiens
ataatcacttttttccaca

SEQ ID NO: 1838805 - DNA, 15 bp, Homo sapiens
ataatgctaatttta

SEQ ID NO: 1838806 - DNA, 16 bp, Homo sapiens
ataatgtagttttgtg

SEQ ID NO: 1838807 - DNA, 11 bp, Homo sapiens
atacccacccc

SEQ ID NO: 1838808 - DNA, 15 bp, Homo sapiens
atacctaattgtgga

SEQ ID NO: 1838809 - DNA, 17 bp, Homo sapiens
atacctacatgtatttg

SEQ ID NO: 1838810 - DNA, 15 bp, Homo sapiens
atacctttgccttgg

SEQ ID NO: 1838811 - DNA, 11 bp, Homo sapiens
atactcccatc

SEQ ID NO: 1838812 - DNA, 17 bp, Homo sapiens
atactgattgggaggtg

SEQ ID NO: 1838813 - DNA, 18 bp, Homo sapiens
atactgccttgtttaatg

SEQ ID NO: 1838814 - DNA, 16 bp, Homo sapiens
atactgggggcaaaat

SEQ ID NO: 1838815 - DNA, 14 bp, Homo sapiens
atagcacagaccct

SEQ ID NO: 1838816 - DNA, 15 bp, Homo sapiens
atagcacagaccctg

SEQ ID NO: 1838817 - DNA, 12 bp, Homo sapiens
atagctcataag

SEQ ID NO: 1838818 - DNA, 23 bp, Homo sapiens
atagctccccgcttctgcctgca

SEQ ID NO: 1838819 - DNA, 12 bp, Homo sapiens
atagctcttgct

SEQ ID NO: 1838820 - DNA, 20 bp, Homo sapiens
atataaagacgttttataag

SEQ ID NO: 1838821 - DNA, 22 bp, Homo sapiens
atataaagacgttttataagca

SEQ ID NO: 1838822 - DNA, 18 bp, Homo sapiens
atataactattgcccagg

SEQ ID NO: 1838823 - DNA, 17 bp, Homo sapiens
atatccaattttaaaat

SEQ ID NO: 1838824 - DNA, 20 bp, Homo sapiens
atatggactcagccttgcaa

SEQ ID NO: 1838825 - DNA, 16 bp, Homo sapiens
atatgtagaaggcaca

SEQ ID NO: 1838826 - DNA, 19 bp, Homo sapiens
atattaacaaattgcattt

SEQ ID NO: 1838827 - DNA, 22 bp, Homo sapiens
atattaacaaattgcatttgtg

SEQ ID NO: 1838828 - DNA, 19 bp, Homo sapiens
atattattacttgtaaata

SEQ ID NO: 1838829 - DNA, 13 bp, Homo sapiens
atattcaggaagc

SEQ ID NO: 1838830 - DNA, 19 bp, Homo sapiens
atattcaggaagctcaggg

SEQ ID NO: 1838831 - DNA, 17 bp, Homo sapiens
atattcattctttttga

SEQ ID NO: 1838832 - DNA, 21 bp, Homo sapiens
atatttccctcccctggggac

SEQ ID NO: 1838833 - DNA, 23 bp, Homo sapiens
atatttctgaggagcctgcaaca

SEQ ID NO: 1838834 - DNA, 13 bp, Homo sapiens
atattttcctcct

SEQ ID NO: 1838835 - DNA, 19 bp, Homo sapiens
atcaactgggctgaacact

SEQ ID NO: 1838836 - DNA, 14 bp, Homo sapiens
atcaagcagccaag

SEQ ID NO: 1838837 - DNA, 18 bp, Homo sapiens
atcaagctgtacatttgg

SEQ ID NO: 1838838 - DNA, 14 bp, Homo sapiens
atcaaggcactgcc

SEQ ID NO: 1838839 - DNA, 18 bp, Homo sapiens
atcaatgataatgctaat

SEQ ID NO: 1838840 - DNA, 21 bp, Homo sapiens
atcacagcctctgaaaaccaa

SEQ ID NO: 1838841 - DNA, 22 bp, Homo sapiens
atcacagttttggttgctttaa

SEQ ID NO: 1838842 - DNA, 15 bp, Homo sapiens
atcacatgtggactt

SEQ ID NO: 1838843 - DNA, 18 bp, Homo sapiens
atcaccaacgtctgtgcc

SEQ ID NO: 1838844 - DNA, 19 bp, Homo sapiens
atcaccaacgtctgtgcca

SEQ ID NO: 1838845 - DNA, 21 bp, Homo sapiens
atcacctagctgaatgttttt

SEQ ID NO: 1838846 - DNA, 18 bp, Homo sapiens
atcacttctgagaactca

SEQ ID NO: 1838847 - DNA, 23 bp, Homo sapiens
atcagcaacaaccagcatccctt

SEQ ID NO: 1838848 - DNA, 17 bp, Homo sapiens
atcagcctgctccagct

SEQ ID NO: 1838849 - DNA, 18 bp, Homo sapiens
atcagcctgctccagctg

SEQ ID NO: 1838850 - DNA, 19 bp, Homo sapiens
atcagcctgctccagctgt

SEQ ID NO: 1838851 - DNA, 20 bp, Homo sapiens
atcagcctgctccagctgtt

SEQ ID NO: 1838852 - DNA, 20 bp, Homo sapiens
atcagcctgggcaatgtgat

SEQ ID NO: 1838853 - DNA, 21 bp, Homo sapiens
atcagcctgggcaatgtgata

SEQ ID NO: 1838854 - DNA, 16 bp, Homo sapiens
atcagctacaattgta

SEQ ID NO: 1838855 - DNA, 13 bp, Homo sapiens
atcaggccaggcc

SEQ ID NO: 1838856 - DNA, 16 bp, Homo sapiens
atcaggccaggccctc

SEQ ID NO: 1838857 - DNA, 15 bp, Homo sapiens
atcagtattgaagca

SEQ ID NO: 1838858 - DNA, 22 bp, Homo sapiens
atcagtattgaagcattttata

SEQ ID NO: 1838859 - DNA, 17 bp, Homo sapiens
atcatcagtattgaagc

SEQ ID NO: 1838860 - DNA, 17 bp, Homo sapiens
atcatctgcattcctga

SEQ ID NO: 1838861 - DNA, 15 bp, Homo sapiens
atcattatttatgta

SEQ ID NO: 1838862 - DNA, 21 bp, Homo sapiens
atccaattttaaaatgaaatg

SEQ ID NO: 1838863 - DNA, 14 bp, Homo sapiens
atccagctggtgag

SEQ ID NO: 1838864 - DNA, 19 bp, Homo sapiens
atccagggctctgaccagt

SEQ ID NO: 1838865 - DNA, 15 bp, Homo sapiens
atcccacatatttca

SEQ ID NO: 1838866 - DNA, 12 bp, Homo sapiens
atcccagcccca

SEQ ID NO: 1838867 - DNA, 23 bp, Homo sapiens
atcccaggatcgcaagagccatg

SEQ ID NO: 1838868 - DNA, 15 bp, Homo sapiens
atcccatttaaaaaa

SEQ ID NO: 1838869 - DNA, 13 bp, Homo sapiens
atccctcatcctc

SEQ ID NO: 1838870 - DNA, 14 bp, Homo sapiens
atccctcatcctca

SEQ ID NO: 1838871 - DNA, 16 bp, Homo sapiens
atccctctctggattg

SEQ ID NO: 1838872 - DNA, 21 bp, Homo sapiens
atcccttggacattttatgtc

SEQ ID NO: 1838873 - DNA, 21 bp, Homo sapiens
atcctaggcatttgctgaata

SEQ ID NO: 1838874 - DNA, 13 bp, Homo sapiens
atcctagttccac

SEQ ID NO: 1838875 - DNA, 16 bp, Homo sapiens
atcctcaaacactgca

SEQ ID NO: 1838876 - DNA, 17 bp, Homo sapiens
atcctcaaacactgcag

SEQ ID NO: 1838877 - DNA, 21 bp, Homo sapiens
atcctcaaacactgcaggcat

SEQ ID NO: 1838878 - DNA, 17 bp, Homo sapiens
atcctcatacccacccc

SEQ ID NO: 1838879 - DNA, 22 bp, Homo sapiens
atcctcatacccacccccaccc

SEQ ID NO: 1838880 - DNA, 14 bp, Homo sapiens
atcctccaggtgca

SEQ ID NO: 1838881 - DNA, 19 bp, Homo sapiens
atcctccaggtgcacaagc

SEQ ID NO: 1838882 - DNA, 12 bp, Homo sapiens
atcctcccaggc

SEQ ID NO: 1838883 - DNA, 17 bp, Homo sapiens
atcctctgtacagagcc

SEQ ID NO: 1838884 - DNA, 18 bp, Homo sapiens
atcctctgtacagagccc

SEQ ID NO: 1838885 - DNA, 20 bp, Homo sapiens
atcctctgtacagagcccac

SEQ ID NO: 1838886 - DNA, 14 bp, Homo sapiens
atccttgtcttatt

SEQ ID NO: 1838887 - DNA, 22 bp, Homo sapiens
atctcacttgtgccaacactca

SEQ ID NO: 1838888 - DNA, 17 bp, Homo sapiens
atctcccccagccccat

SEQ ID NO: 1838889 - DNA, 18 bp, Homo sapiens
atctctccaccttccaaa

SEQ ID NO: 1838890 - DNA, 15 bp, Homo sapiens
atctcttgagcctgg

SEQ ID NO: 1838891 - DNA, 18 bp, Homo sapiens
atctcttgagcctgggag

SEQ ID NO: 1838892 - DNA, 15 bp, Homo sapiens
atctgacatctctgc

SEQ ID NO: 1838893 - DNA, 20 bp, Homo sapiens
atctgacatctctgcaatct

SEQ ID NO: 1838894 - DNA, 14 bp, Homo sapiens
atctgatggcttct

SEQ ID NO: 1838895 - DNA, 14 bp, Homo sapiens
atctgcattcctga

SEQ ID NO: 1838896 - DNA, 15 bp, Homo sapiens
atctgggccagaatt

SEQ ID NO: 1838897 - DNA, 20 bp, Homo sapiens
atctgtaagagcttgctcca

SEQ ID NO: 1838898 - DNA, 23 bp, Homo sapiens
atctgtgaaaggaaagagggagg

SEQ ID NO: 1838899 - DNA, 13 bp, Homo sapiens
atcttacagctgg

SEQ ID NO: 1838900 - DNA, 24 bp, Homo sapiens
atcttctcagaaggcaaatgactt

SEQ ID NO: 1838901 - DNA, 23 bp, Homo sapiens
atcttggcacatttaagagacag

SEQ ID NO: 1838902 - DNA, 16 bp, Homo sapiens
atctttgccaccctca

SEQ ID NO: 1838903 - DNA, 19 bp, Homo sapiens
atgaaatgcattttgctag

SEQ ID NO: 1838904 - DNA, 12 bp, Homo sapiens
atgaacagctgt

SEQ ID NO: 1838905 - DNA, 16 bp, Homo sapiens
atgaaccctggcattt

SEQ ID NO: 1838906 - DNA, 23 bp, Homo sapiens
atgaagtttccttggctggtgca

SEQ ID NO: 1838907 - DNA, 18 bp, Homo sapiens
atgacattcatgcctggc

SEQ ID NO: 1838908 - DNA, 12 bp, Homo sapiens
atgacccaggct

SEQ ID NO: 1838909 - DNA, 19 bp, Homo sapiens
atgacggtaagtgttctca

SEQ ID NO: 1838910 - DNA, 23 bp, Homo sapiens
atgacgtgactggcctgctggat

SEQ ID NO: 1838911 - DNA, 13 bp, Homo sapiens
atgactgtagaat

SEQ ID NO: 1838912 - DNA, 12 bp, Homo sapiens
atgactttggac

SEQ ID NO: 1838913 - DNA, 18 bp, Homo sapiens
atgagcatcaggccaggc

SEQ ID NO: 1838914 - DNA, 18 bp, Homo sapiens
agacccagacaggactgc

SEQ ID NO: 1838915 - DNA, 21 bp, Homo sapiens
agaccctccccacagtgccac

SEQ ID NO: 1838916 - DNA, 21 bp, Homo sapiens
agaccctgccctgtgggcccc

SEQ ID NO: 1838917 - DNA, 23 bp, Homo sapiens
agaccctgccctgtgggccccca

SEQ ID NO: 1838918 - DNA, 19 bp, Homo sapiens
agacccttgtggtcccacc

SEQ ID NO: 1838919 - DNA, 22 bp, Homo sapiens
agacccttgtggtcccacccca

SEQ ID NO: 1838920 - DNA, 17 bp, Homo sapiens
agacgatgtcttcatac

SEQ ID NO: 1838921 - DNA, 19 bp, Homo sapiens
agacgatgtcttcatacct

SEQ ID NO: 1838922 - DNA, 17 bp, Homo sapiens
agacgatttgtcagtta

SEQ ID NO: 1838923 - DNA, 16 bp, Homo sapiens
agacgctgtgctgccc

SEQ ID NO: 1838924 - DNA, 20 bp, Homo sapiens
agacgctgtgctgccctgcc

SEQ ID NO: 1838925 - DNA, 21 bp, Homo sapiens
agacgctgtgctgccctgccc

SEQ ID NO: 1838926 - DNA, 15 bp, Homo sapiens
agactatcagcccaa

SEQ ID NO: 1838927 - DNA, 22 bp, Homo sapiens
agactcctaggcaggacatgct

SEQ ID NO: 1838928 - DNA, 19 bp, Homo sapiens
agactcctgcaggcagcca

SEQ ID NO: 1838929 - DNA, 21 bp, Homo sapiens
agactctttttttgagtgaca

SEQ ID NO: 1838930 - DNA, 22 bp, Homo sapiens
agactctttttttgagtgacag

SEQ ID NO: 1838931 - DNA, 17 bp, Homo sapiens
agacttaatagaaacat

SEQ ID NO: 1838932 - DNA, 17 bp, Homo sapiens
agactttggaaagactt

SEQ ID NO: 1838933 - DNA, 22 bp, Homo sapiens
agagaaaaaatattttcctgcc

SEQ ID NO: 1838934 - DNA, 15 bp, Homo sapiens
agagaaaaacaaatt

SEQ ID NO: 1838935 - DNA, 21 bp, Homo sapiens
agagaagagattgtggtttca

SEQ ID NO: 1838936 - DNA, 22 bp, Homo sapiens
agagaagcattctcattggaaa

SEQ ID NO: 1838937 - DNA, 23 bp, Homo sapiens
agagaagcattctcattggaaat

SEQ ID NO: 1838938 - DNA, 13 bp, Homo sapiens
agagaccatccct

SEQ ID NO: 1838939 - DNA, 23 bp, Homo sapiens
agagaccatccctgaaggccccg

SEQ ID NO: 1838940 - DNA, 12 bp, Homo sapiens
agagactcctgc

SEQ ID NO: 1838941 - DNA, 14 bp, Homo sapiens
agagactcctgcag

SEQ ID NO: 1838942 - DNA, 17 bp, Homo sapiens
agagactcctgcaggca

SEQ ID NO: 1838943 - DNA, 19 bp, Homo sapiens
agagactcctgcaggcagc

SEQ ID NO: 1838944 - DNA, 22 bp, Homo sapiens
agagactcctgcaggcagccag

SEQ ID NO: 1838945 - DNA, 23 bp, Homo sapiens
agagactcctgcaggcagccagg

SEQ ID NO: 1838946 - DNA, 23 bp, Homo sapiens
agagagcaagacgctgtgctgcc

SEQ ID NO: 1838947 - DNA, 14 bp, Homo sapiens
agagagggcaggca

SEQ ID NO: 1838948 - DNA, 20 bp, Homo sapiens
agagattggaatgggcagct

SEQ ID NO: 1838949 - DNA, 17 bp, Homo sapiens
agagcagagaccatccc

SEQ ID NO: 1838950 - DNA, 18 bp, Homo sapiens
agagcagagaccatccct

SEQ ID NO: 1838951 - DNA, 18 bp, Homo sapiens
agagccatgtagaagctg

SEQ ID NO: 1838952 - DNA, 17 bp, Homo sapiens
agagcccacgcccccac

SEQ ID NO: 1838953 - DNA, 18 bp, Homo sapiens
agagcccacgcccccact

SEQ ID NO: 1838954 - DNA, 14 bp, Homo sapiens
agagcccgcagggc

SEQ ID NO: 1838955 - DNA, 20 bp, Homo sapiens
agagctagcagcagggaggg

SEQ ID NO: 1838956 - DNA, 14 bp, Homo sapiens
agagcttggactgg

SEQ ID NO: 1838957 - DNA, 23 bp, Homo sapiens
agagcttggactggatgcatgtt

SEQ ID NO: 1838958 - DNA, 16 bp, Homo sapiens
agaggaaggagaggag

SEQ ID NO: 1838959 - DNA, 13 bp, Homo sapiens
agaggagaggggc

SEQ ID NO: 1838960 - DNA, 21 bp, Homo sapiens
agagggagggagggctccaga

SEQ ID NO: 1838961 - DNA, 16 bp, Homo sapiens
agagggcacacactgt

SEQ ID NO: 1838962 - DNA, 19 bp, Homo sapiens
agagggggtggcctcccaa

SEQ ID NO: 1838963 - DNA, 21 bp, Homo sapiens
agaggtggatgttatgaacag

SEQ ID NO: 1838964 - DNA, 23 bp, Homo sapiens
agaggtggatgttatgaacagct

SEQ ID NO: 1838965 - DNA, 17 bp, Homo sapiens
agaggttatctgtccca

SEQ ID NO: 1838966 - DNA, 17 bp, Homo sapiens
agaggtttgcagtccca

SEQ ID NO: 1838967 - DNA, 12 bp, Homo sapiens
agaggtttttct

SEQ ID NO: 1838968 - DNA, 19 bp, Homo sapiens
agagtaacagtcatcattt

SEQ ID NO: 1838969 - DNA, 21 bp, Homo sapiens
agagtcacacgggggcagctg

SEQ ID NO: 1838970 - DNA, 21 bp, Homo sapiens
agagtgctaagcattagcttt

SEQ ID NO: 1838971 - DNA, 20 bp, Homo sapiens
agagtgggacagttcctgag

SEQ ID NO: 1838972 - DNA, 11 bp, Homo sapiens
agagtgggagc

SEQ ID NO: 1838973 - DNA, 14 bp, Homo sapiens
agataaacacaaga

SEQ ID NO: 1838974 - DNA, 19 bp, Homo sapiens
agataactgttatttataa

SEQ ID NO: 1838975 - DNA, 13 bp, Homo sapiens
agataagaaagca

SEQ ID NO: 1838976 - DNA, 17 bp, Homo sapiens
agataagggtatctggt

SEQ ID NO: 1838977 - DNA, 19 bp, Homo sapiens
agataagggtatctggtga

SEQ ID NO: 1838978 - DNA, 22 bp, Homo sapiens
agatacttggggggctgaggtg

SEQ ID NO: 1838979 - DNA, 20 bp, Homo sapiens
agatataactattgcccagg

SEQ ID NO: 1838980 - DNA, 17 bp, Homo sapiens
agatcccacatatttca

SEQ ID NO: 1838981 - DNA, 19 bp, Homo sapiens
agatcccacatatttcaaa

SEQ ID NO: 1838982 - DNA, 13 bp, Homo sapiens
agatcctaaaaca

SEQ ID NO: 1838983 - DNA, 16 bp, Homo sapiens
agatcctaaaacaaaa

SEQ ID NO: 1838984 - DNA, 14 bp, Homo sapiens
agatctttcatttt

SEQ ID NO: 1838985 - DNA, 20 bp, Homo sapiens
agatgaaatcttacagctgg

SEQ ID NO: 1838986 - DNA, 18 bp, Homo sapiens
agatgaaccctggcattt

SEQ ID NO: 1838987 - DNA, 11 bp, Homo sapiens
agatgaatgtc

SEQ ID NO: 1838988 - DNA, 16 bp, Homo sapiens
agatgcttctcactgc

SEQ ID NO: 1838989 - DNA, 22 bp, Homo sapiens
agatgggcttcccaagggctgc

SEQ ID NO: 1838990 - DNA, 15 bp, Homo sapiens
agatgggggaaagca

SEQ ID NO: 1838991 - DNA, 16 bp, Homo sapiens
agattcaatcccagga

SEQ ID NO: 1838992 - DNA, 17 bp, Homo sapiens
agattcacactgtctgg

SEQ ID NO: 1838993 - DNA, 21 bp, Homo sapiens
agattctatgttaatatttta

SEQ ID NO: 1838994 - DNA, 14 bp, Homo sapiens
agattctgatgcat

SEQ ID NO: 1838995 - DNA, 20 bp, Homo sapiens
agattggtgtttttttctat

SEQ ID NO: 1838996 - DNA, 16 bp, Homo sapiens
agatttattaaagaaa

SEQ ID NO: 1838997 - DNA, 19 bp, Homo sapiens
agatttattaaagaaaaaa

SEQ ID NO: 1838998 - DNA, 14 bp, Homo sapiens
agatttgggctgga

SEQ ID NO: 1838999 - DNA, 17 bp, Homo sapiens
agatttgggctggaaca

SEQ ID NO: 1839000 - DNA, 13 bp, Homo sapiens
agcaaacccagag

SEQ ID NO: 1839001 - DNA, 18 bp, Homo sapiens
agcaaacccagaggtgga

SEQ ID NO: 1839002 - DNA, 19 bp, Homo sapiens
agcaaacccagaggtggat

SEQ ID NO: 1839003 - DNA, 19 bp, Homo sapiens
agcaaaggctgagaacact

SEQ ID NO: 1839004 - DNA, 17 bp, Homo sapiens
agcaaatgcctgccaaa

SEQ ID NO: 1839005 - DNA, 13 bp, Homo sapiens
agcaagacgctgt

SEQ ID NO: 1839006 - DNA, 16 bp, Homo sapiens
agcaagacgctgtgct

SEQ ID NO: 1839007 - DNA, 20 bp, Homo sapiens
agcaagacgctgtgctgccc

SEQ ID NO: 1839008 - DNA, 22 bp, Homo sapiens
agcaagacgctgtgctgccctg

SEQ ID NO: 1839009 - DNA, 11 bp, Homo sapiens
agcaagctccc

SEQ ID NO: 1839010 - DNA, 16 bp, Homo sapiens
agcaagtgagaccctg

SEQ ID NO: 1839011 - DNA, 20 bp, Homo sapiens
agcaagtgagaccctgtctc

SEQ ID NO: 1839012 - DNA, 21 bp, Homo sapiens
agcaagtgattgggacagagg

SEQ ID NO: 1839013 - DNA, 17 bp, Homo sapiens
agcacagaccctgccct

SEQ ID NO: 1839014 - DNA, 21 bp, Homo sapiens
agcacaggtgggcttcccagt

SEQ ID NO: 1839015 - DNA, 18 bp, Homo sapiens
agcaccaagctcaaagcg

SEQ ID NO: 1839016 - DNA, 19 bp, Homo sapiens
agcaccttagacagtccct

SEQ ID NO: 1839017 - DNA, 21 bp, Homo sapiens
agcaccttagacagtccctgc

SEQ ID NO: 1839018 - DNA, 20 bp, Homo sapiens
agcacggctctgtccccagc

SEQ ID NO: 1839019 - DNA, 20 bp, Homo sapiens
agcactgcctgctcccatcc

SEQ ID NO: 1839020 - DNA, 14 bp, Homo sapiens
agcactgtgctcag

SEQ ID NO: 1839021 - DNA, 22 bp, Homo sapiens
agcagaacctgcacacaggaca

SEQ ID NO: 1839022 - DNA, 23 bp, Homo sapiens
agcagaacctgcacacaggacag

SEQ ID NO: 1839023 - DNA, 17 bp, Homo sapiens
agcagagaccatccctg

SEQ ID NO: 1839024 - DNA, 15 bp, Homo sapiens
agcagccacattcct

SEQ ID NO: 1839025 - DNA, 14 bp, Homo sapiens
agcagcgagcctgc

SEQ ID NO: 1839026 - DNA, 13 bp, Homo sapiens
agcaggacatgga

SEQ ID NO: 1839027 - DNA, 21 bp, Homo sapiens
agcaggaggcccttgtcgtgg

SEQ ID NO: 1839028 - DNA, 23 bp, Homo sapiens
agcaggaggcccttgtcgtggga

SEQ ID NO: 1839029 - DNA, 15 bp, Homo sapiens
agcagtgcaggcaca

SEQ ID NO: 1839030 - DNA, 23 bp, Homo sapiens
agcatcagaggtttgcttcctca

SEQ ID NO: 1839031 - DNA, 16 bp, Homo sapiens
agcatcaggccaggcc

SEQ ID NO: 1839032 - DNA, 18 bp, Homo sapiens
agcatcaggccaggccct

SEQ ID NO: 1839033 - DNA, 12 bp, Homo sapiens
agcatgcctgga

SEQ ID NO: 1839034 - DNA, 23 bp, Homo sapiens
agcatgcctggatggggctgcac

SEQ ID NO: 1839035 - DNA, 16 bp, Homo sapiens
agcatggagctggccg

SEQ ID NO: 1839036 - DNA, 12 bp, Homo sapiens
agcatgtttaga

SEQ ID NO: 1839037 - DNA, 13 bp, Homo sapiens
aggtaggaagagc

SEQ ID NO: 1839038 - DNA, 18 bp, Homo sapiens
aggtagtattacaccacc

SEQ ID NO: 1839039 - DNA, 19 bp, Homo sapiens
aggtcagtagactgtgatt

SEQ ID NO: 1839040 - DNA, 20 bp, Homo sapiens
aggtcagtagactgtgattc

SEQ ID NO: 1839041 - DNA, 18 bp, Homo sapiens
aggtccagccctggctga

SEQ ID NO: 1839042 - DNA, 23 bp, Homo sapiens
aggtccagccctggctgaaggac

SEQ ID NO: 1839043 - DNA, 14 bp, Homo sapiens
aggtcgaggcagga

SEQ ID NO: 1839044 - DNA, 21 bp, Homo sapiens
aggtgagaagcagaggaagga

SEQ ID NO: 1839045 - DNA, 16 bp, Homo sapiens
aggtgcacaagctcca

SEQ ID NO: 1839046 - DNA, 17 bp, Homo sapiens
aggtgcacaagctccaa

SEQ ID NO: 1839047 - DNA, 19 bp, Homo sapiens
aggtgcgtgttcagcagaa

SEQ ID NO: 1839048 - DNA, 16 bp, Homo sapiens
aggtggcaaggctgtg

SEQ ID NO: 1839049 - DNA, 23 bp, Homo sapiens
aggtggcctctccttgtggcctg

SEQ ID NO: 1839050 - DNA, 21 bp, Homo sapiens
aggtgggcttcccagtggctg

SEQ ID NO: 1839051 - DNA, 13 bp, Homo sapiens
aggtggggacagg

SEQ ID NO: 1839052 - DNA, 22 bp, Homo sapiens
aggttaagcactttaacacagt

SEQ ID NO: 1839053 - DNA, 18 bp, Homo sapiens
aggttactcataaggcat

SEQ ID NO: 1839054 - DNA, 23 bp, Homo sapiens
aggttccctttgacgccatccca

SEQ ID NO: 1839055 - DNA, 17 bp, Homo sapiens
aggttctctcctcccca

SEQ ID NO: 1839056 - DNA, 22 bp, Homo sapiens
aggttctctcctccccaaggag

SEQ ID NO: 1839057 - DNA, 20 bp, Homo sapiens
aggttggcaaaaaggcagga

SEQ ID NO: 1839058 - DNA, 14 bp, Homo sapiens
aggtttaaatgaac

SEQ ID NO: 1839059 - DNA, 19 bp, Homo sapiens
aggtttaaatgaacaagag

SEQ ID NO: 1839060 - DNA, 22 bp, Homo sapiens
aggtttaaatgaacaagagaag

SEQ ID NO: 1839061 - DNA, 23 bp, Homo sapiens
aggtttctggtctctaggctggg

SEQ ID NO: 1839062 - DNA, 17 bp, Homo sapiens
aggtttgcttcctcagt

SEQ ID NO: 1839063 - DNA, 13 bp, Homo sapiens
aggtttttcttaa

SEQ ID NO: 1839064 - DNA, 18 bp, Homo sapiens
agtaaagtgaagaattta

SEQ ID NO: 1839065 - DNA, 22 bp, Homo sapiens
agtaaatggcttatccagctgg

SEQ ID NO: 1839066 - DNA, 20 bp, Homo sapiens
agtaacagtcatcatttatc

SEQ ID NO: 1839067 - DNA, 19 bp, Homo sapiens
agtaacatttctgttctca

SEQ ID NO: 1839068 - DNA, 12 bp, Homo sapiens
agtaacctgggt

SEQ ID NO: 1839069 - DNA, 17 bp, Homo sapiens
agtaacttacttaggtg

SEQ ID NO: 1839070 - DNA, 18 bp, Homo sapiens
agtaatctcacagcattt

SEQ ID NO: 1839071 - DNA, 14 bp, Homo sapiens
agtaattctcaggc

SEQ ID NO: 1839072 - DNA, 19 bp, Homo sapiens
agtacctgggcaagctggc

SEQ ID NO: 1839073 - DNA, 22 bp, Homo sapiens
agtactacagtcctcccatctc

SEQ ID NO: 1839074 - DNA, 17 bp, Homo sapiens
agtaggaagactttgga

SEQ ID NO: 1839075 - DNA, 15 bp, Homo sapiens
agtatctcagggcct

SEQ ID NO: 1839076 - DNA, 19 bp, Homo sapiens
agtatggagctcagagagg

SEQ ID NO: 1839077 - DNA, 20 bp, Homo sapiens
agtatgggactggcctctgc

SEQ ID NO: 1839078 - DNA, 13 bp, Homo sapiens
agtcaccccagga

SEQ ID NO: 1839079 - DNA, 17 bp, Homo sapiens
agtcaccccggccacct

SEQ ID NO: 1839080 - DNA, 19 bp, Homo sapiens
agtcaccccggccacctgc

SEQ ID NO: 1839081 - DNA, 16 bp, Homo sapiens
agtcactgagacagcc

SEQ ID NO: 1839082 - DNA, 19 bp, Homo sapiens
agtcactgagacagcccgg

SEQ ID NO: 1839083 - DNA, 14 bp, Homo sapiens
agtcatcatttatc

SEQ ID NO: 1839084 - DNA, 17 bp, Homo sapiens
agtcatgcaaaggctgg

SEQ ID NO: 1839085 - DNA, 17 bp, Homo sapiens
agtcatggtggccacgg

SEQ ID NO: 1839086 - DNA, 21 bp, Homo sapiens
agtccaaccagaaacacccct

SEQ ID NO: 1839087 - DNA, 23 bp, Homo sapiens
agtccaaggaaaccacagctgct

SEQ ID NO: 1839088 - DNA, 15 bp, Homo sapiens
agtccagcctggaga

SEQ ID NO: 1839089 - DNA, 20 bp, Homo sapiens
agtcccaagcggtgtctctc

SEQ ID NO: 1839090 - DNA, 16 bp, Homo sapiens
agtccctgccaatgga

SEQ ID NO: 1839091 - DNA, 20 bp, Homo sapiens
agtccttaccagcagagcac

SEQ ID NO: 1839092 - DNA, 18 bp, Homo sapiens
agtctattgaataatgta

SEQ ID NO: 1839093 - DNA, 11 bp, Homo sapiens
agtctctgtga

SEQ ID NO: 1839094 - DNA, 18 bp, Homo sapiens
agtctggcccttcctttt

SEQ ID NO: 1839095 - DNA, 12 bp, Homo sapiens
agtctgttttat

SEQ ID NO: 1839096 - DNA, 14 bp, Homo sapiens
agtctgttttatga

SEQ ID NO: 1839097 - DNA, 14 bp, Homo sapiens
agtcttctatttat

SEQ ID NO: 1839098 - DNA, 15 bp, Homo sapiens
agtcttggctaagga

SEQ ID NO: 1839099 - DNA, 24 bp, Homo sapiens
agtgaaactgcttgtttcctagca

SEQ ID NO: 1839100 - DNA, 16 bp, Homo sapiens
agtgaacttgggccac

SEQ ID NO: 1839101 - DNA, 17 bp, Homo sapiens
agtgacctcagctttga

SEQ ID NO: 1839102 - DNA, 15 bp, Homo sapiens
agtgactgtatctgt

SEQ ID NO: 1839103 - DNA, 16 bp, Homo sapiens
agtgactgtatctgtg

SEQ ID NO: 1839104 - DNA, 12 bp, Homo sapiens
agtgaggctctg

SEQ ID NO: 1839105 - DNA, 21 bp, Homo sapiens
agtgagttgatagcacagacc

SEQ ID NO: 1839106 - DNA, 14 bp, Homo sapiens
agtgatcacagcag

SEQ ID NO: 1839107 - DNA, 16 bp, Homo sapiens
agtgattatatttcac

SEQ ID NO: 1839108 - DNA, 17 bp, Homo sapiens
agtgattgggacagagg

SEQ ID NO: 1839109 - DNA, 14 bp, Homo sapiens
agtgcatatgcaat

SEQ ID NO: 1839110 - DNA, 16 bp, Homo sapiens
agtgcttgccacagag

SEQ ID NO: 1839111 - DNA, 17 bp, Homo sapiens
agtgcttgcttttcatg

SEQ ID NO: 1839112 - DNA, 14 bp, Homo sapiens
agtgctttgagaga

SEQ ID NO: 1839113 - DNA, 19 bp, Homo sapiens
agtggaaaaatagcctgcc

SEQ ID NO: 1839114 - DNA, 19 bp, Homo sapiens
agtggcttcattagagcag

SEQ ID NO: 1839115 - DNA, 21 bp, Homo sapiens
agtggcttcattagagcaggc

SEQ ID NO: 1839116 - DNA, 15 bp, Homo sapiens
agtgggacagttcct

SEQ ID NO: 1839117 - DNA, 23 bp, Homo sapiens
agtgggacagttcctgagaccag

SEQ ID NO: 1839118 - DNA, 18 bp, Homo sapiens
agtgggtgaataatacag

SEQ ID NO: 1839119 - DNA, 17 bp, Homo sapiens
agtgtccaaagcagggt

SEQ ID NO: 1839120 - DNA, 16 bp, Homo sapiens
agtgtctattatcaca

SEQ ID NO: 1839121 - DNA, 20 bp, Homo sapiens
agtgtgcctgaagtcccaga

SEQ ID NO: 1839122 - DNA, 23 bp, Homo sapiens
agtgtggagttcaccttggaagg

SEQ ID NO: 1839123 - DNA, 22 bp, Homo sapiens
agtgtggtgtttcctggcactg

SEQ ID NO: 1839124 - DNA, 19 bp, Homo sapiens
agtgtgtggtcaacatttc

SEQ ID NO: 1839125 - DNA, 14 bp, Homo sapiens
agtgttctcatgaa

SEQ ID NO: 1839126 - DNA, 14 bp, Homo sapiens
agttaaactgatta

SEQ ID NO: 1839127 - DNA, 20 bp, Homo sapiens
agttaaactggcttaactta

SEQ ID NO: 1839128 - DNA, 15 bp, Homo sapiens
agttcaccttggaag

SEQ ID NO: 1839129 - DNA, 16 bp, Homo sapiens
agttcaccttggaagg

SEQ ID NO: 1839130 - DNA, 21 bp, Homo sapiens
agttgatagcacagaccctgc

SEQ ID NO: 1839131 - DNA, 19 bp, Homo sapiens
agttgatatagaacagtgc

SEQ ID NO: 1839132 - DNA, 13 bp, Homo sapiens
agttgattcagct

SEQ ID NO: 1839133 - DNA, 17 bp, Homo sapiens
agttgattcagctctgc

SEQ ID NO: 1839134 - DNA, 17 bp, Homo sapiens
agttgcaatagaacaga

SEQ ID NO: 1839135 - DNA, 20 bp, Homo sapiens
agttgcatggcatcacctcc

SEQ ID NO: 1839136 - DNA, 21 bp, Homo sapiens
agttgcatggcatcacctcca

SEQ ID NO: 1839137 - DNA, 18 bp, Homo sapiens
agttggaaggatctgctg

SEQ ID NO: 1839138 - DNA, 16 bp, Homo sapiens
agttggccagagagcc

SEQ ID NO: 1839139 - DNA, 17 bp, Homo sapiens
agttggtcccccttcca

SEQ ID NO: 1839140 - DNA, 18 bp, Homo sapiens
agttggtcccccttccat

SEQ ID NO: 1839141 - DNA, 23 bp, Homo sapiens
agttgtttgattcagacagctgc

SEQ ID NO: 1839142 - DNA, 17 bp, Homo sapiens
agtttccttggctggtg

SEQ ID NO: 1839143 - DNA, 13 bp, Homo sapiens
agtttctccaagc

SEQ ID NO: 1839144 - DNA, 17 bp, Homo sapiens
agtttctgtcctgctgg

SEQ ID NO: 1839145 - DNA, 18 bp, Homo sapiens
agtttgagatcagcctgg

SEQ ID NO: 1839146 - DNA, 14 bp, Homo sapiens
agttttcttctgtg

SEQ ID NO: 1839147 - DNA, 18 bp, Homo sapiens
agttttgaagattctatg

SEQ ID NO: 1839148 - DNA, 15 bp, Homo sapiens
agttttggttgcttt

SEQ ID NO: 1839149 - DNA, 15 bp, Homo sapiens
agttttgtctgtctc

SEQ ID NO: 1839150 - DNA, 18 bp, Homo sapiens
agttttgtgatgcatttt

SEQ ID NO: 1839151 - DNA, 17 bp, Homo sapiens
ataaaatttttatgtaa

SEQ ID NO: 1839152 - DNA, 23 bp, Homo sapiens
ataaaatttttatgtaattatat

SEQ ID NO: 1839153 - DNA, 19 bp, Homo sapiens
ataaacaagaaaaataaag

SEQ ID NO: 1839154 - DNA, 20 bp, Homo sapiens
ataaacaagaaaaataaaga

SEQ ID NO: 1839155 - DNA, 22 bp, Homo sapiens
ataaacaagaaaaataaagaaa

SEQ ID NO: 1839156 - DNA, 14 bp, Homo sapiens
ataaagaaaagatg

SEQ ID NO: 1839157 - DNA, 15 bp, Homo sapiens
ataaagaaaagatgc

SEQ ID NO: 1839158 - DNA, 16 bp, Homo sapiens
ataaagacgttttata

SEQ ID NO: 1839159 - DNA, 22 bp, Homo sapiens
ataaagacgttttataagcatc

SEQ ID NO: 1839160 - DNA, 23 bp, Homo sapiens
ataaatatattattacttgtaaa

SEQ ID NO: 1839161 - DNA, 18 bp, Homo sapiens
caggtttaagctgttact

SEQ ID NO: 1839162 - DNA, 17 bp, Homo sapiens
caggtttctggtctcta

SEQ ID NO: 1839163 - DNA, 12 bp, Homo sapiens
caggtttttccc

SEQ ID NO: 1839164 - DNA, 12 bp, Homo sapiens
cagtagacaagc

SEQ ID NO: 1839165 - DNA, 13 bp, Homo sapiens
cagtatctcaggg

SEQ ID NO: 1839166 - DNA, 16 bp, Homo sapiens
cagtatgggttaggga

SEQ ID NO: 1839167 - DNA, 12 bp, Homo sapiens
cagtattgaagc

SEQ ID NO: 1839168 - DNA, 14 bp, Homo sapiens
cagtattgaagcat

SEQ ID NO: 1839169 - DNA, 17 bp, Homo sapiens
cagtattgaagcatttt

SEQ ID NO: 1839170 - DNA, 17 bp, Homo sapiens
cagtcaccccaggactc

SEQ ID NO: 1839171 - DNA, 14 bp, Homo sapiens
cagtcaccccggcc

SEQ ID NO: 1839172 - DNA, 17 bp, Homo sapiens
cagtcaccccggccacc

SEQ ID NO: 1839173 - DNA, 19 bp, Homo sapiens
cagtcaccccggccacctg

SEQ ID NO: 1839174 - DNA, 23 bp, Homo sapiens
cagtcacgtggaggagcagtgca

SEQ ID NO: 1839175 - DNA, 13 bp, Homo sapiens
cagtcatcattta

SEQ ID NO: 1839176 - DNA, 19 bp, Homo sapiens
cagtcattatgttaatatt

SEQ ID NO: 1839177 - DNA, 14 bp, Homo sapiens
cagtccaaccagaa

SEQ ID NO: 1839178 - DNA, 13 bp, Homo sapiens
cagtccagcctgg

SEQ ID NO: 1839179 - DNA, 13 bp, Homo sapiens
cagtccccttccc

SEQ ID NO: 1839180 - DNA, 13 bp, Homo sapiens
cagtcccctttct

SEQ ID NO: 1839181 - DNA, 15 bp, Homo sapiens
cagtccctgccaatg

SEQ ID NO: 1839182 - DNA, 17 bp, Homo sapiens
cagtcctcccatctcac

SEQ ID NO: 1839183 - DNA, 19 bp, Homo sapiens
cagtccttaccagcagagc

SEQ ID NO: 1839184 - DNA, 20 bp, Homo sapiens
cagtccttaccagcagagca

SEQ ID NO: 1839185 - DNA, 14 bp, Homo sapiens
cagtgaacattccc

SEQ ID NO: 1839186 - DNA, 13 bp, Homo sapiens
cagtgaggctctg

SEQ ID NO: 1839187 - DNA, 15 bp, Homo sapiens
cagtgaggctctgcc

SEQ ID NO: 1839188 - DNA, 17 bp, Homo sapiens
cagtgaggctctgccct

SEQ ID NO: 1839189 - DNA, 19 bp, Homo sapiens
cagtgaggctctgcccttg

SEQ ID NO: 1839190 - DNA, 20 bp, Homo sapiens
cagtgaggctctgcccttgg

SEQ ID NO: 1839191 - DNA, 12 bp, Homo sapiens
cagtgccaccca

SEQ ID NO: 1839192 - DNA, 13 bp, Homo sapiens
cagtgccacccat

SEQ ID NO: 1839193 - DNA, 18 bp, Homo sapiens
cagtgccgagaaggaagc

SEQ ID NO: 1839194 - DNA, 14 bp, Homo sapiens
cagtgcctcttcca

SEQ ID NO: 1839195 - DNA, 21 bp, Homo sapiens
cagtgcctcttccagtgaaca

SEQ ID NO: 1839196 - DNA, 14 bp, Homo sapiens
cagtggccacggcc

SEQ ID NO: 1839197 - DNA, 23 bp, Homo sapiens
cagtgtggagttcaccttggaag

SEQ ID NO: 1839198 - DNA, 17 bp, Homo sapiens
cagtgtgtggtcaacat

SEQ ID NO: 1839199 - DNA, 20 bp, Homo sapiens
cagttaagcctttggaaaca

SEQ ID NO: 1839200 - DNA, 23 bp, Homo sapiens
cagttcagaatcacttctgagaa

SEQ ID NO: 1839201 - DNA, 19 bp, Homo sapiens
cagttgaaaaacagctgag

SEQ ID NO: 1839202 - DNA, 18 bp, Homo sapiens
cagttggtcccccttcca

SEQ ID NO: 1839203 - DNA, 14 bp, Homo sapiens
cagttgttatttat

SEQ ID NO: 1839204 - DNA, 14 bp, Homo sapiens
cagtttggaagtgt

SEQ ID NO: 1839205 - DNA, 16 bp, Homo sapiens
cagtttgtcacatgaa

SEQ ID NO: 1839206 - DNA, 22 bp, Homo sapiens
cataacccaaggtaccatccta

SEQ ID NO: 1839207 - DNA, 20 bp, Homo sapiens
cataagctatttttctaact

SEQ ID NO: 1839208 - DNA, 22 bp, Homo sapiens
cataaggcatatacaaataaac

SEQ ID NO: 1839209 - DNA, 20 bp, Homo sapiens
cataatctaccaacgaaaga

SEQ ID NO: 1839210 - DNA, 23 bp, Homo sapiens
catactccatcagttagagctga

SEQ ID NO: 1839211 - DNA, 16 bp, Homo sapiens
catactcccatctgtg

SEQ ID NO: 1839212 - DNA, 20 bp, Homo sapiens
catactgattgggaggtgcg

SEQ ID NO: 1839213 - DNA, 23 bp, Homo sapiens
catactgattgggaggtgcgtgt

SEQ ID NO: 1839214 - DNA, 15 bp, Homo sapiens
catagatgcaggtga

SEQ ID NO: 1839215 - DNA, 19 bp, Homo sapiens
catatgacattcatgcctg

SEQ ID NO: 1839216 - DNA, 21 bp, Homo sapiens
catatgacattcatgcctggc

SEQ ID NO: 1839217 - DNA, 15 bp, Homo sapiens
catattcaggaagct

SEQ ID NO: 1839218 - DNA, 22 bp, Homo sapiens
catattcaggaagctcagggcc

SEQ ID NO: 1839219 - DNA, 17 bp, Homo sapiens
catatttaatttgaagg

SEQ ID NO: 1839220 - DNA, 20 bp, Homo sapiens
catcaaggacacgggcctgt

SEQ ID NO: 1839221 - DNA, 22 bp, Homo sapiens
catcaatgataatgctaatttt

SEQ ID NO: 1839222 - DNA, 17 bp, Homo sapiens
catcacaaatggctaca

SEQ ID NO: 1839223 - DNA, 15 bp, Homo sapiens
catcaccaacgtctg

SEQ ID NO: 1839224 - DNA, 12 bp, Homo sapiens
catcacccgcta

SEQ ID NO: 1839225 - DNA, 19 bp, Homo sapiens
catcagaaacaccctcaca

SEQ ID NO: 1839226 - DNA, 14 bp, Homo sapiens
catcaggccaggcc

SEQ ID NO: 1839227 - DNA, 23 bp, Homo sapiens
catccagtctcccaacttgtatt

SEQ ID NO: 1839228 - DNA, 12 bp, Homo sapiens
catccatccagg

SEQ ID NO: 1839229 - DNA, 11 bp, Homo sapiens
catcccagccc

SEQ ID NO: 1839230 - DNA, 13 bp, Homo sapiens
catcccagcccca

SEQ ID NO: 1839231 - DNA, 16 bp, Homo sapiens
catcccagccccaatg

SEQ ID NO: 1839232 - DNA, 17 bp, Homo sapiens
catcccagccccaatga

SEQ ID NO: 1839233 - DNA, 21 bp, Homo sapiens
catcccctgtagagtgggagc

SEQ ID NO: 1839234 - DNA, 18 bp, Homo sapiens
catccctaatgctgcaga

SEQ ID NO: 1839235 - DNA, 13 bp, Homo sapiens
catccctgaaggc

SEQ ID NO: 1839236 - DNA, 20 bp, Homo sapiens
catcccttgaccaggcctgg

SEQ ID NO: 1839237 - DNA, 15 bp, Homo sapiens
catcctctgtacaga

SEQ ID NO: 1839238 - DNA, 18 bp, Homo sapiens
catcctctgtacagagcc

SEQ ID NO: 1839239 - DNA, 23 bp, Homo sapiens
catcctgtgtgttaagctctgct

SEQ ID NO: 1839240 - DNA, 14 bp, Homo sapiens
catccttgagtcaa

SEQ ID NO: 1839241 - DNA, 13 bp, Homo sapiens
catccttgtctta

SEQ ID NO: 1839242 - DNA, 15 bp, Homo sapiens
catctaccctccgat

SEQ ID NO: 1839243 - DNA, 19 bp, Homo sapiens
catctctcaggaatcatct

SEQ ID NO: 1839244 - DNA, 15 bp, Homo sapiens
catctctgcaatctt

SEQ ID NO: 1839245 - DNA, 14 bp, Homo sapiens
catctctggatgcc

SEQ ID NO: 1839246 - DNA, 14 bp, Homo sapiens
catctgctcctgga

SEQ ID NO: 1839247 - DNA, 22 bp, Homo sapiens
catctgctcctggatctccctg

SEQ ID NO: 1839248 - DNA, 17 bp, Homo sapiens
catctggaaccatcaga

SEQ ID NO: 1839249 - DNA, 22 bp, Homo sapiens
catctgtaaaatggagacacca

SEQ ID NO: 1839250 - DNA, 22 bp, Homo sapiens
catctgtaagagcttgctccag

SEQ ID NO: 1839251 - DNA, 21 bp, Homo sapiens
catcttaggttggcaaaaagg

SEQ ID NO: 1839252 - DNA, 19 bp, Homo sapiens
catctttcctgatggcagg

SEQ ID NO: 1839253 - DNA, 19 bp, Homo sapiens
catgaagcaggaggccctt

SEQ ID NO: 1839254 - DNA, 15 bp, Homo sapiens
catgagcatcaggcc

SEQ ID NO: 1839255 - DNA, 14 bp, Homo sapiens
catgagtcccctgt

SEQ ID NO: 1839256 - DNA, 23 bp, Homo sapiens
catgattaaccacttcagctgac

SEQ ID NO: 1839257 - DNA, 12 bp, Homo sapiens
catgcaaactct

SEQ ID NO: 1839258 - DNA, 14 bp, Homo sapiens
catgcaaactcttt

SEQ ID NO: 1839259 - DNA, 16 bp, Homo sapiens
catgcagacctcatgc

SEQ ID NO: 1839260 - DNA, 21 bp, Homo sapiens
catgcagacctcatgcccagc

SEQ ID NO: 1839261 - DNA, 24 bp, Homo sapiens
catgcagctgctccccaggccacc

SEQ ID NO: 1839262 - DNA, 12 bp, Homo sapiens
catgcaggaggt

SEQ ID NO: 1839263 - DNA, 19 bp, Homo sapiens
catgccagcttatctcagg

SEQ ID NO: 1839264 - DNA, 18 bp, Homo sapiens
catgcctggatggggctg

SEQ ID NO: 1839265 - DNA, 13 bp, Homo sapiens
catgcctggcttc

SEQ ID NO: 1839266 - DNA, 14 bp, Homo sapiens
catgcctggcttcg

SEQ ID NO: 1839267 - DNA, 14 bp, Homo sapiens
catgcggagaacaa

SEQ ID NO: 1839268 - DNA, 23 bp, Homo sapiens
catgcggagaacaaatgtgaagg

SEQ ID NO: 1839269 - DNA, 17 bp, Homo sapiens
attcaggaagctcaggg

SEQ ID NO: 1839270 - DNA, 14 bp, Homo sapiens
attcatgcctggct

SEQ ID NO: 1839271 - DNA, 15 bp, Homo sapiens
attcattagttttga

SEQ ID NO: 1839272 - DNA, 18 bp, Homo sapiens
ccagccgccatgctcctg

SEQ ID NO: 1839273 - DNA, 19 bp, Homo sapiens
ccagccgccatgctcctgg

SEQ ID NO: 1839274 - DNA, 19 bp, Homo sapiens
ccagccttgaccattctcc

SEQ ID NO: 1839275 - DNA, 11 bp, Homo sapiens
ccagctcagca

SEQ ID NO: 1839276 - DNA, 12 bp, Homo sapiens
ccagctctctga

SEQ ID NO: 1839277 - DNA, 23 bp, Homo sapiens
ccagctctctgacgcttgtgaca

SEQ ID NO: 1839278 - DNA, 22 bp, Homo sapiens
ccagctctggtccatagagagc

SEQ ID NO: 1839279 - DNA, 19 bp, Homo sapiens
ccagctgtgttcacactgt

SEQ ID NO: 1839280 - DNA, 16 bp, Homo sapiens
ccagctgttcagctgg

SEQ ID NO: 1839281 - DNA, 19 bp, Homo sapiens
ccaggaaaggctccaggag

SEQ ID NO: 1839282 - DNA, 21 bp, Homo sapiens
ccaggaaaggctccaggagca

SEQ ID NO: 1839283 - DNA, 23 bp, Homo sapiens
ccaggaaaggctccaggagcagc

SEQ ID NO: 1839284 - DNA, 16 bp, Homo sapiens
ccaggagcacggctct

SEQ ID NO: 1839285 - DNA, 22 bp, Homo sapiens
ccaggagcacggctctgtcccc

SEQ ID NO: 1839286 - DNA, 12 bp, Homo sapiens
ccaggagcagcc

SEQ ID NO: 1839287 - DNA, 12 bp, Homo sapiens
ccaggaggccag

SEQ ID NO: 1839288 - DNA, 13 bp, Homo sapiens
ccaggaggccagc

SEQ ID NO: 1839289 - DNA, 18 bp, Homo sapiens
ccaggaggccagccttga

SEQ ID NO: 1839290 - DNA, 20 bp, Homo sapiens
ccaggcaggctaaggcgtgg

SEQ ID NO: 1839291 - DNA, 21 bp, Homo sapiens
ccaggccacaagacccttgtg

SEQ ID NO: 1839292 - DNA, 13 bp, Homo sapiens
ccaggccctctgc

SEQ ID NO: 1839293 - DNA, 14 bp, Homo sapiens
ccaggccctctgcc

SEQ ID NO: 1839294 - DNA, 19 bp, Homo sapiens
ccaggccctctgcccactc

SEQ ID NO: 1839295 - DNA, 21 bp, Homo sapiens
ccaggccctctgcccactccc

SEQ ID NO: 1839296 - DNA, 22 bp, Homo sapiens
ccaggccctctgcccactccct

SEQ ID NO: 1839297 - DNA, 13 bp, Homo sapiens
ccaggcctgggcc

SEQ ID NO: 1839298 - DNA, 13 bp, Homo sapiens
ccaggctgggaga

SEQ ID NO: 1839299 - DNA, 17 bp, Homo sapiens
ccaggctgggagagcct

SEQ ID NO: 1839300 - DNA, 22 bp, Homo sapiens
ccaggctgggagagccttccag

SEQ ID NO: 1839301 - DNA, 20 bp, Homo sapiens
ccaggctgggcaaggaggcc

SEQ ID NO: 1839302 - DNA, 20 bp, Homo sapiens
ccaggcttagtcactgagac

SEQ ID NO: 1839303 - DNA, 22 bp, Homo sapiens
ccaggcttagtcactgagacag

SEQ ID NO: 1839304 - DNA, 14 bp, Homo sapiens
ccagggacagaggg

SEQ ID NO: 1839305 - DNA, 19 bp, Homo sapiens
ccagggcctggaagacaga

SEQ ID NO: 1839306 - DNA, 20 bp, Homo sapiens
ccaggggaaaatcagcctgc

SEQ ID NO: 1839307 - DNA, 17 bp, Homo sapiens
ccaggggtgggacaccc

SEQ ID NO: 1839308 - DNA, 18 bp, Homo sapiens
ccaggtgcacaagctcca

SEQ ID NO: 1839309 - DNA, 19 bp, Homo sapiens
ccaggtgcacaagctccaa

SEQ ID NO: 1839310 - DNA, 20 bp, Homo sapiens
ccaggtgcacaagctccaag

SEQ ID NO: 1839311 - DNA, 22 bp, Homo sapiens
ccagtacctcctgtctctggcc

SEQ ID NO: 1839312 - DNA, 16 bp, Homo sapiens
ccagtcaccccggcca

SEQ ID NO: 1839313 - DNA, 19 bp, Homo sapiens
ccagtcaccccggccacct

SEQ ID NO: 1839314 - DNA, 21 bp, Homo sapiens
ccagtcaccccggccacctgc

SEQ ID NO: 1839315 - DNA, 18 bp, Homo sapiens
ccagtgaacattcccagc

SEQ ID NO: 1839316 - DNA, 14 bp, Homo sapiens
ccagtgaggctctg

SEQ ID NO: 1839317 - DNA, 15 bp, Homo sapiens
ccagtgaggctctgc

SEQ ID NO: 1839318 - DNA, 17 bp, Homo sapiens
ccagtgaggctctgccc

SEQ ID NO: 1839319 - DNA, 18 bp, Homo sapiens
ccagtgaggctctgccct

SEQ ID NO: 1839320 - DNA, 19 bp, Homo sapiens
ccagtgaggctctgccctt

SEQ ID NO: 1839321 - DNA, 15 bp, Homo sapiens
ccagtgcatatgcaa

SEQ ID NO: 1839322 - DNA, 17 bp, Homo sapiens
ccagtggctgctgccca

SEQ ID NO: 1839323 - DNA, 18 bp, Homo sapiens
ccagtggctgctgcccag

SEQ ID NO: 1839324 - DNA, 21 bp, Homo sapiens
ccagtggctgctgcccaggcc

SEQ ID NO: 1839325 - DNA, 17 bp, Homo sapiens
ccagtttaacctgatgc

SEQ ID NO: 1839326 - DNA, 16 bp, Homo sapiens
ccataaccgctgattc

SEQ ID NO: 1839327 - DNA, 22 bp, Homo sapiens
ccataaccgctgattctcaggg

SEQ ID NO: 1839328 - DNA, 21 bp, Homo sapiens
ccatagtatgggactggcctc

SEQ ID NO: 1839329 - DNA, 13 bp, Homo sapiens
ccatcaagccacc

SEQ ID NO: 1839330 - DNA, 13 bp, Homo sapiens
ccatcaccagaca

SEQ ID NO: 1839331 - DNA, 18 bp, Homo sapiens
ccatcagaaacaccctca

SEQ ID NO: 1839332 - DNA, 16 bp, Homo sapiens
ccatcccctgtagagt

SEQ ID NO: 1839333 - DNA, 22 bp, Homo sapiens
ccatcccctgtagagtgggagc

SEQ ID NO: 1839334 - DNA, 17 bp, Homo sapiens
ccatccctgaaggcccc

SEQ ID NO: 1839335 - DNA, 17 bp, Homo sapiens
ccatcctaggctgacac

SEQ ID NO: 1839336 - DNA, 12 bp, Homo sapiens
ccatcctctgta

SEQ ID NO: 1839337 - DNA, 13 bp, Homo sapiens
ccatctaccctcc

SEQ ID NO: 1839338 - DNA, 21 bp, Homo sapiens
ccatctcacacatgagcatca

SEQ ID NO: 1839339 - DNA, 18 bp, Homo sapiens
ccatctctggatgcctga

SEQ ID NO: 1839340 - DNA, 11 bp, Homo sapiens
ccatctgctcc

SEQ ID NO: 1839341 - DNA, 12 bp, Homo sapiens
ccatctgctcct

SEQ ID NO: 1839342 - DNA, 14 bp, Homo sapiens
ccatctgctcctgg

SEQ ID NO: 1839343 - DNA, 16 bp, Homo sapiens
ccatgacccaggctgg

SEQ ID NO: 1839344 - DNA, 18 bp, Homo sapiens
ccatgacccaggctgggc

SEQ ID NO: 1839345 - DNA, 18 bp, Homo sapiens
ccatgagtcccctgtttg

SEQ ID NO: 1839346 - DNA, 20 bp, Homo sapiens
ccatgagtggcatggccacc

SEQ ID NO: 1839347 - DNA, 19 bp, Homo sapiens
ccatgattaaccacttcag

SEQ ID NO: 1839348 - DNA, 19 bp, Homo sapiens
ccatgcaatatttcctcat

SEQ ID NO: 1839349 - DNA, 21 bp, Homo sapiens
ccatgcaccctcatacacaga

SEQ ID NO: 1839350 - DNA, 17 bp, Homo sapiens
ccatgcagctgctcccc

SEQ ID NO: 1839351 - DNA, 13 bp, Homo sapiens
ccatgcaggaggt

SEQ ID NO: 1839352 - DNA, 11 bp, Homo sapiens
ccatgctgccc

SEQ ID NO: 1839353 - DNA, 13 bp, Homo sapiens
ccatgctgccctg

SEQ ID NO: 1839354 - DNA, 17 bp, Homo sapiens
ccatgctgccctgtgag

SEQ ID NO: 1839355 - DNA, 18 bp, Homo sapiens
ccatggagagctggagcc

SEQ ID NO: 1839356 - DNA, 19 bp, Homo sapiens
ccatggagagctggagcct

SEQ ID NO: 1839357 - DNA, 15 bp, Homo sapiens
ccatggccctcccag

SEQ ID NO: 1839358 - DNA, 18 bp, Homo sapiens
ccatgtagaagctgcatc

SEQ ID NO: 1839359 - DNA, 16 bp, Homo sapiens
ccattctccacctgcc

SEQ ID NO: 1839360 - DNA, 17 bp, Homo sapiens
ccattctccacctgcca

SEQ ID NO: 1839361 - DNA, 12 bp, Homo sapiens
ccattctggaag

SEQ ID NO: 1839362 - DNA, 21 bp, Homo sapiens
ccatttcatttgtgccagaat

SEQ ID NO: 1839363 - DNA, 18 bp, Homo sapiens
cccaaaactctcctctgc

SEQ ID NO: 1839364 - DNA, 22 bp, Homo sapiens
cccaaatggaaatgggcagagc

SEQ ID NO: 1839365 - DNA, 23 bp, Homo sapiens
cccaaatggaaatgggcagagca

SEQ ID NO: 1839366 - DNA, 19 bp, Homo sapiens
cccaaccacagaggatgct

SEQ ID NO: 1839367 - DNA, 21 bp, Homo sapiens
cccaagagaaggggaagcact

SEQ ID NO: 1839368 - DNA, 12 bp, Homo sapiens
cccaagggcctg

SEQ ID NO: 1839369 - DNA, 15 bp, Homo sapiens
cccagctctggtcca

SEQ ID NO: 1839370 - DNA, 22 bp, Homo sapiens
cccagcttaaaggggctagagt

SEQ ID NO: 1839371 - DNA, 16 bp, Homo sapiens
cccaggaaaggctcca

SEQ ID NO: 1839372 - DNA, 17 bp, Homo sapiens
cccaggaaaggctccag

SEQ ID NO: 1839373 - DNA, 18 bp, Homo sapiens
cccaggaaaggctccagg

SEQ ID NO: 1839374 - DNA, 21 bp, Homo sapiens
cccaggaaaggctccaggagc

SEQ ID NO: 1839375 - DNA, 23 bp, Homo sapiens
cccaggaaaggctccaggagcag

SEQ ID NO: 1839376 - DNA, 13 bp, Homo sapiens
cccaggaggccag

SEQ ID NO: 1839377 - DNA, 14 bp, Homo sapiens
cccaggaggccagc

SEQ ID NO: 1839378 - DNA, 16 bp, Homo sapiens
cccaggaggccagcct

SEQ ID NO: 1839379 - DNA, 18 bp, Homo sapiens
cccaggaggccagccttg

SEQ ID NO: 1839380 - DNA, 21 bp, Homo sapiens
cccaggcattccccaggaggc

SEQ ID NO: 1839381 - DNA, 23 bp, Homo sapiens
cccaggcattccccaggaggcca

SEQ ID NO: 1839382 - DNA, 19 bp, Homo sapiens
cccaggctgggcaaggagg

SEQ ID NO: 1839383 - DNA, 22 bp, Homo sapiens
cccaggcttagtcactgagaca

SEQ ID NO: 1839384 - DNA, 19 bp, Homo sapiens
cccagggtgggaagggcta

SEQ ID NO: 1839385 - DNA, 22 bp, Homo sapiens
cccagtacctcctgtctctggc

SEQ ID NO: 1839386 - DNA, 14 bp, Homo sapiens
cccagtgccctctc

SEQ ID NO: 1839387 - DNA, 15 bp, Homo sapiens
cccagtgccgagaag

SEQ ID NO: 1839388 - DNA, 18 bp, Homo sapiens
cccagtgccgagaaggaa

SEQ ID NO: 1839389 - DNA, 21 bp, Homo sapiens
cccatattaacaaattgcatt

SEQ ID NO: 1839390 - DNA, 20 bp, Homo sapiens
cccatcctctgtacagagcc

SEQ ID NO: 1839391 - DNA, 22 bp, Homo sapiens
cccatcctctgtacagagccca

SEQ ID NO: 1839392 - DNA, 22 bp, Homo sapiens
cccatcctgtgtgttaagctct

SEQ ID NO: 1839393 - DNA, 13 bp, Homo sapiens
cccatctcacaca

SEQ ID NO: 1839394 - DNA, 18 bp, Homo sapiens
cccatctcacacatgagc

SEQ ID NO: 1839395 - DNA, 15 bp, Homo sapiens
cccatgctgccctgt

SEQ ID NO: 1839396 - DNA, 17 bp, Homo sapiens
cccatgctgccctgtga

SEQ ID NO: 1839397 - DNA, 17 bp, Homo sapiens
cccatggccctcccagt

SEQ ID NO: 1839398 - DNA, 18 bp, Homo sapiens
cccattcattccattctg

SEQ ID NO: 1839399 - DNA, 21 bp, Homo sapiens
cccattcattccattctggaa

SEQ ID NO: 1839400 - DNA, 21 bp, Homo sapiens
cccattgttgtcaaggaagaa

SEQ ID NO: 1839401 - DNA, 18 bp, Homo sapiens
ccccaaaactctcctctg

SEQ ID NO: 1839402 - DNA, 23 bp, Homo sapiens
ccccaaaactctcctctgctgct

SEQ ID NO: 1839403 - DNA, 22 bp, Homo sapiens
ccccaaatggaaatgggcagag

SEQ ID NO: 1839404 - DNA, 20 bp, Homo sapiens
ccccacccaagggcctggcc

SEQ ID NO: 1839405 - DNA, 19 bp, Homo sapiens
ccccaccgcagacaggacc

SEQ ID NO: 1839406 - DNA, 13 bp, Homo sapiens
ccccaggaggcca

SEQ ID NO: 1839407 - DNA, 22 bp, Homo sapiens
ccccaggaggccagccttgacc

SEQ ID NO: 1839408 - DNA, 21 bp, Homo sapiens
ccccatcctctgtacagagcc

SEQ ID NO: 1839409 - DNA, 22 bp, Homo sapiens
ccccatcctctgtacagagccc

SEQ ID NO: 1839410 - DNA, 15 bp, Homo sapiens
cccccactggtgaca

SEQ ID NO: 1839411 - DNA, 15 bp, Homo sapiens
cccccagactctttt

SEQ ID NO: 1839412 - DNA, 12 bp, Homo sapiens
cccccagcccca

SEQ ID NO: 1839413 - DNA, 22 bp, Homo sapiens
ccccccagactctttttttgag

SEQ ID NO: 1839414 - DNA, 23 bp, Homo sapiens
ccccgacccttgccgtctacctg

SEQ ID NO: 1839415 - DNA, 12 bp, Homo sapiens
ccccgcccaggc

SEQ ID NO: 1839416 - DNA, 14 bp, Homo sapiens
ccccgcttctgcct

SEQ ID NO: 1839417 - DNA, 13 bp, Homo sapiens
ccccggggcctgt

SEQ ID NO: 1839418 - DNA, 16 bp, Homo sapiens
cccctcaacacctctg

SEQ ID NO: 1839419 - DNA, 20 bp, Homo sapiens
cccctcacagtattgctcac

SEQ ID NO: 1839420 - DNA, 17 bp, Homo sapiens
cccctccccccagactc

SEQ ID NO: 1839421 - DNA, 13 bp, Homo sapiens
cccctctcagaac

SEQ ID NO: 1839422 - DNA, 13 bp, Homo sapiens
cccctgcccctcc

SEQ ID NO: 1839423 - DNA, 15 bp, Homo sapiens
cccctgcctgccctg

SEQ ID NO: 1839424 - DNA, 17 bp, Homo sapiens
cccctgctgggtgtggc

SEQ ID NO: 1839425 - DNA, 20 bp, Homo sapiens
ccccttccatggactttgtt

SEQ ID NO: 1839426 - DNA, 17 bp, Homo sapiens
ccccttctgacccatgc

SEQ ID NO: 1839427 - DNA, 23 bp, Homo sapiens
cccgaatacaaacacctggactt

SEQ ID NO: 1839428 - DNA, 20 bp, Homo sapiens
cccgatgtcgacatgttttt

SEQ ID NO: 1839429 - DNA, 16 bp, Homo sapiens
cccgcagggccatgca

SEQ ID NO: 1839430 - DNA, 18 bp, Homo sapiens
cccgcagggccatgcaga

SEQ ID NO: 1839431 - DNA, 21 bp, Homo sapiens
cccgcagggccatgcagacct

SEQ ID NO: 1839432 - DNA, 23 bp, Homo sapiens
cccgctgatggagccccaccttg

SEQ ID NO: 1839433 - DNA, 23 bp, Homo sapiens
cccggaagccaaacctctgtgag

SEQ ID NO: 1839434 - DNA, 16 bp, Homo sapiens
cccggcagggtcctag

SEQ ID NO: 1839435 - DNA, 15 bp, Homo sapiens
cccgggctctgcctc

SEQ ID NO: 1839436 - DNA, 14 bp, Homo sapiens
ccctatctttgcca

SEQ ID NO: 1839437 - DNA, 16 bp, Homo sapiens
ccctatctttgccacc

SEQ ID NO: 1839438 - DNA, 21 bp, Homo sapiens
ccctatctttgccaccctcat

SEQ ID NO: 1839439 - DNA, 13 bp, Homo sapiens
ccctcacactggg

SEQ ID NO: 1839440 - DNA, 15 bp, Homo sapiens
ccctcagggtccctg

SEQ ID NO: 1839441 - DNA, 18 bp, Homo sapiens
ccctcagggtccctggtg

SEQ ID NO: 1839442 - DNA, 17 bp, Homo sapiens
ccctcatcctcataccc

SEQ ID NO: 1839443 - DNA, 20 bp, Homo sapiens
ccctcatcctcatacccacc

SEQ ID NO: 1839444 - DNA, 14 bp, Homo sapiens
ccctcccagttttc

SEQ ID NO: 1839445 - DNA, 13 bp, Homo sapiens
ccctccctctttc

SEQ ID NO: 1839446 - DNA, 23 bp, Homo sapiens
ccctccctctttccctcccttcc

SEQ ID NO: 1839447 - DNA, 16 bp, Homo sapiens
ccctcctcctggactc

SEQ ID NO: 1839448 - DNA, 22 bp, Homo sapiens
ccctcgaggcggatctttggac

SEQ ID NO: 1839449 - DNA, 11 bp, Homo sapiens
ccctctcagaa

SEQ ID NO: 1839450 - DNA, 14 bp, Homo sapiens
ccctctcagaacat

SEQ ID NO: 1839451 - DNA, 20 bp, Homo sapiens
ccctctcctccgtggcacat

SEQ ID NO: 1839452 - DNA, 11 bp, Homo sapiens
ccctctgccca

SEQ ID NO: 1839453 - DNA, 15 bp, Homo sapiens
ccctctgcccactcc

SEQ ID NO: 1839454 - DNA, 15 bp, Homo sapiens
ccctgaaagccctga

SEQ ID NO: 1839455 - DNA, 16 bp, Homo sapiens
ccctgaaagccctgag

SEQ ID NO: 1839456 - DNA, 16 bp, Homo sapiens
ccctgaaggccccgcc

SEQ ID NO: 1839457 - DNA, 20 bp, Homo sapiens
ccctgaaggccccgcccagg

SEQ ID NO: 1839458 - DNA, 16 bp, Homo sapiens
ccctgacaacactcat

SEQ ID NO: 1839459 - DNA, 17 bp, Homo sapiens
ccctgaggcccagaggg

SEQ ID NO: 1839460 - DNA, 18 bp, Homo sapiens
ccctgaggcccagagggc

SEQ ID NO: 1839461 - DNA, 17 bp, Homo sapiens
ccgccagctgccgcacc

SEQ ID NO: 1839462 - DNA, 16 bp, Homo sapiens
ccgccatgctcctggc

SEQ ID NO: 1839463 - DNA, 21 bp, Homo sapiens
ccgctaagagggagggagggc

SEQ ID NO: 1839464 - DNA, 15 bp, Homo sapiens
ccgctgattctcagg

SEQ ID NO: 1839465 - DNA, 15 bp, Homo sapiens
ccgcttctgcctgca

SEQ ID NO: 1839466 - DNA, 16 bp, Homo sapiens
ccggccacctgcggtg

SEQ ID NO: 1839467 - DNA, 18 bp, Homo sapiens
ccggccacctgcggtgct

SEQ ID NO: 1839468 - DNA, 22 bp, Homo sapiens
ccggccccctccccccagactc

SEQ ID NO: 1839469 - DNA, 17 bp, Homo sapiens
ccggctggcctggcccc

SEQ ID NO: 1839470 - DNA, 13 bp, Homo sapiens
ccgggctctgcct

SEQ ID NO: 1839471 - DNA, 15 bp, Homo sapiens
ccgggctctgcctcc

SEQ ID NO: 1839472 - DNA, 22 bp, Homo sapiens
ccgggctctgcctcccatcacc

SEQ ID NO: 1839473 - DNA, 14 bp, Homo sapiens
ccggggcagccccc

SEQ ID NO: 1839474 - DNA, 15 bp, Homo sapiens
ccgtctacctgaggg

SEQ ID NO: 1839475 - DNA, 13 bp, Homo sapiens
ccgtgggcctggg

SEQ ID NO: 1839476 - DNA, 13 bp, Homo sapiens
ccgttgtgagctg

SEQ ID NO: 1839477 - DNA, 14 bp, Homo sapiens
cctaagtctctgtg

SEQ ID NO: 1839478 - DNA, 13 bp, Homo sapiens
cctactgtgtctt

SEQ ID NO: 1839479 - DNA, 22 bp, Homo sapiens
cctagctgaatgtttttctaaa

SEQ ID NO: 1839480 - DNA, 22 bp, Homo sapiens
cctaggcaggacatgctgaagc

SEQ ID NO: 1839481 - DNA, 23 bp, Homo sapiens
cctagggaagggtggtggagcca

SEQ ID NO: 1839482 - DNA, 17 bp, Homo sapiens
cctagggccactgaaga

SEQ ID NO: 1839483 - DNA, 13 bp, Homo sapiens
cctagttccacca

SEQ ID NO: 1839484 - DNA, 21 bp, Homo sapiens
cctagttccaccatcaagcca

SEQ ID NO: 1839485 - DNA, 13 bp, Homo sapiens
cctatctttgcca

SEQ ID NO: 1839486 - DNA, 19 bp, Homo sapiens
cctatctttgccaccctca

SEQ ID NO: 1839487 - DNA, 20 bp, Homo sapiens
cctatctttgccaccctcat

SEQ ID NO: 1839488 - DNA, 16 bp, Homo sapiens
cctattagagaagaga

SEQ ID NO: 1839489 - DNA, 17 bp, Homo sapiens
cctcaaacactgcaggc

SEQ ID NO: 1839490 - DNA, 21 bp, Homo sapiens
cctcaaacactgcaggcatca

SEQ ID NO: 1839491 - DNA, 15 bp, Homo sapiens
cctcacactgggact

SEQ ID NO: 1839492 - DNA, 20 bp, Homo sapiens
cctcacagtccttaccagca

SEQ ID NO: 1839493 - DNA, 24 bp, Homo sapiens
cctcacagtccttaccagcagagc

SEQ ID NO: 1839494 - DNA, 21 bp, Homo sapiens
cctcagaacaaagtgagacag

SEQ ID NO: 1839495 - DNA, 12 bp, Homo sapiens
cctcaggcaggt

SEQ ID NO: 1839496 - DNA, 18 bp, Homo sapiens
cctcaggcaggtgggatg

SEQ ID NO: 1839497 - DNA, 20 bp, Homo sapiens
cctcagggtccctggtggca

SEQ ID NO: 1839498 - DNA, 22 bp, Homo sapiens
cctcaggtgagaagcagaggaa

SEQ ID NO: 1839499 - DNA, 16 bp, Homo sapiens
cctcatcaaggacacg

SEQ ID NO: 1839500 - DNA, 14 bp, Homo sapiens
cctcatgcccagct

SEQ ID NO: 1839501 - DNA, 17 bp, Homo sapiens
cctcatgcccagctctc

SEQ ID NO: 1839502 - DNA, 18 bp, Homo sapiens
cctcattagcattttgct

SEQ ID NO: 1839503 - DNA, 23 bp, Homo sapiens
cctcatttaaaacaagacttcag

SEQ ID NO: 1839504 - DNA, 17 bp, Homo sapiens
cctccaagaccttctcc

SEQ ID NO: 1839505 - DNA, 11 bp, Homo sapiens
cctccaggtgc

SEQ ID NO: 1839506 - DNA, 19 bp, Homo sapiens
cctccaggtgcacaagctc

SEQ ID NO: 1839507 - DNA, 21 bp, Homo sapiens
cctccaggtgcacaagctcca

SEQ ID NO: 1839508 - DNA, 23 bp, Homo sapiens
cctccagtccaaggaaaccacag

SEQ ID NO: 1839509 - DNA, 15 bp, Homo sapiens
cctccatgtgagaat

SEQ ID NO: 1839510 - DNA, 12 bp, Homo sapiens
cctcccatcacc

SEQ ID NO: 1839511 - DNA, 13 bp, Homo sapiens
cctcccatctcac

SEQ ID NO: 1839512 - DNA, 16 bp, Homo sapiens
cctcccatctcacaca

SEQ ID NO: 1839513 - DNA, 14 bp, Homo sapiens
cctccccccagact

SEQ ID NO: 1839514 - DNA, 15 bp, Homo sapiens
cctcccctcctcctg

SEQ ID NO: 1839515 - DNA, 20 bp, Homo sapiens
cctcccctggggacagcaag

SEQ ID NO: 1839516 - DNA, 23 bp, Homo sapiens
cctcccctggggacagcaagggc

SEQ ID NO: 1839517 - DNA, 13 bp, Homo sapiens
cctccctccctct

SEQ ID NO: 1839518 - DNA, 15 bp, Homo sapiens
cctccctccctcttt

SEQ ID NO: 1839519 - DNA, 13 bp, Homo sapiens
cctccctctttcc

SEQ ID NO: 1839520 - DNA, 13 bp, Homo sapiens
cctccgtggcaca

SEQ ID NO: 1839521 - DNA, 14 bp, Homo sapiens
cctccgtggcacat

SEQ ID NO: 1839522 - DNA, 18 bp, Homo sapiens
cctcctttgtgaggaagc

SEQ ID NO: 1839523 - DNA, 23 bp, Homo sapiens
cctcctttgtgaggaagccgctg

SEQ ID NO: 1839524 - DNA, 18 bp, Homo sapiens
cctcggtgtggagaagcg

SEQ ID NO: 1839525 - DNA, 18 bp, Homo sapiens
cctctcccctgcctgccc

SEQ ID NO: 1839526 - DNA, 22 bp, Homo sapiens
cctctcccttggattgtccccg

SEQ ID NO: 1839527 - DNA, 14 bp, Homo sapiens
cctctctcactcct

SEQ ID NO: 1839528 - DNA, 23 bp, Homo sapiens
cctctgaaaaccaatgttctctc

SEQ ID NO: 1839529 - DNA, 17 bp, Homo sapiens
cctctgcacaagctgca

SEQ ID NO: 1839530 - DNA, 19 bp, Homo sapiens
cctctgcacaagctgcacc

SEQ ID NO: 1839531 - DNA, 16 bp, Homo sapiens
cctctgctgctggctg

SEQ ID NO: 1839532 - DNA, 20 bp, Homo sapiens
cctctgggtctcagtgtcct

SEQ ID NO: 1839533 - DNA, 22 bp, Homo sapiens
cctctgggtctcagtgtcctca

SEQ ID NO: 1839534 - DNA, 15 bp, Homo sapiens
cctctgtacagagcc

SEQ ID NO: 1839535 - DNA, 10 bp, Homo sapiens
cctctgtcta

SEQ ID NO: 1839536 - DNA, 19 bp, Homo sapiens
cctctgttgccaaggctgg

SEQ ID NO: 1839537 - DNA, 15 bp, Homo sapiens
cctcttatgggctgg

SEQ ID NO: 1839538 - DNA, 16 bp, Homo sapiens
cctcttccgaatgggt

SEQ ID NO: 1839539 - DNA, 13 bp, Homo sapiens
cctctttccctcc

SEQ ID NO: 1839540 - DNA, 22 bp, Homo sapiens
cctctttggtctacactgtgct

SEQ ID NO: 1839541 - DNA, 21 bp, Homo sapiens
cctgaaaaaaaacctgagatt

SEQ ID NO: 1839542 - DNA, 13 bp, Homo sapiens
cctgaaagccctg

SEQ ID NO: 1839543 - DNA, 20 bp, Homo sapiens
cctgaaggccccgcccaggc

SEQ ID NO: 1839544 - DNA, 14 bp, Homo sapiens
cctgacaacactca

SEQ ID NO: 1839545 - DNA, 18 bp, Homo sapiens
cctgagatgggcttccca

SEQ ID NO: 1839546 - DNA, 14 bp, Homo sapiens
cctgagatttatta

SEQ ID NO: 1839547 - DNA, 15 bp, Homo sapiens
cctgagatttattaa

SEQ ID NO: 1839548 - DNA, 12 bp, Homo sapiens
cctgagctggga

SEQ ID NO: 1839549 - DNA, 15 bp, Homo sapiens
cctgagctgggatga

SEQ ID NO: 1839550 - DNA, 16 bp, Homo sapiens
ctccagtccaaggaaa

SEQ ID NO: 1839551 - DNA, 23 bp, Homo sapiens
ctccattttttcttcccttttcc

SEQ ID NO: 1839552 - DNA, 15 bp, Homo sapiens
ctcccaactcacccc

SEQ ID NO: 1839553 - DNA, 16 bp, Homo sapiens
ctcccaactcacccca

SEQ ID NO: 1839554 - DNA, 15 bp, Homo sapiens
ctcccacaaaggaga

SEQ ID NO: 1839555 - DNA, 15 bp, Homo sapiens
ctcccaggcattccc

SEQ ID NO: 1839556 - DNA, 20 bp, Homo sapiens
ctcccaggcattccccagga

SEQ ID NO: 1839557 - DNA, 14 bp, Homo sapiens
ctcccatcacccgc

SEQ ID NO: 1839558 - DNA, 13 bp, Homo sapiens
ctcccatcctgtg

SEQ ID NO: 1839559 - DNA, 15 bp, Homo sapiens
ctcccatcctgtgtg

SEQ ID NO: 1839560 - DNA, 19 bp, Homo sapiens
ctcccatcctgtgtgttaa

SEQ ID NO: 1839561 - DNA, 18 bp, Homo sapiens
ctcccatctcacacatga

SEQ ID NO: 1839562 - DNA, 14 bp, Homo sapiens
ctcccatctgtgaa

SEQ ID NO: 1839563 - DNA, 18 bp, Homo sapiens
ctcccatctgtgaaagga

SEQ ID NO: 1839564 - DNA, 18 bp, Homo sapiens
ctccccacagtgccaccc

SEQ ID NO: 1839565 - DNA, 14 bp, Homo sapiens
ctccccaggccacc

SEQ ID NO: 1839566 - DNA, 22 bp, Homo sapiens
ctccccaggccaccccgctgat

SEQ ID NO: 1839567 - DNA, 15 bp, Homo sapiens
ctcccccagccccat

SEQ ID NO: 1839568 - DNA, 14 bp, Homo sapiens
ctccccgcttctgc

SEQ ID NO: 1839569 - DNA, 13 bp, Homo sapiens
ctcccctgctggg

SEQ ID NO: 1839570 - DNA, 14 bp, Homo sapiens
ctcccctgctgggt

SEQ ID NO: 1839571 - DNA, 21 bp, Homo sapiens
ctcccctgctgggtgtggcgc

SEQ ID NO: 1839572 - DNA, 13 bp, Homo sapiens
ctccctcaactga

SEQ ID NO: 1839573 - DNA, 22 bp, Homo sapiens
ctccctcatttcaggagcagcc

SEQ ID NO: 1839574 - DNA, 18 bp, Homo sapiens
ctccctcccctctcagaa

SEQ ID NO: 1839575 - DNA, 15 bp, Homo sapiens
ctccctctttccctc

SEQ ID NO: 1839576 - DNA, 18 bp, Homo sapiens
ctccctggttctgatgat

SEQ ID NO: 1839577 - DNA, 14 bp, Homo sapiens
ctcccttcccacct

SEQ ID NO: 1839578 - DNA, 10 bp, Homo sapiens
ctcccttcct

SEQ ID NO: 1839579 - DNA, 13 bp, Homo sapiens
ctccgtggcacat

SEQ ID NO: 1839580 - DNA, 21 bp, Homo sapiens
ctcctcacaacatggtgtctg

SEQ ID NO: 1839581 - DNA, 16 bp, Homo sapiens
ctcctccgtggcacat

SEQ ID NO: 1839582 - DNA, 14 bp, Homo sapiens
ctcctcctggactc

SEQ ID NO: 1839583 - DNA, 19 bp, Homo sapiens
ctcctcctggactcctgca

SEQ ID NO: 1839584 - DNA, 16 bp, Homo sapiens
ctcctgagtgcttgct

SEQ ID NO: 1839585 - DNA, 12 bp, Homo sapiens
ctcctgcaggca

SEQ ID NO: 1839586 - DNA, 13 bp, Homo sapiens
ctcctgcaggcag

SEQ ID NO: 1839587 - DNA, 16 bp, Homo sapiens
ctcctgcaggcagcca

SEQ ID NO: 1839588 - DNA, 17 bp, Homo sapiens
ctcctgcaggcagccag

SEQ ID NO: 1839589 - DNA, 15 bp, Homo sapiens
ctcctggactcctgc

SEQ ID NO: 1839590 - DNA, 19 bp, Homo sapiens
ctccttcacctttgtcccc

SEQ ID NO: 1839591 - DNA, 18 bp, Homo sapiens
ctcctttgtgaggaagcc

SEQ ID NO: 1839592 - DNA, 13 bp, Homo sapiens
ctcgtttgtgttc

SEQ ID NO: 1839593 - DNA, 19 bp, Homo sapiens
ctcgtttgtgttctgtttt

SEQ ID NO: 1839594 - DNA, 20 bp, Homo sapiens
ctctaccatcccctgtagag

SEQ ID NO: 1839595 - DNA, 13 bp, Homo sapiens
ctctaggctgggg

SEQ ID NO: 1839596 - DNA, 15 bp, Homo sapiens
ctctaggctggggaa

SEQ ID NO: 1839597 - DNA, 23 bp, Homo sapiens
ctctagggaaaaaccagcgtgtg

SEQ ID NO: 1839598 - DNA, 15 bp, Homo sapiens
ctctcactccttgaa

SEQ ID NO: 1839599 - DNA, 12 bp, Homo sapiens
ctctcagaacat

SEQ ID NO: 1839600 - DNA, 21 bp, Homo sapiens
ctctcagcccctgatcctgtg

SEQ ID NO: 1839601 - DNA, 14 bp, Homo sapiens
ctctccagcccctg

SEQ ID NO: 1839602 - DNA, 17 bp, Homo sapiens
ctctccagcccctggat

SEQ ID NO: 1839603 - DNA, 16 bp, Homo sapiens
ctctcccctgcctgcc

SEQ ID NO: 1839604 - DNA, 20 bp, Homo sapiens
ctctcctccccaaggagaca

SEQ ID NO: 1839605 - DNA, 13 bp, Homo sapiens
ctctcctccgtgg

SEQ ID NO: 1839606 - DNA, 18 bp, Homo sapiens
ctctcctccgtggcacat

SEQ ID NO: 1839607 - DNA, 13 bp, Homo sapiens
ctctcctctgctg

SEQ ID NO: 1839608 - DNA, 14 bp, Homo sapiens
ctctcctctgctgc

SEQ ID NO: 1839609 - DNA, 15 bp, Homo sapiens
ctctctcactccttg

SEQ ID NO: 1839610 - DNA, 16 bp, Homo sapiens
ctctctcactccttga

SEQ ID NO: 1839611 - DNA, 21 bp, Homo sapiens
ctctgacaacagacttctgaa

SEQ ID NO: 1839612 - DNA, 14 bp, Homo sapiens
ctctgacgcttgtg

SEQ ID NO: 1839613 - DNA, 18 bp, Homo sapiens
ctctgacgcttgtgacag

SEQ ID NO: 1839614 - DNA, 17 bp, Homo sapiens
ctctgatgaagaggagt

SEQ ID NO: 1839615 - DNA, 20 bp, Homo sapiens
ctctgcacaagctgcaccct

SEQ ID NO: 1839616 - DNA, 17 bp, Homo sapiens
ctctgcactcccctgct

SEQ ID NO: 1839617 - DNA, 21 bp, Homo sapiens
ctctgcactcccctgctgggt

SEQ ID NO: 1839618 - DNA, 15 bp, Homo sapiens
ctctgcccactccct

SEQ ID NO: 1839619 - DNA, 18 bp, Homo sapiens
ctctgcccactccctgca

SEQ ID NO: 1839620 - DNA, 14 bp, Homo sapiens
ctctgccctccaag

SEQ ID NO: 1839621 - DNA, 13 bp, Homo sapiens
ctctgcctcccat

SEQ ID NO: 1839622 - DNA, 16 bp, Homo sapiens
ctctgcctcccatcac

SEQ ID NO: 1839623 - DNA, 17 bp, Homo sapiens
ctctgcctcccatcacc

SEQ ID NO: 1839624 - DNA, 21 bp, Homo sapiens
ctctgctgccgccccacccag

SEQ ID NO: 1839625 - DNA, 14 bp, Homo sapiens
ctctgctgctggct

SEQ ID NO: 1839626 - DNA, 16 bp, Homo sapiens
ctctgctgctggctgg

SEQ ID NO: 1839627 - DNA, 19 bp, Homo sapiens
ctgcctctacccaaccagg

SEQ ID NO: 1839628 - DNA, 13 bp, Homo sapiens
ctgcctcttctct

SEQ ID NO: 1839629 - DNA, 15 bp, Homo sapiens
ctgcctcttctctac

SEQ ID NO: 1839630 - DNA, 13 bp, Homo sapiens
ctgcctgctccca

SEQ ID NO: 1839631 - DNA, 21 bp, Homo sapiens
ctgcctgggatccctcatcct

SEQ ID NO: 1839632 - DNA, 18 bp, Homo sapiens
ctgcggtgctatctcccc

SEQ ID NO: 1839633 - DNA, 20 bp, Homo sapiens
ctgcggtgctatctccccca

SEQ ID NO: 1839634 - DNA, 23 bp, Homo sapiens
ctgcggtgctatctcccccagcc

SEQ ID NO: 1839635 - DNA, 16 bp, Homo sapiens
ctgctaatattttcct

SEQ ID NO: 1839636 - DNA, 17 bp, Homo sapiens
ctgctatcaaagaggtt

SEQ ID NO: 1839637 - DNA, 20 bp, Homo sapiens
ctgctatgtatttgcaaggc

SEQ ID NO: 1839638 - DNA, 18 bp, Homo sapiens
ctgctattaggccagcaa

SEQ ID NO: 1839639 - DNA, 21 bp, Homo sapiens
ctgctattaggccagcaagcg

SEQ ID NO: 1839640 - DNA, 15 bp, Homo sapiens
ctgctccagctgttc

SEQ ID NO: 1839641 - DNA, 14 bp, Homo sapiens
ctgctcccatcctg

SEQ ID NO: 1839642 - DNA, 12 bp, Homo sapiens
ctgctctgatga

SEQ ID NO: 1839643 - DNA, 11 bp, Homo sapiens
ctgctgaaggc

SEQ ID NO: 1839644 - DNA, 18 bp, Homo sapiens
ctgctgactgttttctct

SEQ ID NO: 1839645 - DNA, 19 bp, Homo sapiens
ctgctgaggcccagtgcat

SEQ ID NO: 1839646 - DNA, 20 bp, Homo sapiens
ctgctgaggcccagtgcata

SEQ ID NO: 1839647 - DNA, 22 bp, Homo sapiens
ctgctgaggcccagtgcatatg

SEQ ID NO: 1839648 - DNA, 14 bp, Homo sapiens
ctgctgctgctgtg

SEQ ID NO: 1839649 - DNA, 14 bp, Homo sapiens
ctgctgctggctgg

SEQ ID NO: 1839650 - DNA, 20 bp, Homo sapiens
ctgcttccagtgaggctctg

SEQ ID NO: 1839651 - DNA, 20 bp, Homo sapiens
ctgcttgaggcaactcatct

SEQ ID NO: 1839652 - DNA, 13 bp, Homo sapiens
ctgcttgtttcct

SEQ ID NO: 1839653 - DNA, 21 bp, Homo sapiens
ctggaacagattcacactgtc

SEQ ID NO: 1839654 - DNA, 20 bp, Homo sapiens
ctggaacatcatcaaggcac

SEQ ID NO: 1839655 - DNA, 15 bp, Homo sapiens
ctggaaccatcagaa

SEQ ID NO: 1839656 - DNA, 15 bp, Homo sapiens
ctggaccctgtggat

SEQ ID NO: 1839657 - DNA, 19 bp, Homo sapiens
ctggagactcctaggcagg

SEQ ID NO: 1839658 - DNA, 15 bp, Homo sapiens
ctggagcctggtgcc

SEQ ID NO: 1839659 - DNA, 16 bp, Homo sapiens
ctggagcctggtgccc

SEQ ID NO: 1839660 - DNA, 14 bp, Homo sapiens
ctggatagacttgg

SEQ ID NO: 1839661 - DNA, 22 bp, Homo sapiens
ctggatagacttgggatgggga

SEQ ID NO: 1839662 - DNA, 13 bp, Homo sapiens
ctggattcccagg

SEQ ID NO: 1839663 - DNA, 13 bp, Homo sapiens
ctggattttgtca

SEQ ID NO: 1839664 - DNA, 16 bp, Homo sapiens
ctggcaaggacacaga

SEQ ID NO: 1839665 - DNA, 15 bp, Homo sapiens
ctggcactgcttcca

SEQ ID NO: 1839666 - DNA, 21 bp, Homo sapiens
ctggcactggatgcagaaaca

SEQ ID NO: 1839667 - DNA, 11 bp, Homo sapiens
ctggcagccca

SEQ ID NO: 1839668 - DNA, 13 bp, Homo sapiens
ctggcagctcaga

SEQ ID NO: 1839669 - DNA, 19 bp, Homo sapiens
ctggcagctcagagagggt

SEQ ID NO: 1839670 - DNA, 15 bp, Homo sapiens
ctggcccactgcatc

SEQ ID NO: 1839671 - DNA, 18 bp, Homo sapiens
ctggcccctcagggtccc

SEQ ID NO: 1839672 - DNA, 23 bp, Homo sapiens
ctggccgttgatgttggctggga

SEQ ID NO: 1839673 - DNA, 20 bp, Homo sapiens
ctggcctctgcactcccctg

SEQ ID NO: 1839674 - DNA, 21 bp, Homo sapiens
ctggcctctgcactcccctgc

SEQ ID NO: 1839675 - DNA, 13 bp, Homo sapiens
ctggcctgagctg

SEQ ID NO: 1839676 - DNA, 15 bp, Homo sapiens
ctggcctgagctggg

SEQ ID NO: 1839677 - DNA, 13 bp, Homo sapiens
ctggcctgctgga

SEQ ID NO: 1839678 - DNA, 17 bp, Homo sapiens
ctggccttccacttggc

SEQ ID NO: 1839679 - DNA, 14 bp, Homo sapiens
ctggcctttcatat

SEQ ID NO: 1839680 - DNA, 14 bp, Homo sapiens
ctgtcttggctgtg

SEQ ID NO: 1839681 - DNA, 15 bp, Homo sapiens
ctgtgaagagaacca

SEQ ID NO: 1839682 - DNA, 16 bp, Homo sapiens
ctgtgacaggcagcag

SEQ ID NO: 1839683 - DNA, 23 bp, Homo sapiens
ctgtgagtactacagtcctccca

SEQ ID NO: 1839684 - DNA, 16 bp, Homo sapiens
ctgtgatggggccctg

SEQ ID NO: 1839685 - DNA, 17 bp, Homo sapiens
ctgtgcacgcagtggcc

SEQ ID NO: 1839686 - DNA, 22 bp, Homo sapiens
ctgtgccattttgtattttact

SEQ ID NO: 1839687 - DNA, 14 bp, Homo sapiens
ctgtgctgagtctg

SEQ ID NO: 1839688 - DNA, 20 bp, Homo sapiens
ctgtgctgagtctgaaggct

SEQ ID NO: 1839689 - DNA, 13 bp, Homo sapiens
ctgtgctgccctg

SEQ ID NO: 1839690 - DNA, 14 bp, Homo sapiens
ctgtgctgccctgc

SEQ ID NO: 1839691 - DNA, 18 bp, Homo sapiens
ctgtgctgccctgcccac

SEQ ID NO: 1839692 - DNA, 19 bp, Homo sapiens
ctgtggcctgatcagcagg

SEQ ID NO: 1839693 - DNA, 22 bp, Homo sapiens
ctgtggggctaggggctggggc

SEQ ID NO: 1839694 - DNA, 17 bp, Homo sapiens
ctgtgtaaaaagagagc

SEQ ID NO: 1839695 - DNA, 20 bp, Homo sapiens
ctgtgtcagcatagaagtaa

SEQ ID NO: 1839696 - DNA, 20 bp, Homo sapiens
ctgtgtgttaagctctgcta

SEQ ID NO: 1839697 - DNA, 13 bp, Homo sapiens
ctgttactgtctt

SEQ ID NO: 1839698 - DNA, 17 bp, Homo sapiens
ctgttactgtcttcagt

SEQ ID NO: 1839699 - DNA, 14 bp, Homo sapiens
ctgttatttataat

SEQ ID NO: 1839700 - DNA, 21 bp, Homo sapiens
ctgttcaagagcacacttggc

SEQ ID NO: 1839701 - DNA, 13 bp, Homo sapiens
ctgttcttagctc

SEQ ID NO: 1839702 - DNA, 17 bp, Homo sapiens
ctgttgaatttcccaca

SEQ ID NO: 1839703 - DNA, 23 bp, Homo sapiens
ctgtttggaggagcaaaggctga

SEQ ID NO: 1839704 - DNA, 18 bp, Homo sapiens
ctgtttgtttctgaaagg

SEQ ID NO: 1839705 - DNA, 23 bp, Homo sapiens
ctgtttgtttctgaaagggacgc

SEQ ID NO: 1839706 - DNA, 12 bp, Homo sapiens
ctgttttatgac

SEQ ID NO: 1839707 - DNA, 14 bp, Homo sapiens
ctgttttatgactt

SEQ ID NO: 1839708 - DNA, 16 bp, Homo sapiens
ctgttttatgacttca

SEQ ID NO: 1839709 - DNA, 13 bp, Homo sapiens
ctgttttctgaaa

SEQ ID NO: 1839710 - DNA, 15 bp, Homo sapiens
ctgttttgtgagaac

SEQ ID NO: 1839711 - DNA, 16 bp, Homo sapiens
cttaaaaagtggaaaa

SEQ ID NO: 1839712 - DNA, 22 bp, Homo sapiens
cttaaataataaagatcatgta

SEQ ID NO: 1839713 - DNA, 14 bp, Homo sapiens
cttaagtgagcaga

SEQ ID NO: 1839714 - DNA, 17 bp, Homo sapiens
cttaagtgagcagaaca

SEQ ID NO: 1839715 - DNA, 20 bp, Homo sapiens
cttaatagaaacattgaaga

SEQ ID NO: 1839716 - DNA, 14 bp, Homo sapiens
cttaattctttgtt

SEQ ID NO: 1839717 - DNA, 15 bp, Homo sapiens
cttaattctttgttc

SEQ ID NO: 1839718 - DNA, 14 bp, Homo sapiens
cttacagctgggtg

SEQ ID NO: 1839719 - DNA, 11 bp, Homo sapiens
cttagacagtc

SEQ ID NO: 1839720 - DNA, 14 bp, Homo sapiens
cttagacagtccct

SEQ ID NO: 1839721 - DNA, 15 bp, Homo sapiens
cttagacagtccctg

SEQ ID NO: 1839722 - DNA, 16 bp, Homo sapiens
cttagacagtccctgc

SEQ ID NO: 1839723 - DNA, 19 bp, Homo sapiens
cttagagcagtttctgtcc

SEQ ID NO: 1839724 - DNA, 18 bp, Homo sapiens
cttagcagtccccttccc

SEQ ID NO: 1839725 - DNA, 16 bp, Homo sapiens
cttagctcaatgagca

SEQ ID NO: 1839726 - DNA, 18 bp, Homo sapiens
cttagctcaatgagcatg

SEQ ID NO: 1839727 - DNA, 19 bp, Homo sapiens
cttagctcaatgagcatgt

SEQ ID NO: 1839728 - DNA, 22 bp, Homo sapiens
cttagctcaatgagcatgttta

SEQ ID NO: 1839729 - DNA, 18 bp, Homo sapiens
cttagtcactgagacagc

SEQ ID NO: 1839730 - DNA, 11 bp, Homo sapiens
cttatgaaaag

SEQ ID NO: 1839731 - DNA, 16 bp, Homo sapiens
cttatggatgtcccca

SEQ ID NO: 1839732 - DNA, 21 bp, Homo sapiens
cttatggatgtccccagcaga

SEQ ID NO: 1839733 - DNA, 17 bp, Homo sapiens
cttcaaagcaaatgtct

SEQ ID NO: 1839734 - DNA, 15 bp, Homo sapiens
cttcacggaagagcc

SEQ ID NO: 1839735 - DNA, 19 bp, Homo sapiens
cttcacggaagagccttgc

SEQ ID NO: 1839736 - DNA, 22 bp, Homo sapiens
cttcagagactcctgcaggcag

SEQ ID NO: 1839737 - DNA, 24 bp, Homo sapiens
cttcagagactcctgcaggcagcc

SEQ ID NO: 1839738 - DNA, 18 bp, Homo sapiens
cttcagagctgacacagg

SEQ ID NO: 1839739 - DNA, 11 bp, Homo sapiens
cttcagctgac

SEQ ID NO: 1839740 - DNA, 14 bp, Homo sapiens
cttcagtaagccgt

SEQ ID NO: 1839741 - DNA, 15 bp, Homo sapiens
cttcatctggaacca

SEQ ID NO: 1839742 - DNA, 19 bp, Homo sapiens
cttccaggctgggagagcc

SEQ ID NO: 1839743 - DNA, 21 bp, Homo sapiens
cttccaggggtgggacaccct

SEQ ID NO: 1839744 - DNA, 14 bp, Homo sapiens
cttccagtgaacat

SEQ ID NO: 1839745 - DNA, 21 bp, Homo sapiens
cttccagtgaacattcccagc

SEQ ID NO: 1839746 - DNA, 15 bp, Homo sapiens
cttccagtgaggctc

SEQ ID NO: 1839747 - DNA, 20 bp, Homo sapiens
cttcccataccacccaatgc

SEQ ID NO: 1839748 - DNA, 21 bp, Homo sapiens
cttcccatgacccaggctggg

SEQ ID NO: 1839749 - DNA, 16 bp, Homo sapiens
cttccctatctttgcc

SEQ ID NO: 1839750 - DNA, 22 bp, Homo sapiens
cttcctctgaggctgaaattca

SEQ ID NO: 1839751 - DNA, 22 bp, Homo sapiens
cttcctctttccatctaccctc

SEQ ID NO: 1839752 - DNA, 22 bp, Homo sapiens
cttcctgccagcccctgccatt

SEQ ID NO: 1839753 - DNA, 20 bp, Homo sapiens
cttcgggaggtcgaggcagg

SEQ ID NO: 1839754 - DNA, 22 bp, Homo sapiens
cttctaggtggcaaggctgtgc

SEQ ID NO: 1839755 - DNA, 22 bp, Homo sapiens
cttctatttatttatttattca

SEQ ID NO: 1839756 - DNA, 16 bp, Homo sapiens
cttctcactgccatgc

SEQ ID NO: 1839757 - DNA, 16 bp, Homo sapiens
cttctccccagagttc

SEQ ID NO: 1839758 - DNA, 23 bp, Homo sapiens
cttctgacccatgctgccctgtg

SEQ ID NO: 1839759 - DNA, 18 bp, Homo sapiens
cttctgagcagcgagcct

SEQ ID NO: 1839760 - DNA, 20 bp, Homo sapiens
cttctgagcagcgagcctgc

SEQ ID NO: 1839761 - DNA, 21 bp, Homo sapiens
cttctgagcagcgagcctgct

SEQ ID NO: 1839762 - DNA, 12 bp, Homo sapiens
cttctgcctgca

SEQ ID NO: 1839763 - DNA, 19 bp, Homo sapiens
cttctgggttcaagcgatt

SEQ ID NO: 1839764 - DNA, 23 bp, Homo sapiens
cttcttcagagactcctgcaggc

SEQ ID NO: 1839765 - DNA, 19 bp, Homo sapiens
cttctttgctttgcccagc

SEQ ID NO: 1839766 - DNA, 14 bp, Homo sapiens
cttgaaaacactgt

SEQ ID NO: 1839767 - DNA, 17 bp, Homo sapiens
cttgaccaggcctgggc

SEQ ID NO: 1839768 - DNA, 13 bp, Homo sapiens
cttgagctcagga

SEQ ID NO: 1839769 - DNA, 22 bp, Homo sapiens
cttgaggacttgggcgggacac

SEQ ID NO: 1839770 - DNA, 17 bp, Homo sapiens
cttgaggattgtggaaa

SEQ ID NO: 1839771 - DNA, 18 bp, Homo sapiens
cttgagttgattcagctc

SEQ ID NO: 1839772 - DNA, 19 bp, Homo sapiens
cttgagttgattcagctct

SEQ ID NO: 1839773 - DNA, 21 bp, Homo sapiens
cttgagttgattcagctctgc

SEQ ID NO: 1839774 - DNA, 13 bp, Homo sapiens
cttgcagcaggat

SEQ ID NO: 1839775 - DNA, 18 bp, Homo sapiens
cttgccgtctacctgagg

SEQ ID NO: 1839776 - DNA, 19 bp, Homo sapiens
cttgccgtctacctgaggg

SEQ ID NO: 1839777 - DNA, 23 bp, Homo sapiens
cttgccgtctacctgaggggcct

SEQ ID NO: 1839778 - DNA, 15 bp, Homo sapiens
cttgctccagattct

SEQ ID NO: 1839779 - DNA, 21 bp, Homo sapiens
cttgctccagattctgatgca

SEQ ID NO: 1839780 - DNA, 18 bp, Homo sapiens
cttgcttttcatgcaaac

SEQ ID NO: 1839781 - DNA, 16 bp, Homo sapiens
cttggacattttatgt

SEQ ID NO: 1839782 - DNA, 18 bp, Homo sapiens
cttggacattttatgtct

SEQ ID NO: 1839783 - DNA, 18 bp, Homo sapiens
cttggattgtccccgacc

SEQ ID NO: 1839784 - DNA, 20 bp, Homo sapiens
cttggattgtccccgaccct

SEQ ID NO: 1839785 - DNA, 23 bp, Homo sapiens
cttggattgtccccgacccttgc

SEQ ID NO: 1839786 - DNA, 24 bp, Homo sapiens
cttggattgtccccgacccttgcc

SEQ ID NO: 1839787 - DNA, 16 bp, Homo sapiens
cttggctggtgcacct

SEQ ID NO: 1839788 - DNA, 16 bp, Homo sapiens
cttggctgtggggcta

SEQ ID NO: 1839789 - DNA, 18 bp, Homo sapiens
cttgggccactgtgaaga

SEQ ID NO: 1839790 - DNA, 20 bp, Homo sapiens
cttgggccactgtgaagaga

SEQ ID NO: 1839791 - DNA, 16 bp, Homo sapiens
cttggggggctgaggt

SEQ ID NO: 1839792 - DNA, 22 bp, Homo sapiens
cttggtcctgctgcagttgcca

SEQ ID NO: 1839793 - DNA, 16 bp, Homo sapiens
cttggttggctggcct

SEQ ID NO: 1839794 - DNA, 21 bp, Homo sapiens
cttgtcaggagtgtgtgtgag

SEQ ID NO: 1839795 - DNA, 21 bp, Homo sapiens
cttgtctttggaccctgaggc

SEQ ID NO: 1839796 - DNA, 17 bp, Homo sapiens
cttgtgacagtgcctct

SEQ ID NO: 1839797 - DNA, 15 bp, Homo sapiens
cttgtggtcccaccc

SEQ ID NO: 1839798 - DNA, 16 bp, Homo sapiens
cttgtggtcccacccc

SEQ ID NO: 1839799 - DNA, 22 bp, Homo sapiens
cttgttagaagaggtggcccca

SEQ ID NO: 1839800 - DNA, 16 bp, Homo sapiens
cttgtttaatggtagt

SEQ ID NO: 1839801 - DNA, 18 bp, Homo sapiens
gatcaaggagaggaggca

SEQ ID NO: 1839802 - DNA, 13 bp, Homo sapiens
gatcacagtggcc

SEQ ID NO: 1839803 - DNA, 16 bp, Homo sapiens
gatcctcccaggcttc

SEQ ID NO: 1839804 - DNA, 12 bp, Homo sapiens
gatcctgtgaag

SEQ ID NO: 1839805 - DNA, 13 bp, Homo sapiens
gatcggcaggaca

SEQ ID NO: 1839806 - DNA, 19 bp, Homo sapiens
gatcggcaggacaccctga

SEQ ID NO: 1839807 - DNA, 14 bp, Homo sapiens
gatctaggaagact

SEQ ID NO: 1839808 - DNA, 15 bp, Homo sapiens
gatctccctgagatg

SEQ ID NO: 1839809 - DNA, 16 bp, Homo sapiens
gatctcttgagcctgg

SEQ ID NO: 1839810 - DNA, 17 bp, Homo sapiens
gatctcttgagcctggg

SEQ ID NO: 1839811 - DNA, 21 bp, Homo sapiens
gatctgctgaggcccagtgca

SEQ ID NO: 1839812 - DNA, 13 bp, Homo sapiens
gatctttggacag

SEQ ID NO: 1839813 - DNA, 21 bp, Homo sapiens
gatctttggacagaagcagct

SEQ ID NO: 1839814 - DNA, 19 bp, Homo sapiens
gatgaaatcttacagctgg

SEQ ID NO: 1839815 - DNA, 20 bp, Homo sapiens
gatgaaccctggcatttggc

SEQ ID NO: 1839816 - DNA, 16 bp, Homo sapiens
gatgagcatggagctg

SEQ ID NO: 1839817 - DNA, 15 bp, Homo sapiens
gatgatctaggaaga

SEQ ID NO: 1839818 - DNA, 15 bp, Homo sapiens
gatgatgtgcctggg

SEQ ID NO: 1839819 - DNA, 15 bp, Homo sapiens
gatgcacatccctgg

SEQ ID NO: 1839820 - DNA, 21 bp, Homo sapiens
gatgcattcttggttggctgg

SEQ ID NO: 1839821 - DNA, 22 bp, Homo sapiens
gatgcctgattgccaagctcag

SEQ ID NO: 1839822 - DNA, 16 bp, Homo sapiens
gatgctgacatcattt

SEQ ID NO: 1839823 - DNA, 21 bp, Homo sapiens
gatgcttcttcagagactcct

SEQ ID NO: 1839824 - DNA, 18 bp, Homo sapiens
gatggagccccaccttgt

SEQ ID NO: 1839825 - DNA, 15 bp, Homo sapiens
gatggcaggatggcc

SEQ ID NO: 1839826 - DNA, 18 bp, Homo sapiens
gatggcaggatggcctgg

SEQ ID NO: 1839827 - DNA, 24 bp, Homo sapiens
gatggcatttggtctcaggcagca

SEQ ID NO: 1839828 - DNA, 22 bp, Homo sapiens
gatggccgggcgcggtggctca

SEQ ID NO: 1839829 - DNA, 15 bp, Homo sapiens
gatggggctgcaccg

SEQ ID NO: 1839830 - DNA, 17 bp, Homo sapiens
gatgggggaaagcacag

SEQ ID NO: 1839831 - DNA, 20 bp, Homo sapiens
gatgtatgttgaagcctttg

SEQ ID NO: 1839832 - DNA, 13 bp, Homo sapiens
gatgtgcctgggt

SEQ ID NO: 1839833 - DNA, 20 bp, Homo sapiens
gatgtgcttgttaactgagt

SEQ ID NO: 1839834 - DNA, 15 bp, Homo sapiens
gatgttatgaacagc

SEQ ID NO: 1839835 - DNA, 23 bp, Homo sapiens
gatgttatgaacagctgtgtctg

SEQ ID NO: 1839836 - DNA, 12 bp, Homo sapiens
gattcagacagc

SEQ ID NO: 1839837 - DNA, 16 bp, Homo sapiens
gattccccactcagcc

SEQ ID NO: 1839838 - DNA, 17 bp, Homo sapiens
gattccccactcagcct

SEQ ID NO: 1839839 - DNA, 12 bp, Homo sapiens
gattctcagggt

SEQ ID NO: 1839840 - DNA, 17 bp, Homo sapiens
gattctcagggtctctg

SEQ ID NO: 1839841 - DNA, 22 bp, Homo sapiens
gattctcagggtctctgctgcc

SEQ ID NO: 1839842 - DNA, 15 bp, Homo sapiens
gattctgatgcatac

SEQ ID NO: 1839843 - DNA, 12 bp, Homo sapiens
gattctttcctg

SEQ ID NO: 1839844 - DNA, 17 bp, Homo sapiens
gattctttcctgaggct

SEQ ID NO: 1839845 - DNA, 19 bp, Homo sapiens
gattctttcctgaggctgg

SEQ ID NO: 1839846 - DNA, 22 bp, Homo sapiens
gattggagatagggaaagaaag

SEQ ID NO: 1839847 - DNA, 13 bp, Homo sapiens
gattgggacagag

SEQ ID NO: 1839848 - DNA, 12 bp, Homo sapiens
gatttaaatcag

SEQ ID NO: 1839849 - DNA, 14 bp, Homo sapiens
gatttattaaagaa

SEQ ID NO: 1839850 - DNA, 15 bp, Homo sapiens
gatttattaaagaaa

SEQ ID NO: 1839851 - DNA, 19 bp, Homo sapiens
gatttccagccagggctgc

SEQ ID NO: 1839852 - DNA, 23 bp, Homo sapiens
gatttgggctggaacagattcac

SEQ ID NO: 1839853 - DNA, 16 bp, Homo sapiens
gatttttaaaatgtac

SEQ ID NO: 1839854 - DNA, 14 bp, Homo sapiens
gcaaaaaggcagga

SEQ ID NO: 1839855 - DNA, 16 bp, Homo sapiens
gcaaaaatagctcttg

SEQ ID NO: 1839856 - DNA, 22 bp, Homo sapiens
gcaaaagatgcttctcactgcc

SEQ ID NO: 1839857 - DNA, 23 bp, Homo sapiens
gcaaaatcagaatggaatgctct

SEQ ID NO: 1839858 - DNA, 10 bp, Homo sapiens
gcaaactctt

SEQ ID NO: 1839859 - DNA, 22 bp, Homo sapiens
gcaaactctttggtcgtttttt

SEQ ID NO: 1839860 - DNA, 16 bp, Homo sapiens
gcaaagccagaaaaag

SEQ ID NO: 1839861 - DNA, 23 bp, Homo sapiens
gcaaagggcatgggtcgggagag

SEQ ID NO: 1839862 - DNA, 21 bp, Homo sapiens
gcaaagtcatgcaaaggctgg

SEQ ID NO: 1839863 - DNA, 23 bp, Homo sapiens
gcaagaaatggcgtctgctctgg

SEQ ID NO: 1839864 - DNA, 21 bp, Homo sapiens
gcaaggacacagatgaaacac

SEQ ID NO: 1839865 - DNA, 18 bp, Homo sapiens
gcaaggctgtgctccctg

SEQ ID NO: 1839866 - DNA, 20 bp, Homo sapiens
gcaagtgattgggacagagg

SEQ ID NO: 1839867 - DNA, 19 bp, Homo sapiens
gcaatactaggaagtaaag

SEQ ID NO: 1839868 - DNA, 17 bp, Homo sapiens
gcaatgaagtctctgaa

SEQ ID NO: 1839869 - DNA, 16 bp, Homo sapiens
gcaatgtgtataaaca

SEQ ID NO: 1839870 - DNA, 23 bp, Homo sapiens
gcaatgtgtataaacaagaaaaa

SEQ ID NO: 1839871 - DNA, 18 bp, Homo sapiens
gcacaagctccaagctcc

SEQ ID NO: 1839872 - DNA, 14 bp, Homo sapiens
gcacaagctgcacc

SEQ ID NO: 1839873 - DNA, 15 bp, Homo sapiens
gcacaatagtaacct

SEQ ID NO: 1839874 - DNA, 14 bp, Homo sapiens
gcacacaggacagc

SEQ ID NO: 1839875 - DNA, 16 bp, Homo sapiens
gcacagaccctgccct

SEQ ID NO: 1839876 - DNA, 12 bp, Homo sapiens
cctgctgggtgt

SEQ ID NO: 1839877 - DNA, 14 bp, Homo sapiens
cctgctgggtgtgg

SEQ ID NO: 1839878 - DNA, 20 bp, Homo sapiens
cctgctgggtgtggcgcagc

SEQ ID NO: 1839879 - DNA, 21 bp, Homo sapiens
cctgctgggtgtggcgcagca

SEQ ID NO: 1839880 - DNA, 22 bp, Homo sapiens
cctggaagacagagacctcctg

SEQ ID NO: 1839881 - DNA, 14 bp, Homo sapiens
cctggaccctgtgg

SEQ ID NO: 1839882 - DNA, 14 bp, Homo sapiens
cctggatctccctg

SEQ ID NO: 1839883 - DNA, 15 bp, Homo sapiens
cctggatggggctgc

SEQ ID NO: 1839884 - DNA, 17 bp, Homo sapiens
cctggatggggctgcac

SEQ ID NO: 1839885 - DNA, 12 bp, Homo sapiens
cctggcatttgg

SEQ ID NO: 1839886 - DNA, 14 bp, Homo sapiens
cctggcccactgca

SEQ ID NO: 1839887 - DNA, 21 bp, Homo sapiens
cctggcccctcagggtccctg

SEQ ID NO: 1839888 - DNA, 16 bp, Homo sapiens
cctggcctctgcactc

SEQ ID NO: 1839889 - DNA, 20 bp, Homo sapiens
cctggcctgagctgggatga

SEQ ID NO: 1839890 - DNA, 14 bp, Homo sapiens
cctggcctttcata

SEQ ID NO: 1839891 - DNA, 15 bp, Homo sapiens
cctggcctttcatat

SEQ ID NO: 1839892 - DNA, 14 bp, Homo sapiens
cctggctgaaggac

SEQ ID NO: 1839893 - DNA, 22 bp, Homo sapiens
cctgggagggacatgcttagca

SEQ ID NO: 1839894 - DNA, 22 bp, Homo sapiens
cctgggaggtcaaggctgcagt

SEQ ID NO: 1839895 - DNA, 16 bp, Homo sapiens
cctgggatccctcatc

SEQ ID NO: 1839896 - DNA, 13 bp, Homo sapiens
cctggtggcagct

SEQ ID NO: 1839897 - DNA, 17 bp, Homo sapiens
cctggtggcagctcacc

SEQ ID NO: 1839898 - DNA, 21 bp, Homo sapiens
cctgtagagtgggagctgagt

SEQ ID NO: 1839899 - DNA, 14 bp, Homo sapiens
cctgtccacaggct

SEQ ID NO: 1839900 - DNA, 15 bp, Homo sapiens
cctgtccccctgaca

SEQ ID NO: 1839901 - DNA, 17 bp, Homo sapiens
cctgtccccctgacaac

SEQ ID NO: 1839902 - DNA, 16 bp, Homo sapiens
cctgtgaactgaactc

SEQ ID NO: 1839903 - DNA, 18 bp, Homo sapiens
cctgtgaagtaaggatgt

SEQ ID NO: 1839904 - DNA, 18 bp, Homo sapiens
cctgtgatggggccctgc

SEQ ID NO: 1839905 - DNA, 19 bp, Homo sapiens
cctgtgatggggccctgcc

SEQ ID NO: 1839906 - DNA, 20 bp, Homo sapiens
cctgtgtgttaagctctgct

SEQ ID NO: 1839907 - DNA, 14 bp, Homo sapiens
cctgtttgtttctg

SEQ ID NO: 1839908 - DNA, 18 bp, Homo sapiens
cctgtttgtttctgaaag

SEQ ID NO: 1839909 - DNA, 13 bp, Homo sapiens
cctgttttctgaa

SEQ ID NO: 1839910 - DNA, 17 bp, Homo sapiens
ccttaccactgctctga

SEQ ID NO: 1839911 - DNA, 17 bp, Homo sapiens
ccttaccagcagagcac

SEQ ID NO: 1839912 - DNA, 18 bp, Homo sapiens
ccttagacagtccctgcc

SEQ ID NO: 1839913 - DNA, 19 bp, Homo sapiens
ccttcacctttgtccccac

SEQ ID NO: 1839914 - DNA, 20 bp, Homo sapiens
ccttcacctttgtccccacc

SEQ ID NO: 1839915 - DNA, 22 bp, Homo sapiens
ccttcatttggcattccccact

SEQ ID NO: 1839916 - DNA, 13 bp, Homo sapiens
ccttccaggggtg

SEQ ID NO: 1839917 - DNA, 15 bp, Homo sapiens
ccttccaggggtggg

SEQ ID NO: 1839918 - DNA, 16 bp, Homo sapiens
ccttccaggggtggga

SEQ ID NO: 1839919 - DNA, 14 bp, Homo sapiens
ccttcctctgaggc

SEQ ID NO: 1839920 - DNA, 17 bp, Homo sapiens
ccttcctgccagcccct

SEQ ID NO: 1839921 - DNA, 13 bp, Homo sapiens
ccttctctccagc

SEQ ID NO: 1839922 - DNA, 20 bp, Homo sapiens
ccttctctccagcccctgga

SEQ ID NO: 1839923 - DNA, 23 bp, Homo sapiens
ccttctctccagcccctggatgc

SEQ ID NO: 1839924 - DNA, 12 bp, Homo sapiens
ccttctgaccca

SEQ ID NO: 1839925 - DNA, 17 bp, Homo sapiens
ccttgaagaacctctca

SEQ ID NO: 1839926 - DNA, 18 bp, Homo sapiens
ccttgaagaacctctcac

SEQ ID NO: 1839927 - DNA, 21 bp, Homo sapiens
ccttgaccattctccacctgc

SEQ ID NO: 1839928 - DNA, 16 bp, Homo sapiens
ccttgagagaccaggc

SEQ ID NO: 1839929 - DNA, 20 bp, Homo sapiens
ccttgagagaccaggcaaag

SEQ ID NO: 1839930 - DNA, 17 bp, Homo sapiens
ccttgaggattgtggaa

SEQ ID NO: 1839931 - DNA, 21 bp, Homo sapiens
ccttgcggggataaagagaga

SEQ ID NO: 1839932 - DNA, 21 bp, Homo sapiens
ccttggacattttatgtcttt

SEQ ID NO: 1839933 - DNA, 15 bp, Homo sapiens
ccttggattgtcccc

SEQ ID NO: 1839934 - DNA, 22 bp, Homo sapiens
ccttggttaggcattgtgggaa

SEQ ID NO: 1839935 - DNA, 21 bp, Homo sapiens
cctttgacctgcctcccttca

SEQ ID NO: 1839936 - DNA, 22 bp, Homo sapiens
cctttgacctgcctcccttcat

SEQ ID NO: 1839937 - DNA, 20 bp, Homo sapiens
cctttgacgccatcccagcc

SEQ ID NO: 1839938 - DNA, 21 bp, Homo sapiens
cctttgtaaattgtcagatgc

SEQ ID NO: 1839939 - DNA, 14 bp, Homo sapiens
cctttgtgaggaag

SEQ ID NO: 1839940 - DNA, 17 bp, Homo sapiens
ccttttttggctgctga

SEQ ID NO: 1839941 - DNA, 18 bp, Homo sapiens
ccttttttggctgctgaa

SEQ ID NO: 1839942 - DNA, 20 bp, Homo sapiens
ccttttttggctgctgaagg

SEQ ID NO: 1839943 - DNA, 23 bp, Homo sapiens
cgaacatgtttttcttctccctc

SEQ ID NO: 1839944 - DNA, 22 bp, Homo sapiens
cgaatgacggtaagtgttctca

SEQ ID NO: 1839945 - DNA, 17 bp, Homo sapiens
cgactgcccggcagggt

SEQ ID NO: 1839946 - DNA, 16 bp, Homo sapiens
cgagcatgcctggatg

SEQ ID NO: 1839947 - DNA, 13 bp, Homo sapiens
cgagcctggctcc

SEQ ID NO: 1839948 - DNA, 13 bp, Homo sapiens
cgcaaaaatagct

SEQ ID NO: 1839949 - DNA, 19 bp, Homo sapiens
cgcaaaaatagctcttgct

SEQ ID NO: 1839950 - DNA, 12 bp, Homo sapiens
cgcaaagggcat

SEQ ID NO: 1839951 - DNA, 23 bp, Homo sapiens
cgcaaagggcatgggtcgggaga

SEQ ID NO: 1839952 - DNA, 15 bp, Homo sapiens
cgcagacaggaccag

SEQ ID NO: 1839953 - DNA, 10 bp, Homo sapiens
cgcaggcccc

SEQ ID NO: 1839954 - DNA, 19 bp, Homo sapiens
cgccagattctttcctgag

SEQ ID NO: 1839955 - DNA, 22 bp, Homo sapiens
cgccagattctttcctgaggct

SEQ ID NO: 1839956 - DNA, 14 bp, Homo sapiens
cgccatcccagccc

SEQ ID NO: 1839957 - DNA, 22 bp, Homo sapiens
cgcccaggcttagtcactgaga

SEQ ID NO: 1839958 - DNA, 12 bp, Homo sapiens
cgccccacccag

SEQ ID NO: 1839959 - DNA, 13 bp, Homo sapiens
cgccccacccaga

SEQ ID NO: 1839960 - DNA, 21 bp, Homo sapiens
gcacaggtgggcttcccagtg

SEQ ID NO: 1839961 - DNA, 15 bp, Homo sapiens
gcacatctgttttgt

SEQ ID NO: 1839962 - DNA, 23 bp, Homo sapiens
gcacatttaagagacagtcaccc

SEQ ID NO: 1839963 - DNA, 13 bp, Homo sapiens
gcaccacactggg

SEQ ID NO: 1839964 - DNA, 13 bp, Homo sapiens
gcaccagcagcct

SEQ ID NO: 1839965 - DNA, 15 bp, Homo sapiens
gcaccagcagcctgg

SEQ ID NO: 1839966 - DNA, 18 bp, Homo sapiens
gcacccacctgttttctg

SEQ ID NO: 1839967 - DNA, 16 bp, Homo sapiens
gcaccctcaggcaggt

SEQ ID NO: 1839968 - DNA, 15 bp, Homo sapiens
gcaccggctggcctg

SEQ ID NO: 1839969 - DNA, 17 bp, Homo sapiens
gcaccggctggcctggc

SEQ ID NO: 1839970 - DNA, 19 bp, Homo sapiens
gcaccggctggcctggccc

SEQ ID NO: 1839971 - DNA, 15 bp, Homo sapiens
gcacctgcagccaag

SEQ ID NO: 1839972 - DNA, 22 bp, Homo sapiens
gcacggctctgtccccagcctg

SEQ ID NO: 1839973 - DNA, 15 bp, Homo sapiens
gcactccagcctggg

SEQ ID NO: 1839974 - DNA, 17 bp, Homo sapiens
gcactccagcctgggtg

SEQ ID NO: 1839975 - DNA, 21 bp, Homo sapiens
gcactcgtgtgcaacagacaa

SEQ ID NO: 1839976 - DNA, 18 bp, Homo sapiens
gcactgcctgatggacct

SEQ ID NO: 1839977 - DNA, 21 bp, Homo sapiens
gcactgcctgctcccatcctg

SEQ ID NO: 1839978 - DNA, 12 bp, Homo sapiens
gcactgcttcca

SEQ ID NO: 1839979 - DNA, 13 bp, Homo sapiens
gcactgcttccag

SEQ ID NO: 1839980 - DNA, 16 bp, Homo sapiens
gcactgtgctcagggc

SEQ ID NO: 1839981 - DNA, 13 bp, Homo sapiens
gcacttacaattt

SEQ ID NO: 1839982 - DNA, 19 bp, Homo sapiens
gcactttaacacagtgtct

SEQ ID NO: 1839983 - DNA, 19 bp, Homo sapiens
gcactttgttctggctctt

SEQ ID NO: 1839984 - DNA, 16 bp, Homo sapiens
gcagaaatccaagcac

SEQ ID NO: 1839985 - DNA, 23 bp, Homo sapiens
gcagaacctgcacacaggacagc

SEQ ID NO: 1839986 - DNA, 15 bp, Homo sapiens
gcagacaggaccagg

SEQ ID NO: 1839987 - DNA, 18 bp, Homo sapiens
gcagacaggaccagggat

SEQ ID NO: 1839988 - DNA, 15 bp, Homo sapiens
gcagagaccatccct

SEQ ID NO: 1839989 - DNA, 17 bp, Homo sapiens
gcagagaccatccctga

SEQ ID NO: 1839990 - DNA, 21 bp, Homo sapiens
gcagagaggtttgcagtccca

SEQ ID NO: 1839991 - DNA, 22 bp, Homo sapiens
gcagagcaccttagacagtccc

SEQ ID NO: 1839992 - DNA, 23 bp, Homo sapiens
gcagagcaccttagacagtccct

SEQ ID NO: 1839993 - DNA, 12 bp, Homo sapiens
gcagagcagaga

SEQ ID NO: 1839994 - DNA, 14 bp, Homo sapiens
gcagagtcacacgg

SEQ ID NO: 1839995 - DNA, 13 bp, Homo sapiens
gcagcaccacact

SEQ ID NO: 1839996 - DNA, 18 bp, Homo sapiens
gcagcagggagggcttct

SEQ ID NO: 1839997 - DNA, 18 bp, Homo sapiens
gcagcatattcaggaagc

SEQ ID NO: 1839998 - DNA, 19 bp, Homo sapiens
gcagcatattcaggaagct

SEQ ID NO: 1839999 - DNA, 23 bp, Homo sapiens
gcagcatattcaggaagctcagg

SEQ ID NO: 1840000 - DNA, 13 bp, Homo sapiens
gcagccaggccac

SEQ ID NO: 1840001 - DNA, 16 bp, Homo sapiens
gcagccaggccacaag

SEQ ID NO: 1840002 - DNA, 17 bp, Homo sapiens
gcagcctcacagtcctt

SEQ ID NO: 1840003 - DNA, 12 bp, Homo sapiens
gcagcgagcctg

SEQ ID NO: 1840004 - DNA, 21 bp, Homo sapiens
gcagctcacctctcccttgga

SEQ ID NO: 1840005 - DNA, 19 bp, Homo sapiens
gctaggaacactccttcac

SEQ ID NO: 1840006 - DNA, 15 bp, Homo sapiens
gctaggggctggggc

SEQ ID NO: 1840007 - DNA, 16 bp, Homo sapiens
gctaggggctggggcc

SEQ ID NO: 1840008 - DNA, 22 bp, Homo sapiens
gctagtgtggtgtttcctggca

SEQ ID NO: 1840009 - DNA, 18 bp, Homo sapiens
gctatctcccccagcccc

SEQ ID NO: 1840010 - DNA, 23 bp, Homo sapiens
gctatctcccccagccccatcct

SEQ ID NO: 1840011 - DNA, 13 bp, Homo sapiens
gctatttttctaa

SEQ ID NO: 1840012 - DNA, 13 bp, Homo sapiens
gctcacccagtgc

SEQ ID NO: 1840013 - DNA, 19 bp, Homo sapiens
gctcacccagtgccctctc

SEQ ID NO: 1840014 - DNA, 17 bp, Homo sapiens
gctcacctctcccttgg

SEQ ID NO: 1840015 - DNA, 13 bp, Homo sapiens
gctcagagagggc

SEQ ID NO: 1840016 - DNA, 18 bp, Homo sapiens
gctcagagagggcaggca

SEQ ID NO: 1840017 - DNA, 19 bp, Homo sapiens
gctcagagagggcaggcat

SEQ ID NO: 1840018 - DNA, 17 bp, Homo sapiens
gctcagcaaaagatgct

SEQ ID NO: 1840019 - DNA, 20 bp, Homo sapiens
gctcagcaaaagatgcttct

SEQ ID NO: 1840020 - DNA, 20 bp, Homo sapiens
gctcagcactgcctgctccc

SEQ ID NO: 1840021 - DNA, 17 bp, Homo sapiens
gctcagggcctggctca

SEQ ID NO: 1840022 - DNA, 18 bp, Homo sapiens
gctcagggcctggctcag

SEQ ID NO: 1840023 - DNA, 21 bp, Homo sapiens
gctcaggtggggtcactctgg

SEQ ID NO: 1840024 - DNA, 14 bp, Homo sapiens
gctcatttcaggat

SEQ ID NO: 1840025 - DNA, 13 bp, Homo sapiens
gctccaagctccc

SEQ ID NO: 1840026 - DNA, 19 bp, Homo sapiens
gctccaagctcccaggcat

SEQ ID NO: 1840027 - DNA, 17 bp, Homo sapiens
gctccagattctgatgc

SEQ ID NO: 1840028 - DNA, 21 bp, Homo sapiens
gctccagctgttcagctggtt

SEQ ID NO: 1840029 - DNA, 12 bp, Homo sapiens
gctccaggagca

SEQ ID NO: 1840030 - DNA, 14 bp, Homo sapiens
gctccaggagcagc

SEQ ID NO: 1840031 - DNA, 17 bp, Homo sapiens
gctccaggagcagccac

SEQ ID NO: 1840032 - DNA, 21 bp, Homo sapiens
gctccaggcaggctaaggcgt

SEQ ID NO: 1840033 - DNA, 11 bp, Homo sapiens
gctcccaaggg

SEQ ID NO: 1840034 - DNA, 12 bp, Homo sapiens
gctcccaaggga

SEQ ID NO: 1840035 - DNA, 19 bp, Homo sapiens
gctcccacagaacacagca

SEQ ID NO: 1840036 - DNA, 22 bp, Homo sapiens
gctcccaggcattccccaggag

SEQ ID NO: 1840037 - DNA, 16 bp, Homo sapiens
gctcccttcccacctc

SEQ ID NO: 1840038 - DNA, 18 bp, Homo sapiens
gctcccttcccacctctc

SEQ ID NO: 1840039 - DNA, 20 bp, Homo sapiens
gctccttcctctgaggctga

SEQ ID NO: 1840040 - DNA, 14 bp, Homo sapiens
gctctgcccttggt

SEQ ID NO: 1840041 - DNA, 11 bp, Homo sapiens
gctctgcctcc

SEQ ID NO: 1840042 - DNA, 19 bp, Homo sapiens
ggaaggaaacccagctctg

SEQ ID NO: 1840043 - DNA, 14 bp, Homo sapiens
ggaaggatctgctg

SEQ ID NO: 1840044 - DNA, 15 bp, Homo sapiens
ggaaggatctgctga

SEQ ID NO: 1840045 - DNA, 22 bp, Homo sapiens
ggaaggatctgctgaggcccag

SEQ ID NO: 1840046 - DNA, 14 bp, Homo sapiens
ggaagtcctctggg

SEQ ID NO: 1840047 - DNA, 21 bp, Homo sapiens
ggaagttagtttttaatctct

SEQ ID NO: 1840048 - DNA, 15 bp, Homo sapiens
ggaatacctgtcccc

SEQ ID NO: 1840049 - DNA, 21 bp, Homo sapiens
ggaatctagccgatggaaaat

SEQ ID NO: 1840050 - DNA, 19 bp, Homo sapiens
ggaatgcctgagtgcctgg

SEQ ID NO: 1840051 - DNA, 23 bp, Homo sapiens
ggacacgctcagtggggcagagg

SEQ ID NO: 1840052 - DNA, 23 bp, Homo sapiens
ggacacgggcctgtccacaggct

SEQ ID NO: 1840053 - DNA, 14 bp, Homo sapiens
ggacagaagcagct

SEQ ID NO: 1840054 - DNA, 15 bp, Homo sapiens
ggacagaagcagctc

SEQ ID NO: 1840055 - DNA, 22 bp, Homo sapiens
ggacagggatgagcatggagct

SEQ ID NO: 1840056 - DNA, 13 bp, Homo sapiens
ggacatgcttagc

SEQ ID NO: 1840057 - DNA, 14 bp, Homo sapiens
ggacatggacaagg

SEQ ID NO: 1840058 - DNA, 23 bp, Homo sapiens
ggaccaggcaatgtgactttgca

SEQ ID NO: 1840059 - DNA, 18 bp, Homo sapiens
ggaccccgagcctggctc

SEQ ID NO: 1840060 - DNA, 12 bp, Homo sapiens
ggaccctgaggc

SEQ ID NO: 1840061 - DNA, 15 bp, Homo sapiens
ggaccctgaggccca

SEQ ID NO: 1840062 - DNA, 19 bp, Homo sapiens
ggaccctgaggcccagagg

SEQ ID NO: 1840063 - DNA, 16 bp, Homo sapiens
ggacgcaggcccctct

SEQ ID NO: 1840064 - DNA, 19 bp, Homo sapiens
ggacgctacccgggaaggg

SEQ ID NO: 1840065 - DNA, 17 bp, Homo sapiens
ggactcagctccccaga

SEQ ID NO: 1840066 - DNA, 12 bp, Homo sapiens
ggactgcagcca

SEQ ID NO: 1840067 - DNA, 16 bp, Homo sapiens
ggactgcagtgtggag

SEQ ID NO: 1840068 - DNA, 18 bp, Homo sapiens
ggactggcctctgctgat

SEQ ID NO: 1840069 - DNA, 19 bp, Homo sapiens
ggacttagaaaaccagctc

SEQ ID NO: 1840070 - DNA, 23 bp, Homo sapiens
ggagaaaattggaactctactca

SEQ ID NO: 1840071 - DNA, 20 bp, Homo sapiens
ggagaagtcttctatttatt

SEQ ID NO: 1840072 - DNA, 17 bp, Homo sapiens
ggagactatcagcccaa

SEQ ID NO: 1840073 - DNA, 18 bp, Homo sapiens
ggagactcctaggcagga

SEQ ID NO: 1840074 - DNA, 21 bp, Homo sapiens
ggagactcctaggcaggacat

SEQ ID NO: 1840075 - DNA, 22 bp, Homo sapiens
ggagagccttccaggggtggga

SEQ ID NO: 1840076 - DNA, 13 bp, Homo sapiens
ggagagctggagc

SEQ ID NO: 1840077 - DNA, 16 bp, Homo sapiens
ggagaggggacgcagg

SEQ ID NO: 1840078 - DNA, 20 bp, Homo sapiens
ggagaggggacgcaggcccc

SEQ ID NO: 1840079 - DNA, 23 bp, Homo sapiens
ggagatgaaatcttacagctggg

SEQ ID NO: 1840080 - DNA, 14 bp, Homo sapiens
ggagcaaaggctga

SEQ ID NO: 1840081 - DNA, 22 bp, Homo sapiens
ggagcacggctctgtccccagc

SEQ ID NO: 1840082 - DNA, 12 bp, Homo sapiens
ggagccccacct

SEQ ID NO: 1840083 - DNA, 20 bp, Homo sapiens
ggagccccaccttgtctgct

SEQ ID NO: 1840084 - DNA, 17 bp, Homo sapiens
ggagctcagagagggca

SEQ ID NO: 1840085 - DNA, 20 bp, Homo sapiens
ggagctcagagagggcaggc

SEQ ID NO: 1840086 - DNA, 16 bp, Homo sapiens
ggagctgagtggggga

SEQ ID NO: 1840087 - DNA, 12 bp, Homo sapiens
ggagctgggaga

SEQ ID NO: 1840088 - DNA, 21 bp, Homo sapiens
ggagctgggagaccctcccca

SEQ ID NO: 1840089 - DNA, 19 bp, Homo sapiens
ggaggaaggaaacccagct

SEQ ID NO: 1840090 - DNA, 23 bp, Homo sapiens
ggaggatcacttgagtccagaag

SEQ ID NO: 1840091 - DNA, 21 bp, Homo sapiens
ggaggatctcttgagcctggg

SEQ ID NO: 1840092 - DNA, 18 bp, Homo sapiens
ggaggccaaggtgggagg

SEQ ID NO: 1840093 - DNA, 20 bp, Homo sapiens
ggaggccaaggtgggaggat

SEQ ID NO: 1840094 - DNA, 13 bp, Homo sapiens
ggaggccagcctt

SEQ ID NO: 1840095 - DNA, 16 bp, Homo sapiens
ggaggcccttgtcgtg

SEQ ID NO: 1840096 - DNA, 19 bp, Homo sapiens
ggaggcccttgtcgtggga

SEQ ID NO: 1840097 - DNA, 12 bp, Homo sapiens
ggagggagggct

SEQ ID NO: 1840098 - DNA, 12 bp, Homo sapiens
ggagggctccag

SEQ ID NO: 1840099 - DNA, 17 bp, Homo sapiens
ggagggctccagacaca

SEQ ID NO: 1840100 - DNA, 13 bp, Homo sapiens
ggaggggggaggt

SEQ ID NO: 1840101 - DNA, 15 bp, Homo sapiens
ggaggtcgaggcagg

SEQ ID NO: 1840102 - DNA, 18 bp, Homo sapiens
ggaggtcgaggcaggagg

SEQ ID NO: 1840103 - DNA, 22 bp, Homo sapiens
ggaggtgggatcctccaggtgc

SEQ ID NO: 1840104 - DNA, 21 bp, Homo sapiens
ggagtgagttgatagcacaga

SEQ ID NO: 1840105 - DNA, 17 bp, Homo sapiens
ggagtgtgtgtgagtgt

SEQ ID NO: 1840106 - DNA, 18 bp, Homo sapiens
ggagttttgtctgtctcc

SEQ ID NO: 1840107 - DNA, 14 bp, Homo sapiens
ggatagacttggga

SEQ ID NO: 1840108 - DNA, 12 bp, Homo sapiens
ggatcctccagg

SEQ ID NO: 1840109 - DNA, 15 bp, Homo sapiens
ggatcctccaggtgc

SEQ ID NO: 1840110 - DNA, 21 bp, Homo sapiens
ggatctgctgaggcccagtgc

SEQ ID NO: 1840111 - DNA, 17 bp, Homo sapiens
ggatgagcatggagctg

SEQ ID NO: 1840112 - DNA, 17 bp, Homo sapiens
ggatgcagcctcacagt

SEQ ID NO: 1840113 - DNA, 14 bp, Homo sapiens
ggatggaagtgtct

SEQ ID NO: 1840114 - DNA, 16 bp, Homo sapiens
ggatggcctggccagg

SEQ ID NO: 1840115 - DNA, 12 bp, Homo sapiens
ggatgtcacagt

SEQ ID NO: 1840116 - DNA, 14 bp, Homo sapiens
ggatgtccccagca

SEQ ID NO: 1840117 - DNA, 16 bp, Homo sapiens
ggatgtccccagcaga

SEQ ID NO: 1840118 - DNA, 16 bp, Homo sapiens
ggattcttcctccctc

SEQ ID NO: 1840119 - DNA, 20 bp, Homo sapiens
ggattgtccccgacccttgc

SEQ ID NO: 1840120 - DNA, 16 bp, Homo sapiens
ggattttgtcaagcag

SEQ ID NO: 1840121 - DNA, 13 bp, Homo sapiens
ggcaaacaggcag

SEQ ID NO: 1840122 - DNA, 13 bp, Homo sapiens
ggcaaagccagaa

SEQ ID NO: 1840123 - DNA, 16 bp, Homo sapiens
ggcaaggacacagatg

SEQ ID NO: 1840124 - DNA, 16 bp, Homo sapiens
ggcacatgccccgatg

SEQ ID NO: 1840125 - DNA, 15 bp, Homo sapiens
ggcaccagcagcctg

SEQ ID NO: 1840126 - DNA, 22 bp, Homo sapiens
ggcactgcttccagtgaggctc

SEQ ID NO: 1840127 - DNA, 20 bp, Homo sapiens
ggcacttgggacaaaaacaa

SEQ ID NO: 1840128 - DNA, 16 bp, Homo sapiens
ggcagagcagagacca

SEQ ID NO: 1840129 - DNA, 20 bp, Homo sapiens
ggcagagcagagaccatccc

SEQ ID NO: 1840130 - DNA, 21 bp, Homo sapiens
ggcagagcttggactggatgc

SEQ ID NO: 1840131 - DNA, 15 bp, Homo sapiens
ggcagatggggagac

SEQ ID NO: 1840132 - DNA, 15 bp, Homo sapiens
ggcagcaccacactg

SEQ ID NO: 1840133 - DNA, 14 bp, Homo sapiens
ggcagccaggccac

SEQ ID NO: 1840134 - DNA, 15 bp, Homo sapiens
ggcagccaggccaca

SEQ ID NO: 1840135 - DNA, 17 bp, Homo sapiens
gccagtcaccccggcca

SEQ ID NO: 1840136 - DNA, 21 bp, Homo sapiens
gccagttggtcccccttccat

SEQ ID NO: 1840137 - DNA, 23 bp, Homo sapiens
gccagttggtcccccttccatgg

SEQ ID NO: 1840138 - DNA, 19 bp, Homo sapiens
gccatcatcagtggagcca

SEQ ID NO: 1840139 - DNA, 14 bp, Homo sapiens
gccatcccagcccc

SEQ ID NO: 1840140 - DNA, 16 bp, Homo sapiens
gccatcccagccccaa

SEQ ID NO: 1840141 - DNA, 12 bp, Homo sapiens
gccatctgctcc

SEQ ID NO: 1840142 - DNA, 20 bp, Homo sapiens
gccatgcagacctcatgccc

SEQ ID NO: 1840143 - DNA, 14 bp, Homo sapiens
gccatgcaggaggt

SEQ ID NO: 1840144 - DNA, 14 bp, Homo sapiens
gccatgctcctggc

SEQ ID NO: 1840145 - DNA, 14 bp, Homo sapiens
gccatgctggccag

SEQ ID NO: 1840146 - DNA, 16 bp, Homo sapiens
gccatggagagctgga

SEQ ID NO: 1840147 - DNA, 20 bp, Homo sapiens
gccatggagagctggagcct

SEQ ID NO: 1840148 - DNA, 22 bp, Homo sapiens
gccatggagagctggagcctgg

SEQ ID NO: 1840149 - DNA, 18 bp, Homo sapiens
gccattccccgtctctgg

SEQ ID NO: 1840150 - DNA, 15 bp, Homo sapiens
gcccacctggcctct

SEQ ID NO: 1840151 - DNA, 24 bp, Homo sapiens
gcccacctggcctctgcactcccc

SEQ ID NO: 1840152 - DNA, 14 bp, Homo sapiens
gcccactccctgca

SEQ ID NO: 1840153 - DNA, 11 bp, Homo sapiens
gcccagcccct

SEQ ID NO: 1840154 - DNA, 13 bp, Homo sapiens
gcccagccccttc

SEQ ID NO: 1840155 - DNA, 14 bp, Homo sapiens
gcccagccccttct

SEQ ID NO: 1840156 - DNA, 16 bp, Homo sapiens
gcccagccccttctga

SEQ ID NO: 1840157 - DNA, 24 bp, Homo sapiens
gcccagccccttctgacccatgct

SEQ ID NO: 1840158 - DNA, 14 bp, Homo sapiens
gcccagctctctga

SEQ ID NO: 1840159 - DNA, 12 bp, Homo sapiens
gcccaggaaagg

SEQ ID NO: 1840160 - DNA, 19 bp, Homo sapiens
gcccaggaaaggctccagg

SEQ ID NO: 1840161 - DNA, 21 bp, Homo sapiens
gcccaggaaaggctccaggag

SEQ ID NO: 1840162 - DNA, 22 bp, Homo sapiens
gcccaggaaaggctccaggagc

SEQ ID NO: 1840163 - DNA, 23 bp, Homo sapiens
gcccaggaaaggctccaggagca

SEQ ID NO: 1840164 - DNA, 19 bp, Homo sapiens
gcccaggcttagtcactga

SEQ ID NO: 1840165 - DNA, 23 bp, Homo sapiens
gcccaggcttagtcactgagaca

SEQ ID NO: 1840166 - DNA, 14 bp, Homo sapiens
gcccaggtttctgg

SEQ ID NO: 1840167 - DNA, 22 bp, Homo sapiens
gcccatggccctcccagtacct

SEQ ID NO: 1840168 - DNA, 19 bp, Homo sapiens
gcccattcattccattctg

SEQ ID NO: 1840169 - DNA, 18 bp, Homo sapiens
gccccaaaactctcctct

SEQ ID NO: 1840170 - DNA, 12 bp, Homo sapiens
gccccacccaga

SEQ ID NO: 1840171 - DNA, 13 bp, Homo sapiens
gccccacccagat

SEQ ID NO: 1840172 - DNA, 17 bp, Homo sapiens
gccccaccttgtctgct

SEQ ID NO: 1840173 - DNA, 23 bp, Homo sapiens
gccccctcacagtattgctcacc

SEQ ID NO: 1840174 - DNA, 19 bp, Homo sapiens
gccccctccccccagactc

SEQ ID NO: 1840175 - DNA, 15 bp, Homo sapiens
gccccgccccgttgt

SEQ ID NO: 1840176 - DNA, 12 bp, Homo sapiens
ggccctcccagt

SEQ ID NO: 1840177 - DNA, 14 bp, Homo sapiens
ggccctcccagtac

SEQ ID NO: 1840178 - DNA, 14 bp, Homo sapiens
ggccctgcctcctt

SEQ ID NO: 1840179 - DNA, 16 bp, Homo sapiens
ggcccttctctccagc

SEQ ID NO: 1840180 - DNA, 22 bp, Homo sapiens
ggccgggaccccgagcctggct

SEQ ID NO: 1840181 - DNA, 17 bp, Homo sapiens
ggccgtgggcctggggt

SEQ ID NO: 1840182 - DNA, 19 bp, Homo sapiens
ggccgttgatgttggctgg

SEQ ID NO: 1840183 - DNA, 14 bp, Homo sapiens
ggcctcccaactca

SEQ ID NO: 1840184 - DNA, 13 bp, Homo sapiens
ggcctctgcactc

SEQ ID NO: 1840185 - DNA, 14 bp, Homo sapiens
ggcctctgcactcc

SEQ ID NO: 1840186 - DNA, 16 bp, Homo sapiens
ggcctctgcactcccc

SEQ ID NO: 1840187 - DNA, 22 bp, Homo sapiens
ggcctctgcactcccctgctgg

SEQ ID NO: 1840188 - DNA, 23 bp, Homo sapiens
ggcctgaatgcttataggtggcc

SEQ ID NO: 1840189 - DNA, 12 bp, Homo sapiens
ggcctgagctgg

SEQ ID NO: 1840190 - DNA, 22 bp, Homo sapiens
ggcctggccagggcctggaaga

SEQ ID NO: 1840191 - DNA, 15 bp, Homo sapiens
ggcctggcctgagct

SEQ ID NO: 1840192 - DNA, 19 bp, Homo sapiens
ggcctggcctgagctggga

SEQ ID NO: 1840193 - DNA, 13 bp, Homo sapiens
ggcctttggcttc

SEQ ID NO: 1840194 - DNA, 17 bp, Homo sapiens
ggcgcaaagggcatggg

SEQ ID NO: 1840195 - DNA, 18 bp, Homo sapiens
ggcggctggggtcccagc

SEQ ID NO: 1840196 - DNA, 24 bp, Homo sapiens
ggcggctggggtcccagcagctgc

SEQ ID NO: 1840197 - DNA, 19 bp, Homo sapiens
ggcgggacacaggctccaa

SEQ ID NO: 1840198 - DNA, 22 bp, Homo sapiens
ggcgttctaggtaggaagagcc

SEQ ID NO: 1840199 - DNA, 14 bp, Homo sapiens
ggctaggggctggg

SEQ ID NO: 1840200 - DNA, 23 bp, Homo sapiens
ggctagtgtggtgtttcctggca

SEQ ID NO: 1840201 - DNA, 19 bp, Homo sapiens
ggctcagcaaaagatgctt

SEQ ID NO: 1840202 - DNA, 23 bp, Homo sapiens
ggctcagcaaaagatgcttctca

SEQ ID NO: 1840203 - DNA, 17 bp, Homo sapiens
ggctccaaaccctcgag

SEQ ID NO: 1840204 - DNA, 14 bp, Homo sapiens
ggctccaggagcag

SEQ ID NO: 1840205 - DNA, 17 bp, Homo sapiens
ggctccaggagcagcca

SEQ ID NO: 1840206 - DNA, 18 bp, Homo sapiens
ggctccaggagcagccac

SEQ ID NO: 1840207 - DNA, 19 bp, Homo sapiens
ggctccaggagcagccaca

SEQ ID NO: 1840208 - DNA, 13 bp, Homo sapiens
ggctcccttccca

SEQ ID NO: 1840209 - DNA, 17 bp, Homo sapiens
ggctcccttcccacctc

SEQ ID NO: 1840210 - DNA, 22 bp, Homo sapiens
ggctcccttcccacctctctca

SEQ ID NO: 1840211 - DNA, 16 bp, Homo sapiens
ggctctgcctcccatc

SEQ ID NO: 1840212 - DNA, 17 bp, Homo sapiens
ggctctgtccccagcct

SEQ ID NO: 1840213 - DNA, 13 bp, Homo sapiens
ggctgaaagacag

SEQ ID NO: 1840214 - DNA, 21 bp, Homo sapiens
ggctgaacactccaattaagg

SEQ ID NO: 1840215 - DNA, 13 bp, Homo sapiens
ggctgaggtggga

SEQ ID NO: 1840216 - DNA, 17 bp, Homo sapiens
ggctgcaccggctggcc

SEQ ID NO: 1840217 - DNA, 18 bp, Homo sapiens
ggctgcaccggctggcct

SEQ ID NO: 1840218 - DNA, 13 bp, Homo sapiens
ggctgctgaaggc

SEQ ID NO: 1840219 - DNA, 13 bp, Homo sapiens
ggctgctggcctg

SEQ ID NO: 1840220 - DNA, 20 bp, Homo sapiens
ggctggagtgcagtggcgca

SEQ ID NO: 1840221 - DNA, 13 bp, Homo sapiens
ggctggcctggcc

SEQ ID NO: 1840222 - DNA, 17 bp, Homo sapiens
ggctggcctggcccctc

SEQ ID NO: 1840223 - DNA, 14 bp, Homo sapiens
ggctgggagagcct

SEQ ID NO: 1840224 - DNA, 15 bp, Homo sapiens
ggctgggagagcctt

SEQ ID NO: 1840225 - DNA, 18 bp, Homo sapiens
ggctgggagagccttcca

SEQ ID NO: 1840226 - DNA, 19 bp, Homo sapiens
ggctgggagagccttccag

SEQ ID NO: 1840227 - DNA, 15 bp, Homo sapiens
ggctgggagtggcat

SEQ ID NO: 1840228 - DNA, 20 bp, Homo sapiens
ggctgggctcccttcccacc

SEQ ID NO: 1840229 - DNA, 21 bp, Homo sapiens
ggctgggctcccttcccacct

SEQ ID NO: 1840230 - DNA, 19 bp, Homo sapiens
ggctgggtggcaccagcag

SEQ ID NO: 1840231 - DNA, 19 bp, Homo sapiens
ggctgggttctacccaggt

SEQ ID NO: 1840232 - DNA, 22 bp, Homo sapiens
ggcttaacttagtatattatta

SEQ ID NO: 1840233 - DNA, 18 bp, Homo sapiens
ggcttcattagagcaggc

SEQ ID NO: 1840234 - DNA, 12 bp, Homo sapiens
ggcttcccaagg

SEQ ID NO: 1840235 - DNA, 17 bp, Homo sapiens
ggcttcccagtggctgc

SEQ ID NO: 1840236 - DNA, 21 bp, Homo sapiens
ggcttcccagtggctgctgcc

SEQ ID NO: 1840237 - DNA, 22 bp, Homo sapiens
ggcttcccagtggctgctgccc

SEQ ID NO: 1840238 - DNA, 21 bp, Homo sapiens
ggcttcctcagttcctgccct

SEQ ID NO: 1840239 - DNA, 13 bp, Homo sapiens
ggcttctgagcag

SEQ ID NO: 1840240 - DNA, 14 bp, Homo sapiens
ggcttctgagcagc

SEQ ID NO: 1840241 - DNA, 22 bp, Homo sapiens
gggaactcacctggggctgctg

SEQ ID NO: 1840242 - DNA, 14 bp, Homo sapiens
gggacaccctgtga

SEQ ID NO: 1840243 - DNA, 18 bp, Homo sapiens
gggaccccgagcctggct

SEQ ID NO: 1840244 - DNA, 18 bp, Homo sapiens
gggacgcaggcccctctc

SEQ ID NO: 1840245 - DNA, 15 bp, Homo sapiens
gggagagccttccag

SEQ ID NO: 1840246 - DNA, 14 bp, Homo sapiens
gggagggctccaga

SEQ ID NO: 1840247 - DNA, 15 bp, Homo sapiens
gggagggctccagac

SEQ ID NO: 1840248 - DNA, 18 bp, Homo sapiens
gggagggctccagacaca

SEQ ID NO: 1840249 - DNA, 21 bp, Homo sapiens
gggatatgatttaaatcagcc

SEQ ID NO: 1840250 - DNA, 22 bp, Homo sapiens
gggatggcatttggtctcaggc

SEQ ID NO: 1840251 - DNA, 20 bp, Homo sapiens
gggatttccagccagggctg

SEQ ID NO: 1840252 - DNA, 15 bp, Homo sapiens
gggatttccatgatg

SEQ ID NO: 1840253 - DNA, 13 bp, Homo sapiens
gggcacagggtct

SEQ ID NO: 1840254 - DNA, 23 bp, Homo sapiens
gggcagagcagagaccatccctg

SEQ ID NO: 1840255 - DNA, 23 bp, Homo sapiens
gggcaggactcagctccccagag

SEQ ID NO: 1840256 - DNA, 12 bp, Homo sapiens
gggcaggcttgg

SEQ ID NO: 1840257 - DNA, 18 bp, Homo sapiens
gggcatgggtcgggagag

SEQ ID NO: 1840258 - DNA, 14 bp, Homo sapiens
gggccagttggtcc

SEQ ID NO: 1840259 - DNA, 22 bp, Homo sapiens
gggccagttggtcccccttcca

SEQ ID NO: 1840260 - DNA, 22 bp, Homo sapiens
gggcctcggtgtggagaagcgg

SEQ ID NO: 1840261 - DNA, 19 bp, Homo sapiens
gggcctcttatgggctggg

SEQ ID NO: 1840262 - DNA, 19 bp, Homo sapiens
gggcctggcctgagctggg

SEQ ID NO: 1840263 - DNA, 16 bp, Homo sapiens
gggcctggctcaggtg

SEQ ID NO: 1840264 - DNA, 16 bp, Homo sapiens
gggcctgtccacaggc

SEQ ID NO: 1840265 - DNA, 18 bp, Homo sapiens
gggcgcaaagggcatggg

SEQ ID NO: 1840266 - DNA, 16 bp, Homo sapiens
gggctaggggctgggg

SEQ ID NO: 1840267 - DNA, 14 bp, Homo sapiens
gggctcccttccca

SEQ ID NO: 1840268 - DNA, 23 bp, Homo sapiens
gggctcccttcccacctctctca

SEQ ID NO: 1840269 - DNA, 14 bp, Homo sapiens
gggctgcaccggct

SEQ ID NO: 1840270 - DNA, 19 bp, Homo sapiens
gggctgcaccggctggcct

SEQ ID NO: 1840271 - DNA, 21 bp, Homo sapiens
gggctgcaccggctggcctgg

SEQ ID NO: 1840272 - DNA, 11 bp, Homo sapiens
gggctggaaca

SEQ ID NO: 1840273 - DNA, 22 bp, Homo sapiens
gggctggggccaaataaagtct

SEQ ID NO: 1840274 - DNA, 15 bp, Homo sapiens
aacactgagctgtca

SEQ ID NO: 1840275 - DNA, 12 bp, Homo sapiens
aacactgtgaaa

SEQ ID NO: 1840276 - DNA, 19 bp, Homo sapiens
aacactgttctctgccctc

SEQ ID NO: 1840277 - DNA, 11 bp, Homo sapiens
aacagctgtgt

SEQ ID NO: 1840278 - DNA, 23 bp, Homo sapiens
aacagctgtgtctgccaaacaca

SEQ ID NO: 1840279 - DNA, 15 bp, Homo sapiens
aacagtcatcattta

SEQ ID NO: 1840280 - DNA, 20 bp, Homo sapiens
aacagtgcttgccacagagc

SEQ ID NO: 1840281 - DNA, 15 bp, Homo sapiens
aacataagctatttt

SEQ ID NO: 1840282 - DNA, 18 bp, Homo sapiens
aacataagctatttttct

SEQ ID NO: 1840283 - DNA, 14 bp, Homo sapiens
aacatcatcaaggc

SEQ ID NO: 1840284 - DNA, 16 bp, Homo sapiens
aacatcatcaaggcac

SEQ ID NO: 1840285 - DNA, 22 bp, Homo sapiens
aacatcatcaaggcactgcctg

SEQ ID NO: 1840286 - DNA, 22 bp, Homo sapiens
aacatcgaaaagttattttgta

SEQ ID NO: 1840287 - DNA, 18 bp, Homo sapiens
aacatggtgtctggattc

SEQ ID NO: 1840288 - DNA, 22 bp, Homo sapiens
aacatgtttttcttctccctca

SEQ ID NO: 1840289 - DNA, 10 bp, Homo sapiens
aacattccat

SEQ ID NO: 1840290 - DNA, 17 bp, Homo sapiens
aacattcccagcccagc

SEQ ID NO: 1840291 - DNA, 16 bp, Homo sapiens
aacattggttcttgta

SEQ ID NO: 1840292 - DNA, 23 bp, Homo sapiens
aacattggttcttgtattaagaa

SEQ ID NO: 1840293 - DNA, 15 bp, Homo sapiens
aaccaagtcaagtga

SEQ ID NO: 1840294 - DNA, 13 bp, Homo sapiens
aaccaattatttt

SEQ ID NO: 1840295 - DNA, 14 bp, Homo sapiens
aaccacagctgctg

SEQ ID NO: 1840296 - DNA, 20 bp, Homo sapiens
aaccacatttctaagccttt

SEQ ID NO: 1840297 - DNA, 10 bp, Homo sapiens
aacccagctc

SEQ ID NO: 1840298 - DNA, 22 bp, Homo sapiens
aacctactagacaatgatgtga

SEQ ID NO: 1840299 - DNA, 14 bp, Homo sapiens
aacctgagatttat

SEQ ID NO: 1840300 - DNA, 15 bp, Homo sapiens
aacctgagatttatt

SEQ ID NO: 1840301 - DNA, 18 bp, Homo sapiens
aacctgattgtgtctctt

SEQ ID NO: 1840302 - DNA, 19 bp, Homo sapiens
aacctgattgtgtctcttg

SEQ ID NO: 1840303 - DNA, 15 bp, Homo sapiens
aacctgcacacagga

SEQ ID NO: 1840304 - DNA, 19 bp, Homo sapiens
aacctgcacacaggacagc

SEQ ID NO: 1840305 - DNA, 20 bp, Homo sapiens
aacctgcacacaggacagcg

SEQ ID NO: 1840306 - DNA, 13 bp, Homo sapiens
aacgtctgtgcca

SEQ ID NO: 1840307 - DNA, 23 bp, Homo sapiens
aacgttttctgtttggaggagca

SEQ ID NO: 1840308 - DNA, 15 bp, Homo sapiens
aactaaactttcaca

SEQ ID NO: 1840309 - DNA, 17 bp, Homo sapiens
aactaaactttcacacc

SEQ ID NO: 1840310 - DNA, 16 bp, Homo sapiens
aactactttgctgcta

SEQ ID NO: 1840311 - DNA, 21 bp, Homo sapiens
aactagttactaaacatgtat

SEQ ID NO: 1840312 - DNA, 14 bp, Homo sapiens
aactattgcccagg

SEQ ID NO: 1840313 - DNA, 16 bp, Homo sapiens
aactcaccccagcccc

SEQ ID NO: 1840314 - DNA, 17 bp, Homo sapiens
aactcaccccagcccca

SEQ ID NO: 1840315 - DNA, 20 bp, Homo sapiens
aactcacctggggctgctgg

SEQ ID NO: 1840316 - DNA, 19 bp, Homo sapiens
aactccaccttgcggggat

SEQ ID NO: 1840317 - DNA, 22 bp, Homo sapiens
aactctgacaacagacttctga

SEQ ID NO: 1840318 - DNA, 14 bp, Homo sapiens
aactgaactctgac

SEQ ID NO: 1840319 - DNA, 10 bp, Homo sapiens
aactgaaggg

SEQ ID NO: 1840320 - DNA, 17 bp, Homo sapiens
aactgaaggggtgcacc

SEQ ID NO: 1840321 - DNA, 23 bp, Homo sapiens
aactgaaggggtgcacccacctg

SEQ ID NO: 1840322 - DNA, 16 bp, Homo sapiens
aactgcattggctttg

SEQ ID NO: 1840323 - DNA, 15 bp, Homo sapiens
aactgctgactgttt

SEQ ID NO: 1840324 - DNA, 20 bp, Homo sapiens
aactgctgactgttttctct

SEQ ID NO: 1840325 - DNA, 21 bp, Homo sapiens
aactgctgactgttttctctt

SEQ ID NO: 1840326 - DNA, 18 bp, Homo sapiens
aactggcttaacttagta

SEQ ID NO: 1840327 - DNA, 16 bp, Homo sapiens
aactgggctgaacact

SEQ ID NO: 1840328 - DNA, 15 bp, Homo sapiens
aactgttatttataa

SEQ ID NO: 1840329 - DNA, 20 bp, Homo sapiens
aactgttatttataatcact

SEQ ID NO: 1840330 - DNA, 13 bp, Homo sapiens
aactgtttagatg

SEQ ID NO: 1840331 - DNA, 19 bp, Homo sapiens
aacttgagcgtgaatctgt

SEQ ID NO: 1840332 - DNA, 17 bp, Homo sapiens
aacttgtattaaagaca

SEQ ID NO: 1840333 - DNA, 18 bp, Homo sapiens
aacttgtctttggaccct

SEQ ID NO: 1840334 - DNA, 22 bp, Homo sapiens
aacttgtctttggaccctgagg

SEQ ID NO: 1840335 - DNA, 21 bp, Homo sapiens
aactttaagaactaaaatgtt

SEQ ID NO: 1840336 - DNA, 15 bp, Homo sapiens
aactttgctgagcct

SEQ ID NO: 1840337 - DNA, 21 bp, Homo sapiens
aagaaaaaaatgtattttatg

SEQ ID NO: 1840338 - DNA, 23 bp, Homo sapiens
aagaaaaaaatgtattttatgtt

SEQ ID NO: 1840339 - DNA, 11 bp, Homo sapiens
aagaaaagatg

SEQ ID NO: 1840340 - DNA, 20 bp, Homo sapiens
aagaaagttgcacggctgct

SEQ ID NO: 1840341 - DNA, 22 bp, Homo sapiens
aagaaagttgcacggctgctga

SEQ ID NO: 1840342 - DNA, 18 bp, Homo sapiens
aagaaatggcgtctgctc

SEQ ID NO: 1840343 - DNA, 21 bp, Homo sapiens
aagaaatggcgtctgctctgg

SEQ ID NO: 1840344 - DNA, 14 bp, Homo sapiens
aagaagcaggctac

SEQ ID NO: 1840345 - DNA, 16 bp, Homo sapiens
aagaagcccaggaaag

SEQ ID NO: 1840346 - DNA, 17 bp, Homo sapiens
aagacaaatcaaagcag

SEQ ID NO: 1840347 - DNA, 19 bp, Homo sapiens
aagacaatgtgaaaagaaa

SEQ ID NO: 1840348 - DNA, 16 bp, Homo sapiens
aagaccaccacctcag

SEQ ID NO: 1840349 - DNA, 19 bp, Homo sapiens
aagaccaccacctcagagt

SEQ ID NO: 1840350 - DNA, 18 bp, Homo sapiens
aagacccttgtggtccca

SEQ ID NO: 1840351 - DNA, 22 bp, Homo sapiens
aagacccttgtggtcccacccc

SEQ ID NO: 1840352 - DNA, 13 bp, Homo sapiens
aagacgctgtgct

SEQ ID NO: 1840353 - DNA, 20 bp, Homo sapiens
aagacgctgtgctgccctgc

SEQ ID NO: 1840354 - DNA, 22 bp, Homo sapiens
aagacgctgtgctgccctgccc

SEQ ID NO: 1840355 - DNA, 14 bp, Homo sapiens
aagacttcagattc

SEQ ID NO: 1840356 - DNA, 16 bp, Homo sapiens
aagactttggaaagag

SEQ ID NO: 1840357 - DNA, 20 bp, Homo sapiens
aagagacagtcaccccagga

SEQ ID NO: 1840358 - DNA, 21 bp, Homo sapiens
aagagacagtcaccccaggac

SEQ ID NO: 1840359 - DNA, 22 bp, Homo sapiens
aagagacagtcaccccaggact

SEQ ID NO: 1840360 - DNA, 16 bp, Homo sapiens
aagagagaaaaacaaa

SEQ ID NO: 1840361 - DNA, 22 bp, Homo sapiens
aagagagcttaatgataatatt

SEQ ID NO: 1840362 - DNA, 14 bp, Homo sapiens
aagagatacagagg

SEQ ID NO: 1840363 - DNA, 16 bp, Homo sapiens
aagagattgtggtttc

SEQ ID NO: 1840364 - DNA, 13 bp, Homo sapiens
aagagcacacttg

SEQ ID NO: 1840365 - DNA, 23 bp, Homo sapiens
aagagcccgcagggccatgcaga

SEQ ID NO: 1840366 - DNA, 15 bp, Homo sapiens
aagagcttgctccag

SEQ ID NO: 1840367 - DNA, 16 bp, Homo sapiens
aagagggcacacactg

SEQ ID NO: 1840368 - DNA, 13 bp, Homo sapiens
aagagtaggaaga

SEQ ID NO: 1840369 - DNA, 20 bp, Homo sapiens
aagagtaggaagactttgga

SEQ ID NO: 1840370 - DNA, 23 bp, Homo sapiens
aagatgcactttgctttaatata

SEQ ID NO: 1840371 - DNA, 17 bp, Homo sapiens
aagatgcttctcactgc

SEQ ID NO: 1840372 - DNA, 17 bp, Homo sapiens
aagattcaatcccagga

SEQ ID NO: 1840373 - DNA, 21 bp, Homo sapiens
aagattctatgttaatatttt

SEQ ID NO: 1840374 - DNA, 22 bp, Homo sapiens
aagattctatgttaatatttta

SEQ ID NO: 1840375 - DNA, 16 bp, Homo sapiens
aagcaaatgcctgcca

SEQ ID NO: 1840376 - DNA, 21 bp, Homo sapiens
aagcaaatgcctgccaaattt

SEQ ID NO: 1840377 - DNA, 12 bp, Homo sapiens
aagcaaatgtct

SEQ ID NO: 1840378 - DNA, 15 bp, Homo sapiens
aagcagaaatccaag

SEQ ID NO: 1840379 - DNA, 16 bp, Homo sapiens
aagcaggctacactga

SEQ ID NO: 1840380 - DNA, 14 bp, Homo sapiens
aagcagtagacaag

SEQ ID NO: 1840381 - DNA, 19 bp, Homo sapiens
aagcatcattatttatgta

SEQ ID NO: 1840382 - DNA, 23 bp, Homo sapiens
aagcatcattatttatgtattgt

SEQ ID NO: 1840383 - DNA, 16 bp, Homo sapiens
aagcattagctttaat

SEQ ID NO: 1840384 - DNA, 17 bp, Homo sapiens
aagcattctcattggaa

SEQ ID NO: 1840385 - DNA, 18 bp, Homo sapiens
aagcattctcattggaaa

SEQ ID NO: 1840386 - DNA, 17 bp, Homo sapiens
aagcattttataaatcg

SEQ ID NO: 1840387 - DNA, 13 bp, Homo sapiens
aagccaaagccaa

SEQ ID NO: 1840388 - DNA, 17 bp, Homo sapiens
aagccaataacacacag

SEQ ID NO: 1840389 - DNA, 17 bp, Homo sapiens
aagcccaggaaaggctc

SEQ ID NO: 1840390 - DNA, 19 bp, Homo sapiens
aagcccaggaaaggctcca

SEQ ID NO: 1840391 - DNA, 22 bp, Homo sapiens
aagcccaggaaaggctccagga

SEQ ID NO: 1840392 - DNA, 15 bp, Homo sapiens
aagcctcctccagcc

SEQ ID NO: 1840393 - DNA, 14 bp, Homo sapiens
aagctatttttcta

SEQ ID NO: 1840394 - DNA, 17 bp, Homo sapiens
aagctcagggcctggct

SEQ ID NO: 1840395 - DNA, 11 bp, Homo sapiens
aagctcccagg

SEQ ID NO: 1840396 - DNA, 16 bp, Homo sapiens
aagctctcatagctca

SEQ ID NO: 1840397 - DNA, 17 bp, Homo sapiens
aagctctcatagctcat

SEQ ID NO: 1840398 - DNA, 14 bp, Homo sapiens
aagctctgctatta

SEQ ID NO: 1840399 - DNA, 21 bp, Homo sapiens
aagctgcaccctcaggcaggt

SEQ ID NO: 1840400 - DNA, 22 bp, Homo sapiens
aagctgcaccctcaggcaggtg

SEQ ID NO: 1840401 - DNA, 17 bp, Homo sapiens
aaggaaaaataaatatt

SEQ ID NO: 1840402 - DNA, 17 bp, Homo sapiens
aaggaaaccacagctgc

SEQ ID NO: 1840403 - DNA, 18 bp, Homo sapiens
aaggaaaccacagctgct

SEQ ID NO: 1840404 - DNA, 20 bp, Homo sapiens
aaggaaaccacagctgctgg

SEQ ID NO: 1840405 - DNA, 16 bp, Homo sapiens
aaggaaacccagctct

SEQ ID NO: 1840406 - DNA, 17 bp, Homo sapiens
aaggaaacccagctctg

SEQ ID NO: 1840407 - DNA, 22 bp, Homo sapiens
aaggaaacccagctctggtcca

SEQ ID NO: 1840408 - DNA, 15 bp, Homo sapiens
aaggaaagagggagg

SEQ ID NO: 1840409 - DNA, 13 bp, Homo sapiens
aaggaaaggcaaa

SEQ ID NO: 1840410 - DNA, 22 bp, Homo sapiens
aaggaatccactcccaggcagc

SEQ ID NO: 1840411 - DNA, 22 bp, Homo sapiens
aaggacacagatgaaacacaaa

SEQ ID NO: 1840412 - DNA, 21 bp, Homo sapiens
aaggactgtgacaggcagcag

SEQ ID NO: 1840413 - DNA, 13 bp, Homo sapiens
aaggagaggaggc

SEQ ID NO: 1840414 - DNA, 14 bp, Homo sapiens
aaggagtttatgtt

SEQ ID NO: 1840415 - DNA, 13 bp, Homo sapiens
aaggatctgctga

SEQ ID NO: 1840416 - DNA, 20 bp, Homo sapiens
aaggatctgctgaggcccag

SEQ ID NO: 1840417 - DNA, 22 bp, Homo sapiens
aaggattttatgctttaaacat

SEQ ID NO: 1840418 - DNA, 14 bp, Homo sapiens
aaggcgtggagctg

SEQ ID NO: 1840419 - DNA, 18 bp, Homo sapiens
aaggcgtggagctgcctg

SEQ ID NO: 1840420 - DNA, 19 bp, Homo sapiens
aaggctactacagagaagg

SEQ ID NO: 1840421 - DNA, 21 bp, Homo sapiens
aaggctactacagagaaggct

SEQ ID NO: 1840422 - DNA, 14 bp, Homo sapiens
aaggctccaggagc

SEQ ID NO: 1840423 - DNA, 16 bp, Homo sapiens
aaggctcgagcatgcc

SEQ ID NO: 1840424 - DNA, 19 bp, Homo sapiens
aaggctcgagcatgcctgg

SEQ ID NO: 1840425 - DNA, 16 bp, Homo sapiens
aaggctgggggaagaa

SEQ ID NO: 1840426 - DNA, 16 bp, Homo sapiens
aaggctgtgctccctg

SEQ ID NO: 1840427 - DNA, 19 bp, Homo sapiens
aagggctgccggggcagcc

SEQ ID NO: 1840428 - DNA, 12 bp, Homo sapiens
aagggggctggg

SEQ ID NO: 1840429 - DNA, 19 bp, Homo sapiens
aaggggtgcacccacctgt

SEQ ID NO: 1840430 - DNA, 14 bp, Homo sapiens
aaggtagaatgttt

SEQ ID NO: 1840431 - DNA, 14 bp, Homo sapiens
aaggtcggaccagc

SEQ ID NO: 1840432 - DNA, 16 bp, Homo sapiens
aaggtggggacaggga

SEQ ID NO: 1840433 - DNA, 20 bp, Homo sapiens
aaggtggtgggggtgcagat

SEQ ID NO: 1840434 - DNA, 21 bp, Homo sapiens
aaggttctctcctccccaagg

SEQ ID NO: 1840435 - DNA, 16 bp, Homo sapiens
aagtaaagtgaagaat

SEQ ID NO: 1840436 - DNA, 20 bp, Homo sapiens
aagtatcagctacaattgta

SEQ ID NO: 1840437 - DNA, 22 bp, Homo sapiens
aagtctctgaagtgaaactgct

SEQ ID NO: 1840438 - DNA, 11 bp, Homo sapiens
aagtctctgtg

SEQ ID NO: 1840439 - DNA, 14 bp, Homo sapiens
aagtctctgtgaat

SEQ ID NO: 1840440 - DNA, 16 bp, Homo sapiens
aagtctgttttatgac

SEQ ID NO: 1840441 - DNA, 18 bp, Homo sapiens
aagtctgttttatgactt

SEQ ID NO: 1840442 - DNA, 16 bp, Homo sapiens
aagtcttatcaagcag

SEQ ID NO: 1840443 - DNA, 17 bp, Homo sapiens
aagtcttctatttattt

SEQ ID NO: 1840444 - DNA, 15 bp, Homo sapiens
aagtgagacagtcca

SEQ ID NO: 1840445 - DNA, 16 bp, Homo sapiens
aagtgagcagaacagg

SEQ ID NO: 1840446 - DNA, 19 bp, Homo sapiens
aagtggaaaaatagcctgc

SEQ ID NO: 1840447 - DNA, 12 bp, Homo sapiens
aagtgttctcat

SEQ ID NO: 1840448 - DNA, 14 bp, Homo sapiens
aagttaaactgatt

SEQ ID NO: 1840449 - DNA, 21 bp, Homo sapiens
aagttgatatagaacagtgct

SEQ ID NO: 1840450 - DNA, 15 bp, Homo sapiens
aagttgcacggctgc

SEQ ID NO: 1840451 - DNA, 12 bp, Homo sapiens
aagttggaagga

SEQ ID NO: 1840452 - DNA, 14 bp, Homo sapiens
aagttggaaggatc

SEQ ID NO: 1840453 - DNA, 22 bp, Homo sapiens
aagttgtaggcataaagtcagg

SEQ ID NO: 1840454 - DNA, 15 bp, Homo sapiens
aagttgtttgagaaa

SEQ ID NO: 1840455 - DNA, 21 bp, Homo sapiens
aagttgtttgagaaattaagt

SEQ ID NO: 1840456 - DNA, 16 bp, Homo sapiens
aagtttccttggctgg

SEQ ID NO: 1840457 - DNA, 17 bp, Homo sapiens
aagtttccttggctggt

SEQ ID NO: 1840458 - DNA, 15 bp, Homo sapiens
aataaagaaaagatg

SEQ ID NO: 1840459 - DNA, 20 bp, Homo sapiens
aataaagatcatgtaaaagt

SEQ ID NO: 1840460 - DNA, 18 bp, Homo sapiens
aataaagccttcaaactc

SEQ ID NO: 1840461 - DNA, 18 bp, Homo sapiens
aataaagttaaactgatt

SEQ ID NO: 1840462 - DNA, 13 bp, Homo sapiens
aataacctttctg

SEQ ID NO: 1840463 - DNA, 14 bp, Homo sapiens
aataacctttctgg

SEQ ID NO: 1840464 - DNA, 23 bp, Homo sapiens
aataagcccaacaagttgaagaa

SEQ ID NO: 1840465 - DNA, 20 bp, Homo sapiens
aataatgggcttagagcagt

SEQ ID NO: 1840466 - DNA, 17 bp, Homo sapiens
aatacctggcctcattt

SEQ ID NO: 1840467 - DNA, 19 bp, Homo sapiens
aatacctggcctcatttaa

SEQ ID NO: 1840468 - DNA, 18 bp, Homo sapiens
aatacctgtccccctgac

SEQ ID NO: 1840469 - DNA, 22 bp, Homo sapiens
aatactctaccctcttagaaaa

SEQ ID NO: 1840470 - DNA, 20 bp, Homo sapiens
aatagcctgcctcttctcta

SEQ ID NO: 1840471 - DNA, 11 bp, Homo sapiens
aatataaagac

SEQ ID NO: 1840472 - DNA, 23 bp, Homo sapiens
aatataaagacgttttataagca

SEQ ID NO: 1840473 - DNA, 16 bp, Homo sapiens
aatataaatgcaaata

SEQ ID NO: 1840474 - DNA, 13 bp, Homo sapiens
aatatattattac

SEQ ID NO: 1840475 - DNA, 20 bp, Homo sapiens
aatatattattacttgtaaa

SEQ ID NO: 1840476 - DNA, 18 bp, Homo sapiens
aatatcatcagtattgaa

SEQ ID NO: 1840477 - DNA, 21 bp, Homo sapiens
aatatcccttggacattttat

SEQ ID NO: 1840478 - DNA, 18 bp, Homo sapiens
aatatcttaattctttgt

SEQ ID NO: 1840479 - DNA, 15 bp, Homo sapiens
aatatttataggtca

SEQ ID NO: 1840480 - DNA, 19 bp, Homo sapiens
aatcaactgggctgaacac

SEQ ID NO: 1840481 - DNA, 11 bp, Homo sapiens
aatcagcctgc

SEQ ID NO: 1840482 - DNA, 12 bp, Homo sapiens
aatcccaggatg

SEQ ID NO: 1840483 - DNA, 19 bp, Homo sapiens
aatctagccgatggaaaat

SEQ ID NO: 1840484 - DNA, 21 bp, Homo sapiens
aatctctccaccttccaaaga

SEQ ID NO: 1840485 - DNA, 17 bp, Homo sapiens
aatctgatggcttctcc

SEQ ID NO: 1840486 - DNA, 12 bp, Homo sapiens
aatgaaatgcat

SEQ ID NO: 1840487 - DNA, 15 bp, Homo sapiens
aatgaaatgcatttt

SEQ ID NO: 1840488 - DNA, 17 bp, Homo sapiens
aatgaacaagagaagca

SEQ ID NO: 1840489 - DNA, 18 bp, Homo sapiens
aatgaacaagagaagcat

SEQ ID NO: 1840490 - DNA, 14 bp, Homo sapiens
aatgaagtctctga

SEQ ID NO: 1840491 - DNA, 16 bp, Homo sapiens
aatgaagtctctgaag

SEQ ID NO: 1840492 - DNA, 22 bp, Homo sapiens
aatgacggtaagtgttctcatg

SEQ ID NO: 1840493 - DNA, 23 bp, Homo sapiens
aatgacggtaagtgttctcatga

SEQ ID NO: 1840494 - DNA, 21 bp, Homo sapiens
aatgatgatcctaggcatttg

SEQ ID NO: 1840495 - DNA, 20 bp, Homo sapiens
aatgatgtatgttgaagcct

SEQ ID NO: 1840496 - DNA, 23 bp, Homo sapiens
aatgatgtatgttgaagcctttg

SEQ ID NO: 1840497 - DNA, 13 bp, Homo sapiens
aatgcaaataaca

SEQ ID NO: 1840498 - DNA, 14 bp, Homo sapiens
aatgcaaataacaa

SEQ ID NO: 1840499 - DNA, 17 bp, Homo sapiens
aatgcaaataacaaatg

SEQ ID NO: 1840500 - DNA, 20 bp, Homo sapiens
aatgcactttgttctggctc

SEQ ID NO: 1840501 - DNA, 22 bp, Homo sapiens
aatgcactttgttctggctctt

SEQ ID NO: 1840502 - DNA, 17 bp, Homo sapiens
aatgccaaattaaaaaa

SEQ ID NO: 1840503 - DNA, 21 bp, Homo sapiens
aatgccatcctcaaacactgc

SEQ ID NO: 1840504 - DNA, 11 bp, Homo sapiens
aatgcccagcc

SEQ ID NO: 1840505 - DNA, 14 bp, Homo sapiens
aatgcccagcccct

SEQ ID NO: 1840506 - DNA, 20 bp, Homo sapiens
aatgcccagccccttctgac

SEQ ID NO: 1840507 - DNA, 17 bp, Homo sapiens
aatgcctgagtgcctgg

SEQ ID NO: 1840508 - DNA, 19 bp, Homo sapiens
aatgcctgccaaattttag

SEQ ID NO: 1840509 - DNA, 14 bp, Homo sapiens
aatgctaattttat

SEQ ID NO: 1840510 - DNA, 12 bp, Homo sapiens
aatgctgcagat

SEQ ID NO: 1840511 - DNA, 17 bp, Homo sapiens
aatggccatgcaggagg

SEQ ID NO: 1840512 - DNA, 18 bp, Homo sapiens
aatggccatgcaggaggt

SEQ ID NO: 1840513 - DNA, 23 bp, Homo sapiens
aatggccatgcaggaggtggaga

SEQ ID NO: 1840514 - DNA, 13 bp, Homo sapiens
aatggttaaaaga

SEQ ID NO: 1840515 - DNA, 15 bp, Homo sapiens
aatgtattttatgtt

SEQ ID NO: 1840516 - DNA, 19 bp, Homo sapiens
aatgtattttatgttatat

SEQ ID NO: 1840517 - DNA, 19 bp, Homo sapiens
aatgtcagttgttatttat

SEQ ID NO: 1840518 - DNA, 23 bp, Homo sapiens
aatgtgacttggattcaatttta

SEQ ID NO: 1840519 - DNA, 14 bp, Homo sapiens
aatgtgtataaaca

SEQ ID NO: 1840520 - DNA, 24 bp, Homo sapiens
aattaaaaaagataaacacaagat

SEQ ID NO: 1840521 - DNA, 18 bp, Homo sapiens
aattaagctctcatagct

SEQ ID NO: 1840522 - DNA, 13 bp, Homo sapiens
aattaagtatctg

SEQ ID NO: 1840523 - DNA, 19 bp, Homo sapiens
aattccctggcctttcata

SEQ ID NO: 1840524 - DNA, 22 bp, Homo sapiens
aaaaaactgctgactgttttct

SEQ ID NO: 1840525 - DNA, 12 bp, Homo sapiens
aaaaagactatt

SEQ ID NO: 1840526 - DNA, 19 bp, Homo sapiens
aaaaagataaacacaagat

SEQ ID NO: 1840527 - DNA, 17 bp, Homo sapiens
aaaaagcctccagtcca

SEQ ID NO: 1840528 - DNA, 20 bp, Homo sapiens
aaaaagctccaaatgcagct

SEQ ID NO: 1840529 - DNA, 12 bp, Homo sapiens
aaaaaggcagga

SEQ ID NO: 1840530 - DNA, 21 bp, Homo sapiens
aaaaatatgaccacactccag

SEQ ID NO: 1840531 - DNA, 17 bp, Homo sapiens
aaaaatgtattttatgt

SEQ ID NO: 1840532 - DNA, 22 bp, Homo sapiens
aaaactgctgactgttttctct

SEQ ID NO: 1840533 - DNA, 23 bp, Homo sapiens
aaaactgctgactgttttctctt

SEQ ID NO: 1840534 - DNA, 13 bp, Homo sapiens
aaaagaattgttg

SEQ ID NO: 1840535 - DNA, 22 bp, Homo sapiens
aaaagaattgttgggggttttt

SEQ ID NO: 1840536 - DNA, 22 bp, Homo sapiens
aaaagaggtttttcttaaataa

SEQ ID NO: 1840537 - DNA, 16 bp, Homo sapiens
aaaagatctttcattt

SEQ ID NO: 1840538 - DNA, 14 bp, Homo sapiens
aaaagctgggcagg

SEQ ID NO: 1840539 - DNA, 22 bp, Homo sapiens
aaaatatgaccacactccagct

SEQ ID NO: 1840540 - DNA, 21 bp, Homo sapiens
aaaatcagcctgctccagctg

SEQ ID NO: 1840541 - DNA, 22 bp, Homo sapiens
aaaatcccttacctcggtgcct

SEQ ID NO: 1840542 - DNA, 13 bp, Homo sapiens
aaaatgtatttta

SEQ ID NO: 1840543 - DNA, 15 bp, Homo sapiens
aaaatgtattttatg

SEQ ID NO: 1840544 - DNA, 17 bp, Homo sapiens
aaaatgtattttatgtt

SEQ ID NO: 1840545 - DNA, 22 bp, Homo sapiens
aaaatgtattttatgttatata

SEQ ID NO: 1840546 - DNA, 15 bp, Homo sapiens
aaaattagccaagtg

SEQ ID NO: 1840547 - DNA, 12 bp, Homo sapiens
aaaatttgaata

SEQ ID NO: 1840548 - DNA, 18 bp, Homo sapiens
aaaatttttatgtaatta

SEQ ID NO: 1840549 - DNA, 19 bp, Homo sapiens
aaacaagaaaaataaagaa

SEQ ID NO: 1840550 - DNA, 22 bp, Homo sapiens
aaacaatagtaattctcaggcc

SEQ ID NO: 1840551 - DNA, 14 bp, Homo sapiens
aaacaatttctttt

SEQ ID NO: 1840552 - DNA, 15 bp, Homo sapiens
aaacacaagattggt

SEQ ID NO: 1840553 - DNA, 11 bp, Homo sapiens
aaacaggcagt

SEQ ID NO: 1840554 - DNA, 20 bp, Homo sapiens
aaacattggttcttgtatta

SEQ ID NO: 1840555 - DNA, 13 bp, Homo sapiens
aaaccagctcagc

SEQ ID NO: 1840556 - DNA, 13 bp, Homo sapiens
aaacccagaggtg

SEQ ID NO: 1840557 - DNA, 15 bp, Homo sapiens
aaacctctgtgagca

SEQ ID NO: 1840558 - DNA, 23 bp, Homo sapiens
aaacggcctcactaggcttctgg

SEQ ID NO: 1840559 - DNA, 20 bp, Homo sapiens
aaactactttgctgctaata

SEQ ID NO: 1840560 - DNA, 13 bp, Homo sapiens
aaactctcctctg

SEQ ID NO: 1840561 - DNA, 23 bp, Homo sapiens
aaactcttaaaacccaagtgcct

SEQ ID NO: 1840562 - DNA, 20 bp, Homo sapiens
aaactctttggtcgtttttt

SEQ ID NO: 1840563 - DNA, 21 bp, Homo sapiens
aaactctttggtcgttttttt

SEQ ID NO: 1840564 - DNA, 17 bp, Homo sapiens
aaactgcttgtttccta

SEQ ID NO: 1840565 - DNA, 10 bp, Homo sapiens
aaagaaaaaa

SEQ ID NO: 1840566 - DNA, 13 bp, Homo sapiens
aaagaaaagatgc

SEQ ID NO: 1840567 - DNA, 15 bp, Homo sapiens
aaagaaaagatgcac

SEQ ID NO: 1840568 - DNA, 17 bp, Homo sapiens
aaagaaaagatgcactt

SEQ ID NO: 1840569 - DNA, 20 bp, Homo sapiens
aaagaaaagatgcactttgc

SEQ ID NO: 1840570 - DNA, 23 bp, Homo sapiens
aaagaaagttgcacggctgctga

SEQ ID NO: 1840571 - DNA, 19 bp, Homo sapiens
aaagacaaatcaaagcaga

SEQ ID NO: 1840572 - DNA, 19 bp, Homo sapiens
aaagacttttccaaccctc

SEQ ID NO: 1840573 - DNA, 14 bp, Homo sapiens
aaagagattcgaat

SEQ ID NO: 1840574 - DNA, 11 bp, Homo sapiens
aaagaggtttt

SEQ ID NO: 1840575 - DNA, 16 bp, Homo sapiens
aaagaggtttttctta

SEQ ID NO: 1840576 - DNA, 12 bp, Homo sapiens
aaagataaacac

SEQ ID NO: 1840577 - DNA, 17 bp, Homo sapiens
aaagataaacacaagat

SEQ ID NO: 1840578 - DNA, 14 bp, Homo sapiens
aaagatctttcatt

SEQ ID NO: 1840579 - DNA, 19 bp, Homo sapiens
aaagatgcactttgcttta

SEQ ID NO: 1840580 - DNA, 11 bp, Homo sapiens
aaaggaaagag

SEQ ID NO: 1840581 - DNA, 14 bp, Homo sapiens
aaaggctccaggag

SEQ ID NO: 1840582 - DNA, 20 bp, Homo sapiens
aaaggctccaggagcagcca

SEQ ID NO: 1840583 - DNA, 14 bp, Homo sapiens
aaaggtttaaatga

SEQ ID NO: 1840584 - DNA, 18 bp, Homo sapiens
aaaggtttaaatgaacaa

SEQ ID NO: 1840585 - DNA, 19 bp, Homo sapiens
aaagtcatgcaaaggctgg

SEQ ID NO: 1840586 - DNA, 21 bp, Homo sapiens
aaagtcatgcaaaggctggga

SEQ ID NO: 1840587 - DNA, 18 bp, Homo sapiens
aaagtgaagaatttatct

SEQ ID NO: 1840588 - DNA, 18 bp, Homo sapiens
aaagttggaaggatctgc

SEQ ID NO: 1840589 - DNA, 15 bp, Homo sapiens
aaataaaatggattt

SEQ ID NO: 1840590 - DNA, 21 bp, Homo sapiens
aaataaagttaaactgattat

SEQ ID NO: 1840591 - DNA, 13 bp, Homo sapiens
aaatatattatta

SEQ ID NO: 1840592 - DNA, 22 bp, Homo sapiens
aaatatcccttggacattttat

SEQ ID NO: 1840593 - DNA, 23 bp, Homo sapiens
aaatatcccttggacattttatg

SEQ ID NO: 1840594 - DNA, 13 bp, Homo sapiens
aaatattgctggg

SEQ ID NO: 1840595 - DNA, 19 bp, Homo sapiens
aaatcagcctgctccagct

SEQ ID NO: 1840596 - DNA, 21 bp, Homo sapiens
aaatcagcctgctccagctgt

SEQ ID NO: 1840597 - DNA, 23 bp, Homo sapiens
aaatcagcctgctccagctgttc

SEQ ID NO: 1840598 - DNA, 15 bp, Homo sapiens
aaatcccatttaaaa

SEQ ID NO: 1840599 - DNA, 20 bp, Homo sapiens
aaatcgatgagcgccacctc

SEQ ID NO: 1840600 - DNA, 21 bp, Homo sapiens
aaatcgatgagcgccacctct

SEQ ID NO: 1840601 - DNA, 15 bp, Homo sapiens
aaatcgcttttgata

SEQ ID NO: 1840602 - DNA, 16 bp, Homo sapiens
aaatgaaatgcatttt

SEQ ID NO: 1840603 - DNA, 17 bp, Homo sapiens
aaatgaaatgcattttg

SEQ ID NO: 1840604 - DNA, 19 bp, Homo sapiens
aaatgagcctggcaagaat

SEQ ID NO: 1840605 - DNA, 18 bp, Homo sapiens
aaatgccaaattaaaaaa

SEQ ID NO: 1840606 - DNA, 13 bp, Homo sapiens
aaatgcccagccc

SEQ ID NO: 1840607 - DNA, 15 bp, Homo sapiens
aaatgcccagcccct

SEQ ID NO: 1840608 - DNA, 18 bp, Homo sapiens
aaatgcccagccccttct

SEQ ID NO: 1840609 - DNA, 16 bp, Homo sapiens
aaatggaaatgggcag

SEQ ID NO: 1840610 - DNA, 20 bp, Homo sapiens
aaatggcgtctgctctggtg

SEQ ID NO: 1840611 - DNA, 14 bp, Homo sapiens
aaatgtcttcctgg

SEQ ID NO: 1840612 - DNA, 14 bp, Homo sapiens
aaattaaaaaagat

SEQ ID NO: 1840613 - DNA, 18 bp, Homo sapiens
aaattccctggcctttca

SEQ ID NO: 1840614 - DNA, 18 bp, Homo sapiens
aaattgtcagatgctgtg

SEQ ID NO: 1840615 - DNA, 22 bp, Homo sapiens
aaatttagcattgtagtgcttt

SEQ ID NO: 1840616 - DNA, 14 bp, Homo sapiens
aaattttagattta

SEQ ID NO: 1840617 - DNA, 17 bp, Homo sapiens
aaatttttatgtaatta

SEQ ID NO: 1840618 - DNA, 23 bp, Homo sapiens
aacaaatgccaaattaaaaaaga

SEQ ID NO: 1840619 - DNA, 14 bp, Homo sapiens
aacaaattgcattt

SEQ ID NO: 1840620 - DNA, 17 bp, Homo sapiens
aacaaattgcatttgtg

SEQ ID NO: 1840621 - DNA, 17 bp, Homo sapiens
aacaagacttcagattc

SEQ ID NO: 1840622 - DNA, 16 bp, Homo sapiens
aacaagagaagcattc

SEQ ID NO: 1840623 - DNA, 18 bp, Homo sapiens
aacaatagtaattctcag

SEQ ID NO: 1840624 - DNA, 14 bp, Homo sapiens
aacaattatttgaa

SEQ ID NO: 1840625 - DNA, 17 bp, Homo sapiens
aacactcattgacctga

SEQ ID NO: 1840626 - DNA, 22 bp, Homo sapiens
tggtgtttttttctatgggtgt

SEQ ID NO: 1840627 - DNA, 15 bp, Homo sapiens
tggttaagtctgttt

SEQ ID NO: 1840628 - DNA, 18 bp, Homo sapiens
tggttcttgtattaagaa

SEQ ID NO: 1840629 - DNA, 19 bp, Homo sapiens
tggttcttgtattaagaat

SEQ ID NO: 1840630 - DNA, 23 bp, Homo sapiens
tggtttttaaaaaactgctgact

SEQ ID NO: 1840631 - DNA, 16 bp, Homo sapiens
tgtaacaacaattatt

SEQ ID NO: 1840632 - DNA, 18 bp, Homo sapiens
tgtaagagcttgctccag

SEQ ID NO: 1840633 - DNA, 23 bp, Homo sapiens
tgtacaaggacagcccctcctcc

SEQ ID NO: 1840634 - DNA, 18 bp, Homo sapiens
tgtacagagcccacgccc

SEQ ID NO: 1840635 - DNA, 15 bp, Homo sapiens
tgtactctacaaaat

SEQ ID NO: 1840636 - DNA, 19 bp, Homo sapiens
tgtactctacaaaatatag

SEQ ID NO: 1840637 - DNA, 17 bp, Homo sapiens
tgtaggcataaagtcag

SEQ ID NO: 1840638 - DNA, 15 bp, Homo sapiens
tgtagtcagttgcat

SEQ ID NO: 1840639 - DNA, 11 bp, Homo sapiens
tgtatctgtgt

SEQ ID NO: 1840640 - DNA, 19 bp, Homo sapiens
tgtattatgttccaaggct

SEQ ID NO: 1840641 - DNA, 17 bp, Homo sapiens
tgtattttatgttatat

SEQ ID NO: 1840642 - DNA, 14 bp, Homo sapiens
tgtcaaggaagaag

SEQ ID NO: 1840643 - DNA, 22 bp, Homo sapiens
tgtcagttgttatttattgaaa

SEQ ID NO: 1840644 - DNA, 18 bp, Homo sapiens
tgtccaaagcagggtctg

SEQ ID NO: 1840645 - DNA, 15 bp, Homo sapiens
tgtccaagaagccca

SEQ ID NO: 1840646 - DNA, 22 bp, Homo sapiens
tgtccaagaagcccaggaaagg

SEQ ID NO: 1840647 - DNA, 12 bp, Homo sapiens
tgtccccagcag

SEQ ID NO: 1840648 - DNA, 13 bp, Homo sapiens
tgtccgagctttg

SEQ ID NO: 1840649 - DNA, 14 bp, Homo sapiens
tgtcctcaccacat

SEQ ID NO: 1840650 - DNA, 22 bp, Homo sapiens
tgtcctgcctaaggctgaactt

SEQ ID NO: 1840651 - DNA, 23 bp, Homo sapiens
tgtctagttgtttgattcagaca

SEQ ID NO: 1840652 - DNA, 21 bp, Homo sapiens
tgtctcaaaaaaagaaaaaga

SEQ ID NO: 1840653 - DNA, 20 bp, Homo sapiens
tgtctccctcccctctcaga

SEQ ID NO: 1840654 - DNA, 18 bp, Homo sapiens
tgtctccttaacactgag

SEQ ID NO: 1840655 - DNA, 13 bp, Homo sapiens
tgtctctggcctg

SEQ ID NO: 1840656 - DNA, 18 bp, Homo sapiens
tgtctcttggtcctgctg

SEQ ID NO: 1840657 - DNA, 21 bp, Homo sapiens
tgtctcttggtcctgctgcag

SEQ ID NO: 1840658 - DNA, 22 bp, Homo sapiens
tgtctcttggtcctgctgcagt

SEQ ID NO: 1840659 - DNA, 17 bp, Homo sapiens
tgtctgctaaataaaca

SEQ ID NO: 1840660 - DNA, 15 bp, Homo sapiens
tgtctgtctccctcc

SEQ ID NO: 1840661 - DNA, 14 bp, Homo sapiens
tgtctttggaccct

SEQ ID NO: 1840662 - DNA, 16 bp, Homo sapiens
tgtctttggaccctga

SEQ ID NO: 1840663 - DNA, 19 bp, Homo sapiens
tgtctttggaccctgaggc

SEQ ID NO: 1840664 - DNA, 23 bp, Homo sapiens
tgtcttttcttgcatgaggctag

SEQ ID NO: 1840665 - DNA, 17 bp, Homo sapiens
tgtgaaaagaaaaatga

SEQ ID NO: 1840666 - DNA, 21 bp, Homo sapiens
tgtgaaaggaaagagggaggt

SEQ ID NO: 1840667 - DNA, 19 bp, Homo sapiens
tgtgaactaaactttcaca

SEQ ID NO: 1840668 - DNA, 20 bp, Homo sapiens
tgtgaactaaactttcacac

SEQ ID NO: 1840669 - DNA, 23 bp, Homo sapiens
tgtgaactgaactctgacaacag

SEQ ID NO: 1840670 - DNA, 19 bp, Homo sapiens
tgtgaattgaaatgttcgt

SEQ ID NO: 1840671 - DNA, 17 bp, Homo sapiens
tgtgacaggcagcagag

SEQ ID NO: 1840672 - DNA, 14 bp, Homo sapiens
tgtgacagtgcctc

SEQ ID NO: 1840673 - DNA, 20 bp, Homo sapiens
tgtgacagtgcctcttccag

SEQ ID NO: 1840674 - DNA, 11 bp, Homo sapiens
tgtgaggaagc

SEQ ID NO: 1840675 - DNA, 12 bp, Homo sapiens
tgtgaggaagcc

SEQ ID NO: 1840676 - DNA, 13 bp, Homo sapiens
tgtgaggaagccg

SEQ ID NO: 1840677 - DNA, 18 bp, Homo sapiens
tgtgaggaagccgctggg

SEQ ID NO: 1840678 - DNA, 19 bp, Homo sapiens
tgtgagtactacagtcctc

SEQ ID NO: 1840679 - DNA, 23 bp, Homo sapiens
tgtgagtactacagtcctcccat

SEQ ID NO: 1840680 - DNA, 13 bp, Homo sapiens
tgtgatgcatttt

SEQ ID NO: 1840681 - DNA, 16 bp, Homo sapiens
tgtgatttaggtcagt

SEQ ID NO: 1840682 - DNA, 14 bp, Homo sapiens
tgtgcaacagacaa

SEQ ID NO: 1840683 - DNA, 16 bp, Homo sapiens
tgtgcaatgtgtataa

SEQ ID NO: 1840684 - DNA, 17 bp, Homo sapiens
tgtgcaggagcggcaga

SEQ ID NO: 1840685 - DNA, 15 bp, Homo sapiens
tgtgcctaatgtgtt

SEQ ID NO: 1840686 - DNA, 13 bp, Homo sapiens
tgtgccttttctg

SEQ ID NO: 1840687 - DNA, 15 bp, Homo sapiens
tgtgcggctgtgtgt

SEQ ID NO: 1840688 - DNA, 17 bp, Homo sapiens
tgtgcggctgtgtgtgc

SEQ ID NO: 1840689 - DNA, 18 bp, Homo sapiens
tgtgctgagtctgaaggc

SEQ ID NO: 1840690 - DNA, 18 bp, Homo sapiens
tgtgctgccctgcccacc

SEQ ID NO: 1840691 - DNA, 20 bp, Homo sapiens
tgtgctgccctgcccacctg

SEQ ID NO: 1840692 - DNA, 12 bp, Homo sapiens
tgtggagaagcg

SEQ ID NO: 1840693 - DNA, 21 bp, Homo sapiens
tgtggagaagcggctggcagc

SEQ ID NO: 1840694 - DNA, 13 bp, Homo sapiens
tgtggagggcaca

SEQ ID NO: 1840695 - DNA, 20 bp, Homo sapiens
tgtggagttcaccttggaag

SEQ ID NO: 1840696 - DNA, 14 bp, Homo sapiens
tgtggatgataaaa

SEQ ID NO: 1840697 - DNA, 16 bp, Homo sapiens
tgtggcctgggcctcc

SEQ ID NO: 1840698 - DNA, 23 bp, Homo sapiens
tgtggcgcagcatattcaggaag

SEQ ID NO: 1840699 - DNA, 22 bp, Homo sapiens
tgtggtcaacatttctcatgtt

SEQ ID NO: 1840700 - DNA, 13 bp, Homo sapiens
tgtggtcccaccc

SEQ ID NO: 1840701 - DNA, 13 bp, Homo sapiens
tgtgtataaacaa

SEQ ID NO: 1840702 - DNA, 19 bp, Homo sapiens
tgtgtcagcatagaagtaa

SEQ ID NO: 1840703 - DNA, 16 bp, Homo sapiens
tgtgtctcttggtcct

SEQ ID NO: 1840704 - DNA, 18 bp, Homo sapiens
tgtgtctgccaaacacat

SEQ ID NO: 1840705 - DNA, 21 bp, Homo sapiens
tgtgtctgccaaacacattta

SEQ ID NO: 1840706 - DNA, 23 bp, Homo sapiens
tgtgtggtcaacatttctcatgt

SEQ ID NO: 1840707 - DNA, 22 bp, Homo sapiens
tgttaactgagtgccttttggt

SEQ ID NO: 1840708 - DNA, 20 bp, Homo sapiens
tgttaagtatcagctacaat

SEQ ID NO: 1840709 - DNA, 15 bp, Homo sapiens
tgttactgtcttcag

SEQ ID NO: 1840710 - DNA, 20 bp, Homo sapiens
tgttagaagaggtggcccca

SEQ ID NO: 1840711 - DNA, 14 bp, Homo sapiens
tgttatgaacagct

SEQ ID NO: 1840712 - DNA, 15 bp, Homo sapiens
tgttatgaacagctg

SEQ ID NO: 1840713 - DNA, 20 bp, Homo sapiens
tgttatgaacagctgtgtct

SEQ ID NO: 1840714 - DNA, 21 bp, Homo sapiens
tgttatttataatcacttttt

SEQ ID NO: 1840715 - DNA, 17 bp, Homo sapiens
tgttatttattgaaatg

SEQ ID NO: 1840716 - DNA, 18 bp, Homo sapiens
tgttatttattgaaatga

SEQ ID NO: 1840717 - DNA, 21 bp, Homo sapiens
tgttcattaaacgtcattcag

SEQ ID NO: 1840718 - DNA, 15 bp, Homo sapiens
tgttccattaaacga

SEQ ID NO: 1840719 - DNA, 15 bp, Homo sapiens
tgttctcatgaagca

SEQ ID NO: 1840720 - DNA, 17 bp, Homo sapiens
tgttctcatgaagcagg

SEQ ID NO: 1840721 - DNA, 21 bp, Homo sapiens
tgttctccagtcattatgtta

SEQ ID NO: 1840722 - DNA, 16 bp, Homo sapiens
tgttctctcttctcca

SEQ ID NO: 1840723 - DNA, 19 bp, Homo sapiens
tgttctctgccctccaaga

SEQ ID NO: 1840724 - DNA, 16 bp, Homo sapiens
tgttctggctcttcca

SEQ ID NO: 1840725 - DNA, 21 bp, Homo sapiens
tgttctggctcttccaggctg

SEQ ID NO: 1840726 - DNA, 16 bp, Homo sapiens
tgttgaaactttaaga

SEQ ID NO: 1840727 - DNA, 20 bp, Homo sapiens
tgttggttggttttcttctt

SEQ ID NO: 1840728 - DNA, 18 bp, Homo sapiens
tgtttagactttaacata

SEQ ID NO: 1840729 - DNA, 23 bp, Homo sapiens
tgtttagactttaacataagcta

SEQ ID NO: 1840730 - DNA, 15 bp, Homo sapiens
tgtttagatgaatgt

SEQ ID NO: 1840731 - DNA, 23 bp, Homo sapiens
tgtttcctagcacacacttttgg

SEQ ID NO: 1840732 - DNA, 21 bp, Homo sapiens
tgtttcctggcactgcttcca

SEQ ID NO: 1840733 - DNA, 15 bp, Homo sapiens
tgtttgtaagattta

SEQ ID NO: 1840734 - DNA, 11 bp, Homo sapiens
tgtttgttggt

SEQ ID NO: 1840735 - DNA, 16 bp, Homo sapiens
tgtttgttgtcagctg

SEQ ID NO: 1840736 - DNA, 17 bp, Homo sapiens
tgtttgttgtcagctga

SEQ ID NO: 1840737 - DNA, 13 bp, Homo sapiens
tgttttcaaatgt

SEQ ID NO: 1840738 - DNA, 20 bp, Homo sapiens
tgttttccatgagtcccctg

SEQ ID NO: 1840739 - DNA, 21 bp, Homo sapiens
ttctcagaaggcaaatgactt

SEQ ID NO: 1840740 - DNA, 18 bp, Homo sapiens
ttctcagggtctctgctg

SEQ ID NO: 1840741 - DNA, 20 bp, Homo sapiens
ttctcagggtctctgctgcc

SEQ ID NO: 1840742 - DNA, 13 bp, Homo sapiens
ttctcatgaagca

SEQ ID NO: 1840743 - DNA, 18 bp, Homo sapiens
ttctcattggaaatttag

SEQ ID NO: 1840744 - DNA, 21 bp, Homo sapiens
ttctccacctcccacaaagga

SEQ ID NO: 1840745 - DNA, 14 bp, Homo sapiens
ttctccacctgcca

SEQ ID NO: 1840746 - DNA, 16 bp, Homo sapiens
ttctccacctgccagg

SEQ ID NO: 1840747 - DNA, 19 bp, Homo sapiens
ttctcgtcctcgtttgtgt

SEQ ID NO: 1840748 - DNA, 11 bp, Homo sapiens
ttctctgccct

SEQ ID NO: 1840749 - DNA, 12 bp, Homo sapiens
ttctctgccctc

SEQ ID NO: 1840750 - DNA, 16 bp, Homo sapiens
ttctctgccctccaag

SEQ ID NO: 1840751 - DNA, 18 bp, Homo sapiens
ttctgaaacacacgagca

SEQ ID NO: 1840752 - DNA, 22 bp, Homo sapiens
ttctgagcagcgagcctgctag

SEQ ID NO: 1840753 - DNA, 17 bp, Homo sapiens
ttctggctcttccaggc

SEQ ID NO: 1840754 - DNA, 12 bp, Homo sapiens
ttctggtgtgaa

SEQ ID NO: 1840755 - DNA, 20 bp, Homo sapiens
ttctggtgtgaactaaactt

SEQ ID NO: 1840756 - DNA, 17 bp, Homo sapiens
ttctgtccgagctttga

SEQ ID NO: 1840757 - DNA, 21 bp, Homo sapiens
ttctgtccgagctttgaaaat

SEQ ID NO: 1840758 - DNA, 19 bp, Homo sapiens
ttcttaaataataaagatc

SEQ ID NO: 1840759 - DNA, 23 bp, Homo sapiens
ttcttagctcaatgagcatgttt

SEQ ID NO: 1840760 - DNA, 13 bp, Homo sapiens
ttcttcctccctc

SEQ ID NO: 1840761 - DNA, 14 bp, Homo sapiens
ttcttctccctcag

SEQ ID NO: 1840762 - DNA, 14 bp, Homo sapiens
ttcttcttctcgtc

SEQ ID NO: 1840763 - DNA, 16 bp, Homo sapiens
ttcttggttggctggc

SEQ ID NO: 1840764 - DNA, 19 bp, Homo sapiens
ttcttgtactctacaaaat

SEQ ID NO: 1840765 - DNA, 12 bp, Homo sapiens
ttcttgtattaa

SEQ ID NO: 1840766 - DNA, 13 bp, Homo sapiens
ttctttcatttct

SEQ ID NO: 1840767 - DNA, 21 bp, Homo sapiens
ttctttcctgaggctgggctc

SEQ ID NO: 1840768 - DNA, 11 bp, Homo sapiens
ttctttgttct

SEQ ID NO: 1840769 - DNA, 19 bp, Homo sapiens
ttgaaaacactgttctctg

SEQ ID NO: 1840770 - DNA, 22 bp, Homo sapiens
ttgaaaacactgttctctgccc

SEQ ID NO: 1840771 - DNA, 14 bp, Homo sapiens
ttgaaactttaaga

SEQ ID NO: 1840772 - DNA, 21 bp, Homo sapiens
ttgaacatgtgccttttctga

SEQ ID NO: 1840773 - DNA, 19 bp, Homo sapiens
ttgaaggtagaatgttttc

SEQ ID NO: 1840774 - DNA, 19 bp, Homo sapiens
ttgacgccatcccagcccc

SEQ ID NO: 1840775 - DNA, 22 bp, Homo sapiens
ttgacgccatcccagccccaat

SEQ ID NO: 1840776 - DNA, 14 bp, Homo sapiens
ttgagcctgggagg

SEQ ID NO: 1840777 - DNA, 15 bp, Homo sapiens
ttgaggattgtggaa

SEQ ID NO: 1840778 - DNA, 21 bp, Homo sapiens
ttgaggattgtggaaaaccag

SEQ ID NO: 1840779 - DNA, 14 bp, Homo sapiens
ttgagtgacagctt

SEQ ID NO: 1840780 - DNA, 21 bp, Homo sapiens
ttgatagcacagaccctgccc

SEQ ID NO: 1840781 - DNA, 23 bp, Homo sapiens
ttgatagcacagaccctgccctg

SEQ ID NO: 1840782 - DNA, 17 bp, Homo sapiens
ttgatatagaacagtgc

SEQ ID NO: 1840783 - DNA, 16 bp, Homo sapiens
ttgatgttggctggga

SEQ ID NO: 1840784 - DNA, 14 bp, Homo sapiens
ttgattcagacagc

SEQ ID NO: 1840785 - DNA, 15 bp, Homo sapiens
ttgattcagacagct

SEQ ID NO: 1840786 - DNA, 20 bp, Homo sapiens
ttgcaaatagccagtgctag

SEQ ID NO: 1840787 - DNA, 14 bp, Homo sapiens
ttgcaccactgcac

SEQ ID NO: 1840788 - DNA, 18 bp, Homo sapiens
ttgcacctgcagccaagc

SEQ ID NO: 1840789 - DNA, 21 bp, Homo sapiens
ttgcacctgcagccaagcaaa

SEQ ID NO: 1840790 - DNA, 22 bp, Homo sapiens
ttgcacctgcagccaagcaaat

SEQ ID NO: 1840791 - DNA, 14 bp, Homo sapiens
ttgcacggctgctg

SEQ ID NO: 1840792 - DNA, 14 bp, Homo sapiens
ttgcagaatgatgc

SEQ ID NO: 1840793 - DNA, 11 bp, Homo sapiens
ttgcatttgtg

SEQ ID NO: 1840794 - DNA, 16 bp, Homo sapiens
ttgccaccctcatgct

SEQ ID NO: 1840795 - DNA, 18 bp, Homo sapiens
ttgccagtcaccccggcc

SEQ ID NO: 1840796 - DNA, 23 bp, Homo sapiens
ttgcctttagtgatcacagcagc

SEQ ID NO: 1840797 - DNA, 18 bp, Homo sapiens
ttgctcaatacctggcct

SEQ ID NO: 1840798 - DNA, 22 bp, Homo sapiens
ttgcttcctcagtaacatttct

SEQ ID NO: 1840799 - DNA, 22 bp, Homo sapiens
ttgctttaatataaatgcaaat

SEQ ID NO: 1840800 - DNA, 14 bp, Homo sapiens
ttgctttgcccagc

SEQ ID NO: 1840801 - DNA, 18 bp, Homo sapiens
ttgcttttcatgcaaact

SEQ ID NO: 1840802 - DNA, 22 bp, Homo sapiens
ttgcttttcatgcaaactcttt

SEQ ID NO: 1840803 - DNA, 16 bp, Homo sapiens
ttggacagaagcagct

SEQ ID NO: 1840804 - DNA, 17 bp, Homo sapiens
ttggacattttatgtct

SEQ ID NO: 1840805 - DNA, 15 bp, Homo sapiens
ttggactggatgcat

SEQ ID NO: 1840806 - DNA, 15 bp, Homo sapiens
ttggattcaatttta

SEQ ID NO: 1840807 - DNA, 14 bp, Homo sapiens
ttggcaaagccaga

SEQ ID NO: 1840808 - DNA, 13 bp, Homo sapiens
ttggcattcccca

SEQ ID NO: 1840809 - DNA, 16 bp, Homo sapiens
ttggctgctgaaggct

SEQ ID NO: 1840810 - DNA, 18 bp, Homo sapiens
ttgggccccagaggctgg

SEQ ID NO: 1840811 - DNA, 13 bp, Homo sapiens
ttggtcgtttttt

SEQ ID NO: 1840812 - DNA, 16 bp, Homo sapiens
ttggttgctttaatat

SEQ ID NO: 1840813 - DNA, 14 bp, Homo sapiens
ttggttttcttctt

SEQ ID NO: 1840814 - DNA, 21 bp, Homo sapiens
ttgtaactgtttagatgaatg

SEQ ID NO: 1840815 - DNA, 15 bp, Homo sapiens
ttgtactctacaaaa

SEQ ID NO: 1840816 - DNA, 21 bp, Homo sapiens
ttgtagcgtctttcttttttg

SEQ ID NO: 1840817 - DNA, 20 bp, Homo sapiens
ttgtattttactaataaaat

SEQ ID NO: 1840818 - DNA, 17 bp, Homo sapiens
ttgtcaggagtgtgtgt

SEQ ID NO: 1840819 - DNA, 17 bp, Homo sapiens
ttgtctgtctccctccc

SEQ ID NO: 1840820 - DNA, 15 bp, Homo sapiens
ttgtcttaaaaagtg

SEQ ID NO: 1840821 - DNA, 20 bp, Homo sapiens
ttgtctttggaccctgaggc

SEQ ID NO: 1840822 - DNA, 22 bp, Homo sapiens
ttgtgaaggcaggggaatgtat

SEQ ID NO: 1840823 - DNA, 12 bp, Homo sapiens
ttgtgagctgga

SEQ ID NO: 1840824 - DNA, 13 bp, Homo sapiens
ttgtgagctggat

SEQ ID NO: 1840825 - DNA, 18 bp, Homo sapiens
ttgtgaggaagccgctgg

SEQ ID NO: 1840826 - DNA, 20 bp, Homo sapiens
ttgtgcaatgtgtataaaca

SEQ ID NO: 1840827 - DNA, 21 bp, Homo sapiens
ttgtgcaatgtgtataaacaa

SEQ ID NO: 1840828 - DNA, 15 bp, Homo sapiens
ttgtgcctaatgtgt

SEQ ID NO: 1840829 - DNA, 15 bp, Homo sapiens
ttgtgtctcttatgg

SEQ ID NO: 1840830 - DNA, 15 bp, Homo sapiens
ttgtgttctgttttg

SEQ ID NO: 1840831 - DNA, 19 bp, Homo sapiens
ttgttctgttttgtgagaa

SEQ ID NO: 1840832 - DNA, 18 bp, Homo sapiens
ttgtttcgctctttgaga

SEQ ID NO: 1840833 - DNA, 21 bp, Homo sapiens
tttaaaaaattaatctgggcc

SEQ ID NO: 1840834 - DNA, 21 bp, Homo sapiens
tttaaaatgaaatgcattttg

SEQ ID NO: 1840835 - DNA, 11 bp, Homo sapiens
tttaaaatgta

SEQ ID NO: 1840836 - DNA, 23 bp, Homo sapiens
tttaaatgaacaagagaagcatt

SEQ ID NO: 1840837 - DNA, 12 bp, Homo sapiens
tttaacaaaatt

SEQ ID NO: 1840838 - DNA, 14 bp, Homo sapiens
tttaacataagcta

SEQ ID NO: 1840839 - DNA, 16 bp, Homo sapiens
tttaacataagctatt

SEQ ID NO: 1840840 - DNA, 17 bp, Homo sapiens
tttaacataagctattt

SEQ ID NO: 1840841 - DNA, 18 bp, Homo sapiens
tttaacataagctatttt

SEQ ID NO: 1840842 - DNA, 19 bp, Homo sapiens
tttaacataagctattttt

SEQ ID NO: 1840843 - DNA, 23 bp, Homo sapiens
tcactgagacagcccgggctctg

SEQ ID NO: 1840844 - DNA, 22 bp, Homo sapiens
tcactgttctattcatctcaag

SEQ ID NO: 1840845 - DNA, 15 bp, Homo sapiens
tcacttcaccctgga

SEQ ID NO: 1840846 - DNA, 16 bp, Homo sapiens
tcacttttttccacat

SEQ ID NO: 1840847 - DNA, 22 bp, Homo sapiens
tcagaaacaccctcacactggg

SEQ ID NO: 1840848 - DNA, 20 bp, Homo sapiens
tcagaacatactgattggga

SEQ ID NO: 1840849 - DNA, 18 bp, Homo sapiens
tcagaaggcaaatgactt

SEQ ID NO: 1840850 - DNA, 22 bp, Homo sapiens
tcagaaggcaaatgactttgga

SEQ ID NO: 1840851 - DNA, 14 bp, Homo sapiens
tcagacagctgcct

SEQ ID NO: 1840852 - DNA, 21 bp, Homo sapiens
tcagagagggtgggagtgggc

SEQ ID NO: 1840853 - DNA, 15 bp, Homo sapiens
tcagagatataataa

SEQ ID NO: 1840854 - DNA, 21 bp, Homo sapiens
tcagatgctgtgcaaatgtta

SEQ ID NO: 1840855 - DNA, 20 bp, Homo sapiens
tcagcagaacctgcacacag

SEQ ID NO: 1840856 - DNA, 17 bp, Homo sapiens
tcagcaggagccaatat

SEQ ID NO: 1840857 - DNA, 14 bp, Homo sapiens
tcagcccctgatcc

SEQ ID NO: 1840858 - DNA, 15 bp, Homo sapiens
tcagctgaacctggg

SEQ ID NO: 1840859 - DNA, 13 bp, Homo sapiens
tcaggaagctcag

SEQ ID NO: 1840860 - DNA, 15 bp, Homo sapiens
tcaggaagctcaggg

SEQ ID NO: 1840861 - DNA, 14 bp, Homo sapiens
tcaggaatcatctc

SEQ ID NO: 1840862 - DNA, 10 bp, Homo sapiens
tcaggagcag

SEQ ID NO: 1840863 - DNA, 21 bp, Homo sapiens
tcaggagcagcctcagaacaa

SEQ ID NO: 1840864 - DNA, 20 bp, Homo sapiens
tcaggcagcaccacactggg

SEQ ID NO: 1840865 - DNA, 16 bp, Homo sapiens
tcaggccaggccctct

SEQ ID NO: 1840866 - DNA, 21 bp, Homo sapiens
tcaggccaggccctctgccca

SEQ ID NO: 1840867 - DNA, 21 bp, Homo sapiens
tcaggccatcatcagtggagc

SEQ ID NO: 1840868 - DNA, 17 bp, Homo sapiens
tcagggtctctgctgcc

SEQ ID NO: 1840869 - DNA, 21 bp, Homo sapiens
tcaggtgagaagcagaggaag

SEQ ID NO: 1840870 - DNA, 17 bp, Homo sapiens
tcaggtggggtcactct

SEQ ID NO: 1840871 - DNA, 21 bp, Homo sapiens
tcagtaacatttctgttctca

SEQ ID NO: 1840872 - DNA, 13 bp, Homo sapiens
tcagtaagccgtg

SEQ ID NO: 1840873 - DNA, 19 bp, Homo sapiens
tcagtagactgtgattctt

SEQ ID NO: 1840874 - DNA, 14 bp, Homo sapiens
tcagtattgaagca

SEQ ID NO: 1840875 - DNA, 23 bp, Homo sapiens
tcagtattgaagcattttataaa

SEQ ID NO: 1840876 - DNA, 12 bp, Homo sapiens
tcagtggagcca

SEQ ID NO: 1840877 - DNA, 17 bp, Homo sapiens
tcagttaagcctttgga

SEQ ID NO: 1840878 - DNA, 18 bp, Homo sapiens
tcagttagagctgacaca

SEQ ID NO: 1840879 - DNA, 13 bp, Homo sapiens
tcataattggaat

SEQ ID NO: 1840880 - DNA, 15 bp, Homo sapiens
tcataccacaataaa

SEQ ID NO: 1840881 - DNA, 17 bp, Homo sapiens
tcatagctcataagagt

SEQ ID NO: 1840882 - DNA, 23 bp, Homo sapiens
tcatcaaatggaagacacattga

SEQ ID NO: 1840883 - DNA, 16 bp, Homo sapiens
tcatcaaggcactgcc

SEQ ID NO: 1840884 - DNA, 21 bp, Homo sapiens
tcatcaaggcactgcctgatg

SEQ ID NO: 1840885 - DNA, 19 bp, Homo sapiens
tcatcaccaacgtctgtgc

SEQ ID NO: 1840886 - DNA, 20 bp, Homo sapiens
tcatcagtattgaagcattt

SEQ ID NO: 1840887 - DNA, 18 bp, Homo sapiens
tcatcctcatacccaccc

SEQ ID NO: 1840888 - DNA, 14 bp, Homo sapiens
tcatccttgtctta

SEQ ID NO: 1840889 - DNA, 17 bp, Homo sapiens
tcatctgcattcctgat

SEQ ID NO: 1840890 - DNA, 18 bp, Homo sapiens
tcatctggaaccatcaga

SEQ ID NO: 1840891 - DNA, 22 bp, Homo sapiens
tcatctgtaagagcttgctcca

SEQ ID NO: 1840892 - DNA, 13 bp, Homo sapiens
tcatgcaaactct

SEQ ID NO: 1840893 - DNA, 17 bp, Homo sapiens
tcatgcaaaggctggga

SEQ ID NO: 1840894 - DNA, 15 bp, Homo sapiens
tcatgcccagctctc

SEQ ID NO: 1840895 - DNA, 18 bp, Homo sapiens
tcatgcccagctctctga

SEQ ID NO: 1840896 - DNA, 19 bp, Homo sapiens
tcatgcccagctctctgac

SEQ ID NO: 1840897 - DNA, 20 bp, Homo sapiens
tcatgcccagctctctgacg

SEQ ID NO: 1840898 - DNA, 15 bp, Homo sapiens
tcatgcctggcttcg

SEQ ID NO: 1840899 - DNA, 18 bp, Homo sapiens
tcatgcctggcttcgcaa

SEQ ID NO: 1840900 - DNA, 23 bp, Homo sapiens
tcatggtggccacggccacagcc

SEQ ID NO: 1840901 - DNA, 17 bp, Homo sapiens
tcattatgttaatattt

SEQ ID NO: 1840902 - DNA, 14 bp, Homo sapiens
tcattatttatgta

SEQ ID NO: 1840903 - DNA, 16 bp, Homo sapiens
tcattatttatgtatt

SEQ ID NO: 1840904 - DNA, 22 bp, Homo sapiens
tcattatttatgtattgtgcaa

SEQ ID NO: 1840905 - DNA, 21 bp, Homo sapiens
tcattcaacccacctgcgtct

SEQ ID NO: 1840906 - DNA, 12 bp, Homo sapiens
tcattgacctga

SEQ ID NO: 1840907 - DNA, 23 bp, Homo sapiens
tcatttatcatcacaaatggcta

SEQ ID NO: 1840908 - DNA, 12 bp, Homo sapiens
tcatttcaggat

SEQ ID NO: 1840909 - DNA, 24 bp, Homo sapiens
tcattttgcacctgcagccaagca

SEQ ID NO: 1840910 - DNA, 19 bp, Homo sapiens
tccaaatgcagctttaaaa

SEQ ID NO: 1840911 - DNA, 19 bp, Homo sapiens
tccaagaccttctccttca

SEQ ID NO: 1840912 - DNA, 15 bp, Homo sapiens
tccaagctcccaggc

SEQ ID NO: 1840913 - DNA, 21 bp, Homo sapiens
tccaaggaaaccacagctgct

SEQ ID NO: 1840914 - DNA, 23 bp, Homo sapiens
tccaaggaaaccacagctgctgg

SEQ ID NO: 1840915 - DNA, 20 bp, Homo sapiens
tccaaggctactacagagaa

SEQ ID NO: 1840916 - DNA, 21 bp, Homo sapiens
tccaattttaaaatgaaatgc

SEQ ID NO: 1840917 - DNA, 18 bp, Homo sapiens
tccacctgccagggacag

SEQ ID NO: 1840918 - DNA, 14 bp, Homo sapiens
tccaccttccaaag

SEQ ID NO: 1840919 - DNA, 15 bp, Homo sapiens
tccaccttccaaaga

SEQ ID NO: 1840920 - DNA, 15 bp, Homo sapiens
tccaccttctgggtt

SEQ ID NO: 1840921 - DNA, 18 bp, Homo sapiens
tccagagtggagatccca

SEQ ID NO: 1840922 - DNA, 15 bp, Homo sapiens
gctgctgaaggctcg

SEQ ID NO: 1840923 - DNA, 14 bp, Homo sapiens
gctgctggagactc

SEQ ID NO: 1840924 - DNA, 16 bp, Homo sapiens
gctggaacagattcac

SEQ ID NO: 1840925 - DNA, 13 bp, Homo sapiens
gctggagactcct

SEQ ID NO: 1840926 - DNA, 18 bp, Homo sapiens
gctggagactcctaggca

SEQ ID NO: 1840927 - DNA, 20 bp, Homo sapiens
gctggatagacttgggatgg

SEQ ID NO: 1840928 - DNA, 13 bp, Homo sapiens
gctggccgggacc

SEQ ID NO: 1840929 - DNA, 12 bp, Homo sapiens
gctggcctggcc

SEQ ID NO: 1840930 - DNA, 17 bp, Homo sapiens
gctggcctggcccctca

SEQ ID NO: 1840931 - DNA, 19 bp, Homo sapiens
gctggcctggcccctcagg

SEQ ID NO: 1840932 - DNA, 21 bp, Homo sapiens
gctgggaactcacctggggct

SEQ ID NO: 1840933 - DNA, 22 bp, Homo sapiens
gctgggaattacaggcgtgagc

SEQ ID NO: 1840934 - DNA, 20 bp, Homo sapiens
gctgggagaccctccccaca

SEQ ID NO: 1840935 - DNA, 12 bp, Homo sapiens
gctgggagagcc

SEQ ID NO: 1840936 - DNA, 13 bp, Homo sapiens
gctgggagagcct

SEQ ID NO: 1840937 - DNA, 12 bp, Homo sapiens
gctgggctccct

SEQ ID NO: 1840938 - DNA, 20 bp, Homo sapiens
gctggggaagtcctctgggt

SEQ ID NO: 1840939 - DNA, 12 bp, Homo sapiens
gctggggccagt

SEQ ID NO: 1840940 - DNA, 15 bp, Homo sapiens
gctgggtggcactgc

SEQ ID NO: 1840941 - DNA, 20 bp, Homo sapiens
gctgggttctacccaggtgc

SEQ ID NO: 1840942 - DNA, 15 bp, Homo sapiens
gctgggttctgatcc

SEQ ID NO: 1840943 - DNA, 12 bp, Homo sapiens
gctgtgctgccc

SEQ ID NO: 1840944 - DNA, 17 bp, Homo sapiens
gctgtgctgccctgccc

SEQ ID NO: 1840945 - DNA, 21 bp, Homo sapiens
gctgtggggctaggggctggg

SEQ ID NO: 1840946 - DNA, 21 bp, Homo sapiens
gctgtgtctgccaaacacatt

SEQ ID NO: 1840947 - DNA, 14 bp, Homo sapiens
gctgttcagctggt

SEQ ID NO: 1840948 - DNA, 19 bp, Homo sapiens
gcttagcagtccccttccc

SEQ ID NO: 1840949 - DNA, 17 bp, Homo sapiens
gcttagtcactgagaca

SEQ ID NO: 1840950 - DNA, 19 bp, Homo sapiens
gcttagtcactgagacagc

SEQ ID NO: 1840951 - DNA, 20 bp, Homo sapiens
gcttagtcactgagacagcc

SEQ ID NO: 1840952 - DNA, 16 bp, Homo sapiens
gcttatttaataaaga

SEQ ID NO: 1840953 - DNA, 18 bp, Homo sapiens
gcttcattagagcaggcg

SEQ ID NO: 1840954 - DNA, 19 bp, Homo sapiens
gcttccagtgaggctctgc

SEQ ID NO: 1840955 - DNA, 18 bp, Homo sapiens
gcttcccagtggctgctg

SEQ ID NO: 1840956 - DNA, 19 bp, Homo sapiens
gcttcccagtggctgctgc

SEQ ID NO: 1840957 - DNA, 17 bp, Homo sapiens
gcttctcactgccatgc

SEQ ID NO: 1840958 - DNA, 18 bp, Homo sapiens
gcttctgagcagcgagcc

SEQ ID NO: 1840959 - DNA, 23 bp, Homo sapiens
gcttctgagcagcgagcctgcta

SEQ ID NO: 1840960 - DNA, 17 bp, Homo sapiens
gcttgaaatagtgtctg

SEQ ID NO: 1840961 - DNA, 16 bp, Homo sapiens
gcttgccacagagcgg

SEQ ID NO: 1840962 - DNA, 21 bp, Homo sapiens
gcttgctccagattctgatgc

SEQ ID NO: 1840963 - DNA, 19 bp, Homo sapiens
ggggctaggggctggggcc

SEQ ID NO: 1840964 - DNA, 12 bp, Homo sapiens
ggggctgcaccg

SEQ ID NO: 1840965 - DNA, 13 bp, Homo sapiens
ggggctgggacat

SEQ ID NO: 1840966 - DNA, 12 bp, Homo sapiens
gggggaaagcac

SEQ ID NO: 1840967 - DNA, 22 bp, Homo sapiens
gggggaggtgggatcctccagg

SEQ ID NO: 1840968 - DNA, 11 bp, Homo sapiens
gggggctggga

SEQ ID NO: 1840969 - DNA, 21 bp, Homo sapiens
ggggtaaagggcgcaaagggc

SEQ ID NO: 1840970 - DNA, 22 bp, Homo sapiens
ggggtcactctggcagctcaga

SEQ ID NO: 1840971 - DNA, 12 bp, Homo sapiens
ggggtcccagca

SEQ ID NO: 1840972 - DNA, 18 bp, Homo sapiens
ggggtcccagcagctgcc

SEQ ID NO: 1840973 - DNA, 23 bp, Homo sapiens
gggtaaagggcgcaaagggcatg

SEQ ID NO: 1840974 - DNA, 22 bp, Homo sapiens
gggtcactctggcagctcagag

SEQ ID NO: 1840975 - DNA, 13 bp, Homo sapiens
gggtcccagcagc

SEQ ID NO: 1840976 - DNA, 14 bp, Homo sapiens
gggtctctgctgcc

SEQ ID NO: 1840977 - DNA, 18 bp, Homo sapiens
gggtctctgctgccgccc

SEQ ID NO: 1840978 - DNA, 15 bp, Homo sapiens
gggtgggacaccctg

SEQ ID NO: 1840979 - DNA, 18 bp, Homo sapiens
ggtaactagggaagataa

SEQ ID NO: 1840980 - DNA, 14 bp, Homo sapiens
ggtaggggagggca

SEQ ID NO: 1840981 - DNA, 24 bp, Homo sapiens
ggtcagtgtccaaagcagggtctg

SEQ ID NO: 1840982 - DNA, 15 bp, Homo sapiens
ggtcatttatgaaaa

SEQ ID NO: 1840983 - DNA, 14 bp, Homo sapiens
ggtccctggtggca

SEQ ID NO: 1840984 - DNA, 22 bp, Homo sapiens
ggtccctggtggcagctcacct

SEQ ID NO: 1840985 - DNA, 23 bp, Homo sapiens
ggtcctagaaattccccaccctg

SEQ ID NO: 1840986 - DNA, 21 bp, Homo sapiens
ggtcctgctgcagttgccagt

SEQ ID NO: 1840987 - DNA, 23 bp, Homo sapiens
ggtcctgctgcagttgccagtca

SEQ ID NO: 1840988 - DNA, 14 bp, Homo sapiens
ggtctctgctgccg

SEQ ID NO: 1840989 - DNA, 14 bp, Homo sapiens
ggtgcacccacctg

SEQ ID NO: 1840990 - DNA, 16 bp, Homo sapiens
ggtgcacccacctgtt

SEQ ID NO: 1840991 - DNA, 17 bp, Homo sapiens
ggtgcacccacctgttt

SEQ ID NO: 1840992 - DNA, 22 bp, Homo sapiens
ggtgcacccacctgttttctga

SEQ ID NO: 1840993 - DNA, 15 bp, Homo sapiens
ggtggacatggcccc

SEQ ID NO: 1840994 - DNA, 13 bp, Homo sapiens
ggtggcagctcac

SEQ ID NO: 1840995 - DNA, 18 bp, Homo sapiens
ggtggcttaagtgagcag

SEQ ID NO: 1840996 - DNA, 23 bp, Homo sapiens
ggtggcttaagtgagcagaacag

SEQ ID NO: 1840997 - DNA, 15 bp, Homo sapiens
ggtggggtcactctg

SEQ ID NO: 1840998 - DNA, 21 bp, Homo sapiens
ggtgtgcggcctttggcttca

SEQ ID NO: 1840999 - DNA, 12 bp, Homo sapiens
ggtgtggagaag

SEQ ID NO: 1841000 - DNA, 13 bp, Homo sapiens
ggtgtgggggaag

SEQ ID NO: 1841001 - DNA, 19 bp, Homo sapiens
ggtgtttcctggcactgct

SEQ ID NO: 1841002 - DNA, 16 bp, Homo sapiens
ggttagggaaaacatt

SEQ ID NO: 1841003 - DNA, 21 bp, Homo sapiens
ggttctgatgatgtgcctggg

SEQ ID NO: 1841004 - DNA, 22 bp, Homo sapiens
ggtttaaatgaacaagagaagc

SEQ ID NO: 1841005 - DNA, 22 bp, Homo sapiens
gtaaacccctttagtggcttca

SEQ ID NO: 1841006 - DNA, 22 bp, Homo sapiens
gtaaagggcgcaaagggcatgg

SEQ ID NO: 1841007 - DNA, 19 bp, Homo sapiens
gtaaagtgaagaatttatc

SEQ ID NO: 1841008 - DNA, 15 bp, Homo sapiens
gtaaatataaagacg

SEQ ID NO: 1841009 - DNA, 23 bp, Homo sapiens
gtaaatataaagacgttttataa

SEQ ID NO: 1841010 - DNA, 17 bp, Homo sapiens
gtaaatgcagcgtgaag

SEQ ID NO: 1841011 - DNA, 16 bp, Homo sapiens
gtaacagtcatcattt

SEQ ID NO: 1841012 - DNA, 13 bp, Homo sapiens
gtaacatttctgt

SEQ ID NO: 1841013 - DNA, 16 bp, Homo sapiens
gtaagagcttgctcca

SEQ ID NO: 1841014 - DNA, 18 bp, Homo sapiens
gtaaggaatacctgtccc

SEQ ID NO: 1841015 - DNA, 23 bp, Homo sapiens
gtaaggaatacctgtccccctga

SEQ ID NO: 1841016 - DNA, 16 bp, Homo sapiens
gtaagtgttctcatga

SEQ ID NO: 1841017 - DNA, 23 bp, Homo sapiens
gtaatcctagcactttgggaggc

SEQ ID NO: 1841018 - DNA, 22 bp, Homo sapiens
gtacagagcccacgcccccact

SEQ ID NO: 1841019 - DNA, 19 bp, Homo sapiens
gtacagtcttgcagcagga

SEQ ID NO: 1841020 - DNA, 20 bp, Homo sapiens
gtacgtggcacctcttccga

SEQ ID NO: 1841021 - DNA, 17 bp, Homo sapiens
gtactacagtcctccca

SEQ ID NO: 1841022 - DNA, 15 bp, Homo sapiens
gtagagtgtgcctga

SEQ ID NO: 1841023 - DNA, 17 bp, Homo sapiens
gtagcgtctttcttttt

SEQ ID NO: 1841024 - DNA, 16 bp, Homo sapiens
gtaggggagggcaggc

SEQ ID NO: 1841025 - DNA, 21 bp, Homo sapiens
gtaggggagggcaggcttggg

SEQ ID NO: 1841026 - DNA, 19 bp, Homo sapiens
gtagttttgtgatgcattt

SEQ ID NO: 1841027 - DNA, 17 bp, Homo sapiens
gtataaacaagaaaaat

SEQ ID NO: 1841028 - DNA, 23 bp, Homo sapiens
gtataaacaagaaaaataaagaa

SEQ ID NO: 1841029 - DNA, 22 bp, Homo sapiens
gtatcattgttgtttgatttct

SEQ ID NO: 1841030 - DNA, 13 bp, Homo sapiens
gtatggagctcag

SEQ ID NO: 1841031 - DNA, 15 bp, Homo sapiens
tccagccagggctgc

SEQ ID NO: 1841032 - DNA, 12 bp, Homo sapiens
tccagcccctgg

SEQ ID NO: 1841033 - DNA, 13 bp, Homo sapiens
tccagcccctgga

SEQ ID NO: 1841034 - DNA, 19 bp, Homo sapiens
tccagccctggctgaagga

SEQ ID NO: 1841035 - DNA, 13 bp, Homo sapiens
tccagcctgggtg

SEQ ID NO: 1841036 - DNA, 23 bp, Homo sapiens
tccagctcctcatccagggctct

SEQ ID NO: 1841037 - DNA, 17 bp, Homo sapiens
tccagctgttcagctgg

SEQ ID NO: 1841038 - DNA, 13 bp, Homo sapiens
tccaggagcagcc

SEQ ID NO: 1841039 - DNA, 18 bp, Homo sapiens
tccaggagcagccacatt

SEQ ID NO: 1841040 - DNA, 14 bp, Homo sapiens
tccaggctgggaga

SEQ ID NO: 1841041 - DNA, 21 bp, Homo sapiens
tccaggctgggagagccttcc

SEQ ID NO: 1841042 - DNA, 15 bp, Homo sapiens
tccaggtgcacaagc

SEQ ID NO: 1841043 - DNA, 18 bp, Homo sapiens
tccaggtgcacaagctcc

SEQ ID NO: 1841044 - DNA, 20 bp, Homo sapiens
tccaggtgcacaagctccaa

SEQ ID NO: 1841045 - DNA, 21 bp, Homo sapiens
tccagtcattatgttaatatt

SEQ ID NO: 1841046 - DNA, 15 bp, Homo sapiens
tccagtgaacattcc

SEQ ID NO: 1841047 - DNA, 16 bp, Homo sapiens
tccagtgaggctctgc

SEQ ID NO: 1841048 - DNA, 17 bp, Homo sapiens
tccagtgaggctctgcc

SEQ ID NO: 1841049 - DNA, 15 bp, Homo sapiens
tccatagagagcaag

SEQ ID NO: 1841050 - DNA, 20 bp, Homo sapiens
tccatccttgagtcaaaaaa

SEQ ID NO: 1841051 - DNA, 17 bp, Homo sapiens
tccatgagtcccctgtt

SEQ ID NO: 1841052 - DNA, 19 bp, Homo sapiens
tccattaaacgatttttaa

SEQ ID NO: 1841053 - DNA, 14 bp, Homo sapiens
tccattctggaagt

SEQ ID NO: 1841054 - DNA, 19 bp, Homo sapiens
tccattttttcttcccttt

SEQ ID NO: 1841055 - DNA, 17 bp, Homo sapiens
tcccaactcaccccagc

SEQ ID NO: 1841056 - DNA, 15 bp, Homo sapiens
tcccaagggctgccg

SEQ ID NO: 1841057 - DNA, 14 bp, Homo sapiens
tcccacaaaggaga

SEQ ID NO: 1841058 - DNA, 20 bp, Homo sapiens
tcccaccccacacacgccag

SEQ ID NO: 1841059 - DNA, 17 bp, Homo sapiens
tcccacctctctcactc

SEQ ID NO: 1841060 - DNA, 22 bp, Homo sapiens
tcccacctctctcactccttga

SEQ ID NO: 1841061 - DNA, 23 bp, Homo sapiens
tcccacttggcatcagctggcgt

SEQ ID NO: 1841062 - DNA, 16 bp, Homo sapiens
tcccaggatgagcatc

SEQ ID NO: 1841063 - DNA, 17 bp, Homo sapiens
tcccaggcattccccag

SEQ ID NO: 1841064 - DNA, 21 bp, Homo sapiens
tcccaggcattccccaggagg

SEQ ID NO: 1841065 - DNA, 17 bp, Homo sapiens
tcccagtggctgctgcc

SEQ ID NO: 1841066 - DNA, 23 bp, Homo sapiens
tcccagtggctgctgcccaggcc

SEQ ID NO: 1841067 - DNA, 22 bp, Homo sapiens
tcccataaccgctgattctcag

SEQ ID NO: 1841068 - DNA, 16 bp, Homo sapiens
tcccatcctgtgtgtt

SEQ ID NO: 1841069 - DNA, 20 bp, Homo sapiens
tcccatctcacacatgagca

SEQ ID NO: 1841070 - DNA, 14 bp, Homo sapiens
tcccatgacccagg

SEQ ID NO: 1841071 - DNA, 12 bp, Homo sapiens
tccccaccctga

SEQ ID NO: 1841072 - DNA, 23 bp, Homo sapiens
tccccaccctgaaagccctgagc

SEQ ID NO: 1841073 - DNA, 17 bp, Homo sapiens
tccccaccgcagacagg

SEQ ID NO: 1841074 - DNA, 24 bp, Homo sapiens
tccccaccgcagacaggaccaggg

SEQ ID NO: 1841075 - DNA, 18 bp, Homo sapiens
tccccactcagccttttg

SEQ ID NO: 1841076 - DNA, 19 bp, Homo sapiens
tccccagagtcctctatga

SEQ ID NO: 1841077 - DNA, 14 bp, Homo sapiens
tccccagcctggga

SEQ ID NO: 1841078 - DNA, 15 bp, Homo sapiens
tcccccagccccatc

SEQ ID NO: 1841079 - DNA, 22 bp, Homo sapiens
tcccccagccccatcctctgta

SEQ ID NO: 1841080 - DNA, 12 bp, Homo sapiens
tccccccagact

SEQ ID NO: 1841081 - DNA, 21 bp, Homo sapiens
tcccccttccatggactttgt

SEQ ID NO: 1841082 - DNA, 14 bp, Homo sapiens
tcccctctcagaac

SEQ ID NO: 1841083 - DNA, 16 bp, Homo sapiens
tcccctctcagaacat

SEQ ID NO: 1841084 - DNA, 14 bp, Homo sapiens
tcccctgctgggtg

SEQ ID NO: 1841085 - DNA, 20 bp, Homo sapiens
tcccctgctgggtgtggcgc

SEQ ID NO: 1841086 - DNA, 21 bp, Homo sapiens
tcccctgctgggtgtggcgca

SEQ ID NO: 1841087 - DNA, 21 bp, Homo sapiens
tcccctgtttgtttctgaaag

SEQ ID NO: 1841088 - DNA, 15 bp, Homo sapiens
tcccctttcagagat

SEQ ID NO: 1841089 - DNA, 14 bp, Homo sapiens
tccctaatgctgca

SEQ ID NO: 1841090 - DNA, 20 bp, Homo sapiens
tccctaatgctgcagatttg

SEQ ID NO: 1841091 - DNA, 19 bp, Homo sapiens
tccctatctttgccaccct

SEQ ID NO: 1841092 - DNA, 20 bp, Homo sapiens
tccctcagtctggcccttcc

SEQ ID NO: 1841093 - DNA, 23 bp, Homo sapiens
tccctcatttcaggagcagcctc

SEQ ID NO: 1841094 - DNA, 13 bp, Homo sapiens
tccctcccctctc

SEQ ID NO: 1841095 - DNA, 17 bp, Homo sapiens
tccctcccctctcagaa

SEQ ID NO: 1841096 - DNA, 10 bp, Homo sapiens
tccctccctt

SEQ ID NO: 1841097 - DNA, 11 bp, Homo sapiens
tccctctttcc

SEQ ID NO: 1841098 - DNA, 13 bp, Homo sapiens
tccctctttccct

SEQ ID NO: 1841099 - DNA, 21 bp, Homo sapiens
tccctctttccctcccttcct

SEQ ID NO: 1841100 - DNA, 16 bp, Homo sapiens
tccctgaaggccccgc

SEQ ID NO: 1841101 - DNA, 18 bp, Homo sapiens
tccctgaaggccccgccc

SEQ ID NO: 1841102 - DNA, 13 bp, Homo sapiens
tccctgagatggg

SEQ ID NO: 1841103 - DNA, 23 bp, Homo sapiens
tccctgagatgggcttcccaagg

SEQ ID NO: 1841104 - DNA, 14 bp, Homo sapiens
tccctgccaatgga

SEQ ID NO: 1841105 - DNA, 11 bp, Homo sapiens
tccctggcctt

SEQ ID NO: 1841106 - DNA, 18 bp, Homo sapiens
tccctggtggcagctcac

SEQ ID NO: 1841107 - DNA, 17 bp, Homo sapiens
tccctggttctgatgat

SEQ ID NO: 1841108 - DNA, 12 bp, Homo sapiens
tccctgtcccag

SEQ ID NO: 1841109 - DNA, 21 bp, Homo sapiens
tcccttcatctggaaccatca

SEQ ID NO: 1841110 - DNA, 14 bp, Homo sapiens
tcccttcccacctc

SEQ ID NO: 1841111 - DNA, 16 bp, Homo sapiens
tcccttcccacctctc

SEQ ID NO: 1841112 - DNA, 17 bp, Homo sapiens
tcccttcccacctctct

SEQ ID NO: 1841113 - DNA, 15 bp, Homo sapiens
tcccttcctgccagc

SEQ ID NO: 1841114 - DNA, 19 bp, Homo sapiens
tcccttcctgccagcccct

SEQ ID NO: 1841115 - DNA, 18 bp, Homo sapiens
tcccttggacattttatg

SEQ ID NO: 1841116 - DNA, 19 bp, Homo sapiens
tcccttggattgtccccga

SEQ ID NO: 1841117 - DNA, 19 bp, Homo sapiens
tccctttgacgccatccca

SEQ ID NO: 1841118 - DNA, 19 bp, Homo sapiens
tcccttttttggctgctga

SEQ ID NO: 1841119 - DNA, 22 bp, Homo sapiens
tcctaaaacaaaagctcatcca

SEQ ID NO: 1841120 - DNA, 22 bp, Homo sapiens
tcctaaaataagggcagagtca

SEQ ID NO: 1841121 - DNA, 16 bp, Homo sapiens
tcctagaaattcccca

SEQ ID NO: 1841122 - DNA, 17 bp, Homo sapiens
tcctagcacacactttt

SEQ ID NO: 1841123 - DNA, 23 bp, Homo sapiens
tcctagcgcagccatgtgattac

SEQ ID NO: 1841124 - DNA, 14 bp, Homo sapiens
tcctaggcatttgc

SEQ ID NO: 1841125 - DNA, 17 bp, Homo sapiens
tcctagttccaccatca

SEQ ID NO: 1841126 - DNA, 22 bp, Homo sapiens
tcctagttccaccatcaagcca

SEQ ID NO: 1841127 - DNA, 14 bp, Homo sapiens
tcctcaaacactgc

SEQ ID NO: 1841128 - DNA, 16 bp, Homo sapiens
tcctcaaacactgcag

SEQ ID NO: 1841129 - DNA, 14 bp, Homo sapiens
tcctcaccacatgc

SEQ ID NO: 1841130 - DNA, 21 bp, Homo sapiens
tcctcagtaacatttctgttc

SEQ ID NO: 1841131 - DNA, 18 bp, Homo sapiens
tcctcatccagggctctg

SEQ ID NO: 1841132 - DNA, 20 bp, Homo sapiens
tcctccaggtgcacaagctc

SEQ ID NO: 1841133 - DNA, 16 bp, Homo sapiens
tcctcccctcctcctg

SEQ ID NO: 1841134 - DNA, 22 bp, Homo sapiens
tcctcccctcctcctggactcc

SEQ ID NO: 1841135 - DNA, 11 bp, Homo sapiens
tcctccctccc

SEQ ID NO: 1841136 - DNA, 13 bp, Homo sapiens
tcctccgtggcac

SEQ ID NO: 1841137 - DNA, 14 bp, Homo sapiens
tcctcgtttgtgtt

SEQ ID NO: 1841138 - DNA, 12 bp, Homo sapiens
tcctctgctgct

SEQ ID NO: 1841139 - DNA, 14 bp, Homo sapiens
tcctctgctgctgg

SEQ ID NO: 1841140 - DNA, 15 bp, Homo sapiens
tcctctgctgctggc

SEQ ID NO: 1841141 - DNA, 16 bp, Homo sapiens
tcctctgctgctggct

SEQ ID NO: 1841142 - DNA, 15 bp, Homo sapiens
tcctctggcctgtgt

SEQ ID NO: 1841143 - DNA, 19 bp, Homo sapiens
tcctctgtacagagcccac

SEQ ID NO: 1841144 - DNA, 23 bp, Homo sapiens
tcctctgtacagagcccacgccc

SEQ ID NO: 1841145 - DNA, 11 bp, Homo sapiens
tcctctttcca

SEQ ID NO: 1841146 - DNA, 22 bp, Homo sapiens
tcctctttggtctacactgtgc

SEQ ID NO: 1841147 - DNA, 15 bp, Homo sapiens
tcctgagaccagcca

SEQ ID NO: 1841148 - DNA, 17 bp, Homo sapiens
tcctgaggctgggctcc

SEQ ID NO: 1841149 - DNA, 21 bp, Homo sapiens
tcctgatggcaggatggcctg

SEQ ID NO: 1841150 - DNA, 14 bp, Homo sapiens
tcctgcacacgctc

SEQ ID NO: 1841151 - DNA, 14 bp, Homo sapiens
tcctgcaggcagcc

SEQ ID NO: 1841152 - DNA, 19 bp, Homo sapiens
tcctgcaggcagccaggcc

SEQ ID NO: 1841153 - DNA, 14 bp, Homo sapiens
tcctgccagcccct

SEQ ID NO: 1841154 - DNA, 13 bp, Homo sapiens
tcctgctgcagtt

SEQ ID NO: 1841155 - DNA, 19 bp, Homo sapiens
tcctgtgtgttaagctctg

SEQ ID NO: 1841156 - DNA, 16 bp, Homo sapiens
tccttaccagcagagc

SEQ ID NO: 1841157 - DNA, 17 bp, Homo sapiens
tccttaccagcagagca

SEQ ID NO: 1841158 - DNA, 18 bp, Homo sapiens
tccttcacctttgtcccc

SEQ ID NO: 1841159 - DNA, 20 bp, Homo sapiens
tccttcacctttgtccccac

SEQ ID NO: 1841160 - DNA, 15 bp, Homo sapiens
tccttccaccaagtt

SEQ ID NO: 1841161 - DNA, 16 bp, Homo sapiens
tccttcctctgaggct

SEQ ID NO: 1841162 - DNA, 16 bp, Homo sapiens
tccttgagagaccagg

SEQ ID NO: 1841163 - DNA, 17 bp, Homo sapiens
tcctttgtgaggaagcc

SEQ ID NO: 1841164 - DNA, 16 bp, Homo sapiens
tcgagcatgcctggat

SEQ ID NO: 1841165 - DNA, 22 bp, Homo sapiens
tcgaggcggatctttggacaga

SEQ ID NO: 1841166 - DNA, 23 bp, Homo sapiens
tcgcaggattcttcctccctccc

SEQ ID NO: 1841167 - DNA, 15 bp, Homo sapiens
tcgcttttgataatc

SEQ ID NO: 1841168 - DNA, 22 bp, Homo sapiens
tcgggagaggggacgcaggccc

SEQ ID NO: 1841169 - DNA, 23 bp, Homo sapiens
tcgggagaggggacgcaggcccc

SEQ ID NO: 1841170 - DNA, 19 bp, Homo sapiens
tcgggaggtcgaggcagga

SEQ ID NO: 1841171 - DNA, 21 bp, Homo sapiens
tcgggaggtcgaggcaggagg

SEQ ID NO: 1841172 - DNA, 15 bp, Homo sapiens
tcgggggctgtggat

SEQ ID NO: 1841173 - DNA, 21 bp, Homo sapiens
tcgtatgatacttcgacactg

SEQ ID NO: 1841174 - DNA, 22 bp, Homo sapiens
tcgtatgatacttcgacactgt

SEQ ID NO: 1841175 - DNA, 15 bp, Homo sapiens
tcgtttgtgttctgt

SEQ ID NO: 1841176 - DNA, 17 bp, Homo sapiens
tctaaaggagtttatgt

SEQ ID NO: 1841177 - DNA, 21 bp, Homo sapiens
tctaacgcaaaaatagctctt

SEQ ID NO: 1841178 - DNA, 19 bp, Homo sapiens
tctaagtcaatccaagagt

SEQ ID NO: 1841179 - DNA, 17 bp, Homo sapiens
tctacaactcatacact

SEQ ID NO: 1841180 - DNA, 16 bp, Homo sapiens
tctaggactgcagtgt

SEQ ID NO: 1841181 - DNA, 17 bp, Homo sapiens
tctaggtggcaaggctg

SEQ ID NO: 1841182 - DNA, 20 bp, Homo sapiens
tctaggtggcaaggctgtgc

SEQ ID NO: 1841183 - DNA, 22 bp, Homo sapiens
tctagttgtttgattcagacag

SEQ ID NO: 1841184 - DNA, 20 bp, Homo sapiens
tctatatatacatcatactt

SEQ ID NO: 1841185 - DNA, 15 bp, Homo sapiens
tctatgggtgttatc

SEQ ID NO: 1841186 - DNA, 14 bp, Homo sapiens
tctatgttaatatt

SEQ ID NO: 1841187 - DNA, 22 bp, Homo sapiens
tctatttttacctactgtgtct

SEQ ID NO: 1841188 - DNA, 17 bp, Homo sapiens
tctcaaagagattcgaa

SEQ ID NO: 1841189 - DNA, 17 bp, Homo sapiens
tctcaaccacctttcag

SEQ ID NO: 1841190 - DNA, 23 bp, Homo sapiens
tctcacacatgagcatcaggcca

SEQ ID NO: 1841191 - DNA, 20 bp, Homo sapiens
tctttgttttgtgtctctta

SEQ ID NO: 1841192 - DNA, 21 bp, Homo sapiens
tcttttttggccatctgctcc

SEQ ID NO: 1841193 - DNA, 20 bp, Homo sapiens
tgaaaaaggaggaagagaaa

SEQ ID NO: 1841194 - DNA, 22 bp, Homo sapiens
tgaaaaaggaggaagagaaaaa

SEQ ID NO: 1841195 - DNA, 19 bp, Homo sapiens
tgaaaagaaaaatgagcct

SEQ ID NO: 1841196 - DNA, 22 bp, Homo sapiens
tgaaaagaaaaatgagcctggc

SEQ ID NO: 1841197 - DNA, 13 bp, Homo sapiens
tgaaaagaattgt

SEQ ID NO: 1841198 - DNA, 15 bp, Homo sapiens
tgaaaagttggaagg

SEQ ID NO: 1841199 - DNA, 22 bp, Homo sapiens
tgaaaagttggaaggatctgct

SEQ ID NO: 1841200 - DNA, 14 bp, Homo sapiens
tgaaaattcagtgg

SEQ ID NO: 1841201 - DNA, 15 bp, Homo sapiens
tgaaacacacgagca

SEQ ID NO: 1841202 - DNA, 17 bp, Homo sapiens
tgaaacacacgagcaaa

SEQ ID NO: 1841203 - DNA, 13 bp, Homo sapiens
tgaaactccacct

SEQ ID NO: 1841204 - DNA, 22 bp, Homo sapiens
tgaaactgcttgtttcctagca

SEQ ID NO: 1841205 - DNA, 21 bp, Homo sapiens
tgaaataccaacctgaagaca

SEQ ID NO: 1841206 - DNA, 13 bp, Homo sapiens
tgaaatagtgtct

SEQ ID NO: 1841207 - DNA, 13 bp, Homo sapiens
tgaaatgcatttt

SEQ ID NO: 1841208 - DNA, 13 bp, Homo sapiens
tgaaatgtcaacc

SEQ ID NO: 1841209 - DNA, 18 bp, Homo sapiens
tgaacaagagaagcattc

SEQ ID NO: 1841210 - DNA, 21 bp, Homo sapiens
tgaacatgtgccttttctgaa

SEQ ID NO: 1841211 - DNA, 18 bp, Homo sapiens
tgaacattcccagcccag

SEQ ID NO: 1841212 - DNA, 17 bp, Homo sapiens
tgaactaaactttcaca

SEQ ID NO: 1841213 - DNA, 17 bp, Homo sapiens
tgaactgaactctgaca

SEQ ID NO: 1841214 - DNA, 11 bp, Homo sapiens
tgaactttgct

SEQ ID NO: 1841215 - DNA, 15 bp, Homo sapiens
tgaagaaaatgaagc

SEQ ID NO: 1841216 - DNA, 14 bp, Homo sapiens
tgaagacccagaca

SEQ ID NO: 1841217 - DNA, 17 bp, Homo sapiens
tgaagcaccaagctcaa

SEQ ID NO: 1841218 - DNA, 18 bp, Homo sapiens
tgaagcattttataaatc

SEQ ID NO: 1841219 - DNA, 21 bp, Homo sapiens
tgaaggctcgagcatgcctgg

SEQ ID NO: 1841220 - DNA, 15 bp, Homo sapiens
tgaagggcaagaaat

SEQ ID NO: 1841221 - DNA, 21 bp, Homo sapiens
tgaagtttccttggctggtgc

SEQ ID NO: 1841222 - DNA, 15 bp, Homo sapiens
tgaatgtcagttgtt

SEQ ID NO: 1841223 - DNA, 20 bp, Homo sapiens
tgaatgtttttctaaaggag

SEQ ID NO: 1841224 - DNA, 19 bp, Homo sapiens
tgacaacagacttctgaaa

SEQ ID NO: 1841225 - DNA, 18 bp, Homo sapiens
tgacacaaacctgcctgg

SEQ ID NO: 1841226 - DNA, 19 bp, Homo sapiens
tgacacaaacctgcctggg

SEQ ID NO: 1841227 - DNA, 19 bp, Homo sapiens
tgacactggtattcctgcc

SEQ ID NO: 1841228 - DNA, 20 bp, Homo sapiens
tgacactggtattcctgcct

SEQ ID NO: 1841229 - DNA, 13 bp, Homo sapiens
tgacaggcagcag

SEQ ID NO: 1841230 - DNA, 15 bp, Homo sapiens
tgacaggcagcagag

SEQ ID NO: 1841231 - DNA, 14 bp, Homo sapiens
tgacagtgcctctt

SEQ ID NO: 1841232 - DNA, 21 bp, Homo sapiens
tgacagtgcctcttccagtga

SEQ ID NO: 1841233 - DNA, 18 bp, Homo sapiens
tgacatcaggtttttccc

SEQ ID NO: 1841234 - DNA, 13 bp, Homo sapiens
tgacatgtctttt

SEQ ID NO: 1841235 - DNA, 15 bp, Homo sapiens
tgacatgtcttttct

SEQ ID NO: 1841236 - DNA, 19 bp, Homo sapiens
tgacatgtgttggcagcct

SEQ ID NO: 1841237 - DNA, 17 bp, Homo sapiens
tgaccacactccagctg

SEQ ID NO: 1841238 - DNA, 20 bp, Homo sapiens
tgaccacactccagctggga

SEQ ID NO: 1841239 - DNA, 20 bp, Homo sapiens
tgaccaggcctgggccagag

SEQ ID NO: 1841240 - DNA, 17 bp, Homo sapiens
tgaccattctccacctg

SEQ ID NO: 1841241 - DNA, 13 bp, Homo sapiens
tgacccaggctgg

SEQ ID NO: 1841242 - DNA, 15 bp, Homo sapiens
tgacccaggctgggc

SEQ ID NO: 1841243 - DNA, 19 bp, Homo sapiens
tgacccaggctgggcaagg

SEQ ID NO: 1841244 - DNA, 15 bp, Homo sapiens
tgacccatgctgccc

SEQ ID NO: 1841245 - DNA, 17 bp, Homo sapiens
tgacccatgctgccctg

SEQ ID NO: 1841246 - DNA, 16 bp, Homo sapiens
tgacctcagctttgat

SEQ ID NO: 1841247 - DNA, 12 bp, Homo sapiens
tgacctgaggcc

SEQ ID NO: 1841248 - DNA, 17 bp, Homo sapiens
tgacctgaggcccttct

SEQ ID NO: 1841249 - DNA, 16 bp, Homo sapiens
tgacctgcctcccttc

SEQ ID NO: 1841250 - DNA, 21 bp, Homo sapiens
tgacctgcctcccttcatgca

SEQ ID NO: 1841251 - DNA, 23 bp, Homo sapiens
tgacctgcctcccttcatgcatg

SEQ ID NO: 1841252 - DNA, 14 bp, Homo sapiens
tgacgccatcccag

SEQ ID NO: 1841253 - DNA, 20 bp, Homo sapiens
tgacgccatcccagccccaa

SEQ ID NO: 1841254 - DNA, 16 bp, Homo sapiens
tgacgcttgtgacagt

SEQ ID NO: 1841255 - DNA, 17 bp, Homo sapiens
tgacggtaagtgttctc

SEQ ID NO: 1841256 - DNA, 19 bp, Homo sapiens
tgactgtatctgtgtagac

SEQ ID NO: 1841257 - DNA, 21 bp, Homo sapiens
tgactgttttctcttgagagg

SEQ ID NO: 1841258 - DNA, 22 bp, Homo sapiens
tgagaaatagcttatgaaaaga

SEQ ID NO: 1841259 - DNA, 16 bp, Homo sapiens
tgagaacactgtgaaa

SEQ ID NO: 1841260 - DNA, 20 bp, Homo sapiens
tgagaagcagaggaaggaga

SEQ ID NO: 1841261 - DNA, 17 bp, Homo sapiens
tgagacattacagtttg

SEQ ID NO: 1841262 - DNA, 15 bp, Homo sapiens
tgagatcagcctggg

SEQ ID NO: 1841263 - DNA, 22 bp, Homo sapiens
tgagatgggcttcccaagggct

SEQ ID NO: 1841264 - DNA, 13 bp, Homo sapiens
tgagcagaacagg

SEQ ID NO: 1841265 - DNA, 17 bp, Homo sapiens
tgagcagcgagcctgct

SEQ ID NO: 1841266 - DNA, 14 bp, Homo sapiens
tgagcatcacagtt

SEQ ID NO: 1841267 - DNA, 16 bp, Homo sapiens
tgagcatcacagtttt

SEQ ID NO: 1841268 - DNA, 17 bp, Homo sapiens
tgagcatcacagttttg

SEQ ID NO: 1841269 - DNA, 14 bp, Homo sapiens
tgagcatcaggcca

SEQ ID NO: 1841270 - DNA, 16 bp, Homo sapiens
tgagcatcaggccagg

SEQ ID NO: 1841271 - DNA, 19 bp, Homo sapiens
tgagcatcaggccaggccc

SEQ ID NO: 1841272 - DNA, 21 bp, Homo sapiens
tgagcatcaggccaggccctc

SEQ ID NO: 1841273 - DNA, 14 bp, Homo sapiens
tgagcatggagctg

SEQ ID NO: 1841274 - DNA, 14 bp, Homo sapiens
tgagcatgtttaga

SEQ ID NO: 1841275 - DNA, 23 bp, Homo sapiens
tgagcatgtttagactttaacat

SEQ ID NO: 1841276 - DNA, 11 bp, Homo sapiens
tgagcctggca

SEQ ID NO: 1841277 - DNA, 19 bp, Homo sapiens
tgagctcaggagtttgaga

SEQ ID NO: 1841278 - DNA, 19 bp, Homo sapiens
tgagctggatagacttggg

SEQ ID NO: 1841279 - DNA, 13 bp, Homo sapiens
tgagctgggatga

SEQ ID NO: 1841280 - DNA, 23 bp, Homo sapiens
tgaggacttgggcgggacacagg

SEQ ID NO: 1841281 - DNA, 15 bp, Homo sapiens
tgaggattgtggaaa

SEQ ID NO: 1841282 - DNA, 22 bp, Homo sapiens
tgaggattgtggaaaaccagga

SEQ ID NO: 1841283 - DNA, 20 bp, Homo sapiens
gttttccatgagtcccctgt

SEQ ID NO: 1841284 - DNA, 19 bp, Homo sapiens
gttttctcctgcctgtgct

SEQ ID NO: 1841285 - DNA, 20 bp, Homo sapiens
gttttctcctgcctgtgctg

SEQ ID NO: 1841286 - DNA, 17 bp, Homo sapiens
gttttctgaaacacacg

SEQ ID NO: 1841287 - DNA, 16 bp, Homo sapiens
gttttgaagattctat

SEQ ID NO: 1841288 - DNA, 20 bp, Homo sapiens
gtttttcttaaataataaag

SEQ ID NO: 1841289 - DNA, 16 bp, Homo sapiens
gttttttttttgtttg

SEQ ID NO: 1841290 - DNA, 17 bp, Homo sapiens
gttttttttttgtttgt

SEQ ID NO: 1841291 - DNA, 20 bp, Homo sapiens
taaaaaactgctgactgttt

SEQ ID NO: 1841292 - DNA, 22 bp, Homo sapiens
taaaaagctccaaatgcagctt

SEQ ID NO: 1841293 - DNA, 20 bp, Homo sapiens
taaaaaggaatccactccca

SEQ ID NO: 1841294 - DNA, 13 bp, Homo sapiens
taaaacccaagtg

SEQ ID NO: 1841295 - DNA, 19 bp, Homo sapiens
taaaagaggtttttcttaa

SEQ ID NO: 1841296 - DNA, 21 bp, Homo sapiens
taaaagaggtttttcttaaat

SEQ ID NO: 1841297 - DNA, 13 bp, Homo sapiens
taaaagtcttgtg

SEQ ID NO: 1841298 - DNA, 20 bp, Homo sapiens
taaaatttttatgtaattat

SEQ ID NO: 1841299 - DNA, 13 bp, Homo sapiens
taaacaagaaaaa

SEQ ID NO: 1841300 - DNA, 14 bp, Homo sapiens
taaacaagaaaaat

SEQ ID NO: 1841301 - DNA, 18 bp, Homo sapiens
taaacaagaaaaataaag

SEQ ID NO: 1841302 - DNA, 20 bp, Homo sapiens
taaacaagaaaaataaagaa

SEQ ID NO: 1841303 - DNA, 18 bp, Homo sapiens
taaacatgtatgtaaata

SEQ ID NO: 1841304 - DNA, 16 bp, Homo sapiens
taaaccgccaaggctg

SEQ ID NO: 1841305 - DNA, 18 bp, Homo sapiens
taaacgatttttaaaatg

SEQ ID NO: 1841306 - DNA, 12 bp, Homo sapiens
taaactggctta

SEQ ID NO: 1841307 - DNA, 18 bp, Homo sapiens
taaactggcttaacttag

SEQ ID NO: 1841308 - DNA, 13 bp, Homo sapiens
taaactttcacac

SEQ ID NO: 1841309 - DNA, 11 bp, Homo sapiens
taaagaaaaaa

SEQ ID NO: 1841310 - DNA, 16 bp, Homo sapiens
taaagaaaaaaatgta

SEQ ID NO: 1841311 - DNA, 17 bp, Homo sapiens
taaagaaaaaaatgtat

SEQ ID NO: 1841312 - DNA, 15 bp, Homo sapiens
taaagaaaagatgca

SEQ ID NO: 1841313 - DNA, 18 bp, Homo sapiens
taaagaaaagatgcactt

SEQ ID NO: 1841314 - DNA, 17 bp, Homo sapiens
taaagacgatttgtcag

SEQ ID NO: 1841315 - DNA, 16 bp, Homo sapiens
taaagacgttttataa

SEQ ID NO: 1841316 - DNA, 21 bp, Homo sapiens
taaagacgttttataagcatc

SEQ ID NO: 1841317 - DNA, 16 bp, Homo sapiens
taaaggagtttatgtt

SEQ ID NO: 1841318 - DNA, 17 bp, Homo sapiens
taaaggagtttatgttc

SEQ ID NO: 1841319 - DNA, 12 bp, Homo sapiens
taaatataaaga

SEQ ID NO: 1841320 - DNA, 13 bp, Homo sapiens
taaatataaagac

SEQ ID NO: 1841321 - DNA, 14 bp, Homo sapiens
taaatataaagacg

SEQ ID NO: 1841322 - DNA, 17 bp, Homo sapiens
taaatataaagacgttt

SEQ ID NO: 1841323 - DNA, 15 bp, Homo sapiens
taaatatattattac

SEQ ID NO: 1841324 - DNA, 22 bp, Homo sapiens
taaatatcccttggacatttta

SEQ ID NO: 1841325 - DNA, 18 bp, Homo sapiens
taaatcgcttttgataat

SEQ ID NO: 1841326 - DNA, 17 bp, Homo sapiens
taaatgaacaagagaag

SEQ ID NO: 1841327 - DNA, 16 bp, Homo sapiens
taaatgcaaataacaa

SEQ ID NO: 1841328 - DNA, 17 bp, Homo sapiens
taaatgcaaataacaaa

SEQ ID NO: 1841329 - DNA, 20 bp, Homo sapiens
taacaaatgccaaattaaaa

SEQ ID NO: 1841330 - DNA, 15 bp, Homo sapiens
taacaaattgcattt

SEQ ID NO: 1841331 - DNA, 15 bp, Homo sapiens
taacaattgtgaagt

SEQ ID NO: 1841332 - DNA, 13 bp, Homo sapiens
taacacacagcta

SEQ ID NO: 1841333 - DNA, 14 bp, Homo sapiens
taacacagtgtctg

SEQ ID NO: 1841334 - DNA, 16 bp, Homo sapiens
taacagtcatcattta

SEQ ID NO: 1841335 - DNA, 17 bp, Homo sapiens
taacagtcatcatttat

SEQ ID NO: 1841336 - DNA, 19 bp, Homo sapiens
taacataagctatttttct

SEQ ID NO: 1841337 - DNA, 20 bp, Homo sapiens
taacatcgaaaagttatttt

SEQ ID NO: 1841338 - DNA, 17 bp, Homo sapiens
taaccaattcctcattt

SEQ ID NO: 1841339 - DNA, 16 bp, Homo sapiens
taaccacttcagctga

SEQ ID NO: 1841340 - DNA, 20 bp, Homo sapiens
taaccctttctgggatgcaa

SEQ ID NO: 1841341 - DNA, 15 bp, Homo sapiens
taacctactagacaa

SEQ ID NO: 1841342 - DNA, 22 bp, Homo sapiens
taactcttctttcatttcttct

SEQ ID NO: 1841343 - DNA, 16 bp, Homo sapiens
taactgttatttataa

SEQ ID NO: 1841344 - DNA, 20 bp, Homo sapiens
taacttgtctttggaccctg

SEQ ID NO: 1841345 - DNA, 21 bp, Homo sapiens
taactttactaagtaatctca

SEQ ID NO: 1841346 - DNA, 17 bp, Homo sapiens
taagacatttttggaag

SEQ ID NO: 1841347 - DNA, 17 bp, Homo sapiens
taagaccaccacctcag

SEQ ID NO: 1841348 - DNA, 14 bp, Homo sapiens
taagacgacaagga

SEQ ID NO: 1841349 - DNA, 21 bp, Homo sapiens
taagagacagtcaccccagga

SEQ ID NO: 1841350 - DNA, 17 bp, Homo sapiens
taagagcttgctccaga

SEQ ID NO: 1841351 - DNA, 17 bp, Homo sapiens
taagagggcacacactg

SEQ ID NO: 1841352 - DNA, 18 bp, Homo sapiens
taagagggcacacactgt

SEQ ID NO: 1841353 - DNA, 19 bp, Homo sapiens
taagagtaacagtcatcat

SEQ ID NO: 1841354 - DNA, 14 bp, Homo sapiens
taagatatgtaaca

SEQ ID NO: 1841355 - DNA, 22 bp, Homo sapiens
taagcactttaacacagtgtct

SEQ ID NO: 1841356 - DNA, 14 bp, Homo sapiens
taagcatcattatt

SEQ ID NO: 1841357 - DNA, 19 bp, Homo sapiens
taagcatcattatttatgt

SEQ ID NO: 1841358 - DNA, 23 bp, Homo sapiens
taagcatcattatttatgtattg

SEQ ID NO: 1841359 - DNA, 22 bp, Homo sapiens
taagcccaacaagttgaagaag

SEQ ID NO: 1841360 - DNA, 20 bp, Homo sapiens
taagcctttgagactgttcc

SEQ ID NO: 1841361 - DNA, 21 bp, Homo sapiens
taagctatttttctaactaca

SEQ ID NO: 1841362 - DNA, 12 bp, Homo sapiens
taaggaaactgg

SEQ ID NO: 1841363 - DNA, 9 bp, Homo sapiens
taaggaata

SEQ ID NO: 1841364 - DNA, 17 bp, Homo sapiens
taaggaatacctgtccc

SEQ ID NO: 1841365 - DNA, 18 bp, Homo sapiens
taaggaatacctgtcccc

SEQ ID NO: 1841366 - DNA, 13 bp, Homo sapiens
taaggattttatg

SEQ ID NO: 1841367 - DNA, 16 bp, Homo sapiens
taaggcatatacaaat

SEQ ID NO: 1841368 - DNA, 17 bp, Homo sapiens
taagggtatctggtgac

SEQ ID NO: 1841369 - DNA, 15 bp, Homo sapiens
taagtatctgacatc

SEQ ID NO: 1841370 - DNA, 22 bp, Homo sapiens
taagtgcacaacattacaggga

SEQ ID NO: 1841371 - DNA, 12 bp, Homo sapiens
taatataaatgc

SEQ ID NO: 1841372 - DNA, 23 bp, Homo sapiens
taatatcatcagtattgaagcat

SEQ ID NO: 1841373 - DNA, 19 bp, Homo sapiens
taatatggactcagccttg

SEQ ID NO: 1841374 - DNA, 20 bp, Homo sapiens
taatattaaggaagacaatg

SEQ ID NO: 1841375 - DNA, 17 bp, Homo sapiens
taatcacttttttccac

SEQ ID NO: 1841376 - DNA, 23 bp, Homo sapiens
taatcctctcaaccacctttcag

SEQ ID NO: 1841377 - DNA, 20 bp, Homo sapiens
taatctctccaccttccaaa

SEQ ID NO: 1841378 - DNA, 21 bp, Homo sapiens
taatgtgacttggattcaatt

SEQ ID NO: 1841379 - DNA, 14 bp, Homo sapiens
taattaagctctca

SEQ ID NO: 1841380 - DNA, 21 bp, Homo sapiens
taattacaatgtaatagaagc

SEQ ID NO: 1841381 - DNA, 14 bp, Homo sapiens
taattatatatact

SEQ ID NO: 1841382 - DNA, 15 bp, Homo sapiens
taattctcaggccat

SEQ ID NO: 1841383 - DNA, 17 bp, Homo sapiens
tacaaagctgaagaaaa

SEQ ID NO: 1841384 - DNA, 18 bp, Homo sapiens
tacaaagctgaagaaaat

SEQ ID NO: 1841385 - DNA, 15 bp, Homo sapiens
tacaaaggtttaaat

SEQ ID NO: 1841386 - DNA, 17 bp, Homo sapiens
tacaactcatacactcg

SEQ ID NO: 1841387 - DNA, 14 bp, Homo sapiens
tacaaggacagccc

SEQ ID NO: 1841388 - DNA, 16 bp, Homo sapiens
tacactgtgctgagtc

SEQ ID NO: 1841389 - DNA, 23 bp, Homo sapiens
tacagagcccacgcccccactgg

SEQ ID NO: 1841390 - DNA, 20 bp, Homo sapiens
tacagctgggtggcactgcc

SEQ ID NO: 1841391 - DNA, 19 bp, Homo sapiens
tacagttgaaaaacagctg

SEQ ID NO: 1841392 - DNA, 20 bp, Homo sapiens
tacagttgaaaaacagctga

SEQ ID NO: 1841393 - DNA, 13 bp, Homo sapiens
tacatgtatttgt

SEQ ID NO: 1841394 - DNA, 12 bp, Homo sapiens
taccagcagagc

SEQ ID NO: 1841395 - DNA, 22 bp, Homo sapiens
taccagcagagcaccttagaca

SEQ ID NO: 1841396 - DNA, 17 bp, Homo sapiens
taccatcccctgtagag

SEQ ID NO: 1841397 - DNA, 15 bp, Homo sapiens
tacccacccccaccc

SEQ ID NO: 1841398 - DNA, 17 bp, Homo sapiens
tacccacccccacccaa

SEQ ID NO: 1841399 - DNA, 22 bp, Homo sapiens
tacccaggtgctaggaacactc

SEQ ID NO: 1841400 - DNA, 12 bp, Homo sapiens
taccctctgggt

SEQ ID NO: 1841401 - DNA, 13 bp, Homo sapiens
tacctacatgtat

SEQ ID NO: 1841402 - DNA, 14 bp, Homo sapiens
tacctcctgtctct

SEQ ID NO: 1841403 - DNA, 17 bp, Homo sapiens
tacctggcctcatttaa

SEQ ID NO: 1841404 - DNA, 19 bp, Homo sapiens
tactatatatgtgatgatc

SEQ ID NO: 1841405 - DNA, 22 bp, Homo sapiens
tactcaacccattgttgtcaag

SEQ ID NO: 1841406 - DNA, 12 bp, Homo sapiens
tactcccatctg

SEQ ID NO: 1841407 - DNA, 17 bp, Homo sapiens
tactcccatctgtgaaa

SEQ ID NO: 1841408 - DNA, 22 bp, Homo sapiens
ggctgggttctacccaggtgct

SEQ ID NO: 1841409 - DNA, 19 bp, Homo sapiens
ggcttcccagtggctgctg

SEQ ID NO: 1841410 - DNA, 20 bp, Homo sapiens
ggcttcccagtggctgctgc

SEQ ID NO: 1841411 - DNA, 23 bp, Homo sapiens
ggcttggggaaaatggccatgca

SEQ ID NO: 1841412 - DNA, 20 bp, Homo sapiens
gggaaaatggccatgcagga

SEQ ID NO: 1841413 - DNA, 18 bp, Homo sapiens
gggaagaagctctctcct

SEQ ID NO: 1841414 - DNA, 22 bp, Homo sapiens
gggacagagggggtggcctccc

SEQ ID NO: 1841415 - DNA, 14 bp, Homo sapiens
gggacgcaggcccc

SEQ ID NO: 1841416 - DNA, 19 bp, Homo sapiens
gggagaggggacgcaggcc

SEQ ID NO: 1841417 - DNA, 19 bp, Homo sapiens
gggaggccaaggtgggagg

SEQ ID NO: 1841418 - DNA, 11 bp, Homo sapiens
gggagggctcc

SEQ ID NO: 1841419 - DNA, 18 bp, Homo sapiens
gggaggtcgaggcaggag

SEQ ID NO: 1841420 - DNA, 17 bp, Homo sapiens
gggaggtgggatcctcc

SEQ ID NO: 1841421 - DNA, 20 bp, Homo sapiens
gggaggtgggatcctccagg

SEQ ID NO: 1841422 - DNA, 21 bp, Homo sapiens
gggagtgagttgatagcacag

SEQ ID NO: 1841423 - DNA, 16 bp, Homo sapiens
gggatcctccaggtgc

SEQ ID NO: 1841424 - DNA, 20 bp, Homo sapiens
gggatgagcatggagctggc

SEQ ID NO: 1841425 - DNA, 21 bp, Homo sapiens
gggatgagcatggagctggcc

SEQ ID NO: 1841426 - DNA, 13 bp, Homo sapiens
gggatggtgccct

SEQ ID NO: 1841427 - DNA, 14 bp, Homo sapiens
gggcaaacaggcag

SEQ ID NO: 1841428 - DNA, 12 bp, Homo sapiens
gggcacacactg

SEQ ID NO: 1841429 - DNA, 13 bp, Homo sapiens
gggcacacactgt

SEQ ID NO: 1841430 - DNA, 20 bp, Homo sapiens
gggcactttaaatgaagcta

SEQ ID NO: 1841431 - DNA, 16 bp, Homo sapiens
gggcagagcagagacc

SEQ ID NO: 1841432 - DNA, 22 bp, Homo sapiens
gggcagagcagagaccatccct

SEQ ID NO: 1841433 - DNA, 15 bp, Homo sapiens
gggcaggcatgaagt

SEQ ID NO: 1841434 - DNA, 21 bp, Homo sapiens
gggcatgggtcgggagagggg

SEQ ID NO: 1841435 - DNA, 14 bp, Homo sapiens
gggccccagaggct

SEQ ID NO: 1841436 - DNA, 13 bp, Homo sapiens
gggccctgcctcc

SEQ ID NO: 1841437 - DNA, 12 bp, Homo sapiens
gggcctggcctg

SEQ ID NO: 1841438 - DNA, 14 bp, Homo sapiens
gggcctggcctgag

SEQ ID NO: 1841439 - DNA, 12 bp, Homo sapiens
gggcctggctca

SEQ ID NO: 1841440 - DNA, 18 bp, Homo sapiens
gggcctggtcgttttcaa

SEQ ID NO: 1841441 - DNA, 13 bp, Homo sapiens
gggctccagacac

SEQ ID NO: 1841442 - DNA, 15 bp, Homo sapiens
gggctctagaattcc

SEQ ID NO: 1841443 - DNA, 17 bp, Homo sapiens
gggctgcaccggctggc

SEQ ID NO: 1841444 - DNA, 17 bp, Homo sapiens
gggctgggttctaccca

SEQ ID NO: 1841445 - DNA, 24 bp, Homo sapiens
gggcttagagcagtttctgtcctg

SEQ ID NO: 1841446 - DNA, 20 bp, Homo sapiens
gggcttcccagtggctgctg

SEQ ID NO: 1841447 - DNA, 16 bp, Homo sapiens
ggggaaaatcagcctg

SEQ ID NO: 1841448 - DNA, 21 bp, Homo sapiens
ggggaaaatcagcctgctcca

SEQ ID NO: 1841449 - DNA, 23 bp, Homo sapiens
ggggaaaatggccatgcaggagg

SEQ ID NO: 1841450 - DNA, 14 bp, Homo sapiens
ggggacgcaggccc

SEQ ID NO: 1841451 - DNA, 21 bp, Homo sapiens
ggggacgcaggcccctctcct

SEQ ID NO: 1841452 - DNA, 22 bp, Homo sapiens
ggggacgcaggcccctctcctc

SEQ ID NO: 1841453 - DNA, 12 bp, Homo sapiens
ggggagggcagg

SEQ ID NO: 1841454 - DNA, 21 bp, Homo sapiens
ggggatttccagccagggctg

SEQ ID NO: 1841455 - DNA, 12 bp, Homo sapiens
ggggcagccccc

SEQ ID NO: 1841456 - DNA, 18 bp, Homo sapiens
ggggccaaataaagtctc

SEQ ID NO: 1841457 - DNA, 19 bp, Homo sapiens
ggggccctgcctcctttgt

SEQ ID NO: 1841458 - DNA, 23 bp, Homo sapiens
ggggccctgcctcctttgtgagg

SEQ ID NO: 1841459 - DNA, 14 bp, Homo sapiens
gcaaagggcatggg

SEQ ID NO: 1841460 - DNA, 16 bp, Homo sapiens
gcaaagtcatgcaaag

SEQ ID NO: 1841461 - DNA, 13 bp, Homo sapiens
gcaaatgactttg

SEQ ID NO: 1841462 - DNA, 14 bp, Homo sapiens
gcaaatgcccaagg

SEQ ID NO: 1841463 - DNA, 15 bp, Homo sapiens
gcaaatgcctgccaa

SEQ ID NO: 1841464 - DNA, 19 bp, Homo sapiens
gcaacagacaagtgactgt

SEQ ID NO: 1841465 - DNA, 18 bp, Homo sapiens
gcaactgcattggctttg

SEQ ID NO: 1841466 - DNA, 21 bp, Homo sapiens
gcaagaaatggcgtctgctct

SEQ ID NO: 1841467 - DNA, 14 bp, Homo sapiens
gcaagacgctgtgc

SEQ ID NO: 1841468 - DNA, 20 bp, Homo sapiens
gcaagacgctgtgctgccct

SEQ ID NO: 1841469 - DNA, 21 bp, Homo sapiens
gcaagacgctgtgctgccctg

SEQ ID NO: 1841470 - DNA, 19 bp, Homo sapiens
gcaatatttcctcatgtga

SEQ ID NO: 1841471 - DNA, 23 bp, Homo sapiens
gcaatgccatcctcaaacactgc

SEQ ID NO: 1841472 - DNA, 20 bp, Homo sapiens
gcaatgtgtataaacaagaa

SEQ ID NO: 1841473 - DNA, 18 bp, Homo sapiens
gcacaaactcaccatctg

SEQ ID NO: 1841474 - DNA, 15 bp, Homo sapiens
gcacaagctccaagc

SEQ ID NO: 1841475 - DNA, 17 bp, Homo sapiens
gcacaagctccaagctc

SEQ ID NO: 1841476 - DNA, 21 bp, Homo sapiens
gcacaagctccaagctcccag

SEQ ID NO: 1841477 - DNA, 22 bp, Homo sapiens
gcacaagctgcaccctcaggca

SEQ ID NO: 1841478 - DNA, 17 bp, Homo sapiens
gcacacaggacagcggg

SEQ ID NO: 1841479 - DNA, 14 bp, Homo sapiens
gcacacttggccca

SEQ ID NO: 1841480 - DNA, 20 bp, Homo sapiens
gcacagaccctgccctgtgg

SEQ ID NO: 1841481 - DNA, 21 bp, Homo sapiens
gcacagaccctgccctgtggg

SEQ ID NO: 1841482 - DNA, 21 bp, Homo sapiens
gcacatttaagagacagtcac

SEQ ID NO: 1841483 - DNA, 15 bp, Homo sapiens
gcaccacactgggtg

SEQ ID NO: 1841484 - DNA, 19 bp, Homo sapiens
gcaccactgcactccagcc

SEQ ID NO: 1841485 - DNA, 14 bp, Homo sapiens
gcaccagcagcctg

SEQ ID NO: 1841486 - DNA, 20 bp, Homo sapiens
gcacccacctgttttctgaa

SEQ ID NO: 1841487 - DNA, 15 bp, Homo sapiens
gcacccttctgctgt

SEQ ID NO: 1841488 - DNA, 21 bp, Homo sapiens
gcaccggctggcctggcccct

SEQ ID NO: 1841489 - DNA, 17 bp, Homo sapiens
gcaccttagacagtccc

SEQ ID NO: 1841490 - DNA, 18 bp, Homo sapiens
gcaccttagacagtccct

SEQ ID NO: 1841491 - DNA, 19 bp, Homo sapiens
gcaccttagacagtccctg

SEQ ID NO: 1841492 - DNA, 20 bp, Homo sapiens
gcaccttagacagtccctgc

SEQ ID NO: 1841493 - DNA, 21 bp, Homo sapiens
gcaccttagacagtccctgcc

SEQ ID NO: 1841494 - DNA, 14 bp, Homo sapiens
gcacggctctgtcc

SEQ ID NO: 1841495 - DNA, 12 bp, Homo sapiens
gcacggctgctg

SEQ ID NO: 1841496 - DNA, 14 bp, Homo sapiens
gcactccagcctgg

SEQ ID NO: 1841497 - DNA, 12 bp, Homo sapiens
gcactcccctgc

SEQ ID NO: 1841498 - DNA, 13 bp, Homo sapiens
gcactcccctgct

SEQ ID NO: 1841499 - DNA, 22 bp, Homo sapiens
gcactcccctgctgggtgtggc

SEQ ID NO: 1841500 - DNA, 16 bp, Homo sapiens
gcactgactgggcata

SEQ ID NO: 1841501 - DNA, 17 bp, Homo sapiens
gcactgactgggcatag

SEQ ID NO: 1841502 - DNA, 15 bp, Homo sapiens
gcactgccatgcagg

SEQ ID NO: 1841503 - DNA, 15 bp, Homo sapiens
gcactgcttccagtg

SEQ ID NO: 1841504 - DNA, 18 bp, Homo sapiens
gcactgcttccagtgagg

SEQ ID NO: 1841505 - DNA, 19 bp, Homo sapiens
gcactttgctttaatataa

SEQ ID NO: 1841506 - DNA, 20 bp, Homo sapiens
gcactttgctttaatataaa

SEQ ID NO: 1841507 - DNA, 18 bp, Homo sapiens
gcagaacctgcacacagg

SEQ ID NO: 1841508 - DNA, 19 bp, Homo sapiens
gcagaacctgcacacagga

SEQ ID NO: 1841509 - DNA, 12 bp, Homo sapiens
gcagacaggacc

SEQ ID NO: 1841510 - DNA, 13 bp, Homo sapiens
gcagacctcatgc

SEQ ID NO: 1841511 - DNA, 21 bp, Homo sapiens
gcagacctcatgcccagctct

SEQ ID NO: 1841512 - DNA, 14 bp, Homo sapiens
gcagagaccatccc

SEQ ID NO: 1841513 - DNA, 12 bp, Homo sapiens
gcagagacttgg

SEQ ID NO: 1841514 - DNA, 22 bp, Homo sapiens
gcagagattggaatgggcagct

SEQ ID NO: 1841515 - DNA, 20 bp, Homo sapiens
gcagagcagagaccatccct

SEQ ID NO: 1841516 - DNA, 14 bp, Homo sapiens
gcagcaccacactg

SEQ ID NO: 1841517 - DNA, 18 bp, Homo sapiens
gcagcaggatagagtggg

SEQ ID NO: 1841518 - DNA, 14 bp, Homo sapiens
gcagcctggaccct

SEQ ID NO: 1841519 - DNA, 14 bp, Homo sapiens
gcagctcacctctc

SEQ ID NO: 1841520 - DNA, 18 bp, Homo sapiens
gcagctcagagagggtgg

SEQ ID NO: 1841521 - DNA, 19 bp, Homo sapiens
gcagctcagagagggtggg

SEQ ID NO: 1841522 - DNA, 16 bp, Homo sapiens
gcagctgatacaaatt

SEQ ID NO: 1841523 - DNA, 15 bp, Homo sapiens
gcagctgctccccag

SEQ ID NO: 1841524 - DNA, 21 bp, Homo sapiens
gcaggagcggcagatggggag

SEQ ID NO: 1841525 - DNA, 20 bp, Homo sapiens
gcaggaggatcacttgagtc

SEQ ID NO: 1841526 - DNA, 23 bp, Homo sapiens
gcaggaggatcacttgagtccag

SEQ ID NO: 1841527 - DNA, 22 bp, Homo sapiens
gcaggaggcccttgtcgtggga

SEQ ID NO: 1841528 - DNA, 13 bp, Homo sapiens
gcaggcagccagg

SEQ ID NO: 1841529 - DNA, 17 bp, Homo sapiens
gcaggcagccaggccac

SEQ ID NO: 1841530 - DNA, 20 bp, Homo sapiens
gcaggccacacttcaaacta

SEQ ID NO: 1841531 - DNA, 14 bp, Homo sapiens
gcaggcccctctcc

SEQ ID NO: 1841532 - DNA, 15 bp, Homo sapiens
gcaggcccctctcct

SEQ ID NO: 1841533 - DNA, 21 bp, Homo sapiens
gcaggctaaggcgtggagctg

SEQ ID NO: 1841534 - DNA, 15 bp, Homo sapiens
gcagggccatgcaga

SEQ ID NO: 1841535 - DNA, 16 bp, Homo sapiens
gcagggccatgcagac

SEQ ID NO: 1841536 - DNA, 18 bp, Homo sapiens
gcagggccatgcagacct

SEQ ID NO: 1841537 - DNA, 14 bp, Homo sapiens
gcagggtctgggca

SEQ ID NO: 1841538 - DNA, 17 bp, Homo sapiens
gcagggtctgggcagga

SEQ ID NO: 1841539 - DNA, 20 bp, Homo sapiens
gcagggtctgggcaggactc

SEQ ID NO: 1841540 - DNA, 24 bp, Homo sapiens
gcagtcacgtggaggagcagtgca

SEQ ID NO: 1841541 - DNA, 14 bp, Homo sapiens
gcagttgccagtca

SEQ ID NO: 1841542 - DNA, 22 bp, Homo sapiens
gcagttggccagagagcctggt

SEQ ID NO: 1841543 - DNA, 16 bp, Homo sapiens
gcagtttctgtcctgc

SEQ ID NO: 1841544 - DNA, 15 bp, Homo sapiens
gcataaaaattagcc

SEQ ID NO: 1841545 - DNA, 21 bp, Homo sapiens
gcataggtgatctcatttaat

SEQ ID NO: 1841546 - DNA, 17 bp, Homo sapiens
gcatattcaggaagctc

SEQ ID NO: 1841547 - DNA, 12 bp, Homo sapiens
gcatcacagttt

SEQ ID NO: 1841548 - DNA, 15 bp, Homo sapiens
gcatcagtgccctcc

SEQ ID NO: 1841549 - DNA, 18 bp, Homo sapiens
gcatcccttgaccaggcc

SEQ ID NO: 1841550 - DNA, 20 bp, Homo sapiens
gcatcccttgaccaggcctg

SEQ ID NO: 1841551 - DNA, 15 bp, Homo sapiens
gcatgcctggatggg

SEQ ID NO: 1841552 - DNA, 18 bp, Homo sapiens
gcatggcatcacctccac

SEQ ID NO: 1841553 - DNA, 16 bp, Homo sapiens
gcatgtttagacttta

SEQ ID NO: 1841554 - DNA, 12 bp, Homo sapiens
gcattccccact

SEQ ID NO: 1841555 - DNA, 16 bp, Homo sapiens
gcattccccaggaggc

SEQ ID NO: 1841556 - DNA, 22 bp, Homo sapiens
gcattccccaggaggccagcct

SEQ ID NO: 1841557 - DNA, 18 bp, Homo sapiens
gcattctcattggaaatt

SEQ ID NO: 1841558 - DNA, 17 bp, Homo sapiens
gcatttggtctcaggca

SEQ ID NO: 1841559 - DNA, 22 bp, Homo sapiens
gcattttgctaaatgtgaatga

SEQ ID NO: 1841560 - DNA, 22 bp, Homo sapiens
gccaaattttagatttaccttg

SEQ ID NO: 1841561 - DNA, 16 bp, Homo sapiens
gccaacactcaagaag

SEQ ID NO: 1841562 - DNA, 21 bp, Homo sapiens
gccaagatcacagtggccacg

SEQ ID NO: 1841563 - DNA, 20 bp, Homo sapiens
gccaagctcaggaccaggca

SEQ ID NO: 1841564 - DNA, 21 bp, Homo sapiens
gccaagggatgaaagagaagg

SEQ ID NO: 1841565 - DNA, 15 bp, Homo sapiens
gccaaggtgggagga

SEQ ID NO: 1841566 - DNA, 23 bp, Homo sapiens
gccaaggtgggaggattgcttga

SEQ ID NO: 1841567 - DNA, 16 bp, Homo sapiens
gccacattcctgatgc

SEQ ID NO: 1841568 - DNA, 20 bp, Homo sapiens
gccacattcctgatgcttct

SEQ ID NO: 1841569 - DNA, 22 bp, Homo sapiens
gccaccccgctgatggagcccc

SEQ ID NO: 1841570 - DNA, 15 bp, Homo sapiens
gccaccctcatgctg

SEQ ID NO: 1841571 - DNA, 16 bp, Homo sapiens
gccaccctcatgctgt

SEQ ID NO: 1841572 - DNA, 19 bp, Homo sapiens
gccaccctgcctctaccca

SEQ ID NO: 1841573 - DNA, 17 bp, Homo sapiens
gccagattctttcctga

SEQ ID NO: 1841574 - DNA, 19 bp, Homo sapiens
gccagattctttcctgagg

SEQ ID NO: 1841575 - DNA, 24 bp, Homo sapiens
gccagattctttcctgaggctggg

SEQ ID NO: 1841576 - DNA, 10 bp, Homo sapiens
gccagcccct

SEQ ID NO: 1841577 - DNA, 14 bp, Homo sapiens
gccagccttgacca

SEQ ID NO: 1841578 - DNA, 20 bp, Homo sapiens
gccagccttgaccattctcc

SEQ ID NO: 1841579 - DNA, 14 bp, Homo sapiens
gccagctcatttca

SEQ ID NO: 1841580 - DNA, 18 bp, Homo sapiens
gccaggagcacggctctg

SEQ ID NO: 1841581 - DNA, 21 bp, Homo sapiens
gccaggagcacggctctgtcc

SEQ ID NO: 1841582 - DNA, 18 bp, Homo sapiens
gccaggccacaagaccct

SEQ ID NO: 1841583 - DNA, 21 bp, Homo sapiens
gccaggccacaagacccttgt

SEQ ID NO: 1841584 - DNA, 16 bp, Homo sapiens
gccaggccctctgccc

SEQ ID NO: 1841585 - DNA, 15 bp, Homo sapiens
gccaggctggtctcg

SEQ ID NO: 1841586 - DNA, 11 bp, Homo sapiens
gccagggctgc

SEQ ID NO: 1841587 - DNA, 17 bp, Homo sapiens
gccaggggaaaatcagc

SEQ ID NO: 1841588 - DNA, 21 bp, Homo sapiens
gccaggggaaaatcagcctgc

SEQ ID NO: 1841589 - DNA, 18 bp, Homo sapiens
gccagtcaccccggccac

SEQ ID NO: 1841590 - DNA, 20 bp, Homo sapiens
gccagtcaccccggccacct

SEQ ID NO: 1841591 - DNA, 21 bp, Homo sapiens
gccagtcaccccggccacctg

SEQ ID NO: 1841592 - DNA, 16 bp, Homo sapiens
gccagttggtccccct

SEQ ID NO: 1841593 - DNA, 20 bp, Homo sapiens
gccagttggtcccccttcca

SEQ ID NO: 1841594 - DNA, 15 bp, Homo sapiens
gccatcccagcccca

SEQ ID NO: 1841595 - DNA, 17 bp, Homo sapiens
gccatcccagccccaat

SEQ ID NO: 1841596 - DNA, 18 bp, Homo sapiens
gccatcctcaaacactgc

SEQ ID NO: 1841597 - DNA, 21 bp, Homo sapiens
gccatcctcaaacactgcagg

SEQ ID NO: 1841598 - DNA, 22 bp, Homo sapiens
gccatgcagacctcatgcccag

SEQ ID NO: 1841599 - DNA, 17 bp, Homo sapiens
gccatgcaggaggtgga

SEQ ID NO: 1841600 - DNA, 13 bp, Homo sapiens
gccatgccagctt

SEQ ID NO: 1841601 - DNA, 18 bp, Homo sapiens
gccatggagagctggagc

SEQ ID NO: 1841602 - DNA, 23 bp, Homo sapiens
gccatggagagctggagcctggt

SEQ ID NO: 1841603 - DNA, 15 bp, Homo sapiens
gccatgtagaagctg

SEQ ID NO: 1841604 - DNA, 18 bp, Homo sapiens
gccatgtagaagctgcat

SEQ ID NO: 1841605 - DNA, 13 bp, Homo sapiens
gcccaagatgctt

SEQ ID NO: 1841606 - DNA, 23 bp, Homo sapiens
gcccaagggaaagaaaaggaagg

SEQ ID NO: 1841607 - DNA, 20 bp, Homo sapiens
gcccaagtggcagagcttgg

SEQ ID NO: 1841608 - DNA, 21 bp, Homo sapiens
gcccaatgcactttgttctgg

SEQ ID NO: 1841609 - DNA, 13 bp, Homo sapiens
gcccacgccccca

SEQ ID NO: 1841610 - DNA, 15 bp, Homo sapiens
gcccactccctgcaa

SEQ ID NO: 1841611 - DNA, 19 bp, Homo sapiens
gcccactccctgcaacctg

SEQ ID NO: 1841612 - DNA, 15 bp, Homo sapiens
gcccagagggcctgc

SEQ ID NO: 1841613 - DNA, 19 bp, Homo sapiens
gcccagagggcctgcaagg

SEQ ID NO: 1841614 - DNA, 20 bp, Homo sapiens
gcccagagggcctgcaaggg

SEQ ID NO: 1841615 - DNA, 17 bp, Homo sapiens
gcccagccccttctgac

SEQ ID NO: 1841616 - DNA, 17 bp, Homo sapiens
gcccagctctctgacgc

SEQ ID NO: 1841617 - DNA, 16 bp, Homo sapiens
gcccaggaaaggctcc

SEQ ID NO: 1841618 - DNA, 18 bp, Homo sapiens
gcccaggaaaggctccag

SEQ ID NO: 1841619 - DNA, 23 bp, Homo sapiens
gcccaggtttctggtctctaggc

SEQ ID NO: 1841620 - DNA, 18 bp, Homo sapiens
gccccactttgaagggca

SEQ ID NO: 1841621 - DNA, 22 bp, Homo sapiens
gccccatcctctgtacagagcc

SEQ ID NO: 1841622 - DNA, 15 bp, Homo sapiens
gccccctccccccag

SEQ ID NO: 1841623 - DNA, 14 bp, Homo sapiens
gcccctcagggtcc

SEQ ID NO: 1841624 - DNA, 21 bp, Homo sapiens
gcccctcagggtccctggtgg

SEQ ID NO: 1841625 - DNA, 12 bp, Homo sapiens
gcccctctcctc

SEQ ID NO: 1841626 - DNA, 13 bp, Homo sapiens
gcccctctcctcc

SEQ ID NO: 1841627 - DNA, 19 bp, Homo sapiens
gccccttctgacccatgct

SEQ ID NO: 1841628 - DNA, 22 bp, Homo sapiens
gcccgcagggccatgcagacct

SEQ ID NO: 1841629 - DNA, 13 bp, Homo sapiens
gcccgggctctgc

SEQ ID NO: 1841630 - DNA, 15 bp, Homo sapiens
gcccgggctctgcct

SEQ ID NO: 1841631 - DNA, 18 bp, Homo sapiens
gcccgggctctgcctccc

SEQ ID NO: 1841632 - DNA, 21 bp, Homo sapiens
gccctaacctctgagtcacca

SEQ ID NO: 1841633 - DNA, 19 bp, Homo sapiens
gccctccaagaccttctcc

SEQ ID NO: 1841634 - DNA, 20 bp, Homo sapiens
gccctctcccctcagcctct

SEQ ID NO: 1841635 - DNA, 12 bp, Homo sapiens
gccctctgccca

SEQ ID NO: 1841636 - DNA, 14 bp, Homo sapiens
gccctgagctttct

SEQ ID NO: 1841637 - DNA, 14 bp, Homo sapiens
gccctgcccacctg

SEQ ID NO: 1841638 - DNA, 15 bp, Homo sapiens
gccctgcccacctgg

SEQ ID NO: 1841639 - DNA, 12 bp, Homo sapiens
gccctgcctcct

SEQ ID NO: 1841640 - DNA, 17 bp, Homo sapiens
gccctggctgaaggact

SEQ ID NO: 1841641 - DNA, 20 bp, Homo sapiens
gccctggctgaaggactgtg

SEQ ID NO: 1841642 - DNA, 21 bp, Homo sapiens
gccctggctgaaggactgtga

SEQ ID NO: 1841643 - DNA, 16 bp, Homo sapiens
gccctgtgggccccca

SEQ ID NO: 1841644 - DNA, 21 bp, Homo sapiens
gccctgtgggcccccaaatgg

SEQ ID NO: 1841645 - DNA, 19 bp, Homo sapiens
gcccttctctccagcccct

SEQ ID NO: 1841646 - DNA, 23 bp, Homo sapiens
gcccttctctccagcccctggat

SEQ ID NO: 1841647 - DNA, 14 bp, Homo sapiens
gccgccccacccag

SEQ ID NO: 1841648 - DNA, 18 bp, Homo sapiens
gccgggaccccgagcctg

SEQ ID NO: 1841649 - DNA, 21 bp, Homo sapiens
gccgggcgcggtggctcacgc

SEQ ID NO: 1841650 - DNA, 18 bp, Homo sapiens
gcctcacagtccttacca

SEQ ID NO: 1841651 - DNA, 20 bp, Homo sapiens
gcctcagtaagacgacaagg

SEQ ID NO: 1841652 - DNA, 13 bp, Homo sapiens
gcctcccaactca

SEQ ID NO: 1841653 - DNA, 18 bp, Homo sapiens
gcctcccaactcacccca

SEQ ID NO: 1841654 - DNA, 19 bp, Homo sapiens
gcctcccaactcaccccag

SEQ ID NO: 1841655 - DNA, 17 bp, Homo sapiens
gcctcccatcacccgct

SEQ ID NO: 1841656 - DNA, 13 bp, Homo sapiens
gcctcctccagcc

SEQ ID NO: 1841657 - DNA, 19 bp, Homo sapiens
gcctcctttgtgaggaagc

SEQ ID NO: 1841658 - DNA, 21 bp, Homo sapiens
gcctctacccaaccagggccc

SEQ ID NO: 1841659 - DNA, 16 bp, Homo sapiens
gcctctcccctgcctg

SEQ ID NO: 1841660 - DNA, 17 bp, Homo sapiens
gcctctgcactcccctg

SEQ ID NO: 1841661 - DNA, 19 bp, Homo sapiens
gcctctgcactcccctgct

SEQ ID NO: 1841662 - DNA, 20 bp, Homo sapiens
gcctctgcactcccctgctg

SEQ ID NO: 1841663 - DNA, 16 bp, Homo sapiens
gcctcttatgggctgg

SEQ ID NO: 1841664 - DNA, 17 bp, Homo sapiens
gcctcttatgggctggg

SEQ ID NO: 1841665 - DNA, 18 bp, Homo sapiens
gcctcttatgggctgggt

SEQ ID NO: 1841666 - DNA, 14 bp, Homo sapiens
gcctcttgtagtct

SEQ ID NO: 1841667 - DNA, 19 bp, Homo sapiens
gcctcttgtagtcttggct

SEQ ID NO: 1841668 - DNA, 18 bp, Homo sapiens
gcctctttgccccgactc

SEQ ID NO: 1841669 - DNA, 22 bp, Homo sapiens
gcctgaatgcttataggtggcc

SEQ ID NO: 1841670 - DNA, 19 bp, Homo sapiens
gcctgattgccaagctcag

SEQ ID NO: 1841671 - DNA, 13 bp, Homo sapiens
gcctgcaagggag

SEQ ID NO: 1841672 - DNA, 15 bp, Homo sapiens
gcctgcaagggagtg

SEQ ID NO: 1841673 - DNA, 16 bp, Homo sapiens
gcctgctccagctgtt

SEQ ID NO: 1841674 - DNA, 14 bp, Homo sapiens
gcctggaagacaga

SEQ ID NO: 1841675 - DNA, 18 bp, Homo sapiens
gcctggatggggctgcac

SEQ ID NO: 1841676 - DNA, 15 bp, Homo sapiens
gcctggcccctcagg

SEQ ID NO: 1841677 - DNA, 13 bp, Homo sapiens
gcctggcctgagc

SEQ ID NO: 1841678 - DNA, 18 bp, Homo sapiens
gcctggcctgagctggga

SEQ ID NO: 1841679 - DNA, 13 bp, Homo sapiens
gcctggctcaggt

SEQ ID NO: 1841680 - DNA, 16 bp, Homo sapiens
gcctgggaaagcccct

SEQ ID NO: 1841681 - DNA, 22 bp, Homo sapiens
gcctgggaggtcaaggctgcag

SEQ ID NO: 1841682 - DNA, 14 bp, Homo sapiens
gcctgggatccctc

SEQ ID NO: 1841683 - DNA, 21 bp, Homo sapiens
gcctgggatccctcatcctca

SEQ ID NO: 1841684 - DNA, 13 bp, Homo sapiens
gcctggtgctgct

SEQ ID NO: 1841685 - DNA, 14 bp, Homo sapiens
gcctggttagaggc

SEQ ID NO: 1841686 - DNA, 20 bp, Homo sapiens
gcctgtaatcctagcacttt

SEQ ID NO: 1841687 - DNA, 17 bp, Homo sapiens
gcctgtgaactgaactc

SEQ ID NO: 1841688 - DNA, 13 bp, Homo sapiens
gcctgtgctgtga

SEQ ID NO: 1841689 - DNA, 14 bp, Homo sapiens
gcctgtgctgtgac

SEQ ID NO: 1841690 - DNA, 12 bp, Homo sapiens
gccttccagggg

SEQ ID NO: 1841691 - DNA, 16 bp, Homo sapiens
gccttccaggggtggg

SEQ ID NO: 1841692 - DNA, 21 bp, Homo sapiens
gccttccaggggtgggacacc

SEQ ID NO: 1841693 - DNA, 15 bp, Homo sapiens
gccttgtttaatggt

SEQ ID NO: 1841694 - DNA, 21 bp, Homo sapiens
gcctttagtgatcacagcagc

SEQ ID NO: 1841695 - DNA, 22 bp, Homo sapiens
gcctttggaaacagctcgactt

SEQ ID NO: 1841696 - DNA, 14 bp, Homo sapiens
gccttttctagccc

SEQ ID NO: 1841697 - DNA, 22 bp, Homo sapiens
gccttttgggaataatagcaca

SEQ ID NO: 1841698 - DNA, 20 bp, Homo sapiens
gcgcagcatattcaggaagc

SEQ ID NO: 1841699 - DNA, 19 bp, Homo sapiens
gcgctggccgggaccccga

SEQ ID NO: 1841700 - DNA, 17 bp, Homo sapiens
gcggaggggacagagcg

SEQ ID NO: 1841701 - DNA, 16 bp, Homo sapiens
gcggcagatggggaga

SEQ ID NO: 1841702 - DNA, 21 bp, Homo sapiens
gcggctggggtcccagcagct

SEQ ID NO: 1841703 - DNA, 14 bp, Homo sapiens
gcgtgagctgagca

SEQ ID NO: 1841704 - DNA, 14 bp, Homo sapiens
gcgtggacaggtgt

SEQ ID NO: 1841705 - DNA, 15 bp, Homo sapiens
gcgtggagctgcctg

SEQ ID NO: 1841706 - DNA, 18 bp, Homo sapiens
gcgttccatgatgctggg

SEQ ID NO: 1841707 - DNA, 13 bp, Homo sapiens
gctaaagccagga

SEQ ID NO: 1841708 - DNA, 16 bp, Homo sapiens
gagcctggtgctgctg

SEQ ID NO: 1841709 - DNA, 14 bp, Homo sapiens
gagccttccagggg

SEQ ID NO: 1841710 - DNA, 15 bp, Homo sapiens
gagccttccaggggt

SEQ ID NO: 1841711 - DNA, 17 bp, Homo sapiens
gagcgtgagctgagcag

SEQ ID NO: 1841712 - DNA, 18 bp, Homo sapiens
gagctcagagagggcagg

SEQ ID NO: 1841713 - DNA, 22 bp, Homo sapiens
gagctgacacaaacctgcctgg

SEQ ID NO: 1841714 - DNA, 23 bp, Homo sapiens
gagctgacacaaacctgcctggg

SEQ ID NO: 1841715 - DNA, 15 bp, Homo sapiens
gagctgagtggggga

SEQ ID NO: 1841716 - DNA, 15 bp, Homo sapiens
gagctggagcctggt

SEQ ID NO: 1841717 - DNA, 18 bp, Homo sapiens
gagctggatagacttggg

SEQ ID NO: 1841718 - DNA, 19 bp, Homo sapiens
gagctggccgtgggcctgg

SEQ ID NO: 1841719 - DNA, 13 bp, Homo sapiens
gagcttgctccag

SEQ ID NO: 1841720 - DNA, 17 bp, Homo sapiens
gaggaagagaaaaaata

SEQ ID NO: 1841721 - DNA, 22 bp, Homo sapiens
gaggaaggaaacccagctctgg

SEQ ID NO: 1841722 - DNA, 16 bp, Homo sapiens
gaggatctcttgagcc

SEQ ID NO: 1841723 - DNA, 16 bp, Homo sapiens
gaggattgcttgagct

SEQ ID NO: 1841724 - DNA, 22 bp, Homo sapiens
gaggcagtacctgggcaagctg

SEQ ID NO: 1841725 - DNA, 19 bp, Homo sapiens
ctgatgcttcttcagagac

SEQ ID NO: 1841726 - DNA, 16 bp, Homo sapiens
ctgatggagccccacc

SEQ ID NO: 1841727 - DNA, 19 bp, Homo sapiens
ctgatggcttctccagggt

SEQ ID NO: 1841728 - DNA, 15 bp, Homo sapiens
ctgattctcagggtc

SEQ ID NO: 1841729 - DNA, 17 bp, Homo sapiens
ctgattctcagggtctc

SEQ ID NO: 1841730 - DNA, 20 bp, Homo sapiens
ctgattctcagggtctctgc

SEQ ID NO: 1841731 - DNA, 17 bp, Homo sapiens
ctgattgggaggtgcgt

SEQ ID NO: 1841732 - DNA, 16 bp, Homo sapiens
gaaatattgctggggt

SEQ ID NO: 1841733 - DNA, 17 bp, Homo sapiens
gaaatggcgtctgctct

SEQ ID NO: 1841734 - DNA, 18 bp, Homo sapiens
gaaatggcgtctgctctg

SEQ ID NO: 1841735 - DNA, 22 bp, Homo sapiens
gaaatggcgtctgctctggtgg

SEQ ID NO: 1841736 - DNA, 17 bp, Homo sapiens
gaaatgggcagagcaga

SEQ ID NO: 1841737 - DNA, 17 bp, Homo sapiens
gaaattcccttcatctg

SEQ ID NO: 1841738 - DNA, 21 bp, Homo sapiens
gaaattcccttcatctggaac

SEQ ID NO: 1841739 - DNA, 12 bp, Homo sapiens
gaaatttagcat

SEQ ID NO: 1841740 - DNA, 18 bp, Homo sapiens
gaaatttagcattgtagt

SEQ ID NO: 1841741 - DNA, 16 bp, Homo sapiens
gaacaagagaagcatt

SEQ ID NO: 1841742 - DNA, 17 bp, Homo sapiens
gaacaagagaagcattc

SEQ ID NO: 1841743 - DNA, 17 bp, Homo sapiens
gaacagattcacactgt

SEQ ID NO: 1841744 - DNA, 15 bp, Homo sapiens
gaacagctgtgtctg

SEQ ID NO: 1841745 - DNA, 16 bp, Homo sapiens
gaacagctgtgtctgc

SEQ ID NO: 1841746 - DNA, 22 bp, Homo sapiens
gaacatcatcaaggcactgcct

SEQ ID NO: 1841747 - DNA, 13 bp, Homo sapiens
gaacattcccagc

SEQ ID NO: 1841748 - DNA, 18 bp, Homo sapiens
gaacattcccagcccagc

SEQ ID NO: 1841749 - DNA, 18 bp, Homo sapiens
gaacctgcacacaggaca

SEQ ID NO: 1841750 - DNA, 20 bp, Homo sapiens
gaacctgcacacaggacagc

SEQ ID NO: 1841751 - DNA, 22 bp, Homo sapiens
gaacctgcacacaggacagcgg

SEQ ID NO: 1841752 - DNA, 18 bp, Homo sapiens
gaactcatccctaatgct

SEQ ID NO: 1841753 - DNA, 23 bp, Homo sapiens
gaagacaatgtgaaaagaaaaat

SEQ ID NO: 1841754 - DNA, 13 bp, Homo sapiens
gaagactttggaa

SEQ ID NO: 1841755 - DNA, 17 bp, Homo sapiens
gaagactttggaaagag

SEQ ID NO: 1841756 - DNA, 22 bp, Homo sapiens
gaagagcccgcagggccatgca

SEQ ID NO: 1841757 - DNA, 15 bp, Homo sapiens
gaagaggtggcccca

SEQ ID NO: 1841758 - DNA, 22 bp, Homo sapiens
gaagatataactattgcccagg

SEQ ID NO: 1841759 - DNA, 15 bp, Homo sapiens
gaagcagaggaagga

SEQ ID NO: 1841760 - DNA, 18 bp, Homo sapiens
gaagcaggctacactgac

SEQ ID NO: 1841761 - DNA, 23 bp, Homo sapiens
gaagcaggctacactgacactgg

SEQ ID NO: 1841762 - DNA, 18 bp, Homo sapiens
gaagcattctcattggaa

SEQ ID NO: 1841763 - DNA, 13 bp, Homo sapiens
gaagcattttata

SEQ ID NO: 1841764 - DNA, 15 bp, Homo sapiens
gaagcccaggaaagg

SEQ ID NO: 1841765 - DNA, 19 bp, Homo sapiens
gaagcccaggaaaggctcc

SEQ ID NO: 1841766 - DNA, 20 bp, Homo sapiens
gaagcccaggaaaggctcca

SEQ ID NO: 1841767 - DNA, 23 bp, Homo sapiens
gaagcccaggaaaggctccagga

SEQ ID NO: 1841768 - DNA, 18 bp, Homo sapiens
gaagccgctggggccagt

SEQ ID NO: 1841769 - DNA, 20 bp, Homo sapiens
gaagccgctggggccagttg

SEQ ID NO: 1841770 - DNA, 18 bp, Homo sapiens
gaagctcagggcctggct

SEQ ID NO: 1841771 - DNA, 19 bp, Homo sapiens
gaagctcagggcctggctc

SEQ ID NO: 1841772 - DNA, 20 bp, Homo sapiens
gaagctcagggcctggctca

SEQ ID NO: 1841773 - DNA, 14 bp, Homo sapiens
gaagctttctgtct

SEQ ID NO: 1841774 - DNA, 23 bp, Homo sapiens
gaaggactgtgacaggcagcaga

SEQ ID NO: 1841775 - DNA, 14 bp, Homo sapiens
gaaggatctgctga

SEQ ID NO: 1841776 - DNA, 14 bp, Homo sapiens
gaaggccccgccca

SEQ ID NO: 1841777 - DNA, 18 bp, Homo sapiens
gaaggccccgcccaggct

SEQ ID NO: 1841778 - DNA, 19 bp, Homo sapiens
gaaggctcgagcatgcctg

SEQ ID NO: 1841779 - DNA, 18 bp, Homo sapiens
gaaggctcttctccccag

SEQ ID NO: 1841780 - DNA, 20 bp, Homo sapiens
gaaggctgggttctgatcct

SEQ ID NO: 1841781 - DNA, 13 bp, Homo sapiens
gaagggcaagaaa

SEQ ID NO: 1841782 - DNA, 16 bp, Homo sapiens
gaagggggctgggaca

SEQ ID NO: 1841783 - DNA, 17 bp, Homo sapiens
gaaggtagaatgttttc

SEQ ID NO: 1841784 - DNA, 16 bp, Homo sapiens
gaagtctctgaagtga

SEQ ID NO: 1841785 - DNA, 13 bp, Homo sapiens
gaagtcttctatt

SEQ ID NO: 1841786 - DNA, 17 bp, Homo sapiens
gaagtcttctatttatt

SEQ ID NO: 1841787 - DNA, 13 bp, Homo sapiens
gaagtgactttgg

SEQ ID NO: 1841788 - DNA, 15 bp, Homo sapiens
gaagtgactttggct

SEQ ID NO: 1841789 - DNA, 20 bp, Homo sapiens
gaagtgactttggctgcatg

SEQ ID NO: 1841790 - DNA, 21 bp, Homo sapiens
gaagtgactttggctgcatgc

SEQ ID NO: 1841791 - DNA, 21 bp, Homo sapiens
gaagttgatatagaacagtgc

SEQ ID NO: 1841792 - DNA, 15 bp, Homo sapiens
gaataacctttctgg

SEQ ID NO: 1841793 - DNA, 18 bp, Homo sapiens
gaataatagcacatgatt

SEQ ID NO: 1841794 - DNA, 15 bp, Homo sapiens
gaatacctgtccccc

SEQ ID NO: 1841795 - DNA, 20 bp, Homo sapiens
gaatattagtgacctcagct

SEQ ID NO: 1841796 - DNA, 23 bp, Homo sapiens
gaatattttgttttgtgcagaga

SEQ ID NO: 1841797 - DNA, 21 bp, Homo sapiens
gaatcatctcctttgcagaat

SEQ ID NO: 1841798 - DNA, 18 bp, Homo sapiens
gaatgaaatactgtttga

SEQ ID NO: 1841799 - DNA, 19 bp, Homo sapiens
gaatgaaatactgtttgag

SEQ ID NO: 1841800 - DNA, 19 bp, Homo sapiens
gaatgacggtaagtgttct

SEQ ID NO: 1841801 - DNA, 18 bp, Homo sapiens
gaatgcttataggtggcc

SEQ ID NO: 1841802 - DNA, 22 bp, Homo sapiens
gaattacaggcgtgagccacca

SEQ ID NO: 1841803 - DNA, 14 bp, Homo sapiens
gaattgaagcagga

SEQ ID NO: 1841804 - DNA, 17 bp, Homo sapiens
gaatttcccacataccc

SEQ ID NO: 1841805 - DNA, 16 bp, Homo sapiens
gacaacagacttctga

SEQ ID NO: 1841806 - DNA, 15 bp, Homo sapiens
gacaataatctcact

SEQ ID NO: 1841807 - DNA, 17 bp, Homo sapiens
gacacaaacctgcctgg

SEQ ID NO: 1841808 - DNA, 23 bp, Homo sapiens
gacacatgtccaagaagcccagg

SEQ ID NO: 1841809 - DNA, 13 bp, Homo sapiens
gacaccctgtgat

SEQ ID NO: 1841810 - DNA, 18 bp, Homo sapiens
gacacctaactcttcttt

SEQ ID NO: 1841811 - DNA, 15 bp, Homo sapiens
gacacgggcctgtcc

SEQ ID NO: 1841812 - DNA, 18 bp, Homo sapiens
gacacgggcctgtccaca

SEQ ID NO: 1841813 - DNA, 21 bp, Homo sapiens
gacacgggcctgtccacaggc

SEQ ID NO: 1841814 - DNA, 19 bp, Homo sapiens
gacactggtattcctgcct

SEQ ID NO: 1841815 - DNA, 18 bp, Homo sapiens
gacactgttcttagctca

SEQ ID NO: 1841816 - DNA, 23 bp, Homo sapiens
gacactgttcttagctcaatgag

SEQ ID NO: 1841817 - DNA, 15 bp, Homo sapiens
gacagaagcagctct

SEQ ID NO: 1841818 - DNA, 16 bp, Homo sapiens
gacagaagcagctctt

SEQ ID NO: 1841819 - DNA, 16 bp, Homo sapiens
gacagagacctcctgc

SEQ ID NO: 1841820 - DNA, 23 bp, Homo sapiens
gacagagcgtgagctgagcaggc

SEQ ID NO: 1841821 - DNA, 13 bp, Homo sapiens
gacagagggggtg

SEQ ID NO: 1841822 - DNA, 18 bp, Homo sapiens
gacagcccgggctctgcc

SEQ ID NO: 1841823 - DNA, 20 bp, Homo sapiens
gacagcccgggctctgcctc

SEQ ID NO: 1841824 - DNA, 12 bp, Homo sapiens
gacagctgcctg

SEQ ID NO: 1841825 - DNA, 17 bp, Homo sapiens
gacagctgcctgggatc

SEQ ID NO: 1841826 - DNA, 21 bp, Homo sapiens
gacagctgcctgggatccctc

SEQ ID NO: 1841827 - DNA, 15 bp, Homo sapiens
gacagctttctggga

SEQ ID NO: 1841828 - DNA, 23 bp, Homo sapiens
gacaggaccagggatttccatga

SEQ ID NO: 1841829 - DNA, 18 bp, Homo sapiens
gacaggagacctggcact

SEQ ID NO: 1841830 - DNA, 14 bp, Homo sapiens
gacagggatgagca

SEQ ID NO: 1841831 - DNA, 23 bp, Homo sapiens
gacagggatgagcatggagctgg

SEQ ID NO: 1841832 - DNA, 16 bp, Homo sapiens
gacagtccagcctgga

SEQ ID NO: 1841833 - DNA, 20 bp, Homo sapiens
gacagtgcctcttccagtga

SEQ ID NO: 1841834 - DNA, 16 bp, Homo sapiens
gacatcaggtttttcc

SEQ ID NO: 1841835 - DNA, 19 bp, Homo sapiens
gacatgagtgcgtgctcag

SEQ ID NO: 1841836 - DNA, 14 bp, Homo sapiens
gacatgctgaagcc

SEQ ID NO: 1841837 - DNA, 18 bp, Homo sapiens
gacatgctgaagccaaag

SEQ ID NO: 1841838 - DNA, 19 bp, Homo sapiens
gacatgctgaagccaaagc

SEQ ID NO: 1841839 - DNA, 13 bp, Homo sapiens
gacattcatgcct

SEQ ID NO: 1841840 - DNA, 18 bp, Homo sapiens
gacattcatgcctggctt

SEQ ID NO: 1841841 - DNA, 16 bp, Homo sapiens
gaccaccacctcagag

SEQ ID NO: 1841842 - DNA, 13 bp, Homo sapiens
gaccaggcctggg

SEQ ID NO: 1841843 - DNA, 19 bp, Homo sapiens
gaccagtttaacctgatgc

SEQ ID NO: 1841844 - DNA, 16 bp, Homo sapiens
gaccatccctgaaggc

SEQ ID NO: 1841845 - DNA, 18 bp, Homo sapiens
gaccatccctgaaggccc

SEQ ID NO: 1841846 - DNA, 19 bp, Homo sapiens
gaccatccctgaaggcccc

SEQ ID NO: 1841847 - DNA, 20 bp, Homo sapiens
gaccatccctgaaggccccg

SEQ ID NO: 1841848 - DNA, 16 bp, Homo sapiens
gaccattctccacctg

SEQ ID NO: 1841849 - DNA, 17 bp, Homo sapiens
gaccattctccacctgc

SEQ ID NO: 1841850 - DNA, 20 bp, Homo sapiens
gaccattctccacctgccag

SEQ ID NO: 1841851 - DNA, 16 bp, Homo sapiens
gacccaaccacagagg

SEQ ID NO: 1841852 - DNA, 13 bp, Homo sapiens
gacccatgctgcc

SEQ ID NO: 1841853 - DNA, 15 bp, Homo sapiens
gacccatgctgccct

SEQ ID NO: 1841854 - DNA, 16 bp, Homo sapiens
gacccatgctgccctg

SEQ ID NO: 1841855 - DNA, 17 bp, Homo sapiens
gacccatgctgccctgt

SEQ ID NO: 1841856 - DNA, 16 bp, Homo sapiens
ctggggtaccaagaga

SEQ ID NO: 1841857 - DNA, 13 bp, Homo sapiens
ctggggtcccagc

SEQ ID NO: 1841858 - DNA, 14 bp, Homo sapiens
ctggggtcccagca

SEQ ID NO: 1841859 - DNA, 16 bp, Homo sapiens
ctggggtcccagcagc

SEQ ID NO: 1841860 - DNA, 20 bp, Homo sapiens
ctggggtcccagcagctgcc

SEQ ID NO: 1841861 - DNA, 16 bp, Homo sapiens
ctgggtaaatgcagcg

SEQ ID NO: 1841862 - DNA, 18 bp, Homo sapiens
ctgggtggcaccagcagc

SEQ ID NO: 1841863 - DNA, 22 bp, Homo sapiens
ctgggtggcaccagcagcctgg

SEQ ID NO: 1841864 - DNA, 23 bp, Homo sapiens
ctgggtggcaccagcagcctgga

SEQ ID NO: 1841865 - DNA, 14 bp, Homo sapiens
ctgggtggcactgc

SEQ ID NO: 1841866 - DNA, 15 bp, Homo sapiens
ctgggtggcactgcc

SEQ ID NO: 1841867 - DNA, 19 bp, Homo sapiens
ctgggttctacccaggtgc

SEQ ID NO: 1841868 - DNA, 14 bp, Homo sapiens
ctggtctctaggct

SEQ ID NO: 1841869 - DNA, 20 bp, Homo sapiens
ctggtctctaggctggggaa

SEQ ID NO: 1841870 - DNA, 15 bp, Homo sapiens
ctggtgactttcctc

SEQ ID NO: 1841871 - DNA, 20 bp, Homo sapiens
ctggtgactttcctctttgg

SEQ ID NO: 1841872 - DNA, 21 bp, Homo sapiens
ctggtgactttcctctttggt

SEQ ID NO: 1841873 - DNA, 14 bp, Homo sapiens
ctggtgctgctgct

SEQ ID NO: 1841874 - DNA, 20 bp, Homo sapiens
ctggtggcagctcacctctc

SEQ ID NO: 1841875 - DNA, 23 bp, Homo sapiens
ctggtggcagctcacctctccct

SEQ ID NO: 1841876 - DNA, 20 bp, Homo sapiens
ctgtaagagcttgctccaga

SEQ ID NO: 1841877 - DNA, 14 bp, Homo sapiens
ctgtacagagccca

SEQ ID NO: 1841878 - DNA, 16 bp, Homo sapiens
ctgtacatttgtgctc

SEQ ID NO: 1841879 - DNA, 13 bp, Homo sapiens
ctgtagagtggga

SEQ ID NO: 1841880 - DNA, 13 bp, Homo sapiens
ctgtatctgtgta

SEQ ID NO: 1841881 - DNA, 17 bp, Homo sapiens
ctgtccacaggcttctg

SEQ ID NO: 1841882 - DNA, 15 bp, Homo sapiens
ctgtccccagcctgg

SEQ ID NO: 1841883 - DNA, 18 bp, Homo sapiens
ctgtcgggggctgtggat

SEQ ID NO: 1841884 - DNA, 19 bp, Homo sapiens
ctgtctaggactgcagtgt

SEQ ID NO: 1841885 - DNA, 16 bp, Homo sapiens
ctgtctcaaaaaaaga

SEQ ID NO: 1841886 - DNA, 20 bp, Homo sapiens
ctgtctccctcccctctcag

SEQ ID NO: 1841887 - DNA, 23 bp, Homo sapiens
ctgtctccctcccctctcagaac

SEQ ID NO: 1841888 - DNA, 13 bp, Homo sapiens
ctgtctctggcct

SEQ ID NO: 1841889 - DNA, 13 bp, Homo sapiens
ctgtgaactgaac

SEQ ID NO: 1841890 - DNA, 14 bp, Homo sapiens
ctgtgaagtaagga

SEQ ID NO: 1841891 - DNA, 17 bp, Homo sapiens
ctgtgacaggcagcaga

SEQ ID NO: 1841892 - DNA, 16 bp, Homo sapiens
ctgtgagcatcacagt

SEQ ID NO: 1841893 - DNA, 19 bp, Homo sapiens
ctgtgagcatcacagtttt

SEQ ID NO: 1841894 - DNA, 21 bp, Homo sapiens
ctgtgagtactacagtcctcc

SEQ ID NO: 1841895 - DNA, 15 bp, Homo sapiens
ctgtgatggggccct

SEQ ID NO: 1841896 - DNA, 17 bp, Homo sapiens
ctgtgatggggccctgc

SEQ ID NO: 1841897 - DNA, 20 bp, Homo sapiens
ctgtgatggggccctgcctc

SEQ ID NO: 1841898 - DNA, 12 bp, Homo sapiens
ctgtgcacgcag

SEQ ID NO: 1841899 - DNA, 19 bp, Homo sapiens
ctgtgctgccctgcccacc

SEQ ID NO: 1841900 - DNA, 22 bp, Homo sapiens
ctgtgctgccctgcccacctgg

SEQ ID NO: 1841901 - DNA, 17 bp, Homo sapiens
ctgtgtcagcatagaag

SEQ ID NO: 1841902 - DNA, 19 bp, Homo sapiens
ctgtgtcagcatagaagta

SEQ ID NO: 1841903 - DNA, 16 bp, Homo sapiens
ctgtgtcataccacaa

SEQ ID NO: 1841904 - DNA, 18 bp, Homo sapiens
ctgtgtgactcaaaccaa

SEQ ID NO: 1841905 - DNA, 17 bp, Homo sapiens
ctgtgtgttaagctctg

SEQ ID NO: 1841906 - DNA, 14 bp, Homo sapiens
ctgtgttcacactg

SEQ ID NO: 1841907 - DNA, 13 bp, Homo sapiens
ctgttatataaat

SEQ ID NO: 1841908 - DNA, 15 bp, Homo sapiens
ctgttatataaatgg

SEQ ID NO: 1841909 - DNA, 20 bp, Homo sapiens
ctgttatttataatcacttt

SEQ ID NO: 1841910 - DNA, 23 bp, Homo sapiens
ctgttcaagagcacacttggccc

SEQ ID NO: 1841911 - DNA, 18 bp, Homo sapiens
ctgttcagctggttgagg

SEQ ID NO: 1841912 - DNA, 13 bp, Homo sapiens
ctgttctctgccc

SEQ ID NO: 1841913 - DNA, 15 bp, Homo sapiens
ctgttctctgccctc

SEQ ID NO: 1841914 - DNA, 16 bp, Homo sapiens
ctgttctctgccctcc

SEQ ID NO: 1841915 - DNA, 18 bp, Homo sapiens
ctgttctctgccctccaa

SEQ ID NO: 1841916 - DNA, 17 bp, Homo sapiens
ctgttcttagctcaatg

SEQ ID NO: 1841917 - DNA, 23 bp, Homo sapiens
ctgttcttagctcaatgagcatg

SEQ ID NO: 1841918 - DNA, 15 bp, Homo sapiens
ctgtttatagaataa

SEQ ID NO: 1841919 - DNA, 15 bp, Homo sapiens
ctgttttatgacttc

SEQ ID NO: 1841920 - DNA, 14 bp, Homo sapiens
ctgttttctcttga

SEQ ID NO: 1841921 - DNA, 17 bp, Homo sapiens
ctgttttctcttgagag

SEQ ID NO: 1841922 - DNA, 17 bp, Homo sapiens
ctgttttctgaaacaca

SEQ ID NO: 1841923 - DNA, 16 bp, Homo sapiens
ctgttttgtttcgctc

SEQ ID NO: 1841924 - DNA, 17 bp, Homo sapiens
cttaaaaagtggaaaaa

SEQ ID NO: 1841925 - DNA, 21 bp, Homo sapiens
cttaaaataaagttaaactga

SEQ ID NO: 1841926 - DNA, 21 bp, Homo sapiens
cttaactcattgcaacctcca

SEQ ID NO: 1841927 - DNA, 17 bp, Homo sapiens
cttaactttactaagta

SEQ ID NO: 1841928 - DNA, 17 bp, Homo sapiens
cttaagagatgcctcat

SEQ ID NO: 1841929 - DNA, 16 bp, Homo sapiens
cttaagtgagcagaac

SEQ ID NO: 1841930 - DNA, 10 bp, Homo sapiens
cttaattatt

SEQ ID NO: 1841931 - DNA, 16 bp, Homo sapiens
cttaattctttgttct

SEQ ID NO: 1841932 - DNA, 19 bp, Homo sapiens
cttaattctttgttctgtt

SEQ ID NO: 1841933 - DNA, 20 bp, Homo sapiens
cttaattctttgttctgttt

SEQ ID NO: 1841934 - DNA, 23 bp, Homo sapiens
cttacagctgggtggcactgcca

SEQ ID NO: 1841935 - DNA, 15 bp, Homo sapiens
cttaccagcagagca

SEQ ID NO: 1841936 - DNA, 16 bp, Homo sapiens
cttaccagcagagcac

SEQ ID NO: 1841937 - DNA, 13 bp, Homo sapiens
cttacctcggtgc

SEQ ID NO: 1841938 - DNA, 19 bp, Homo sapiens
cttagaaaaccagctcagc

SEQ ID NO: 1841939 - DNA, 20 bp, Homo sapiens
cttagaaaaccagctcagca

SEQ ID NO: 1841940 - DNA, 21 bp, Homo sapiens
cttagaaaaccagctcagcac

SEQ ID NO: 1841941 - DNA, 17 bp, Homo sapiens
cttagacagtccctgcc

SEQ ID NO: 1841942 - DNA, 19 bp, Homo sapiens
cttagacagtccctgccaa

SEQ ID NO: 1841943 - DNA, 22 bp, Homo sapiens
cttagagcagtttctgtcctgc

SEQ ID NO: 1841944 - DNA, 20 bp, Homo sapiens
cttagctcaatgagcatgtt

SEQ ID NO: 1841945 - DNA, 18 bp, Homo sapiens
cttagctttgctctgcca

SEQ ID NO: 1841946 - DNA, 19 bp, Homo sapiens
cttagtcactgagacagcc

SEQ ID NO: 1841947 - DNA, 14 bp, Homo sapiens
cttatagacaacat

SEQ ID NO: 1841948 - DNA, 21 bp, Homo sapiens
cttatgaaaagaattgttggg

SEQ ID NO: 1841949 - DNA, 20 bp, Homo sapiens
cttatggatgtccccagcag

SEQ ID NO: 1841950 - DNA, 22 bp, Homo sapiens
cttatgggctgggttctaccca

SEQ ID NO: 1841951 - DNA, 23 bp, Homo sapiens
cttatgggctgggttctacccag

SEQ ID NO: 1841952 - DNA, 14 bp, Homo sapiens
cttattcccttcct

SEQ ID NO: 1841953 - DNA, 14 bp, Homo sapiens
cttcaaactacttt

SEQ ID NO: 1841954 - DNA, 20 bp, Homo sapiens
cttcacctttgtccccaccg

SEQ ID NO: 1841955 - DNA, 18 bp, Homo sapiens
cttcagagactcctgcag

SEQ ID NO: 1841956 - DNA, 23 bp, Homo sapiens
cttcagagactcctgcaggcagc

SEQ ID NO: 1841957 - DNA, 12 bp, Homo sapiens
cttcagagctga

SEQ ID NO: 1841958 - DNA, 23 bp, Homo sapiens
cttcagattccccactcagcctt

SEQ ID NO: 1841959 - DNA, 23 bp, Homo sapiens
cttcatgcatggaaattcccttc

SEQ ID NO: 1841960 - DNA, 17 bp, Homo sapiens
cttcattaataataaat

SEQ ID NO: 1841961 - DNA, 23 bp, Homo sapiens
cttccaccaagttggaacatcct

SEQ ID NO: 1841962 - DNA, 12 bp, Homo sapiens
cttccaggctgg

SEQ ID NO: 1841963 - DNA, 14 bp, Homo sapiens
cttccaggctggga

SEQ ID NO: 1841964 - DNA, 14 bp, Homo sapiens
cttccaggggtggg

SEQ ID NO: 1841965 - DNA, 22 bp, Homo sapiens
cttccaggggtgggacaccctg

SEQ ID NO: 1841966 - DNA, 24 bp, Homo sapiens
cttccaggggtgggacaccctgtg

SEQ ID NO: 1841967 - DNA, 17 bp, Homo sapiens
cttccagtgaggctctg

SEQ ID NO: 1841968 - DNA, 21 bp, Homo sapiens
cttccagtgaggctctgccct

SEQ ID NO: 1841969 - DNA, 22 bp, Homo sapiens
cttccatctttcctgatggcag

SEQ ID NO: 1841970 - DNA, 16 bp, Homo sapiens
cttccatggactttgt

SEQ ID NO: 1841971 - DNA, 14 bp, Homo sapiens
cttcccagtggctg

SEQ ID NO: 1841972 - DNA, 15 bp, Homo sapiens
cttcccatgacccag

SEQ ID NO: 1841973 - DNA, 16 bp, Homo sapiens
cttccctaaaatcagg

SEQ ID NO: 1841974 - DNA, 18 bp, Homo sapiens
cttccctatctttgccac

SEQ ID NO: 1841975 - DNA, 16 bp, Homo sapiens
cttcctctgaggctga

SEQ ID NO: 1841976 - DNA, 15 bp, Homo sapiens
cttcctgccagcccc

SEQ ID NO: 1841977 - DNA, 16 bp, Homo sapiens
gaaagagatacagagg

SEQ ID NO: 1841978 - DNA, 12 bp, Homo sapiens
gaaaggctccag

SEQ ID NO: 1841979 - DNA, 18 bp, Homo sapiens
gaaaggctccaggagcag

SEQ ID NO: 1841980 - DNA, 20 bp, Homo sapiens
gaaagggacgctacccggga

SEQ ID NO: 1841981 - DNA, 18 bp, Homo sapiens
gaaatagcttatgaaaag

SEQ ID NO: 1841982 - DNA, 21 bp, Homo sapiens
gaaatagcttatgaaaagaat

SEQ ID NO: 1841983 - DNA, 18 bp, Homo sapiens
ctccctcagtctggccct

SEQ ID NO: 1841984 - DNA, 19 bp, Homo sapiens
ctccctctttccctccctt

SEQ ID NO: 1841985 - DNA, 20 bp, Homo sapiens
ctccctctttccctcccttc

SEQ ID NO: 1841986 - DNA, 12 bp, Homo sapiens
ctccctgagatg

SEQ ID NO: 1841987 - DNA, 23 bp, Homo sapiens
ctcccttcccacctctctcactc

SEQ ID NO: 1841988 - DNA, 22 bp, Homo sapiens
ctcctccagccgccatgctcct

SEQ ID NO: 1841989 - DNA, 15 bp, Homo sapiens
ctcctcctggactcc

SEQ ID NO: 1841990 - DNA, 13 bp, Homo sapiens
ctcctctgctgct

SEQ ID NO: 1841991 - DNA, 15 bp, Homo sapiens
ctcctctgctgctgg

SEQ ID NO: 1841992 - DNA, 16 bp, Homo sapiens
ctcctctgctgctggc

SEQ ID NO: 1841993 - DNA, 21 bp, Homo sapiens
ctcctgaaaaaaaacctgaga

SEQ ID NO: 1841994 - DNA, 14 bp, Homo sapiens
ctcctgcaggcagc

SEQ ID NO: 1841995 - DNA, 18 bp, Homo sapiens
ctcctgcctgtgctgtga

SEQ ID NO: 1841996 - DNA, 15 bp, Homo sapiens
ctcctggatctccct

SEQ ID NO: 1841997 - DNA, 16 bp, Homo sapiens
ctcctggcccactgca

SEQ ID NO: 1841998 - DNA, 19 bp, Homo sapiens
ctcctggcccactgcatcg

SEQ ID NO: 1841999 - DNA, 13 bp, Homo sapiens
ctccttcaccttt

SEQ ID NO: 1842000 - DNA, 14 bp, Homo sapiens
ctccttcacctttg

SEQ ID NO: 1842001 - DNA, 20 bp, Homo sapiens
ctccttgagagaccaggcaa

SEQ ID NO: 1842002 - DNA, 18 bp, Homo sapiens
ctccttgtggcctgggcc

SEQ ID NO: 1842003 - DNA, 17 bp, Homo sapiens
ctcctttgtgaggaagc

SEQ ID NO: 1842004 - DNA, 15 bp, Homo sapiens
ctcgagcatgcctgg

SEQ ID NO: 1842005 - DNA, 19 bp, Homo sapiens
ctcgagcatgcctggatgg

SEQ ID NO: 1842006 - DNA, 22 bp, Homo sapiens
ctcgagcatgcctggatggggc

SEQ ID NO: 1842007 - DNA, 21 bp, Homo sapiens
ctctatatatacatcatactt

SEQ ID NO: 1842008 - DNA, 12 bp, Homo sapiens
ctctcactcctt

SEQ ID NO: 1842009 - DNA, 14 bp, Homo sapiens
ctctcactccttga

SEQ ID NO: 1842010 - DNA, 15 bp, Homo sapiens
ctctccagcccctgg

SEQ ID NO: 1842011 - DNA, 12 bp, Homo sapiens
ctctcctctgct

SEQ ID NO: 1842012 - DNA, 15 bp, Homo sapiens
ctctcctgccccttg

SEQ ID NO: 1842013 - DNA, 13 bp, Homo sapiens
ctctctcctccct

SEQ ID NO: 1842014 - DNA, 21 bp, Homo sapiens
ctctctgacgcttgtgacagt

SEQ ID NO: 1842015 - DNA, 16 bp, Homo sapiens
ctctgacaacagactt

SEQ ID NO: 1842016 - DNA, 22 bp, Homo sapiens
ctctgacaacagacttctgaaa

SEQ ID NO: 1842017 - DNA, 15 bp, Homo sapiens
ctctgatcaagtatt

SEQ ID NO: 1842018 - DNA, 22 bp, Homo sapiens
ctctgcaagaattgaagcagga

SEQ ID NO: 1842019 - DNA, 18 bp, Homo sapiens
ctctgcaatcttctcaga

SEQ ID NO: 1842020 - DNA, 16 bp, Homo sapiens
ctctgcacaagctgca

SEQ ID NO: 1842021 - DNA, 17 bp, Homo sapiens
ctctgcacaagctgcac

SEQ ID NO: 1842022 - DNA, 19 bp, Homo sapiens
ctctgcacaagctgcaccc

SEQ ID NO: 1842023 - DNA, 14 bp, Homo sapiens
ctctgcactcccct

SEQ ID NO: 1842024 - DNA, 18 bp, Homo sapiens
ctctgcactcccctgctg

SEQ ID NO: 1842025 - DNA, 20 bp, Homo sapiens
ctctgcactcccctgctggg

SEQ ID NO: 1842026 - DNA, 13 bp, Homo sapiens
ctctgcccactcc

SEQ ID NO: 1842027 - DNA, 17 bp, Homo sapiens
ctctgcccactccctgc

SEQ ID NO: 1842028 - DNA, 19 bp, Homo sapiens
ctctggatgcctgattgcc

SEQ ID NO: 1842029 - DNA, 12 bp, Homo sapiens
ctctggcagctc

SEQ ID NO: 1842030 - DNA, 23 bp, Homo sapiens
ctctggcagctcagagagggtgg

SEQ ID NO: 1842031 - DNA, 16 bp, Homo sapiens
ctctggtccatagaga

SEQ ID NO: 1842032 - DNA, 18 bp, Homo sapiens
ctctggtccatagagagc

SEQ ID NO: 1842033 - DNA, 15 bp, Homo sapiens
ctctgtacagagccc

SEQ ID NO: 1842034 - DNA, 14 bp, Homo sapiens
ctctgtccccagcc

SEQ ID NO: 1842035 - DNA, 23 bp, Homo sapiens
ctctgtctaggactgcagtgtgg

SEQ ID NO: 1842036 - DNA, 22 bp, Homo sapiens
ctctgtgagcatcacagttttg

SEQ ID NO: 1842037 - DNA, 20 bp, Homo sapiens
ctctgtgcacttatttatga

SEQ ID NO: 1842038 - DNA, 22 bp, Homo sapiens
ctctgttgccaaggctggagtg

SEQ ID NO: 1842039 - DNA, 15 bp, Homo sapiens
ctcttagaaaaacca

SEQ ID NO: 1842040 - DNA, 15 bp, Homo sapiens
ctcttatgggctggg

SEQ ID NO: 1842041 - DNA, 19 bp, Homo sapiens
ctcttcagttaagcctttg

SEQ ID NO: 1842042 - DNA, 13 bp, Homo sapiens
ctcttccaggctg

SEQ ID NO: 1842043 - DNA, 21 bp, Homo sapiens
ctcttccaggctgggagagcc

SEQ ID NO: 1842044 - DNA, 14 bp, Homo sapiens
ctcttctccccaga

SEQ ID NO: 1842045 - DNA, 16 bp, Homo sapiens
ctcttggtcctgctgc

SEQ ID NO: 1842046 - DNA, 17 bp, Homo sapiens
ctcttggtcctgctgca

SEQ ID NO: 1842047 - DNA, 19 bp, Homo sapiens
ctcttggtcctgctgcagt

SEQ ID NO: 1842048 - DNA, 13 bp, Homo sapiens
ctctttccctccc

SEQ ID NO: 1842049 - DNA, 14 bp, Homo sapiens
ctctttgagaaata

SEQ ID NO: 1842050 - DNA, 22 bp, Homo sapiens
ctctttggtctacactgtgctg

SEQ ID NO: 1842051 - DNA, 22 bp, Homo sapiens
ctcttttcctttggtccttcaa

SEQ ID NO: 1842052 - DNA, 13 bp, Homo sapiens
ctctttttttgag

SEQ ID NO: 1842053 - DNA, 16 bp, Homo sapiens
ctctttttttgagtga

SEQ ID NO: 1842054 - DNA, 13 bp, Homo sapiens
ctgaaacacacga

SEQ ID NO: 1842055 - DNA, 16 bp, Homo sapiens
ctgaaagccctgagct

SEQ ID NO: 1842056 - DNA, 19 bp, Homo sapiens
ctgaaagccctgagctttc

SEQ ID NO: 1842057 - DNA, 18 bp, Homo sapiens
ctgaacactccaattaag

SEQ ID NO: 1842058 - DNA, 23 bp, Homo sapiens
ctgaacactccaattaaggattt

SEQ ID NO: 1842059 - DNA, 12 bp, Homo sapiens
ctgaaccattac

SEQ ID NO: 1842060 - DNA, 15 bp, Homo sapiens
ctgaaccattactgt

SEQ ID NO: 1842061 - DNA, 13 bp, Homo sapiens
ctgaactttgctg

SEQ ID NO: 1842062 - DNA, 21 bp, Homo sapiens
ctgaactttgctgagcctgta

SEQ ID NO: 1842063 - DNA, 12 bp, Homo sapiens
ctgaaggactgt

SEQ ID NO: 1842064 - DNA, 15 bp, Homo sapiens
ctgaaggactgtgac

SEQ ID NO: 1842065 - DNA, 21 bp, Homo sapiens
ctgaaggactgtgacaggcag

SEQ ID NO: 1842066 - DNA, 13 bp, Homo sapiens
ctgaaggccccgc

SEQ ID NO: 1842067 - DNA, 17 bp, Homo sapiens
ctgaaggctgggttctg

SEQ ID NO: 1842068 - DNA, 18 bp, Homo sapiens
ctgaaggggtgcacccac

SEQ ID NO: 1842069 - DNA, 22 bp, Homo sapiens
ctgaaggggtgcacccacctgt

SEQ ID NO: 1842070 - DNA, 22 bp, Homo sapiens
ctgaagtcccagatacttgggg

SEQ ID NO: 1842071 - DNA, 22 bp, Homo sapiens
ctgacaacactcattgacctga

SEQ ID NO: 1842072 - DNA, 15 bp, Homo sapiens
ctgacaacagacttc

SEQ ID NO: 1842073 - DNA, 19 bp, Homo sapiens
ctgacaacagacttctgaa

SEQ ID NO: 1842074 - DNA, 18 bp, Homo sapiens
ctgacacaggatgaaggc

SEQ ID NO: 1842075 - DNA, 19 bp, Homo sapiens
ctgacacctaactcttctt

SEQ ID NO: 1842076 - DNA, 13 bp, Homo sapiens
ctgacatcatttg

SEQ ID NO: 1842077 - DNA, 16 bp, Homo sapiens
ctgacccatgctgccc

SEQ ID NO: 1842078 - DNA, 17 bp, Homo sapiens
ctgacccatgctgccct

SEQ ID NO: 1842079 - DNA, 18 bp, Homo sapiens
ctgacccatgctgccctg

SEQ ID NO: 1842080 - DNA, 19 bp, Homo sapiens
ctgacccatgctgccctgt

SEQ ID NO: 1842081 - DNA, 20 bp, Homo sapiens
ctgacccatgctgccctgtg

SEQ ID NO: 1842082 - DNA, 22 bp, Homo sapiens
ctgacccatgctgccctgtgag

SEQ ID NO: 1842083 - DNA, 13 bp, Homo sapiens
ctgacgcttgtga

SEQ ID NO: 1842084 - DNA, 22 bp, Homo sapiens
ctgagaacactgtgaaaacatt

SEQ ID NO: 1842085 - DNA, 14 bp, Homo sapiens
ctgagacagcccgg

SEQ ID NO: 1842086 - DNA, 15 bp, Homo sapiens
ctgagacagcccggg

SEQ ID NO: 1842087 - DNA, 20 bp, Homo sapiens
ctgagacagcccgggctctg

SEQ ID NO: 1842088 - DNA, 21 bp, Homo sapiens
ctgagatcaaaacggttttac

SEQ ID NO: 1842089 - DNA, 20 bp, Homo sapiens
ctgagatgggcttcccaagg

SEQ ID NO: 1842090 - DNA, 17 bp, Homo sapiens
ctgagatttattaaaga

SEQ ID NO: 1842091 - DNA, 18 bp, Homo sapiens
ctgagcagcgagcctgct

SEQ ID NO: 1842092 - DNA, 12 bp, Homo sapiens
ctgagcaggcca

SEQ ID NO: 1842093 - DNA, 23 bp, Homo sapiens
ctgagcaggccacacttcaaact

SEQ ID NO: 1842094 - DNA, 15 bp, Homo sapiens
ctgaggcccagaggg

SEQ ID NO: 1842095 - DNA, 16 bp, Homo sapiens
ctgaggcccagagggc

SEQ ID NO: 1842096 - DNA, 17 bp, Homo sapiens
ctgaggcccagagggcc

SEQ ID NO: 1842097 - DNA, 16 bp, Homo sapiens
ctgaggcccagtgcat

SEQ ID NO: 1842098 - DNA, 17 bp, Homo sapiens
ctgaggcccagtgcata

SEQ ID NO: 1842099 - DNA, 14 bp, Homo sapiens
ctgaggcccttctc

SEQ ID NO: 1842100 - DNA, 18 bp, Homo sapiens
ctgaggcccttctctcca

SEQ ID NO: 1842101 - DNA, 19 bp, Homo sapiens
ctgaggcccttctctccag

SEQ ID NO: 1842102 - DNA, 15 bp, Homo sapiens
ctgaggctgggctcc

SEQ ID NO: 1842103 - DNA, 15 bp, Homo sapiens
ctgagtctgaaggct

SEQ ID NO: 1842104 - DNA, 18 bp, Homo sapiens
ctgagtctgaaggctggg

SEQ ID NO: 1842105 - DNA, 13 bp, Homo sapiens
ctgagtgcctggc

SEQ ID NO: 1842106 - DNA, 19 bp, Homo sapiens
ctgagtgcctggccaaagg

SEQ ID NO: 1842107 - DNA, 22 bp, Homo sapiens
ctgagtgggggatcacagcctc

SEQ ID NO: 1842108 - DNA, 13 bp, Homo sapiens
cattctccacctg

SEQ ID NO: 1842109 - DNA, 14 bp, Homo sapiens
cattctccacctgc

SEQ ID NO: 1842110 - DNA, 19 bp, Homo sapiens
cattctccacctgccaggg

SEQ ID NO: 1842111 - DNA, 14 bp, Homo sapiens
cattctttttgaaa

SEQ ID NO: 1842112 - DNA, 18 bp, Homo sapiens
cattgctgggcttgtctg

SEQ ID NO: 1842113 - DNA, 18 bp, Homo sapiens
cattgtagcgtctttctt

SEQ ID NO: 1842114 - DNA, 20 bp, Homo sapiens
cattgtagtgctttgagaga

SEQ ID NO: 1842115 - DNA, 15 bp, Homo sapiens
cattgtgggaagggg

SEQ ID NO: 1842116 - DNA, 16 bp, Homo sapiens
cattgttgtcaaggaa

SEQ ID NO: 1842117 - DNA, 19 bp, Homo sapiens
catttaagagacagtcacc

SEQ ID NO: 1842118 - DNA, 23 bp, Homo sapiens
catttaagagacagtcaccccag

SEQ ID NO: 1842119 - DNA, 18 bp, Homo sapiens
catttcatttgtgccaga

SEQ ID NO: 1842120 - DNA, 16 bp, Homo sapiens
catttctcatgttgaa

SEQ ID NO: 1842121 - DNA, 17 bp, Homo sapiens
catttctcatgttgaaa

SEQ ID NO: 1842122 - DNA, 11 bp, Homo sapiens
catttctgttc

SEQ ID NO: 1842123 - DNA, 23 bp, Homo sapiens
catttcttctacaactcatacac

SEQ ID NO: 1842124 - DNA, 22 bp, Homo sapiens
catttgcgttccatgatgctgg

SEQ ID NO: 1842125 - DNA, 11 bp, Homo sapiens
cattttataaa

SEQ ID NO: 1842126 - DNA, 13 bp, Homo sapiens
cattttataaatc

SEQ ID NO: 1842127 - DNA, 23 bp, Homo sapiens
cattttataaatcgcttttgata

SEQ ID NO: 1842128 - DNA, 22 bp, Homo sapiens
cattttatagaatgtgtcacac

SEQ ID NO: 1842129 - DNA, 21 bp, Homo sapiens
cattttgctaaatgtgaatga

SEQ ID NO: 1842130 - DNA, 14 bp, Homo sapiens
cattttttcttccc

SEQ ID NO: 1842131 - DNA, 17 bp, Homo sapiens
ccaaaactctcctctgc

SEQ ID NO: 1842132 - DNA, 12 bp, Homo sapiens
ccaaagcagggt

SEQ ID NO: 1842133 - DNA, 15 bp, Homo sapiens
ccaaagcagggtctg

SEQ ID NO: 1842134 - DNA, 17 bp, Homo sapiens
ccaaagcctcctccagc

SEQ ID NO: 1842135 - DNA, 22 bp, Homo sapiens
ccaaagcctcctccagccgcca

SEQ ID NO: 1842136 - DNA, 20 bp, Homo sapiens
ccaaaggaataacctttctg

SEQ ID NO: 1842137 - DNA, 19 bp, Homo sapiens
ccaaaggccatggagagct

SEQ ID NO: 1842138 - DNA, 21 bp, Homo sapiens
ccaaaggccatggagagctgg

SEQ ID NO: 1842139 - DNA, 17 bp, Homo sapiens
ccaaattaaaaaagata

SEQ ID NO: 1842140 - DNA, 18 bp, Homo sapiens
ccaaattaaaaaagataa

SEQ ID NO: 1842141 - DNA, 21 bp, Homo sapiens
ccaacactcaagaagcaggct

SEQ ID NO: 1842142 - DNA, 14 bp, Homo sapiens
ccaacatactccca

SEQ ID NO: 1842143 - DNA, 16 bp, Homo sapiens
ccaacatactcccatc

SEQ ID NO: 1842144 - DNA, 15 bp, Homo sapiens
ccaaccctcatcacc

SEQ ID NO: 1842145 - DNA, 18 bp, Homo sapiens
ccaaccctggcacccagg

SEQ ID NO: 1842146 - DNA, 16 bp, Homo sapiens
ccaactcaccccagcc

SEQ ID NO: 1842147 - DNA, 18 bp, Homo sapiens
ccaactcaccccagcccc

SEQ ID NO: 1842148 - DNA, 18 bp, Homo sapiens
ccaacttcttcagagctg

SEQ ID NO: 1842149 - DNA, 14 bp, Homo sapiens
ccaagaagcccagg

SEQ ID NO: 1842150 - DNA, 15 bp, Homo sapiens
ccaagaagcccagga

SEQ ID NO: 1842151 - DNA, 15 bp, Homo sapiens
ccaagaccttctcct

SEQ ID NO: 1842152 - DNA, 16 bp, Homo sapiens
ccaagagtctgatgat

SEQ ID NO: 1842153 - DNA, 17 bp, Homo sapiens
ccaagatcacagtggcc

SEQ ID NO: 1842154 - DNA, 15 bp, Homo sapiens
ccaagcaaatgcctg

SEQ ID NO: 1842155 - DNA, 14 bp, Homo sapiens
ccaagcactgtgct

SEQ ID NO: 1842156 - DNA, 14 bp, Homo sapiens
ccaagcaggacatg

SEQ ID NO: 1842157 - DNA, 22 bp, Homo sapiens
ccaagcctacttttgccattga

SEQ ID NO: 1842158 - DNA, 19 bp, Homo sapiens
ccaagctcaggaccaggca

SEQ ID NO: 1842159 - DNA, 16 bp, Homo sapiens
ccaagctcccaggcat

SEQ ID NO: 1842160 - DNA, 16 bp, Homo sapiens
ccaagggcctggcctg

SEQ ID NO: 1842161 - DNA, 17 bp, Homo sapiens
ccaagtggcagagcttg

SEQ ID NO: 1842162 - DNA, 18 bp, Homo sapiens
ccaagtggcagagcttgg

SEQ ID NO: 1842163 - DNA, 19 bp, Homo sapiens
ccaagtggcagagcttgga

SEQ ID NO: 1842164 - DNA, 22 bp, Homo sapiens
ccaatgcactttgttctggctc

SEQ ID NO: 1842165 - DNA, 13 bp, Homo sapiens
ccaattaaggatt

SEQ ID NO: 1842166 - DNA, 14 bp, Homo sapiens
ccttcatctggaac

SEQ ID NO: 1842167 - DNA, 15 bp, Homo sapiens
ccttcatgcatggaa

SEQ ID NO: 1842168 - DNA, 19 bp, Homo sapiens
ccttcatttggcattcccc

SEQ ID NO: 1842169 - DNA, 18 bp, Homo sapiens
ccttccaggggtgggaca

SEQ ID NO: 1842170 - DNA, 13 bp, Homo sapiens
ccttccctccaag

SEQ ID NO: 1842171 - DNA, 14 bp, Homo sapiens
ccttcctctttcca

SEQ ID NO: 1842172 - DNA, 16 bp, Homo sapiens
ccttctccctcatttc

SEQ ID NO: 1842173 - DNA, 15 bp, Homo sapiens
ccttctctccagccc

SEQ ID NO: 1842174 - DNA, 16 bp, Homo sapiens
ccttctctccagcccc

SEQ ID NO: 1842175 - DNA, 21 bp, Homo sapiens
ccttctctccagcccctggat

SEQ ID NO: 1842176 - DNA, 15 bp, Homo sapiens
ccttgaaaacactgt

SEQ ID NO: 1842177 - DNA, 19 bp, Homo sapiens
ccttgaaaacactgttctc

SEQ ID NO: 1842178 - DNA, 22 bp, Homo sapiens
ccttgaaaacactgttctctgc

SEQ ID NO: 1842179 - DNA, 12 bp, Homo sapiens
ccttgaccaggc

SEQ ID NO: 1842180 - DNA, 15 bp, Homo sapiens
ccttgaccaggcctg

SEQ ID NO: 1842181 - DNA, 16 bp, Homo sapiens
ccttgaccaggcctgg

SEQ ID NO: 1842182 - DNA, 19 bp, Homo sapiens
ccttgaccattctccacct

SEQ ID NO: 1842183 - DNA, 21 bp, Homo sapiens
ccttgagagaccaggcaaagc

SEQ ID NO: 1842184 - DNA, 22 bp, Homo sapiens
ccttgagttgattcagctctgc

SEQ ID NO: 1842185 - DNA, 16 bp, Homo sapiens
ccttgccgtctacctg

SEQ ID NO: 1842186 - DNA, 17 bp, Homo sapiens
ccttgccgtctacctga

SEQ ID NO: 1842187 - DNA, 22 bp, Homo sapiens
ccttggaagttgcatggcatca

SEQ ID NO: 1842188 - DNA, 16 bp, Homo sapiens
ccttggacacgctcag

SEQ ID NO: 1842189 - DNA, 12 bp, Homo sapiens
ccttggctggtg

SEQ ID NO: 1842190 - DNA, 13 bp, Homo sapiens
ccttgtcgtggga

SEQ ID NO: 1842191 - DNA, 22 bp, Homo sapiens
ccttgtggcctgggcctcctca

SEQ ID NO: 1842192 - DNA, 14 bp, Homo sapiens
ctactatatatgtg

SEQ ID NO: 1842193 - DNA, 22 bp, Homo sapiens
ctacttctttgctttgcccagc

SEQ ID NO: 1842194 - DNA, 18 bp, Homo sapiens
ctagagcacaacataatt

SEQ ID NO: 1842195 - DNA, 22 bp, Homo sapiens
ctagaggggggatttccagcca

SEQ ID NO: 1842196 - DNA, 17 bp, Homo sapiens
ctagagtgaacttgggc

SEQ ID NO: 1842197 - DNA, 16 bp, Homo sapiens
ctagcccgaatacaaa

SEQ ID NO: 1842198 - DNA, 17 bp, Homo sapiens
ctaggaagactttggaa

SEQ ID NO: 1842199 - DNA, 22 bp, Homo sapiens
ctaggacgccacccagcaaaag

SEQ ID NO: 1842200 - DNA, 22 bp, Homo sapiens
ctaggcaggacatgctgaagcc

SEQ ID NO: 1842201 - DNA, 21 bp, Homo sapiens
ctaggcatttgctgaatacag

SEQ ID NO: 1842202 - DNA, 12 bp, Homo sapiens
ctaggcctgggg

SEQ ID NO: 1842203 - DNA, 21 bp, Homo sapiens
ctaggctgacacctaactctt

SEQ ID NO: 1842204 - DNA, 16 bp, Homo sapiens
ctaggtaggaagagcc

SEQ ID NO: 1842205 - DNA, 23 bp, Homo sapiens
ctagtgtggtgtttcctggcact

SEQ ID NO: 1842206 - DNA, 14 bp, Homo sapiens
ctagttccaccatc

SEQ ID NO: 1842207 - DNA, 20 bp, Homo sapiens
ctagttccaccatcaagcca

SEQ ID NO: 1842208 - DNA, 22 bp, Homo sapiens
ctagttgtttgattcagacagc

SEQ ID NO: 1842209 - DNA, 20 bp, Homo sapiens
ctatataaccacatttctaa

SEQ ID NO: 1842210 - DNA, 23 bp, Homo sapiens
ctatattggtttatgtagtcagt

SEQ ID NO: 1842211 - DNA, 19 bp, Homo sapiens
ctatatttttctcaatgtt

SEQ ID NO: 1842212 - DNA, 18 bp, Homo sapiens
ctatgatttttttttcca

SEQ ID NO: 1842213 - DNA, 14 bp, Homo sapiens
ccctccccacagtg

SEQ ID NO: 1842214 - DNA, 23 bp, Homo sapiens
ccctccccacagtgccacccatg

SEQ ID NO: 1842215 - DNA, 15 bp, Homo sapiens
ccctccccccagact

SEQ ID NO: 1842216 - DNA, 16 bp, Homo sapiens
ccctcccctctcagaa

SEQ ID NO: 1842217 - DNA, 15 bp, Homo sapiens
ccctcccctggggac

SEQ ID NO: 1842218 - DNA, 19 bp, Homo sapiens
ccctctcctccgtggcaca

SEQ ID NO: 1842219 - DNA, 11 bp, Homo sapiens
ccctctctgga

SEQ ID NO: 1842220 - DNA, 18 bp, Homo sapiens
ccctctgcccactccctg

SEQ ID NO: 1842221 - DNA, 19 bp, Homo sapiens
ccctctgcccactccctgc

SEQ ID NO: 1842222 - DNA, 20 bp, Homo sapiens
ccctctttccctcccttcct

SEQ ID NO: 1842223 - DNA, 14 bp, Homo sapiens
ccctgaaggccccg

SEQ ID NO: 1842224 - DNA, 22 bp, Homo sapiens
ccctgacaacactcattgacct

SEQ ID NO: 1842225 - DNA, 13 bp, Homo sapiens
ccctgaggcccag

SEQ ID NO: 1842226 - DNA, 14 bp, Homo sapiens
ccctgaggcccaga

SEQ ID NO: 1842227 - DNA, 16 bp, Homo sapiens
ccctgcaacctgattg

SEQ ID NO: 1842228 - DNA, 18 bp, Homo sapiens
ccctgcccacctggcctc

SEQ ID NO: 1842229 - DNA, 12 bp, Homo sapiens
ccctgccctgtg

SEQ ID NO: 1842230 - DNA, 14 bp, Homo sapiens
ccctgccctgtggg

SEQ ID NO: 1842231 - DNA, 21 bp, Homo sapiens
ccctgccctgtgggcccccaa

SEQ ID NO: 1842232 - DNA, 11 bp, Homo sapiens
ccctgcctcct

SEQ ID NO: 1842233 - DNA, 14 bp, Homo sapiens
ccctgcctcctttg

SEQ ID NO: 1842234 - DNA, 17 bp, Homo sapiens
ccctgctcccacagaac

SEQ ID NO: 1842235 - DNA, 16 bp, Homo sapiens
ccctgctgggtgtggc

SEQ ID NO: 1842236 - DNA, 21 bp, Homo sapiens
ccctggatgcagcctcacagt

SEQ ID NO: 1842237 - DNA, 19 bp, Homo sapiens
ccctggctgaaggactgtg

SEQ ID NO: 1842238 - DNA, 18 bp, Homo sapiens
ccctgggagggacatgct

SEQ ID NO: 1842239 - DNA, 23 bp, Homo sapiens
ccctggttctgatgatgtgcctg

SEQ ID NO: 1842240 - DNA, 21 bp, Homo sapiens
ccctgtgagtactacagtcct

SEQ ID NO: 1842241 - DNA, 19 bp, Homo sapiens
ccctgtgatggggccctgc

SEQ ID NO: 1842242 - DNA, 15 bp, Homo sapiens
ccctgtgggccccca

SEQ ID NO: 1842243 - DNA, 16 bp, Homo sapiens
ccctgtgggcccccaa

SEQ ID NO: 1842244 - DNA, 16 bp, Homo sapiens
ccctgtttgtttctga

SEQ ID NO: 1842245 - DNA, 19 bp, Homo sapiens
ccctgtttgtttctgaaag

SEQ ID NO: 1842246 - DNA, 16 bp, Homo sapiens
cccttcatgcatggaa

SEQ ID NO: 1842247 - DNA, 12 bp, Homo sapiens
cccttcccacct

SEQ ID NO: 1842248 - DNA, 13 bp, Homo sapiens
cccttcccacctc

SEQ ID NO: 1842249 - DNA, 21 bp, Homo sapiens
cccttcccatgacccaggctg

SEQ ID NO: 1842250 - DNA, 22 bp, Homo sapiens
cccttggttaggcattgtggga

SEQ ID NO: 1842251 - DNA, 18 bp, Homo sapiens
cccttgtggtcccacccc

SEQ ID NO: 1842252 - DNA, 22 bp, Homo sapiens
cccttgtggtcccaccccacac

SEQ ID NO: 1842253 - DNA, 21 bp, Homo sapiens
ccgagattgcaccactgcact

SEQ ID NO: 1842254 - DNA, 19 bp, Homo sapiens
ccgagcctggctccaaacc

SEQ ID NO: 1842255 - DNA, 17 bp, Homo sapiens
ccgcagacaggaccagg

SEQ ID NO: 1842256 - DNA, 17 bp, Homo sapiens
ccgccaaggctggggga

SEQ ID NO: 1842257 - DNA, 15 bp, Homo sapiens
ccgctgatggagccc

SEQ ID NO: 1842258 - DNA, 19 bp, Homo sapiens
ccgctgatggagccccacc

SEQ ID NO: 1842259 - DNA, 22 bp, Homo sapiens
ccgctgattctcagggtctctg

SEQ ID NO: 1842260 - DNA, 22 bp, Homo sapiens
ccggaagccaaacctctgtgag

SEQ ID NO: 1842261 - DNA, 17 bp, Homo sapiens
ccgggaagggggctggg

SEQ ID NO: 1842262 - DNA, 17 bp, Homo sapiens
ccgggaccccgagcctg

SEQ ID NO: 1842263 - DNA, 18 bp, Homo sapiens
ccgggaccccgagcctgg

SEQ ID NO: 1842264 - DNA, 20 bp, Homo sapiens
ccgggcgcggtggctcacgc

SEQ ID NO: 1842265 - DNA, 18 bp, Homo sapiens
ccgggctctgcctcccat

SEQ ID NO: 1842266 - DNA, 16 bp, Homo sapiens
ccgtctcccaaagtgc

SEQ ID NO: 1842267 - DNA, 18 bp, Homo sapiens
ccgtctctggttcctccc

SEQ ID NO: 1842268 - DNA, 18 bp, Homo sapiens
ccgttgatgttggctggg

SEQ ID NO: 1842269 - DNA, 13 bp, Homo sapiens
cctaaaacaaaag

SEQ ID NO: 1842270 - DNA, 12 bp, Homo sapiens
cctaatgctgca

SEQ ID NO: 1842271 - DNA, 13 bp, Homo sapiens
cctaattgtggat

SEQ ID NO: 1842272 - DNA, 21 bp, Homo sapiens
cctacagttgaaaaacagctg

SEQ ID NO: 1842273 - DNA, 17 bp, Homo sapiens
cctagcactttgggagg

SEQ ID NO: 1842274 - DNA, 14 bp, Homo sapiens
cctagctgaatgtt

SEQ ID NO: 1842275 - DNA, 19 bp, Homo sapiens
cctagctgaatgtttttct

SEQ ID NO: 1842276 - DNA, 23 bp, Homo sapiens
cctaggcaggacatgctgaagcc

SEQ ID NO: 1842277 - DNA, 22 bp, Homo sapiens
cctagggaagggtggtggagcc

SEQ ID NO: 1842278 - DNA, 17 bp, Homo sapiens
cctattagagaagagat

SEQ ID NO: 1842279 - DNA, 13 bp, Homo sapiens
cctcaaacactgc

SEQ ID NO: 1842280 - DNA, 22 bp, Homo sapiens
cctcacagtattgctcacccag

SEQ ID NO: 1842281 - DNA, 17 bp, Homo sapiens
cctcacagtccttacca

SEQ ID NO: 1842282 - DNA, 23 bp, Homo sapiens
cctcacagtccttaccagcagag

SEQ ID NO: 1842283 - DNA, 21 bp, Homo sapiens
cctcactaggcttctggttga

SEQ ID NO: 1842284 - DNA, 23 bp, Homo sapiens
cctcagaacaaagtgagacagtc

SEQ ID NO: 1842285 - DNA, 11 bp, Homo sapiens
cctcaggcagg

SEQ ID NO: 1842286 - DNA, 14 bp, Homo sapiens
cctcagggtccctg

SEQ ID NO: 1842287 - DNA, 16 bp, Homo sapiens
cctcaggtgagaagca

SEQ ID NO: 1842288 - DNA, 17 bp, Homo sapiens
cctcaggtgagaagcag

SEQ ID NO: 1842289 - DNA, 22 bp, Homo sapiens
cctcagtaacatttctgttctc

SEQ ID NO: 1842290 - DNA, 20 bp, Homo sapiens
cctcagtctggcccttcctt

SEQ ID NO: 1842291 - DNA, 12 bp, Homo sapiens
cctcatacccac

SEQ ID NO: 1842292 - DNA, 13 bp, Homo sapiens
cctcatacccacc

SEQ ID NO: 1842293 - DNA, 13 bp, Homo sapiens
cctcatcctcata

SEQ ID NO: 1842294 - DNA, 13 bp, Homo sapiens
cctcatgcccagc

SEQ ID NO: 1842295 - DNA, 11 bp, Homo sapiens
cacttcaaact

SEQ ID NO: 1842296 - DNA, 16 bp, Homo sapiens
cacttcaaactacttt

SEQ ID NO: 1842297 - DNA, 21 bp, Homo sapiens
cacttcagctgacttttctgt

SEQ ID NO: 1842298 - DNA, 23 bp, Homo sapiens
cacttcgggaggtcgaggcagga

SEQ ID NO: 1842299 - DNA, 19 bp, Homo sapiens
cacttggcatcagctggcg

SEQ ID NO: 1842300 - DNA, 21 bp, Homo sapiens
cactttaacacagtgtctggc

SEQ ID NO: 1842301 - DNA, 20 bp, Homo sapiens
cactttgctttaatataaat

SEQ ID NO: 1842302 - DNA, 22 bp, Homo sapiens
cacttttggttaagtctgtttt

SEQ ID NO: 1842303 - DNA, 14 bp, Homo sapiens
cagaaaaagatctt

SEQ ID NO: 1842304 - DNA, 16 bp, Homo sapiens
cagaaacacccctctg

SEQ ID NO: 1842305 - DNA, 23 bp, Homo sapiens
cagaaacacccctctgtctagga

SEQ ID NO: 1842306 - DNA, 17 bp, Homo sapiens
cagaaccaattattttc

SEQ ID NO: 1842307 - DNA, 13 bp, Homo sapiens
cagaacctgcaca

SEQ ID NO: 1842308 - DNA, 18 bp, Homo sapiens
cagaaggcaaatgacttt

SEQ ID NO: 1842309 - DNA, 20 bp, Homo sapiens
cagaaggcaaatgactttgg

SEQ ID NO: 1842310 - DNA, 16 bp, Homo sapiens
cagaatggaatgctct

SEQ ID NO: 1842311 - DNA, 17 bp, Homo sapiens
cagaatttccctctgat

SEQ ID NO: 1842312 - DNA, 21 bp, Homo sapiens
cagacacatgtccaagaagcc

SEQ ID NO: 1842313 - DNA, 23 bp, Homo sapiens
cagacacatgtccaagaagccca

SEQ ID NO: 1842314 - DNA, 13 bp, Homo sapiens
cagacagctgcct

SEQ ID NO: 1842315 - DNA, 18 bp, Homo sapiens
cagacagctgcctgggat

SEQ ID NO: 1842316 - DNA, 24 bp, Homo sapiens
cagacaggaccagggatttccatg

SEQ ID NO: 1842317 - DNA, 12 bp, Homo sapiens
cagaccctgccc

SEQ ID NO: 1842318 - DNA, 14 bp, Homo sapiens
cagaccctgccctg

SEQ ID NO: 1842319 - DNA, 17 bp, Homo sapiens
cagaccctgccctgtgg

SEQ ID NO: 1842320 - DNA, 20 bp, Homo sapiens
cagactctttttttgagtga

SEQ ID NO: 1842321 - DNA, 22 bp, Homo sapiens
cagactgtgtaaaaagagagct

SEQ ID NO: 1842322 - DNA, 15 bp, Homo sapiens
cagagaaagaggaag

SEQ ID NO: 1842323 - DNA, 18 bp, Homo sapiens
cagagaaagaggaagctt

SEQ ID NO: 1842324 - DNA, 16 bp, Homo sapiens
cagagaccatccctga

SEQ ID NO: 1842325 - DNA, 17 bp, Homo sapiens
cagagaccatccctgaa

SEQ ID NO: 1842326 - DNA, 18 bp, Homo sapiens
cagagactcctgcaggca

SEQ ID NO: 1842327 - DNA, 18 bp, Homo sapiens
cagagacttgggacattg

SEQ ID NO: 1842328 - DNA, 13 bp, Homo sapiens
cagagagggcagg

SEQ ID NO: 1842329 - DNA, 14 bp, Homo sapiens
cagagagggcaggc

SEQ ID NO: 1842330 - DNA, 18 bp, Homo sapiens
cagagagggcaggcatga

SEQ ID NO: 1842331 - DNA, 22 bp, Homo sapiens
cagagagggtgggagtgggccc

SEQ ID NO: 1842332 - DNA, 23 bp, Homo sapiens
cagagagggtgggagtgggccca

SEQ ID NO: 1842333 - DNA, 18 bp, Homo sapiens
cagagaggtttgcagtcc

SEQ ID NO: 1842334 - DNA, 20 bp, Homo sapiens
cagagaggtttgcagtccca

SEQ ID NO: 1842335 - DNA, 22 bp, Homo sapiens
cagagattggaatgggcagctc

SEQ ID NO: 1842336 - DNA, 15 bp, Homo sapiens
cagagcagagaccat

SEQ ID NO: 1842337 - DNA, 19 bp, Homo sapiens
cagagcagagaccatccct

SEQ ID NO: 1842338 - DNA, 21 bp, Homo sapiens
cagagcagagaccatccctga

SEQ ID NO: 1842339 - DNA, 23 bp, Homo sapiens
cagagcccacgcccccactggtg

SEQ ID NO: 1842340 - DNA, 14 bp, Homo sapiens
cagagctgacacag

SEQ ID NO: 1842341 - DNA, 15 bp, Homo sapiens
cagagcttggactgg

SEQ ID NO: 1842342 - DNA, 21 bp, Homo sapiens
cagaggcagtacctgggcaag

SEQ ID NO: 1842343 - DNA, 13 bp, Homo sapiens
cagagggggtggc

SEQ ID NO: 1842344 - DNA, 18 bp, Homo sapiens
cagagggggtggcctccc

SEQ ID NO: 1842345 - DNA, 14 bp, Homo sapiens
cagagtatggagct

SEQ ID NO: 1842346 - DNA, 21 bp, Homo sapiens
cagagtcacacgggggcagct

SEQ ID NO: 1842347 - DNA, 16 bp, Homo sapiens
cagagttccccatgca

SEQ ID NO: 1842348 - DNA, 18 bp, Homo sapiens
cagagttccccatgcaga

SEQ ID NO: 1842349 - DNA, 20 bp, Homo sapiens
cagataactgttatttataa

SEQ ID NO: 1842350 - DNA, 14 bp, Homo sapiens
cagatgggggaaag

SEQ ID NO: 1842351 - DNA, 19 bp, Homo sapiens
cagatgggggaaagcacag

SEQ ID NO: 1842352 - DNA, 23 bp, Homo sapiens
cagatgggtgcttggaggaagga

SEQ ID NO: 1842353 - DNA, 15 bp, Homo sapiens
cagattctgatgcat

SEQ ID NO: 1842354 - DNA, 14 bp, Homo sapiens
cagattctttcctg

SEQ ID NO: 1842355 - DNA, 17 bp, Homo sapiens
cagattctttcctgagg

SEQ ID NO: 1842356 - DNA, 18 bp, Homo sapiens
cagattctttcctgaggc

SEQ ID NO: 1842357 - DNA, 20 bp, Homo sapiens
cagattctttcctgaggctg

SEQ ID NO: 1842358 - DNA, 22 bp, Homo sapiens
cagattctttcctgaggctggg

SEQ ID NO: 1842359 - DNA, 22 bp, Homo sapiens
cagattgagttttcttctgtga

SEQ ID NO: 1842360 - DNA, 15 bp, Homo sapiens
cagatttgggctgga

SEQ ID NO: 1842361 - DNA, 18 bp, Homo sapiens
cagatttgggctggaaca

SEQ ID NO: 1842362 - DNA, 23 bp, Homo sapiens
cagcaccacactgggtgcgtctc

SEQ ID NO: 1842363 - DNA, 15 bp, Homo sapiens
cagcactgcctgctc

SEQ ID NO: 1842364 - DNA, 21 bp, Homo sapiens
cagcagaacctgcacacagga

SEQ ID NO: 1842365 - DNA, 13 bp, Homo sapiens
cagcagagacggg

SEQ ID NO: 1842366 - DNA, 14 bp, Homo sapiens
aattcctcatttgt

SEQ ID NO: 1842367 - DNA, 14 bp, Homo sapiens
aattctgtttttct

SEQ ID NO: 1842368 - DNA, 22 bp, Homo sapiens
aattcttcacctaagtctctgt

SEQ ID NO: 1842369 - DNA, 11 bp, Homo sapiens
aattcttccct

SEQ ID NO: 1842370 - DNA, 13 bp, Homo sapiens
aattttattatag

SEQ ID NO: 1842371 - DNA, 14 bp, Homo sapiens
acaaaacttttcta

SEQ ID NO: 1842372 - DNA, 16 bp, Homo sapiens
acaaaggtttaaatga

SEQ ID NO: 1842373 - DNA, 18 bp, Homo sapiens
acaaatgccaaattaaaa

SEQ ID NO: 1842374 - DNA, 22 bp, Homo sapiens
acaaatgccaaattaaaaaaga

SEQ ID NO: 1842375 - DNA, 23 bp, Homo sapiens
acaacactcattgacctgaggcc

SEQ ID NO: 1842376 - DNA, 20 bp, Homo sapiens
acaagaaaaataaagaaaag

SEQ ID NO: 1842377 - DNA, 15 bp, Homo sapiens
acaagagaagcattc

SEQ ID NO: 1842378 - DNA, 19 bp, Homo sapiens
acaagagaagcattctcat

SEQ ID NO: 1842379 - DNA, 17 bp, Homo sapiens
acaagattggtgttttt

SEQ ID NO: 1842380 - DNA, 13 bp, Homo sapiens
acaagcaagctcc

SEQ ID NO: 1842381 - DNA, 15 bp, Homo sapiens
acaagctccaagctc

SEQ ID NO: 1842382 - DNA, 17 bp, Homo sapiens
acaagctccaagctccc

SEQ ID NO: 1842383 - DNA, 19 bp, Homo sapiens
acaagctgcaccctcaggc

SEQ ID NO: 1842384 - DNA, 21 bp, Homo sapiens
acaagctgcaccctcaggcag

SEQ ID NO: 1842385 - DNA, 22 bp, Homo sapiens
acaagctgcaccctcaggcagg

SEQ ID NO: 1842386 - DNA, 20 bp, Homo sapiens
acaaggatgatctaggaaga

SEQ ID NO: 1842387 - DNA, 19 bp, Homo sapiens
acaagtgactgtatctgtg

SEQ ID NO: 1842388 - DNA, 20 bp, Homo sapiens
acaagtgactgtatctgtgt

SEQ ID NO: 1842389 - DNA, 22 bp, Homo sapiens
acaagtgactgtatctgtgtag

SEQ ID NO: 1842390 - DNA, 16 bp, Homo sapiens
acaagttgaagaagct

SEQ ID NO: 1842391 - DNA, 16 bp, Homo sapiens
acacaaacctgcctgg

SEQ ID NO: 1842392 - DNA, 18 bp, Homo sapiens
acacaaacgggctcagca

SEQ ID NO: 1842393 - DNA, 17 bp, Homo sapiens
acacaagattggtgttt

SEQ ID NO: 1842394 - DNA, 14 bp, Homo sapiens
acacacgagcaaac

SEQ ID NO: 1842395 - DNA, 19 bp, Homo sapiens
acacacgagcaaacccaga

SEQ ID NO: 1842396 - DNA, 20 bp, Homo sapiens
acacagctaacacacagctc

SEQ ID NO: 1842397 - DNA, 21 bp, Homo sapiens
acacagctaacacacagctcc

SEQ ID NO: 1842398 - DNA, 11 bp, Homo sapiens
acacagtgtct

SEQ ID NO: 1842399 - DNA, 18 bp, Homo sapiens
acacatgtccaagaagcc

SEQ ID NO: 1842400 - DNA, 21 bp, Homo sapiens
acacatgtccaagaagcccag

SEQ ID NO: 1842401 - DNA, 22 bp, Homo sapiens
acacatgtccaagaagcccagg

SEQ ID NO: 1842402 - DNA, 12 bp, Homo sapiens
acaccctgtgat

SEQ ID NO: 1842403 - DNA, 19 bp, Homo sapiens
acaccctgtgatggggccc

SEQ ID NO: 1842404 - DNA, 17 bp, Homo sapiens
acacgagcaaacccaga

SEQ ID NO: 1842405 - DNA, 20 bp, Homo sapiens
acacgagcaaacccagaggt

SEQ ID NO: 1842406 - DNA, 17 bp, Homo sapiens
acacgctccttcctctg

SEQ ID NO: 1842407 - DNA, 15 bp, Homo sapiens
acacggacactcaaa

SEQ ID NO: 1842408 - DNA, 13 bp, Homo sapiens
acacgggcctgtc

SEQ ID NO: 1842409 - DNA, 15 bp, Homo sapiens
acacgggcctgtcca

SEQ ID NO: 1842410 - DNA, 16 bp, Homo sapiens
acacgggggcagctga

SEQ ID NO: 1842411 - DNA, 23 bp, Homo sapiens
acacgggggcagctgatacaaat

SEQ ID NO: 1842412 - DNA, 21 bp, Homo sapiens
acactcaaaagctgggcaggt

SEQ ID NO: 1842413 - DNA, 15 bp, Homo sapiens
acactcaagaagcag

SEQ ID NO: 1842414 - DNA, 17 bp, Homo sapiens
acactcattgacctgag

SEQ ID NO: 1842415 - DNA, 19 bp, Homo sapiens
acactcattgacctgaggc

SEQ ID NO: 1842416 - DNA, 17 bp, Homo sapiens
acactcgtatgatactt

SEQ ID NO: 1842417 - DNA, 16 bp, Homo sapiens
acactgcaggcatcac

SEQ ID NO: 1842418 - DNA, 16 bp, Homo sapiens
acactgggtgcgtctc

SEQ ID NO: 1842419 - DNA, 17 bp, Homo sapiens
acactgtgctgagtctg

SEQ ID NO: 1842420 - DNA, 22 bp, Homo sapiens
acactgtgctgagtctgaaggc

SEQ ID NO: 1842421 - DNA, 16 bp, Homo sapiens
acactgttctctgccc

SEQ ID NO: 1842422 - DNA, 20 bp, Homo sapiens
acactgttctctgccctcca

SEQ ID NO: 1842423 - DNA, 13 bp, Homo sapiens
acagaagcagctc

SEQ ID NO: 1842424 - DNA, 14 bp, Homo sapiens
acagaccctgccct

SEQ ID NO: 1842425 - DNA, 15 bp, Homo sapiens
acagaccctgccctg

SEQ ID NO: 1842426 - DNA, 23 bp, Homo sapiens
acagagcgtgagctgagcaggcc

SEQ ID NO: 1842427 - DNA, 22 bp, Homo sapiens
acagagggggtggcctcccaac

SEQ ID NO: 1842428 - DNA, 23 bp, Homo sapiens
acagatgggtgcttggaggaagg

SEQ ID NO: 1842429 - DNA, 17 bp, Homo sapiens
acagcacttacaatttt

SEQ ID NO: 1842430 - DNA, 14 bp, Homo sapiens
acagcccctcctcc

SEQ ID NO: 1842431 - DNA, 17 bp, Homo sapiens
acagcccgggctctgcc

SEQ ID NO: 1842432 - DNA, 20 bp, Homo sapiens
acagcccgggctctgcctcc

SEQ ID NO: 1842433 - DNA, 21 bp, Homo sapiens
acagcccgggctctgcctccc

SEQ ID NO: 1842434 - DNA, 23 bp, Homo sapiens
acagcccgggctctgcctcccat

SEQ ID NO: 1842435 - DNA, 15 bp, Homo sapiens
acagctaacacacag

SEQ ID NO: 1842436 - DNA, 14 bp, Homo sapiens
acagctgcctggga

SEQ ID NO: 1842437 - DNA, 19 bp, Homo sapiens
acagctgggtggcactgcc

SEQ ID NO: 1842438 - DNA, 16 bp, Homo sapiens
acagctgtgtctgcca

SEQ ID NO: 1842439 - DNA, 12 bp, Homo sapiens
acagctttctgg

SEQ ID NO: 1842440 - DNA, 16 bp, Homo sapiens
acagctttctgggatg

SEQ ID NO: 1842441 - DNA, 17 bp, Homo sapiens
acagctttctgggatgt

SEQ ID NO: 1842442 - DNA, 19 bp, Homo sapiens
acagctttctgggatgtca

SEQ ID NO: 1842443 - DNA, 14 bp, Homo sapiens
acaggacagcggga

SEQ ID NO: 1842444 - DNA, 14 bp, Homo sapiens
acaggatgaaggca

SEQ ID NO: 1842445 - DNA, 14 bp, Homo sapiens
acagggatgagcat

SEQ ID NO: 1842446 - DNA, 21 bp, Homo sapiens
acagggatgagcatggagctg

SEQ ID NO: 1842447 - DNA, 19 bp, Homo sapiens
acaggtgccgccagctgcc

SEQ ID NO: 1842448 - DNA, 20 bp, Homo sapiens
acaggtgggcttcccagtgg

SEQ ID NO: 1842449 - DNA, 17 bp, Homo sapiens
acagtaacgcaggggaa

SEQ ID NO: 1842450 - DNA, 14 bp, Homo sapiens
acagtccaaccaga

SEQ ID NO: 1842451 - DNA, 20 bp, Homo sapiens
acagtccaaccagaaacacc

SEQ ID NO: 1842452 - DNA, 14 bp, Homo sapiens
acagtccagcctgg

SEQ ID NO: 1842453 - DNA, 16 bp, Homo sapiens
acagtccagcctggag

SEQ ID NO: 1842454 - DNA, 15 bp, Homo sapiens
acagtccctgccaat

SEQ ID NO: 1842455 - DNA, 20 bp, Homo sapiens
acagtccttaccagcagagc

SEQ ID NO: 1842456 - DNA, 15 bp, Homo sapiens
acagtcttgcagcag

SEQ ID NO: 1842457 - DNA, 13 bp, Homo sapiens
acagtgcctcttc

SEQ ID NO: 1842458 - DNA, 15 bp, Homo sapiens
acagtgcctcttcca

SEQ ID NO: 1842459 - DNA, 21 bp, Homo sapiens
acagtgcttgccacagagcgg

SEQ ID NO: 1842460 - DNA, 24 bp, Homo sapiens
acagttttggttgctttaatatca

SEQ ID NO: 1842461 - DNA, 17 bp, Homo sapiens
acataagctatttttct

SEQ ID NO: 1842462 - DNA, 18 bp, Homo sapiens
acataagctatttttcta

SEQ ID NO: 1842463 - DNA, 13 bp, Homo sapiens
acatactcccatc

SEQ ID NO: 1842464 - DNA, 19 bp, Homo sapiens
acatcatcaaggcactgcc

SEQ ID NO: 1842465 - DNA, 24 bp, Homo sapiens
acatcttggcacatttaagagaca

SEQ ID NO: 1842466 - DNA, 17 bp, Homo sapiens
acatgagcatcaggcca

SEQ ID NO: 1842467 - DNA, 23 bp, Homo sapiens
acatgcttagcagtccccttccc

SEQ ID NO: 1842468 - DNA, 19 bp, Homo sapiens
acatgtatttgtttgcata

SEQ ID NO: 1842469 - DNA, 15 bp, Homo sapiens
acatgtccaagaagc

SEQ ID NO: 1842470 - DNA, 19 bp, Homo sapiens
acatgtccaagaagcccag

SEQ ID NO: 1842471 - DNA, 21 bp, Homo sapiens
acatgtccaagaagcccagga

SEQ ID NO: 1842472 - DNA, 17 bp, Homo sapiens
acatgtgttggcagcct

SEQ ID NO: 1842473 - DNA, 18 bp, Homo sapiens
acatgtttttatatgtct

SEQ ID NO: 1842474 - DNA, 16 bp, Homo sapiens
acattcatgcctggct

SEQ ID NO: 1842475 - DNA, 14 bp, Homo sapiens
acattcctgatgct

SEQ ID NO: 1842476 - DNA, 16 bp, Homo sapiens
acattggttcttgtat

SEQ ID NO: 1842477 - DNA, 18 bp, Homo sapiens
acattggttcttgtatta

SEQ ID NO: 1842478 - DNA, 20 bp, Homo sapiens
acatttaagagacagtcacc

SEQ ID NO: 1842479 - DNA, 22 bp, Homo sapiens
acatttaccctttggccccact

SEQ ID NO: 1842480 - DNA, 14 bp, Homo sapiens
acatttctgttctc

SEQ ID NO: 1842481 - DNA, 15 bp, Homo sapiens
acattttatgtcttt

SEQ ID NO: 1842482 - DNA, 17 bp, Homo sapiens
accaacatactcccatc

SEQ ID NO: 1842483 - DNA, 19 bp, Homo sapiens
accaacatactcccatctg

SEQ ID NO: 1842484 - DNA, 17 bp, Homo sapiens
accaacgtctgtgccat

SEQ ID NO: 1842485 - DNA, 15 bp, Homo sapiens
accaatgttctctct

SEQ ID NO: 1842486 - DNA, 22 bp, Homo sapiens
accacactgggtgcgtctccag

SEQ ID NO: 1842487 - DNA, 12 bp, Homo sapiens
accacagctgct

SEQ ID NO: 1842488 - DNA, 15 bp, Homo sapiens
accacagctgctgga

SEQ ID NO: 1842489 - DNA, 21 bp, Homo sapiens
accactgcactccagcctggg

SEQ ID NO: 1842490 - DNA, 18 bp, Homo sapiens
catactcccatctgtgaa

SEQ ID NO: 1842491 - DNA, 20 bp, Homo sapiens
catactcccatctgtgaaag

SEQ ID NO: 1842492 - DNA, 17 bp, Homo sapiens
catactgattgggaggt

SEQ ID NO: 1842493 - DNA, 21 bp, Homo sapiens
catagagagcaagacgctgtg

SEQ ID NO: 1842494 - DNA, 13 bp, Homo sapiens
cataggcccagtg

SEQ ID NO: 1842495 - DNA, 16 bp, Homo sapiens
cataggtgatctcatt

SEQ ID NO: 1842496 - DNA, 22 bp, Homo sapiens
catatgacattcatgcctggct

SEQ ID NO: 1842497 - DNA, 19 bp, Homo sapiens
catattaacaaattgcatt

SEQ ID NO: 1842498 - DNA, 21 bp, Homo sapiens
catattaacaaattgcatttg

SEQ ID NO: 1842499 - DNA, 14 bp, Homo sapiens
catattcaggaagc

SEQ ID NO: 1842500 - DNA, 15 bp, Homo sapiens
catatttaacaaaat

SEQ ID NO: 1842501 - DNA, 16 bp, Homo sapiens
catatttaacaaaatt

SEQ ID NO: 1842502 - DNA, 19 bp, Homo sapiens
catcaaatggaagacacat

SEQ ID NO: 1842503 - DNA, 16 bp, Homo sapiens
catcaagactggaagg

SEQ ID NO: 1842504 - DNA, 21 bp, Homo sapiens
catcaaggacacgggcctgtc

SEQ ID NO: 1842505 - DNA, 17 bp, Homo sapiens
catcaaggcactgcctg

SEQ ID NO: 1842506 - DNA, 13 bp, Homo sapiens
catcacaaatggc

SEQ ID NO: 1842507 - DNA, 17 bp, Homo sapiens
catcacagctaacaatt

SEQ ID NO: 1842508 - DNA, 21 bp, Homo sapiens
catcacagttttggttgcttt

SEQ ID NO: 1842509 - DNA, 20 bp, Homo sapiens
catcaccaacgtctgtgcca

SEQ ID NO: 1842510 - DNA, 17 bp, Homo sapiens
catcagaaacaccctca

SEQ ID NO: 1842511 - DNA, 21 bp, Homo sapiens
catcagaggtttgcttcctca

SEQ ID NO: 1842512 - DNA, 22 bp, Homo sapiens
catcaggagaaaaagcctccag

SEQ ID NO: 1842513 - DNA, 15 bp, Homo sapiens
catcaggccaggccc

SEQ ID NO: 1842514 - DNA, 19 bp, Homo sapiens
catcaggccaggccctctg

SEQ ID NO: 1842515 - DNA, 23 bp, Homo sapiens
catcaggccaggccctctgccca

SEQ ID NO: 1842516 - DNA, 14 bp, Homo sapiens
catcagtggagcca

SEQ ID NO: 1842517 - DNA, 16 bp, Homo sapiens
catcagttagagctga

SEQ ID NO: 1842518 - DNA, 18 bp, Homo sapiens
catcagttagagctgaca

SEQ ID NO: 1842519 - DNA, 14 bp, Homo sapiens
catcatacttaact

SEQ ID NO: 1842520 - DNA, 13 bp, Homo sapiens
catcatcaaggca

SEQ ID NO: 1842521 - DNA, 19 bp, Homo sapiens
catcatcaaggcactgcct

SEQ ID NO: 1842522 - DNA, 20 bp, Homo sapiens
catcatcaaggcactgcctg

SEQ ID NO: 1842523 - DNA, 14 bp, Homo sapiens
catcattatttatg

SEQ ID NO: 1842524 - DNA, 15 bp, Homo sapiens
catcattatttatgt

SEQ ID NO: 1842525 - DNA, 19 bp, Homo sapiens
catcattatttatgtattg

SEQ ID NO: 1842526 - DNA, 12 bp, Homo sapiens
catcatttcact

SEQ ID NO: 1842527 - DNA, 16 bp, Homo sapiens
catcatttgtattatg

SEQ ID NO: 1842528 - DNA, 19 bp, Homo sapiens
catccagggctctgaccag

SEQ ID NO: 1842529 - DNA, 21 bp, Homo sapiens
catccctgaaggccccgccca

SEQ ID NO: 1842530 - DNA, 22 bp, Homo sapiens
catccctgaaggccccgcccag

SEQ ID NO: 1842531 - DNA, 19 bp, Homo sapiens
catcccttgaccaggcctg

SEQ ID NO: 1842532 - DNA, 19 bp, Homo sapiens
catcctcaaacactgcagg

SEQ ID NO: 1842533 - DNA, 22 bp, Homo sapiens
catcctcaaacactgcaggcat

SEQ ID NO: 1842534 - DNA, 16 bp, Homo sapiens
catcctcatacccacc

SEQ ID NO: 1842535 - DNA, 18 bp, Homo sapiens
catcctcatacccacccc

SEQ ID NO: 1842536 - DNA, 22 bp, Homo sapiens
catctcaaggaataatgggctt

SEQ ID NO: 1842537 - DNA, 16 bp, Homo sapiens
catctcacacatgagc

SEQ ID NO: 1842538 - DNA, 20 bp, Homo sapiens
catctcacacatgagcatca

SEQ ID NO: 1842539 - DNA, 22 bp, Homo sapiens
catctccaaatatcagtgggct

SEQ ID NO: 1842540 - DNA, 13 bp, Homo sapiens
catctcctttgca

SEQ ID NO: 1842541 - DNA, 16 bp, Homo sapiens
catctctacaaaaagc

SEQ ID NO: 1842542 - DNA, 22 bp, Homo sapiens
catctctgcaatcttctcagaa

SEQ ID NO: 1842543 - DNA, 10 bp, Homo sapiens
catctgctcc

SEQ ID NO: 1842544 - DNA, 11 bp, Homo sapiens
catctgctcct

SEQ ID NO: 1842545 - DNA, 19 bp, Homo sapiens
catctggaaccatcagaaa

SEQ ID NO: 1842546 - DNA, 23 bp, Homo sapiens
catctggccgttgatgttggctg

SEQ ID NO: 1842547 - DNA, 16 bp, Homo sapiens
catctgtaagagcttg

SEQ ID NO: 1842548 - DNA, 19 bp, Homo sapiens
catctgtaagagcttgctc

SEQ ID NO: 1842549 - DNA, 18 bp, Homo sapiens
catctgtgaaaggaaaga

SEQ ID NO: 1842550 - DNA, 19 bp, Homo sapiens
catctgtgaaaggaaagag

SEQ ID NO: 1842551 - DNA, 21 bp, Homo sapiens
catctttcctgatggcaggat

SEQ ID NO: 1842552 - DNA, 13 bp, Homo sapiens
cacaaacctgcct

SEQ ID NO: 1842553 - DNA, 17 bp, Homo sapiens
cacaaacctgcctgggt

SEQ ID NO: 1842554 - DNA, 13 bp, Homo sapiens
cacaaaggagagc

SEQ ID NO: 1842555 - DNA, 14 bp, Homo sapiens
cacaagacccttgt

SEQ ID NO: 1842556 - DNA, 15 bp, Homo sapiens
cacaagattggtgtt

SEQ ID NO: 1842557 - DNA, 17 bp, Homo sapiens
cacaagattggtgtttt

SEQ ID NO: 1842558 - DNA, 23 bp, Homo sapiens
cacaagattggtgtttttttcta

SEQ ID NO: 1842559 - DNA, 13 bp, Homo sapiens
cacaagctccaag

SEQ ID NO: 1842560 - DNA, 21 bp, Homo sapiens
cacaagctccaagctcccagg

SEQ ID NO: 1842561 - DNA, 17 bp, Homo sapiens
cacaagctgcaccctca

SEQ ID NO: 1842562 - DNA, 21 bp, Homo sapiens
cacacatgagcatcaggccag

SEQ ID NO: 1842563 - DNA, 22 bp, Homo sapiens
cacacatgagcatcaggccagg

SEQ ID NO: 1842564 - DNA, 19 bp, Homo sapiens
cacacgagcaaacccagag

SEQ ID NO: 1842565 - DNA, 23 bp, Homo sapiens
cacacgagcaaacccagaggtgg

SEQ ID NO: 1842566 - DNA, 20 bp, Homo sapiens
cacactgggtgcgtctccag

SEQ ID NO: 1842567 - DNA, 16 bp, Homo sapiens
cacagaccctgccctg

SEQ ID NO: 1842568 - DNA, 22 bp, Homo sapiens
cacagaccctgccctgtgggcc

SEQ ID NO: 1842569 - DNA, 22 bp, Homo sapiens
cacagaggatgctgacatcatt

SEQ ID NO: 1842570 - DNA, 16 bp, Homo sapiens
cacagagtataaataa

SEQ ID NO: 1842571 - DNA, 14 bp, Homo sapiens
cacagatgggtgct

SEQ ID NO: 1842572 - DNA, 18 bp, Homo sapiens
cacagcaattcctcaggc

SEQ ID NO: 1842573 - DNA, 19 bp, Homo sapiens
cacagcgctggccgggacc

SEQ ID NO: 1842574 - DNA, 21 bp, Homo sapiens
cacagctaacaattgtgaagt

SEQ ID NO: 1842575 - DNA, 16 bp, Homo sapiens
cacagtccaaccagaa

SEQ ID NO: 1842576 - DNA, 13 bp, Homo sapiens
cacagtccttacc

SEQ ID NO: 1842577 - DNA, 21 bp, Homo sapiens
cacagtccttaccagcagagc

SEQ ID NO: 1842578 - DNA, 23 bp, Homo sapiens
cacagtccttaccagcagagcac

SEQ ID NO: 1842579 - DNA, 22 bp, Homo sapiens
cacagtggccaagatcacagtg

SEQ ID NO: 1842580 - DNA, 19 bp, Homo sapiens
cacagttttggttgcttta

SEQ ID NO: 1842581 - DNA, 15 bp, Homo sapiens
cacatctgttttgta

SEQ ID NO: 1842582 - DNA, 13 bp, Homo sapiens
cacatcttggcac

SEQ ID NO: 1842583 - DNA, 13 bp, Homo sapiens
cacatgagcatca

SEQ ID NO: 1842584 - DNA, 14 bp, Homo sapiens
cacatgatttgggc

SEQ ID NO: 1842585 - DNA, 17 bp, Homo sapiens
cacatgtccaagaagcc

SEQ ID NO: 1842586 - DNA, 18 bp, Homo sapiens
cacatgtccaagaagccc

SEQ ID NO: 1842587 - DNA, 22 bp, Homo sapiens
cacatgtccaagaagcccagga

SEQ ID NO: 1842588 - DNA, 17 bp, Homo sapiens
caccaacatactcccat

SEQ ID NO: 1842589 - DNA, 21 bp, Homo sapiens
caccaacatactcccatctgt

SEQ ID NO: 1842590 - DNA, 15 bp, Homo sapiens
caccacactgggtgc

SEQ ID NO: 1842591 - DNA, 18 bp, Homo sapiens
caccaccacggtggtcac

SEQ ID NO: 1842592 - DNA, 14 bp, Homo sapiens
caccacctcagagt

SEQ ID NO: 1842593 - DNA, 14 bp, Homo sapiens
caccagcagcctgg

SEQ ID NO: 1842594 - DNA, 18 bp, Homo sapiens
caccagggcctggctggg

SEQ ID NO: 1842595 - DNA, 13 bp, Homo sapiens
caccatcaagcca

SEQ ID NO: 1842596 - DNA, 15 bp, Homo sapiens
caccatcaagccacc

SEQ ID NO: 1842597 - DNA, 17 bp, Homo sapiens
caccatcaagccaccaa

SEQ ID NO: 1842598 - DNA, 23 bp, Homo sapiens
caccatcttaagagatgcctcat

SEQ ID NO: 1842599 - DNA, 13 bp, Homo sapiens
cacccaagggcct

SEQ ID NO: 1842600 - DNA, 14 bp, Homo sapiens
cacccaagggcctg

SEQ ID NO: 1842601 - DNA, 16 bp, Homo sapiens
cacccaagggcctggc

SEQ ID NO: 1842602 - DNA, 23 bp, Homo sapiens
cacccaagggcctggcctgagct

SEQ ID NO: 1842603 - DNA, 22 bp, Homo sapiens
cacccaagtccaggcccaagga

SEQ ID NO: 1842604 - DNA, 18 bp, Homo sapiens
cacccacctgttttctga

SEQ ID NO: 1842605 - DNA, 11 bp, Homo sapiens
caccccagccc

SEQ ID NO: 1842606 - DNA, 14 bp, Homo sapiens
caccccggccacct

SEQ ID NO: 1842607 - DNA, 13 bp, Homo sapiens
cacccctctgtct

SEQ ID NO: 1842608 - DNA, 22 bp, Homo sapiens
cacccctctgtctaggactgca

SEQ ID NO: 1842609 - DNA, 19 bp, Homo sapiens
cacccgctaagagggaggg

SEQ ID NO: 1842610 - DNA, 14 bp, Homo sapiens
caccctcaggcagg

SEQ ID NO: 1842611 - DNA, 14 bp, Homo sapiens
caccctcatgctgt

SEQ ID NO: 1842612 - DNA, 17 bp, Homo sapiens
caccctgataggaagag

SEQ ID NO: 1842613 - DNA, 18 bp, Homo sapiens
caccctgcctctacccaa

SEQ ID NO: 1842614 - DNA, 20 bp, Homo sapiens
caccctgcctctacccaacc

SEQ ID NO: 1842615 - DNA, 21 bp, Homo sapiens
caccctgcctctacccaacca

SEQ ID NO: 1842616 - DNA, 22 bp, Homo sapiens
caccctgcctctacccaaccag

SEQ ID NO: 1842617 - DNA, 13 bp, Homo sapiens
caccgcagacagg

SEQ ID NO: 1842618 - DNA, 14 bp, Homo sapiens
caccgcagacagga

SEQ ID NO: 1842619 - DNA, 14 bp, Homo sapiens
caccgttcattcag

SEQ ID NO: 1842620 - DNA, 15 bp, Homo sapiens
cacctaactcttctt

SEQ ID NO: 1842621 - DNA, 13 bp, Homo sapiens
cacctctcccttg

SEQ ID NO: 1842622 - DNA, 12 bp, Homo sapiens
cacctcttccga

SEQ ID NO: 1842623 - DNA, 22 bp, Homo sapiens
cacctctttaaaaactcactta

SEQ ID NO: 1842624 - DNA, 23 bp, Homo sapiens
cacctgcagccaagcaaatgcct

SEQ ID NO: 1842625 - DNA, 13 bp, Homo sapiens
cacctgccaggga

SEQ ID NO: 1842626 - DNA, 16 bp, Homo sapiens
cacctgcggtgctatc

SEQ ID NO: 1842627 - DNA, 17 bp, Homo sapiens
cacctgcggtgctatct

SEQ ID NO: 1842628 - DNA, 19 bp, Homo sapiens
cacctgcggtgctatctcc

SEQ ID NO: 1842629 - DNA, 23 bp, Homo sapiens
cacctgcggtgctatctccccca

SEQ ID NO: 1842630 - DNA, 17 bp, Homo sapiens
cacctggcctctgcact

SEQ ID NO: 1842631 - DNA, 20 bp, Homo sapiens
cacctgttttctgaaacaca

SEQ ID NO: 1842632 - DNA, 21 bp, Homo sapiens
caccttagacagtccctgcca

SEQ ID NO: 1842633 - DNA, 22 bp, Homo sapiens
caccttagcctgccctcctttc

SEQ ID NO: 1842634 - DNA, 12 bp, Homo sapiens
caccttccaaag

SEQ ID NO: 1842635 - DNA, 22 bp, Homo sapiens
caccttccaaagagtgctaagc

SEQ ID NO: 1842636 - DNA, 14 bp, Homo sapiens
caccttgcggggat

SEQ ID NO: 1842637 - DNA, 13 bp, Homo sapiens
caccttgtctgct

SEQ ID NO: 1842638 - DNA, 23 bp, Homo sapiens
cacctttattctggcagaggagg

SEQ ID NO: 1842639 - DNA, 17 bp, Homo sapiens
caccttttttaaggaaa

SEQ ID NO: 1842640 - DNA, 13 bp, Homo sapiens
cacgcccccactg

SEQ ID NO: 1842641 - DNA, 18 bp, Homo sapiens
cacgcccccactggtgac

SEQ ID NO: 1842642 - DNA, 19 bp, Homo sapiens
cacgcctgtaatcctagca

SEQ ID NO: 1842643 - DNA, 14 bp, Homo sapiens
cacgctccttcctc

SEQ ID NO: 1842644 - DNA, 22 bp, Homo sapiens
cacggaagagccttgcggaagg

SEQ ID NO: 1842645 - DNA, 22 bp, Homo sapiens
cacgggggcagctgatacaaat

SEQ ID NO: 1842646 - DNA, 17 bp, Homo sapiens
cacggtttgaagcctgg

SEQ ID NO: 1842647 - DNA, 20 bp, Homo sapiens
cacggtttgaagcctggaac

SEQ ID NO: 1842648 - DNA, 15 bp, Homo sapiens
cactcaagaagcagg

SEQ ID NO: 1842649 - DNA, 17 bp, Homo sapiens
cactcaagaagcaggct

SEQ ID NO: 1842650 - DNA, 23 bp, Homo sapiens
cactcaagaagcaggctacactg

SEQ ID NO: 1842651 - DNA, 19 bp, Homo sapiens
cactcattgacctgaggcc

SEQ ID NO: 1842652 - DNA, 15 bp, Homo sapiens
cactccaattaagga

SEQ ID NO: 1842653 - DNA, 21 bp, Homo sapiens
cactccaattaaggattttat

SEQ ID NO: 1842654 - DNA, 13 bp, Homo sapiens
cactccagcctgg

SEQ ID NO: 1842655 - DNA, 14 bp, Homo sapiens
cactcccaggcagc

SEQ ID NO: 1842656 - DNA, 13 bp, Homo sapiens
cactcccctgctg

SEQ ID NO: 1842657 - DNA, 13 bp, Homo sapiens
cactccctgcaac

SEQ ID NO: 1842658 - DNA, 14 bp, Homo sapiens
cactccttcacaga

SEQ ID NO: 1842659 - DNA, 12 bp, Homo sapiens
cactctggcagc

SEQ ID NO: 1842660 - DNA, 13 bp, Homo sapiens
cactctggcagct

SEQ ID NO: 1842661 - DNA, 17 bp, Homo sapiens
cactctggcagctcaga

SEQ ID NO: 1842662 - DNA, 12 bp, Homo sapiens
cactgagacagc

SEQ ID NO: 1842663 - DNA, 14 bp, Homo sapiens
cactgagacagccc

SEQ ID NO: 1842664 - DNA, 23 bp, Homo sapiens
cactgagacagcccgggctctgc

SEQ ID NO: 1842665 - DNA, 19 bp, Homo sapiens
cactgcactccagcctggg

SEQ ID NO: 1842666 - DNA, 19 bp, Homo sapiens
cactgccatgcagggcctc

SEQ ID NO: 1842667 - DNA, 22 bp, Homo sapiens
cactgcctgatggacctgtcac

SEQ ID NO: 1842668 - DNA, 20 bp, Homo sapiens
cactgcctgctcccatcctg

SEQ ID NO: 1842669 - DNA, 20 bp, Homo sapiens
cactgcttccagtgaggctc

SEQ ID NO: 1842670 - DNA, 21 bp, Homo sapiens
cactgcttccagtgaggctct

SEQ ID NO: 1842671 - DNA, 22 bp, Homo sapiens
cactgcttccagtgaggctctg

SEQ ID NO: 1842672 - DNA, 19 bp, Homo sapiens
cactggtattcctgcctcc

SEQ ID NO: 1842673 - DNA, 15 bp, Homo sapiens
cactgtgctgagtct

SEQ ID NO: 1842674 - DNA, 22 bp, Homo sapiens
cactgtgctgagtctgaaggct

SEQ ID NO: 1842675 - DNA, 14 bp, Homo sapiens
cactgttctctgcc

SEQ ID NO: 1842676 - DNA, 16 bp, Homo sapiens
cactgttctctgccct

SEQ ID NO: 1842677 - DNA, 21 bp, Homo sapiens
aggttcaggtcccctttcaga

SEQ ID NO: 1842678 - DNA, 22 bp, Homo sapiens
aggttccctttgacgccatccc

SEQ ID NO: 1842679 - DNA, 17 bp, Homo sapiens
aggttctggtgtgaact

SEQ ID NO: 1842680 - DNA, 14 bp, Homo sapiens
aggttggtgggggc

SEQ ID NO: 1842681 - DNA, 13 bp, Homo sapiens
aggtttaaatgaa

SEQ ID NO: 1842682 - DNA, 18 bp, Homo sapiens
aggtttctggtctctagg

SEQ ID NO: 1842683 - DNA, 15 bp, Homo sapiens
agtaaagtgaagaat

SEQ ID NO: 1842684 - DNA, 16 bp, Homo sapiens
agtaacagtcatcatt

SEQ ID NO: 1842685 - DNA, 15 bp, Homo sapiens
agtaacatttctgtt

SEQ ID NO: 1842686 - DNA, 22 bp, Homo sapiens
agtacctcctgtctctggcctg

SEQ ID NO: 1842687 - DNA, 21 bp, Homo sapiens
agtctattgaataatgtagtt

SEQ ID NO: 1842688 - DNA, 19 bp, Homo sapiens
agtctctgaagtgaaactg

SEQ ID NO: 1842689 - DNA, 13 bp, Homo sapiens
agtctgaaggctg

SEQ ID NO: 1842690 - DNA, 15 bp, Homo sapiens
agtctgaaggctggg

SEQ ID NO: 1842691 - DNA, 16 bp, Homo sapiens
agtctgaaggctgggt

SEQ ID NO: 1842692 - DNA, 17 bp, Homo sapiens
agtctgaaggctgggtt

SEQ ID NO: 1842693 - DNA, 21 bp, Homo sapiens
agtgaaactgcttgtttccta

SEQ ID NO: 1842694 - DNA, 15 bp, Homo sapiens
agtgaacattcccag

SEQ ID NO: 1842695 - DNA, 19 bp, Homo sapiens
agtgaacattcccagccca

SEQ ID NO: 1842696 - DNA, 20 bp, Homo sapiens
agtgaacattcccagcccag

SEQ ID NO: 1842697 - DNA, 15 bp, Homo sapiens
agtgaagaatttatc

SEQ ID NO: 1842698 - DNA, 19 bp, Homo sapiens
agtgaagaatttatctctt

SEQ ID NO: 1842699 - DNA, 15 bp, Homo sapiens
agtgacagctttctg

SEQ ID NO: 1842700 - DNA, 16 bp, Homo sapiens
agtgacagctttctgg

SEQ ID NO: 1842701 - DNA, 18 bp, Homo sapiens
agtgacagctttctggga

SEQ ID NO: 1842702 - DNA, 17 bp, Homo sapiens
agtgagaccctgtctca

SEQ ID NO: 1842703 - DNA, 21 bp, Homo sapiens
agtgagaccctgtctcaaaaa

SEQ ID NO: 1842704 - DNA, 19 bp, Homo sapiens
agtgagcagaacaggtagt

SEQ ID NO: 1842705 - DNA, 22 bp, Homo sapiens
agtgagttgatagcacagaccc

SEQ ID NO: 1842706 - DNA, 16 bp, Homo sapiens
agtgccctccaggata

SEQ ID NO: 1842707 - DNA, 21 bp, Homo sapiens
agtgcctcttccagtgaacat

SEQ ID NO: 1842708 - DNA, 14 bp, Homo sapiens
agtgcgtgctcagt

SEQ ID NO: 1842709 - DNA, 18 bp, Homo sapiens
agtgctaagcattagctt

SEQ ID NO: 1842710 - DNA, 19 bp, Homo sapiens
agtgctaagcattagcttt

SEQ ID NO: 1842711 - DNA, 20 bp, Homo sapiens
agtgctaagcattagcttta

SEQ ID NO: 1842712 - DNA, 15 bp, Homo sapiens
agtgcttgccacaga

SEQ ID NO: 1842713 - DNA, 19 bp, Homo sapiens
agtgcttgccacagagcgg

SEQ ID NO: 1842714 - DNA, 13 bp, Homo sapiens
agtgcttgctttt

SEQ ID NO: 1842715 - DNA, 22 bp, Homo sapiens
agtgcttgcttttcatgcaaac

SEQ ID NO: 1842716 - DNA, 11 bp, Homo sapiens
agtggaaaaat

SEQ ID NO: 1842717 - DNA, 18 bp, Homo sapiens
agtggagatcccacatat

SEQ ID NO: 1842718 - DNA, 18 bp, Homo sapiens
agtggccaagatcacagt

SEQ ID NO: 1842719 - DNA, 22 bp, Homo sapiens
agtggccaagatcacagtggcc

SEQ ID NO: 1842720 - DNA, 23 bp, Homo sapiens
agtggccaagatcacagtggcca

SEQ ID NO: 1842721 - DNA, 13 bp, Homo sapiens
agtggctgctgcc

SEQ ID NO: 1842722 - DNA, 17 bp, Homo sapiens
agtggctgctgcccagg

SEQ ID NO: 1842723 - DNA, 19 bp, Homo sapiens
agtggctgctgcccaggcc

SEQ ID NO: 1842724 - DNA, 22 bp, Homo sapiens
agtggctgctgcccaggcccag

SEQ ID NO: 1842725 - DNA, 20 bp, Homo sapiens
agtggcttcattagagcagg

SEQ ID NO: 1842726 - DNA, 22 bp, Homo sapiens
agtggcttcattagagcaggcg

SEQ ID NO: 1842727 - DNA, 22 bp, Homo sapiens
agtgggcccaatgcactttgtt

SEQ ID NO: 1842728 - DNA, 19 bp, Homo sapiens
agtgggtgaataatacagt

SEQ ID NO: 1842729 - DNA, 21 bp, Homo sapiens
agtgtccaaagcagggtctgg

SEQ ID NO: 1842730 - DNA, 21 bp, Homo sapiens
agtgtgcctgaagtcccagat

SEQ ID NO: 1842731 - DNA, 16 bp, Homo sapiens
agtgtggtgtttcctg

SEQ ID NO: 1842732 - DNA, 17 bp, Homo sapiens
agtgtggtgtttcctgg

SEQ ID NO: 1842733 - DNA, 19 bp, Homo sapiens
agtgtggtgtttcctggca

SEQ ID NO: 1842734 - DNA, 20 bp, Homo sapiens
agtgttctcatgaagcagga

SEQ ID NO: 1842735 - DNA, 22 bp, Homo sapiens
agtgttctcatgaagcaggagg

SEQ ID NO: 1842736 - DNA, 14 bp, Homo sapiens
agttaagcctttgg

SEQ ID NO: 1842737 - DNA, 20 bp, Homo sapiens
agttaggggagaggaaaagt

SEQ ID NO: 1842738 - DNA, 18 bp, Homo sapiens
agttcaccttggaagggc

SEQ ID NO: 1842739 - DNA, 18 bp, Homo sapiens
agttccaccatcaagcca

SEQ ID NO: 1842740 - DNA, 23 bp, Homo sapiens
agttcctcattagcattttgcta

SEQ ID NO: 1842741 - DNA, 20 bp, Homo sapiens
agttcctgagaccagccaac

SEQ ID NO: 1842742 - DNA, 17 bp, Homo sapiens
agttgaaaaacagctga

SEQ ID NO: 1842743 - DNA, 14 bp, Homo sapiens
agttgatagcacag

SEQ ID NO: 1842744 - DNA, 15 bp, Homo sapiens
agttgatagcacaga

SEQ ID NO: 1842745 - DNA, 19 bp, Homo sapiens
agttgatagcacagaccct

SEQ ID NO: 1842746 - DNA, 20 bp, Homo sapiens
agttgatagcacagaccctg

SEQ ID NO: 1842747 - DNA, 15 bp, Homo sapiens
agttgatatagaaca

SEQ ID NO: 1842748 - DNA, 15 bp, Homo sapiens
agttgcaatagaaca

SEQ ID NO: 1842749 - DNA, 19 bp, Homo sapiens
agttggaaggatctgctga

SEQ ID NO: 1842750 - DNA, 11 bp, Homo sapiens
agttggtcccc

SEQ ID NO: 1842751 - DNA, 21 bp, Homo sapiens
agttgtttgattcagacagct

SEQ ID NO: 1842752 - DNA, 15 bp, Homo sapiens
agtttccttggctgg

SEQ ID NO: 1842753 - DNA, 18 bp, Homo sapiens
agtttccttggctggtgc

SEQ ID NO: 1842754 - DNA, 19 bp, Homo sapiens
agtttgagatcagcctggg

SEQ ID NO: 1842755 - DNA, 22 bp, Homo sapiens
agttttggttgctttaatatca

SEQ ID NO: 1842756 - DNA, 17 bp, Homo sapiens
agttttgtctgtctccc

SEQ ID NO: 1842757 - DNA, 20 bp, Homo sapiens
ataaaaggtcggaccagctt

SEQ ID NO: 1842758 - DNA, 13 bp, Homo sapiens
ataaacaagaaaa

SEQ ID NO: 1842759 - DNA, 17 bp, Homo sapiens
ataaacaagaaaaataa

SEQ ID NO: 1842760 - DNA, 21 bp, Homo sapiens
ataaacaagaaaaataaagaa

SEQ ID NO: 1842761 - DNA, 17 bp, Homo sapiens
ataaacatgtgccctca

SEQ ID NO: 1842762 - DNA, 16 bp, Homo sapiens
ataaagaaaagatgca

SEQ ID NO: 1842763 - DNA, 17 bp, Homo sapiens
ataaagaaaagatgcac

SEQ ID NO: 1842764 - DNA, 20 bp, Homo sapiens
ataaagacgttttataagca

SEQ ID NO: 1842765 - DNA, 21 bp, Homo sapiens
ataaagagagaaaaacaaatt

SEQ ID NO: 1842766 - DNA, 12 bp, Homo sapiens
ataaatatatta

SEQ ID NO: 1842767 - DNA, 22 bp, Homo sapiens
ataaatatattattacttgtaa

SEQ ID NO: 1842768 - DNA, 16 bp, Homo sapiens
ataaatcgcttttgat

SEQ ID NO: 1842769 - DNA, 21 bp, Homo sapiens
ataaatcgcttttgataatca

SEQ ID NO: 1842770 - DNA, 21 bp, Homo sapiens
ataaattccctggcctttcat

SEQ ID NO: 1842771 - DNA, 14 bp, Homo sapiens
ataacacacagcta

SEQ ID NO: 1842772 - DNA, 23 bp, Homo sapiens
ataacacacagctaacacacagc

SEQ ID NO: 1842773 - DNA, 19 bp, Homo sapiens
ataacatcgaaaagttatt

SEQ ID NO: 1842774 - DNA, 20 bp, Homo sapiens
ataaccaattcctcatttgt

SEQ ID NO: 1842775 - DNA, 18 bp, Homo sapiens
ataactgttatttataat

SEQ ID NO: 1842776 - DNA, 17 bp, Homo sapiens
ataagagtaacagtcat

SEQ ID NO: 1842777 - DNA, 22 bp, Homo sapiens
ataagagtaacagtcatcattt

SEQ ID NO: 1842778 - DNA, 15 bp, Homo sapiens
ataagcatcattatt

SEQ ID NO: 1842779 - DNA, 19 bp, Homo sapiens
ataagcatcattatttatg

SEQ ID NO: 1842780 - DNA, 16 bp, Homo sapiens
ataagctatttttcta

SEQ ID NO: 1842781 - DNA, 18 bp, Homo sapiens
ataagctatttttctaac

SEQ ID NO: 1842782 - DNA, 23 bp, Homo sapiens
ataataaattccctggcctttca

SEQ ID NO: 1842783 - DNA, 12 bp, Homo sapiens
ataattggaata

SEQ ID NO: 1842784 - DNA, 21 bp, Homo sapiens
ataatttttatttttggcaaa

SEQ ID NO: 1842785 - DNA, 16 bp, Homo sapiens
atacagaggcaactgc

SEQ ID NO: 1842786 - DNA, 14 bp, Homo sapiens
atacccacccccac

SEQ ID NO: 1842787 - DNA, 16 bp, Homo sapiens
atacccacccccaccc

SEQ ID NO: 1842788 - DNA, 17 bp, Homo sapiens
atacccacccccaccca

SEQ ID NO: 1842789 - DNA, 16 bp, Homo sapiens
atacctaattgtggat

SEQ ID NO: 1842790 - DNA, 15 bp, Homo sapiens
atacctacatgtatt

SEQ ID NO: 1842791 - DNA, 13 bp, Homo sapiens
atacctggcctca

SEQ ID NO: 1842792 - DNA, 22 bp, Homo sapiens
atacctggcctcatttaaaaca

SEQ ID NO: 1842793 - DNA, 13 bp, Homo sapiens
atacctgtccccc

SEQ ID NO: 1842794 - DNA, 15 bp, Homo sapiens
atacctgtccccctg

SEQ ID NO: 1842795 - DNA, 17 bp, Homo sapiens
atacctgtccccctgac

SEQ ID NO: 1842796 - DNA, 19 bp, Homo sapiens
atactaggaagtaaagtga

SEQ ID NO: 1842797 - DNA, 18 bp, Homo sapiens
atactgattgggaggtgc

SEQ ID NO: 1842798 - DNA, 22 bp, Homo sapiens
atactgattgggaggtgcgtgt

SEQ ID NO: 1842799 - DNA, 20 bp, Homo sapiens
atactgccttgtttaatggt

SEQ ID NO: 1842800 - DNA, 16 bp, Homo sapiens
atactgtttgaggttt

SEQ ID NO: 1842801 - DNA, 13 bp, Homo sapiens
atacttaacttta

SEQ ID NO: 1842802 - DNA, 16 bp, Homo sapiens
atacttaactttacta

SEQ ID NO: 1842803 - DNA, 15 bp, Homo sapiens
atacttcgacactgt

SEQ ID NO: 1842804 - DNA, 15 bp, Homo sapiens
atagaagcttaaaat

SEQ ID NO: 1842805 - DNA, 18 bp, Homo sapiens
atagacccacaagaggca

SEQ ID NO: 1842806 - DNA, 15 bp, Homo sapiens
atagacttgggatgg

SEQ ID NO: 1842807 - DNA, 17 bp, Homo sapiens
atagcacagaccctgcc

SEQ ID NO: 1842808 - DNA, 16 bp, Homo sapiens
attccccaggaggcca

SEQ ID NO: 1842809 - DNA, 20 bp, Homo sapiens
attccccaggaggccagcct

SEQ ID NO: 1842810 - DNA, 13 bp, Homo sapiens
attccctggcctt

SEQ ID NO: 1842811 - DNA, 15 bp, Homo sapiens
attctatgttaatat

SEQ ID NO: 1842812 - DNA, 16 bp, Homo sapiens
attctcagggtctctg

SEQ ID NO: 1842813 - DNA, 17 bp, Homo sapiens
attctcagggtctctgc

SEQ ID NO: 1842814 - DNA, 18 bp, Homo sapiens
attctcagggtctctgct

SEQ ID NO: 1842815 - DNA, 19 bp, Homo sapiens
attctcagggtctctgctg

SEQ ID NO: 1842816 - DNA, 21 bp, Homo sapiens
attctcagggtctctgctgcc

SEQ ID NO: 1842817 - DNA, 22 bp, Homo sapiens
attctcattggaaatttagcat

SEQ ID NO: 1842818 - DNA, 13 bp, Homo sapiens
attctccacctgc

SEQ ID NO: 1842819 - DNA, 16 bp, Homo sapiens
attctccacctgccag

SEQ ID NO: 1842820 - DNA, 17 bp, Homo sapiens
attctccacctgccagg

SEQ ID NO: 1842821 - DNA, 20 bp, Homo sapiens
attctccacctgccagggac

SEQ ID NO: 1842822 - DNA, 15 bp, Homo sapiens
attcttagcaaaaaa

SEQ ID NO: 1842823 - DNA, 16 bp, Homo sapiens
attcttagcaaaaaat

SEQ ID NO: 1842824 - DNA, 22 bp, Homo sapiens
attcttagcaaaaaatgaacag

SEQ ID NO: 1842825 - DNA, 20 bp, Homo sapiens
attcttccctatctttgcca

SEQ ID NO: 1842826 - DNA, 13 bp, Homo sapiens
attcttcctccct

SEQ ID NO: 1842827 - DNA, 22 bp, Homo sapiens
attctttcctgaggctgggctc

SEQ ID NO: 1842828 - DNA, 13 bp, Homo sapiens
attctttgttctg

SEQ ID NO: 1842829 - DNA, 14 bp, Homo sapiens
attctttgttctgt

SEQ ID NO: 1842830 - DNA, 16 bp, Homo sapiens
attgataagagggcac

SEQ ID NO: 1842831 - DNA, 22 bp, Homo sapiens
attgataagagggcacacactg

SEQ ID NO: 1842832 - DNA, 22 bp, Homo sapiens
attgccaagctcaggaccaggc

SEQ ID NO: 1842833 - DNA, 16 bp, Homo sapiens
attgctcacccagtgc

SEQ ID NO: 1842834 - DNA, 23 bp, Homo sapiens
attgctcacccagtgccctctcc

SEQ ID NO: 1842835 - DNA, 22 bp, Homo sapiens
attggagaagtaatcctaggga

SEQ ID NO: 1842836 - DNA, 19 bp, Homo sapiens
attggtgtttttttctatg

SEQ ID NO: 1842837 - DNA, 14 bp, Homo sapiens
attgtagtgctttg

SEQ ID NO: 1842838 - DNA, 17 bp, Homo sapiens
attgtccccgacccttg

SEQ ID NO: 1842839 - DNA, 15 bp, Homo sapiens
attgtgcaatgtgta

SEQ ID NO: 1842840 - DNA, 17 bp, Homo sapiens
attgtgcaatgtgtata

SEQ ID NO: 1842841 - DNA, 11 bp, Homo sapiens
attgtggaaaa

SEQ ID NO: 1842842 - DNA, 16 bp, Homo sapiens
attgtggaaaaccagg

SEQ ID NO: 1842843 - DNA, 14 bp, Homo sapiens
attgtgggaagggg

SEQ ID NO: 1842844 - DNA, 18 bp, Homo sapiens
attgtgtctcttggtcct

SEQ ID NO: 1842845 - DNA, 14 bp, Homo sapiens
atttaaaaaaaatc

SEQ ID NO: 1842846 - DNA, 15 bp, Homo sapiens
atttaagatatgtaa

SEQ ID NO: 1842847 - DNA, 11 bp, Homo sapiens
atttaataaag

SEQ ID NO: 1842848 - DNA, 14 bp, Homo sapiens
atttaccctttggc

SEQ ID NO: 1842849 - DNA, 20 bp, Homo sapiens
atttaccctttggccccact

SEQ ID NO: 1842850 - DNA, 22 bp, Homo sapiens
atttagcattgtagtgctttga

SEQ ID NO: 1842851 - DNA, 15 bp, Homo sapiens
atttataatcacttt

SEQ ID NO: 1842852 - DNA, 23 bp, Homo sapiens
atttataatcacttttttccaca

SEQ ID NO: 1842853 - DNA, 12 bp, Homo sapiens
atttatgtattg

SEQ ID NO: 1842854 - DNA, 22 bp, Homo sapiens
atttatgtattgtgcaatgtgt

SEQ ID NO: 1842855 - DNA, 13 bp, Homo sapiens
atttattaaagaa

SEQ ID NO: 1842856 - DNA, 18 bp, Homo sapiens
atttattaaagaaaaaaa

SEQ ID NO: 1842857 - DNA, 20 bp, Homo sapiens
atttattaaagaaaaaaatg

SEQ ID NO: 1842858 - DNA, 20 bp, Homo sapiens
atttattaaatgcccagccc

SEQ ID NO: 1842859 - DNA, 15 bp, Homo sapiens
atttattgaaatgat

SEQ ID NO: 1842860 - DNA, 16 bp, Homo sapiens
atttatttatttattc

SEQ ID NO: 1842861 - DNA, 12 bp, Homo sapiens
atttcacttgtc

SEQ ID NO: 1842862 - DNA, 22 bp, Homo sapiens
atttcatttgtgccagaatgct

SEQ ID NO: 1842863 - DNA, 17 bp, Homo sapiens
atttccagccaaagcct

SEQ ID NO: 1842864 - DNA, 16 bp, Homo sapiens
atttctaagcctttga

SEQ ID NO: 1842865 - DNA, 15 bp, Homo sapiens
atttctcatgttgaa

SEQ ID NO: 1842866 - DNA, 14 bp, Homo sapiens
atttctgttctcat

SEQ ID NO: 1842867 - DNA, 12 bp, Homo sapiens
atttgagacagg

SEQ ID NO: 1842868 - DNA, 16 bp, Homo sapiens
atttgcaaggctgatt

SEQ ID NO: 1842869 - DNA, 21 bp, Homo sapiens
atttgcaaggctgatttatgg

SEQ ID NO: 1842870 - DNA, 15 bp, Homo sapiens
atttggcctcttgta

SEQ ID NO: 1842871 - DNA, 14 bp, Homo sapiens
atttgtgccagaat

SEQ ID NO: 1842872 - DNA, 15 bp, Homo sapiens
atttgttcattaaac

SEQ ID NO: 1842873 - DNA, 21 bp, Homo sapiens
attttaaaatgaaatgcattt

SEQ ID NO: 1842874 - DNA, 16 bp, Homo sapiens
attttataaatcgctt

SEQ ID NO: 1842875 - DNA, 13 bp, Homo sapiens
attttatgtcttt

SEQ ID NO: 1842876 - DNA, 14 bp, Homo sapiens
attttatgttatat

SEQ ID NO: 1842877 - DNA, 19 bp, Homo sapiens
attttccctattagagaag

SEQ ID NO: 1842878 - DNA, 16 bp, Homo sapiens
attttcctgccaggca

SEQ ID NO: 1842879 - DNA, 23 bp, Homo sapiens
attttgcacctgcagccaagcaa

SEQ ID NO: 1842880 - DNA, 19 bp, Homo sapiens
attttgtgcccccatgtaa

SEQ ID NO: 1842881 - DNA, 22 bp, Homo sapiens
attttgtttttgtcttaaaaag

SEQ ID NO: 1842882 - DNA, 16 bp, Homo sapiens
atttttaaaatgtaca

SEQ ID NO: 1842883 - DNA, 23 bp, Homo sapiens
atttttatgtaattatatatact

SEQ ID NO: 1842884 - DNA, 14 bp, Homo sapiens
atttttttcacctc

SEQ ID NO: 1842885 - DNA, 19 bp, Homo sapiens
attttttttctgttatata

SEQ ID NO: 1842886 - DNA, 13 bp, Homo sapiens
atttttttttcca

SEQ ID NO: 1842887 - DNA, 21 bp, Homo sapiens
caaaaacatgcttttccaaac

SEQ ID NO: 1842888 - DNA, 21 bp, Homo sapiens
caaaactctcctctgctgctg

SEQ ID NO: 1842889 - DNA, 23 bp, Homo sapiens
caaaactctcctctgctgctggc

SEQ ID NO: 1842890 - DNA, 16 bp, Homo sapiens
caaaagatgcttctca

SEQ ID NO: 1842891 - DNA, 18 bp, Homo sapiens
caaaagatgcttctcact

SEQ ID NO: 1842892 - DNA, 15 bp, Homo sapiens
caaaagcccattcat

SEQ ID NO: 1842893 - DNA, 19 bp, Homo sapiens
caaaagcccattcattcca

SEQ ID NO: 1842894 - DNA, 20 bp, Homo sapiens
caaaagcccattcattccat

SEQ ID NO: 1842895 - DNA, 17 bp, Homo sapiens
caaaatcagaatggaat

SEQ ID NO: 1842896 - DNA, 21 bp, Homo sapiens
caaaatgagccctgtcctgcc

SEQ ID NO: 1842897 - DNA, 19 bp, Homo sapiens
caaacacatttaccctttg

SEQ ID NO: 1842898 - DNA, 16 bp, Homo sapiens
caaacccagaggtgga

SEQ ID NO: 1842899 - DNA, 15 bp, Homo sapiens
caaacctgcctgggt

SEQ ID NO: 1842900 - DNA, 16 bp, Homo sapiens
caaacctgcctgggtt

SEQ ID NO: 1842901 - DNA, 14 bp, Homo sapiens
caaagaggttttaa

SEQ ID NO: 1842902 - DNA, 21 bp, Homo sapiens
caaagaggttttaaaaaaatc

SEQ ID NO: 1842903 - DNA, 20 bp, Homo sapiens
caaaggaataacctttctgg

SEQ ID NO: 1842904 - DNA, 13 bp, Homo sapiens
caaaggccatgga

SEQ ID NO: 1842905 - DNA, 14 bp, Homo sapiens
caaaggctgagaac

SEQ ID NO: 1842906 - DNA, 11 bp, Homo sapiens
caaaggctggg

SEQ ID NO: 1842907 - DNA, 23 bp, Homo sapiens
caaagggcatgggtcgggagagg

SEQ ID NO: 1842908 - DNA, 20 bp, Homo sapiens
caaaggtttaaatgaacaag

SEQ ID NO: 1842909 - DNA, 15 bp, Homo sapiens
caaataaagtctctt

SEQ ID NO: 1842910 - DNA, 19 bp, Homo sapiens
caaatgcccaagggaaaga

SEQ ID NO: 1842911 - DNA, 17 bp, Homo sapiens
caaatgcctgccaaatt

SEQ ID NO: 1842912 - DNA, 19 bp, Homo sapiens
caaatggaagacacattga

SEQ ID NO: 1842913 - DNA, 15 bp, Homo sapiens
caaattaaaaaagat

SEQ ID NO: 1842914 - DNA, 16 bp, Homo sapiens
caaattaaaaaagata

SEQ ID NO: 1842915 - DNA, 17 bp, Homo sapiens
caaattaaaaaagataa

SEQ ID NO: 1842916 - DNA, 15 bp, Homo sapiens
caacaagttgaagaa

SEQ ID NO: 1842917 - DNA, 20 bp, Homo sapiens
caacacctctgcacaagctg

SEQ ID NO: 1842918 - DNA, 22 bp, Homo sapiens
caacacctctgcacaagctgca

SEQ ID NO: 1842919 - DNA, 14 bp, Homo sapiens
caacactcaagtct

SEQ ID NO: 1842920 - DNA, 20 bp, Homo sapiens
caacactcattgacctgagg

SEQ ID NO: 1842921 - DNA, 21 bp, Homo sapiens
caacattacagggaatgcctg

SEQ ID NO: 1842922 - DNA, 16 bp, Homo sapiens
caaccacctttcagat

SEQ ID NO: 1842923 - DNA, 23 bp, Homo sapiens
caaccagaaacacccctctgtct

SEQ ID NO: 1842924 - DNA, 23 bp, Homo sapiens
caaccatgagtggcatggccacc

SEQ ID NO: 1842925 - DNA, 12 bp, Homo sapiens
caaccctcatca

SEQ ID NO: 1842926 - DNA, 15 bp, Homo sapiens
caaccctcatcacca

SEQ ID NO: 1842927 - DNA, 21 bp, Homo sapiens
caacctgattgtgtctcttgg

SEQ ID NO: 1842928 - DNA, 15 bp, Homo sapiens
caactcaccccagcc

SEQ ID NO: 1842929 - DNA, 16 bp, Homo sapiens
caactcaccccagccc

SEQ ID NO: 1842930 - DNA, 20 bp, Homo sapiens
ccaaaggccatggagagctg

SEQ ID NO: 1842931 - DNA, 14 bp, Homo sapiens
ccaaataaagtctc

SEQ ID NO: 1842932 - DNA, 15 bp, Homo sapiens
ccaaattaaaaaaga

SEQ ID NO: 1842933 - DNA, 21 bp, Homo sapiens
ccaaattttagatttaccttg

SEQ ID NO: 1842934 - DNA, 14 bp, Homo sapiens
ccaacactcaagaa

SEQ ID NO: 1842935 - DNA, 19 bp, Homo sapiens
ccaacatactcccatctgt

SEQ ID NO: 1842936 - DNA, 13 bp, Homo sapiens
ccaggggtgggac

SEQ ID NO: 1842937 - DNA, 14 bp, Homo sapiens
ccaggggtgggaca

SEQ ID NO: 1842938 - DNA, 21 bp, Homo sapiens
ccaggggtgggacaccctgtg

SEQ ID NO: 1842939 - DNA, 22 bp, Homo sapiens
ccaggggtgggacaccctgtga

SEQ ID NO: 1842940 - DNA, 21 bp, Homo sapiens
ccaggtactgatcctgtttct

SEQ ID NO: 1842941 - DNA, 24 bp, Homo sapiens
ccaggtgcacaagctccaagctcc

SEQ ID NO: 1842942 - DNA, 19 bp, Homo sapiens
ccaggtgctaggaacactc

SEQ ID NO: 1842943 - DNA, 21 bp, Homo sapiens
ccaggtgctaggaacactcct

SEQ ID NO: 1842944 - DNA, 13 bp, Homo sapiens
ccaggtttaagct

SEQ ID NO: 1842945 - DNA, 17 bp, Homo sapiens
ccagtaaacagaggagt

SEQ ID NO: 1842946 - DNA, 18 bp, Homo sapiens
ccagtacctcctgtctct

SEQ ID NO: 1842947 - DNA, 20 bp, Homo sapiens
ccagtacctcctgtctctgg

SEQ ID NO: 1842948 - DNA, 15 bp, Homo sapiens
ccagtcatctgtaag

SEQ ID NO: 1842949 - DNA, 20 bp, Homo sapiens
ccagtgaaatcagttactct

SEQ ID NO: 1842950 - DNA, 15 bp, Homo sapiens
ccagtgaacattccc

SEQ ID NO: 1842951 - DNA, 17 bp, Homo sapiens
ccagtgaacattcccag

SEQ ID NO: 1842952 - DNA, 14 bp, Homo sapiens
ccagtgagatgcat

SEQ ID NO: 1842953 - DNA, 13 bp, Homo sapiens
ccagtgaggctct

SEQ ID NO: 1842954 - DNA, 16 bp, Homo sapiens
ccagtgaggctctgcc

SEQ ID NO: 1842955 - DNA, 21 bp, Homo sapiens
ccagtgctagttctgacccaa

SEQ ID NO: 1842956 - DNA, 13 bp, Homo sapiens
ccagtggctgctg

SEQ ID NO: 1842957 - DNA, 19 bp, Homo sapiens
ccagtggctgctgcccagg

SEQ ID NO: 1842958 - DNA, 13 bp, Homo sapiens
ccagttggtcccc

SEQ ID NO: 1842959 - DNA, 20 bp, Homo sapiens
ccagttggtcccccttccat

SEQ ID NO: 1842960 - DNA, 23 bp, Homo sapiens
ccagttggtcccccttccatgga

SEQ ID NO: 1842961 - DNA, 17 bp, Homo sapiens
ccataaccgctgattct

SEQ ID NO: 1842962 - DNA, 13 bp, Homo sapiens
ccataggcccagt

SEQ ID NO: 1842963 - DNA, 12 bp, Homo sapiens
ccataggtcacc

SEQ ID NO: 1842964 - DNA, 16 bp, Homo sapiens
ccatcaagccaccaac

SEQ ID NO: 1842965 - DNA, 12 bp, Homo sapiens
ccatcacccgct

SEQ ID NO: 1842966 - DNA, 23 bp, Homo sapiens
ccatcagaaacaccctcacactg

SEQ ID NO: 1842967 - DNA, 14 bp, Homo sapiens
ccatcccagcccca

SEQ ID NO: 1842968 - DNA, 16 bp, Homo sapiens
ccatcctaggctgaca

SEQ ID NO: 1842969 - DNA, 19 bp, Homo sapiens
ccatcctctgtacagagcc

SEQ ID NO: 1842970 - DNA, 22 bp, Homo sapiens
ccatcctgtgtgttaagctctg

SEQ ID NO: 1842971 - DNA, 20 bp, Homo sapiens
ccatctcacacatgagcatc

SEQ ID NO: 1842972 - DNA, 15 bp, Homo sapiens
ccatctctggatgcc

SEQ ID NO: 1842973 - DNA, 22 bp, Homo sapiens
ccatctctggatgcctgattgc

SEQ ID NO: 1842974 - DNA, 15 bp, Homo sapiens
ccatctgctcctgga

SEQ ID NO: 1842975 - DNA, 14 bp, Homo sapiens
ccatgagtcccctg

SEQ ID NO: 1842976 - DNA, 15 bp, Homo sapiens
ccatgagtcccctgt

SEQ ID NO: 1842977 - DNA, 22 bp, Homo sapiens
ccatgcagacctcatgcccagc

SEQ ID NO: 1842978 - DNA, 15 bp, Homo sapiens
ccatgcagctgctcc

SEQ ID NO: 1842979 - DNA, 15 bp, Homo sapiens
ccatgctcctggccc

SEQ ID NO: 1842980 - DNA, 13 bp, Homo sapiens
ccatggactttgt

SEQ ID NO: 1842981 - DNA, 15 bp, Homo sapiens
ccatggagagctgga

SEQ ID NO: 1842982 - DNA, 14 bp, Homo sapiens
ccatgtagaagctg

SEQ ID NO: 1842983 - DNA, 18 bp, Homo sapiens
ccatgttttgtttacggt

SEQ ID NO: 1842984 - DNA, 15 bp, Homo sapiens
ccattctccacctgc

SEQ ID NO: 1842985 - DNA, 19 bp, Homo sapiens
ccattctccacctgccagg

SEQ ID NO: 1842986 - DNA, 20 bp, Homo sapiens
ccattctccacctgccaggg

SEQ ID NO: 1842987 - DNA, 21 bp, Homo sapiens
ccatttgcgttccatgatgct

SEQ ID NO: 1842988 - DNA, 21 bp, Homo sapiens
ccattttgtattttactaata

SEQ ID NO: 1842989 - DNA, 17 bp, Homo sapiens
ccattttttcttccctt

SEQ ID NO: 1842990 - DNA, 23 bp, Homo sapiens
ccattttttcttcccttttccct

SEQ ID NO: 1842991 - DNA, 16 bp, Homo sapiens
cccaactcaccccagc

SEQ ID NO: 1842992 - DNA, 20 bp, Homo sapiens
cccaactcaccccagcccca

SEQ ID NO: 1842993 - DNA, 17 bp, Homo sapiens
cccaagcggtgtctctc

SEQ ID NO: 1842994 - DNA, 17 bp, Homo sapiens
cccaagggaaagaaaag

SEQ ID NO: 1842995 - DNA, 18 bp, Homo sapiens
cccaagggcctggcctga

SEQ ID NO: 1842996 - DNA, 17 bp, Homo sapiens
cccaaggtaccatccta

SEQ ID NO: 1842997 - DNA, 19 bp, Homo sapiens
cccacagcgctggccggga

SEQ ID NO: 1842998 - DNA, 17 bp, Homo sapiens
cccacccccacccaagg

SEQ ID NO: 1842999 - DNA, 14 bp, Homo sapiens
cccacctctctcac

SEQ ID NO: 1843000 - DNA, 17 bp, Homo sapiens
cccacctggcctctgca

SEQ ID NO: 1843001 - DNA, 17 bp, Homo sapiens
cccacgcccccactggt

SEQ ID NO: 1843002 - DNA, 19 bp, Homo sapiens
cccacgcccccactggtga

SEQ ID NO: 1843003 - DNA, 13 bp, Homo sapiens
cccactccctgca

SEQ ID NO: 1843004 - DNA, 19 bp, Homo sapiens
cccagactctttttttgag

SEQ ID NO: 1843005 - DNA, 15 bp, Homo sapiens
cccagagggcctgca

SEQ ID NO: 1843006 - DNA, 18 bp, Homo sapiens
cccagagggcctgcaagg

SEQ ID NO: 1843007 - DNA, 14 bp, Homo sapiens
cccagccccatcct

SEQ ID NO: 1843008 - DNA, 18 bp, Homo sapiens
cccagccccatcctctgt

SEQ ID NO: 1843009 - DNA, 19 bp, Homo sapiens
cccagccccatcctctgta

SEQ ID NO: 1843010 - DNA, 22 bp, Homo sapiens
cccagccccgccccgttgtgag

SEQ ID NO: 1843011 - DNA, 16 bp, Homo sapiens
cccagctctggtccat

SEQ ID NO: 1843012 - DNA, 18 bp, Homo sapiens
cccagctctggtccatag

SEQ ID NO: 1843013 - DNA, 23 bp, Homo sapiens
cccagctctggtccatagagagc

SEQ ID NO: 1843014 - DNA, 15 bp, Homo sapiens
cccaggaaaggctcc

SEQ ID NO: 1843015 - DNA, 19 bp, Homo sapiens
cccaggaaaggctccagga

SEQ ID NO: 1843016 - DNA, 17 bp, Homo sapiens
cccaggcattccccagg

SEQ ID NO: 1843017 - DNA, 20 bp, Homo sapiens
cccaggcattccccaggagg

SEQ ID NO: 1843018 - DNA, 13 bp, Homo sapiens
cccaggctgggca

SEQ ID NO: 1843019 - DNA, 23 bp, Homo sapiens
cccaggtgctaggaacactcctt

SEQ ID NO: 1843020 - DNA, 13 bp, Homo sapiens
cccaggtttctgg

SEQ ID NO: 1843021 - DNA, 19 bp, Homo sapiens
cccaggtttctggtctcta

SEQ ID NO: 1843022 - DNA, 22 bp, Homo sapiens
cccaggtttctggtctctaggc

SEQ ID NO: 1843023 - DNA, 14 bp, Homo sapiens
cccagtacctcctg

SEQ ID NO: 1843024 - DNA, 14 bp, Homo sapiens
cccagtggctgctg

SEQ ID NO: 1843025 - DNA, 15 bp, Homo sapiens
cccagtggctgctgc

SEQ ID NO: 1843026 - DNA, 21 bp, Homo sapiens
cccagtggctgctgcccaggc

SEQ ID NO: 1843027 - DNA, 14 bp, Homo sapiens
cccagttagctctc

SEQ ID NO: 1843028 - DNA, 15 bp, Homo sapiens
cccatcctctgtaca

SEQ ID NO: 1843029 - DNA, 19 bp, Homo sapiens
cccatcctctgtacagagc

SEQ ID NO: 1843030 - DNA, 19 bp, Homo sapiens
cccatctctacaaaaagca

SEQ ID NO: 1843031 - DNA, 12 bp, Homo sapiens
cccatctgtgaa

SEQ ID NO: 1843032 - DNA, 20 bp, Homo sapiens
cccatctgtgaaaggaaaga

SEQ ID NO: 1843033 - DNA, 17 bp, Homo sapiens
cccatgacccaggctgg

SEQ ID NO: 1843034 - DNA, 18 bp, Homo sapiens
cccatgacccaggctggg

SEQ ID NO: 1843035 - DNA, 19 bp, Homo sapiens
cccatgacccaggctgggc

SEQ ID NO: 1843036 - DNA, 19 bp, Homo sapiens
cccatgcagctgctcccca

SEQ ID NO: 1843037 - DNA, 16 bp, Homo sapiens
cccatgctgccctgtg

SEQ ID NO: 1843038 - DNA, 19 bp, Homo sapiens
cccattgttgtcaaggaag

SEQ ID NO: 1843039 - DNA, 20 bp, Homo sapiens
cccattgttgtcaaggaaga

SEQ ID NO: 1843040 - DNA, 20 bp, Homo sapiens
ccccaaaactctcctctgct

SEQ ID NO: 1843041 - DNA, 15 bp, Homo sapiens
ccccacagtgccacc

SEQ ID NO: 1843042 - DNA, 16 bp, Homo sapiens
ccccacagtgccaccc

SEQ ID NO: 1843043 - DNA, 14 bp, Homo sapiens
ccccacccaagggc

SEQ ID NO: 1843044 - DNA, 15 bp, Homo sapiens
ccccaccttgtctgc

SEQ ID NO: 1843045 - DNA, 12 bp, Homo sapiens
ccccactggtga

SEQ ID NO: 1843046 - DNA, 13 bp, Homo sapiens
ccccactggtgac

SEQ ID NO: 1843047 - DNA, 14 bp, Homo sapiens
ccccactggtgaca

SEQ ID NO: 1843048 - DNA, 13 bp, Homo sapiens
ccccactttgaag

SEQ ID NO: 1843049 - DNA, 13 bp, Homo sapiens
ccccagaggctgg

SEQ ID NO: 1843050 - DNA, 10 bp, Homo sapiens
ccccagcccc

SEQ ID NO: 1843051 - DNA, 12 bp, Homo sapiens
ccccagccccaa

SEQ ID NO: 1843052 - DNA, 14 bp, Homo sapiens
ccccagccccaaaa

SEQ ID NO: 1843053 - DNA, 14 bp, Homo sapiens
ccccagccccatcc

SEQ ID NO: 1843054 - DNA, 15 bp, Homo sapiens
ccccaggaggccagc

SEQ ID NO: 1843055 - DNA, 13 bp, Homo sapiens
ccccaggccaccc

SEQ ID NO: 1843056 - DNA, 14 bp, Homo sapiens
ccccatcctctgta

SEQ ID NO: 1843057 - DNA, 22 bp, Homo sapiens
cccccaaatggaaatgggcaga

SEQ ID NO: 1843058 - DNA, 13 bp, Homo sapiens
cccccacccaagg

SEQ ID NO: 1843059 - DNA, 21 bp, Homo sapiens
cagctgggtggcactgccatg

SEQ ID NO: 1843060 - DNA, 22 bp, Homo sapiens
cagctgtgtctgccaaacacat

SEQ ID NO: 1843061 - DNA, 15 bp, Homo sapiens
cagctgttcagctgg

SEQ ID NO: 1843062 - DNA, 12 bp, Homo sapiens
cagctttgtttg

SEQ ID NO: 1843063 - DNA, 18 bp, Homo sapiens
cagcttttcccaaaagcc

SEQ ID NO: 1843064 - DNA, 22 bp, Homo sapiens
caggaaaggctccaggagcagc

SEQ ID NO: 1843065 - DNA, 23 bp, Homo sapiens
caggaaaggctccaggagcagcc

SEQ ID NO: 1843066 - DNA, 18 bp, Homo sapiens
caggaccaggcaatgtga

SEQ ID NO: 1843067 - DNA, 14 bp, Homo sapiens
caggactcagctcc

SEQ ID NO: 1843068 - DNA, 17 bp, Homo sapiens
caggactcagctcccca

SEQ ID NO: 1843069 - DNA, 18 bp, Homo sapiens
caggactcagctccccag

SEQ ID NO: 1843070 - DNA, 20 bp, Homo sapiens
caggactcagctccccagag

SEQ ID NO: 1843071 - DNA, 18 bp, Homo sapiens
caggactgcagagggctc

SEQ ID NO: 1843072 - DNA, 12 bp, Homo sapiens
caggagcagcca

SEQ ID NO: 1843073 - DNA, 14 bp, Homo sapiens
caggagcagccaca

SEQ ID NO: 1843074 - DNA, 16 bp, Homo sapiens
cacaggatgaaggcaa

SEQ ID NO: 1843075 - DNA, 21 bp, Homo sapiens
cacagggcctttggcaggtgc

SEQ ID NO: 1843076 - DNA, 18 bp, Homo sapiens
cacaggtgccgccagctg

SEQ ID NO: 1843077 - DNA, 21 bp, Homo sapiens
cacaggtgccgccagctgccg

SEQ ID NO: 1843078 - DNA, 23 bp, Homo sapiens
cacaggtgccgccagctgccgca

SEQ ID NO: 1843079 - DNA, 18 bp, Homo sapiens
cacaggtgggcttcccag

SEQ ID NO: 1843080 - DNA, 15 bp, Homo sapiens
cacagtccttaccag

SEQ ID NO: 1843081 - DNA, 13 bp, Homo sapiens
cacagtgccaccc

SEQ ID NO: 1843082 - DNA, 14 bp, Homo sapiens
cacagtgccaccca

SEQ ID NO: 1843083 - DNA, 16 bp, Homo sapiens
cacagtgtatgaaggg

SEQ ID NO: 1843084 - DNA, 21 bp, Homo sapiens
cacagtgtgtggtcaacattt

SEQ ID NO: 1843085 - DNA, 23 bp, Homo sapiens
cacagttttggttgctttaatat

SEQ ID NO: 1843086 - DNA, 22 bp, Homo sapiens
cacataattcaggaagcagctt

SEQ ID NO: 1843087 - DNA, 21 bp, Homo sapiens
cacatgagcatcaggccaggc

SEQ ID NO: 1843088 - DNA, 16 bp, Homo sapiens
cacatgtccaagaagc

SEQ ID NO: 1843089 - DNA, 13 bp, Homo sapiens
cacatgtggactt

SEQ ID NO: 1843090 - DNA, 18 bp, Homo sapiens
cacatttaccctttggcc

SEQ ID NO: 1843091 - DNA, 17 bp, Homo sapiens
cacatttctaagccttt

SEQ ID NO: 1843092 - DNA, 20 bp, Homo sapiens
caccaacatactcccatctg

SEQ ID NO: 1843093 - DNA, 23 bp, Homo sapiens
caccaacatactcccatctgtga

SEQ ID NO: 1843094 - DNA, 13 bp, Homo sapiens
caccaagctcaaa

SEQ ID NO: 1843095 - DNA, 15 bp, Homo sapiens
caccacggtggtcac

SEQ ID NO: 1843096 - DNA, 17 bp, Homo sapiens
ctccctattttttttct

SEQ ID NO: 1843097 - DNA, 20 bp, Homo sapiens
ctccctattttttttctgtt

SEQ ID NO: 1843098 - DNA, 22 bp, Homo sapiens
ctccctattttttttctgttat

SEQ ID NO: 1843099 - DNA, 17 bp, Homo sapiens
ctccctcccctctcaga

SEQ ID NO: 1843100 - DNA, 19 bp, Homo sapiens
ctccctcccctctcagaac

SEQ ID NO: 1843101 - DNA, 19 bp, Homo sapiens
ctcccttcatgcatggaaa

SEQ ID NO: 1843102 - DNA, 15 bp, Homo sapiens
ctcccttcccacctc

SEQ ID NO: 1843103 - DNA, 16 bp, Homo sapiens
ctcccttcccacctct

SEQ ID NO: 1843104 - DNA, 17 bp, Homo sapiens
ctcccttcccacctctc

SEQ ID NO: 1843105 - DNA, 17 bp, Homo sapiens
ctcccttggattgtccc

SEQ ID NO: 1843106 - DNA, 16 bp, Homo sapiens
ctcctcatccagggct

SEQ ID NO: 1843107 - DNA, 14 bp, Homo sapiens
ctcctccgtggcac

SEQ ID NO: 1843108 - DNA, 15 bp, Homo sapiens
ctcctccgtggcaca

SEQ ID NO: 1843109 - DNA, 13 bp, Homo sapiens
ctcctctcagccc

SEQ ID NO: 1843110 - DNA, 23 bp, Homo sapiens
ctcctgaaaaaaaacctgagatt

SEQ ID NO: 1843111 - DNA, 19 bp, Homo sapiens
ctcctgagtgcttgctttt

SEQ ID NO: 1843112 - DNA, 11 bp, Homo sapiens
ctcctgcaggc

SEQ ID NO: 1843113 - DNA, 15 bp, Homo sapiens
ctcctgcaggcagcc

SEQ ID NO: 1843114 - DNA, 18 bp, Homo sapiens
ctcctgcaggcagccagg

SEQ ID NO: 1843115 - DNA, 22 bp, Homo sapiens
ctcctgcaggcagccaggccac

SEQ ID NO: 1843116 - DNA, 14 bp, Homo sapiens
ctcctgcctgtgct

SEQ ID NO: 1843117 - DNA, 21 bp, Homo sapiens
ctcctggatctccctgagatg

SEQ ID NO: 1843118 - DNA, 20 bp, Homo sapiens
ctccttaacactgagctgtc

SEQ ID NO: 1843119 - DNA, 16 bp, Homo sapiens
ctccttcacagatggg

SEQ ID NO: 1843120 - DNA, 19 bp, Homo sapiens
ctccttcacagatgggtgc

SEQ ID NO: 1843121 - DNA, 16 bp, Homo sapiens
ctccttcacctttgtc

SEQ ID NO: 1843122 - DNA, 21 bp, Homo sapiens
ctccttcacctttgtccccac

SEQ ID NO: 1843123 - DNA, 21 bp, Homo sapiens
ctccttgaaaacactgttctc

SEQ ID NO: 1843124 - DNA, 16 bp, Homo sapiens
ctccttgtggcctggg

SEQ ID NO: 1843125 - DNA, 20 bp, Homo sapiens
ctcctttgcagaatgatgca

SEQ ID NO: 1843126 - DNA, 23 bp, Homo sapiens
ctcctttgtgaggaagccgctgg

SEQ ID NO: 1843127 - DNA, 16 bp, Homo sapiens
ctcggtgtggagaagc

SEQ ID NO: 1843128 - DNA, 14 bp, Homo sapiens
ctcgtcctcgtttg

SEQ ID NO: 1843129 - DNA, 14 bp, Homo sapiens
ctctaggctgggga

SEQ ID NO: 1843130 - DNA, 17 bp, Homo sapiens
ctctatatatacatcat

SEQ ID NO: 1843131 - DNA, 20 bp, Homo sapiens
ctctcaaccacctttcagat

SEQ ID NO: 1843132 - DNA, 22 bp, Homo sapiens
ctctcagcccctgatcctgtga

SEQ ID NO: 1843133 - DNA, 17 bp, Homo sapiens
ctctccaccttccaaag

SEQ ID NO: 1843134 - DNA, 19 bp, Homo sapiens
ctctccagcccctggatgc

SEQ ID NO: 1843135 - DNA, 17 bp, Homo sapiens
ctctcctccgtggcaca

SEQ ID NO: 1843136 - DNA, 18 bp, Homo sapiens
ctctcctctgctgctggc

SEQ ID NO: 1843137 - DNA, 12 bp, Homo sapiens
ctctctcactcc

SEQ ID NO: 1843138 - DNA, 19 bp, Homo sapiens
ctctgaagtgaaactgctt

SEQ ID NO: 1843139 - DNA, 23 bp, Homo sapiens
ctctgaagtgaaactgcttgttt

SEQ ID NO: 1843140 - DNA, 15 bp, Homo sapiens
ctctgacgcttgtga

SEQ ID NO: 1843141 - DNA, 23 bp, Homo sapiens
ctctgacgcttgtgacagtgcct

SEQ ID NO: 1843142 - DNA, 20 bp, Homo sapiens
ctctgatatgtctagggtgt

SEQ ID NO: 1843143 - DNA, 17 bp, Homo sapiens
ctctgcaatcttctcag

SEQ ID NO: 1843144 - DNA, 10 bp, Homo sapiens
ctctgcacaa

SEQ ID NO: 1843145 - DNA, 13 bp, Homo sapiens
ctctgcacaagct

SEQ ID NO: 1843146 - DNA, 15 bp, Homo sapiens
ctctgcacaagctgc

SEQ ID NO: 1843147 - DNA, 18 bp, Homo sapiens
ctctgcacaagctgcacc

SEQ ID NO: 1843148 - DNA, 21 bp, Homo sapiens
ctctgcacaagctgcaccctc

SEQ ID NO: 1843149 - DNA, 15 bp, Homo sapiens
ctctgcactcccctg

SEQ ID NO: 1843150 - DNA, 16 bp, Homo sapiens
ctctgcactcccctgc

SEQ ID NO: 1843151 - DNA, 19 bp, Homo sapiens
ctctgccaacttcttcaga

SEQ ID NO: 1843152 - DNA, 23 bp, Homo sapiens
ctctgccaacttcttcagagctg

SEQ ID NO: 1843153 - DNA, 20 bp, Homo sapiens
ctctgcccactccctgcaac

SEQ ID NO: 1843154 - DNA, 23 bp, Homo sapiens
ctctgccctccaagaccttctcc

SEQ ID NO: 1843155 - DNA, 14 bp, Homo sapiens
ctctgcctcccatc

SEQ ID NO: 1843156 - DNA, 18 bp, Homo sapiens
ctctgctattaggccagc

SEQ ID NO: 1843157 - DNA, 13 bp, Homo sapiens
ctctgctgccgcc

SEQ ID NO: 1843158 - DNA, 13 bp, Homo sapiens
ctctgctgctggc

SEQ ID NO: 1843159 - DNA, 15 bp, Homo sapiens
ctctgctgctggctg

SEQ ID NO: 1843160 - DNA, 15 bp, Homo sapiens
ctctggatgcctgat

SEQ ID NO: 1843161 - DNA, 23 bp, Homo sapiens
ctctggatgcctgattgccaagc

SEQ ID NO: 1843162 - DNA, 15 bp, Homo sapiens
ctctggcagctcaga

SEQ ID NO: 1843163 - DNA, 19 bp, Homo sapiens
ctctggcagctcagagagg

SEQ ID NO: 1843164 - DNA, 15 bp, Homo sapiens
ctctggtccatagag

SEQ ID NO: 1843165 - DNA, 21 bp, Homo sapiens
ctctggtggcttaagtgagca

SEQ ID NO: 1843166 - DNA, 13 bp, Homo sapiens
ctctgtacagagc

SEQ ID NO: 1843167 - DNA, 14 bp, Homo sapiens
ctctgtacagagcc

SEQ ID NO: 1843168 - DNA, 16 bp, Homo sapiens
ctctgtacagagccca

SEQ ID NO: 1843169 - DNA, 12 bp, Homo sapiens
ctctgtccccag

SEQ ID NO: 1843170 - DNA, 17 bp, Homo sapiens
ctctgtccccagcctgg

SEQ ID NO: 1843171 - DNA, 13 bp, Homo sapiens
ctctgtctaggac

SEQ ID NO: 1843172 - DNA, 13 bp, Homo sapiens
ctcttaaaaccca

SEQ ID NO: 1843173 - DNA, 24 bp, Homo sapiens
ctcttaaaacccaagtgccttagc

SEQ ID NO: 1843174 - DNA, 19 bp, Homo sapiens
ctcttatggatgtccccag

SEQ ID NO: 1843175 - DNA, 14 bp, Homo sapiens
ctcttatgggctgg

SEQ ID NO: 1843176 - DNA, 23 bp, Homo sapiens
ctcttcagttaagcctttggaaa

SEQ ID NO: 1843177 - DNA, 14 bp, Homo sapiens
ctcttccaggctgg

SEQ ID NO: 1843178 - DNA, 22 bp, Homo sapiens
ctcttccgaatgggttttctat

SEQ ID NO: 1843179 - DNA, 16 bp, Homo sapiens
ctcttgagcctgggag

SEQ ID NO: 1843180 - DNA, 13 bp, Homo sapiens
ctcttggtcctgc

SEQ ID NO: 1843181 - DNA, 17 bp, Homo sapiens
ctcttgtagtcttggct

SEQ ID NO: 1843182 - DNA, 15 bp, Homo sapiens
ctctttggacactca

SEQ ID NO: 1843183 - DNA, 19 bp, Homo sapiens
ctctttggtctacactgtg

SEQ ID NO: 1843184 - DNA, 14 bp, Homo sapiens
ctgaaacacacgag

SEQ ID NO: 1843185 - DNA, 14 bp, Homo sapiens
ctgaaccattactg

SEQ ID NO: 1843186 - DNA, 16 bp, Homo sapiens
ctgaactctgacaaca

SEQ ID NO: 1843187 - DNA, 13 bp, Homo sapiens
ctgaaggactgtg

SEQ ID NO: 1843188 - DNA, 22 bp, Homo sapiens
ctgaaggactgtgacaggcagc

SEQ ID NO: 1843189 - DNA, 23 bp, Homo sapiens
ctgaaggactgtgacaggcagca

SEQ ID NO: 1843190 - DNA, 21 bp, Homo sapiens
ctgaaggggtgcacccacctg

SEQ ID NO: 1843191 - DNA, 21 bp, Homo sapiens
ctgaagggtaatatggactca

SEQ ID NO: 1843192 - DNA, 13 bp, Homo sapiens
ctgaagtgaaact

SEQ ID NO: 1843193 - DNA, 19 bp, Homo sapiens
ctgaatgcttataggtggc

SEQ ID NO: 1843194 - DNA, 22 bp, Homo sapiens
ctgcttgaggcaactcatctta

SEQ ID NO: 1843195 - DNA, 13 bp, Homo sapiens
ctggaagacagag

SEQ ID NO: 1843196 - DNA, 20 bp, Homo sapiens
ctggaaggtggggacaggga

SEQ ID NO: 1843197 - DNA, 18 bp, Homo sapiens
ctggaagtgactttggct

SEQ ID NO: 1843198 - DNA, 17 bp, Homo sapiens
ctggagcctggtgccct

SEQ ID NO: 1843199 - DNA, 13 bp, Homo sapiens
ctggatctccctg

SEQ ID NO: 1843200 - DNA, 16 bp, Homo sapiens
ctggatgcagcctcac

SEQ ID NO: 1843201 - DNA, 18 bp, Homo sapiens
ctggatgcagcctcacag

SEQ ID NO: 1843202 - DNA, 22 bp, Homo sapiens
ctggatgcagcctcacagtcct

SEQ ID NO: 1843203 - DNA, 16 bp, Homo sapiens
ctggatggggctgcac

SEQ ID NO: 1843204 - DNA, 23 bp, Homo sapiens
ctggattattcaaaatgatgtat

SEQ ID NO: 1843205 - DNA, 14 bp, Homo sapiens
ctggattcccagga

SEQ ID NO: 1843206 - DNA, 14 bp, Homo sapiens
ctggcactgcttcc

SEQ ID NO: 1843207 - DNA, 17 bp, Homo sapiens
ctggcactgcttccagt

SEQ ID NO: 1843208 - DNA, 20 bp, Homo sapiens
ctggcactgcttccagtgag

SEQ ID NO: 1843209 - DNA, 15 bp, Homo sapiens
ctggcacttgggaca

SEQ ID NO: 1843210 - DNA, 14 bp, Homo sapiens
ctggcagaggaggg

SEQ ID NO: 1843211 - DNA, 15 bp, Homo sapiens
ctggcagctcagaga

SEQ ID NO: 1843212 - DNA, 14 bp, Homo sapiens
ctggccagggcctg

SEQ ID NO: 1843213 - DNA, 15 bp, Homo sapiens
ctggccagggcctgg

SEQ ID NO: 1843214 - DNA, 23 bp, Homo sapiens
ctggccagggcctggaagacaga

SEQ ID NO: 1843215 - DNA, 17 bp, Homo sapiens
ctggcccctcagggtcc

SEQ ID NO: 1843216 - DNA, 20 bp, Homo sapiens
ctggcccctcagggtccctg

SEQ ID NO: 1843217 - DNA, 22 bp, Homo sapiens
ctggcccctcagggtccctggt

SEQ ID NO: 1843218 - DNA, 12 bp, Homo sapiens
ctggcccttcct

SEQ ID NO: 1843219 - DNA, 22 bp, Homo sapiens
ctggccgggaccccgagcctgg

SEQ ID NO: 1843220 - DNA, 22 bp, Homo sapiens
ctggccgttgatgttggctggg

SEQ ID NO: 1843221 - DNA, 16 bp, Homo sapiens
ctggcctgagctggga

SEQ ID NO: 1843222 - DNA, 24 bp, Homo sapiens
ctggcctggcccctcagggtccct

SEQ ID NO: 1843223 - DNA, 14 bp, Homo sapiens
ctggcctgtgtcta

SEQ ID NO: 1843224 - DNA, 19 bp, Homo sapiens
ctggcggctggggtcccag

SEQ ID NO: 1843225 - DNA, 20 bp, Homo sapiens
ctggcggctggggtcccagc

SEQ ID NO: 1843226 - DNA, 15 bp, Homo sapiens
ccccctccccccaga

SEQ ID NO: 1843227 - DNA, 23 bp, Homo sapiens
cccccttgaggattgtggaaaac

SEQ ID NO: 1843228 - DNA, 20 bp, Homo sapiens
ccccgctgatggagccccac

SEQ ID NO: 1843229 - DNA, 18 bp, Homo sapiens
ccccggccacctgcggtg

SEQ ID NO: 1843230 - DNA, 23 bp, Homo sapiens
cccctcagcctctcccctgcctg

SEQ ID NO: 1843231 - DNA, 16 bp, Homo sapiens
cccctcagggtccctg

SEQ ID NO: 1843232 - DNA, 17 bp, Homo sapiens
cccctcagggtccctgg

SEQ ID NO: 1843233 - DNA, 18 bp, Homo sapiens
cccctcagggtccctggt

SEQ ID NO: 1843234 - DNA, 18 bp, Homo sapiens
cccctcctcctggactcc

SEQ ID NO: 1843235 - DNA, 22 bp, Homo sapiens
cccctcctcctggactcctgca

SEQ ID NO: 1843236 - DNA, 19 bp, Homo sapiens
cccctgcctgccctggtga

SEQ ID NO: 1843237 - DNA, 14 bp, Homo sapiens
cccctgctgggtgt

SEQ ID NO: 1843238 - DNA, 18 bp, Homo sapiens
cccctgtacatttgtgct

SEQ ID NO: 1843239 - DNA, 20 bp, Homo sapiens
cccgccccgttgtgagctgg

SEQ ID NO: 1843240 - DNA, 21 bp, Homo sapiens
cccgccccgttgtgagctgga

SEQ ID NO: 1843241 - DNA, 15 bp, Homo sapiens
cccgggaagggggct

SEQ ID NO: 1843242 - DNA, 21 bp, Homo sapiens
cccgggaagggggctgggaca

SEQ ID NO: 1843243 - DNA, 12 bp, Homo sapiens
cccgggctctgc

SEQ ID NO: 1843244 - DNA, 14 bp, Homo sapiens
cccgggctctgcct

SEQ ID NO: 1843245 - DNA, 16 bp, Homo sapiens
cccgggctctgcctcc

SEQ ID NO: 1843246 - DNA, 13 bp, Homo sapiens
cccggggcctgtt

SEQ ID NO: 1843247 - DNA, 18 bp, Homo sapiens
ccctattagagaagagat

SEQ ID NO: 1843248 - DNA, 10 bp, Homo sapiens
ccctcacact

SEQ ID NO: 1843249 - DNA, 21 bp, Homo sapiens
ccctcagggtccctggtggca

SEQ ID NO: 1843250 - DNA, 16 bp, Homo sapiens
ccctcatcaaggacac

SEQ ID NO: 1843251 - DNA, 22 bp, Homo sapiens
ccctcatcaccaacgtctgtgc

SEQ ID NO: 1843252 - DNA, 22 bp, Homo sapiens
ccctcatcctcatacccacccc

SEQ ID NO: 1843253 - DNA, 16 bp, Homo sapiens
ccctcatttcaggagc

SEQ ID NO: 1843254 - DNA, 21 bp, Homo sapiens
ccctccaagaccttctccttc

SEQ ID NO: 1843255 - DNA, 16 bp, Homo sapiens
ccctccccccagactc

SEQ ID NO: 1843256 - DNA, 12 bp, Homo sapiens
ccctctcctccg

SEQ ID NO: 1843257 - DNA, 13 bp, Homo sapiens
ccctctcctccgt

SEQ ID NO: 1843258 - DNA, 12 bp, Homo sapiens
ccctctttccct

SEQ ID NO: 1843259 - DNA, 18 bp, Homo sapiens
ccctgaaagccctgagct

SEQ ID NO: 1843260 - DNA, 12 bp, Homo sapiens
ccctgaaggccc

SEQ ID NO: 1843261 - DNA, 22 bp, Homo sapiens
ccctgaaggccccgcccaggct

SEQ ID NO: 1843262 - DNA, 23 bp, Homo sapiens
ccctgaggcccagagggcctgca

SEQ ID NO: 1843263 - DNA, 14 bp, Homo sapiens
ccctgcccacctgg

SEQ ID NO: 1843264 - DNA, 17 bp, Homo sapiens
ccctgcccacctggcct

SEQ ID NO: 1843265 - DNA, 19 bp, Homo sapiens
ccctgcccctcctctccct

SEQ ID NO: 1843266 - DNA, 15 bp, Homo sapiens
ccctgccctgtgggc

SEQ ID NO: 1843267 - DNA, 20 bp, Homo sapiens
ccctgccctgtgggccccca

SEQ ID NO: 1843268 - DNA, 23 bp, Homo sapiens
ccctgcctcctttgtgaggaagc

SEQ ID NO: 1843269 - DNA, 15 bp, Homo sapiens
ccctgcctctaccca

SEQ ID NO: 1843270 - DNA, 13 bp, Homo sapiens
ccctggatgcagc

SEQ ID NO: 1843271 - DNA, 17 bp, Homo sapiens
ccctggatgcagcctca

SEQ ID NO: 1843272 - DNA, 15 bp, Homo sapiens
ccctggctgaaggac

SEQ ID NO: 1843273 - DNA, 18 bp, Homo sapiens
ccctggctgaaggactgt

SEQ ID NO: 1843274 - DNA, 20 bp, Homo sapiens
ccctggggacagcaagggct

SEQ ID NO: 1843275 - DNA, 13 bp, Homo sapiens
ccctggtgacatc

SEQ ID NO: 1843276 - DNA, 21 bp, Homo sapiens
ccctgtagagtgggagctgag

SEQ ID NO: 1843277 - DNA, 20 bp, Homo sapiens
ccctgtctcaaaaaaagaaa

SEQ ID NO: 1843278 - DNA, 23 bp, Homo sapiens
ccctgtctcaaaaaaagaaaaag

SEQ ID NO: 1843279 - DNA, 17 bp, Homo sapiens
ccctgtgatggggccct

SEQ ID NO: 1843280 - DNA, 22 bp, Homo sapiens
ccctgtgatggggccctgcctc

SEQ ID NO: 1843281 - DNA, 18 bp, Homo sapiens
ccctgtgggcccccaaat

SEQ ID NO: 1843282 - DNA, 15 bp, Homo sapiens
ccctgtttgtttctg

SEQ ID NO: 1843283 - DNA, 17 bp, Homo sapiens
cccttaccactgctctg

SEQ ID NO: 1843284 - DNA, 18 bp, Homo sapiens
cccttactttaacccttt

SEQ ID NO: 1843285 - DNA, 21 bp, Homo sapiens
cccttctgacccatgctgccc

SEQ ID NO: 1843286 - DNA, 17 bp, Homo sapiens
cccttgccgtctacctg

SEQ ID NO: 1843287 - DNA, 18 bp, Homo sapiens
cccttgccgtctacctga

SEQ ID NO: 1843288 - DNA, 14 bp, Homo sapiens
cccttggacatttt

SEQ ID NO: 1843289 - DNA, 15 bp, Homo sapiens
cccttggacatttta

SEQ ID NO: 1843290 - DNA, 17 bp, Homo sapiens
cccttggattgtccccg

SEQ ID NO: 1843291 - DNA, 23 bp, Homo sapiens
cccttggttaggcattgtgggaa

SEQ ID NO: 1843292 - DNA, 14 bp, Homo sapiens
cccttgtggtccca

SEQ ID NO: 1843293 - DNA, 16 bp, Homo sapiens
cccttgtggtcccacc

SEQ ID NO: 1843294 - DNA, 20 bp, Homo sapiens
ccctttgacgccatcccagc

SEQ ID NO: 1843295 - DNA, 21 bp, Homo sapiens
ccctttggccccactttgaag

SEQ ID NO: 1843296 - DNA, 23 bp, Homo sapiens
cccttttttggctgctgaaggct

SEQ ID NO: 1843297 - DNA, 13 bp, Homo sapiens
ccgagaagaacag

SEQ ID NO: 1843298 - DNA, 19 bp, Homo sapiens
ccgagctttgaaaattcag

SEQ ID NO: 1843299 - DNA, 17 bp, Homo sapiens
ccgatgtcgacatgttt

SEQ ID NO: 1843300 - DNA, 15 bp, Homo sapiens
ccgcagacaggacca

SEQ ID NO: 1843301 - DNA, 16 bp, Homo sapiens
ccgcagacaggaccag

SEQ ID NO: 1843302 - DNA, 11 bp, Homo sapiens
ccgcagggcca

SEQ ID NO: 1843303 - DNA, 22 bp, Homo sapiens
ccgcgtgcggaggggacagagc

SEQ ID NO: 1843304 - DNA, 14 bp, Homo sapiens
ccgctgatggagcc

SEQ ID NO: 1843305 - DNA, 17 bp, Homo sapiens
ccgctgatggagcccca

SEQ ID NO: 1843306 - DNA, 11 bp, Homo sapiens
ccgctggggcc

SEQ ID NO: 1843307 - DNA, 14 bp, Homo sapiens
ccgctggggccagt

SEQ ID NO: 1843308 - DNA, 17 bp, Homo sapiens
ccggccacctgcggtgc

SEQ ID NO: 1843309 - DNA, 12 bp, Homo sapiens
ccggctggcctg

SEQ ID NO: 1843310 - DNA, 14 bp, Homo sapiens
ccgggctctgcctc

SEQ ID NO: 1843311 - DNA, 17 bp, Homo sapiens
ccgtctacctgaggggc

SEQ ID NO: 1843312 - DNA, 22 bp, Homo sapiens
cctacatgtatttgtttgcata

SEQ ID NO: 1843313 - DNA, 14 bp, Homo sapiens
cctaccacatgcca

SEQ ID NO: 1843314 - DNA, 23 bp, Homo sapiens
cctacttctttgctttgcccagc

SEQ ID NO: 1843315 - DNA, 17 bp, Homo sapiens
cctagcacacacttttg

SEQ ID NO: 1843316 - DNA, 13 bp, Homo sapiens
cctaggcaggaca

SEQ ID NO: 1843317 - DNA, 18 bp, Homo sapiens
cctaggcaggacatgctg

SEQ ID NO: 1843318 - DNA, 12 bp, Homo sapiens
cctatctttgcc

SEQ ID NO: 1843319 - DNA, 15 bp, Homo sapiens
cctatctttgccacc

SEQ ID NO: 1843320 - DNA, 22 bp, Homo sapiens
cctatgagggtgagctggtccc

SEQ ID NO: 1843321 - DNA, 20 bp, Homo sapiens
cctattttttttctgttata

SEQ ID NO: 1843322 - DNA, 18 bp, Homo sapiens
cctcaaacactgcaggca

SEQ ID NO: 1843323 - DNA, 13 bp, Homo sapiens
cctcacactggga

SEQ ID NO: 1843324 - DNA, 17 bp, Homo sapiens
cctcacagtattgctca

SEQ ID NO: 1843325 - DNA, 22 bp, Homo sapiens
cctcacagtccttaccagcaga

SEQ ID NO: 1843326 - DNA, 12 bp, Homo sapiens
cctcaccccact

SEQ ID NO: 1843327 - DNA, 12 bp, Homo sapiens
cctcagcctctc

SEQ ID NO: 1843328 - DNA, 14 bp, Homo sapiens
cctcagcttggcac

SEQ ID NO: 1843329 - DNA, 22 bp, Homo sapiens
cctcagggtccctggtggcagc

SEQ ID NO: 1843330 - DNA, 18 bp, Homo sapiens
cctcaggtgagaagcaga

SEQ ID NO: 1843331 - DNA, 20 bp, Homo sapiens
cctcaggtgagaagcagagg

SEQ ID NO: 1843332 - DNA, 17 bp, Homo sapiens
cctcagtaacatttctg

SEQ ID NO: 1843333 - DNA, 15 bp, Homo sapiens
cctcagtctggccct

SEQ ID NO: 1843334 - DNA, 13 bp, Homo sapiens
cctcatcaccaac

SEQ ID NO: 1843335 - DNA, 14 bp, Homo sapiens
cctcatcaccaacg

SEQ ID NO: 1843336 - DNA, 15 bp, Homo sapiens
cctcatccagggctc

SEQ ID NO: 1843337 - DNA, 19 bp, Homo sapiens
cctcatgcccagctctctg

SEQ ID NO: 1843338 - DNA, 18 bp, Homo sapiens
cctcatgtgatcacaatt

SEQ ID NO: 1843339 - DNA, 22 bp, Homo sapiens
cctcatttcaggagcagcctca

SEQ ID NO: 1843340 - DNA, 20 bp, Homo sapiens
cctccaagaccttctccttc

SEQ ID NO: 1843341 - DNA, 15 bp, Homo sapiens
cctcccaactcaccc

SEQ ID NO: 1843342 - DNA, 21 bp, Homo sapiens
cctcccaactcaccccagccc

SEQ ID NO: 1843343 - DNA, 17 bp, Homo sapiens
cctcccatcacccgcta

SEQ ID NO: 1843344 - DNA, 13 bp, Homo sapiens
ctaggctggggaa

SEQ ID NO: 1843345 - DNA, 22 bp, Homo sapiens
ctaggctggggaagtcctctgg

SEQ ID NO: 1843346 - DNA, 14 bp, Homo sapiens
ctaggtaggaagag

SEQ ID NO: 1843347 - DNA, 19 bp, Homo sapiens
ctaggtggcaaggctgtgc

SEQ ID NO: 1843348 - DNA, 23 bp, Homo sapiens
ctaggtggcaaggctgtgctccc

SEQ ID NO: 1843349 - DNA, 12 bp, Homo sapiens
ctagtccttgtt

SEQ ID NO: 1843350 - DNA, 18 bp, Homo sapiens
ctagtggccgaaccagaa

SEQ ID NO: 1843351 - DNA, 19 bp, Homo sapiens
ctagtgtggtgtttcctgg

SEQ ID NO: 1843352 - DNA, 22 bp, Homo sapiens
ctagttccaccatcaagccacc

SEQ ID NO: 1843353 - DNA, 19 bp, Homo sapiens
ctatataaccacatttcta

SEQ ID NO: 1843354 - DNA, 16 bp, Homo sapiens
ctatatatacatcata

SEQ ID NO: 1843355 - DNA, 14 bp, Homo sapiens
ctatctcccccagc

SEQ ID NO: 1843356 - DNA, 15 bp, Homo sapiens
ctatctcccccagcc

SEQ ID NO: 1843357 - DNA, 16 bp, Homo sapiens
ctatctcccccagccc

SEQ ID NO: 1843358 - DNA, 17 bp, Homo sapiens
ctatctcccccagcccc

SEQ ID NO: 1843359 - DNA, 14 bp, Homo sapiens
ctatctttgccacc

SEQ ID NO: 1843360 - DNA, 15 bp, Homo sapiens
ctatctttgccaccc

SEQ ID NO: 1843361 - DNA, 19 bp, Homo sapiens
ctatggacggtgctccagg

SEQ ID NO: 1843362 - DNA, 23 bp, Homo sapiens
ctatgtatttgcaaggctgattt

SEQ ID NO: 1843363 - DNA, 15 bp, Homo sapiens
ctatgttaatatttt

SEQ ID NO: 1843364 - DNA, 12 bp, Homo sapiens
ctattatcacat

SEQ ID NO: 1843365 - DNA, 16 bp, Homo sapiens
ctattgctgcttgagg

SEQ ID NO: 1843366 - DNA, 18 bp, Homo sapiens
ctatttgcttatttaata

SEQ ID NO: 1843367 - DNA, 12 bp, Homo sapiens
ctatttttctaa

SEQ ID NO: 1843368 - DNA, 15 bp, Homo sapiens
ctatttttctaacta

SEQ ID NO: 1843369 - DNA, 20 bp, Homo sapiens
ctattttttttctgttatat

SEQ ID NO: 1843370 - DNA, 18 bp, Homo sapiens
ctcaaaaaaagaaaaaga

SEQ ID NO: 1843371 - DNA, 19 bp, Homo sapiens
ctcaaaacccatctgggct

SEQ ID NO: 1843372 - DNA, 12 bp, Homo sapiens
ctcaaacactgc

SEQ ID NO: 1843373 - DNA, 13 bp, Homo sapiens
ctcaaacactgca

SEQ ID NO: 1843374 - DNA, 16 bp, Homo sapiens
ctcaaacactgcaggc

SEQ ID NO: 1843375 - DNA, 19 bp, Homo sapiens
ctcaaaccaaatcactgaa

SEQ ID NO: 1843376 - DNA, 22 bp, Homo sapiens
ctcaaaccaaatcactgaactt

SEQ ID NO: 1843377 - DNA, 16 bp, Homo sapiens
ctcaaagagattcgaa

SEQ ID NO: 1843378 - DNA, 18 bp, Homo sapiens
ctcaaccacctttcagat

SEQ ID NO: 1843379 - DNA, 20 bp, Homo sapiens
ctcaacccattgttgtcaag

SEQ ID NO: 1843380 - DNA, 13 bp, Homo sapiens
ctcaagaagcagg

SEQ ID NO: 1843381 - DNA, 23 bp, Homo sapiens
ctcaagaagcaggctacactgac

SEQ ID NO: 1843382 - DNA, 21 bp, Homo sapiens
ctcaatgagcatgtttagact

SEQ ID NO: 1843383 - DNA, 14 bp, Homo sapiens
ctcaattcttccct

SEQ ID NO: 1843384 - DNA, 19 bp, Homo sapiens
ctcacagtccttaccagca

SEQ ID NO: 1843385 - DNA, 13 bp, Homo sapiens
ctcacctctccct

SEQ ID NO: 1843386 - DNA, 16 bp, Homo sapiens
ctcacctctcccttgg

SEQ ID NO: 1843387 - DNA, 17 bp, Homo sapiens
ctcacctggggctgctg

SEQ ID NO: 1843388 - DNA, 20 bp, Homo sapiens
ctcacctggggctgctggcc

SEQ ID NO: 1843389 - DNA, 13 bp, Homo sapiens
ctcactaggcttc

SEQ ID NO: 1843390 - DNA, 16 bp, Homo sapiens
ctcactaggcttctgg

SEQ ID NO: 1843391 - DNA, 14 bp, Homo sapiens
ctcacttcaccctg

SEQ ID NO: 1843392 - DNA, 17 bp, Homo sapiens
ctcagaacatactgatt

SEQ ID NO: 1843393 - DNA, 21 bp, Homo sapiens
ctcagaacatactgattggga

SEQ ID NO: 1843394 - DNA, 19 bp, Homo sapiens
ctcagaaggcaaatgactt

SEQ ID NO: 1843395 - DNA, 13 bp, Homo sapiens
ctcagagagggca

SEQ ID NO: 1843396 - DNA, 15 bp, Homo sapiens
ctcagagagggcagg

SEQ ID NO: 1843397 - DNA, 19 bp, Homo sapiens
ctcagagagggtgggagtg

SEQ ID NO: 1843398 - DNA, 16 bp, Homo sapiens
ctcagagtatggagct

SEQ ID NO: 1843399 - DNA, 21 bp, Homo sapiens
ctcagcaaaagatgcttctca

SEQ ID NO: 1843400 - DNA, 17 bp, Homo sapiens
ctcagcactgcctgctc

SEQ ID NO: 1843401 - DNA, 22 bp, Homo sapiens
ctcagcccctgatcctgtgaag

SEQ ID NO: 1843402 - DNA, 12 bp, Homo sapiens
ctcagccttgca

SEQ ID NO: 1843403 - DNA, 20 bp, Homo sapiens
ctcagccttgcaaatagcca

SEQ ID NO: 1843404 - DNA, 12 bp, Homo sapiens
ctcagctcccca

SEQ ID NO: 1843405 - DNA, 16 bp, Homo sapiens
ctcagctccccagagt

SEQ ID NO: 1843406 - DNA, 22 bp, Homo sapiens
ctcagcttggcactcaggtgct

SEQ ID NO: 1843407 - DNA, 12 bp, Homo sapiens
ctcaggaccagg

SEQ ID NO: 1843408 - DNA, 15 bp, Homo sapiens
ctcaggaccaggcaa

SEQ ID NO: 1843409 - DNA, 18 bp, Homo sapiens
ctcaggagtttgagacca

SEQ ID NO: 1843410 - DNA, 13 bp, Homo sapiens
ctcaggcagcacc

SEQ ID NO: 1843411 - DNA, 17 bp, Homo sapiens
ctcaggcagcaccacac

SEQ ID NO: 1843412 - DNA, 15 bp, Homo sapiens
ctcaggcaggtggga

SEQ ID NO: 1843413 - DNA, 18 bp, Homo sapiens
ctcaggcaggtgggatgg

SEQ ID NO: 1843414 - DNA, 14 bp, Homo sapiens
ctcagggcctggct

SEQ ID NO: 1843415 - DNA, 15 bp, Homo sapiens
ctcagggcctggctc

SEQ ID NO: 1843416 - DNA, 16 bp, Homo sapiens
ctcagggcctggctca
